United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 185

SEQ ID NO: 7709488 - DNA, 22 bp, Homo sapiens
tgcctgggctcggtagccatcg

SEQ ID NO: 7709489 - DNA, 22 bp, Homo sapiens
tgcctgtaataatgctaagcac

SEQ ID NO: 7709490 - DNA, 22 bp, Homo sapiens
tgcctggtatttgaataaagag

SEQ ID NO: 7709491 - DNA, 22 bp, Homo sapiens
tgcctgtcagggggagtgggaa

SEQ ID NO: 7709492 - DNA, 22 bp, Homo sapiens
tgcctgggttgactcttagctg

SEQ ID NO: 7709493 - DNA, 22 bp, Homo sapiens
tgcctgggttgactcttagctg

SEQ ID NO: 7709494 - DNA, 22 bp, Homo sapiens
tgcctgggttgactcttagctg

SEQ ID NO: 7709495 - DNA, 22 bp, Homo sapiens
tgcctgggtgtaaagggccaac

SEQ ID NO: 7709496 - DNA, 22 bp, Homo sapiens
tgcctgggttcccaccccaaag

SEQ ID NO: 7709497 - DNA, 22 bp, Homo sapiens
tgcctgggttcccaccccaaag

SEQ ID NO: 7709498 - DNA, 22 bp, Homo sapiens
tgcctgggttcccaccccaaag

SEQ ID NO: 7709499 - DNA, 22 bp, Homo sapiens
tgcctgggtgtaaagggccaac

SEQ ID NO: 7709500 - DNA, 22 bp, Homo sapiens
tgcctgggtgtaaagggccaac

SEQ ID NO: 7709501 - DNA, 22 bp, Homo sapiens
tgcctgggtgtaaagggccaac

SEQ ID NO: 7709502 - DNA, 22 bp, Homo sapiens
tgcctgggtgtaaagggccaac

SEQ ID NO: 7709503 - DNA, 22 bp, Homo sapiens
tgcctgggtgtaaagggccaac

SEQ ID NO: 7709504 - DNA, 22 bp, Homo sapiens
tgcctgggtgtaaagggccaac

SEQ ID NO: 7709505 - DNA, 22 bp, Homo sapiens
tgcctgggtgtaaagggccaac

SEQ ID NO: 7709506 - DNA, 22 bp, Homo sapiens
tgcctgggtgtaaagggccaac

SEQ ID NO: 7709507 - DNA, 22 bp, Homo sapiens
tgcctgggtgccctctgctcct

SEQ ID NO: 7709508 - DNA, 22 bp, Homo sapiens
tgcctgggtgccctctgctcct

SEQ ID NO: 7709509 - DNA, 22 bp, Homo sapiens
tgcctgggtgccctctgctcct

SEQ ID NO: 7709510 - DNA, 22 bp, Homo sapiens
tgcctgggtgccctctgctcct

SEQ ID NO: 7709511 - DNA, 22 bp, Homo sapiens
tgcctgggtgctggctggtcac

SEQ ID NO: 7709512 - DNA, 22 bp, Homo sapiens
tgcctgggtgctggctggtcac

SEQ ID NO: 7709513 - DNA, 22 bp, Homo sapiens
tgcctgggtgctggctggtcac

SEQ ID NO: 7709514 - DNA, 22 bp, Homo sapiens
tgcctgggtgctggctggtcac

SEQ ID NO: 7709515 - DNA, 22 bp, Homo sapiens
tgcctgggtgctggctggtcac

SEQ ID NO: 7709516 - DNA, 22 bp, Homo sapiens
tgcctgtgacccaaggatgcga

SEQ ID NO: 7709517 - DNA, 22 bp, Homo sapiens
tgcctgtgacccaaggatgcga

SEQ ID NO: 7709518 - DNA, 22 bp, Homo sapiens
tgcctgtgacccaaggatgcga

SEQ ID NO: 7709519 - DNA, 22 bp, Homo sapiens
tgcctgtgatcagctgagttca

SEQ ID NO: 7709520 - DNA, 22 bp, Homo sapiens
tgcctgtgatcagctgagttca

SEQ ID NO: 7709521 - DNA, 22 bp, Homo sapiens
tgcctgtgaaaaccctggggtt

SEQ ID NO: 7709522 - DNA, 22 bp, Homo sapiens
tgcctgtgaaaaccctggggtt

SEQ ID NO: 7709523 - DNA, 22 bp, Homo sapiens
tgcctgtctttcctccctcgta

SEQ ID NO: 7709524 - DNA, 22 bp, Homo sapiens
tgcctgtcttggagtcctggcc

SEQ ID NO: 7709525 - DNA, 22 bp, Homo sapiens
tgcctgtcttggagtcctggcc

SEQ ID NO: 7709526 - DNA, 22 bp, Homo sapiens
tgcctgtcttcaggagtgtcac

SEQ ID NO: 7709527 - DNA, 22 bp, Homo sapiens
tgcctgtcttcaggagtgtcac

SEQ ID NO: 7709528 - DNA, 22 bp, Homo sapiens
tgcctgtctctgactgccatta

SEQ ID NO: 7709529 - DNA, 22 bp, Homo sapiens
tgcctgtctctgactgccatta

SEQ ID NO: 7709530 - DNA, 22 bp, Homo sapiens
tgcctgtcttaatatctggaaa

SEQ ID NO: 7709531 - DNA, 19 bp, Homo sapiens
tgcctgtcagtagatctca

SEQ ID NO: 7709532 - DNA, 22 bp, Homo sapiens
tgcctttaggggcctctccctc

SEQ ID NO: 7709533 - DNA, 22 bp, Homo sapiens
tgcctttagggaaaagcaagct

SEQ ID NO: 7709534 - DNA, 22 bp, Homo sapiens
tgcctttactgattagctgtgt

SEQ ID NO: 7709535 - DNA, 22 bp, Homo sapiens
tgcctttactataaaggatctg

SEQ ID NO: 7709536 - DNA, 22 bp, Homo sapiens
tgcctttaaggaatcattcttg

SEQ ID NO: 7709537 - DNA, 22 bp, Homo sapiens
tgcctttactataaaggatctg

SEQ ID NO: 7709538 - DNA, 22 bp, Homo sapiens
tgcctttaacttaaagcatgac

SEQ ID NO: 7709539 - DNA, 22 bp, Homo sapiens
tgcctttaaccagtctagacag

SEQ ID NO: 7709540 - DNA, 22 bp, Homo sapiens
tgcctttaacttaaagcatgac

SEQ ID NO: 7709541 - DNA, 22 bp, Homo sapiens
tgcctttaaccagtctagacag

SEQ ID NO: 7709542 - DNA, 22 bp, Homo sapiens
tgcctttaacaagatctccaga

SEQ ID NO: 7709543 - DNA, 22 bp, Homo sapiens
tgcctttaacaagatctccaga

SEQ ID NO: 7709544 - DNA, 22 bp, Homo sapiens
tgcctttaaactgatcatcagg

SEQ ID NO: 7709545 - DNA, 22 bp, Homo sapiens
tgcctttaaactgatcatcagg

SEQ ID NO: 7709546 - DNA, 22 bp, Homo sapiens
tgcctttaaactgatcatcagg

SEQ ID NO: 7709547 - DNA, 22 bp, Homo sapiens
tgcctttaaactgatcatcagg

SEQ ID NO: 7709548 - DNA, 22 bp, Homo sapiens
tgcctttaaaaaggaagtcatt

SEQ ID NO: 7709549 - DNA, 22 bp, Homo sapiens
tgccttgtccttcgtcagggct

SEQ ID NO: 7709550 - DNA, 22 bp, Homo sapiens
tgccttggtttccccatctgta

SEQ ID NO: 7709551 - DNA, 22 bp, Homo sapiens
tgccttgtccttcgtcagggct

SEQ ID NO: 7709552 - DNA, 22 bp, Homo sapiens
tgccttggttctctacttggag

SEQ ID NO: 7709553 - DNA, 22 bp, Homo sapiens
tgccttggtttccccatctgta

SEQ ID NO: 7709554 - DNA, 22 bp, Homo sapiens
tgccttggtggcagtctgcggt

SEQ ID NO: 7709555 - DNA, 22 bp, Homo sapiens
tgccttggtttccccatctgta

SEQ ID NO: 7709556 - DNA, 22 bp, Homo sapiens
tgccttggtttccccatctgta

SEQ ID NO: 7709557 - DNA, 22 bp, Homo sapiens
tgccttggtttccccatctgta

SEQ ID NO: 7709558 - DNA, 22 bp, Homo sapiens
tgccttggtttccccatctgta

SEQ ID NO: 7709559 - DNA, 20 bp, Homo sapiens
tgccttggagcagccaaggt

SEQ ID NO: 7709560 - DNA, 22 bp, Homo sapiens
tgccttggaggaatgatgagag

SEQ ID NO: 7709561 - DNA, 22 bp, Homo sapiens
tgccttggattgcagggaacct

SEQ ID NO: 7709562 - DNA, 22 bp, Homo sapiens
tgccttggattgcagggaacct

SEQ ID NO: 7709563 - DNA, 22 bp, Homo sapiens
tgccttggattgcagggaacct

SEQ ID NO: 7709564 - DNA, 22 bp, Homo sapiens
tgccttgggagccagcatgcca

SEQ ID NO: 7709565 - DNA, 20 bp, Homo sapiens
tgccttgggacagtgcctgt

SEQ ID NO: 7709566 - DNA, 20 bp, Homo sapiens
tgccttgggacagtgcctgt

SEQ ID NO: 7709567 - DNA, 19 bp, Homo sapiens
tgccttggctgccaggaaa

SEQ ID NO: 7709568 - DNA, 22 bp, Homo sapiens
tgccttggttctctacttggag

SEQ ID NO: 7709569 - DNA, 22 bp, Homo sapiens
tgccttggtggcagtctgcggt

SEQ ID NO: 7709570 - DNA, 22 bp, Homo sapiens
tgccttggtggcagtctgcggt

SEQ ID NO: 7709571 - DNA, 22 bp, Homo sapiens
tgccttggtggcagtctgcggt

SEQ ID NO: 7709572 - DNA, 22 bp, Homo sapiens
tgccttggtgcttcttcatgtg

SEQ ID NO: 7709573 - DNA, 22 bp, Homo sapiens
tgccttggtgcttcttcatgtg

SEQ ID NO: 7709574 - DNA, 22 bp, Homo sapiens
tgccttggtgcttcttcatgtg

SEQ ID NO: 7709575 - DNA, 22 bp, Homo sapiens
tgccttgggtcaacctttgagt

SEQ ID NO: 7709576 - DNA, 22 bp, Homo sapiens
tgccttgggtcaacctttgagt

SEQ ID NO: 7709577 - DNA, 22 bp, Homo sapiens
tgccttgggatatatggacact

SEQ ID NO: 7709578 - DNA, 22 bp, Homo sapiens
tgccttgggatatatggacact

SEQ ID NO: 7709579 - DNA, 22 bp, Homo sapiens
tgccttgggatatatggacact

SEQ ID NO: 7709580 - DNA, 22 bp, Homo sapiens
tgccttgggagccagcatgcca

SEQ ID NO: 7709581 - DNA, 22 bp, Homo sapiens
tgccttgggatatatggacact

SEQ ID NO: 7709582 - DNA, 22 bp, Homo sapiens
tgcctttataagccagcagcaa

SEQ ID NO: 7709583 - DNA, 22 bp, Homo sapiens
tgcctttactgattagctgtgt

SEQ ID NO: 7709584 - DNA, 20 bp, Homo sapiens
tgcctttcctgtttcatctt

SEQ ID NO: 7709585 - DNA, 22 bp, Homo sapiens
tgcctttgcaattgaggaggat

SEQ ID NO: 7709586 - DNA, 22 bp, Homo sapiens
tgcctttggtttgctacatgcc

SEQ ID NO: 7709587 - DNA, 20 bp, Homo sapiens
tgcctttcctgtttcatctt

SEQ ID NO: 7709588 - DNA, 20 bp, Homo sapiens
tgcctttcctgtttcatctt

SEQ ID NO: 7709589 - DNA, 22 bp, Homo sapiens
tgcctttgcaattgaggaggat

SEQ ID NO: 7709590 - DNA, 22 bp, Homo sapiens
tgcctttggtttgctacatgcc

SEQ ID NO: 7709591 - DNA, 22 bp, Homo sapiens
tgccttttaccttgtaattctg

SEQ ID NO: 7709592 - DNA, 22 bp, Homo sapiens
tgccttttaccttgtaattctg

SEQ ID NO: 7709593 - DNA, 22 bp, Homo sapiens
tgccttttaccttgtaattctg

SEQ ID NO: 7709594 - DNA, 22 bp, Homo sapiens
tgccttttagtgctcaataaag

SEQ ID NO: 7709595 - DNA, 22 bp, Homo sapiens
tgccttttagtgctcaataaag

SEQ ID NO: 7709596 - DNA, 20 bp, Homo sapiens
tgccttttatacctttaaac

SEQ ID NO: 7709597 - DNA, 22 bp, Homo sapiens
tgccttttagtgctcaataaag

SEQ ID NO: 7709598 - DNA, 22 bp, Homo sapiens
tgccttttatggctagcctcag

SEQ ID NO: 7709599 - DNA, 22 bp, Homo sapiens
tgccttttccagcttccagagg

SEQ ID NO: 7709600 - DNA, 22 bp, Homo sapiens
tgccttttccagcttccagagg

SEQ ID NO: 7709601 - DNA, 22 bp, Homo sapiens
tgccttttccagcttccaggag

SEQ ID NO: 7709602 - DNA, 20 bp, Homo sapiens
tgccttttatacctttaaac

SEQ ID NO: 7709603 - DNA, 22 bp, Homo sapiens
tgccttttatggctagcctcag

SEQ ID NO: 7709604 - DNA, 22 bp, Homo sapiens
tgccttttccagtttctagggg

SEQ ID NO: 7709605 - DNA, 22 bp, Homo sapiens
tgccttttccagtttctagggg

SEQ ID NO: 7709606 - DNA, 22 bp, Homo sapiens
tgccttttccagtttctagggg

SEQ ID NO: 7709607 - DNA, 22 bp, Homo sapiens
tgccttttctgtagctctggaa

SEQ ID NO: 7709608 - DNA, 22 bp, Homo sapiens
tgccttttccagcttccaggag

SEQ ID NO: 7709609 - DNA, 22 bp, Homo sapiens
tgccttttccagttcctagaag

SEQ ID NO: 7709610 - DNA, 22 bp, Homo sapiens
tgccttttccagttcctagaag

SEQ ID NO: 7709611 - DNA, 22 bp, Homo sapiens
tgccttttctgtagctctggaa

SEQ ID NO: 7709612 - DNA, 22 bp, Homo sapiens
tgccttttgaagcctcacaggt

SEQ ID NO: 7709613 - DNA, 22 bp, Homo sapiens
tgccttttgtatgcaggccatg

SEQ ID NO: 7709614 - DNA, 22 bp, Homo sapiens
tgccttttgtatgcaggccatg

SEQ ID NO: 7709615 - DNA, 22 bp, Homo sapiens
tgccttttgaagcctcacaggt

SEQ ID NO: 7709616 - DNA, 22 bp, Homo sapiens
tgccttttgaagcctcacaggt

SEQ ID NO: 7709617 - DNA, 22 bp, Homo sapiens
tgccttttgttagggctgccag

SEQ ID NO: 7709618 - DNA, 22 bp, Homo sapiens
tgccttttgttagggctgccag

SEQ ID NO: 7709619 - DNA, 22 bp, Homo sapiens
tgccttttgttagggctgccag

SEQ ID NO: 7709620 - DNA, 22 bp, Homo sapiens
tgcgaccctagccccctcactt

SEQ ID NO: 7709621 - DNA, 22 bp, Homo sapiens
tgcgaccctagccccctcactt

SEQ ID NO: 7709622 - DNA, 22 bp, Homo sapiens
tgcgagagtggaaaggaagcct

SEQ ID NO: 7709623 - DNA, 22 bp, Homo sapiens
tgcgagtatttttaggcagatt

SEQ ID NO: 7709624 - DNA, 22 bp, Homo sapiens
tgcgatgcaacagcttggcgga

SEQ ID NO: 7709625 - DNA, 22 bp, Homo sapiens
tgcgatgcaacagcttggcgga

SEQ ID NO: 7709626 - DNA, 22 bp, Homo sapiens
tgcgatgcaacagcttggcgga

SEQ ID NO: 7709627 - DNA, 22 bp, Homo sapiens
tgcgatggcgtagacaaatccc

SEQ ID NO: 7709628 - DNA, 22 bp, Homo sapiens
tgcgatgtatgcagtatttgtt

SEQ ID NO: 7709629 - DNA, 17 bp, Homo sapiens
tgcgatgtctgtgtttg

SEQ ID NO: 7709630 - DNA, 22 bp, Homo sapiens
tgcctgtgtatgtgcatgcaca

SEQ ID NO: 7709631 - DNA, 22 bp, Homo sapiens
tgcctgtggttccagttttttc

SEQ ID NO: 7709632 - DNA, 22 bp, Homo sapiens
tgcctgtgtatgtgcatgcaca

SEQ ID NO: 7709633 - DNA, 22 bp, Homo sapiens
tgcctgtgtatgtgcatgcaca

SEQ ID NO: 7709634 - DNA, 22 bp, Homo sapiens
tgcctgtgtatgtgcatgcaca

SEQ ID NO: 7709635 - DNA, 19 bp, Homo sapiens
tgcctgtggcgagcatctt

SEQ ID NO: 7709636 - DNA, 19 bp, Homo sapiens
tgcctgtggcgagcatctt

SEQ ID NO: 7709637 - DNA, 22 bp, Homo sapiens
tgcctgtgggtgatgatttgat

SEQ ID NO: 7709638 - DNA, 22 bp, Homo sapiens
tgcctgtgggtgatgatttgat

SEQ ID NO: 7709639 - DNA, 19 bp, Homo sapiens
tgcctgtggcgagcatctt

SEQ ID NO: 7709640 - DNA, 22 bp, Homo sapiens
tgcctgtgctgggattgcatgt

SEQ ID NO: 7709641 - DNA, 22 bp, Homo sapiens
tgcctgtggaaaggctggtgct

SEQ ID NO: 7709642 - DNA, 22 bp, Homo sapiens
tgcctgtggaaaggctggtgct

SEQ ID NO: 7709643 - DNA, 19 bp, Homo sapiens
tgcctgtggcgagcatctt

SEQ ID NO: 7709644 - DNA, 22 bp, Homo sapiens
tgcctgtgcccttcttggcatt

SEQ ID NO: 7709645 - DNA, 22 bp, Homo sapiens
tgcctgtgcccttcttggcatt

SEQ ID NO: 7709646 - DNA, 22 bp, Homo sapiens
tgcctgtgcccttcttggcatt

SEQ ID NO: 7709647 - DNA, 22 bp, Homo sapiens
tgcctgtgccctttgctgggag

SEQ ID NO: 7709648 - DNA, 22 bp, Homo sapiens
tgcctgtgccctttgctgggag

SEQ ID NO: 7709649 - DNA, 22 bp, Homo sapiens
tgcctgtgtgaccacgggcaag

SEQ ID NO: 7709650 - DNA, 22 bp, Homo sapiens
tgccttcttgaatatggttctt

SEQ ID NO: 7709651 - DNA, 22 bp, Homo sapiens
tgccttcttgaatatggttctt

SEQ ID NO: 7709652 - DNA, 22 bp, Homo sapiens
tgccttcttgaatatggttctt

SEQ ID NO: 7709653 - DNA, 22 bp, Homo sapiens
tgccttgcacataatatacatt

SEQ ID NO: 7709654 - DNA, 22 bp, Homo sapiens
tgccttgcaggttttaaataca

SEQ ID NO: 7709655 - DNA, 22 bp, Homo sapiens
tgccttggactctttattccag

SEQ ID NO: 7709656 - DNA, 20 bp, Homo sapiens
tgccttggagcagccaaggt

SEQ ID NO: 7709657 - DNA, 22 bp, Homo sapiens
tgccttgcttaacaagatggca

SEQ ID NO: 7709658 - DNA, 22 bp, Homo sapiens
tgccttgcttcaatcaaaccgt

SEQ ID NO: 7709659 - DNA, 22 bp, Homo sapiens
tgccttgctttggcggaggctg

SEQ ID NO: 7709660 - DNA, 22 bp, Homo sapiens
tgccttggactctttattccag

SEQ ID NO: 7709661 - DNA, 22 bp, Homo sapiens
tgccttgctggatgtcagtttt

SEQ ID NO: 7709662 - DNA, 22 bp, Homo sapiens
tgccttgctggatgtcagtttt

SEQ ID NO: 7709663 - DNA, 16 bp, Homo sapiens
tgccttgctgtcagtc

SEQ ID NO: 7709664 - DNA, 22 bp, Homo sapiens
tgccttgcttcaatcaaaccgt

SEQ ID NO: 7709665 - DNA, 22 bp, Homo sapiens
tgccttgctgctttggagtcct

SEQ ID NO: 7709666 - DNA, 22 bp, Homo sapiens
tgccttgctctgtaaaatctct

SEQ ID NO: 7709667 - DNA, 22 bp, Homo sapiens
tgccttgctgctttggagtcct

SEQ ID NO: 7709668 - DNA, 22 bp, Homo sapiens
tgccttgcgggcgtttctgttg

SEQ ID NO: 7709669 - DNA, 22 bp, Homo sapiens
tgccttgcgggcgtttctgttg

SEQ ID NO: 7709670 - DNA, 22 bp, Homo sapiens
tgccttgcggtgtatttctggg

SEQ ID NO: 7709671 - DNA, 22 bp, Homo sapiens
tgccttgcggtgtatttctggg

SEQ ID NO: 7709672 - DNA, 20 bp, Homo sapiens
tgccttgccaagcctcctaa

SEQ ID NO: 7709673 - DNA, 22 bp, Homo sapiens
tgccttgccactgctcttaatg

SEQ ID NO: 7709674 - DNA, 22 bp, Homo sapiens
tgccttgccactgctcttaatg

SEQ ID NO: 7709675 - DNA, 22 bp, Homo sapiens
tgcctgtgtatttccggcctgc

SEQ ID NO: 7709676 - DNA, 22 bp, Homo sapiens
tgcctgtgtcacagtgatgttt

SEQ ID NO: 7709677 - DNA, 22 bp, Homo sapiens
tgcctgtgtcacagtgatgttt

SEQ ID NO: 7709678 - DNA, 22 bp, Homo sapiens
tgcctgtgtcacagtgatgttt

SEQ ID NO: 7709679 - DNA, 22 bp, Homo sapiens
tgcctgtgtgaccacgggcaag

SEQ ID NO: 7709680 - DNA, 22 bp, Homo sapiens
tgcctgtgtccccttcttggca

SEQ ID NO: 7709681 - DNA, 22 bp, Homo sapiens
tgcctgtgtcagcaggtggaag

SEQ ID NO: 7709682 - DNA, 22 bp, Homo sapiens
tgcctgtgtcagcaggtggaag

SEQ ID NO: 7709683 - DNA, 22 bp, Homo sapiens
tgcctgtgtccccttcttggca

SEQ ID NO: 7709684 - DNA, 22 bp, Homo sapiens
tgctctctcaggcctggcccac

SEQ ID NO: 7709685 - DNA, 19 bp, Homo sapiens
tgctctctggtgcttcatg

SEQ ID NO: 7709686 - DNA, 19 bp, Homo sapiens
tgctctctggtgcttcatg

SEQ ID NO: 7709687 - DNA, 22 bp, Homo sapiens
tgctctccggcttccgtggcct

SEQ ID NO: 7709688 - DNA, 22 bp, Homo sapiens
tgctctcatggaggtagagaat

SEQ ID NO: 7709689 - DNA, 22 bp, Homo sapiens
tgctctcagagtcaggaggtaa

SEQ ID NO: 7709690 - DNA, 22 bp, Homo sapiens
tgctctcagagtcaggaggtaa

SEQ ID NO: 7709691 - DNA, 22 bp, Homo sapiens
tgctctccggcttccgtggcct

SEQ ID NO: 7709692 - DNA, 22 bp, Homo sapiens
tgctctcctgctcctcagccca

SEQ ID NO: 7709693 - DNA, 22 bp, Homo sapiens
tgctctcctgctcctcagccca

SEQ ID NO: 7709694 - DNA, 22 bp, Homo sapiens
tgctctcctgctcctcagccca

SEQ ID NO: 7709695 - DNA, 22 bp, Homo sapiens
tgctctcctgctcctcagccca

SEQ ID NO: 7709696 - DNA, 22 bp, Homo sapiens
tgctctcctgctcctcagccca

SEQ ID NO: 7709697 - DNA, 22 bp, Homo sapiens
tgctctgggaccgtcattaaaa

SEQ ID NO: 7709698 - DNA, 22 bp, Homo sapiens
tgctctggctgggatgagtgca

SEQ ID NO: 7709699 - DNA, 22 bp, Homo sapiens
tgctctgggaccgtcattaaaa

SEQ ID NO: 7709700 - DNA, 22 bp, Homo sapiens
tgctctggctgggatgagtgca

SEQ ID NO: 7709701 - DNA, 22 bp, Homo sapiens
tgctctggctgggatgagtgca

SEQ ID NO: 7709702 - DNA, 22 bp, Homo sapiens
tgctctggctgggatgagtgca

SEQ ID NO: 7709703 - DNA, 22 bp, Homo sapiens
tgctctggctggagcaatgact

SEQ ID NO: 7709704 - DNA, 22 bp, Homo sapiens
tgctctggctggagcaatgact

SEQ ID NO: 7709705 - DNA, 19 bp, Homo sapiens
tgctctctggtgcttcatg

SEQ ID NO: 7709706 - DNA, 22 bp, Homo sapiens
tgctctggctggagcaatgact

SEQ ID NO: 7709707 - DNA, 22 bp, Homo sapiens
tgctctggctggagcaatgact

SEQ ID NO: 7709708 - DNA, 22 bp, Homo sapiens
tgctctggctgggatgagtgca

SEQ ID NO: 7709709 - DNA, 22 bp, Homo sapiens
tgctctggctgggatgagtgca

SEQ ID NO: 7709710 - DNA, 22 bp, Homo sapiens
tgctctggctgggatgagtgca

SEQ ID NO: 7709711 - DNA, 22 bp, Homo sapiens
tgctctgggattcagcagcctg

SEQ ID NO: 7709712 - DNA, 23 bp, Homo sapiens
tgctctgggaggccctggagagc

SEQ ID NO: 7709713 - DNA, 22 bp, Homo sapiens
tgctctgggattcagcagcctg

SEQ ID NO: 7709714 - DNA, 22 bp, Homo sapiens
tgctctgggattcagcagcctg

SEQ ID NO: 7709715 - DNA, 22 bp, Homo sapiens
tgctctgggattcagcagcctg

SEQ ID NO: 7709716 - DNA, 23 bp, Homo sapiens
tgctctgggaggccctggagagc

SEQ ID NO: 7709717 - DNA, 23 bp, Homo sapiens
tgctctgggaggccctggagagc

SEQ ID NO: 7709718 - DNA, 23 bp, Homo sapiens
tgctctgggaggccctggagagc

SEQ ID NO: 7709719 - DNA, 23 bp, Homo sapiens
tgctctgggaggccctggagagc

SEQ ID NO: 7709720 - DNA, 23 bp, Homo sapiens
tgctctgggaggccctggagagc

SEQ ID NO: 7709721 - DNA, 22 bp, Homo sapiens
tgctctgggggaagccagctgt

SEQ ID NO: 7709722 - DNA, 22 bp, Homo sapiens
tgctctggggctccccaccaga

SEQ ID NO: 7709723 - DNA, 22 bp, Homo sapiens
tgctctggggctccccaccaga

SEQ ID NO: 7709724 - DNA, 22 bp, Homo sapiens
tgctctggggctccccaccaga

SEQ ID NO: 7709725 - DNA, 22 bp, Homo sapiens
tgctctggggagctcctctgcg

SEQ ID NO: 7709726 - DNA, 22 bp, Homo sapiens
tgctctgggggaagccagctgt

SEQ ID NO: 7709727 - DNA, 22 bp, Homo sapiens
tgctctgggggaagccagctgt

SEQ ID NO: 7709728 - DNA, 22 bp, Homo sapiens
tgctctgggggaagccagctgt

SEQ ID NO: 7709729 - DNA, 22 bp, Homo sapiens
tgctctgggggaagccagctgt

SEQ ID NO: 7709730 - DNA, 22 bp, Homo sapiens
tgctctgggggaagccagctgt

SEQ ID NO: 7709731 - DNA, 22 bp, Homo sapiens
tgctctgggggaagccagctgt

SEQ ID NO: 7709732 - DNA, 22 bp, Homo sapiens
tgctctgggggaagccagctgt

SEQ ID NO: 7709733 - DNA, 22 bp, Homo sapiens
tgctctggggagctcctctgcg

SEQ ID NO: 7709734 - DNA, 22 bp, Homo sapiens
tgctctggggagctcctctgcg

SEQ ID NO: 7709735 - DNA, 22 bp, Homo sapiens
tgctctggggagctcctctgcg

SEQ ID NO: 7709736 - DNA, 22 bp, Homo sapiens
tgctctggggagctcctctgcg

SEQ ID NO: 7709737 - DNA, 22 bp, Homo sapiens
tgctctggggagctcctctgcg

SEQ ID NO: 7709738 - DNA, 22 bp, Homo sapiens
tgctctggggagctcctctgcg

SEQ ID NO: 7709739 - DNA, 22 bp, Homo sapiens
tgctctgggctcaatggcagct

SEQ ID NO: 7709740 - DNA, 22 bp, Homo sapiens
tgctctggggagctcctctgcg

SEQ ID NO: 7709741 - DNA, 22 bp, Homo sapiens
tgctctggggagctcctctgcg

SEQ ID NO: 7709742 - DNA, 22 bp, Homo sapiens
tgctctggggagctcctctgcg

SEQ ID NO: 7709743 - DNA, 22 bp, Homo sapiens
tgctctggggagctcctctgcg

SEQ ID NO: 7709744 - DNA, 22 bp, Homo sapiens
tgctctggggagctcctctgcg

SEQ ID NO: 7709745 - DNA, 22 bp, Homo sapiens
tgctctgggattcagcagcctg

SEQ ID NO: 7709746 - DNA, 22 bp, Homo sapiens
tgctctgggcaacagcctccct

SEQ ID NO: 7709747 - DNA, 22 bp, Homo sapiens
tgctctgggcaacagcctccct

SEQ ID NO: 7709748 - DNA, 22 bp, Homo sapiens
tgctctgggcaacagcctccct

SEQ ID NO: 7709749 - DNA, 22 bp, Homo sapiens
tgctctgggctatctgagaaag

SEQ ID NO: 7709750 - DNA, 22 bp, Homo sapiens
tgctctgggctatctgagaaag

SEQ ID NO: 7709751 - DNA, 22 bp, Homo sapiens
tgctctgggctatctgagaaag

SEQ ID NO: 7709752 - DNA, 22 bp, Homo sapiens
tgctctgggcaacagcctccct

SEQ ID NO: 7709753 - DNA, 22 bp, Homo sapiens
tgctctgggcaacagcctccct

SEQ ID NO: 7709754 - DNA, 22 bp, Homo sapiens
tgctctgggcaacagcctccct

SEQ ID NO: 7709755 - DNA, 22 bp, Homo sapiens
tgctctgggctatctgagaaag

SEQ ID NO: 7709756 - DNA, 22 bp, Homo sapiens
tgctctgggctcaatggcagct

SEQ ID NO: 7709757 - DNA, 22 bp, Homo sapiens
tgctctgggctcaatggcagct

SEQ ID NO: 7709758 - DNA, 22 bp, Homo sapiens
tgctctgggctcaatggcagct

SEQ ID NO: 7709759 - DNA, 22 bp, Homo sapiens
tgctctgggctcaatggcagct

SEQ ID NO: 7709760 - DNA, 22 bp, Homo sapiens
tgctctgggctcaatggcagct

SEQ ID NO: 7709761 - DNA, 22 bp, Homo sapiens
tgctctgggctcaatggcagct

SEQ ID NO: 7709762 - DNA, 22 bp, Homo sapiens
tgctctgggctcaatggcagct

SEQ ID NO: 7709763 - DNA, 22 bp, Homo sapiens
tgctctgggctcaatggcagct

SEQ ID NO: 7709764 - DNA, 22 bp, Homo sapiens
tgctctgggctcaatggcagct

SEQ ID NO: 7709765 - DNA, 22 bp, Homo sapiens
tgctcctgggctgaagcacact

SEQ ID NO: 7709766 - DNA, 17 bp, Homo sapiens
tgctcctgtggcagcct

SEQ ID NO: 7709767 - DNA, 17 bp, Homo sapiens
tgctcctgtggcagcct

SEQ ID NO: 7709768 - DNA, 17 bp, Homo sapiens
tgctcctgtggcagcct

SEQ ID NO: 7709769 - DNA, 17 bp, Homo sapiens
tgctcctgtggcagcct

SEQ ID NO: 7709770 - DNA, 17 bp, Homo sapiens
tgctcctgtggcagcct

SEQ ID NO: 7709771 - DNA, 17 bp, Homo sapiens
tgctcctgtggcagcct

SEQ ID NO: 7709772 - DNA, 17 bp, Homo sapiens
tgctcctgtggcagcct

SEQ ID NO: 7709773 - DNA, 22 bp, Homo sapiens
tgctcctgtttcatcagctata

SEQ ID NO: 7709774 - DNA, 22 bp, Homo sapiens
tgctcctgtttcatcagctata

SEQ ID NO: 7709775 - DNA, 17 bp, Homo sapiens
tgctcctgtggcagcct

SEQ ID NO: 7709776 - DNA, 17 bp, Homo sapiens
tgctcctgtggcagcct

SEQ ID NO: 7709777 - DNA, 22 bp, Homo sapiens
tgctcctgtttcatcagctata

SEQ ID NO: 7709778 - DNA, 22 bp, Homo sapiens
tgctcctgtttcatcagctata

SEQ ID NO: 7709779 - DNA, 22 bp, Homo sapiens
tgctcctgtttcatcagctata

SEQ ID NO: 7709780 - DNA, 22 bp, Homo sapiens
tgctcctgtttcatcagctata

SEQ ID NO: 7709781 - DNA, 22 bp, Homo sapiens
tgctcctggatgaggtactcca

SEQ ID NO: 7709782 - DNA, 22 bp, Homo sapiens
tgctcctggatgaggtactcca

SEQ ID NO: 7709783 - DNA, 22 bp, Homo sapiens
tgctcctggcatctctgcgtcc

SEQ ID NO: 7709784 - DNA, 22 bp, Homo sapiens
tgctcctggcatctctgcgtcc

SEQ ID NO: 7709785 - DNA, 22 bp, Homo sapiens
tgctcctggatgaggtactcca

SEQ ID NO: 7709786 - DNA, 22 bp, Homo sapiens
tgctcctggatgaggtactcca

SEQ ID NO: 7709787 - DNA, 22 bp, Homo sapiens
tgctcctggatgaggtactcca

SEQ ID NO: 7709788 - DNA, 22 bp, Homo sapiens
tgctcctggactggtgtgagat

SEQ ID NO: 7709789 - DNA, 22 bp, Homo sapiens
tgctcctggactggtgtgagat

SEQ ID NO: 7709790 - DNA, 22 bp, Homo sapiens
tgctcctggcatctctgcgtcc

SEQ ID NO: 7709791 - DNA, 22 bp, Homo sapiens
tgctcctggcttcaggttgggc

SEQ ID NO: 7709792 - DNA, 22 bp, Homo sapiens
tgctcctggctccttccctaac

SEQ ID NO: 7709793 - DNA, 17 bp, Homo sapiens
tgctcctgggacaagga

SEQ ID NO: 7709794 - DNA, 17 bp, Homo sapiens
tgctcctgggacaagga

SEQ ID NO: 7709795 - DNA, 22 bp, Homo sapiens
tgctcctggcttcaggttgggc

SEQ ID NO: 7709796 - DNA, 22 bp, Homo sapiens
tgctcctggcttcaggttgggc

SEQ ID NO: 7709797 - DNA, 22 bp, Homo sapiens
tgctctatctaaaagtcctgga

SEQ ID NO: 7709798 - DNA, 22 bp, Homo sapiens
tgctctagtgggtagagcattg

SEQ ID NO: 7709799 - DNA, 22 bp, Homo sapiens
tgctctcagagtcaggaggtaa

SEQ ID NO: 7709800 - DNA, 22 bp, Homo sapiens
tgctctattaattttaacgatg

SEQ ID NO: 7709801 - DNA, 22 bp, Homo sapiens
tgctctatttcttcacctacaa

SEQ ID NO: 7709802 - DNA, 22 bp, Homo sapiens
tgctctagtgggtagagcattg

SEQ ID NO: 7709803 - DNA, 22 bp, Homo sapiens
tgctctagtgggtagagcattg

SEQ ID NO: 7709804 - DNA, 22 bp, Homo sapiens
tgctctagctcataggactcat

SEQ ID NO: 7709805 - DNA, 22 bp, Homo sapiens
tgctctagcctgtaaaacatga

SEQ ID NO: 7709806 - DNA, 22 bp, Homo sapiens
tgctcgcgctgttccagcagct

SEQ ID NO: 7709807 - DNA, 22 bp, Homo sapiens
tgctcgccccacatgccctcat

SEQ ID NO: 7709808 - DNA, 22 bp, Homo sapiens
tgctcgctgactcaacaagctt

SEQ ID NO: 7709809 - DNA, 22 bp, Homo sapiens
tgctctaagaactctaggaatt

SEQ ID NO: 7709810 - DNA, 15 bp, Homo sapiens
tgctctaagatgagg

SEQ ID NO: 7709811 - DNA, 22 bp, Homo sapiens
tgctctagagctattggcttcc

SEQ ID NO: 7709812 - DNA, 22 bp, Homo sapiens
tgctctaagaactctaggaatt

SEQ ID NO: 7709813 - DNA, 22 bp, Homo sapiens
tgctctagctcataggactcat

SEQ ID NO: 7709814 - DNA, 22 bp, Homo sapiens
tgctcgaggtccccaccggctc

SEQ ID NO: 7709815 - DNA, 22 bp, Homo sapiens
tgctcctttcatccaattctca

SEQ ID NO: 7709816 - DNA, 22 bp, Homo sapiens
tgctcctttcatccaattctca

SEQ ID NO: 7709817 - DNA, 21 bp, Homo sapiens
tgctcctttaccccacaagac

SEQ ID NO: 7709818 - DNA, 22 bp, Homo sapiens
tgctccttcctcatcctgtgca

SEQ ID NO: 7709819 - DNA, 22 bp, Homo sapiens
tgctccttcccttcccagtgag

SEQ ID NO: 7709820 - DNA, 21 bp, Homo sapiens
tgctccttagctgcccctgcc

SEQ ID NO: 7709821 - DNA, 21 bp, Homo sapiens
tgctccttagctgcccctgcc

SEQ ID NO: 7709822 - DNA, 22 bp, Homo sapiens
tgctcgaggtccccaccggctc

SEQ ID NO: 7709823 - DNA, 22 bp, Homo sapiens
tgctcctttcatccaattctca

SEQ ID NO: 7709824 - DNA, 22 bp, Homo sapiens
tgctcgaggtccccaccggctc

SEQ ID NO: 7709825 - DNA, 22 bp, Homo sapiens
tgctcgccccacatgccctcat

SEQ ID NO: 7709826 - DNA, 22 bp, Homo sapiens
tgctcgccccacatgccctcat

SEQ ID NO: 7709827 - DNA, 22 bp, Homo sapiens
tgctcgccccacatgccctcat

SEQ ID NO: 7709828 - DNA, 22 bp, Homo sapiens
tgctcgccccacatgccctcat

SEQ ID NO: 7709829 - DNA, 22 bp, Homo sapiens
tgctcgccccacatgccctcat

SEQ ID NO: 7709830 - DNA, 22 bp, Homo sapiens
tgctcgccccacatgccctcat

SEQ ID NO: 7709831 - DNA, 19 bp, Homo sapiens
tgctccaggccttgccgca

SEQ ID NO: 7709832 - DNA, 22 bp, Homo sapiens
tgctccaggccgcctggggctg

SEQ ID NO: 7709833 - DNA, 22 bp, Homo sapiens
tgctccaggccgcctggggctg

SEQ ID NO: 7709834 - DNA, 22 bp, Homo sapiens
tgctccaggccgcctggggctg

SEQ ID NO: 7709835 - DNA, 22 bp, Homo sapiens
tgctccaggccgcctggggctg

SEQ ID NO: 7709836 - DNA, 22 bp, Homo sapiens
tgctccaggctgctgaagatct

SEQ ID NO: 7709837 - DNA, 22 bp, Homo sapiens
tgctccaggctgctgaagatct

SEQ ID NO: 7709838 - DNA, 19 bp, Homo sapiens
tgctccaggccttgccgca

SEQ ID NO: 7709839 - DNA, 19 bp, Homo sapiens
tgctccaggccttgccgca

SEQ ID NO: 7709840 - DNA, 21 bp, Homo sapiens
tgctccagggcagcttccagc

SEQ ID NO: 7709841 - DNA, 21 bp, Homo sapiens
tgctccagggcagcttccagc

SEQ ID NO: 7709842 - DNA, 21 bp, Homo sapiens
tgctccagggcagcttccagc

SEQ ID NO: 7709843 - DNA, 21 bp, Homo sapiens
tgctccagggcagcttccagc

SEQ ID NO: 7709844 - DNA, 21 bp, Homo sapiens
tgctccagggcagcttccagc

SEQ ID NO: 7709845 - DNA, 22 bp, Homo sapiens
tgctccagggcctccagtgggg

SEQ ID NO: 7709846 - DNA, 22 bp, Homo sapiens
tgctccagggcctccagtgggg

SEQ ID NO: 7709847 - DNA, 22 bp, Homo sapiens
tgctccagggcctccagtgggg

SEQ ID NO: 7709848 - DNA, 22 bp, Homo sapiens
tgctccagggcctccagtgggg

SEQ ID NO: 7709849 - DNA, 22 bp, Homo sapiens
tgctccagggcctccagtgggg

SEQ ID NO: 7709850 - DNA, 18 bp, Homo sapiens
tgctccaggcccatgggc

SEQ ID NO: 7709851 - DNA, 18 bp, Homo sapiens
tgctccaggcccatgggc

SEQ ID NO: 7709852 - DNA, 18 bp, Homo sapiens
tgctccaggcccatgggc

SEQ ID NO: 7709853 - DNA, 22 bp, Homo sapiens
tgctccaggcaagctgagagtt

SEQ ID NO: 7709854 - DNA, 22 bp, Homo sapiens
tgctccaggcaagctgagagtt

SEQ ID NO: 7709855 - DNA, 22 bp, Homo sapiens
tgctccaggcaagctgagagtt

SEQ ID NO: 7709856 - DNA, 22 bp, Homo sapiens
tgctccaggcaagctgagagtt

SEQ ID NO: 7709857 - DNA, 22 bp, Homo sapiens
tgctccaggccgcctggggctg

SEQ ID NO: 7709858 - DNA, 22 bp, Homo sapiens
tgctccaggccgcctggggctg

SEQ ID NO: 7709859 - DNA, 22 bp, Homo sapiens
tgctccaggccgcctggggctg

SEQ ID NO: 7709860 - DNA, 22 bp, Homo sapiens
tgctccaggccgcctggggctg

SEQ ID NO: 7709861 - DNA, 18 bp, Homo sapiens
tgctccaggcccatgggc

SEQ ID NO: 7709862 - DNA, 21 bp, Homo sapiens
tgctccaggagggggcagtcc

SEQ ID NO: 7709863 - DNA, 21 bp, Homo sapiens
tgctccaggagggggcagtcc

SEQ ID NO: 7709864 - DNA, 21 bp, Homo sapiens
tgctccaggagggggcagtcc

SEQ ID NO: 7709865 - DNA, 22 bp, Homo sapiens
tgctccaggagcactttccatt

SEQ ID NO: 7709866 - DNA, 22 bp, Homo sapiens
tgctccaggagcactttccatt

SEQ ID NO: 7709867 - DNA, 21 bp, Homo sapiens
tgctccaggagggggcagtcc

SEQ ID NO: 7709868 - DNA, 21 bp, Homo sapiens
tgctccaggagggggcagtcc

SEQ ID NO: 7709869 - DNA, 21 bp, Homo sapiens
tgctccaggagggggcagtcc

SEQ ID NO: 7709870 - DNA, 22 bp, Homo sapiens
tgctccaggcaagctgagagtt

SEQ ID NO: 7709871 - DNA, 22 bp, Homo sapiens
tgctccaggcaagctgagagtt

SEQ ID NO: 7709872 - DNA, 22 bp, Homo sapiens
tgctccaggcaagctgagagtt

SEQ ID NO: 7709873 - DNA, 22 bp, Homo sapiens
tgctccaggagcaacctttgag

SEQ ID NO: 7709874 - DNA, 22 bp, Homo sapiens
tgctccaggagcaacctttgag

SEQ ID NO: 7709875 - DNA, 20 bp, Homo sapiens
tgctccaggaacactggccg

SEQ ID NO: 7709876 - DNA, 20 bp, Homo sapiens
tgctccaggaacactggccg

SEQ ID NO: 7709877 - DNA, 20 bp, Homo sapiens
tgctccaggaacactggccg

SEQ ID NO: 7709878 - DNA, 20 bp, Homo sapiens
tgctccaggaacactggccg

SEQ ID NO: 7709879 - DNA, 22 bp, Homo sapiens
tgctccagctggagatgggggc

SEQ ID NO: 7709880 - DNA, 22 bp, Homo sapiens
tgctccagctggagatgggggc

SEQ ID NO: 7709881 - DNA, 20 bp, Homo sapiens
tgctccaggaacactggccg

SEQ ID NO: 7709882 - DNA, 20 bp, Homo sapiens
tgctccaggaacactggccg

SEQ ID NO: 7709883 - DNA, 20 bp, Homo sapiens
tgctccaggaacactggccg

SEQ ID NO: 7709884 - DNA, 20 bp, Homo sapiens
tgctccaggaacactggccg

SEQ ID NO: 7709885 - DNA, 22 bp, Homo sapiens
tgctccagcgctgccaccagtt

SEQ ID NO: 7709886 - DNA, 22 bp, Homo sapiens
tgctccagcgctgccaccagtt

SEQ ID NO: 7709887 - DNA, 22 bp, Homo sapiens
tgctccagcctatgctctccgg

SEQ ID NO: 7709888 - DNA, 22 bp, Homo sapiens
tgctccagcctatgctctccgg

SEQ ID NO: 7709889 - DNA, 22 bp, Homo sapiens
tgctccagcctatgctctccgg

SEQ ID NO: 7709890 - DNA, 22 bp, Homo sapiens
tgctccagcccctggtgcacag

SEQ ID NO: 7709891 - DNA, 22 bp, Homo sapiens
tgctccagcccctggtgcacag

SEQ ID NO: 7709892 - DNA, 22 bp, Homo sapiens
tgctccagcaccaagagctcca

SEQ ID NO: 7709893 - DNA, 22 bp, Homo sapiens
tgctccagcatgaccctcaatg

SEQ ID NO: 7709894 - DNA, 22 bp, Homo sapiens
tgctccagcatgaccctcaatg

SEQ ID NO: 7709895 - DNA, 22 bp, Homo sapiens
tgctccagcctatgctctccgg

SEQ ID NO: 7709896 - DNA, 22 bp, Homo sapiens
tgctccagcgctgccaccagtt

SEQ ID NO: 7709897 - DNA, 22 bp, Homo sapiens
tgctccagcgctgccaccagtt

SEQ ID NO: 7709898 - DNA, 22 bp, Homo sapiens
tgctccagcgctgccaccagtt

SEQ ID NO: 7709899 - DNA, 23 bp, Homo sapiens
tgctccagcctctttgatagtgt

SEQ ID NO: 7709900 - DNA, 23 bp, Homo sapiens
tgctccagcctctttgatagtgt

SEQ ID NO: 7709901 - DNA, 23 bp, Homo sapiens
tgctccagcctctttgatagtgt

SEQ ID NO: 7709902 - DNA, 22 bp, Homo sapiens
tgctcctgaggttggagatcca

SEQ ID NO: 7709903 - DNA, 22 bp, Homo sapiens
tgctcctgaggttggagatcca

SEQ ID NO: 7709904 - DNA, 22 bp, Homo sapiens
tgctcctgagcggtttccatga

SEQ ID NO: 7709905 - DNA, 22 bp, Homo sapiens
tgctcctgagtgtgcaggagat

SEQ ID NO: 7709906 - DNA, 22 bp, Homo sapiens
tgctcctgagtgtgcaggagat

SEQ ID NO: 7709907 - DNA, 22 bp, Homo sapiens
tgctcctgagtgtgcaggagat

SEQ ID NO: 7709908 - DNA, 22 bp, Homo sapiens
tgctcctgatatctaatgtgta

SEQ ID NO: 7709909 - DNA, 22 bp, Homo sapiens
tgctcctgatatctaatgtgta

SEQ ID NO: 7709910 - DNA, 22 bp, Homo sapiens
tgctcctgacagttttaggctc

SEQ ID NO: 7709911 - DNA, 22 bp, Homo sapiens
tgctcctgacagttttaggctc

SEQ ID NO: 7709912 - DNA, 22 bp, Homo sapiens
tgctcctgaacacagccctatg

SEQ ID NO: 7709913 - DNA, 22 bp, Homo sapiens
tgctcctgaattacactactac

SEQ ID NO: 7709914 - DNA, 22 bp, Homo sapiens
tgctcctgaattacactactac

SEQ ID NO: 7709915 - DNA, 22 bp, Homo sapiens
tgctcctgctggccctcgtgcc

SEQ ID NO: 7709916 - DNA, 22 bp, Homo sapiens
tgctcctgctggccctcgtgcc

SEQ ID NO: 7709917 - DNA, 22 bp, Homo sapiens
tgctcctgctggccctcgtgcc

SEQ ID NO: 7709918 - DNA, 22 bp, Homo sapiens
tgctcctgctgcatgcatctcc

SEQ ID NO: 7709919 - DNA, 22 bp, Homo sapiens
tgctcctgctgcatgcatctcc

SEQ ID NO: 7709920 - DNA, 22 bp, Homo sapiens
tgctcctgctgcatgcatctcc

SEQ ID NO: 7709921 - DNA, 22 bp, Homo sapiens
tgctcctgatatctaatgtgta

SEQ ID NO: 7709922 - DNA, 22 bp, Homo sapiens
tgctcctgctcctcccggttga

SEQ ID NO: 7709923 - DNA, 22 bp, Homo sapiens
tgctcctgccgtggtcgggact

SEQ ID NO: 7709924 - DNA, 22 bp, Homo sapiens
tgctcctgctgcatgcatctcc

SEQ ID NO: 7709925 - DNA, 22 bp, Homo sapiens
tgctcctgctgcatgcatctcc

SEQ ID NO: 7709926 - DNA, 22 bp, Homo sapiens
tgctcctgctgcatgcatctcc

SEQ ID NO: 7709927 - DNA, 22 bp, Homo sapiens
tgctcctgctgcatgcatctcc

SEQ ID NO: 7709928 - DNA, 22 bp, Homo sapiens
tgctcctgctgcatgcatctcc

SEQ ID NO: 7709929 - DNA, 22 bp, Homo sapiens
tgctccgggaaagagcagccgc

SEQ ID NO: 7709930 - DNA, 22 bp, Homo sapiens
tgctccgttcttctgcttcttg

SEQ ID NO: 7709931 - DNA, 22 bp, Homo sapiens
tgctccgttcttctgcttcttg

SEQ ID NO: 7709932 - DNA, 20 bp, Homo sapiens
tgctcctaccacttctgccc

SEQ ID NO: 7709933 - DNA, 22 bp, Homo sapiens
tgctcctgaacacagccctatg

SEQ ID NO: 7709934 - DNA, 22 bp, Homo sapiens
tgctcctgaacacagccctatg

SEQ ID NO: 7709935 - DNA, 22 bp, Homo sapiens
tgctcctatcctcctgctgaca

SEQ ID NO: 7709936 - DNA, 22 bp, Homo sapiens
tgctccctgctcagagaggcca

SEQ ID NO: 7709937 - DNA, 22 bp, Homo sapiens
tgctcccttgccagaggggaag

SEQ ID NO: 7709938 - DNA, 22 bp, Homo sapiens
tgctcccttgccagaggggaag

SEQ ID NO: 7709939 - DNA, 20 bp, Homo sapiens
tgctcccttgcgagtcgctg

SEQ ID NO: 7709940 - DNA, 19 bp, Homo sapiens
tgctccgctaaggcagaca

SEQ ID NO: 7709941 - DNA, 22 bp, Homo sapiens
tgctcccatgtgtgggtacaga

SEQ ID NO: 7709942 - DNA, 22 bp, Homo sapiens
tgctccctgctcagagaggcca

SEQ ID NO: 7709943 - DNA, 22 bp, Homo sapiens
tgctccctgctcagagaggcca

SEQ ID NO: 7709944 - DNA, 22 bp, Homo sapiens
tgctccctgacccaggtcttct

SEQ ID NO: 7709945 - DNA, 22 bp, Homo sapiens
tgctccctgacccaggtcttct

SEQ ID NO: 7709946 - DNA, 22 bp, Homo sapiens
tgctcccatgtgtgggtacaga

SEQ ID NO: 7709947 - DNA, 23 bp, Homo sapiens
tgctcccaggtgacgctgctgtt

SEQ ID NO: 7709948 - DNA, 23 bp, Homo sapiens
tgctcccaggtgacgctgctgtt

SEQ ID NO: 7709949 - DNA, 22 bp, Homo sapiens
tgctcccatgtgtgggtacaga

SEQ ID NO: 7709950 - DNA, 22 bp, Homo sapiens
tgctccagggcctccagtgggg

SEQ ID NO: 7709951 - DNA, 22 bp, Homo sapiens
tgctccagggcctccagtgggg

SEQ ID NO: 7709952 - DNA, 22 bp, Homo sapiens
tgctccagggcctccagtgggg

SEQ ID NO: 7709953 - DNA, 22 bp, Homo sapiens
tgctccagggctgccagaccct

SEQ ID NO: 7709954 - DNA, 22 bp, Homo sapiens
tgctccagggctgccagaccct

SEQ ID NO: 7709955 - DNA, 22 bp, Homo sapiens
tgctcccaggactcttgagcca

SEQ ID NO: 7709956 - DNA, 22 bp, Homo sapiens
tgctcccaggcattctctgttg

SEQ ID NO: 7709957 - DNA, 22 bp, Homo sapiens
tgctcccagggactctggctgg

SEQ ID NO: 7709958 - DNA, 22 bp, Homo sapiens
tgctcccaggctctgtggtctg

SEQ ID NO: 7709959 - DNA, 22 bp, Homo sapiens
tgctcccaggctctgtggtctg

SEQ ID NO: 7709960 - DNA, 22 bp, Homo sapiens
tgctcccaggcattctctgttg

SEQ ID NO: 7709961 - DNA, 20 bp, Homo sapiens
tgctgaggttgacatgccca

SEQ ID NO: 7709962 - DNA, 20 bp, Homo sapiens
tgctgaggttgacatgccca

SEQ ID NO: 7709963 - DNA, 22 bp, Homo sapiens
tgctgaggtcatttccaagtga

SEQ ID NO: 7709964 - DNA, 22 bp, Homo sapiens
tgctgaggtcatttccaagtga

SEQ ID NO: 7709965 - DNA, 22 bp, Homo sapiens
tgctgaggtcatttccaagtga

SEQ ID NO: 7709966 - DNA, 22 bp, Homo sapiens
tgctgaggtcatttccaagtga

SEQ ID NO: 7709967 - DNA, 22 bp, Homo sapiens
tgctgaggtcacggcggccaga

SEQ ID NO: 7709968 - DNA, 22 bp, Homo sapiens
tgctgaggtcaccttgctgcta

SEQ ID NO: 7709969 - DNA, 22 bp, Homo sapiens
tgctgaggtcaccttgctgcta

SEQ ID NO: 7709970 - DNA, 22 bp, Homo sapiens
tgctgaggtcacggcggccaga

SEQ ID NO: 7709971 - DNA, 22 bp, Homo sapiens
tgctgaggtcacggcggccaga

SEQ ID NO: 7709972 - DNA, 22 bp, Homo sapiens
tgctgaggtcacggcggccaga

SEQ ID NO: 7709973 - DNA, 22 bp, Homo sapiens
tgctgaggtcacggcggccaga

SEQ ID NO: 7709974 - DNA, 22 bp, Homo sapiens
tgctgaggctagacctggaagt

SEQ ID NO: 7709975 - DNA, 22 bp, Homo sapiens
tgctgaggctagacctggaagt

SEQ ID NO: 7709976 - DNA, 22 bp, Homo sapiens
tgctgagggaggggttttccag

SEQ ID NO: 7709977 - DNA, 22 bp, Homo sapiens
tgctgagggagcatcaaagaaa

SEQ ID NO: 7709978 - DNA, 22 bp, Homo sapiens
tgctgagggaggggttttccag

SEQ ID NO: 7709979 - DNA, 22 bp, Homo sapiens
tgctgaggtaaccatatcctgc

SEQ ID NO: 7709980 - DNA, 22 bp, Homo sapiens
tgctgaggtcaccttgctgcta

SEQ ID NO: 7709981 - DNA, 22 bp, Homo sapiens
tgctgagggctgttaaggaagc

SEQ ID NO: 7709982 - DNA, 22 bp, Homo sapiens
tgctgagggctgttaaggaagc

SEQ ID NO: 7709983 - DNA, 22 bp, Homo sapiens
tgctgagggctgttaaggaagc

SEQ ID NO: 7709984 - DNA, 22 bp, Homo sapiens
tgctgagggcagatgaattaga

SEQ ID NO: 7709985 - DNA, 22 bp, Homo sapiens
tgctgagggcagatgaattaga

SEQ ID NO: 7709986 - DNA, 22 bp, Homo sapiens
tgctgaggctagacctggaagt

SEQ ID NO: 7709987 - DNA, 22 bp, Homo sapiens
tgctgaggctagacctggaagt

SEQ ID NO: 7709988 - DNA, 20 bp, Homo sapiens
tgctgaggcctgaggcctgg

SEQ ID NO: 7709989 - DNA, 20 bp, Homo sapiens
tgctgaggcctgaggcctgg

SEQ ID NO: 7709990 - DNA, 20 bp, Homo sapiens
tgctgaggcctgaggcctgg

SEQ ID NO: 7709991 - DNA, 20 bp, Homo sapiens
tgctgaggcctgaggcctgg

SEQ ID NO: 7709992 - DNA, 20 bp, Homo sapiens
tgctgaggcctgaggcctgg

SEQ ID NO: 7709993 - DNA, 22 bp, Homo sapiens
tgctgaggcccaggagcacttt

SEQ ID NO: 7709994 - DNA, 20 bp, Homo sapiens
tgctgaggcctgaggcctgg

SEQ ID NO: 7709995 - DNA, 20 bp, Homo sapiens
tgctgaggcctgaggcctgg

SEQ ID NO: 7709996 - DNA, 20 bp, Homo sapiens
tgctgaggcctgaggcctgg

SEQ ID NO: 7709997 - DNA, 22 bp, Homo sapiens
tgctgaggcccaggagcacttt

SEQ ID NO: 7709998 - DNA, 22 bp, Homo sapiens
tgctgaggcccaggagcacttt

SEQ ID NO: 7709999 - DNA, 22 bp, Homo sapiens
tgctgaggcatttggacagagt

SEQ ID NO: 7710000 - DNA, 22 bp, Homo sapiens
tgctgaggcccaggagcacttt

SEQ ID NO: 7710001 - DNA, 22 bp, Homo sapiens
tgctgaggcccaggagcacttt

SEQ ID NO: 7710002 - DNA, 22 bp, Homo sapiens
tgctgaggcccaggagcacttt

SEQ ID NO: 7710003 - DNA, 22 bp, Homo sapiens
tgctgaggcagatgtctgtgac

SEQ ID NO: 7710004 - DNA, 22 bp, Homo sapiens
tgctgaggcagatgtctgtgac

SEQ ID NO: 7710005 - DNA, 22 bp, Homo sapiens
tgctgaggcagatgtctgtgac

SEQ ID NO: 7710006 - DNA, 22 bp, Homo sapiens
tgctgaggcagatgtctgtgac

SEQ ID NO: 7710007 - DNA, 22 bp, Homo sapiens
tgctgaggcagatgtctgtgac

SEQ ID NO: 7710008 - DNA, 22 bp, Homo sapiens
tgctgaggcagatgtctgtgac

SEQ ID NO: 7710009 - DNA, 22 bp, Homo sapiens
tgctgaggcagatgtctgtgac

SEQ ID NO: 7710010 - DNA, 22 bp, Homo sapiens
tgctgaggcatttggacagagt

SEQ ID NO: 7710011 - DNA, 22 bp, Homo sapiens
tgctgaggcatttggacagagt

SEQ ID NO: 7710012 - DNA, 22 bp, Homo sapiens
tgctgaggcagtcctaacagga

SEQ ID NO: 7710013 - DNA, 22 bp, Homo sapiens
tgctgaggcagtcctaacagga

SEQ ID NO: 7710014 - DNA, 22 bp, Homo sapiens
tgctgcagttcaccctgccgtc

SEQ ID NO: 7710015 - DNA, 22 bp, Homo sapiens
tgctgcagttattgaaactatg

SEQ ID NO: 7710016 - DNA, 22 bp, Homo sapiens
tgctgcagttcaccctgccgtc

SEQ ID NO: 7710017 - DNA, 22 bp, Homo sapiens
tgctgcagttcaccctgccgtc

SEQ ID NO: 7710018 - DNA, 22 bp, Homo sapiens
tgctgcagttcaccctgccgtc

SEQ ID NO: 7710019 - DNA, 22 bp, Homo sapiens
tgctgcagtgggattagcctga

SEQ ID NO: 7710020 - DNA, 22 bp, Homo sapiens
tgctgcagtgtttgctgaagtt

SEQ ID NO: 7710021 - DNA, 22 bp, Homo sapiens
tgctgcagtgtttgctgaagtt

SEQ ID NO: 7710022 - DNA, 22 bp, Homo sapiens
tgctgcagtgtttgctgaagtt

SEQ ID NO: 7710023 - DNA, 22 bp, Homo sapiens
tgctgcagtgggattagcctga

SEQ ID NO: 7710024 - DNA, 22 bp, Homo sapiens
tgctgcagtatatatttcttgg

SEQ ID NO: 7710025 - DNA, 19 bp, Homo sapiens
tgctgcagtcaggcgaggg

SEQ ID NO: 7710026 - DNA, 22 bp, Homo sapiens
tgctgcaggtgtgttcagtgag

SEQ ID NO: 7710027 - DNA, 22 bp, Homo sapiens
tgctgcaggtgtgttcagtgag

SEQ ID NO: 7710028 - DNA, 22 bp, Homo sapiens
tgctgcaggtgtgttcagtgag

SEQ ID NO: 7710029 - DNA, 22 bp, Homo sapiens
tgctgcagggccttccctgcat

SEQ ID NO: 7710030 - DNA, 22 bp, Homo sapiens
tgctgcagggccttccctgcat

SEQ ID NO: 7710031 - DNA, 22 bp, Homo sapiens
tgctgcagggccttccctgcat

SEQ ID NO: 7710032 - DNA, 22 bp, Homo sapiens
tgctgcagggccttccctgcat

SEQ ID NO: 7710033 - DNA, 22 bp, Homo sapiens
tgctgcagggatttcagagaca

SEQ ID NO: 7710034 - DNA, 22 bp, Homo sapiens
tgctgcagggatttcagagaca

SEQ ID NO: 7710035 - DNA, 22 bp, Homo sapiens
tgctgcagggatttcagagaca

SEQ ID NO: 7710036 - DNA, 22 bp, Homo sapiens
tgctgcagggatttcagagaca

SEQ ID NO: 7710037 - DNA, 22 bp, Homo sapiens
tgctgcagggaagtcggggggt

SEQ ID NO: 7710038 - DNA, 22 bp, Homo sapiens
tgctgcaggccttggctgggaa

SEQ ID NO: 7710039 - DNA, 22 bp, Homo sapiens
tgctgcaggccttggctgggaa

SEQ ID NO: 7710040 - DNA, 22 bp, Homo sapiens
tgctgcaggcagcccctctact

SEQ ID NO: 7710041 - DNA, 22 bp, Homo sapiens
tgctgcaaatgagaagagactg

SEQ ID NO: 7710042 - DNA, 22 bp, Homo sapiens
tgctgcaaattctttaattctt

SEQ ID NO: 7710043 - DNA, 22 bp, Homo sapiens
tgctgcaggccttggctgggaa

SEQ ID NO: 7710044 - DNA, 22 bp, Homo sapiens
tgctgatgctgttctgttagga

SEQ ID NO: 7710045 - DNA, 18 bp, Homo sapiens
tgctgatggtccattagt

SEQ ID NO: 7710046 - DNA, 22 bp, Homo sapiens
tgctgattttgcctactgatcc

SEQ ID NO: 7710047 - DNA, 21 bp, Homo sapiens
tgctgatgtcagagaagcaag

SEQ ID NO: 7710048 - DNA, 22 bp, Homo sapiens
tgctgagtactctcctgtgtag

SEQ ID NO: 7710049 - DNA, 22 bp, Homo sapiens
tgctgagtacactaaagaacat

SEQ ID NO: 7710050 - DNA, 22 bp, Homo sapiens
tgctgagtatttgtttgaataa

SEQ ID NO: 7710051 - DNA, 22 bp, Homo sapiens
tgctgagtctgaaacagctcag

SEQ ID NO: 7710052 - DNA, 22 bp, Homo sapiens
tgctgagtcgtattatttttta

SEQ ID NO: 7710053 - DNA, 22 bp, Homo sapiens
tgctgagtatttgtttgaataa

SEQ ID NO: 7710054 - DNA, 22 bp, Homo sapiens
tgctgagtcgtattatttttta

SEQ ID NO: 7710055 - DNA, 22 bp, Homo sapiens
tgctgatgagtccttctatcgc

SEQ ID NO: 7710056 - DNA, 22 bp, Homo sapiens
tgctgatctatcacctctgaga

SEQ ID NO: 7710057 - DNA, 22 bp, Homo sapiens
tgctgatctatcacctctgaga

SEQ ID NO: 7710058 - DNA, 22 bp, Homo sapiens
tgctgagtgggattcctgtgct

SEQ ID NO: 7710059 - DNA, 15 bp, Homo sapiens
tgctgagttctgctg

SEQ ID NO: 7710060 - DNA, 22 bp, Homo sapiens
tgctgagtgggattcctgtgct

SEQ ID NO: 7710061 - DNA, 22 bp, Homo sapiens
tgctgagtggcggcctcacttt

SEQ ID NO: 7710062 - DNA, 22 bp, Homo sapiens
tgctgagtctgaaacagctcag

SEQ ID NO: 7710063 - DNA, 15 bp, Homo sapiens
tgctgagtgcccatt

SEQ ID NO: 7710064 - DNA, 20 bp, Homo sapiens
tgctgaggttgacatgccca

SEQ ID NO: 7710065 - DNA, 22 bp, Homo sapiens
tgctgaggttgtggagtgcatt

SEQ ID NO: 7710066 - DNA, 22 bp, Homo sapiens
tgctgaggttgtggagtgcatt

SEQ ID NO: 7710067 - DNA, 22 bp, Homo sapiens
tgctgaggttgtggagtgcatt

SEQ ID NO: 7710068 - DNA, 22 bp, Homo sapiens
tgctgaggttgtggagtgcatt

SEQ ID NO: 7710069 - DNA, 22 bp, Homo sapiens
tgctgaggttgtggagtgcatt

SEQ ID NO: 7710070 - DNA, 22 bp, Homo sapiens
tgctgaggttgtggagtgcatt

SEQ ID NO: 7710071 - DNA, 22 bp, Homo sapiens
tgctgaggttgtggagtgcatt

SEQ ID NO: 7710072 - DNA, 22 bp, Homo sapiens
tgctgaggtttctgactatgga

SEQ ID NO: 7710073 - DNA, 22 bp, Homo sapiens
tgctgaggtttctgactatgga

SEQ ID NO: 7710074 - DNA, 22 bp, Homo sapiens
tgctgagtactctcctgtgtag

SEQ ID NO: 7710075 - DNA, 22 bp, Homo sapiens
tgctgaggtttcgtctgcttgc

SEQ ID NO: 7710076 - DNA, 22 bp, Homo sapiens
tgctgaggtttcgtctgcttgc

SEQ ID NO: 7710077 - DNA, 22 bp, Homo sapiens
tgctgaggtttctgactatgga

SEQ ID NO: 7710078 - DNA, 22 bp, Homo sapiens
tgctgaggtttctgactatgga

SEQ ID NO: 7710079 - DNA, 22 bp, Homo sapiens
tgctgagcgcatccggcggccg

SEQ ID NO: 7710080 - DNA, 22 bp, Homo sapiens
tgctgagcgcatccggcggccg

SEQ ID NO: 7710081 - DNA, 22 bp, Homo sapiens
tgctgagatgaatagggctgtc

SEQ ID NO: 7710082 - DNA, 21 bp, Homo sapiens
tgctgagatttgcctgattac

SEQ ID NO: 7710083 - DNA, 21 bp, Homo sapiens
tgctgagatttgcctgattac

SEQ ID NO: 7710084 - DNA, 22 bp, Homo sapiens
tgctgagatctgccagtagatg

SEQ ID NO: 7710085 - DNA, 22 bp, Homo sapiens
tgctgagatgaatagggctgtc

SEQ ID NO: 7710086 - DNA, 22 bp, Homo sapiens
tgctgagcgcatccggcggccg

SEQ ID NO: 7710087 - DNA, 22 bp, Homo sapiens
tgctgagcgcatccggcggccg

SEQ ID NO: 7710088 - DNA, 22 bp, Homo sapiens
tgctgagcgcatccggcggccg

SEQ ID NO: 7710089 - DNA, 22 bp, Homo sapiens
tgctgagcgcatccggcggccg

SEQ ID NO: 7710090 - DNA, 22 bp, Homo sapiens
tgctgaggaaaaatgtgactct

SEQ ID NO: 7710091 - DNA, 22 bp, Homo sapiens
tgctgaaagaccgtatttatct

SEQ ID NO: 7710092 - DNA, 22 bp, Homo sapiens
tgctgaaacaataacatactgg

SEQ ID NO: 7710093 - DNA, 22 bp, Homo sapiens
tgctgaaacaataacatactgg

SEQ ID NO: 7710094 - DNA, 23 bp, Homo sapiens
tgctcttctcagacctgtcagcc

SEQ ID NO: 7710095 - DNA, 22 bp, Homo sapiens
tgctgaaaactcaaccattgtg

SEQ ID NO: 7710096 - DNA, 22 bp, Homo sapiens
tgctgaaaactcaaccattgtg

SEQ ID NO: 7710097 - DNA, 22 bp, Homo sapiens
tgctgaaaagtaaataggccta

SEQ ID NO: 7710098 - DNA, 22 bp, Homo sapiens
tgctgaaaatgcgtatcttcca

SEQ ID NO: 7710099 - DNA, 22 bp, Homo sapiens
tgctgaagggaaggtcttgaat

SEQ ID NO: 7710100 - DNA, 22 bp, Homo sapiens
tgctgaaggcaggggaggtggc

SEQ ID NO: 7710101 - DNA, 22 bp, Homo sapiens
tgctgaaatatttatgggtcaa

SEQ ID NO: 7710102 - DNA, 22 bp, Homo sapiens
tgctgaaatatttatgggtcaa

SEQ ID NO: 7710103 - DNA, 22 bp, Homo sapiens
tgctgaaattagaacattgagg

SEQ ID NO: 7710104 - DNA, 22 bp, Homo sapiens
tgctgaaattagaacattgagg

SEQ ID NO: 7710105 - DNA, 20 bp, Homo sapiens
tgctgaagaatcacagatgg

SEQ ID NO: 7710106 - DNA, 22 bp, Homo sapiens
tgctgaggaggtggctgtgctt

SEQ ID NO: 7710107 - DNA, 22 bp, Homo sapiens
tgctgaggaggtggctgtgctt

SEQ ID NO: 7710108 - DNA, 19 bp, Homo sapiens
tgctgaggatgcaagatcc

SEQ ID NO: 7710109 - DNA, 19 bp, Homo sapiens
tgctgaggatgcaagatcc

SEQ ID NO: 7710110 - DNA, 19 bp, Homo sapiens
tgctgaggatgcaagatcc

SEQ ID NO: 7710111 - DNA, 19 bp, Homo sapiens
tgctgaggatgcaagatcc

SEQ ID NO: 7710112 - DNA, 22 bp, Homo sapiens
tgctgaggaggtggctgtgctt

SEQ ID NO: 7710113 - DNA, 22 bp, Homo sapiens
tgctgaggaggtggctgtgctt

SEQ ID NO: 7710114 - DNA, 22 bp, Homo sapiens
tgctgaggaggtggctgtgctt

SEQ ID NO: 7710115 - DNA, 22 bp, Homo sapiens
tgctgaggaggtggctgtgctt

SEQ ID NO: 7710116 - DNA, 22 bp, Homo sapiens
tgctgaggagggcacccggggg

SEQ ID NO: 7710117 - DNA, 22 bp, Homo sapiens
tgctgaggactaaaggagatga

SEQ ID NO: 7710118 - DNA, 22 bp, Homo sapiens
tgctgaggaataattgttcctg

SEQ ID NO: 7710119 - DNA, 22 bp, Homo sapiens
tgctgaggaatttggtttatgt

SEQ ID NO: 7710120 - DNA, 22 bp, Homo sapiens
tgctgaggaaagaggataaaag

SEQ ID NO: 7710121 - DNA, 22 bp, Homo sapiens
tgctgaggaaaaatgtgactct

SEQ ID NO: 7710122 - DNA, 22 bp, Homo sapiens
tgctgaggactaaaggagatga

SEQ ID NO: 7710123 - DNA, 22 bp, Homo sapiens
tgctgaggactaaaggagatga

SEQ ID NO: 7710124 - DNA, 22 bp, Homo sapiens
tgctgaggactaaaggagatga

SEQ ID NO: 7710125 - DNA, 22 bp, Homo sapiens
tgctgaggactaaaggagatga

SEQ ID NO: 7710126 - DNA, 22 bp, Homo sapiens
tgctgaggacacctagccttct

SEQ ID NO: 7710127 - DNA, 22 bp, Homo sapiens
tgctgaggacacctagccttct

SEQ ID NO: 7710128 - DNA, 18 bp, Homo sapiens
tgctctgtttaatgattt

SEQ ID NO: 7710129 - DNA, 22 bp, Homo sapiens
tgctcttcacagtttcagcatc

SEQ ID NO: 7710130 - DNA, 22 bp, Homo sapiens
tgctcttacattaattcagcat

SEQ ID NO: 7710131 - DNA, 22 bp, Homo sapiens
tgctcttaattccattagactt

SEQ ID NO: 7710132 - DNA, 22 bp, Homo sapiens
tgctctgtgtgtggttatttcc

SEQ ID NO: 7710133 - DNA, 22 bp, Homo sapiens
tgctctgttcagtgtatcttgt

SEQ ID NO: 7710134 - DNA, 22 bp, Homo sapiens
tgctcttcaccattacatcatg

SEQ ID NO: 7710135 - DNA, 22 bp, Homo sapiens
tgctcttcacagtttcagcatc

SEQ ID NO: 7710136 - DNA, 22 bp, Homo sapiens
tgctcttcaccattacatcatg

SEQ ID NO: 7710137 - DNA, 22 bp, Homo sapiens
tgctcttcacagtttcagcatc

SEQ ID NO: 7710138 - DNA, 22 bp, Homo sapiens
tgctcttcggggccactgcttg

SEQ ID NO: 7710139 - DNA, 22 bp, Homo sapiens
tgctcttcaccattacatcatg

SEQ ID NO: 7710140 - DNA, 22 bp, Homo sapiens
tgctcttcaccattacatcatg

SEQ ID NO: 7710141 - DNA, 23 bp, Homo sapiens
tgctcttctcagacctgtcagcc

SEQ ID NO: 7710142 - DNA, 23 bp, Homo sapiens
tgctcttctcagacctgtcagcc

SEQ ID NO: 7710143 - DNA, 23 bp, Homo sapiens
tgctcttctcagacctgtcagcc

SEQ ID NO: 7710144 - DNA, 22 bp, Homo sapiens
tgctcttcggggccactgcttg

SEQ ID NO: 7710145 - DNA, 22 bp, Homo sapiens
tgctctgtcaagaaaagatgcc

SEQ ID NO: 7710146 - DNA, 22 bp, Homo sapiens
tgctctgtattctatggcagtt

SEQ ID NO: 7710147 - DNA, 22 bp, Homo sapiens
tgctctgtaggggaaagagagc

SEQ ID NO: 7710148 - DNA, 22 bp, Homo sapiens
tgctctgtaacaaattgacatg

SEQ ID NO: 7710149 - DNA, 22 bp, Homo sapiens
tgctctgtaacaaattgacatg

SEQ ID NO: 7710150 - DNA, 23 bp, Homo sapiens
tgctctgtgaatagttggtgact

SEQ ID NO: 7710151 - DNA, 22 bp, Homo sapiens
tgctctgtgataaaggcgtatg

SEQ ID NO: 7710152 - DNA, 22 bp, Homo sapiens
tgctctgtggtccaagatggct

SEQ ID NO: 7710153 - DNA, 22 bp, Homo sapiens
tgctctggtcctccctcggcgc

SEQ ID NO: 7710154 - DNA, 22 bp, Homo sapiens
tgctctggtcctccctcggcgc

SEQ ID NO: 7710155 - DNA, 21 bp, Homo sapiens
tgctctggtagaaactctttc

SEQ ID NO: 7710156 - DNA, 21 bp, Homo sapiens
tgctctggtagaaactctttc

SEQ ID NO: 7710157 - DNA, 22 bp, Homo sapiens
tgctctggtaactcacttccat

SEQ ID NO: 7710158 - DNA, 22 bp, Homo sapiens
tgctctggtaactcacttccat

SEQ ID NO: 7710159 - DNA, 22 bp, Homo sapiens
tgctctggtaactcacttccat

SEQ ID NO: 7710160 - DNA, 22 bp, Homo sapiens
tgctctggtaactcacttccat

SEQ ID NO: 7710161 - DNA, 22 bp, Homo sapiens
tgctctggtaactcacttccat

SEQ ID NO: 7710162 - DNA, 22 bp, Homo sapiens
tgctctggtaactcacttccat

SEQ ID NO: 7710163 - DNA, 22 bp, Homo sapiens
tgctctggtaactcacttccat

SEQ ID NO: 7710164 - DNA, 22 bp, Homo sapiens
tgctctggtaactcacttccat

SEQ ID NO: 7710165 - DNA, 22 bp, Homo sapiens
tgctctggtaactcacttccat

SEQ ID NO: 7710166 - DNA, 18 bp, Homo sapiens
tgctctggtctcacttgg

SEQ ID NO: 7710167 - DNA, 21 bp, Homo sapiens
tgctctggtgttttatttaac

SEQ ID NO: 7710168 - DNA, 21 bp, Homo sapiens
tgctctggtgttttatttaac

SEQ ID NO: 7710169 - DNA, 21 bp, Homo sapiens
tgctctggtgttttatttaac

SEQ ID NO: 7710170 - DNA, 18 bp, Homo sapiens
tgctctggtctcacttgg

SEQ ID NO: 7710171 - DNA, 18 bp, Homo sapiens
tgctctggtctcacttgg

SEQ ID NO: 7710172 - DNA, 18 bp, Homo sapiens
tgctctggtctcacttgg

SEQ ID NO: 7710173 - DNA, 18 bp, Homo sapiens
tgctctggtctcacttgg

SEQ ID NO: 7710174 - DNA, 18 bp, Homo sapiens
tgctctggtctcacttgg

SEQ ID NO: 7710175 - DNA, 18 bp, Homo sapiens
tgctctggtctcacttgg

SEQ ID NO: 7710176 - DNA, 22 bp, Homo sapiens
tgctctggtcctccctcggcgc

SEQ ID NO: 7710177 - DNA, 22 bp, Homo sapiens
tgctctggtcctccctcggcgc

SEQ ID NO: 7710178 - DNA, 22 bp, Homo sapiens
tgctctgggttcttgctgttac

SEQ ID NO: 7710179 - DNA, 22 bp, Homo sapiens
tgctctgggttcttgctgttac

SEQ ID NO: 7710180 - DNA, 22 bp, Homo sapiens
tgctctgggttcttgctgttac

SEQ ID NO: 7710181 - DNA, 22 bp, Homo sapiens
tgctctgggttcttgctgttac

SEQ ID NO: 7710182 - DNA, 22 bp, Homo sapiens
tgctctgggtcctgggcctcct

SEQ ID NO: 7710183 - DNA, 22 bp, Homo sapiens
tgctctgggtcctgggcctcct

SEQ ID NO: 7710184 - DNA, 22 bp, Homo sapiens
tgctctgggtcctgggcctcct

SEQ ID NO: 7710185 - DNA, 22 bp, Homo sapiens
tgctctgggtcctgggcctcct

SEQ ID NO: 7710186 - DNA, 22 bp, Homo sapiens
tgctctgggtcctgggcctcct

SEQ ID NO: 7710187 - DNA, 22 bp, Homo sapiens
tgctctgggtcctgggcctcct

SEQ ID NO: 7710188 - DNA, 20 bp, Homo sapiens
tgctctgggggtggagagac

SEQ ID NO: 7710189 - DNA, 20 bp, Homo sapiens
tgctctgggggtggagagac

SEQ ID NO: 7710190 - DNA, 20 bp, Homo sapiens
tgctctgggggtggagagac

SEQ ID NO: 7710191 - DNA, 20 bp, Homo sapiens
tgctctgggggtggagagac

SEQ ID NO: 7710192 - DNA, 20 bp, Homo sapiens
tgctctgggggtggagagac

SEQ ID NO: 7710193 - DNA, 20 bp, Homo sapiens
tgctctgggggtggagagac

SEQ ID NO: 7710194 - DNA, 20 bp, Homo sapiens
tgctctgggggtggagagac

SEQ ID NO: 7710195 - DNA, 22 bp, Homo sapiens
tgctctgggggaagccagctgt

SEQ ID NO: 7710196 - DNA, 20 bp, Homo sapiens
tgctctgggggtggagagac

SEQ ID NO: 7710197 - DNA, 20 bp, Homo sapiens
tgctctgggggtggagagac

SEQ ID NO: 7710198 - DNA, 20 bp, Homo sapiens
tgctctgggggtggagagac

SEQ ID NO: 7710199 - DNA, 20 bp, Homo sapiens
tgctctgggggtggagagac

SEQ ID NO: 7710200 - DNA, 20 bp, Homo sapiens
tgctctgggggtggagagac

SEQ ID NO: 7710201 - DNA, 20 bp, Homo sapiens
tgctctgggggtggagagac

SEQ ID NO: 7710202 - DNA, 22 bp, Homo sapiens
tggagaaggccggccaggagtg

SEQ ID NO: 7710203 - DNA, 22 bp, Homo sapiens
tggagaaggccggccaggagtg

SEQ ID NO: 7710204 - DNA, 22 bp, Homo sapiens
tggagaaggccggccaggagtg

SEQ ID NO: 7710205 - DNA, 22 bp, Homo sapiens
tggagaaggccggccaggagtg

SEQ ID NO: 7710206 - DNA, 22 bp, Homo sapiens
tggagaaggggcagggtctcca

SEQ ID NO: 7710207 - DNA, 22 bp, Homo sapiens
tggagaaggggcagggtctcca

SEQ ID NO: 7710208 - DNA, 22 bp, Homo sapiens
tggagaaggggcagggtctcca

SEQ ID NO: 7710209 - DNA, 22 bp, Homo sapiens
tggagaaggacagcctgagaaa

SEQ ID NO: 7710210 - DNA, 22 bp, Homo sapiens
tggagaaggacagcctgagaaa

SEQ ID NO: 7710211 - DNA, 22 bp, Homo sapiens
tggagaaggacagcctgagaaa

SEQ ID NO: 7710212 - DNA, 22 bp, Homo sapiens
tggagaaggacagcctgagaaa

SEQ ID NO: 7710213 - DNA, 22 bp, Homo sapiens
tggagaagctgtaggtggactc

SEQ ID NO: 7710214 - DNA, 22 bp, Homo sapiens
tggagaaggacagcctgagaaa

SEQ ID NO: 7710215 - DNA, 22 bp, Homo sapiens
tggagaaggacagcctgagaaa

SEQ ID NO: 7710216 - DNA, 22 bp, Homo sapiens
tggagaaagctgcatatggaaa

SEQ ID NO: 7710217 - DNA, 22 bp, Homo sapiens
tggagaaagctgcatatggaaa

SEQ ID NO: 7710218 - DNA, 22 bp, Homo sapiens
tggagaaaaggttgaatccatc

SEQ ID NO: 7710219 - DNA, 22 bp, Homo sapiens
tggagaaaaggttgaatccatc

SEQ ID NO: 7710220 - DNA, 22 bp, Homo sapiens
tggagaaaaggttgaatccatc

SEQ ID NO: 7710221 - DNA, 22 bp, Homo sapiens
tggagaaaaggttgaatccatc

SEQ ID NO: 7710222 - DNA, 22 bp, Homo sapiens
tggactttttaactgataggag

SEQ ID NO: 7710223 - DNA, 19 bp, Homo sapiens
tggacttgagctgctttga

SEQ ID NO: 7710224 - DNA, 19 bp, Homo sapiens
tggacttgagctgctttga

SEQ ID NO: 7710225 - DNA, 22 bp, Homo sapiens
tggacttgcagagaagcccttc

SEQ ID NO: 7710226 - DNA, 22 bp, Homo sapiens
tggactttcacatagcaaagga

SEQ ID NO: 7710227 - DNA, 22 bp, Homo sapiens
tggagaagattggtcaccattc

SEQ ID NO: 7710228 - DNA, 22 bp, Homo sapiens
tggagaagattggtcaccattc

SEQ ID NO: 7710229 - DNA, 22 bp, Homo sapiens
tggagaaagctgcatatggaaa

SEQ ID NO: 7710230 - DNA, 22 bp, Homo sapiens
tggagaagattggtcaccattc

SEQ ID NO: 7710231 - DNA, 22 bp, Homo sapiens
tggagaagctgtaggtggactc

SEQ ID NO: 7710232 - DNA, 22 bp, Homo sapiens
tggagaagctgtaggtggactc

SEQ ID NO: 7710233 - DNA, 22 bp, Homo sapiens
tggagaagctgtaggtggactc

SEQ ID NO: 7710234 - DNA, 22 bp, Homo sapiens
tggagaagctgtaggtggactc

SEQ ID NO: 7710235 - DNA, 22 bp, Homo sapiens
tggagaagctgtaggtggactc

SEQ ID NO: 7710236 - DNA, 22 bp, Homo sapiens
tggagagaagaggcagtgtgct

SEQ ID NO: 7710237 - DNA, 22 bp, Homo sapiens
tggagagaagaggcagtgtgct

SEQ ID NO: 7710238 - DNA, 22 bp, Homo sapiens
tggagagaagaggcagtgtgct

SEQ ID NO: 7710239 - DNA, 22 bp, Homo sapiens
tggagagaagaggcagtgtgct

SEQ ID NO: 7710240 - DNA, 22 bp, Homo sapiens
tggagagaagaggcagtgtgct

SEQ ID NO: 7710241 - DNA, 22 bp, Homo sapiens
tggagagagtcgggatagtaca

SEQ ID NO: 7710242 - DNA, 22 bp, Homo sapiens
tggagagagtcgggatagtaca

SEQ ID NO: 7710243 - DNA, 22 bp, Homo sapiens
tggagagagtcgggatagtaca

SEQ ID NO: 7710244 - DNA, 22 bp, Homo sapiens
tggagagaacagtgtctgaaag

SEQ ID NO: 7710245 - DNA, 22 bp, Homo sapiens
tggagagaacagtgtctgaaag

SEQ ID NO: 7710246 - DNA, 22 bp, Homo sapiens
tggagagaacagtgtctgaaag

SEQ ID NO: 7710247 - DNA, 22 bp, Homo sapiens
tggagagaacagtgtctgaaag

SEQ ID NO: 7710248 - DNA, 22 bp, Homo sapiens
tggagagaagaggcagtgtgct

SEQ ID NO: 7710249 - DNA, 22 bp, Homo sapiens
tggagagaacagtgtctgaaag

SEQ ID NO: 7710250 - DNA, 22 bp, Homo sapiens
tggagagaagaggcagtgtgct

SEQ ID NO: 7710251 - DNA, 22 bp, Homo sapiens
tggagagaagaggcagtgtgct

SEQ ID NO: 7710252 - DNA, 22 bp, Homo sapiens
tggagagaagaggcagtgtgct

SEQ ID NO: 7710253 - DNA, 22 bp, Homo sapiens
tggagaagtcaaagtgaacagg

SEQ ID NO: 7710254 - DNA, 22 bp, Homo sapiens
tggagaatatttccaaatctaa

SEQ ID NO: 7710255 - DNA, 22 bp, Homo sapiens
tggagaagtcaaagtgaacagg

SEQ ID NO: 7710256 - DNA, 22 bp, Homo sapiens
tggagaagtcaaagtgaacagg

SEQ ID NO: 7710257 - DNA, 22 bp, Homo sapiens
tggagaagtcaaagtgaacagg

SEQ ID NO: 7710258 - DNA, 22 bp, Homo sapiens
tggagaagtcaaagtgaacagg

SEQ ID NO: 7710259 - DNA, 22 bp, Homo sapiens
tggagaagtcaaagtgaacagg

SEQ ID NO: 7710260 - DNA, 22 bp, Homo sapiens
tggagaagtcaaagtgaacagg

SEQ ID NO: 7710261 - DNA, 22 bp, Homo sapiens
tggagagaaagttgaatggagg

SEQ ID NO: 7710262 - DNA, 22 bp, Homo sapiens
tggagagaaagttgaatggagg

SEQ ID NO: 7710263 - DNA, 22 bp, Homo sapiens
tggagagaaagttgaatggagg

SEQ ID NO: 7710264 - DNA, 22 bp, Homo sapiens
tggagagaaagttgaatggagg

SEQ ID NO: 7710265 - DNA, 22 bp, Homo sapiens
tggagagaaagttgaatggagg

SEQ ID NO: 7710266 - DNA, 22 bp, Homo sapiens
tggagagcgcgacgggaggaag

SEQ ID NO: 7710267 - DNA, 22 bp, Homo sapiens
tggagagcgtgcttagcactct

SEQ ID NO: 7710268 - DNA, 22 bp, Homo sapiens
tggagagcgcgacgggaggaag

SEQ ID NO: 7710269 - DNA, 22 bp, Homo sapiens
tggagagcgcgacgggaggaag

SEQ ID NO: 7710270 - DNA, 22 bp, Homo sapiens
tggagagcgcgacgggaggaag

SEQ ID NO: 7710271 - DNA, 22 bp, Homo sapiens
tggagagcctggagtccctgat

SEQ ID NO: 7710272 - DNA, 22 bp, Homo sapiens
tggagagccttcccggcatcgc

SEQ ID NO: 7710273 - DNA, 22 bp, Homo sapiens
tggagagccttcccggcatcgc

SEQ ID NO: 7710274 - DNA, 22 bp, Homo sapiens
tggagagccttcccggcatcgc

SEQ ID NO: 7710275 - DNA, 22 bp, Homo sapiens
tggagagcgtgcttagcactct

SEQ ID NO: 7710276 - DNA, 22 bp, Homo sapiens
tggagagcgtgcttagcactct

SEQ ID NO: 7710277 - DNA, 22 bp, Homo sapiens
tggagagcgtgcttagcactct

SEQ ID NO: 7710278 - DNA, 22 bp, Homo sapiens
tggagagctatttggacctcca

SEQ ID NO: 7710279 - DNA, 22 bp, Homo sapiens
tggagagctatttggacctcca

SEQ ID NO: 7710280 - DNA, 22 bp, Homo sapiens
tggagagctcctatttgctgtc

SEQ ID NO: 7710281 - DNA, 22 bp, Homo sapiens
tggagagctggttcaaagcaga

SEQ ID NO: 7710282 - DNA, 22 bp, Homo sapiens
tggagaggaaagtgcagttttg

SEQ ID NO: 7710283 - DNA, 22 bp, Homo sapiens
tggagagctgttgaaatgcaga

SEQ ID NO: 7710284 - DNA, 22 bp, Homo sapiens
tggagagctggttcaaagcaga

SEQ ID NO: 7710285 - DNA, 22 bp, Homo sapiens
tggagagctggttcaaagcaga

SEQ ID NO: 7710286 - DNA, 22 bp, Homo sapiens
tggagaggaaagtgcagttttg

SEQ ID NO: 7710287 - DNA, 22 bp, Homo sapiens
tggagaggaaagtgcagttttg

SEQ ID NO: 7710288 - DNA, 22 bp, Homo sapiens
tggagaggaaagtgcagttttg

SEQ ID NO: 7710289 - DNA, 22 bp, Homo sapiens
tggagaggaaagtgcagttttg

SEQ ID NO: 7710290 - DNA, 19 bp, Homo sapiens
tggagaggaaatgctgctc

SEQ ID NO: 7710291 - DNA, 19 bp, Homo sapiens
tggagaggaaatgctgctc

SEQ ID NO: 7710292 - DNA, 22 bp, Homo sapiens
tggagaggaaagtgcagttttg

SEQ ID NO: 7710293 - DNA, 19 bp, Homo sapiens
tggagaggaaatgctgctc

SEQ ID NO: 7710294 - DNA, 19 bp, Homo sapiens
tggagaggaaatgctgctc

SEQ ID NO: 7710295 - DNA, 19 bp, Homo sapiens
tggagaggaaatgctgctc

SEQ ID NO: 7710296 - DNA, 19 bp, Homo sapiens
tggagaggaaatgctgctc

SEQ ID NO: 7710297 - DNA, 19 bp, Homo sapiens
tggagaggaaatgctgctc

SEQ ID NO: 7710298 - DNA, 19 bp, Homo sapiens
tggagaggaaatgctgctc

SEQ ID NO: 7710299 - DNA, 22 bp, Homo sapiens
tggagagcaagtcgcagacatg

SEQ ID NO: 7710300 - DNA, 22 bp, Homo sapiens
tggagagcaagtcgcagacatg

SEQ ID NO: 7710301 - DNA, 22 bp, Homo sapiens
tggagagcaagtcgcagacatg

SEQ ID NO: 7710302 - DNA, 22 bp, Homo sapiens
tggagagcaagtcgcagacatg

SEQ ID NO: 7710303 - DNA, 22 bp, Homo sapiens
tggagagatgtctgttcaaggt

SEQ ID NO: 7710304 - DNA, 22 bp, Homo sapiens
tggagagatgtctgttcaaggt

SEQ ID NO: 7710305 - DNA, 22 bp, Homo sapiens
tggagagatgtctgttcaaggt

SEQ ID NO: 7710306 - DNA, 22 bp, Homo sapiens
tggagagcaagtcgcagacatg

SEQ ID NO: 7710307 - DNA, 22 bp, Homo sapiens
tggagagcaagtcgcagacatg

SEQ ID NO: 7710308 - DNA, 22 bp, Homo sapiens
tggagagcaagtcgcagacatg

SEQ ID NO: 7710309 - DNA, 22 bp, Homo sapiens
tggagagcaagtcgcagacatg

SEQ ID NO: 7710310 - DNA, 22 bp, Homo sapiens
tggagagcaatgaggggcaggc

SEQ ID NO: 7710311 - DNA, 22 bp, Homo sapiens
tggagagcaatgaggggcaggc

SEQ ID NO: 7710312 - DNA, 22 bp, Homo sapiens
tggagagcaatgaggggcaggc

SEQ ID NO: 7710313 - DNA, 22 bp, Homo sapiens
tggagagcaatgaggggcaggc

SEQ ID NO: 7710314 - DNA, 22 bp, Homo sapiens
tggagagcacagttcctgcttc

SEQ ID NO: 7710315 - DNA, 22 bp, Homo sapiens
tggagagcaatgaggggcaggc

SEQ ID NO: 7710316 - DNA, 22 bp, Homo sapiens
tggagagcacagttcctgcttc

SEQ ID NO: 7710317 - DNA, 22 bp, Homo sapiens
tggagagcactgtctcattttg

SEQ ID NO: 7710318 - DNA, 22 bp, Homo sapiens
tggagagcactgtctcattttg

SEQ ID NO: 7710319 - DNA, 18 bp, Homo sapiens
tggagagcagcagtgggg

SEQ ID NO: 7710320 - DNA, 21 bp, Homo sapiens
tggagagcccttgcctgagtc

SEQ ID NO: 7710321 - DNA, 21 bp, Homo sapiens
tggagagcccttgcctgagtc

SEQ ID NO: 7710322 - DNA, 21 bp, Homo sapiens
tggagagcccttgcctgagtc

SEQ ID NO: 7710323 - DNA, 22 bp, Homo sapiens
tggagagcccgagacatcctgt

SEQ ID NO: 7710324 - DNA, 22 bp, Homo sapiens
tggagagcccgagacatcctgt

SEQ ID NO: 7710325 - DNA, 20 bp, Homo sapiens
tggagagcctctggactgtg

SEQ ID NO: 7710326 - DNA, 20 bp, Homo sapiens
tggagagcctctggactgtg

SEQ ID NO: 7710327 - DNA, 20 bp, Homo sapiens
tggagagcctctggactgtg

SEQ ID NO: 7710328 - DNA, 20 bp, Homo sapiens
tggagagcctctggactgtg

SEQ ID NO: 7710329 - DNA, 21 bp, Homo sapiens
tggagagcccttgcctgagtc

SEQ ID NO: 7710330 - DNA, 20 bp, Homo sapiens
tggagagcctctggactgtg

SEQ ID NO: 7710331 - DNA, 18 bp, Homo sapiens
tggagagcagcagtgggg

SEQ ID NO: 7710332 - DNA, 18 bp, Homo sapiens
tggagagcagcagtgggg

SEQ ID NO: 7710333 - DNA, 18 bp, Homo sapiens
tggagagcagcagtgggg

SEQ ID NO: 7710334 - DNA, 22 bp, Homo sapiens
tggagagcagggctggagttca

SEQ ID NO: 7710335 - DNA, 18 bp, Homo sapiens
tggagagcagcagtgggg

SEQ ID NO: 7710336 - DNA, 22 bp, Homo sapiens
tggagagcagggctggagttca

SEQ ID NO: 7710337 - DNA, 22 bp, Homo sapiens
tggagagcaggggatgcgggcg

SEQ ID NO: 7710338 - DNA, 22 bp, Homo sapiens
tggagagcaggggatgcgggcg

SEQ ID NO: 7710339 - DNA, 22 bp, Homo sapiens
tggagagcaggggatgcgggcg

SEQ ID NO: 7710340 - DNA, 22 bp, Homo sapiens
tggagagcagggctggagttca

SEQ ID NO: 7710341 - DNA, 22 bp, Homo sapiens
tggagagcagggctggagttca

SEQ ID NO: 7710342 - DNA, 22 bp, Homo sapiens
tggagcagcattcatccagcag

SEQ ID NO: 7710343 - DNA, 22 bp, Homo sapiens
tggagcagcattcatccagcag

SEQ ID NO: 7710344 - DNA, 22 bp, Homo sapiens
tggagcagcattcatccagcag

SEQ ID NO: 7710345 - DNA, 22 bp, Homo sapiens
tggagcagcattcatccagcag

SEQ ID NO: 7710346 - DNA, 22 bp, Homo sapiens
tggagcagcattcatccagcag

SEQ ID NO: 7710347 - DNA, 22 bp, Homo sapiens
tggagcagcattcatccagcag

SEQ ID NO: 7710348 - DNA, 22 bp, Homo sapiens
tggagcagcatcactttgagct

SEQ ID NO: 7710349 - DNA, 22 bp, Homo sapiens
tggagcagcattcatccagcag

SEQ ID NO: 7710350 - DNA, 22 bp, Homo sapiens
tggagcagccatgatgacagag

SEQ ID NO: 7710351 - DNA, 22 bp, Homo sapiens
tggagcagcattcatccagcag

SEQ ID NO: 7710352 - DNA, 22 bp, Homo sapiens
tggagcagcattcatccagcag

SEQ ID NO: 7710353 - DNA, 22 bp, Homo sapiens
tggagcagcattcatccagcag

SEQ ID NO: 7710354 - DNA, 22 bp, Homo sapiens
tggagcagcacaagaaagggga

SEQ ID NO: 7710355 - DNA, 22 bp, Homo sapiens
tggagcagcacaagaaagggga

SEQ ID NO: 7710356 - DNA, 22 bp, Homo sapiens
tggagcagcacaagaaagggga

SEQ ID NO: 7710357 - DNA, 22 bp, Homo sapiens
tggagcagcacaagaaagggga

SEQ ID NO: 7710358 - DNA, 22 bp, Homo sapiens
tggagcagcacaagaaagggga

SEQ ID NO: 7710359 - DNA, 22 bp, Homo sapiens
tggagcagcacaagaaagggga

SEQ ID NO: 7710360 - DNA, 22 bp, Homo sapiens
tggagcagcacaagaaagggga

SEQ ID NO: 7710361 - DNA, 22 bp, Homo sapiens
tggagcagcatcactttgagct

SEQ ID NO: 7710362 - DNA, 22 bp, Homo sapiens
tggagcagcatcactttgagct

SEQ ID NO: 7710363 - DNA, 22 bp, Homo sapiens
tggagcagcatcactttgagct

SEQ ID NO: 7710364 - DNA, 22 bp, Homo sapiens
tggagcagcatcactttgagct

SEQ ID NO: 7710365 - DNA, 22 bp, Homo sapiens
tggagcagcacaagaaagggga

SEQ ID NO: 7710366 - DNA, 22 bp, Homo sapiens
tggagcagcatcactttgagct

SEQ ID NO: 7710367 - DNA, 22 bp, Homo sapiens
tggagcagccatgatgacagag

SEQ ID NO: 7710368 - DNA, 22 bp, Homo sapiens
tggagcagccatgatgacagag

SEQ ID NO: 7710369 - DNA, 22 bp, Homo sapiens
tggagcagccatgatgacagag

SEQ ID NO: 7710370 - DNA, 22 bp, Homo sapiens
tggagcagccatgatgacagag

SEQ ID NO: 7710371 - DNA, 22 bp, Homo sapiens
tggagcagccatgatgacagag

SEQ ID NO: 7710372 - DNA, 22 bp, Homo sapiens
tggagcagccatgatgacagag

SEQ ID NO: 7710373 - DNA, 22 bp, Homo sapiens
tggagcagccatgatgacagag

SEQ ID NO: 7710374 - DNA, 22 bp, Homo sapiens
tggagcagccatgatgacagag

SEQ ID NO: 7710375 - DNA, 22 bp, Homo sapiens
tggagcagccatgatgacagag

SEQ ID NO: 7710376 - DNA, 22 bp, Homo sapiens
tggagcagccatgatgacagag

SEQ ID NO: 7710377 - DNA, 22 bp, Homo sapiens
tggagcagccttttctaagcaa

SEQ ID NO: 7710378 - DNA, 22 bp, Homo sapiens
tggagcagccttttctaagcaa

SEQ ID NO: 7710379 - DNA, 22 bp, Homo sapiens
tggagcagccttttctaagcaa

SEQ ID NO: 7710380 - DNA, 22 bp, Homo sapiens
tggagcagccatgatgacagag

SEQ ID NO: 7710381 - DNA, 22 bp, Homo sapiens
tggagcagctaagcctctgaga

SEQ ID NO: 7710382 - DNA, 22 bp, Homo sapiens
tggagcagctaagcctctgaga

SEQ ID NO: 7710383 - DNA, 22 bp, Homo sapiens
tggagcagccttttctaagcaa

SEQ ID NO: 7710384 - DNA, 22 bp, Homo sapiens
tggagcagccttttctaagcaa

SEQ ID NO: 7710385 - DNA, 22 bp, Homo sapiens
tggagcagccttttctaagcaa

SEQ ID NO: 7710386 - DNA, 22 bp, Homo sapiens
tggagcagagttcagcggggag

SEQ ID NO: 7710387 - DNA, 22 bp, Homo sapiens
tggagcagagttcagcggggag

SEQ ID NO: 7710388 - DNA, 22 bp, Homo sapiens
tggagcagagttcagcggggag

SEQ ID NO: 7710389 - DNA, 22 bp, Homo sapiens
tggagcagagttcagcggggag

SEQ ID NO: 7710390 - DNA, 22 bp, Homo sapiens
tggagcagagttcagcggggag

SEQ ID NO: 7710391 - DNA, 22 bp, Homo sapiens
tggagcagagttcagcggggag

SEQ ID NO: 7710392 - DNA, 22 bp, Homo sapiens
tggagcagagttcagcggggag

SEQ ID NO: 7710393 - DNA, 22 bp, Homo sapiens
tggagcagcacaagaaagggga

SEQ ID NO: 7710394 - DNA, 22 bp, Homo sapiens
tggagcagagttcagcggggag

SEQ ID NO: 7710395 - DNA, 22 bp, Homo sapiens
tggagcagcacaagaaagggga

SEQ ID NO: 7710396 - DNA, 22 bp, Homo sapiens
tggagcagcacaagaaagggga

SEQ ID NO: 7710397 - DNA, 22 bp, Homo sapiens
tggagcagaggctgaggttggg

SEQ ID NO: 7710398 - DNA, 22 bp, Homo sapiens
tggagcagaggctgaggttggg

SEQ ID NO: 7710399 - DNA, 22 bp, Homo sapiens
tggagcagaggctgaggttggg

SEQ ID NO: 7710400 - DNA, 22 bp, Homo sapiens
tggagcagaggctgaggttggg

SEQ ID NO: 7710401 - DNA, 22 bp, Homo sapiens
tggagcagaggaagaaggcttt

SEQ ID NO: 7710402 - DNA, 22 bp, Homo sapiens
tggagcagaggctgaggttggg

SEQ ID NO: 7710403 - DNA, 22 bp, Homo sapiens
tggagcagagttcagcggggag

SEQ ID NO: 7710404 - DNA, 22 bp, Homo sapiens
tggagcagaggctgaggttggg

SEQ ID NO: 7710405 - DNA, 22 bp, Homo sapiens
tggagcagaggctgaggttggg

SEQ ID NO: 7710406 - DNA, 22 bp, Homo sapiens
tggagcagaggctgaggttggg

SEQ ID NO: 7710407 - DNA, 22 bp, Homo sapiens
tggagcagagatggtggccttc

SEQ ID NO: 7710408 - DNA, 22 bp, Homo sapiens
tggagcagagatggtggccttc

SEQ ID NO: 7710409 - DNA, 22 bp, Homo sapiens
tggagcagaggaagaaggcttt

SEQ ID NO: 7710410 - DNA, 22 bp, Homo sapiens
tggagcagagatggtggccttc

SEQ ID NO: 7710411 - DNA, 22 bp, Homo sapiens
tggagcagagatggtggccttc

SEQ ID NO: 7710412 - DNA, 22 bp, Homo sapiens
tggagcagagatggtggccttc

SEQ ID NO: 7710413 - DNA, 22 bp, Homo sapiens
tggagcagagatggtggccttc

SEQ ID NO: 7710414 - DNA, 22 bp, Homo sapiens
tggagcagagatggtggccttc

SEQ ID NO: 7710415 - DNA, 22 bp, Homo sapiens
tggagcagagatggtggccttc

SEQ ID NO: 7710416 - DNA, 22 bp, Homo sapiens
tggagcagaggaagaaggcttt

SEQ ID NO: 7710417 - DNA, 22 bp, Homo sapiens
tggagcagaggaagaaggcttt

SEQ ID NO: 7710418 - DNA, 22 bp, Homo sapiens
tggagcagaggaagaaggcttt

SEQ ID NO: 7710419 - DNA, 22 bp, Homo sapiens
tggagcagaggaagaaggcttt

SEQ ID NO: 7710420 - DNA, 22 bp, Homo sapiens
tggagcagaggaagaaggcttt

SEQ ID NO: 7710421 - DNA, 22 bp, Homo sapiens
tggagcagaggaagaaggcttt

SEQ ID NO: 7710422 - DNA, 22 bp, Homo sapiens
tggagcagaggaagaaggcttt

SEQ ID NO: 7710423 - DNA, 22 bp, Homo sapiens
tggagcagaggaagaaggcttt

SEQ ID NO: 7710424 - DNA, 22 bp, Homo sapiens
tggagcagaggaagaaggcttt

SEQ ID NO: 7710425 - DNA, 22 bp, Homo sapiens
tggagcagaggctgaggttggg

SEQ ID NO: 7710426 - DNA, 22 bp, Homo sapiens
tggagcagagatgggagcccaa

SEQ ID NO: 7710427 - DNA, 22 bp, Homo sapiens
tggagcagagatgggagcccaa

SEQ ID NO: 7710428 - DNA, 22 bp, Homo sapiens
tggagcagagatgggagcccaa

SEQ ID NO: 7710429 - DNA, 22 bp, Homo sapiens
tggagcagagatgggagcccaa

SEQ ID NO: 7710430 - DNA, 22 bp, Homo sapiens
tggagcagagatgggagcccaa

SEQ ID NO: 7710431 - DNA, 22 bp, Homo sapiens
tggagcagagatgggagcccaa

SEQ ID NO: 7710432 - DNA, 22 bp, Homo sapiens
tggagcagagatgggagcccaa

SEQ ID NO: 7710433 - DNA, 22 bp, Homo sapiens
tggagcagagatggtggccttc

SEQ ID NO: 7710434 - DNA, 22 bp, Homo sapiens
tggagcagaaatttgaagccat

SEQ ID NO: 7710435 - DNA, 22 bp, Homo sapiens
tggagcagaaatttgaagccat

SEQ ID NO: 7710436 - DNA, 22 bp, Homo sapiens
tggagcagaaatttgaagccat

SEQ ID NO: 7710437 - DNA, 22 bp, Homo sapiens
tggagcagaaatttgaagccat

SEQ ID NO: 7710438 - DNA, 22 bp, Homo sapiens
tggagcagagatgggagcccaa

SEQ ID NO: 7710439 - DNA, 22 bp, Homo sapiens
tggagcagaaatttgaagccat

SEQ ID NO: 7710440 - DNA, 22 bp, Homo sapiens
tggagcagaaatttgaagccat

SEQ ID NO: 7710441 - DNA, 22 bp, Homo sapiens
tggagcagaaatttgaagccat

SEQ ID NO: 7710442 - DNA, 22 bp, Homo sapiens
tggagcagaaatggcctcttgt

SEQ ID NO: 7710443 - DNA, 22 bp, Homo sapiens
tggagcagaaatggcctcttgt

SEQ ID NO: 7710444 - DNA, 22 bp, Homo sapiens
tggagagttctgtagatatcta

SEQ ID NO: 7710445 - DNA, 22 bp, Homo sapiens
tggagagttctgtagatatcta

SEQ ID NO: 7710446 - DNA, 22 bp, Homo sapiens
tggagagtgtagacttcagagt

SEQ ID NO: 7710447 - DNA, 22 bp, Homo sapiens
tggagagtgtagacttcagagt

SEQ ID NO: 7710448 - DNA, 22 bp, Homo sapiens
tggagagtgtagacttcagagt

SEQ ID NO: 7710449 - DNA, 22 bp, Homo sapiens
tggagagtgtagacttcagagt

SEQ ID NO: 7710450 - DNA, 22 bp, Homo sapiens
tggagagtggtttgggggacat

SEQ ID NO: 7710451 - DNA, 22 bp, Homo sapiens
tggagagtggtttgggggacat

SEQ ID NO: 7710452 - DNA, 22 bp, Homo sapiens
tggagagtggatatgggagcaa

SEQ ID NO: 7710453 - DNA, 22 bp, Homo sapiens
tggagagtggatatgggagcaa

SEQ ID NO: 7710454 - DNA, 22 bp, Homo sapiens
tggagagtggatatgggagcaa

SEQ ID NO: 7710455 - DNA, 22 bp, Homo sapiens
tggagagtctctgagccagggc

SEQ ID NO: 7710456 - DNA, 22 bp, Homo sapiens
tggagagtctctgagccagggc

SEQ ID NO: 7710457 - DNA, 22 bp, Homo sapiens
tggagagtctctgagccagggc

SEQ ID NO: 7710458 - DNA, 22 bp, Homo sapiens
tggagagtctctgagccagggc

SEQ ID NO: 7710459 - DNA, 22 bp, Homo sapiens
tggagagtctctgagccagggc

SEQ ID NO: 7710460 - DNA, 22 bp, Homo sapiens
tggagagtggatatgggagcaa

SEQ ID NO: 7710461 - DNA, 22 bp, Homo sapiens
tggagagtggatatgggagcaa

SEQ ID NO: 7710462 - DNA, 21 bp, Homo sapiens
tggagagtgatttcagtgtgg

SEQ ID NO: 7710463 - DNA, 21 bp, Homo sapiens
tggagagtgatttcagtgtgg

SEQ ID NO: 7710464 - DNA, 22 bp, Homo sapiens
tggagagtctctgagccagggc

SEQ ID NO: 7710465 - DNA, 22 bp, Homo sapiens
tggagagtctctgagccagggc

SEQ ID NO: 7710466 - DNA, 22 bp, Homo sapiens
tggagaggtttaaacaaaagtt

SEQ ID NO: 7710467 - DNA, 22 bp, Homo sapiens
tggagaggtttaaacaaaagtt

SEQ ID NO: 7710468 - DNA, 22 bp, Homo sapiens
tggagaggtttaaacaaaagtt

SEQ ID NO: 7710469 - DNA, 22 bp, Homo sapiens
tggagaggttgaataacttgtc

SEQ ID NO: 7710470 - DNA, 22 bp, Homo sapiens
tggagaggtttaaacaaaagtt

SEQ ID NO: 7710471 - DNA, 22 bp, Homo sapiens
tggagagtctcaaggcaggaaa

SEQ ID NO: 7710472 - DNA, 22 bp, Homo sapiens
tggagagtaatttctgaagacc

SEQ ID NO: 7710473 - DNA, 22 bp, Homo sapiens
tggagagtctcaaggcaggaaa

SEQ ID NO: 7710474 - DNA, 22 bp, Homo sapiens
tggagagtctcaaggcaggaaa

SEQ ID NO: 7710475 - DNA, 22 bp, Homo sapiens
tggagagtaaatggcagaatca

SEQ ID NO: 7710476 - DNA, 22 bp, Homo sapiens
tggagaggtttaaacaaaagtt

SEQ ID NO: 7710477 - DNA, 22 bp, Homo sapiens
tggagagtaaatggcagaatca

SEQ ID NO: 7710478 - DNA, 22 bp, Homo sapiens
tggagagtaatttctgaagacc

SEQ ID NO: 7710479 - DNA, 22 bp, Homo sapiens
tggagagtaatttctgaagacc

SEQ ID NO: 7710480 - DNA, 22 bp, Homo sapiens
tggagagtaaatggcagaatca

SEQ ID NO: 7710481 - DNA, 22 bp, Homo sapiens
tggagaggagcaccatggccat

SEQ ID NO: 7710482 - DNA, 22 bp, Homo sapiens
tggagaggagcaccatggccat

SEQ ID NO: 7710483 - DNA, 22 bp, Homo sapiens
tggagaggttgaataacttgtc

SEQ ID NO: 7710484 - DNA, 22 bp, Homo sapiens
tggagaggttgaataacttgtc

SEQ ID NO: 7710485 - DNA, 22 bp, Homo sapiens
tggagaggttgaataacttgtc

SEQ ID NO: 7710486 - DNA, 22 bp, Homo sapiens
tggagaggagcaccatggccat

SEQ ID NO: 7710487 - DNA, 22 bp, Homo sapiens
tggagaggagcaccatggccat

SEQ ID NO: 7710488 - DNA, 22 bp, Homo sapiens
tggagaggagcaccatggccat

SEQ ID NO: 7710489 - DNA, 22 bp, Homo sapiens
tggagaggagcaccatggccat

SEQ ID NO: 7710490 - DNA, 19 bp, Homo sapiens
tggagaggaaatgctgctc

SEQ ID NO: 7710491 - DNA, 19 bp, Homo sapiens
tggagaggaaatgctgctc

SEQ ID NO: 7710492 - DNA, 19 bp, Homo sapiens
tggagaggaaatgctgctc

SEQ ID NO: 7710493 - DNA, 22 bp, Homo sapiens
tggagaggagcaccatggccat

SEQ ID NO: 7710494 - DNA, 22 bp, Homo sapiens
tggagaggagcaccatggccat

SEQ ID NO: 7710495 - DNA, 22 bp, Homo sapiens
tggagaggagcaccatggccat

SEQ ID NO: 7710496 - DNA, 22 bp, Homo sapiens
tggagaggagcaccatggccat

SEQ ID NO: 7710497 - DNA, 22 bp, Homo sapiens
tggagcaggaaacatctagagg

SEQ ID NO: 7710498 - DNA, 22 bp, Homo sapiens
tggagcaggaaacatctagagg

SEQ ID NO: 7710499 - DNA, 22 bp, Homo sapiens
tggagcaggaaacatctagagg

SEQ ID NO: 7710500 - DNA, 22 bp, Homo sapiens
tggagcaggaaacatctagagg

SEQ ID NO: 7710501 - DNA, 22 bp, Homo sapiens
tggagcaggaaacatctagagg

SEQ ID NO: 7710502 - DNA, 18 bp, Homo sapiens
tggagcaggaagcctggc

SEQ ID NO: 7710503 - DNA, 18 bp, Homo sapiens
tggagcaggaagcctggc

SEQ ID NO: 7710504 - DNA, 18 bp, Homo sapiens
tggagcaggaagcctggc

SEQ ID NO: 7710505 - DNA, 18 bp, Homo sapiens
tggagcaggaagcctggc

SEQ ID NO: 7710506 - DNA, 18 bp, Homo sapiens
tggagcaggaagcctggc

SEQ ID NO: 7710507 - DNA, 18 bp, Homo sapiens
tggagcaggaagcctggc

SEQ ID NO: 7710508 - DNA, 18 bp, Homo sapiens
tggagcaggaagcctggc

SEQ ID NO: 7710509 - DNA, 18 bp, Homo sapiens
tggagcaggaagcctggc

SEQ ID NO: 7710510 - DNA, 18 bp, Homo sapiens
tggagcaggaagcctggc

SEQ ID NO: 7710511 - DNA, 22 bp, Homo sapiens
tggagcaggaagtctatggctg

SEQ ID NO: 7710512 - DNA, 22 bp, Homo sapiens
tggagcaggaagtctatggctg

SEQ ID NO: 7710513 - DNA, 22 bp, Homo sapiens
tggagcaggaagtctatggctg

SEQ ID NO: 7710514 - DNA, 22 bp, Homo sapiens
tggagcaggaagtctatggctg

SEQ ID NO: 7710515 - DNA, 22 bp, Homo sapiens
tggagcaggaagtctatggctg

SEQ ID NO: 7710516 - DNA, 22 bp, Homo sapiens
tggagcaggaagtctatggctg

SEQ ID NO: 7710517 - DNA, 22 bp, Homo sapiens
tggagcagctgaacagagttga

SEQ ID NO: 7710518 - DNA, 22 bp, Homo sapiens
tggagcagctgaacagagttga

SEQ ID NO: 7710519 - DNA, 22 bp, Homo sapiens
tggagcagctgaacagagttga

SEQ ID NO: 7710520 - DNA, 22 bp, Homo sapiens
tggagcagctgaacagagttga

SEQ ID NO: 7710521 - DNA, 22 bp, Homo sapiens
tggagcagctgaacagagttga

SEQ ID NO: 7710522 - DNA, 22 bp, Homo sapiens
tggagcagctgaacagagttga

SEQ ID NO: 7710523 - DNA, 22 bp, Homo sapiens
tggagcagctgaacagagttga

SEQ ID NO: 7710524 - DNA, 22 bp, Homo sapiens
tggagcagctctagcgggcgcc

SEQ ID NO: 7710525 - DNA, 22 bp, Homo sapiens
tggagcagctctagcgggcgcc

SEQ ID NO: 7710526 - DNA, 22 bp, Homo sapiens
tggagcagctctagcgggcgcc

SEQ ID NO: 7710527 - DNA, 22 bp, Homo sapiens
tggagcagctctagcgggcgcc

SEQ ID NO: 7710528 - DNA, 22 bp, Homo sapiens
tggagcagctctagcgggcgcc

SEQ ID NO: 7710529 - DNA, 22 bp, Homo sapiens
tggagcagctctagcgggcgcc

SEQ ID NO: 7710530 - DNA, 22 bp, Homo sapiens
tggagcagctctagcgggcgcc

SEQ ID NO: 7710531 - DNA, 22 bp, Homo sapiens
tggagcagctctagcgggcgcc

SEQ ID NO: 7710532 - DNA, 22 bp, Homo sapiens
tggagcagctaagcctctgaga

SEQ ID NO: 7710533 - DNA, 22 bp, Homo sapiens
tggagcagctaagcctctgaga

SEQ ID NO: 7710534 - DNA, 22 bp, Homo sapiens
tggagcagctaagcctctgaga

SEQ ID NO: 7710535 - DNA, 22 bp, Homo sapiens
tggagcagctaagcctctgaga

SEQ ID NO: 7710536 - DNA, 22 bp, Homo sapiens
tggagcaggtgccaggtgtgtg

SEQ ID NO: 7710537 - DNA, 22 bp, Homo sapiens
tggagcaggtgccaggtgtgtg

SEQ ID NO: 7710538 - DNA, 22 bp, Homo sapiens
tggagcaggtgccaggtgtgtg

SEQ ID NO: 7710539 - DNA, 22 bp, Homo sapiens
tggagcaggtgccaggtgtgtg

SEQ ID NO: 7710540 - DNA, 22 bp, Homo sapiens
tggagcaggtgccaggtgtgtg

SEQ ID NO: 7710541 - DNA, 22 bp, Homo sapiens
tggagcaggtgctcagggtaat

SEQ ID NO: 7710542 - DNA, 22 bp, Homo sapiens
tggagcaggtgctcagggtaat

SEQ ID NO: 7710543 - DNA, 22 bp, Homo sapiens
tggagcaggtgctcagggtaat

SEQ ID NO: 7710544 - DNA, 22 bp, Homo sapiens
tggagcaggtgctcagggtaat

SEQ ID NO: 7710545 - DNA, 22 bp, Homo sapiens
tggagcaggtgccaggtgtgtg

SEQ ID NO: 7710546 - DNA, 22 bp, Homo sapiens
tggagcaggtgctcagggtaat

SEQ ID NO: 7710547 - DNA, 22 bp, Homo sapiens
tggagcaggtgccaggtgtgtg

SEQ ID NO: 7710548 - DNA, 22 bp, Homo sapiens
tggagcaggtgccaggtgtgtg

SEQ ID NO: 7710549 - DNA, 22 bp, Homo sapiens
tggagcaggtgccaggtgtgtg

SEQ ID NO: 7710550 - DNA, 22 bp, Homo sapiens
tggagcaggtgccaggtgtgtg

SEQ ID NO: 7710551 - DNA, 22 bp, Homo sapiens
tggagcaggtgccaggtgtgtg

SEQ ID NO: 7710552 - DNA, 22 bp, Homo sapiens
tggagcaggtcggcaccatttg

SEQ ID NO: 7710553 - DNA, 22 bp, Homo sapiens
tggagcaggtcggcaccatttg

SEQ ID NO: 7710554 - DNA, 22 bp, Homo sapiens
tggagcaggaagtctatggctg

SEQ ID NO: 7710555 - DNA, 22 bp, Homo sapiens
tggagcaggaagtctatggctg

SEQ ID NO: 7710556 - DNA, 22 bp, Homo sapiens
tggagcaggaagtctatggctg

SEQ ID NO: 7710557 - DNA, 22 bp, Homo sapiens
tggagcaggacggggagtggta

SEQ ID NO: 7710558 - DNA, 22 bp, Homo sapiens
tggagcaggaagtctatggctg

SEQ ID NO: 7710559 - DNA, 22 bp, Homo sapiens
tggagcaggacggggagtggta

SEQ ID NO: 7710560 - DNA, 22 bp, Homo sapiens
tggagcaggacggggagtggta

SEQ ID NO: 7710561 - DNA, 18 bp, Homo sapiens
tggagcaggtaggcatga

SEQ ID NO: 7710562 - DNA, 22 bp, Homo sapiens
tggagcaggtcggcaccatttg

SEQ ID NO: 7710563 - DNA, 22 bp, Homo sapiens
tggagcaggtcggcaccatttg

SEQ ID NO: 7710564 - DNA, 22 bp, Homo sapiens
tggagcaggtcggcaccatttg

SEQ ID NO: 7710565 - DNA, 18 bp, Homo sapiens
tggagcaggtaggcatga

SEQ ID NO: 7710566 - DNA, 22 bp, Homo sapiens
tggagcaggacggggagtggta

SEQ ID NO: 7710567 - DNA, 22 bp, Homo sapiens
tggagcaggacggggagtggta

SEQ ID NO: 7710568 - DNA, 22 bp, Homo sapiens
tggagcaggacggggagtggta

SEQ ID NO: 7710569 - DNA, 22 bp, Homo sapiens
tggagcaggacggggagtggta

SEQ ID NO: 7710570 - DNA, 22 bp, Homo sapiens
tggagcaggtgggatgtcgtga

SEQ ID NO: 7710571 - DNA, 22 bp, Homo sapiens
tggagcaggtgggatgtcgtga

SEQ ID NO: 7710572 - DNA, 22 bp, Homo sapiens
tggagcaggtgggatgtcgtga

SEQ ID NO: 7710573 - DNA, 22 bp, Homo sapiens
tggagcaggtgggatgtcgtga

SEQ ID NO: 7710574 - DNA, 22 bp, Homo sapiens
tggagcaggtgggatgtcgtga

SEQ ID NO: 7710575 - DNA, 22 bp, Homo sapiens
tggagcagtggtcctggagatg

SEQ ID NO: 7710576 - DNA, 22 bp, Homo sapiens
tggagcagtggtcctggagatg

SEQ ID NO: 7710577 - DNA, 22 bp, Homo sapiens
tggagcagtggtcctggagatg

SEQ ID NO: 7710578 - DNA, 22 bp, Homo sapiens
tggagcagtggtcctggagatg

SEQ ID NO: 7710579 - DNA, 22 bp, Homo sapiens
tggagcagtggtcctggagatg

SEQ ID NO: 7710580 - DNA, 22 bp, Homo sapiens
tggagcaggtgctcagggtaat

SEQ ID NO: 7710581 - DNA, 22 bp, Homo sapiens
tggagcaggtgctcagggtaat

SEQ ID NO: 7710582 - DNA, 22 bp, Homo sapiens
tggagcaggtgctcagggtaat

SEQ ID NO: 7710583 - DNA, 22 bp, Homo sapiens
tggagcaggtgctcagggtaat

SEQ ID NO: 7710584 - DNA, 22 bp, Homo sapiens
tggagcaggtgctcagggtaat

SEQ ID NO: 7710585 - DNA, 22 bp, Homo sapiens
tggagcaggtgctcagggtaat

SEQ ID NO: 7710586 - DNA, 22 bp, Homo sapiens
tggagcaggtgctcagggtaat

SEQ ID NO: 7710587 - DNA, 22 bp, Homo sapiens
tggagccaaaaagggaaggaga

SEQ ID NO: 7710588 - DNA, 22 bp, Homo sapiens
tggagccaaaaagggaaggaga

SEQ ID NO: 7710589 - DNA, 23 bp, Homo sapiens
tggagccaaacatcacatgcctg

SEQ ID NO: 7710590 - DNA, 22 bp, Homo sapiens
tggagccaatgaacatttgctg

SEQ ID NO: 7710591 - DNA, 20 bp, Homo sapiens
tggagccaaggtgtgtctgg

SEQ ID NO: 7710592 - DNA, 22 bp, Homo sapiens
tggagccaaaaagggaaggaga

SEQ ID NO: 7710593 - DNA, 22 bp, Homo sapiens
tggagccaaaaagggaaggaga

SEQ ID NO: 7710594 - DNA, 22 bp, Homo sapiens
tggagccaaaaagggaaggaga

SEQ ID NO: 7710595 - DNA, 22 bp, Homo sapiens
tggagcattcaggtttcccttt

SEQ ID NO: 7710596 - DNA, 22 bp, Homo sapiens
tggagcattcaggtttcccttt

SEQ ID NO: 7710597 - DNA, 22 bp, Homo sapiens
tggagcatgagagtctttagct

SEQ ID NO: 7710598 - DNA, 22 bp, Homo sapiens
tggagcatgagagtctttagct

SEQ ID NO: 7710599 - DNA, 22 bp, Homo sapiens
tggagcagtggtcctggagatg

SEQ ID NO: 7710600 - DNA, 22 bp, Homo sapiens
tggagcagtggtcctggagatg

SEQ ID NO: 7710601 - DNA, 22 bp, Homo sapiens
tggagcagtggtcctggagatg

SEQ ID NO: 7710602 - DNA, 22 bp, Homo sapiens
tggagcagtggtcctggagatg

SEQ ID NO: 7710603 - DNA, 22 bp, Homo sapiens
tggagccagagcgcagcctggg

SEQ ID NO: 7710604 - DNA, 22 bp, Homo sapiens
tggagccagagcgcagcctggg

SEQ ID NO: 7710605 - DNA, 22 bp, Homo sapiens
tggagccagagcgcagcctggg

SEQ ID NO: 7710606 - DNA, 22 bp, Homo sapiens
tggagccaccttcttatttgtc

SEQ ID NO: 7710607 - DNA, 20 bp, Homo sapiens
tggagccacagtcaggttcc

SEQ ID NO: 7710608 - DNA, 22 bp, Homo sapiens
tggagccactcactatctgagt

SEQ ID NO: 7710609 - DNA, 22 bp, Homo sapiens
tggagccagcccaggcccctct

SEQ ID NO: 7710610 - DNA, 22 bp, Homo sapiens
tggagccagcccaggcccctct

SEQ ID NO: 7710611 - DNA, 22 bp, Homo sapiens
tggagccagcaggactcagagg

SEQ ID NO: 7710612 - DNA, 22 bp, Homo sapiens
tggagccagcaggactcagagg

SEQ ID NO: 7710613 - DNA, 22 bp, Homo sapiens
tggagccaggctggccctgcca

SEQ ID NO: 7710614 - DNA, 22 bp, Homo sapiens
tggagccaggagcctgggagtc

SEQ ID NO: 7710615 - DNA, 22 bp, Homo sapiens
tggagccaggagcctgggagtc

SEQ ID NO: 7710616 - DNA, 22 bp, Homo sapiens
tggagccaggagcctgggagtc

SEQ ID NO: 7710617 - DNA, 22 bp, Homo sapiens
tggagccaggagcctgggagtc

SEQ ID NO: 7710618 - DNA, 18 bp, Homo sapiens
tggagccagctctaggat

SEQ ID NO: 7710619 - DNA, 18 bp, Homo sapiens
tggagccagctctaggat

SEQ ID NO: 7710620 - DNA, 22 bp, Homo sapiens
tggagccagcgagccgaggcgg

SEQ ID NO: 7710621 - DNA, 22 bp, Homo sapiens
tggagccagcggcctgctgagg

SEQ ID NO: 7710622 - DNA, 22 bp, Homo sapiens
tggagccagcggcctgctgagg

SEQ ID NO: 7710623 - DNA, 18 bp, Homo sapiens
tggagccagctctaggat

SEQ ID NO: 7710624 - DNA, 18 bp, Homo sapiens
tggagccagctctaggat

SEQ ID NO: 7710625 - DNA, 22 bp, Homo sapiens
tggagccagcggcctgctgagg

SEQ ID NO: 7710626 - DNA, 22 bp, Homo sapiens
tggagccagcggcctgctgagg

SEQ ID NO: 7710627 - DNA, 22 bp, Homo sapiens
tggagccagcggcctgctgagg

SEQ ID NO: 7710628 - DNA, 22 bp, Homo sapiens
tggagcccacggatgtcgcttt

SEQ ID NO: 7710629 - DNA, 22 bp, Homo sapiens
tggagcccacggatgtcgcttt

SEQ ID NO: 7710630 - DNA, 22 bp, Homo sapiens
tggagcccacggatgtcgcttt

SEQ ID NO: 7710631 - DNA, 22 bp, Homo sapiens
tggagcccagacactggcattg

SEQ ID NO: 7710632 - DNA, 22 bp, Homo sapiens
tggagcccagacactggcattg

SEQ ID NO: 7710633 - DNA, 18 bp, Homo sapiens
tggagccattgccaccat

SEQ ID NO: 7710634 - DNA, 18 bp, Homo sapiens
tggagccattgccaccat

SEQ ID NO: 7710635 - DNA, 22 bp, Homo sapiens
tggagccagtgttgcccaacac

SEQ ID NO: 7710636 - DNA, 22 bp, Homo sapiens
tggagccagggtagaagcagag

SEQ ID NO: 7710637 - DNA, 22 bp, Homo sapiens
tggagcccagggtgagaaggag

SEQ ID NO: 7710638 - DNA, 22 bp, Homo sapiens
tggagcccaggagaggataaac

SEQ ID NO: 7710639 - DNA, 22 bp, Homo sapiens
tggagcccagggtgagaaggag

SEQ ID NO: 7710640 - DNA, 22 bp, Homo sapiens
tggagcccaggtgcaagagagt

SEQ ID NO: 7710641 - DNA, 22 bp, Homo sapiens
tggagcccagggtgagaaggag

SEQ ID NO: 7710642 - DNA, 22 bp, Homo sapiens
tggagcccagggtgagaaggag

SEQ ID NO: 7710643 - DNA, 22 bp, Homo sapiens
tggagcccaggagaggataaac

SEQ ID NO: 7710644 - DNA, 22 bp, Homo sapiens
tggagcccagacactggcattg

SEQ ID NO: 7710645 - DNA, 22 bp, Homo sapiens
tggagcccagacactggcattg

SEQ ID NO: 7710646 - DNA, 22 bp, Homo sapiens
tggagcccaggtgcaagagagt

SEQ ID NO: 7710647 - DNA, 22 bp, Homo sapiens
tggagcccaggtgcaagagagt

SEQ ID NO: 7710648 - DNA, 22 bp, Homo sapiens
tggagcctccagtctttctaga

SEQ ID NO: 7710649 - DNA, 22 bp, Homo sapiens
tggagcctcctcacactgtggc

SEQ ID NO: 7710650 - DNA, 22 bp, Homo sapiens
tggagcctccagtctttctaga

SEQ ID NO: 7710651 - DNA, 22 bp, Homo sapiens
tggagcctcctcacactgtggc

SEQ ID NO: 7710652 - DNA, 22 bp, Homo sapiens
tggagcctcctcacactgtggc

SEQ ID NO: 7710653 - DNA, 22 bp, Homo sapiens
tggagcctgagtcagcggaggc

SEQ ID NO: 7710654 - DNA, 23 bp, Homo sapiens
tggagcctgggatacaatagatg

SEQ ID NO: 7710655 - DNA, 22 bp, Homo sapiens
tggagcgagctcaaaggcagga

SEQ ID NO: 7710656 - DNA, 22 bp, Homo sapiens
tggagctcaaaggcctgtggga

SEQ ID NO: 7710657 - DNA, 22 bp, Homo sapiens
tggagccttttacccacaggag

SEQ ID NO: 7710658 - DNA, 22 bp, Homo sapiens
tggagccttttacccacaggag

SEQ ID NO: 7710659 - DNA, 22 bp, Homo sapiens
tggagccttttacccacaggag

SEQ ID NO: 7710660 - DNA, 22 bp, Homo sapiens
tggagccttttgttctgggaca

SEQ ID NO: 7710661 - DNA, 23 bp, Homo sapiens
tggagcctgggatacaatagatg

SEQ ID NO: 7710662 - DNA, 22 bp, Homo sapiens
tggagcctgtgtttctgcccag

SEQ ID NO: 7710663 - DNA, 22 bp, Homo sapiens
tggagcctgtgtttctgcccag

SEQ ID NO: 7710664 - DNA, 22 bp, Homo sapiens
tggagcctgttctgagaagccg

SEQ ID NO: 7710665 - DNA, 22 bp, Homo sapiens
tggagctccactggaaaaatgt

SEQ ID NO: 7710666 - DNA, 23 bp, Homo sapiens
tggagctcctgcccatcctggct

SEQ ID NO: 7710667 - DNA, 22 bp, Homo sapiens
tggagctctgattaaattggaa

SEQ ID NO: 7710668 - DNA, 22 bp, Homo sapiens
tggagctgaactttgaggccag

SEQ ID NO: 7710669 - DNA, 22 bp, Homo sapiens
tggagctctggaagttctaagc

SEQ ID NO: 7710670 - DNA, 22 bp, Homo sapiens
tggagctgaactttgaggccag

SEQ ID NO: 7710671 - DNA, 22 bp, Homo sapiens
tggagctgaactttgaggccag

SEQ ID NO: 7710672 - DNA, 22 bp, Homo sapiens
tggagctgaactttgaggccag

SEQ ID NO: 7710673 - DNA, 22 bp, Homo sapiens
tggagctgaactttgaggccag

SEQ ID NO: 7710674 - DNA, 21 bp, Homo sapiens
tggagctgaatttttggcatc

SEQ ID NO: 7710675 - DNA, 21 bp, Homo sapiens
tggagctgaatttttggcatc

SEQ ID NO: 7710676 - DNA, 21 bp, Homo sapiens
tggagctgaatttttggcatc

SEQ ID NO: 7710677 - DNA, 18 bp, Homo sapiens
tggagctgagtgctgtgc

SEQ ID NO: 7710678 - DNA, 18 bp, Homo sapiens
tggagctgagtgctgtgc

SEQ ID NO: 7710679 - DNA, 18 bp, Homo sapiens
tggagctgagtgctgtgc

SEQ ID NO: 7710680 - DNA, 23 bp, Homo sapiens
tggagctgacagtcagagggagg

SEQ ID NO: 7710681 - DNA, 23 bp, Homo sapiens
tggagctgacagtcagagggagg

SEQ ID NO: 7710682 - DNA, 21 bp, Homo sapiens
tggagctgaatttttggcatc

SEQ ID NO: 7710683 - DNA, 21 bp, Homo sapiens
tggagctgaatttttggcatc

SEQ ID NO: 7710684 - DNA, 23 bp, Homo sapiens
tggagctgacagtcagagggagg

SEQ ID NO: 7710685 - DNA, 22 bp, Homo sapiens
tggagctggaatttgagctgga

SEQ ID NO: 7710686 - DNA, 22 bp, Homo sapiens
tggagctggaatttgagctgga

SEQ ID NO: 7710687 - DNA, 22 bp, Homo sapiens
tggagctggaatttgagctgga

SEQ ID NO: 7710688 - DNA, 22 bp, Homo sapiens
tggagctggcagcggaaaaggg

SEQ ID NO: 7710689 - DNA, 22 bp, Homo sapiens
tggagctggcagcggaaaaggg

SEQ ID NO: 7710690 - DNA, 22 bp, Homo sapiens
tggagctggaatttgagctgga

SEQ ID NO: 7710691 - DNA, 22 bp, Homo sapiens
tggagctggcagcggaaaaggg

SEQ ID NO: 7710692 - DNA, 22 bp, Homo sapiens
tggagctggcttgtggaagttg

SEQ ID NO: 7710693 - DNA, 22 bp, Homo sapiens
tggagctggcttgtggaagttg

SEQ ID NO: 7710694 - DNA, 22 bp, Homo sapiens
tggagctggcttgtggaagttg

SEQ ID NO: 7710695 - DNA, 22 bp, Homo sapiens
tggagctggcttgtggaagttg

SEQ ID NO: 7710696 - DNA, 22 bp, Homo sapiens
tggagctggcttgtggaagttg

SEQ ID NO: 7710697 - DNA, 22 bp, Homo sapiens
tggagctgggagtcctgggctg

SEQ ID NO: 7710698 - DNA, 22 bp, Homo sapiens
tggagctggcttgtggaagttg

SEQ ID NO: 7710699 - DNA, 22 bp, Homo sapiens
tggagctggcttgtggaagttg

SEQ ID NO: 7710700 - DNA, 22 bp, Homo sapiens
tggagctggaagacagtgatat

SEQ ID NO: 7710701 - DNA, 22 bp, Homo sapiens
tggagctggaagacagtgatat

SEQ ID NO: 7710702 - DNA, 22 bp, Homo sapiens
tggagctggaatttctgggcct

SEQ ID NO: 7710703 - DNA, 22 bp, Homo sapiens
tggagctggaatttctgggcct

SEQ ID NO: 7710704 - DNA, 22 bp, Homo sapiens
tggagctggaatttctgggcct

SEQ ID NO: 7710705 - DNA, 22 bp, Homo sapiens
tggagctggaatttctgggcct

SEQ ID NO: 7710706 - DNA, 22 bp, Homo sapiens
tggagctggaatttgagctgga

SEQ ID NO: 7710707 - DNA, 22 bp, Homo sapiens
tggagctggaatttgagctgga

SEQ ID NO: 7710708 - DNA, 22 bp, Homo sapiens
tggagctggaatttgagctgga

SEQ ID NO: 7710709 - DNA, 22 bp, Homo sapiens
tggagctggaatttctgggcct

SEQ ID NO: 7710710 - DNA, 22 bp, Homo sapiens
tggagctggaatttctgggcct

SEQ ID NO: 7710711 - DNA, 22 bp, Homo sapiens
tggagctggaatttctgggcct

SEQ ID NO: 7710712 - DNA, 21 bp, Homo sapiens
tggagctgccacttgtcctcc

SEQ ID NO: 7710713 - DNA, 22 bp, Homo sapiens
tggagctgcctggcacctacag

SEQ ID NO: 7710714 - DNA, 22 bp, Homo sapiens
tggagctgcctggcacctacag

SEQ ID NO: 7710715 - DNA, 21 bp, Homo sapiens
tggagctgccacttgtcctcc

SEQ ID NO: 7710716 - DNA, 22 bp, Homo sapiens
tggagctggaagaatgtagacg

SEQ ID NO: 7710717 - DNA, 17 bp, Homo sapiens
tggagctgcgtgtgttc

SEQ ID NO: 7710718 - DNA, 17 bp, Homo sapiens
tggagctgcgtgtgttc

SEQ ID NO: 7710719 - DNA, 22 bp, Homo sapiens
tggagctggaagaatgtagacg

SEQ ID NO: 7710720 - DNA, 22 bp, Homo sapiens
tggagctggaagaatgtagacg

SEQ ID NO: 7710721 - DNA, 22 bp, Homo sapiens
tggagctggaagacagtgatat

SEQ ID NO: 7710722 - DNA, 18 bp, Homo sapiens
tggagctgagtgctgtgc

SEQ ID NO: 7710723 - DNA, 18 bp, Homo sapiens
tggagctgagtgctgtgc

SEQ ID NO: 7710724 - DNA, 18 bp, Homo sapiens
tggagctgagtgctgtgc

SEQ ID NO: 7710725 - DNA, 18 bp, Homo sapiens
tggagctgagtgctgtgc

SEQ ID NO: 7710726 - DNA, 22 bp, Homo sapiens
tggagctgatacagctggcttt

SEQ ID NO: 7710727 - DNA, 22 bp, Homo sapiens
tggagctgatacagctggcttt

SEQ ID NO: 7710728 - DNA, 22 bp, Homo sapiens
tggagctgatacagctggcttt

SEQ ID NO: 7710729 - DNA, 22 bp, Homo sapiens
tggagctgatacagctggcttt

SEQ ID NO: 7710730 - DNA, 21 bp, Homo sapiens
tggagctgccacttgagctgc

SEQ ID NO: 7710731 - DNA, 21 bp, Homo sapiens
tggagctgccacttgagctgc

SEQ ID NO: 7710732 - DNA, 21 bp, Homo sapiens
tggagctgccacttgagctgc

SEQ ID NO: 7710733 - DNA, 22 bp, Homo sapiens
tggagctgatacagctggcttt

SEQ ID NO: 7710734 - DNA, 22 bp, Homo sapiens
tggagctgatacagctggcttt

SEQ ID NO: 7710735 - DNA, 22 bp, Homo sapiens
tggagctgatacagctggcttt

SEQ ID NO: 7710736 - DNA, 22 bp, Homo sapiens
tggagctgatacagctggcttt

SEQ ID NO: 7710737 - DNA, 22 bp, Homo sapiens
tggagggcgcttagatggaggg

SEQ ID NO: 7710738 - DNA, 22 bp, Homo sapiens
tggagggcgcttagatggaggg

SEQ ID NO: 7710739 - DNA, 22 bp, Homo sapiens
tggagggcgcttagatggaggg

SEQ ID NO: 7710740 - DNA, 22 bp, Homo sapiens
tggagggcgcttagatggaggg

SEQ ID NO: 7710741 - DNA, 22 bp, Homo sapiens
tggagggcgcttagatggaggg

SEQ ID NO: 7710742 - DNA, 22 bp, Homo sapiens
tggagggcgcttagatggaggg

SEQ ID NO: 7710743 - DNA, 22 bp, Homo sapiens
tggagggcgcttagatggaggg

SEQ ID NO: 7710744 - DNA, 22 bp, Homo sapiens
tggagggcgcttagatggaggg

SEQ ID NO: 7710745 - DNA, 22 bp, Homo sapiens
tggagggcgcttagatggaggg

SEQ ID NO: 7710746 - DNA, 22 bp, Homo sapiens
tggagggcatgctgtccatggg

SEQ ID NO: 7710747 - DNA, 22 bp, Homo sapiens
tggagggcgcttagatggaggg

SEQ ID NO: 7710748 - DNA, 22 bp, Homo sapiens
tggagggcatctgtggtcaggc

SEQ ID NO: 7710749 - DNA, 22 bp, Homo sapiens
tggagggcatctgtggtcaggc

SEQ ID NO: 7710750 - DNA, 22 bp, Homo sapiens
tggagggcatctgtggtcaggc

SEQ ID NO: 7710751 - DNA, 22 bp, Homo sapiens
tggagggcatctgtggtcaggc

SEQ ID NO: 7710752 - DNA, 22 bp, Homo sapiens
tggagggcatctgtggtcaggc

SEQ ID NO: 7710753 - DNA, 22 bp, Homo sapiens
tggagggcatgctgtccatggg

SEQ ID NO: 7710754 - DNA, 22 bp, Homo sapiens
tggagggcatgctgtccatggg

SEQ ID NO: 7710755 - DNA, 22 bp, Homo sapiens
tggagggcatctgtggtcaggc

SEQ ID NO: 7710756 - DNA, 22 bp, Homo sapiens
tggagggcatgctgtccatggg

SEQ ID NO: 7710757 - DNA, 20 bp, Homo sapiens
tggagggattgttggcaaat

SEQ ID NO: 7710758 - DNA, 20 bp, Homo sapiens
tggagggattgttggcaaat

SEQ ID NO: 7710759 - DNA, 22 bp, Homo sapiens
tggagggatacaaagatgaaaa

SEQ ID NO: 7710760 - DNA, 23 bp, Homo sapiens
tggagggcagaataacagactac

SEQ ID NO: 7710761 - DNA, 20 bp, Homo sapiens
tggagggattgttggcaaat

SEQ ID NO: 7710762 - DNA, 23 bp, Homo sapiens
tggagggcagaataacagactac

SEQ ID NO: 7710763 - DNA, 23 bp, Homo sapiens
tggagggcagaataacagactac

SEQ ID NO: 7710764 - DNA, 23 bp, Homo sapiens
tggagggcagaataacagactac

SEQ ID NO: 7710765 - DNA, 22 bp, Homo sapiens
tggagggcatagctgttctttc

SEQ ID NO: 7710766 - DNA, 22 bp, Homo sapiens
tggagggcatagctgttctttc

SEQ ID NO: 7710767 - DNA, 22 bp, Homo sapiens
tggagggcatagctgttctttc

SEQ ID NO: 7710768 - DNA, 22 bp, Homo sapiens
tggagggcatctgtggtcaggc

SEQ ID NO: 7710769 - DNA, 22 bp, Homo sapiens
tggagggcatctgtggtcaggc

SEQ ID NO: 7710770 - DNA, 22 bp, Homo sapiens
tggagggcatctgtggtcaggc

SEQ ID NO: 7710771 - DNA, 22 bp, Homo sapiens
tggagggcatctgtggtcaggc

SEQ ID NO: 7710772 - DNA, 22 bp, Homo sapiens
tggagggcatctgtggtcaggc

SEQ ID NO: 7710773 - DNA, 22 bp, Homo sapiens
tggagggcatctgtggtcaggc

SEQ ID NO: 7710774 - DNA, 22 bp, Homo sapiens
tggagggaacccaggctgctct

SEQ ID NO: 7710775 - DNA, 22 bp, Homo sapiens
tggagggaacccaggctgctct

SEQ ID NO: 7710776 - DNA, 22 bp, Homo sapiens
tggagggaacccaggctgctct

SEQ ID NO: 7710777 - DNA, 22 bp, Homo sapiens
tggagggaacccaggctgctct

SEQ ID NO: 7710778 - DNA, 22 bp, Homo sapiens
tggagggaacccaggctgctct

SEQ ID NO: 7710779 - DNA, 22 bp, Homo sapiens
tggagggaacaaaggagtccca

SEQ ID NO: 7710780 - DNA, 22 bp, Homo sapiens
tggagggaacaaaggagtccca

SEQ ID NO: 7710781 - DNA, 22 bp, Homo sapiens
tggagggaacaaaggagtccca

SEQ ID NO: 7710782 - DNA, 22 bp, Homo sapiens
tggagggaacaaaggagtccca

SEQ ID NO: 7710783 - DNA, 22 bp, Homo sapiens
tggagggatacaaagatgaaaa

SEQ ID NO: 7710784 - DNA, 22 bp, Homo sapiens
tggagggatacaaagatgaaaa

SEQ ID NO: 7710785 - DNA, 22 bp, Homo sapiens
tggagggatacaaagatgaaaa

SEQ ID NO: 7710786 - DNA, 22 bp, Homo sapiens
tggagggatacaaagatgaaaa

SEQ ID NO: 7710787 - DNA, 22 bp, Homo sapiens
tggagggaacccaggctgctct

SEQ ID NO: 7710788 - DNA, 22 bp, Homo sapiens
tggagggaacccaggctgctct

SEQ ID NO: 7710789 - DNA, 22 bp, Homo sapiens
tggagggaacccaggctgctct

SEQ ID NO: 7710790 - DNA, 22 bp, Homo sapiens
tggagggaacccaggctgctct

SEQ ID NO: 7710791 - DNA, 22 bp, Homo sapiens
tggagggaacccaggctgctct

SEQ ID NO: 7710792 - DNA, 22 bp, Homo sapiens
tggagggaacaaaggagtccca

SEQ ID NO: 7710793 - DNA, 22 bp, Homo sapiens
tggagggaacaaaggagtccca

SEQ ID NO: 7710794 - DNA, 22 bp, Homo sapiens
tggaggctgtgtgcatgagacc

SEQ ID NO: 7710795 - DNA, 22 bp, Homo sapiens
tggaggctgtgtgcatgagacc

SEQ ID NO: 7710796 - DNA, 22 bp, Homo sapiens
tggaggctggtttctgctgagg

SEQ ID NO: 7710797 - DNA, 22 bp, Homo sapiens
tggaggctgtgtgcatgagacc

SEQ ID NO: 7710798 - DNA, 22 bp, Homo sapiens
tggaggctgtgtgcatgagacc

SEQ ID NO: 7710799 - DNA, 22 bp, Homo sapiens
tggaggctgtgtgcatgagacc

SEQ ID NO: 7710800 - DNA, 22 bp, Homo sapiens
tggaggctgtgtgcatgagacc

SEQ ID NO: 7710801 - DNA, 22 bp, Homo sapiens
tggaggctgtgtgcatgagacc

SEQ ID NO: 7710802 - DNA, 22 bp, Homo sapiens
tggaggctgtgtgcatgagacc

SEQ ID NO: 7710803 - DNA, 22 bp, Homo sapiens
tggaggctggtttctgctgagg

SEQ ID NO: 7710804 - DNA, 22 bp, Homo sapiens
tggaggctggagtgcagtggcg

SEQ ID NO: 7710805 - DNA, 22 bp, Homo sapiens
tggaggctggtttctgctgagg

SEQ ID NO: 7710806 - DNA, 22 bp, Homo sapiens
tggaggctggtttctgctgagg

SEQ ID NO: 7710807 - DNA, 22 bp, Homo sapiens
tggagggctctttcacctggta

SEQ ID NO: 7710808 - DNA, 22 bp, Homo sapiens
tggagggctctttcacctggta

SEQ ID NO: 7710809 - DNA, 22 bp, Homo sapiens
tggagggctctttcacctggta

SEQ ID NO: 7710810 - DNA, 22 bp, Homo sapiens
tggagggctctttcacctggta

SEQ ID NO: 7710811 - DNA, 22 bp, Homo sapiens
tggagggctctttcacctggta

SEQ ID NO: 7710812 - DNA, 22 bp, Homo sapiens
tggagggctctttcacctggta

SEQ ID NO: 7710813 - DNA, 22 bp, Homo sapiens
tggagggctctttcacctggta

SEQ ID NO: 7710814 - DNA, 18 bp, Homo sapiens
tggagggcttgctgcagc

SEQ ID NO: 7710815 - DNA, 18 bp, Homo sapiens
tggagggcttgctgcagc

SEQ ID NO: 7710816 - DNA, 18 bp, Homo sapiens
tggagggcttgctgcagc

SEQ ID NO: 7710817 - DNA, 18 bp, Homo sapiens
tggagggcttgctgcagc

SEQ ID NO: 7710818 - DNA, 18 bp, Homo sapiens
tggagggcttgctgcagc

SEQ ID NO: 7710819 - DNA, 22 bp, Homo sapiens
tggaggtggcacaagggaggtc

SEQ ID NO: 7710820 - DNA, 22 bp, Homo sapiens
tggaggtggcacaagggaggtc

SEQ ID NO: 7710821 - DNA, 22 bp, Homo sapiens
tggaggtggcacaagggaggtc

SEQ ID NO: 7710822 - DNA, 22 bp, Homo sapiens
tggaggtggcacaagggaggtc

SEQ ID NO: 7710823 - DNA, 22 bp, Homo sapiens
tggaggtggagttggaaactga

SEQ ID NO: 7710824 - DNA, 22 bp, Homo sapiens
tggaggtggagttggaaactga

SEQ ID NO: 7710825 - DNA, 22 bp, Homo sapiens
tggagggctaagctgagggata

SEQ ID NO: 7710826 - DNA, 22 bp, Homo sapiens
tggagggctctttcacctggta

SEQ ID NO: 7710827 - DNA, 22 bp, Homo sapiens
tggagggctctttcacctggta

SEQ ID NO: 7710828 - DNA, 22 bp, Homo sapiens
tggagggctaagctgagggata

SEQ ID NO: 7710829 - DNA, 22 bp, Homo sapiens
tggagggctaagctgagggata

SEQ ID NO: 7710830 - DNA, 22 bp, Homo sapiens
tggagggctaagctgagggata

SEQ ID NO: 7710831 - DNA, 22 bp, Homo sapiens
tggagggctaagctgagggata

SEQ ID NO: 7710832 - DNA, 22 bp, Homo sapiens
tggagggctaagctgagggata

SEQ ID NO: 7710833 - DNA, 22 bp, Homo sapiens
tggagggctaagctgagggata

SEQ ID NO: 7710834 - DNA, 22 bp, Homo sapiens
tggagggctaagctgagggata

SEQ ID NO: 7710835 - DNA, 22 bp, Homo sapiens
tggagggcgcttagatggaggg

SEQ ID NO: 7710836 - DNA, 22 bp, Homo sapiens
tggagggcgcttagatggaggg

SEQ ID NO: 7710837 - DNA, 22 bp, Homo sapiens
tggagggcgcttagatggaggg

SEQ ID NO: 7710838 - DNA, 22 bp, Homo sapiens
tggagggcgcttagatggaggg

SEQ ID NO: 7710839 - DNA, 22 bp, Homo sapiens
tggagggcgcttagatggaggg

SEQ ID NO: 7710840 - DNA, 22 bp, Homo sapiens
tggagggctaagctgagggata

SEQ ID NO: 7710841 - DNA, 22 bp, Homo sapiens
tggagggctaagctgagggata

SEQ ID NO: 7710842 - DNA, 22 bp, Homo sapiens
tggagggcgcttagatggaggg

SEQ ID NO: 7710843 - DNA, 22 bp, Homo sapiens
tggaggtggcacaagggaggtc

SEQ ID NO: 7710844 - DNA, 22 bp, Homo sapiens
tggaggtggcatctgacagctg

SEQ ID NO: 7710845 - DNA, 22 bp, Homo sapiens
tggaggtggcatctgacagctg

SEQ ID NO: 7710846 - DNA, 22 bp, Homo sapiens
tggaggtggcatctgacagctg

SEQ ID NO: 7710847 - DNA, 22 bp, Homo sapiens
tggaggtggcatctgacagctg

SEQ ID NO: 7710848 - DNA, 22 bp, Homo sapiens
tggaggtggcacaagggaggtc

SEQ ID NO: 7710849 - DNA, 22 bp, Homo sapiens
tggaggtggcacaagggaggtc

SEQ ID NO: 7710850 - DNA, 22 bp, Homo sapiens
tggaggtggcacaagggaggtc

SEQ ID NO: 7710851 - DNA, 22 bp, Homo sapiens
tggaggtggcacaagggaggtc

SEQ ID NO: 7710852 - DNA, 22 bp, Homo sapiens
tggaggtggcacaagggaggtc

SEQ ID NO: 7710853 - DNA, 22 bp, Homo sapiens
tggaggtggcacaagggaggtc

SEQ ID NO: 7710854 - DNA, 22 bp, Homo sapiens
tggaggtggcacaagggaggtc

SEQ ID NO: 7710855 - DNA, 22 bp, Homo sapiens
tggaggtgggagggactgtcct

SEQ ID NO: 7710856 - DNA, 22 bp, Homo sapiens
tggaggtggcatctgacagctg

SEQ ID NO: 7710857 - DNA, 22 bp, Homo sapiens
tggaggtggcatctgacagctg

SEQ ID NO: 7710858 - DNA, 22 bp, Homo sapiens
tggaggtgggagggactgtcct

SEQ ID NO: 7710859 - DNA, 22 bp, Homo sapiens
tggaggtgggagggactgtcct

SEQ ID NO: 7710860 - DNA, 22 bp, Homo sapiens
tggaggtggcatctgacagctg

SEQ ID NO: 7710861 - DNA, 22 bp, Homo sapiens
tggaggtgggagggactgtcct

SEQ ID NO: 7710862 - DNA, 22 bp, Homo sapiens
tggaggtgggagggactgtcct

SEQ ID NO: 7710863 - DNA, 22 bp, Homo sapiens
tggaggtgggagggactgtcct

SEQ ID NO: 7710864 - DNA, 22 bp, Homo sapiens
tggaggtgggagggactgtcct

SEQ ID NO: 7710865 - DNA, 22 bp, Homo sapiens
tggaggtgggagggactgtcct

SEQ ID NO: 7710866 - DNA, 20 bp, Homo sapiens
tggaggtggtctgctgtcct

SEQ ID NO: 7710867 - DNA, 20 bp, Homo sapiens
tggaggtggtctgctgtcct

SEQ ID NO: 7710868 - DNA, 20 bp, Homo sapiens
tggaggtggtctgctgtcct

SEQ ID NO: 7710869 - DNA, 20 bp, Homo sapiens
tggaggtggtctgctgtcct

SEQ ID NO: 7710870 - DNA, 20 bp, Homo sapiens
tggaggtggtctgctgtcct

SEQ ID NO: 7710871 - DNA, 20 bp, Homo sapiens
tggaggtggtctgctgtcct

SEQ ID NO: 7710872 - DNA, 20 bp, Homo sapiens
tggaggtggtctgctgtcct

SEQ ID NO: 7710873 - DNA, 22 bp, Homo sapiens
tggaggtggggctcaggaatct

SEQ ID NO: 7710874 - DNA, 22 bp, Homo sapiens
tggaggtggggctcaggaatct

SEQ ID NO: 7710875 - DNA, 22 bp, Homo sapiens
tggaggtggtgcccagcaattt

SEQ ID NO: 7710876 - DNA, 22 bp, Homo sapiens
tggaggtgtataaggtagcttc

SEQ ID NO: 7710877 - DNA, 22 bp, Homo sapiens
tggaggtgtataaggtagcttc

SEQ ID NO: 7710878 - DNA, 22 bp, Homo sapiens
tggaggtgtataaggtagcttc

SEQ ID NO: 7710879 - DNA, 22 bp, Homo sapiens
tggaggtgtataaggtagcttc

SEQ ID NO: 7710880 - DNA, 22 bp, Homo sapiens
tggaggtgtataaggtagcttc

SEQ ID NO: 7710881 - DNA, 22 bp, Homo sapiens
tggaggtgtataaggtagcttc

SEQ ID NO: 7710882 - DNA, 22 bp, Homo sapiens
tggaggtggtgcccagcaattt

SEQ ID NO: 7710883 - DNA, 20 bp, Homo sapiens
tggaggtggtctgctgtcct

SEQ ID NO: 7710884 - DNA, 22 bp, Homo sapiens
tggaggtggtgcccagcaattt

SEQ ID NO: 7710885 - DNA, 20 bp, Homo sapiens
tggaggtggtctgctgtcct

SEQ ID NO: 7710886 - DNA, 22 bp, Homo sapiens
tggaggtgtggagtcaaaggga

SEQ ID NO: 7710887 - DNA, 22 bp, Homo sapiens
tggaggtgtggagtcaaaggga

SEQ ID NO: 7710888 - DNA, 22 bp, Homo sapiens
tggaggtgtccaactcgtgggt

SEQ ID NO: 7710889 - DNA, 22 bp, Homo sapiens
tggaggtgtccaactcgtgggt

SEQ ID NO: 7710890 - DNA, 22 bp, Homo sapiens
tggaggtgtccaactcgtgggt

SEQ ID NO: 7710891 - DNA, 22 bp, Homo sapiens
tggaggtgtccaactcgtgggt

SEQ ID NO: 7710892 - DNA, 16 bp, Homo sapiens
tggaggtgtttctagt

SEQ ID NO: 7710893 - DNA, 22 bp, Homo sapiens
tggaggtgtggagtcaaaggga

SEQ ID NO: 7710894 - DNA, 22 bp, Homo sapiens
tggaggtgtggagtcaaaggga

SEQ ID NO: 7710895 - DNA, 22 bp, Homo sapiens
tggaggtgtccaactcgtgggt

SEQ ID NO: 7710896 - DNA, 22 bp, Homo sapiens
tggaggtgtccaactcgtgggt

SEQ ID NO: 7710897 - DNA, 22 bp, Homo sapiens
tggaggtgtccaactcgtgggt

SEQ ID NO: 7710898 - DNA, 22 bp, Homo sapiens
tggaggtgtataaggtagcttc

SEQ ID NO: 7710899 - DNA, 22 bp, Homo sapiens
tggaggtgtccaactcgtgggt

SEQ ID NO: 7710900 - DNA, 22 bp, Homo sapiens
tggaggtgtataaggtagcttc

SEQ ID NO: 7710901 - DNA, 22 bp, Homo sapiens
tggaggtgtataaggtagcttc

SEQ ID NO: 7710902 - DNA, 22 bp, Homo sapiens
tggaggtgtataaggtagcttc

SEQ ID NO: 7710903 - DNA, 22 bp, Homo sapiens
tggaggtgtataaggtagcttc

SEQ ID NO: 7710904 - DNA, 22 bp, Homo sapiens
tggagtcagtctgggttgcaat

SEQ ID NO: 7710905 - DNA, 22 bp, Homo sapiens
tggagtcagagggggaagtcac

SEQ ID NO: 7710906 - DNA, 22 bp, Homo sapiens
tggagtcagaatgcgacaggcc

SEQ ID NO: 7710907 - DNA, 22 bp, Homo sapiens
tggagtcagagggggaagtcac

SEQ ID NO: 7710908 - DNA, 22 bp, Homo sapiens
tggagtcagctagacctgtgtt

SEQ ID NO: 7710909 - DNA, 22 bp, Homo sapiens
tggagtcaggatcttataaata

SEQ ID NO: 7710910 - DNA, 23 bp, Homo sapiens
tggaggttttactgagttgagga

SEQ ID NO: 7710911 - DNA, 22 bp, Homo sapiens
tggagtcagaatgcgacaggcc

SEQ ID NO: 7710912 - DNA, 22 bp, Homo sapiens
tggagtcacttccatatgggaa

SEQ ID NO: 7710913 - DNA, 22 bp, Homo sapiens
tggagtgaagtaaagaggacaa

SEQ ID NO: 7710914 - DNA, 22 bp, Homo sapiens
tggagtgagctctaagaaactt

SEQ ID NO: 7710915 - DNA, 21 bp, Homo sapiens
tggagtgcaacactaggtata

SEQ ID NO: 7710916 - DNA, 22 bp, Homo sapiens
tggagtgaagtaaagaggacaa

SEQ ID NO: 7710917 - DNA, 22 bp, Homo sapiens
tggagtgaagtaaagaggacaa

SEQ ID NO: 7710918 - DNA, 22 bp, Homo sapiens
tggagtgaagggttggcacggt

SEQ ID NO: 7710919 - DNA, 22 bp, Homo sapiens
tggagtgcaatagtaataaggt

SEQ ID NO: 7710920 - DNA, 22 bp, Homo sapiens
tggagtgcaatagtaataaggt

SEQ ID NO: 7710921 - DNA, 21 bp, Homo sapiens
tggagtgcactcagagttggt

SEQ ID NO: 7710922 - DNA, 21 bp, Homo sapiens
tggagtgcactcagagttggt

SEQ ID NO: 7710923 - DNA, 22 bp, Homo sapiens
tggagtggacttcatgaggcca

SEQ ID NO: 7710924 - DNA, 22 bp, Homo sapiens
tggagtggacttcatgaggcca

SEQ ID NO: 7710925 - DNA, 22 bp, Homo sapiens
tggagtggacttcatgaggcca

SEQ ID NO: 7710926 - DNA, 22 bp, Homo sapiens
tggagtggacttcatgaggcca

SEQ ID NO: 7710927 - DNA, 22 bp, Homo sapiens
tggagtggacttcatgaggcca

SEQ ID NO: 7710928 - DNA, 20 bp, Homo sapiens
tggagtgctgtgttgagaag

SEQ ID NO: 7710929 - DNA, 22 bp, Homo sapiens
tggagtggacttcatgaggcca

SEQ ID NO: 7710930 - DNA, 21 bp, Homo sapiens
tggagtgcactcagagttggt

SEQ ID NO: 7710931 - DNA, 22 bp, Homo sapiens
tggagtgcagttgggaggacac

SEQ ID NO: 7710932 - DNA, 22 bp, Homo sapiens
tggagtgcagttgggaggacac

SEQ ID NO: 7710933 - DNA, 20 bp, Homo sapiens
tggagtgctgtgttgagaag

SEQ ID NO: 7710934 - DNA, 20 bp, Homo sapiens
tggagtgctgtgttgagaag

SEQ ID NO: 7710935 - DNA, 22 bp, Homo sapiens
tggagtggacttcatgaggcca

SEQ ID NO: 7710936 - DNA, 20 bp, Homo sapiens
tggagtctgacagatgggta

SEQ ID NO: 7710937 - DNA, 20 bp, Homo sapiens
tggagtctgacagatgggta

SEQ ID NO: 7710938 - DNA, 22 bp, Homo sapiens
tggagtccttgttggaagtgaa

SEQ ID NO: 7710939 - DNA, 22 bp, Homo sapiens
tggagtctgtgatgctctgggt

SEQ ID NO: 7710940 - DNA, 22 bp, Homo sapiens
tggagtctgtgatgctctgggt

SEQ ID NO: 7710941 - DNA, 20 bp, Homo sapiens
tggagtctgacagatgggta

SEQ ID NO: 7710942 - DNA, 22 bp, Homo sapiens
tggagtgaagggttggcacggt

SEQ ID NO: 7710943 - DNA, 22 bp, Homo sapiens
tggagtgaagtaaagaggacaa

SEQ ID NO: 7710944 - DNA, 20 bp, Homo sapiens
tggagtcatgggacactcac

SEQ ID NO: 7710945 - DNA, 22 bp, Homo sapiens
tggagtcccactgggaactggg

SEQ ID NO: 7710946 - DNA, 22 bp, Homo sapiens
tggagtcccactgggaactggg

SEQ ID NO: 7710947 - DNA, 22 bp, Homo sapiens
tggagtcatgatggctgctgat

SEQ ID NO: 7710948 - DNA, 22 bp, Homo sapiens
tggagtccgctccaagttctct

SEQ ID NO: 7710949 - DNA, 22 bp, Homo sapiens
tggagtccgctccaagttctct

SEQ ID NO: 7710950 - DNA, 22 bp, Homo sapiens
tggagtccccgagaggcctgca

SEQ ID NO: 7710951 - DNA, 22 bp, Homo sapiens
tggataaactcactgtaagttg

SEQ ID NO: 7710952 - DNA, 22 bp, Homo sapiens
tggataaactcactgtaagttg

SEQ ID NO: 7710953 - DNA, 23 bp, Homo sapiens
tggataaagctgtgctgcatagg

SEQ ID NO: 7710954 - DNA, 22 bp, Homo sapiens
tggataaactcactgtaagttg

SEQ ID NO: 7710955 - DNA, 23 bp, Homo sapiens
tggataaagctgtgctgcatagg

SEQ ID NO: 7710956 - DNA, 23 bp, Homo sapiens
tggataaagctgtgctgcatagg

SEQ ID NO: 7710957 - DNA, 21 bp, Homo sapiens
tggataaaggcacttttcatc

SEQ ID NO: 7710958 - DNA, 21 bp, Homo sapiens
tggataaaggcacttttcatc

SEQ ID NO: 7710959 - DNA, 20 bp, Homo sapiens
tggagttgttctgctaggtc

SEQ ID NO: 7710960 - DNA, 22 bp, Homo sapiens
tggagttgtgtcatctttgtaa

SEQ ID NO: 7710961 - DNA, 20 bp, Homo sapiens
tggagttgttctgctaggtc

SEQ ID NO: 7710962 - DNA, 22 bp, Homo sapiens
tggagtttccctgtgaaaatgc

SEQ ID NO: 7710963 - DNA, 22 bp, Homo sapiens
tggataaaacgttctgaaaaac

SEQ ID NO: 7710964 - DNA, 23 bp, Homo sapiens
tggataaaatacttacattcaac

SEQ ID NO: 7710965 - DNA, 23 bp, Homo sapiens
tggataaaatacttacattcaac

SEQ ID NO: 7710966 - DNA, 23 bp, Homo sapiens
tggataaaatacttacattcaac

SEQ ID NO: 7710967 - DNA, 22 bp, Homo sapiens
tggagtgggcaatgtaggcaag

SEQ ID NO: 7710968 - DNA, 22 bp, Homo sapiens
tggagtgggcaatgtaggcaag

SEQ ID NO: 7710969 - DNA, 22 bp, Homo sapiens
tggagtgggcaatgtaggcaag

SEQ ID NO: 7710970 - DNA, 22 bp, Homo sapiens
tggagtggacttcatgaggcca

SEQ ID NO: 7710971 - DNA, 22 bp, Homo sapiens
tggagtggacttcatgaggcca

SEQ ID NO: 7710972 - DNA, 22 bp, Homo sapiens
tggagtgggcaatgtaggcaag

SEQ ID NO: 7710973 - DNA, 22 bp, Homo sapiens
tggagttaaaaacaggatgcac

SEQ ID NO: 7710974 - DNA, 22 bp, Homo sapiens
tggagtgggcaatgtaggcaag

SEQ ID NO: 7710975 - DNA, 22 bp, Homo sapiens
tggagtgggcaatgtaggcaag

SEQ ID NO: 7710976 - DNA, 22 bp, Homo sapiens
tggagtgggcaatgtaggcaag

SEQ ID NO: 7710977 - DNA, 22 bp, Homo sapiens
tggagtgggcaatgtaggcaag

SEQ ID NO: 7710978 - DNA, 22 bp, Homo sapiens
tggagttcatccatgacagctt

SEQ ID NO: 7710979 - DNA, 22 bp, Homo sapiens
tggagttcatccatgacagctt

SEQ ID NO: 7710980 - DNA, 22 bp, Homo sapiens
tggagttctcaggtgagggctt

SEQ ID NO: 7710981 - DNA, 22 bp, Homo sapiens
tggagttctcaggtgagggctt

SEQ ID NO: 7710982 - DNA, 22 bp, Homo sapiens
tggagttctcaggtgagggctt

SEQ ID NO: 7710983 - DNA, 22 bp, Homo sapiens
tggagttcttgttctatgcaag

SEQ ID NO: 7710984 - DNA, 22 bp, Homo sapiens
tggagttctttttcaagataga

SEQ ID NO: 7710985 - DNA, 22 bp, Homo sapiens
tggagttgcagctaccagacat

SEQ ID NO: 7710986 - DNA, 22 bp, Homo sapiens
tggatgctcacttctgcagggt

SEQ ID NO: 7710987 - DNA, 22 bp, Homo sapiens
tggatgctgagaacactgcctg

SEQ ID NO: 7710988 - DNA, 22 bp, Homo sapiens
tggatatgttggaggtgaaggt

SEQ ID NO: 7710989 - DNA, 22 bp, Homo sapiens
tggatatgggccatggaaaaaa

SEQ ID NO: 7710990 - DNA, 22 bp, Homo sapiens
tggatatgcccagggcacccta

SEQ ID NO: 7710991 - DNA, 22 bp, Homo sapiens
tggataaatagatacacttgca

SEQ ID NO: 7710992 - DNA, 22 bp, Homo sapiens
tggataaatggtgctatcaccc

SEQ ID NO: 7710993 - DNA, 22 bp, Homo sapiens
tggatacagaagccttggctgt

SEQ ID NO: 7710994 - DNA, 22 bp, Homo sapiens
tggatatccttgttaactttct

SEQ ID NO: 7710995 - DNA, 22 bp, Homo sapiens
tggatatccttgttaactttct

SEQ ID NO: 7710996 - DNA, 22 bp, Homo sapiens
tggatatccttgttaactttct

SEQ ID NO: 7710997 - DNA, 22 bp, Homo sapiens
tggatggagactgatatgggta

SEQ ID NO: 7710998 - DNA, 22 bp, Homo sapiens
tggatggattgacgaaggcagc

SEQ ID NO: 7710999 - DNA, 22 bp, Homo sapiens
tggatggatctcaagggaatta

SEQ ID NO: 7711000 - DNA, 22 bp, Homo sapiens
tggatggatctcaagggaatta

SEQ ID NO: 7711001 - DNA, 22 bp, Homo sapiens
tggatggattgacgaaggcagc

SEQ ID NO: 7711002 - DNA, 22 bp, Homo sapiens
tggatggccccactggatccat

SEQ ID NO: 7711003 - DNA, 22 bp, Homo sapiens
tggatggccccactggatccat

SEQ ID NO: 7711004 - DNA, 22 bp, Homo sapiens
tggatggctggggaagagcagg

SEQ ID NO: 7711005 - DNA, 22 bp, Homo sapiens
tggatgggttgaaatgtgagcc

SEQ ID NO: 7711006 - DNA, 22 bp, Homo sapiens
tggatggggcagcttaggtgtg

SEQ ID NO: 7711007 - DNA, 22 bp, Homo sapiens
tggatggggcagcttaggtgtg

SEQ ID NO: 7711008 - DNA, 22 bp, Homo sapiens
tggatggctggggaagagcagg

SEQ ID NO: 7711009 - DNA, 22 bp, Homo sapiens
tggatggctgtggtctttgccc

SEQ ID NO: 7711010 - DNA, 22 bp, Homo sapiens
tggatggctgtggtctttgccc

SEQ ID NO: 7711011 - DNA, 22 bp, Homo sapiens
tggaggattccacttacatgag

SEQ ID NO: 7711012 - DNA, 22 bp, Homo sapiens
tggaggattaatctggaaagat

SEQ ID NO: 7711013 - DNA, 22 bp, Homo sapiens
tggaggatgcctggggaggcct

SEQ ID NO: 7711014 - DNA, 22 bp, Homo sapiens
tggaggcaactgaagatgtagt

SEQ ID NO: 7711015 - DNA, 22 bp, Homo sapiens
tggaggcaactgaagatgtagt

SEQ ID NO: 7711016 - DNA, 22 bp, Homo sapiens
tggaggattccacttacatgag

SEQ ID NO: 7711017 - DNA, 22 bp, Homo sapiens
tggaggcaactgaagatgtagt

SEQ ID NO: 7711018 - DNA, 22 bp, Homo sapiens
tggaggcaactgaagatgtagt

SEQ ID NO: 7711019 - DNA, 22 bp, Homo sapiens
tggaggcaactgaagatgtagt

SEQ ID NO: 7711020 - DNA, 22 bp, Homo sapiens
tggaggatgcctggggaggcct

SEQ ID NO: 7711021 - DNA, 22 bp, Homo sapiens
tggaggatgcctggggaggcct

SEQ ID NO: 7711022 - DNA, 22 bp, Homo sapiens
tggaggatgcctggggaggcct

SEQ ID NO: 7711023 - DNA, 22 bp, Homo sapiens
tggaggattaatctggaaagat

SEQ ID NO: 7711024 - DNA, 22 bp, Homo sapiens
tggaggatgcctggggaggcct

SEQ ID NO: 7711025 - DNA, 22 bp, Homo sapiens
tggaggagtgtgattgtctgcc

SEQ ID NO: 7711026 - DNA, 22 bp, Homo sapiens
tggaggagtgtgattgtctgcc

SEQ ID NO: 7711027 - DNA, 22 bp, Homo sapiens
tggaggagtgtgattgtctgcc

SEQ ID NO: 7711028 - DNA, 22 bp, Homo sapiens
tggaggagtgtgattgtctgcc

SEQ ID NO: 7711029 - DNA, 22 bp, Homo sapiens
tggaggagtgtgattgtctgcc

SEQ ID NO: 7711030 - DNA, 22 bp, Homo sapiens
tggaggagtgtgattgtctgcc

SEQ ID NO: 7711031 - DNA, 22 bp, Homo sapiens
tggaggagtgtgattgtctgcc

SEQ ID NO: 7711032 - DNA, 22 bp, Homo sapiens
tggaggagtagattttcagagg

SEQ ID NO: 7711033 - DNA, 22 bp, Homo sapiens
tggaggagtagattttcagagg

SEQ ID NO: 7711034 - DNA, 22 bp, Homo sapiens
tggaggagggctggtgtctgta

SEQ ID NO: 7711035 - DNA, 22 bp, Homo sapiens
tggaggagggctggtgtctgta

SEQ ID NO: 7711036 - DNA, 22 bp, Homo sapiens
tggaggagggctggtgtctgta

SEQ ID NO: 7711037 - DNA, 22 bp, Homo sapiens
tggaggagggctggtgtctgta

SEQ ID NO: 7711038 - DNA, 22 bp, Homo sapiens
tggaggagggctggtgtctgta

SEQ ID NO: 7711039 - DNA, 22 bp, Homo sapiens
tggaggagggctggtgtctgta

SEQ ID NO: 7711040 - DNA, 22 bp, Homo sapiens
tggaggagggctggtgtctgta

SEQ ID NO: 7711041 - DNA, 22 bp, Homo sapiens
tggaggagggctggtgtctgta

SEQ ID NO: 7711042 - DNA, 22 bp, Homo sapiens
tggaggagggctggtgtctgta

SEQ ID NO: 7711043 - DNA, 22 bp, Homo sapiens
tggaggagaccattccactcag

SEQ ID NO: 7711044 - DNA, 22 bp, Homo sapiens
tggaggagaatttatggtcgaa

SEQ ID NO: 7711045 - DNA, 22 bp, Homo sapiens
tggaggagaccattccactcag

SEQ ID NO: 7711046 - DNA, 22 bp, Homo sapiens
tggaggagaccattccactcag

SEQ ID NO: 7711047 - DNA, 22 bp, Homo sapiens
tggaggagaccattccactcag

SEQ ID NO: 7711048 - DNA, 22 bp, Homo sapiens
tggaggagaatttatggtcgaa

SEQ ID NO: 7711049 - DNA, 22 bp, Homo sapiens
tggaggagaatttatggtcgaa

SEQ ID NO: 7711050 - DNA, 22 bp, Homo sapiens
tggaggagaatttatggtcgaa

SEQ ID NO: 7711051 - DNA, 22 bp, Homo sapiens
tggaggagaatttatggtcgaa

SEQ ID NO: 7711052 - DNA, 22 bp, Homo sapiens
tggaggagaatttatggtcgaa

SEQ ID NO: 7711053 - DNA, 22 bp, Homo sapiens
tggaggagaatttatggtcgaa

SEQ ID NO: 7711054 - DNA, 22 bp, Homo sapiens
tggaggaaaattactggggtct

SEQ ID NO: 7711055 - DNA, 18 bp, Homo sapiens
tggaggaaaaatctcatg

SEQ ID NO: 7711056 - DNA, 22 bp, Homo sapiens
tggaggaaaaaaccaggcagag

SEQ ID NO: 7711057 - DNA, 22 bp, Homo sapiens
tggaggaaaattactggggtct

SEQ ID NO: 7711058 - DNA, 22 bp, Homo sapiens
tggaggagaactccctggctac

SEQ ID NO: 7711059 - DNA, 22 bp, Homo sapiens
tggaggagaccgcattttattt

SEQ ID NO: 7711060 - DNA, 19 bp, Homo sapiens
tggaggagaggaaaagtca

SEQ ID NO: 7711061 - DNA, 19 bp, Homo sapiens
tggaggagaggaaaagtca

SEQ ID NO: 7711062 - DNA, 19 bp, Homo sapiens
tggaggagaggaaaagtca

SEQ ID NO: 7711063 - DNA, 19 bp, Homo sapiens
tggaggagaggaaaagtca

SEQ ID NO: 7711064 - DNA, 19 bp, Homo sapiens
tggaggagaggaaaagtca

SEQ ID NO: 7711065 - DNA, 22 bp, Homo sapiens
tggaggaggaacttcttatctc

SEQ ID NO: 7711066 - DNA, 19 bp, Homo sapiens
tggaggagaggaaaagtca

SEQ ID NO: 7711067 - DNA, 22 bp, Homo sapiens
tggaggaggaacttcttatctc

SEQ ID NO: 7711068 - DNA, 22 bp, Homo sapiens
tggaggaggaacttcttatctc

SEQ ID NO: 7711069 - DNA, 22 bp, Homo sapiens
tggaggagggctggtgtctgta

SEQ ID NO: 7711070 - DNA, 22 bp, Homo sapiens
tggaggaggatgcatttgttgt

SEQ ID NO: 7711071 - DNA, 22 bp, Homo sapiens
tggaggagggctggtgtctgta

SEQ ID NO: 7711072 - DNA, 22 bp, Homo sapiens
tggaggagggctggtgtctgta

SEQ ID NO: 7711073 - DNA, 18 bp, Homo sapiens
tggaggaaaaatctcatg

SEQ ID NO: 7711074 - DNA, 22 bp, Homo sapiens
tggaggaaaaaaccaggcagag

SEQ ID NO: 7711075 - DNA, 22 bp, Homo sapiens
tggaggaaaaaaccaggcagag

SEQ ID NO: 7711076 - DNA, 22 bp, Homo sapiens
tggaggaaaaaaccaggcagag

SEQ ID NO: 7711077 - DNA, 22 bp, Homo sapiens
tggaggaaaaaaccaggcagag

SEQ ID NO: 7711078 - DNA, 22 bp, Homo sapiens
tggaggaaaaaaccaggcagag

SEQ ID NO: 7711079 - DNA, 20 bp, Homo sapiens
tggagctgtggtaaggagca

SEQ ID NO: 7711080 - DNA, 20 bp, Homo sapiens
tggagctgtggtaaggagca

SEQ ID NO: 7711081 - DNA, 20 bp, Homo sapiens
tggagctgtggtaaggagca

SEQ ID NO: 7711082 - DNA, 20 bp, Homo sapiens
tggagctgtggtaaggagca

SEQ ID NO: 7711083 - DNA, 22 bp, Homo sapiens
tggagctgtcactcagaaccaa

SEQ ID NO: 7711084 - DNA, 22 bp, Homo sapiens
tggagctgtcactcagaaccaa

SEQ ID NO: 7711085 - DNA, 20 bp, Homo sapiens
tggagctgtaatcttgtctg

SEQ ID NO: 7711086 - DNA, 20 bp, Homo sapiens
tggagctgtaatcttgtctg

SEQ ID NO: 7711087 - DNA, 22 bp, Homo sapiens
tggagctgtagccaccaccctg

SEQ ID NO: 7711088 - DNA, 22 bp, Homo sapiens
tggagctggttctggggaagct

SEQ ID NO: 7711089 - DNA, 20 bp, Homo sapiens
tggagctgtaatcttgtctg

SEQ ID NO: 7711090 - DNA, 22 bp, Homo sapiens
tggagctggttctggggaagct

SEQ ID NO: 7711091 - DNA, 22 bp, Homo sapiens
tggagctggttctggggaagct

SEQ ID NO: 7711092 - DNA, 22 bp, Homo sapiens
tggagctggttctggggaagct

SEQ ID NO: 7711093 - DNA, 22 bp, Homo sapiens
tggagctggttctggggaagct

SEQ ID NO: 7711094 - DNA, 22 bp, Homo sapiens
tggagctggtaaacagtgacat

SEQ ID NO: 7711095 - DNA, 22 bp, Homo sapiens
tggagctggtaaacagtgacat

SEQ ID NO: 7711096 - DNA, 22 bp, Homo sapiens
tggagctggtaaacagtgacat

SEQ ID NO: 7711097 - DNA, 22 bp, Homo sapiens
tggagctggtaaacagtgacat

SEQ ID NO: 7711098 - DNA, 22 bp, Homo sapiens
tggagctggtaaacagtgacat

SEQ ID NO: 7711099 - DNA, 22 bp, Homo sapiens
tggagctggggtttgaatctgg

SEQ ID NO: 7711100 - DNA, 22 bp, Homo sapiens
tggagctggtaaacagtgacat

SEQ ID NO: 7711101 - DNA, 22 bp, Homo sapiens
tggagctggtaaacagtgacat

SEQ ID NO: 7711102 - DNA, 23 bp, Homo sapiens
tggagctgggctcagaccctggg

SEQ ID NO: 7711103 - DNA, 23 bp, Homo sapiens
tggagctgggctcagaccctggg

SEQ ID NO: 7711104 - DNA, 23 bp, Homo sapiens
tggagctgggctcagaccctggg

SEQ ID NO: 7711105 - DNA, 22 bp, Homo sapiens
tggagctgggatttgaactgca

SEQ ID NO: 7711106 - DNA, 22 bp, Homo sapiens
tggagctgggagtcctgggctg

SEQ ID NO: 7711107 - DNA, 22 bp, Homo sapiens
tggagctggcttgtggaagttg

SEQ ID NO: 7711108 - DNA, 22 bp, Homo sapiens
tggagctgggagtcctgggctg

SEQ ID NO: 7711109 - DNA, 22 bp, Homo sapiens
tggagctgggagtcctgggctg

SEQ ID NO: 7711110 - DNA, 23 bp, Homo sapiens
tggagctgggatttgatttgatt

SEQ ID NO: 7711111 - DNA, 23 bp, Homo sapiens
tggagctgggatttgatttgatt

SEQ ID NO: 7711112 - DNA, 22 bp, Homo sapiens
tggagctgggatttgaactgca

SEQ ID NO: 7711113 - DNA, 23 bp, Homo sapiens
tggagctgggcagctgggaaagt

SEQ ID NO: 7711114 - DNA, 23 bp, Homo sapiens
tggagctgggcagctgggaaagt

SEQ ID NO: 7711115 - DNA, 23 bp, Homo sapiens
tggagctgggcagctgggaaagt

SEQ ID NO: 7711116 - DNA, 22 bp, Homo sapiens
tggaggcagtaactgagcaaca

SEQ ID NO: 7711117 - DNA, 22 bp, Homo sapiens
tggaggcagtaactgagcaaca

SEQ ID NO: 7711118 - DNA, 22 bp, Homo sapiens
tggaggcagtaactgagcaaca

SEQ ID NO: 7711119 - DNA, 22 bp, Homo sapiens
tggaggcagtaactgagcaaca

SEQ ID NO: 7711120 - DNA, 22 bp, Homo sapiens
tggaggcagtaactgagcaaca

SEQ ID NO: 7711121 - DNA, 22 bp, Homo sapiens
tggaggcagtaactgagcaaca

SEQ ID NO: 7711122 - DNA, 22 bp, Homo sapiens
tggaggcaggttagccagacga

SEQ ID NO: 7711123 - DNA, 22 bp, Homo sapiens
tggaggcaggttagccagacga

SEQ ID NO: 7711124 - DNA, 22 bp, Homo sapiens
tggaggcaggttagccagacga

SEQ ID NO: 7711125 - DNA, 22 bp, Homo sapiens
tggaggcaggttagccagacga

SEQ ID NO: 7711126 - DNA, 22 bp, Homo sapiens
tggaggcaggttagccagacga

SEQ ID NO: 7711127 - DNA, 22 bp, Homo sapiens
tggaggcagtaactgagcaaca

SEQ ID NO: 7711128 - DNA, 22 bp, Homo sapiens
tggaggcagtcacctgaagtca

SEQ ID NO: 7711129 - DNA, 22 bp, Homo sapiens
tggaggcagtcacctgaagtca

SEQ ID NO: 7711130 - DNA, 22 bp, Homo sapiens
tggaggcagtcacctgaagtca

SEQ ID NO: 7711131 - DNA, 22 bp, Homo sapiens
tggaggcagtcacctgaagtca

SEQ ID NO: 7711132 - DNA, 22 bp, Homo sapiens
tggaggcagtcaaatgactgac

SEQ ID NO: 7711133 - DNA, 22 bp, Homo sapiens
tggaggcagtcacctgaagtca

SEQ ID NO: 7711134 - DNA, 22 bp, Homo sapiens
tggaggcagtcaaatgactgac

SEQ ID NO: 7711135 - DNA, 22 bp, Homo sapiens
tggaggcagtcaaatgactgac

SEQ ID NO: 7711136 - DNA, 22 bp, Homo sapiens
tggaggcagtcaaatgactgac

SEQ ID NO: 7711137 - DNA, 22 bp, Homo sapiens
tggaggcagtaactgagcaaca

SEQ ID NO: 7711138 - DNA, 22 bp, Homo sapiens
tggaggcagtcaaatgactgac

SEQ ID NO: 7711139 - DNA, 22 bp, Homo sapiens
tggaggcagtcaaatgactgac

SEQ ID NO: 7711140 - DNA, 22 bp, Homo sapiens
tggaggcagtcaaatgactgac

SEQ ID NO: 7711141 - DNA, 22 bp, Homo sapiens
tggaggccagtgaaagtagatt

SEQ ID NO: 7711142 - DNA, 22 bp, Homo sapiens
tggaggccatacctcctgacat

SEQ ID NO: 7711143 - DNA, 22 bp, Homo sapiens
tggaggccagtgaaagtagatt

SEQ ID NO: 7711144 - DNA, 22 bp, Homo sapiens
tggaggccagtgaaagtagatt

SEQ ID NO: 7711145 - DNA, 22 bp, Homo sapiens
tggaggccagtgaaagtagatt

SEQ ID NO: 7711146 - DNA, 22 bp, Homo sapiens
tggaggccagtgaaagtagatt

SEQ ID NO: 7711147 - DNA, 20 bp, Homo sapiens
tggaggccaggatactttgt

SEQ ID NO: 7711148 - DNA, 19 bp, Homo sapiens
tggaggccaggacacaggt

SEQ ID NO: 7711149 - DNA, 19 bp, Homo sapiens
tggaggccaggacacaggt

SEQ ID NO: 7711150 - DNA, 22 bp, Homo sapiens
tggaggcagtcacctgaagtca

SEQ ID NO: 7711151 - DNA, 22 bp, Homo sapiens
tggaggcccacactgggtagat

SEQ ID NO: 7711152 - DNA, 22 bp, Homo sapiens
tggaggcccaagattctacagc

SEQ ID NO: 7711153 - DNA, 22 bp, Homo sapiens
tggaggcccacactgggtagat

SEQ ID NO: 7711154 - DNA, 22 bp, Homo sapiens
tggaggcccacactgggtagat

SEQ ID NO: 7711155 - DNA, 22 bp, Homo sapiens
tggaggcccacactgggtagat

SEQ ID NO: 7711156 - DNA, 22 bp, Homo sapiens
tggaggccatgccagagcccta

SEQ ID NO: 7711157 - DNA, 22 bp, Homo sapiens
tggaggccatacctcctgacat

SEQ ID NO: 7711158 - DNA, 22 bp, Homo sapiens
tggaggccatgccagagcccta

SEQ ID NO: 7711159 - DNA, 22 bp, Homo sapiens
tggaggccatgccagagcccta

SEQ ID NO: 7711160 - DNA, 22 bp, Homo sapiens
tggaggcccaagattctacagc

SEQ ID NO: 7711161 - DNA, 22 bp, Homo sapiens
tggaggcccccaggcaacagca

SEQ ID NO: 7711162 - DNA, 22 bp, Homo sapiens
tggaggcccccaggcaacagca

SEQ ID NO: 7711163 - DNA, 22 bp, Homo sapiens
tggaggcccccaggcaacagca

SEQ ID NO: 7711164 - DNA, 22 bp, Homo sapiens
tggaggcccccaggcaacagca

SEQ ID NO: 7711165 - DNA, 22 bp, Homo sapiens
tggaggcccccaggcaacagca

SEQ ID NO: 7711166 - DNA, 22 bp, Homo sapiens
tggaggcccccaggcaacagca

SEQ ID NO: 7711167 - DNA, 22 bp, Homo sapiens
tggaggccctcattgtagaagt

SEQ ID NO: 7711168 - DNA, 22 bp, Homo sapiens
tggaggccctcattgtagaagt

SEQ ID NO: 7711169 - DNA, 22 bp, Homo sapiens
tggaggccctcattgtagaagt

SEQ ID NO: 7711170 - DNA, 22 bp, Homo sapiens
tggaggccctcattgtagaagt

SEQ ID NO: 7711171 - DNA, 22 bp, Homo sapiens
tggaggccgaattagagcgttg

SEQ ID NO: 7711172 - DNA, 22 bp, Homo sapiens
tggaggccgaattagagcgttg

SEQ ID NO: 7711173 - DNA, 22 bp, Homo sapiens
tggaggccgaattagagcgttg

SEQ ID NO: 7711174 - DNA, 22 bp, Homo sapiens
tggaggccgaattagagcgttg

SEQ ID NO: 7711175 - DNA, 22 bp, Homo sapiens
tggaggccgcgtagtctgagca

SEQ ID NO: 7711176 - DNA, 22 bp, Homo sapiens
tggaggccgcgtagtctgagca

SEQ ID NO: 7711177 - DNA, 22 bp, Homo sapiens
tggaggccgcgtagtctgagca

SEQ ID NO: 7711178 - DNA, 22 bp, Homo sapiens
tggaggccgcaatgcagtttcc

SEQ ID NO: 7711179 - DNA, 22 bp, Homo sapiens
tggaggccgcaatgcagtttcc

SEQ ID NO: 7711180 - DNA, 22 bp, Homo sapiens
tggaggccggactgagaggcat

SEQ ID NO: 7711181 - DNA, 22 bp, Homo sapiens
tggaggccgcgtagtctgagca

SEQ ID NO: 7711182 - DNA, 22 bp, Homo sapiens
tggaggccgcgtagtctgagca

SEQ ID NO: 7711183 - DNA, 22 bp, Homo sapiens
tggaggccgcgtagtctgagca

SEQ ID NO: 7711184 - DNA, 22 bp, Homo sapiens
tggaggcctaggttgatgtgtg

SEQ ID NO: 7711185 - DNA, 22 bp, Homo sapiens
tggaggccggactgagaggcat

SEQ ID NO: 7711186 - DNA, 22 bp, Homo sapiens
tggaggccggactgagaggcat

SEQ ID NO: 7711187 - DNA, 22 bp, Homo sapiens
tggaggccggactgagaggcat

SEQ ID NO: 7711188 - DNA, 22 bp, Homo sapiens
tggaggccggactgagaggcat

SEQ ID NO: 7711189 - DNA, 19 bp, Homo sapiens
tggaggcctcaggaaaaga

SEQ ID NO: 7711190 - DNA, 19 bp, Homo sapiens
tggaggcctcaggaaaaga

SEQ ID NO: 7711191 - DNA, 19 bp, Homo sapiens
tggaggcctcaggaaaaga

SEQ ID NO: 7711192 - DNA, 19 bp, Homo sapiens
tggaggcctcaggaaaaga

SEQ ID NO: 7711193 - DNA, 22 bp, Homo sapiens
tggaggcctaggttgatgtgtg

SEQ ID NO: 7711194 - DNA, 22 bp, Homo sapiens
tggaggcctaggttgatgtgtg

SEQ ID NO: 7711195 - DNA, 22 bp, Homo sapiens
tggaggcctaggttgatgtgtg

SEQ ID NO: 7711196 - DNA, 22 bp, Homo sapiens
tggaggcctaggttgatgtgtg

SEQ ID NO: 7711197 - DNA, 22 bp, Homo sapiens
tggaggctggagtgcagtggcg

SEQ ID NO: 7711198 - DNA, 22 bp, Homo sapiens
tggaggctggagtgcagtggcg

SEQ ID NO: 7711199 - DNA, 22 bp, Homo sapiens
tggaggctggagtgcagtggcg

SEQ ID NO: 7711200 - DNA, 22 bp, Homo sapiens
tggaggcgagagcgcgcgggct

SEQ ID NO: 7711201 - DNA, 22 bp, Homo sapiens
tggaggcctgggtgtgttgagc

SEQ ID NO: 7711202 - DNA, 22 bp, Homo sapiens
tggaggcctgggtgtgttgagc

SEQ ID NO: 7711203 - DNA, 22 bp, Homo sapiens
tggaggcctggtctctcttccc

SEQ ID NO: 7711204 - DNA, 22 bp, Homo sapiens
tggaggcctggactttaaggga

SEQ ID NO: 7711205 - DNA, 22 bp, Homo sapiens
tggaggcctggattattttgag

SEQ ID NO: 7711206 - DNA, 22 bp, Homo sapiens
tggaggcctcctcaaattttta

SEQ ID NO: 7711207 - DNA, 20 bp, Homo sapiens
tggaggcctgcaggtttggg

SEQ ID NO: 7711208 - DNA, 20 bp, Homo sapiens
tggaggcctgcaggtttggg

SEQ ID NO: 7711209 - DNA, 22 bp, Homo sapiens
tggaggcaggtggaggagtgaa

SEQ ID NO: 7711210 - DNA, 22 bp, Homo sapiens
tggaggcaggtggaggagtgaa

SEQ ID NO: 7711211 - DNA, 22 bp, Homo sapiens
tggaggcaggtggaggagtgaa

SEQ ID NO: 7711212 - DNA, 22 bp, Homo sapiens
tggaggcaggtggaggagtgaa

SEQ ID NO: 7711213 - DNA, 22 bp, Homo sapiens
tggaggcaggtggaggagtgaa

SEQ ID NO: 7711214 - DNA, 22 bp, Homo sapiens
tggaggcaggtggaggagtgaa

SEQ ID NO: 7711215 - DNA, 22 bp, Homo sapiens
tggaggcaggtggaggagtgaa

SEQ ID NO: 7711216 - DNA, 22 bp, Homo sapiens
tggaggcaggtggaggagtgaa

SEQ ID NO: 7711217 - DNA, 22 bp, Homo sapiens
tggaggcaggggatacaggtca

SEQ ID NO: 7711218 - DNA, 22 bp, Homo sapiens
tggaggcaggggatacaggtca

SEQ ID NO: 7711219 - DNA, 23 bp, Homo sapiens
tggaggcaggatgctaaggagtc

SEQ ID NO: 7711220 - DNA, 22 bp, Homo sapiens
tggaggcaggggatacaggtca

SEQ ID NO: 7711221 - DNA, 22 bp, Homo sapiens
tggaggcaggggatacaggtca

SEQ ID NO: 7711222 - DNA, 22 bp, Homo sapiens
tggaggcaggggatacaggtca

SEQ ID NO: 7711223 - DNA, 22 bp, Homo sapiens
tggaggcaggggatacaggtca

SEQ ID NO: 7711224 - DNA, 23 bp, Homo sapiens
tggaggcaggatgctaaggagtc

SEQ ID NO: 7711225 - DNA, 23 bp, Homo sapiens
tggaggcaggatgctaaggagtc

SEQ ID NO: 7711226 - DNA, 23 bp, Homo sapiens
tggaggcaggatgctaaggagtc

SEQ ID NO: 7711227 - DNA, 23 bp, Homo sapiens
tggaggcaggatgctaaggagtc

SEQ ID NO: 7711228 - DNA, 23 bp, Homo sapiens
tggaggcaggatgctaaggagtc

SEQ ID NO: 7711229 - DNA, 22 bp, Homo sapiens
tggaggcaggagacagggcaaa

SEQ ID NO: 7711230 - DNA, 22 bp, Homo sapiens
tggaggcagatacactgtaaaa

SEQ ID NO: 7711231 - DNA, 22 bp, Homo sapiens
tggaggcagatacactgtaaaa

SEQ ID NO: 7711232 - DNA, 22 bp, Homo sapiens
tggaggcagatacactgtaaaa

SEQ ID NO: 7711233 - DNA, 22 bp, Homo sapiens
tggaggcagatacactgtaaaa

SEQ ID NO: 7711234 - DNA, 18 bp, Homo sapiens
tggaggcagagttctggc

SEQ ID NO: 7711235 - DNA, 18 bp, Homo sapiens
tggaggcagagttctggc

SEQ ID NO: 7711236 - DNA, 18 bp, Homo sapiens
tggaggcagagttctggc

SEQ ID NO: 7711237 - DNA, 18 bp, Homo sapiens
tggaggcagagttctggc

SEQ ID NO: 7711238 - DNA, 22 bp, Homo sapiens
tggaggcaggagacagggcaaa

SEQ ID NO: 7711239 - DNA, 22 bp, Homo sapiens
tggaggcaggagacagggcaaa

SEQ ID NO: 7711240 - DNA, 22 bp, Homo sapiens
tggaggcaggagacagggcaaa

SEQ ID NO: 7711241 - DNA, 22 bp, Homo sapiens
tggaggcagccgtgaaccacct

SEQ ID NO: 7711242 - DNA, 22 bp, Homo sapiens
tggaggcagatacactgtaaaa

SEQ ID NO: 7711243 - DNA, 22 bp, Homo sapiens
tggaggcaggagacagggcaaa

SEQ ID NO: 7711244 - DNA, 22 bp, Homo sapiens
tggaggcaggagacagggcaaa

SEQ ID NO: 7711245 - DNA, 22 bp, Homo sapiens
tggaggcaggagacagggcaaa

SEQ ID NO: 7711246 - DNA, 22 bp, Homo sapiens
tggaggcaggagacagggcaaa

SEQ ID NO: 7711247 - DNA, 22 bp, Homo sapiens
tggaggcaggagacagggcaaa

SEQ ID NO: 7711248 - DNA, 19 bp, Homo sapiens
tggaggcaagacatggagg

SEQ ID NO: 7711249 - DNA, 19 bp, Homo sapiens
tggaggcaagacatggagg

SEQ ID NO: 7711250 - DNA, 19 bp, Homo sapiens
tggaggcaagacatggagg

SEQ ID NO: 7711251 - DNA, 19 bp, Homo sapiens
tggaggcaagacatggagg

SEQ ID NO: 7711252 - DNA, 22 bp, Homo sapiens
tggaggcaactgaagatgtagt

SEQ ID NO: 7711253 - DNA, 22 bp, Homo sapiens
tggaggcaccactggctgcccg

SEQ ID NO: 7711254 - DNA, 19 bp, Homo sapiens
tggaggcaagacatggagg

SEQ ID NO: 7711255 - DNA, 19 bp, Homo sapiens
tggaggcaagacatggagg

SEQ ID NO: 7711256 - DNA, 22 bp, Homo sapiens
tggaggcaccactggctgcccg

SEQ ID NO: 7711257 - DNA, 22 bp, Homo sapiens
tggaggcaccactggctgcccg

SEQ ID NO: 7711258 - DNA, 19 bp, Homo sapiens
tggaggcaagacatggagg

SEQ ID NO: 7711259 - DNA, 22 bp, Homo sapiens
tggaggcaccactggctgcccg

SEQ ID NO: 7711260 - DNA, 22 bp, Homo sapiens
tggaggcaccactggctgcccg

SEQ ID NO: 7711261 - DNA, 22 bp, Homo sapiens
tggaggcaccactggctgcccg

SEQ ID NO: 7711262 - DNA, 22 bp, Homo sapiens
tggaggcaccactggctgcccg

SEQ ID NO: 7711263 - DNA, 20 bp, Homo sapiens
tggaggcacctgtggagatc

SEQ ID NO: 7711264 - DNA, 20 bp, Homo sapiens
tggaggcacctgtggagatc

SEQ ID NO: 7711265 - DNA, 20 bp, Homo sapiens
tggaggcacctgtggagatc

SEQ ID NO: 7711266 - DNA, 20 bp, Homo sapiens
tggaggcacctgtggagatc

SEQ ID NO: 7711267 - DNA, 20 bp, Homo sapiens
tggaggcacctgtggagatc

SEQ ID NO: 7711268 - DNA, 22 bp, Homo sapiens
tggaggcaccactggctgcccg

SEQ ID NO: 7711269 - DNA, 22 bp, Homo sapiens
tggaggcactaaatggccacaa

SEQ ID NO: 7711270 - DNA, 22 bp, Homo sapiens
tggaggcactaaatggccacaa

SEQ ID NO: 7711271 - DNA, 20 bp, Homo sapiens
tggaggcacctgtggagatc

SEQ ID NO: 7711272 - DNA, 22 bp, Homo sapiens
tggaggcactaaatggccacaa

SEQ ID NO: 7711273 - DNA, 22 bp, Homo sapiens
tggaggcactaaatggccacaa

SEQ ID NO: 7711274 - DNA, 20 bp, Homo sapiens
tggaggcacctgtggagatc

SEQ ID NO: 7711275 - DNA, 20 bp, Homo sapiens
tggaggcacctgtggagatc

SEQ ID NO: 7711276 - DNA, 20 bp, Homo sapiens
tggaggcacctgtggagatc

SEQ ID NO: 7711277 - DNA, 20 bp, Homo sapiens
tggaggcacctgtggagatc

SEQ ID NO: 7711278 - DNA, 20 bp, Homo sapiens
tggaggcagagccagaggga

SEQ ID NO: 7711279 - DNA, 20 bp, Homo sapiens
tggaggcagagccagaggga

SEQ ID NO: 7711280 - DNA, 20 bp, Homo sapiens
tggaggcagagccagaggga

SEQ ID NO: 7711281 - DNA, 20 bp, Homo sapiens
tggaggcagagccagaggga

SEQ ID NO: 7711282 - DNA, 20 bp, Homo sapiens
tggaggcagagccagaggga

SEQ ID NO: 7711283 - DNA, 20 bp, Homo sapiens
tggaggcagagccagaggga

SEQ ID NO: 7711284 - DNA, 20 bp, Homo sapiens
tggaggcagagccagaggga

SEQ ID NO: 7711285 - DNA, 20 bp, Homo sapiens
tggaggcagagccagaggga

SEQ ID NO: 7711286 - DNA, 22 bp, Homo sapiens
tggaacacatctaaggaagcag

SEQ ID NO: 7711287 - DNA, 22 bp, Homo sapiens
tggaacacatctaaggaagcag

SEQ ID NO: 7711288 - DNA, 22 bp, Homo sapiens
tggaacacaggactatcagctg

SEQ ID NO: 7711289 - DNA, 22 bp, Homo sapiens
tggaacacagtgattgatagcg

SEQ ID NO: 7711290 - DNA, 22 bp, Homo sapiens
tggaacaattcttgaagggaat

SEQ ID NO: 7711291 - DNA, 22 bp, Homo sapiens
tggaacaattcttgaagggaat

SEQ ID NO: 7711292 - DNA, 22 bp, Homo sapiens
tggaacaatcccggtttagctc

SEQ ID NO: 7711293 - DNA, 22 bp, Homo sapiens
tggaacacaagtcattgagggg

SEQ ID NO: 7711294 - DNA, 22 bp, Homo sapiens
tggaacacacttcaaggagaaa

SEQ ID NO: 7711295 - DNA, 22 bp, Homo sapiens
tggaacacacttcaaggagaaa

SEQ ID NO: 7711296 - DNA, 22 bp, Homo sapiens
tggaacaccttgctccagaaag

SEQ ID NO: 7711297 - DNA, 22 bp, Homo sapiens
tggaacacatctcgctgcaggg

SEQ ID NO: 7711298 - DNA, 22 bp, Homo sapiens
tggaacactgatcattgccttt

SEQ ID NO: 7711299 - DNA, 22 bp, Homo sapiens
tggaacactgtggatgagaaga

SEQ ID NO: 7711300 - DNA, 22 bp, Homo sapiens
tggaacactgtggatgagaaga

SEQ ID NO: 7711301 - DNA, 22 bp, Homo sapiens
tggaacactttgttgaaatgca

SEQ ID NO: 7711302 - DNA, 22 bp, Homo sapiens
tggaaccatcaaagagatcctg

SEQ ID NO: 7711303 - DNA, 19 bp, Homo sapiens
tggaacctgtgccagggct

SEQ ID NO: 7711304 - DNA, 22 bp, Homo sapiens
tggaacctggcctgagctacca

SEQ ID NO: 7711305 - DNA, 22 bp, Homo sapiens
tggaacctggtgatgtacaagt

SEQ ID NO: 7711306 - DNA, 22 bp, Homo sapiens
tggaacactttcagtagctatt

SEQ ID NO: 7711307 - DNA, 22 bp, Homo sapiens
tggaacctggcattagggacac

SEQ ID NO: 7711308 - DNA, 22 bp, Homo sapiens
tggaacctggcctgagctacca

SEQ ID NO: 7711309 - DNA, 23 bp, Homo sapiens
tggaagaaaatggtttggctgtg

SEQ ID NO: 7711310 - DNA, 23 bp, Homo sapiens
tggaagaaaatggtttggctgtg

SEQ ID NO: 7711311 - DNA, 22 bp, Homo sapiens
tggaactaaggtagaaactatt

SEQ ID NO: 7711312 - DNA, 22 bp, Homo sapiens
tggaactaaggtagaaactatt

SEQ ID NO: 7711313 - DNA, 22 bp, Homo sapiens
tggaacgtcgtaatgttggtta

SEQ ID NO: 7711314 - DNA, 22 bp, Homo sapiens
tggaagaaaattcaatcgagtt

SEQ ID NO: 7711315 - DNA, 22 bp, Homo sapiens
tggaagaaaattcaatcgagtt

SEQ ID NO: 7711316 - DNA, 22 bp, Homo sapiens
tggaagaaaattcaatcgagtt

SEQ ID NO: 7711317 - DNA, 22 bp, Homo sapiens
tggaagaaaattcaatcgagtt

SEQ ID NO: 7711318 - DNA, 22 bp, Homo sapiens
tggaagaaaattcaatcgagtt

SEQ ID NO: 7711319 - DNA, 22 bp, Homo sapiens
tggaagaaaattcaatcgagtt

SEQ ID NO: 7711320 - DNA, 23 bp, Homo sapiens
tggaagaaaatggtttggctgtg

SEQ ID NO: 7711321 - DNA, 23 bp, Homo sapiens
tggaagaaaatggtttggctgtg

SEQ ID NO: 7711322 - DNA, 23 bp, Homo sapiens
tggaagaaaatggtttggctgtg

SEQ ID NO: 7711323 - DNA, 22 bp, Homo sapiens
tggaaattactaacacttagag

SEQ ID NO: 7711324 - DNA, 18 bp, Homo sapiens
tggaaattgaaacagaaa

SEQ ID NO: 7711325 - DNA, 22 bp, Homo sapiens
tggaaattgctattaccgatga

SEQ ID NO: 7711326 - DNA, 22 bp, Homo sapiens
tggaaattgctattaccgatga

SEQ ID NO: 7711327 - DNA, 22 bp, Homo sapiens
tggaaatttatcaagatataca

SEQ ID NO: 7711328 - DNA, 22 bp, Homo sapiens
tggaaatttattcatcattcat

SEQ ID NO: 7711329 - DNA, 22 bp, Homo sapiens
tggaaatttattcatcattcat

SEQ ID NO: 7711330 - DNA, 22 bp, Homo sapiens
tggaaatttatcaagatataca

SEQ ID NO: 7711331 - DNA, 22 bp, Homo sapiens
tggaacaaaatatttatgtttg

SEQ ID NO: 7711332 - DNA, 22 bp, Homo sapiens
tggaaattttgaacagtttcta

SEQ ID NO: 7711333 - DNA, 22 bp, Homo sapiens
tggaaattttgaacagtttcta

SEQ ID NO: 7711334 - DNA, 22 bp, Homo sapiens
tggaaatttattcatcattcat

SEQ ID NO: 7711335 - DNA, 22 bp, Homo sapiens
tggaaatggatctgatgagtct

SEQ ID NO: 7711336 - DNA, 22 bp, Homo sapiens
tggaaatggatctgatgagtct

SEQ ID NO: 7711337 - DNA, 22 bp, Homo sapiens
tggaaatggatctgatgagtct

SEQ ID NO: 7711338 - DNA, 22 bp, Homo sapiens
tggaaatgtttcttgagctcag

SEQ ID NO: 7711339 - DNA, 22 bp, Homo sapiens
tggaaatgtttcttgagctcag

SEQ ID NO: 7711340 - DNA, 22 bp, Homo sapiens
tggaaatgtcaaaacctctgat

SEQ ID NO: 7711341 - DNA, 22 bp, Homo sapiens
tggaaattaacttggtacatat

SEQ ID NO: 7711342 - DNA, 22 bp, Homo sapiens
tggaaattactaacacttagag

SEQ ID NO: 7711343 - DNA, 22 bp, Homo sapiens
tggaaattaaaattcctcttaa

SEQ ID NO: 7711344 - DNA, 22 bp, Homo sapiens
tggaaattaacttggtacatat

SEQ ID NO: 7711345 - DNA, 22 bp, Homo sapiens
tggaaatgtttcttgagctcag

SEQ ID NO: 7711346 - DNA, 22 bp, Homo sapiens
tggaaattaaaattcctcttaa

SEQ ID NO: 7711347 - DNA, 22 bp, Homo sapiens
tggaacaaattacaattaactt

SEQ ID NO: 7711348 - DNA, 22 bp, Homo sapiens
tggaacaaattacaattaactt

SEQ ID NO: 7711349 - DNA, 22 bp, Homo sapiens
tggaacaaattacaattaactt

SEQ ID NO: 7711350 - DNA, 22 bp, Homo sapiens
tggaacaaattttggggacctt

SEQ ID NO: 7711351 - DNA, 22 bp, Homo sapiens
tggaacaaattttggggacctt

SEQ ID NO: 7711352 - DNA, 22 bp, Homo sapiens
tggaacaacatgctggaaaatt

SEQ ID NO: 7711353 - DNA, 22 bp, Homo sapiens
tggaacaaaatatttatgtttg

SEQ ID NO: 7711354 - DNA, 22 bp, Homo sapiens
tggaacaaaatatttatgtttg

SEQ ID NO: 7711355 - DNA, 22 bp, Homo sapiens
tggaacaaacatggtgatggct

SEQ ID NO: 7711356 - DNA, 22 bp, Homo sapiens
tggaacaaacatggtgatggct

SEQ ID NO: 7711357 - DNA, 22 bp, Homo sapiens
tggaacaaacatggtgatggct

SEQ ID NO: 7711358 - DNA, 19 bp, Homo sapiens
tggaacaaactgcaatgac

SEQ ID NO: 7711359 - DNA, 19 bp, Homo sapiens
tggaacaaactgcaatgac

SEQ ID NO: 7711360 - DNA, 22 bp, Homo sapiens
tggaacaacatgctggaaaatt

SEQ ID NO: 7711361 - DNA, 22 bp, Homo sapiens
tggaacaacatgctggaaaatt

SEQ ID NO: 7711362 - DNA, 22 bp, Homo sapiens
tggaacaactccctcggagcct

SEQ ID NO: 7711363 - DNA, 22 bp, Homo sapiens
tggaacaactccctcggagcct

SEQ ID NO: 7711364 - DNA, 22 bp, Homo sapiens
tggaacaagaagcaggtcgctt

SEQ ID NO: 7711365 - DNA, 22 bp, Homo sapiens
tggaacaagaagcaggtcgctt

SEQ ID NO: 7711366 - DNA, 22 bp, Homo sapiens
tggaacaagacagcatagagct

SEQ ID NO: 7711367 - DNA, 22 bp, Homo sapiens
tggaacaagacagcatagagct

SEQ ID NO: 7711368 - DNA, 22 bp, Homo sapiens
tggaacaagacagcatagagct

SEQ ID NO: 7711369 - DNA, 22 bp, Homo sapiens
tggaacaagggcgtggcggtcg

SEQ ID NO: 7711370 - DNA, 22 bp, Homo sapiens
tggaacaagggcgtggcggtcg

SEQ ID NO: 7711371 - DNA, 22 bp, Homo sapiens
tggaacaagggttcatttaaat

SEQ ID NO: 7711372 - DNA, 22 bp, Homo sapiens
tggaacaagggttcatttaaat

SEQ ID NO: 7711373 - DNA, 22 bp, Homo sapiens
tggaacaagggttcatttaaat

SEQ ID NO: 7711374 - DNA, 22 bp, Homo sapiens
tggaacaatcccggtttagctc

SEQ ID NO: 7711375 - DNA, 22 bp, Homo sapiens
tggaaaggaggcttgtggaata

SEQ ID NO: 7711376 - DNA, 22 bp, Homo sapiens
tggaaaggaggcttgtggaata

SEQ ID NO: 7711377 - DNA, 22 bp, Homo sapiens
tggaaaggaggcttgtggaata

SEQ ID NO: 7711378 - DNA, 22 bp, Homo sapiens
tggaaaggaggcttgtggaata

SEQ ID NO: 7711379 - DNA, 22 bp, Homo sapiens
tggaaaggacagttgctgatag

SEQ ID NO: 7711380 - DNA, 22 bp, Homo sapiens
tggaaagggacttatgagttcc

SEQ ID NO: 7711381 - DNA, 22 bp, Homo sapiens
tggaaagggacttatgagttcc

SEQ ID NO: 7711382 - DNA, 22 bp, Homo sapiens
tggaaaggaggcttgtggaata

SEQ ID NO: 7711383 - DNA, 22 bp, Homo sapiens
tggaaagggacttatgagttcc

SEQ ID NO: 7711384 - DNA, 22 bp, Homo sapiens
tggaaaggacagttgctgatag

SEQ ID NO: 7711385 - DNA, 22 bp, Homo sapiens
tggaaaggacagttgctgatag

SEQ ID NO: 7711386 - DNA, 21 bp, Homo sapiens
tggaaagattcaaagaccagg

SEQ ID NO: 7711387 - DNA, 21 bp, Homo sapiens
tggaaagattcaaagaccagg

SEQ ID NO: 7711388 - DNA, 22 bp, Homo sapiens
tggaaagcgaggagttggcatt

SEQ ID NO: 7711389 - DNA, 22 bp, Homo sapiens
tggaaagcagttcttagaatcg

SEQ ID NO: 7711390 - DNA, 22 bp, Homo sapiens
tggaaatacaagaagtatgtca

SEQ ID NO: 7711391 - DNA, 22 bp, Homo sapiens
tggaaatacttgccataaaact

SEQ ID NO: 7711392 - DNA, 22 bp, Homo sapiens
tggaaatacaagaagtatgtca

SEQ ID NO: 7711393 - DNA, 22 bp, Homo sapiens
tggaaatacaagaagtatgtca

SEQ ID NO: 7711394 - DNA, 22 bp, Homo sapiens
tggaaagtgctctagactttct

SEQ ID NO: 7711395 - DNA, 22 bp, Homo sapiens
tggaaagtgctctagactttct

SEQ ID NO: 7711396 - DNA, 22 bp, Homo sapiens
tggaaagtttctgatttcctaa

SEQ ID NO: 7711397 - DNA, 22 bp, Homo sapiens
tggaaaggtgtaaagcagaacc

SEQ ID NO: 7711398 - DNA, 22 bp, Homo sapiens
tggaaaggtgtaaagcagaacc

SEQ ID NO: 7711399 - DNA, 22 bp, Homo sapiens
tggaaaggtgtaaagcagaacc

SEQ ID NO: 7711400 - DNA, 22 bp, Homo sapiens
tggaaaggtaggatttcaagac

SEQ ID NO: 7711401 - DNA, 22 bp, Homo sapiens
tggaaaggtaggatttcaagac

SEQ ID NO: 7711402 - DNA, 22 bp, Homo sapiens
tggaaaggtgtaaagcagaacc

SEQ ID NO: 7711403 - DNA, 22 bp, Homo sapiens
tggaaaggtgtaaagcagaacc

SEQ ID NO: 7711404 - DNA, 19 bp, Homo sapiens
tggaaagtaaccccagagt

SEQ ID NO: 7711405 - DNA, 22 bp, Homo sapiens
tggaaaggtgtaaagcagaacc

SEQ ID NO: 7711406 - DNA, 22 bp, Homo sapiens
tggaaagtgagacatatttata

SEQ ID NO: 7711407 - DNA, 22 bp, Homo sapiens
tggaaagtctcttttgactgta

SEQ ID NO: 7711408 - DNA, 22 bp, Homo sapiens
tggaaagtgagacatatttata

SEQ ID NO: 7711409 - DNA, 22 bp, Homo sapiens
tggaaagtctcttttgactgta

SEQ ID NO: 7711410 - DNA, 22 bp, Homo sapiens
tggaaatatacaatgtgtctct

SEQ ID NO: 7711411 - DNA, 22 bp, Homo sapiens
tggaaatagttgtgagtcaggc

SEQ ID NO: 7711412 - DNA, 22 bp, Homo sapiens
tggaaatagttgtgagtcaggc

SEQ ID NO: 7711413 - DNA, 22 bp, Homo sapiens
tggaaatatgctccattctttt

SEQ ID NO: 7711414 - DNA, 22 bp, Homo sapiens
tggaaatagctccagtttcatt

SEQ ID NO: 7711415 - DNA, 22 bp, Homo sapiens
tggaaatagctccagtttcatt

SEQ ID NO: 7711416 - DNA, 22 bp, Homo sapiens
tggaaatagctccagtttcatt

SEQ ID NO: 7711417 - DNA, 22 bp, Homo sapiens
tggaaatagatagtatcattca

SEQ ID NO: 7711418 - DNA, 22 bp, Homo sapiens
tggaaatacttgccataaaact

SEQ ID NO: 7711419 - DNA, 22 bp, Homo sapiens
tggaaatacttgccataaaact

SEQ ID NO: 7711420 - DNA, 22 bp, Homo sapiens
tggaaatacttgccataaaact

SEQ ID NO: 7711421 - DNA, 22 bp, Homo sapiens
tggaaatacttgccataaaact

SEQ ID NO: 7711422 - DNA, 22 bp, Homo sapiens
tggaaatagatagtatcattca

SEQ ID NO: 7711423 - DNA, 22 bp, Homo sapiens
tggaaatagatagtatcattca

SEQ ID NO: 7711424 - DNA, 22 bp, Homo sapiens
tggaaatagatagtatcattca

SEQ ID NO: 7711425 - DNA, 22 bp, Homo sapiens
tggaaatagctccagtttcatt

SEQ ID NO: 7711426 - DNA, 22 bp, Homo sapiens
tggaaatagctccagttaagca

SEQ ID NO: 7711427 - DNA, 22 bp, Homo sapiens
tggaaatagctccagttaagca

SEQ ID NO: 7711428 - DNA, 22 bp, Homo sapiens
tggaaatattgggtaatagttg

SEQ ID NO: 7711429 - DNA, 22 bp, Homo sapiens
tggaaatattgggtaatagttg

SEQ ID NO: 7711430 - DNA, 22 bp, Homo sapiens
tggaaatatttgctcattatct

SEQ ID NO: 7711431 - DNA, 22 bp, Homo sapiens
tggaaatatttgctcattatct

SEQ ID NO: 7711432 - DNA, 22 bp, Homo sapiens
tggaaatatttgctcattatct

SEQ ID NO: 7711433 - DNA, 22 bp, Homo sapiens
tggaaatggatctgatgagtct

SEQ ID NO: 7711434 - DNA, 19 bp, Homo sapiens
tggaaatggaagctcagcc

SEQ ID NO: 7711435 - DNA, 19 bp, Homo sapiens
tggaaatggaagctcagcc

SEQ ID NO: 7711436 - DNA, 19 bp, Homo sapiens
tggaaatggaagctcagcc

SEQ ID NO: 7711437 - DNA, 22 bp, Homo sapiens
tggaaatgcctggcttcctgaa

SEQ ID NO: 7711438 - DNA, 21 bp, Homo sapiens
tggaaatgagcgttcagcttt

SEQ ID NO: 7711439 - DNA, 19 bp, Homo sapiens
tggaaatggaagctcagcc

SEQ ID NO: 7711440 - DNA, 21 bp, Homo sapiens
tggaaatgagcgttcagcttt

SEQ ID NO: 7711441 - DNA, 22 bp, Homo sapiens
tggaaaaactgagacttagaca

SEQ ID NO: 7711442 - DNA, 22 bp, Homo sapiens
tggaaaaactgagacttagaca

SEQ ID NO: 7711443 - DNA, 22 bp, Homo sapiens
tggaaaaactgagacttagaca

SEQ ID NO: 7711444 - DNA, 22 bp, Homo sapiens
tggaaaaactgagacttagaca

SEQ ID NO: 7711445 - DNA, 22 bp, Homo sapiens
tggaaaaactgagacttagaca

SEQ ID NO: 7711446 - DNA, 21 bp, Homo sapiens
tggaaaaatgtggcctagtga

SEQ ID NO: 7711447 - DNA, 21 bp, Homo sapiens
tggaaaaatgtggcctagtga

SEQ ID NO: 7711448 - DNA, 21 bp, Homo sapiens
tggaaaaatgtggcctagtga

SEQ ID NO: 7711449 - DNA, 22 bp, Homo sapiens
tggaaaaactgagacttagaca

SEQ ID NO: 7711450 - DNA, 22 bp, Homo sapiens
tggaaaaactgagacttagaca

SEQ ID NO: 7711451 - DNA, 22 bp, Homo sapiens
tggaaaaactgagacttagaca

SEQ ID NO: 7711452 - DNA, 22 bp, Homo sapiens
tggaaaaaacccagactctaga

SEQ ID NO: 7711453 - DNA, 22 bp, Homo sapiens
tggaaaaaacccagactctaga

SEQ ID NO: 7711454 - DNA, 22 bp, Homo sapiens
tggaaaaaacccagactctaga

SEQ ID NO: 7711455 - DNA, 22 bp, Homo sapiens
tggaaaaaacccagactctaga

SEQ ID NO: 7711456 - DNA, 22 bp, Homo sapiens
tggaaaaaacccagactctaga

SEQ ID NO: 7711457 - DNA, 22 bp, Homo sapiens
tggaaaaaacccagactctaga

SEQ ID NO: 7711458 - DNA, 22 bp, Homo sapiens
tggaaaaaacccagactctaga

SEQ ID NO: 7711459 - DNA, 22 bp, Homo sapiens
tggaaaaaaattggctagcttc

SEQ ID NO: 7711460 - DNA, 22 bp, Homo sapiens
tggaaaaaaattggctagcttc

SEQ ID NO: 7711461 - DNA, 22 bp, Homo sapiens
tggaaaaaaattggctagcttc

SEQ ID NO: 7711462 - DNA, 22 bp, Homo sapiens
tggaaaaaaattggctagcttc

SEQ ID NO: 7711463 - DNA, 22 bp, Homo sapiens
tggaaaaaaattggctagcttc

SEQ ID NO: 7711464 - DNA, 22 bp, Homo sapiens
tggaaaaaaattggctagcttc

SEQ ID NO: 7711465 - DNA, 22 bp, Homo sapiens
tgcttttatttaatatcttgca

SEQ ID NO: 7711466 - DNA, 20 bp, Homo sapiens
tgcttttatacctataatga

SEQ ID NO: 7711467 - DNA, 20 bp, Homo sapiens
tgcttttatacctataatga

SEQ ID NO: 7711468 - DNA, 22 bp, Homo sapiens
tgcttttaggagattaaaatta

SEQ ID NO: 7711469 - DNA, 20 bp, Homo sapiens
tgcttttatacctataatga

SEQ ID NO: 7711470 - DNA, 22 bp, Homo sapiens
tgctttttagtactgtcttatt

SEQ ID NO: 7711471 - DNA, 22 bp, Homo sapiens
tgctttttagtactgtcttatt

SEQ ID NO: 7711472 - DNA, 22 bp, Homo sapiens
tgctttttagtactgtcttatt

SEQ ID NO: 7711473 - DNA, 22 bp, Homo sapiens
tgctttttagtactgtcttatt

SEQ ID NO: 7711474 - DNA, 22 bp, Homo sapiens
tgctttttagtactgtcttatt

SEQ ID NO: 7711475 - DNA, 22 bp, Homo sapiens
tgctttttagtactgtcttatt

SEQ ID NO: 7711476 - DNA, 22 bp, Homo sapiens
tgctttttgcaccctttgccgt

SEQ ID NO: 7711477 - DNA, 22 bp, Homo sapiens
tgctttttgcaccctttgccgt

SEQ ID NO: 7711478 - DNA, 22 bp, Homo sapiens
tgctttttgcaccctttgccgt

SEQ ID NO: 7711479 - DNA, 22 bp, Homo sapiens
tgctttgctttggagagccagc

SEQ ID NO: 7711480 - DNA, 22 bp, Homo sapiens
tgctttggatctatttgctgag

SEQ ID NO: 7711481 - DNA, 22 bp, Homo sapiens
tgctttggcccaacattgatgc

SEQ ID NO: 7711482 - DNA, 22 bp, Homo sapiens
tgctttggccactagaattcag

SEQ ID NO: 7711483 - DNA, 22 bp, Homo sapiens
tgctttggccactagaattcag

SEQ ID NO: 7711484 - DNA, 22 bp, Homo sapiens
tgctttggccactagaattcag

SEQ ID NO: 7711485 - DNA, 21 bp, Homo sapiens
tgctttgggaattctcagtct

SEQ ID NO: 7711486 - DNA, 22 bp, Homo sapiens
tgctttggctgacacgctcctg

SEQ ID NO: 7711487 - DNA, 22 bp, Homo sapiens
tgctttggcccaacattgatgc

SEQ ID NO: 7711488 - DNA, 22 bp, Homo sapiens
tgctttggctgacacgctcctg

SEQ ID NO: 7711489 - DNA, 22 bp, Homo sapiens
tgctttgggtttgactctcatg

SEQ ID NO: 7711490 - DNA, 22 bp, Homo sapiens
tgctttgggtttgactctcatg

SEQ ID NO: 7711491 - DNA, 22 bp, Homo sapiens
tgctttgggtctctctagtttc

SEQ ID NO: 7711492 - DNA, 22 bp, Homo sapiens
tgctttgggtttgactctcatg

SEQ ID NO: 7711493 - DNA, 22 bp, Homo sapiens
tgctttgggtttgactctcatg

SEQ ID NO: 7711494 - DNA, 22 bp, Homo sapiens
tgctttgtgacagattagtttt

SEQ ID NO: 7711495 - DNA, 22 bp, Homo sapiens
tgctttgggtttgactctcatg

SEQ ID NO: 7711496 - DNA, 22 bp, Homo sapiens
tgcttttagctagtaactagta

SEQ ID NO: 7711497 - DNA, 22 bp, Homo sapiens
tgcttttagctagtaactagta

SEQ ID NO: 7711498 - DNA, 22 bp, Homo sapiens
tgcttttaagaacaatgctgct

SEQ ID NO: 7711499 - DNA, 22 bp, Homo sapiens
tgcttttaagaacaatgctgct

SEQ ID NO: 7711500 - DNA, 22 bp, Homo sapiens
tgcttttaggagattaaaatta

SEQ ID NO: 7711501 - DNA, 22 bp, Homo sapiens
tgcttttagctagtaactagta

SEQ ID NO: 7711502 - DNA, 22 bp, Homo sapiens
tgcttttaggagattaaaatta

SEQ ID NO: 7711503 - DNA, 22 bp, Homo sapiens
tgcttttaggagattaaaatta

SEQ ID NO: 7711504 - DNA, 22 bp, Homo sapiens
tgcttttaggagattaaaatta

SEQ ID NO: 7711505 - DNA, 22 bp, Homo sapiens
tgcttttaggagattaaaatta

SEQ ID NO: 7711506 - DNA, 22 bp, Homo sapiens
tgcttttaggagattaaaatta

SEQ ID NO: 7711507 - DNA, 22 bp, Homo sapiens
tgctttgtgacagattagtttt

SEQ ID NO: 7711508 - DNA, 22 bp, Homo sapiens
tgctttgtgatatgctgtgtct

SEQ ID NO: 7711509 - DNA, 22 bp, Homo sapiens
tgctttgtgtacacaagaatca

SEQ ID NO: 7711510 - DNA, 22 bp, Homo sapiens
tgctttgtgtacacaagaatca

SEQ ID NO: 7711511 - DNA, 22 bp, Homo sapiens
tgcttttaagaacaatgctgct

SEQ ID NO: 7711512 - DNA, 22 bp, Homo sapiens
tgctttgtgtttgaatagataa

SEQ ID NO: 7711513 - DNA, 22 bp, Homo sapiens
tgctttgtgtacacaagaatca

SEQ ID NO: 7711514 - DNA, 22 bp, Homo sapiens
tgctttgtgtttgaatagataa

SEQ ID NO: 7711515 - DNA, 22 bp, Homo sapiens
tgctttgtgtttgaatagataa

SEQ ID NO: 7711516 - DNA, 22 bp, Homo sapiens
tgctttgtgtttgaatagataa

SEQ ID NO: 7711517 - DNA, 22 bp, Homo sapiens
tgctttgtgtttgaatagataa

SEQ ID NO: 7711518 - DNA, 22 bp, Homo sapiens
tggaaacaaagtcataagctca

SEQ ID NO: 7711519 - DNA, 22 bp, Homo sapiens
tggaaacaaagtcataagctca

SEQ ID NO: 7711520 - DNA, 22 bp, Homo sapiens
tggaaacaaagtcataagctca

SEQ ID NO: 7711521 - DNA, 22 bp, Homo sapiens
tggaaacaaagtcataagctca

SEQ ID NO: 7711522 - DNA, 22 bp, Homo sapiens
tggaaacaaagctggatgtagt

SEQ ID NO: 7711523 - DNA, 17 bp, Homo sapiens
tggaaacaaaacttatt

SEQ ID NO: 7711524 - DNA, 22 bp, Homo sapiens
tggaaaattagtagtgaaaggc

SEQ ID NO: 7711525 - DNA, 22 bp, Homo sapiens
tggaaaatgtgactattctaaa

SEQ ID NO: 7711526 - DNA, 22 bp, Homo sapiens
tggaaaatgtgactattctaaa

SEQ ID NO: 7711527 - DNA, 22 bp, Homo sapiens
tggaaaatgtgactattctaaa

SEQ ID NO: 7711528 - DNA, 19 bp, Homo sapiens
tggaaaatggattgaatca

SEQ ID NO: 7711529 - DNA, 22 bp, Homo sapiens
tggaaaattagtagtgaaaggc

SEQ ID NO: 7711530 - DNA, 22 bp, Homo sapiens
tggaaaatgtgactattctaaa

SEQ ID NO: 7711531 - DNA, 22 bp, Homo sapiens
tggaaaattagtagtgaaaggc

SEQ ID NO: 7711532 - DNA, 22 bp, Homo sapiens
tggaaaatcaggggacattgat

SEQ ID NO: 7711533 - DNA, 22 bp, Homo sapiens
tggaaaatatttaggtgaatga

SEQ ID NO: 7711534 - DNA, 22 bp, Homo sapiens
tggaaaatatttaggtgaatga

SEQ ID NO: 7711535 - DNA, 22 bp, Homo sapiens
tggaaaatcaggggacattgat

SEQ ID NO: 7711536 - DNA, 22 bp, Homo sapiens
tggaaaatcaggggacattgat

SEQ ID NO: 7711537 - DNA, 19 bp, Homo sapiens
tggaaaatggattgaatca

SEQ ID NO: 7711538 - DNA, 22 bp, Homo sapiens
tggaaaacatgcacattggatt

SEQ ID NO: 7711539 - DNA, 22 bp, Homo sapiens
tggaaaacaatgatttgggcaa

SEQ ID NO: 7711540 - DNA, 22 bp, Homo sapiens
tggaaaacaatgatttgggcaa

SEQ ID NO: 7711541 - DNA, 22 bp, Homo sapiens
tggaaaacaaagctctcattat

SEQ ID NO: 7711542 - DNA, 22 bp, Homo sapiens
tggaaaaccagaccgcgttggg

SEQ ID NO: 7711543 - DNA, 21 bp, Homo sapiens
tggaaaacatttaaatagcaa

SEQ ID NO: 7711544 - DNA, 21 bp, Homo sapiens
tggaaaacatttaaatagcaa

SEQ ID NO: 7711545 - DNA, 22 bp, Homo sapiens
tggaaacatctctgcctttatt

SEQ ID NO: 7711546 - DNA, 22 bp, Homo sapiens
tggaaacatctctgcctttatt

SEQ ID NO: 7711547 - DNA, 22 bp, Homo sapiens
tggaaagagaaactcttgctaa

SEQ ID NO: 7711548 - DNA, 22 bp, Homo sapiens
tggaaagagatgttgtttctga

SEQ ID NO: 7711549 - DNA, 22 bp, Homo sapiens
tggaaagagatgttgtttctga

SEQ ID NO: 7711550 - DNA, 22 bp, Homo sapiens
tggaaagaggtagaggatctgg

SEQ ID NO: 7711551 - DNA, 22 bp, Homo sapiens
tggaaagaggtagaggatctgg

SEQ ID NO: 7711552 - DNA, 22 bp, Homo sapiens
tggaaagaggaagtgcccagca

SEQ ID NO: 7711553 - DNA, 22 bp, Homo sapiens
tggaaagaggaagtgcccagca

SEQ ID NO: 7711554 - DNA, 22 bp, Homo sapiens
tggaaagagatgttgtttctga

SEQ ID NO: 7711555 - DNA, 22 bp, Homo sapiens
tggaaagaggaagtgcccagca

SEQ ID NO: 7711556 - DNA, 22 bp, Homo sapiens
tggaaagaggaagtgcccagca

SEQ ID NO: 7711557 - DNA, 22 bp, Homo sapiens
tggaaagatgaagatgtttaag

SEQ ID NO: 7711558 - DNA, 22 bp, Homo sapiens
tggaaagatgaagatgtttaag

SEQ ID NO: 7711559 - DNA, 21 bp, Homo sapiens
tggaaagattcaaagaccagg

SEQ ID NO: 7711560 - DNA, 21 bp, Homo sapiens
tggaaagattcaaagaccagg

SEQ ID NO: 7711561 - DNA, 21 bp, Homo sapiens
tggaaagattcaaagaccagg

SEQ ID NO: 7711562 - DNA, 22 bp, Homo sapiens
tggaaagatgaagatgtttaag

SEQ ID NO: 7711563 - DNA, 22 bp, Homo sapiens
tggaaagatgaagatgtttaag

SEQ ID NO: 7711564 - DNA, 22 bp, Homo sapiens
tggaaagaggtagaggatctgg

SEQ ID NO: 7711565 - DNA, 22 bp, Homo sapiens
tggaaagaggtagaggatctgg

SEQ ID NO: 7711566 - DNA, 22 bp, Homo sapiens
tggaaagaggtagaggatctgg

SEQ ID NO: 7711567 - DNA, 22 bp, Homo sapiens
tggaaacactgcatgttcaccc

SEQ ID NO: 7711568 - DNA, 22 bp, Homo sapiens
tggaaacactgcatgttcaccc

SEQ ID NO: 7711569 - DNA, 22 bp, Homo sapiens
tggaaacagatcataactaagc

SEQ ID NO: 7711570 - DNA, 22 bp, Homo sapiens
tggaaacagatcataactaagc

SEQ ID NO: 7711571 - DNA, 22 bp, Homo sapiens
tggaaacaggagaatatcttct

SEQ ID NO: 7711572 - DNA, 21 bp, Homo sapiens
tggaaacagcgccatctgccg

SEQ ID NO: 7711573 - DNA, 21 bp, Homo sapiens
tggaaacagcgccatctgccg

SEQ ID NO: 7711574 - DNA, 21 bp, Homo sapiens
tggaaacagcgccatctgccg

SEQ ID NO: 7711575 - DNA, 22 bp, Homo sapiens
tggaaacaggagaatatcttct

SEQ ID NO: 7711576 - DNA, 22 bp, Homo sapiens
tggaaacaggagaatatcttct

SEQ ID NO: 7711577 - DNA, 22 bp, Homo sapiens
tggaaacactcaagcttatatt

SEQ ID NO: 7711578 - DNA, 22 bp, Homo sapiens
tggaaacactcaagcttatatt

SEQ ID NO: 7711579 - DNA, 22 bp, Homo sapiens
tggaaacactcaagcttatatt

SEQ ID NO: 7711580 - DNA, 22 bp, Homo sapiens
tggaaacactgcatgttcaccc

SEQ ID NO: 7711581 - DNA, 22 bp, Homo sapiens
tggaaacactgcatgttcaccc

SEQ ID NO: 7711582 - DNA, 22 bp, Homo sapiens
tggaaacacccacgcatgcata

SEQ ID NO: 7711583 - DNA, 22 bp, Homo sapiens
tggaaacacccacgcatgcata

SEQ ID NO: 7711584 - DNA, 22 bp, Homo sapiens
tggaaacacccacgcatgcata

SEQ ID NO: 7711585 - DNA, 22 bp, Homo sapiens
tggaaacactcaagcttatatt

SEQ ID NO: 7711586 - DNA, 22 bp, Homo sapiens
tgctttctgctcttgtccacac

SEQ ID NO: 7711587 - DNA, 22 bp, Homo sapiens
tgctttctgtttttcatataat

SEQ ID NO: 7711588 - DNA, 22 bp, Homo sapiens
tgctttctgtttttcatataat

SEQ ID NO: 7711589 - DNA, 22 bp, Homo sapiens
tgctttctgtttttcatataat

SEQ ID NO: 7711590 - DNA, 22 bp, Homo sapiens
tgctttctttagctcctgagtc

SEQ ID NO: 7711591 - DNA, 22 bp, Homo sapiens
tgctttctttagctcctgagtc

SEQ ID NO: 7711592 - DNA, 17 bp, Homo sapiens
tgctttcttcctgccct

SEQ ID NO: 7711593 - DNA, 22 bp, Homo sapiens
tgctttctttagctcctgagtc

SEQ ID NO: 7711594 - DNA, 22 bp, Homo sapiens
tgctttgctctcactgtaaggt

SEQ ID NO: 7711595 - DNA, 19 bp, Homo sapiens
tgctttgccttgattagct

SEQ ID NO: 7711596 - DNA, 22 bp, Homo sapiens
tgctttgcaaataatagaatgt

SEQ ID NO: 7711597 - DNA, 22 bp, Homo sapiens
tgctttgcaaataatagaatgt

SEQ ID NO: 7711598 - DNA, 22 bp, Homo sapiens
tgctttgcaaaagaacatagtg

SEQ ID NO: 7711599 - DNA, 20 bp, Homo sapiens
tgctttgatggaaatacagc

SEQ ID NO: 7711600 - DNA, 22 bp, Homo sapiens
tgctttgcacatagaagctcag

SEQ ID NO: 7711601 - DNA, 22 bp, Homo sapiens
tgctttgacagggatgacatga

SEQ ID NO: 7711602 - DNA, 22 bp, Homo sapiens
tgctttgacagggatgacatga

SEQ ID NO: 7711603 - DNA, 22 bp, Homo sapiens
tgctttgaaagataatactgtc

SEQ ID NO: 7711604 - DNA, 22 bp, Homo sapiens
tgctttgaaagataatactgtc

SEQ ID NO: 7711605 - DNA, 22 bp, Homo sapiens
tgctttgaaagataatactgtc

SEQ ID NO: 7711606 - DNA, 22 bp, Homo sapiens
tgctttgacagggatgacatga

SEQ ID NO: 7711607 - DNA, 20 bp, Homo sapiens
tgctttgatggaaatacagc

SEQ ID NO: 7711608 - DNA, 20 bp, Homo sapiens
tgctttgatggaaatacagc

SEQ ID NO: 7711609 - DNA, 20 bp, Homo sapiens
tgctttgatggaaatacagc

SEQ ID NO: 7711610 - DNA, 20 bp, Homo sapiens
tgctttgatggaaatacagc

SEQ ID NO: 7711611 - DNA, 20 bp, Homo sapiens
tgctttgatggaaatacagc

SEQ ID NO: 7711612 - DNA, 22 bp, Homo sapiens
tgctttattcagggtttacccc

SEQ ID NO: 7711613 - DNA, 22 bp, Homo sapiens
tgctttattcagggtttacccc

SEQ ID NO: 7711614 - DNA, 22 bp, Homo sapiens
tgctttattcagtctctgccat

SEQ ID NO: 7711615 - DNA, 22 bp, Homo sapiens
tgctttatgttatcagaagggt

SEQ ID NO: 7711616 - DNA, 22 bp, Homo sapiens
tgctttatgttatcagaagggt

SEQ ID NO: 7711617 - DNA, 22 bp, Homo sapiens
tgctttatgttatcagaagggt

SEQ ID NO: 7711618 - DNA, 22 bp, Homo sapiens
tgctttattaagagagaaattt

SEQ ID NO: 7711619 - DNA, 22 bp, Homo sapiens
tgctttattaagagagaaattt

SEQ ID NO: 7711620 - DNA, 22 bp, Homo sapiens
tgctttattaagagagaaattt

SEQ ID NO: 7711621 - DNA, 21 bp, Homo sapiens
tgctttctaaaaatactattg

SEQ ID NO: 7711622 - DNA, 22 bp, Homo sapiens
tgctttattcccttctgatgtg

SEQ ID NO: 7711623 - DNA, 19 bp, Homo sapiens
tgctttctaaacacatgca

SEQ ID NO: 7711624 - DNA, 22 bp, Homo sapiens
tgctttctctctaccccacttt

SEQ ID NO: 7711625 - DNA, 22 bp, Homo sapiens
tgctttctcctgtctgaaagat

SEQ ID NO: 7711626 - DNA, 22 bp, Homo sapiens
tgctttattcagtctctgccat

SEQ ID NO: 7711627 - DNA, 22 bp, Homo sapiens
tgctttattcccttctgatgtg

SEQ ID NO: 7711628 - DNA, 22 bp, Homo sapiens
tgctttattcccttctgatgtg

SEQ ID NO: 7711629 - DNA, 22 bp, Homo sapiens
tgctttattcccttctgatgtg

SEQ ID NO: 7711630 - DNA, 22 bp, Homo sapiens
tgctttattcccttctgatgtg

SEQ ID NO: 7711631 - DNA, 22 bp, Homo sapiens
tgctttattcgacatctggtag

SEQ ID NO: 7711632 - DNA, 22 bp, Homo sapiens
tgctttattcgacatctggtag

SEQ ID NO: 7711633 - DNA, 22 bp, Homo sapiens
tgctttattcgacatctggtag

SEQ ID NO: 7711634 - DNA, 22 bp, Homo sapiens
tgctttataggggattgcaggc

SEQ ID NO: 7711635 - DNA, 22 bp, Homo sapiens
tgctttataggggattgcaggc

SEQ ID NO: 7711636 - DNA, 22 bp, Homo sapiens
tgctttataggggattgcaggc

SEQ ID NO: 7711637 - DNA, 22 bp, Homo sapiens
tgctttatagacaaggaagtag

SEQ ID NO: 7711638 - DNA, 22 bp, Homo sapiens
tgctttatagacaaggaagtag

SEQ ID NO: 7711639 - DNA, 22 bp, Homo sapiens
tgctttatagacaaggaagtag

SEQ ID NO: 7711640 - DNA, 22 bp, Homo sapiens
tgctttataacttagtttatgg

SEQ ID NO: 7711641 - DNA, 22 bp, Homo sapiens
tgctttataacttagtttatgg

SEQ ID NO: 7711642 - DNA, 22 bp, Homo sapiens
tgctttataaccatttctgtgg

SEQ ID NO: 7711643 - DNA, 22 bp, Homo sapiens
tgctttataacttagtttatgg

SEQ ID NO: 7711644 - DNA, 22 bp, Homo sapiens
tgctttataacttagtttatgg

SEQ ID NO: 7711645 - DNA, 22 bp, Homo sapiens
tgctttatctgtgagaacctga

SEQ ID NO: 7711646 - DNA, 22 bp, Homo sapiens
tgctttatctgtgagaacctga

SEQ ID NO: 7711647 - DNA, 22 bp, Homo sapiens
tgctttatctgtgagaacctga

SEQ ID NO: 7711648 - DNA, 22 bp, Homo sapiens
tgctttatctgacttggcgctg

SEQ ID NO: 7711649 - DNA, 22 bp, Homo sapiens
tgctttatctgacttggcgctg

SEQ ID NO: 7711650 - DNA, 22 bp, Homo sapiens
tgctttatctgacttggcgctg

SEQ ID NO: 7711651 - DNA, 22 bp, Homo sapiens
tgctttatatctctcttcttag

SEQ ID NO: 7711652 - DNA, 22 bp, Homo sapiens
tgctttatatctctcttcttag

SEQ ID NO: 7711653 - DNA, 22 bp, Homo sapiens
tgctttatcaaagctatagtga

SEQ ID NO: 7711654 - DNA, 22 bp, Homo sapiens
tgctttatcaaagctatagtga

SEQ ID NO: 7711655 - DNA, 22 bp, Homo sapiens
tgctttatcaaagctatagtga

SEQ ID NO: 7711656 - DNA, 22 bp, Homo sapiens
tgctttatcaaagctatagtga

SEQ ID NO: 7711657 - DNA, 22 bp, Homo sapiens
tgctttatcaaagctatagtga

SEQ ID NO: 7711658 - DNA, 22 bp, Homo sapiens
tgctttatcaaagctatagtga

SEQ ID NO: 7711659 - DNA, 22 bp, Homo sapiens
tgctttatcaaagctatagtga

SEQ ID NO: 7711660 - DNA, 20 bp, Homo sapiens
tgctttatgctatactttgt

SEQ ID NO: 7711661 - DNA, 18 bp, Homo sapiens
tgctttatgcttatataa

SEQ ID NO: 7711662 - DNA, 18 bp, Homo sapiens
tgctttatgcttatataa

SEQ ID NO: 7711663 - DNA, 18 bp, Homo sapiens
tgctttatgcttatataa

SEQ ID NO: 7711664 - DNA, 18 bp, Homo sapiens
tgctttatgcttatataa

SEQ ID NO: 7711665 - DNA, 20 bp, Homo sapiens
tgctttatgctatactttgt

SEQ ID NO: 7711666 - DNA, 20 bp, Homo sapiens
tgctttatgctatactttgt

SEQ ID NO: 7711667 - DNA, 20 bp, Homo sapiens
tgctttatgctatactttgt

SEQ ID NO: 7711668 - DNA, 22 bp, Homo sapiens
tgctttatggagcccatctcat

SEQ ID NO: 7711669 - DNA, 18 bp, Homo sapiens
tgctttatgcttatataa

SEQ ID NO: 7711670 - DNA, 18 bp, Homo sapiens
tgctttatgcttatataa

SEQ ID NO: 7711671 - DNA, 22 bp, Homo sapiens
tgctttatggatttgtgtcctg

SEQ ID NO: 7711672 - DNA, 22 bp, Homo sapiens
tgctttatggagcccatctcat

SEQ ID NO: 7711673 - DNA, 22 bp, Homo sapiens
tgctttatggagcccatctcat

SEQ ID NO: 7711674 - DNA, 22 bp, Homo sapiens
tgctttatgtggctgatactca

SEQ ID NO: 7711675 - DNA, 22 bp, Homo sapiens
tgctttatgtggctgatactca

SEQ ID NO: 7711676 - DNA, 22 bp, Homo sapiens
tgctttatgttatcagaagggt

SEQ ID NO: 7711677 - DNA, 22 bp, Homo sapiens
tgctttatgttatcagaagggt

SEQ ID NO: 7711678 - DNA, 22 bp, Homo sapiens
tgctttatgtggctgatactca

SEQ ID NO: 7711679 - DNA, 22 bp, Homo sapiens
tgctttatgtggctgatactca

SEQ ID NO: 7711680 - DNA, 22 bp, Homo sapiens
tgctttatgtggctgatactca

SEQ ID NO: 7711681 - DNA, 21 bp, Homo sapiens
tgctttatgggaaaaatgtca

SEQ ID NO: 7711682 - DNA, 21 bp, Homo sapiens
tgctttatgggaaaaatgtca

SEQ ID NO: 7711683 - DNA, 22 bp, Homo sapiens
tgctttatggatttgtgtcctg

SEQ ID NO: 7711684 - DNA, 21 bp, Homo sapiens
tgctttatgggaaaaatgtca

SEQ ID NO: 7711685 - DNA, 21 bp, Homo sapiens
tgctttatgggaaaaatgtca

SEQ ID NO: 7711686 - DNA, 22 bp, Homo sapiens
tgcttctttaaatgatagtcaa

SEQ ID NO: 7711687 - DNA, 22 bp, Homo sapiens
tgcttctttaaatgatagtcaa

SEQ ID NO: 7711688 - DNA, 22 bp, Homo sapiens
tgcttctttaaatgatagtcaa

SEQ ID NO: 7711689 - DNA, 22 bp, Homo sapiens
tgcttctttactataggcaatt

SEQ ID NO: 7711690 - DNA, 22 bp, Homo sapiens
tgcttctttactataggcaatt

SEQ ID NO: 7711691 - DNA, 22 bp, Homo sapiens
tgcttctttactataggcaatt

SEQ ID NO: 7711692 - DNA, 22 bp, Homo sapiens
tgcttctttatgatgtatgatt

SEQ ID NO: 7711693 - DNA, 22 bp, Homo sapiens
tgcttctttatgatgtatgatt

SEQ ID NO: 7711694 - DNA, 22 bp, Homo sapiens
tgcttctttatgatgtatgatt

SEQ ID NO: 7711695 - DNA, 22 bp, Homo sapiens
tgcttctttatgatgtatgatt

SEQ ID NO: 7711696 - DNA, 16 bp, Homo sapiens
tgcttcttttgcatca

SEQ ID NO: 7711697 - DNA, 22 bp, Homo sapiens
tgcttcttcctccatgtgttct

SEQ ID NO: 7711698 - DNA, 22 bp, Homo sapiens
tgcttcttcctccatgtgttct

SEQ ID NO: 7711699 - DNA, 22 bp, Homo sapiens
tgcttctgtttgtttctgtcat

SEQ ID NO: 7711700 - DNA, 22 bp, Homo sapiens
tgcttcttactcatatgctgat

SEQ ID NO: 7711701 - DNA, 22 bp, Homo sapiens
tgcttcttactcatatgctgat

SEQ ID NO: 7711702 - DNA, 22 bp, Homo sapiens
tgcttcttactcatatgctgat

SEQ ID NO: 7711703 - DNA, 22 bp, Homo sapiens
tgcttctgtttcattgatctta

SEQ ID NO: 7711704 - DNA, 22 bp, Homo sapiens
tgcttctgttctttcacctacg

SEQ ID NO: 7711705 - DNA, 22 bp, Homo sapiens
tgcttctgttctttcacctacg

SEQ ID NO: 7711706 - DNA, 22 bp, Homo sapiens
tgcttctgttctttcacctacg

SEQ ID NO: 7711707 - DNA, 22 bp, Homo sapiens
tgcttctgttacataccagaac

SEQ ID NO: 7711708 - DNA, 22 bp, Homo sapiens
tgcttctgttacataccagaac

SEQ ID NO: 7711709 - DNA, 22 bp, Homo sapiens
tgcttctgtctcttatgccttg

SEQ ID NO: 7711710 - DNA, 17 bp, Homo sapiens
tgcttctgtattgctgg

SEQ ID NO: 7711711 - DNA, 22 bp, Homo sapiens
tgcttctgtattttgggcttga

SEQ ID NO: 7711712 - DNA, 22 bp, Homo sapiens
tgcttctgtattttgggcttga

SEQ ID NO: 7711713 - DNA, 22 bp, Homo sapiens
tgcttctgggtcccagcctggc

SEQ ID NO: 7711714 - DNA, 22 bp, Homo sapiens
tgcttctgggtcccagcctggc

SEQ ID NO: 7711715 - DNA, 22 bp, Homo sapiens
tgcttctgggtaggcctcagga

SEQ ID NO: 7711716 - DNA, 22 bp, Homo sapiens
tgcttctgggtcccagcctggc

SEQ ID NO: 7711717 - DNA, 22 bp, Homo sapiens
tgcttctgctgatattttgtga

SEQ ID NO: 7711718 - DNA, 22 bp, Homo sapiens
tgcttctggaaacagtggctgt

SEQ ID NO: 7711719 - DNA, 22 bp, Homo sapiens
tgcttctggaaacagtggctgt

SEQ ID NO: 7711720 - DNA, 19 bp, Homo sapiens
tgcttctggaaccatgatc

SEQ ID NO: 7711721 - DNA, 22 bp, Homo sapiens
tgcttctggaaacagtggctgt

SEQ ID NO: 7711722 - DNA, 22 bp, Homo sapiens
tgcttctggagtaacagggtga

SEQ ID NO: 7711723 - DNA, 22 bp, Homo sapiens
tgcttctggagtaacagggtga

SEQ ID NO: 7711724 - DNA, 19 bp, Homo sapiens
tgcttctggaatgcaaggc

SEQ ID NO: 7711725 - DNA, 19 bp, Homo sapiens
tgcttctggaatgcaaggc

SEQ ID NO: 7711726 - DNA, 22 bp, Homo sapiens
tgcttctgctttacttggttca

SEQ ID NO: 7711727 - DNA, 19 bp, Homo sapiens
tgcttctggaatgcaaggc

SEQ ID NO: 7711728 - DNA, 22 bp, Homo sapiens
tgcttctggagtaacagggtga

SEQ ID NO: 7711729 - DNA, 22 bp, Homo sapiens
tgcttctggcacttgagggggt

SEQ ID NO: 7711730 - DNA, 22 bp, Homo sapiens
tgcttctggcacttgagggggt

SEQ ID NO: 7711731 - DNA, 22 bp, Homo sapiens
tgcttctggcacttgagggggt

SEQ ID NO: 7711732 - DNA, 22 bp, Homo sapiens
tgcttctggcacttgagggggt

SEQ ID NO: 7711733 - DNA, 22 bp, Homo sapiens
tgcttctggcttatctcgtgcc

SEQ ID NO: 7711734 - DNA, 22 bp, Homo sapiens
tgcttctggcagattgagtgag

SEQ ID NO: 7711735 - DNA, 22 bp, Homo sapiens
tgcttctggggacaggctgcct

SEQ ID NO: 7711736 - DNA, 22 bp, Homo sapiens
tgcttctggggacaggctgcct

SEQ ID NO: 7711737 - DNA, 22 bp, Homo sapiens
tgcttctggggacaggctgcct

SEQ ID NO: 7711738 - DNA, 22 bp, Homo sapiens
tgcttctgggcctggtgttccc

SEQ ID NO: 7711739 - DNA, 22 bp, Homo sapiens
tgcttctggggacaggctgcct

SEQ ID NO: 7711740 - DNA, 22 bp, Homo sapiens
tgcttctggggacaggctgcct

SEQ ID NO: 7711741 - DNA, 19 bp, Homo sapiens
tgcttctggggcttctcca

SEQ ID NO: 7711742 - DNA, 19 bp, Homo sapiens
tgcttctggggcttctcca

SEQ ID NO: 7711743 - DNA, 19 bp, Homo sapiens
tgcttctggggcttctcca

SEQ ID NO: 7711744 - DNA, 22 bp, Homo sapiens
tgcttctggggacaggctgcct

SEQ ID NO: 7711745 - DNA, 22 bp, Homo sapiens
tgcttctgggtaggcctcagga

SEQ ID NO: 7711746 - DNA, 22 bp, Homo sapiens
tgcttctgggtaggcctcagga

SEQ ID NO: 7711747 - DNA, 22 bp, Homo sapiens
tgcttctgggtaggcctcagga

SEQ ID NO: 7711748 - DNA, 22 bp, Homo sapiens
tgcttctgggtaggcctcagga

SEQ ID NO: 7711749 - DNA, 19 bp, Homo sapiens
tgcttctggggcttctcca

SEQ ID NO: 7711750 - DNA, 19 bp, Homo sapiens
tgcttgaggtgtgctagag

SEQ ID NO: 7711751 - DNA, 22 bp, Homo sapiens
tgcttgattaagccttgtttgc

SEQ ID NO: 7711752 - DNA, 22 bp, Homo sapiens
tgcttgatggctcttctttcta

SEQ ID NO: 7711753 - DNA, 22 bp, Homo sapiens
tgcttgatgagtgtgccaagca

SEQ ID NO: 7711754 - DNA, 22 bp, Homo sapiens
tgcttgatttggcagtgtattc

SEQ ID NO: 7711755 - DNA, 22 bp, Homo sapiens
tgcttgattagggaagtcacat

SEQ ID NO: 7711756 - DNA, 22 bp, Homo sapiens
tgcttgattagggaagtcacat

SEQ ID NO: 7711757 - DNA, 22 bp, Homo sapiens
tgcttgattagggaagtcacat

SEQ ID NO: 7711758 - DNA, 22 bp, Homo sapiens
tgcttgattagggaagtcacat

SEQ ID NO: 7711759 - DNA, 22 bp, Homo sapiens
tgcttgaacaaggataaatttg

SEQ ID NO: 7711760 - DNA, 22 bp, Homo sapiens
tgcttgaacaaggataaatttg

SEQ ID NO: 7711761 - DNA, 22 bp, Homo sapiens
tgcttgaacaaggataaatttg

SEQ ID NO: 7711762 - DNA, 22 bp, Homo sapiens
tgcttctttttatcttggagta

SEQ ID NO: 7711763 - DNA, 22 bp, Homo sapiens
tgcttctttttatcttggagta

SEQ ID NO: 7711764 - DNA, 22 bp, Homo sapiens
tgcttgaagcctacattcgtca

SEQ ID NO: 7711765 - DNA, 22 bp, Homo sapiens
tgcttgaagatatactacttcc

SEQ ID NO: 7711766 - DNA, 22 bp, Homo sapiens
tgcttgaagatatactacttcc

SEQ ID NO: 7711767 - DNA, 22 bp, Homo sapiens
tgcttgaacccaggaagtggag

SEQ ID NO: 7711768 - DNA, 22 bp, Homo sapiens
tgcttgactctggaataaaatg

SEQ ID NO: 7711769 - DNA, 22 bp, Homo sapiens
tgcttgctcgccgcctgctgac

SEQ ID NO: 7711770 - DNA, 22 bp, Homo sapiens
tgcttgctccctcacactgtcc

SEQ ID NO: 7711771 - DNA, 22 bp, Homo sapiens
tgcttgctatgcatcctgaact

SEQ ID NO: 7711772 - DNA, 19 bp, Homo sapiens
tgcttgcctgcctttccca

SEQ ID NO: 7711773 - DNA, 22 bp, Homo sapiens
tgcttgcagatgaaaggaagtc

SEQ ID NO: 7711774 - DNA, 22 bp, Homo sapiens
tgcttgcagatgaaaggaagtc

SEQ ID NO: 7711775 - DNA, 21 bp, Homo sapiens
tgcttgcagaactttcaggct

SEQ ID NO: 7711776 - DNA, 22 bp, Homo sapiens
tgcttgcatccaacattaaggg

SEQ ID NO: 7711777 - DNA, 22 bp, Homo sapiens
tgcttgcaaatactctgctgtt

SEQ ID NO: 7711778 - DNA, 22 bp, Homo sapiens
tgcttgcaaatactctgctgtt

SEQ ID NO: 7711779 - DNA, 22 bp, Homo sapiens
tgcttgcaagagatgcaatgac

SEQ ID NO: 7711780 - DNA, 19 bp, Homo sapiens
tgcttgcacatcaagctac

SEQ ID NO: 7711781 - DNA, 21 bp, Homo sapiens
tgcttgcagaactttcaggct

SEQ ID NO: 7711782 - DNA, 21 bp, Homo sapiens
tgcttgtctgcctagaggctt

SEQ ID NO: 7711783 - DNA, 22 bp, Homo sapiens
tgcttgtcttcaggaatgctga

SEQ ID NO: 7711784 - DNA, 21 bp, Homo sapiens
tgcttgtctgcctagaggctt

SEQ ID NO: 7711785 - DNA, 22 bp, Homo sapiens
tgcttgtcttcaggaatgctga

SEQ ID NO: 7711786 - DNA, 22 bp, Homo sapiens
tgcttgtcttcaggattatggt

SEQ ID NO: 7711787 - DNA, 22 bp, Homo sapiens
tgcttgtcttcaggattatggt

SEQ ID NO: 7711788 - DNA, 22 bp, Homo sapiens
tgcttgtgacagaactgtgtcc

SEQ ID NO: 7711789 - DNA, 22 bp, Homo sapiens
tgcttgtgagagttttttcaga

SEQ ID NO: 7711790 - DNA, 22 bp, Homo sapiens
tgctttaacataagatatcttt

SEQ ID NO: 7711791 - DNA, 22 bp, Homo sapiens
tgctttaaatatgaattagcat

SEQ ID NO: 7711792 - DNA, 22 bp, Homo sapiens
tgctttaaatatgaattagcat

SEQ ID NO: 7711793 - DNA, 22 bp, Homo sapiens
tgctttaaatatgaattagcat

SEQ ID NO: 7711794 - DNA, 22 bp, Homo sapiens
tgctttaaaccatggatgtgag

SEQ ID NO: 7711795 - DNA, 22 bp, Homo sapiens
tgctttaaaccatggatgtgag

SEQ ID NO: 7711796 - DNA, 22 bp, Homo sapiens
tgctttaaagtatttctcgcaa

SEQ ID NO: 7711797 - DNA, 22 bp, Homo sapiens
tgctttaaaccatggatgtgag

SEQ ID NO: 7711798 - DNA, 22 bp, Homo sapiens
tgcttgtgtgagggcctgggag

SEQ ID NO: 7711799 - DNA, 22 bp, Homo sapiens
tgcttgtgtgagggcctgggag

SEQ ID NO: 7711800 - DNA, 22 bp, Homo sapiens
tgcttgttcatggcctagtggc

SEQ ID NO: 7711801 - DNA, 22 bp, Homo sapiens
tgcttgtgtgagggcctgggag

SEQ ID NO: 7711802 - DNA, 22 bp, Homo sapiens
tgctttaaaatggactgttttg

SEQ ID NO: 7711803 - DNA, 22 bp, Homo sapiens
tgcttgttcatggcctagtggc

SEQ ID NO: 7711804 - DNA, 21 bp, Homo sapiens
tgcttgttctctgtccttgca

SEQ ID NO: 7711805 - DNA, 22 bp, Homo sapiens
tgctttaaaatggactgttttg

SEQ ID NO: 7711806 - DNA, 22 bp, Homo sapiens
tgctttaaaatggactgttttg

SEQ ID NO: 7711807 - DNA, 22 bp, Homo sapiens
tgctttaaaatggactgttttg

SEQ ID NO: 7711808 - DNA, 22 bp, Homo sapiens
tgctttaagacactaagtttga

SEQ ID NO: 7711809 - DNA, 22 bp, Homo sapiens
tgctttaagacactaagtttga

SEQ ID NO: 7711810 - DNA, 22 bp, Homo sapiens
tgctttaaccatcttgtttgga

SEQ ID NO: 7711811 - DNA, 22 bp, Homo sapiens
tgctttaacgctgagggtctca

SEQ ID NO: 7711812 - DNA, 22 bp, Homo sapiens
tgctttaagacactaagtttga

SEQ ID NO: 7711813 - DNA, 22 bp, Homo sapiens
tgctttaagacactaagtttga

SEQ ID NO: 7711814 - DNA, 22 bp, Homo sapiens
tgctttaagacactaagtttga

SEQ ID NO: 7711815 - DNA, 22 bp, Homo sapiens
tgctttaaccatcttgtttgga

SEQ ID NO: 7711816 - DNA, 22 bp, Homo sapiens
tgctttaacgctgagggtctca

SEQ ID NO: 7711817 - DNA, 22 bp, Homo sapiens
tgctttaacataagatatcttt

SEQ ID NO: 7711818 - DNA, 22 bp, Homo sapiens
tgctttaaccatcttgtttgga

SEQ ID NO: 7711819 - DNA, 22 bp, Homo sapiens
tgctttaaccatcttgtttgga

SEQ ID NO: 7711820 - DNA, 22 bp, Homo sapiens
tgctttaaccatcttgtttgga

SEQ ID NO: 7711821 - DNA, 22 bp, Homo sapiens
tgctttataaccatttctgtgg

SEQ ID NO: 7711822 - DNA, 22 bp, Homo sapiens
tgctttactaaataacttacca

SEQ ID NO: 7711823 - DNA, 22 bp, Homo sapiens
tgctttagttcaacatgccaaa

SEQ ID NO: 7711824 - DNA, 22 bp, Homo sapiens
tgctttagttcaacatgccaaa

SEQ ID NO: 7711825 - DNA, 22 bp, Homo sapiens
tgctttaagagattgttagtac

SEQ ID NO: 7711826 - DNA, 22 bp, Homo sapiens
tgctttaagagattgttagtac

SEQ ID NO: 7711827 - DNA, 22 bp, Homo sapiens
tgctttaagagattgttagtac

SEQ ID NO: 7711828 - DNA, 22 bp, Homo sapiens
tgctttaagagattgttagtac

SEQ ID NO: 7711829 - DNA, 22 bp, Homo sapiens
tgctttaagagattgttagtac

SEQ ID NO: 7711830 - DNA, 22 bp, Homo sapiens
tgctttacaagcctgcttcctc

SEQ ID NO: 7711831 - DNA, 22 bp, Homo sapiens
tggactggaatgctgatcctct

SEQ ID NO: 7711832 - DNA, 22 bp, Homo sapiens
tggactggaatgctgatcctct

SEQ ID NO: 7711833 - DNA, 22 bp, Homo sapiens
tggactgctttgtaatttaaaa

SEQ ID NO: 7711834 - DNA, 22 bp, Homo sapiens
tggactgatgctccctattgaa

SEQ ID NO: 7711835 - DNA, 22 bp, Homo sapiens
tggactgatgctccctattgaa

SEQ ID NO: 7711836 - DNA, 22 bp, Homo sapiens
tggactgggctaatggcagaca

SEQ ID NO: 7711837 - DNA, 22 bp, Homo sapiens
tggactgggctaatggcagaca

SEQ ID NO: 7711838 - DNA, 22 bp, Homo sapiens
tggactgagcttgagagggttg

SEQ ID NO: 7711839 - DNA, 22 bp, Homo sapiens
tggactgaattgaagcaggaag

SEQ ID NO: 7711840 - DNA, 22 bp, Homo sapiens
tggactgaattgaagcaggaag

SEQ ID NO: 7711841 - DNA, 22 bp, Homo sapiens
tggactgaattgaagcaggaag

SEQ ID NO: 7711842 - DNA, 22 bp, Homo sapiens
tggactcttggaccttctctaa

SEQ ID NO: 7711843 - DNA, 22 bp, Homo sapiens
tggactgaagttacagatgaca

SEQ ID NO: 7711844 - DNA, 22 bp, Homo sapiens
tggactgaagttacagatgaca

SEQ ID NO: 7711845 - DNA, 22 bp, Homo sapiens
tggactctaagcagaggatcta

SEQ ID NO: 7711846 - DNA, 22 bp, Homo sapiens
tggactctgaactggcactgac

SEQ ID NO: 7711847 - DNA, 22 bp, Homo sapiens
tggactctatgatgcgccagca

SEQ ID NO: 7711848 - DNA, 22 bp, Homo sapiens
tggactctgaactggcactgac

SEQ ID NO: 7711849 - DNA, 22 bp, Homo sapiens
tggactcccagagctgctctcc

SEQ ID NO: 7711850 - DNA, 22 bp, Homo sapiens
tggactaaagaaacattccgtg

SEQ ID NO: 7711851 - DNA, 22 bp, Homo sapiens
tggactaaagaggaaagatgta

SEQ ID NO: 7711852 - DNA, 22 bp, Homo sapiens
tggactaataggagaaaacaag

SEQ ID NO: 7711853 - DNA, 22 bp, Homo sapiens
tggactaaagaggaagcaaata

SEQ ID NO: 7711854 - DNA, 22 bp, Homo sapiens
tggactaaagaggaagcaaata

SEQ ID NO: 7711855 - DNA, 19 bp, Homo sapiens
tggacctgtgcccatggct

SEQ ID NO: 7711856 - DNA, 20 bp, Homo sapiens
tggacctgtctctttaggga

SEQ ID NO: 7711857 - DNA, 23 bp, Homo sapiens
tggaccctgcacaccagctctac

SEQ ID NO: 7711858 - DNA, 23 bp, Homo sapiens
tggaccctgcacaccagctctac

SEQ ID NO: 7711859 - DNA, 23 bp, Homo sapiens
tggaccctgcacaccagctctac

SEQ ID NO: 7711860 - DNA, 22 bp, Homo sapiens
tggaccctgaagcaacagggag

SEQ ID NO: 7711861 - DNA, 22 bp, Homo sapiens
tggaccctggactgccctggcc

SEQ ID NO: 7711862 - DNA, 22 bp, Homo sapiens
tggaccctgaagcaacagggag

SEQ ID NO: 7711863 - DNA, 22 bp, Homo sapiens
tggaccctggactgccctggcc

SEQ ID NO: 7711864 - DNA, 17 bp, Homo sapiens
tggacccttgggcctcc

SEQ ID NO: 7711865 - DNA, 17 bp, Homo sapiens
tggacccttgggcctcc

SEQ ID NO: 7711866 - DNA, 22 bp, Homo sapiens
tggaccctacccggccctcggc

SEQ ID NO: 7711867 - DNA, 22 bp, Homo sapiens
tggaccctacccggccctcggc

SEQ ID NO: 7711868 - DNA, 22 bp, Homo sapiens
tggaccccctcaaggcagagct

SEQ ID NO: 7711869 - DNA, 22 bp, Homo sapiens
tggaccccctcaaggcagagct

SEQ ID NO: 7711870 - DNA, 22 bp, Homo sapiens
tggacccaggcaggtctgtcct

SEQ ID NO: 7711871 - DNA, 22 bp, Homo sapiens
tggacccaggcaggtctgtcct

SEQ ID NO: 7711872 - DNA, 22 bp, Homo sapiens
tggacccaggcaggtctgtcct

SEQ ID NO: 7711873 - DNA, 22 bp, Homo sapiens
tggacccatattgtctgcattc

SEQ ID NO: 7711874 - DNA, 22 bp, Homo sapiens
tggaccccagacaagccagggt

SEQ ID NO: 7711875 - DNA, 22 bp, Homo sapiens
tggaccccagacaagccagggt

SEQ ID NO: 7711876 - DNA, 22 bp, Homo sapiens
tggacctgcgtaggtgctgggc

SEQ ID NO: 7711877 - DNA, 22 bp, Homo sapiens
tggacctgcgtaggtgctgggc

SEQ ID NO: 7711878 - DNA, 22 bp, Homo sapiens
tggacctgagcctggccctgcc

SEQ ID NO: 7711879 - DNA, 22 bp, Homo sapiens
tggacctgctggatgggcaggt

SEQ ID NO: 7711880 - DNA, 22 bp, Homo sapiens
tggacctgctggatgggcaggt

SEQ ID NO: 7711881 - DNA, 22 bp, Homo sapiens
tggacctgctggatgggcaggt

SEQ ID NO: 7711882 - DNA, 22 bp, Homo sapiens
tggacctgaagaataggaagta

SEQ ID NO: 7711883 - DNA, 22 bp, Homo sapiens
tggacctcactgtctgctggta

SEQ ID NO: 7711884 - DNA, 22 bp, Homo sapiens
tggacctcactgtctgctggta

SEQ ID NO: 7711885 - DNA, 22 bp, Homo sapiens
tggacctgaagaataggaagta

SEQ ID NO: 7711886 - DNA, 22 bp, Homo sapiens
tggacctgaagaataggaagta

SEQ ID NO: 7711887 - DNA, 20 bp, Homo sapiens
tggacaggggcataggttgc

SEQ ID NO: 7711888 - DNA, 20 bp, Homo sapiens
tggacaggggcataggttgc

SEQ ID NO: 7711889 - DNA, 22 bp, Homo sapiens
tggacagggcagagaccgagtc

SEQ ID NO: 7711890 - DNA, 20 bp, Homo sapiens
tggacaggggcataggttgc

SEQ ID NO: 7711891 - DNA, 20 bp, Homo sapiens
tggacaggggcataggttgc

SEQ ID NO: 7711892 - DNA, 20 bp, Homo sapiens
tggacaggggcataggttgc

SEQ ID NO: 7711893 - DNA, 22 bp, Homo sapiens
tggacagggcagagaccgagtc

SEQ ID NO: 7711894 - DNA, 22 bp, Homo sapiens
tggacagggcagagaccgagtc

SEQ ID NO: 7711895 - DNA, 22 bp, Homo sapiens
tggacaggcaagcaagacatac

SEQ ID NO: 7711896 - DNA, 22 bp, Homo sapiens
tggacagggcagagaccgagtc

SEQ ID NO: 7711897 - DNA, 22 bp, Homo sapiens
tggacagggcagagaccgagtc

SEQ ID NO: 7711898 - DNA, 20 bp, Homo sapiens
tggacaggggcataggttgc

SEQ ID NO: 7711899 - DNA, 20 bp, Homo sapiens
tggacaggggcataggttgc

SEQ ID NO: 7711900 - DNA, 22 bp, Homo sapiens
tggacagggcagagaccgagtc

SEQ ID NO: 7711901 - DNA, 22 bp, Homo sapiens
tggacagggcagagaccgagtc

SEQ ID NO: 7711902 - DNA, 22 bp, Homo sapiens
tggacagggcagagaccgagtc

SEQ ID NO: 7711903 - DNA, 22 bp, Homo sapiens
tggacagggcagagaccgagtc

SEQ ID NO: 7711904 - DNA, 22 bp, Homo sapiens
tggacagggcagagaccgagtc

SEQ ID NO: 7711905 - DNA, 22 bp, Homo sapiens
tggacaggctcctaggggttcc

SEQ ID NO: 7711906 - DNA, 22 bp, Homo sapiens
tggacaggctcctaggggttcc

SEQ ID NO: 7711907 - DNA, 22 bp, Homo sapiens
tggacaggctcctaggggttcc

SEQ ID NO: 7711908 - DNA, 22 bp, Homo sapiens
tggacaggctcctaggggttcc

SEQ ID NO: 7711909 - DNA, 22 bp, Homo sapiens
tggacaggctcctaggggttcc

SEQ ID NO: 7711910 - DNA, 22 bp, Homo sapiens
tggacaggctcctaggggttcc

SEQ ID NO: 7711911 - DNA, 22 bp, Homo sapiens
tggacaggctcctaggggttcc

SEQ ID NO: 7711912 - DNA, 22 bp, Homo sapiens
tggacaggctcctaggggttcc

SEQ ID NO: 7711913 - DNA, 22 bp, Homo sapiens
tggacaggggctgctgttgtca

SEQ ID NO: 7711914 - DNA, 20 bp, Homo sapiens
tggacaggggcataggttgc

SEQ ID NO: 7711915 - DNA, 22 bp, Homo sapiens
tggacaggggctgctgttgtca

SEQ ID NO: 7711916 - DNA, 22 bp, Homo sapiens
tggacaggggctgctgttgtca

SEQ ID NO: 7711917 - DNA, 22 bp, Homo sapiens
tggacaggggctgctgttgtca

SEQ ID NO: 7711918 - DNA, 22 bp, Homo sapiens
tggacaggggctgctgttgtca

SEQ ID NO: 7711919 - DNA, 22 bp, Homo sapiens
tggacaggggctgctgttgtca

SEQ ID NO: 7711920 - DNA, 23 bp, Homo sapiens
tggacagggtaactggtggtttt

SEQ ID NO: 7711921 - DNA, 23 bp, Homo sapiens
tggacagggtaactggtggtttt

SEQ ID NO: 7711922 - DNA, 23 bp, Homo sapiens
tggacagggtaactggtggtttt

SEQ ID NO: 7711923 - DNA, 23 bp, Homo sapiens
tggacagggtaactggtggtttt

SEQ ID NO: 7711924 - DNA, 23 bp, Homo sapiens
tggacagggtaactggtggtttt

SEQ ID NO: 7711925 - DNA, 23 bp, Homo sapiens
tggacagggtaactggtggtttt

SEQ ID NO: 7711926 - DNA, 23 bp, Homo sapiens
tggacagggtaactggtggtttt

SEQ ID NO: 7711927 - DNA, 22 bp, Homo sapiens
tggacaggggctgctgttgtca

SEQ ID NO: 7711928 - DNA, 18 bp, Homo sapiens
tggacagggtggagaaaa

SEQ ID NO: 7711929 - DNA, 18 bp, Homo sapiens
tggacagggtggagaaaa

SEQ ID NO: 7711930 - DNA, 18 bp, Homo sapiens
tggacagggtggagaaaa

SEQ ID NO: 7711931 - DNA, 18 bp, Homo sapiens
tggacagggtggagaaaa

SEQ ID NO: 7711932 - DNA, 18 bp, Homo sapiens
tggacagggtggagaaaa

SEQ ID NO: 7711933 - DNA, 18 bp, Homo sapiens
tggacagggtggagaaaa

SEQ ID NO: 7711934 - DNA, 18 bp, Homo sapiens
tggacagggtggagaaaa

SEQ ID NO: 7711935 - DNA, 18 bp, Homo sapiens
tggacagggtggagaaaa

SEQ ID NO: 7711936 - DNA, 18 bp, Homo sapiens
tggacagggtggagaaaa

SEQ ID NO: 7711937 - DNA, 23 bp, Homo sapiens
tggacagggtaactggtggtttt

SEQ ID NO: 7711938 - DNA, 18 bp, Homo sapiens
tggacagggtggagaaaa

SEQ ID NO: 7711939 - DNA, 21 bp, Homo sapiens
tggacatttacccttcaggga

SEQ ID NO: 7711940 - DNA, 22 bp, Homo sapiens
tggacattccacccatatcaga

SEQ ID NO: 7711941 - DNA, 22 bp, Homo sapiens
tggaccacatagtgaggccccc

SEQ ID NO: 7711942 - DNA, 20 bp, Homo sapiens
tggaccaccctcctctttgc

SEQ ID NO: 7711943 - DNA, 22 bp, Homo sapiens
tggaccactctggtgcccatgt

SEQ ID NO: 7711944 - DNA, 21 bp, Homo sapiens
tggaccaaagtaatttgcctt

SEQ ID NO: 7711945 - DNA, 22 bp, Homo sapiens
tggaccaacattcactggcata

SEQ ID NO: 7711946 - DNA, 22 bp, Homo sapiens
tggaccaattctcagttttctt

SEQ ID NO: 7711947 - DNA, 22 bp, Homo sapiens
tggaccaattctcagttttctt

SEQ ID NO: 7711948 - DNA, 22 bp, Homo sapiens
tggacaggtgagtgactcaggg

SEQ ID NO: 7711949 - DNA, 22 bp, Homo sapiens
tggacaggtgagtgactcaggg

SEQ ID NO: 7711950 - DNA, 18 bp, Homo sapiens
tggacagggtggagaaaa

SEQ ID NO: 7711951 - DNA, 22 bp, Homo sapiens
tggacaggtgagtgactcaggg

SEQ ID NO: 7711952 - DNA, 22 bp, Homo sapiens
tggacaggtgagtgactcaggg

SEQ ID NO: 7711953 - DNA, 22 bp, Homo sapiens
tggacaggtgagtgactcaggg

SEQ ID NO: 7711954 - DNA, 22 bp, Homo sapiens
tggacaggtgagtgactcaggg

SEQ ID NO: 7711955 - DNA, 22 bp, Homo sapiens
tggacaggtgagtgactcaggg

SEQ ID NO: 7711956 - DNA, 22 bp, Homo sapiens
tggacaggtgcacacagcagcc

SEQ ID NO: 7711957 - DNA, 22 bp, Homo sapiens
tggacaggtgagtgactcaggg

SEQ ID NO: 7711958 - DNA, 22 bp, Homo sapiens
tggacaggtgagtgactcaggg

SEQ ID NO: 7711959 - DNA, 22 bp, Homo sapiens
tggacaggtgagtgactcaggg

SEQ ID NO: 7711960 - DNA, 22 bp, Homo sapiens
tggacaggtgagtgactcaggg

SEQ ID NO: 7711961 - DNA, 22 bp, Homo sapiens
tggacccaccccagggcctgct

SEQ ID NO: 7711962 - DNA, 22 bp, Homo sapiens
tggacccaggcaggtctgtcct

SEQ ID NO: 7711963 - DNA, 22 bp, Homo sapiens
tggacccaccccagggcctgct

SEQ ID NO: 7711964 - DNA, 20 bp, Homo sapiens
tggaccataaacaccaggta

SEQ ID NO: 7711965 - DNA, 22 bp, Homo sapiens
tggaccatgagctgcaggtgtt

SEQ ID NO: 7711966 - DNA, 22 bp, Homo sapiens
tggaccagggtcccagagtatg

SEQ ID NO: 7711967 - DNA, 21 bp, Homo sapiens
tggaccaggaaggtggtggtg

SEQ ID NO: 7711968 - DNA, 22 bp, Homo sapiens
tggaccagggtcccagagtatg

SEQ ID NO: 7711969 - DNA, 22 bp, Homo sapiens
tggaccagggtcccagagtatg

SEQ ID NO: 7711970 - DNA, 22 bp, Homo sapiens
tggaccagggtcccagagtatg

SEQ ID NO: 7711971 - DNA, 22 bp, Homo sapiens
tggaccagggtcccagagtatg

SEQ ID NO: 7711972 - DNA, 22 bp, Homo sapiens
tggaccagcagccccagtgcct

SEQ ID NO: 7711973 - DNA, 22 bp, Homo sapiens
tggaccagcagccccagtgcct

SEQ ID NO: 7711974 - DNA, 22 bp, Homo sapiens
tggaccagcagccccagtgcct

SEQ ID NO: 7711975 - DNA, 22 bp, Homo sapiens
tggaccagcagccccagtgcct

SEQ ID NO: 7711976 - DNA, 22 bp, Homo sapiens
tggaccagcagccccagtgcct

SEQ ID NO: 7711977 - DNA, 22 bp, Homo sapiens
tggaccagcagccccagtgcct

SEQ ID NO: 7711978 - DNA, 22 bp, Homo sapiens
tggaccagcagccccagtgcct

SEQ ID NO: 7711979 - DNA, 21 bp, Homo sapiens
tggaccaggaaggtggtggtg

SEQ ID NO: 7711980 - DNA, 22 bp, Homo sapiens
tggaccagctcctcgggagacg

SEQ ID NO: 7711981 - DNA, 21 bp, Homo sapiens
tggaccaggaaggtggtggtg

SEQ ID NO: 7711982 - DNA, 21 bp, Homo sapiens
tggaccaggaaggtggtggtg

SEQ ID NO: 7711983 - DNA, 22 bp, Homo sapiens
tggacaggatagtgcagtacgc

SEQ ID NO: 7711984 - DNA, 22 bp, Homo sapiens
tggacaggatagtgcagtacgc

SEQ ID NO: 7711985 - DNA, 22 bp, Homo sapiens
tggacaggatagtgcagtacgc

SEQ ID NO: 7711986 - DNA, 22 bp, Homo sapiens
tggacaggatagtgcagtacgc

SEQ ID NO: 7711987 - DNA, 23 bp, Homo sapiens
tggacaggacccccttcggaccc

SEQ ID NO: 7711988 - DNA, 22 bp, Homo sapiens
tggacaggatagtgcagtacgc

SEQ ID NO: 7711989 - DNA, 22 bp, Homo sapiens
tggacaggatagtgcagtacgc

SEQ ID NO: 7711990 - DNA, 22 bp, Homo sapiens
tggacaggatagtgcagtacgc

SEQ ID NO: 7711991 - DNA, 22 bp, Homo sapiens
tggacaggatctgagactgaga

SEQ ID NO: 7711992 - DNA, 22 bp, Homo sapiens
tggacaggatctgagactgaga

SEQ ID NO: 7711993 - DNA, 22 bp, Homo sapiens
tggacaggatctgagactgaga

SEQ ID NO: 7711994 - DNA, 22 bp, Homo sapiens
tggacaggatctgagactgaga

SEQ ID NO: 7711995 - DNA, 22 bp, Homo sapiens
tggacaggatagtgcagtacgc

SEQ ID NO: 7711996 - DNA, 22 bp, Homo sapiens
tggacaggatctgagactgaga

SEQ ID NO: 7711997 - DNA, 22 bp, Homo sapiens
tggacaggatctgagactgaga

SEQ ID NO: 7711998 - DNA, 22 bp, Homo sapiens
tggacaggatctgagactgaga

SEQ ID NO: 7711999 - DNA, 22 bp, Homo sapiens
tggacaggatctgagactgaga

SEQ ID NO: 7712000 - DNA, 22 bp, Homo sapiens
tggacaggatctgagactgaga

SEQ ID NO: 7712001 - DNA, 22 bp, Homo sapiens
tggacaggcaagcaagacatac

SEQ ID NO: 7712002 - DNA, 22 bp, Homo sapiens
tggacaggcaagcaagacatac

SEQ ID NO: 7712003 - DNA, 22 bp, Homo sapiens
tggacaggcaagcaagacatac

SEQ ID NO: 7712004 - DNA, 22 bp, Homo sapiens
tggacaggcaagcaagacatac

SEQ ID NO: 7712005 - DNA, 22 bp, Homo sapiens
tggacaggatctgagactgaga

SEQ ID NO: 7712006 - DNA, 22 bp, Homo sapiens
tggacaggcaagcaagacatac

SEQ ID NO: 7712007 - DNA, 22 bp, Homo sapiens
tggacaggcaagcaagacatac

SEQ ID NO: 7712008 - DNA, 22 bp, Homo sapiens
tggacaggcaagcaagacatac

SEQ ID NO: 7712009 - DNA, 22 bp, Homo sapiens
tggacagcttgcagagccaccc

SEQ ID NO: 7712010 - DNA, 22 bp, Homo sapiens
tggacagcttgcagagccaccc

SEQ ID NO: 7712011 - DNA, 23 bp, Homo sapiens
tggacaggacccccttcggaccc

SEQ ID NO: 7712012 - DNA, 22 bp, Homo sapiens
tggacagcttgcagagccaccc

SEQ ID NO: 7712013 - DNA, 22 bp, Homo sapiens
tggacaggatagtgcagtacgc

SEQ ID NO: 7712014 - DNA, 22 bp, Homo sapiens
tggacaggatagtgcagtacgc

SEQ ID NO: 7712015 - DNA, 23 bp, Homo sapiens
tggacaggacccccttcggaccc

SEQ ID NO: 7712016 - DNA, 23 bp, Homo sapiens
tggacaggacccccttcggaccc

SEQ ID NO: 7712017 - DNA, 23 bp, Homo sapiens
tggacaggacccccttcggaccc

SEQ ID NO: 7712018 - DNA, 23 bp, Homo sapiens
tggacagcagcagcagtgtcacc

SEQ ID NO: 7712019 - DNA, 22 bp, Homo sapiens
tggacagcgaaagtgcctggga

SEQ ID NO: 7712020 - DNA, 22 bp, Homo sapiens
tggacagcgaaagtgcctggga

SEQ ID NO: 7712021 - DNA, 22 bp, Homo sapiens
tggacagccatgcaaatgagct

SEQ ID NO: 7712022 - DNA, 22 bp, Homo sapiens
tggacagcgaaagtgcctggga

SEQ ID NO: 7712023 - DNA, 22 bp, Homo sapiens
tggacagcaaacatggagagaa

SEQ ID NO: 7712024 - DNA, 22 bp, Homo sapiens
tggacagcaaacatggagagaa

SEQ ID NO: 7712025 - DNA, 23 bp, Homo sapiens
tggacagcagcagcagtgtcacc

SEQ ID NO: 7712026 - DNA, 23 bp, Homo sapiens
tggacagcagcagcagtgtcacc

SEQ ID NO: 7712027 - DNA, 22 bp, Homo sapiens
tggacacaatgttgccttaggg

SEQ ID NO: 7712028 - DNA, 22 bp, Homo sapiens
tggacaactggtttttgacaaa

SEQ ID NO: 7712029 - DNA, 22 bp, Homo sapiens
tggacaacatagtgagacctca

SEQ ID NO: 7712030 - DNA, 22 bp, Homo sapiens
tggacaacatagtgagacctca

SEQ ID NO: 7712031 - DNA, 22 bp, Homo sapiens
tggacacacatgtatgtcagag

SEQ ID NO: 7712032 - DNA, 22 bp, Homo sapiens
tggacacaatgttgccttaggg

SEQ ID NO: 7712033 - DNA, 22 bp, Homo sapiens
tggacacacatgtatgtcagag

SEQ ID NO: 7712034 - DNA, 22 bp, Homo sapiens
tggacacacatgtatgtcagag

SEQ ID NO: 7712035 - DNA, 18 bp, Homo sapiens
tggacacatggcctgggt

SEQ ID NO: 7712036 - DNA, 18 bp, Homo sapiens
tggacacatggcctgggt

SEQ ID NO: 7712037 - DNA, 18 bp, Homo sapiens
tggacacatggcctgggt

SEQ ID NO: 7712038 - DNA, 18 bp, Homo sapiens
tggacacatggcctgggt

SEQ ID NO: 7712039 - DNA, 18 bp, Homo sapiens
tggacacatggcctgggt

SEQ ID NO: 7712040 - DNA, 18 bp, Homo sapiens
tggacacatggcctgggt

SEQ ID NO: 7712041 - DNA, 22 bp, Homo sapiens
tggacacagtaggagctgcgca

SEQ ID NO: 7712042 - DNA, 20 bp, Homo sapiens
tggacacagccctgttgagt

SEQ ID NO: 7712043 - DNA, 22 bp, Homo sapiens
tggacacatcactgcagccact

SEQ ID NO: 7712044 - DNA, 22 bp, Homo sapiens
tggacacatcactgcagccact

SEQ ID NO: 7712045 - DNA, 22 bp, Homo sapiens
tggacacagtggtgaaggtaca

SEQ ID NO: 7712046 - DNA, 22 bp, Homo sapiens
tggacagagctgacagtatata

SEQ ID NO: 7712047 - DNA, 22 bp, Homo sapiens
tggacagagctgacagtatata

SEQ ID NO: 7712048 - DNA, 22 bp, Homo sapiens
tggacagagaggaaggccattt

SEQ ID NO: 7712049 - DNA, 22 bp, Homo sapiens
tggacagagaggaaggccattt

SEQ ID NO: 7712050 - DNA, 22 bp, Homo sapiens
tggacagagctgacagtatata

SEQ ID NO: 7712051 - DNA, 22 bp, Homo sapiens
tggacagagctgacagtatata

SEQ ID NO: 7712052 - DNA, 22 bp, Homo sapiens
tggacagcaaacatggagagaa

SEQ ID NO: 7712053 - DNA, 22 bp, Homo sapiens
tggacagagaggaaggccattt

SEQ ID NO: 7712054 - DNA, 22 bp, Homo sapiens
tggacagagaggaaggccattt

SEQ ID NO: 7712055 - DNA, 22 bp, Homo sapiens
tggacagagaggaaggccattt

SEQ ID NO: 7712056 - DNA, 20 bp, Homo sapiens
tggacagaattagacacttt

SEQ ID NO: 7712057 - DNA, 22 bp, Homo sapiens
tggacagagaggaaggccattt

SEQ ID NO: 7712058 - DNA, 22 bp, Homo sapiens
tggacagagaggaaggccattt

SEQ ID NO: 7712059 - DNA, 22 bp, Homo sapiens
tggacagagaggaaggccattt

SEQ ID NO: 7712060 - DNA, 20 bp, Homo sapiens
tggacagaattagacacttt

SEQ ID NO: 7712061 - DNA, 22 bp, Homo sapiens
tggacagaaacccgagtgatct

SEQ ID NO: 7712062 - DNA, 22 bp, Homo sapiens
tggacagaaacccgagtgatct

SEQ ID NO: 7712063 - DNA, 22 bp, Homo sapiens
tggacagaaacccgagtgatct

SEQ ID NO: 7712064 - DNA, 20 bp, Homo sapiens
tggacagaattagacacttt

SEQ ID NO: 7712065 - DNA, 20 bp, Homo sapiens
tggacagaattagacacttt

SEQ ID NO: 7712066 - DNA, 21 bp, Homo sapiens
tggaatgaggctgagcagtgc

SEQ ID NO: 7712067 - DNA, 23 bp, Homo sapiens
tggaatgagctgggaagctgagc

SEQ ID NO: 7712068 - DNA, 23 bp, Homo sapiens
tggaatgagctgggaagctgagc

SEQ ID NO: 7712069 - DNA, 22 bp, Homo sapiens
tggaatgatctgatgtatttta

SEQ ID NO: 7712070 - DNA, 22 bp, Homo sapiens
tggaatgagtggctaagattca

SEQ ID NO: 7712071 - DNA, 22 bp, Homo sapiens
tggaatgagtggctaagattca

SEQ ID NO: 7712072 - DNA, 22 bp, Homo sapiens
tggaatgatgactaggaattgt

SEQ ID NO: 7712073 - DNA, 22 bp, Homo sapiens
tggaatgatgactaggaattgt

SEQ ID NO: 7712074 - DNA, 22 bp, Homo sapiens
tggaatgcagtgggagcttacc

SEQ ID NO: 7712075 - DNA, 22 bp, Homo sapiens
tggaatgcagtgggagcttacc

SEQ ID NO: 7712076 - DNA, 22 bp, Homo sapiens
tggaatgcagtgggagcttacc

SEQ ID NO: 7712077 - DNA, 22 bp, Homo sapiens
tggaatgcagtgggagcttacc

SEQ ID NO: 7712078 - DNA, 22 bp, Homo sapiens
tggaatgcagtgggagcttacc

SEQ ID NO: 7712079 - DNA, 22 bp, Homo sapiens
tggaatggaaacaaactgagga

SEQ ID NO: 7712080 - DNA, 22 bp, Homo sapiens
tggaatggaaacaaactgagga

SEQ ID NO: 7712081 - DNA, 22 bp, Homo sapiens
tggaatgccgggccaggctccg

SEQ ID NO: 7712082 - DNA, 22 bp, Homo sapiens
tggaatgccgggccaggctccg

SEQ ID NO: 7712083 - DNA, 22 bp, Homo sapiens
tggaatggaaacaaactgagga

SEQ ID NO: 7712084 - DNA, 22 bp, Homo sapiens
tggaatgccgggccaggctccg

SEQ ID NO: 7712085 - DNA, 22 bp, Homo sapiens
tggaatgacaagttgttcagag

SEQ ID NO: 7712086 - DNA, 22 bp, Homo sapiens
tggaatgacagagagtctgaat

SEQ ID NO: 7712087 - DNA, 22 bp, Homo sapiens
tggaatgagctggctaataacc

SEQ ID NO: 7712088 - DNA, 22 bp, Homo sapiens
tggaatgagctggctaataacc

SEQ ID NO: 7712089 - DNA, 22 bp, Homo sapiens
tggaatgagctggctaataacc

SEQ ID NO: 7712090 - DNA, 22 bp, Homo sapiens
tggaatgacagagagtctgaat

SEQ ID NO: 7712091 - DNA, 22 bp, Homo sapiens
tggaatgaaggagatggccttt

SEQ ID NO: 7712092 - DNA, 22 bp, Homo sapiens
tggaatgaaggagatggccttt

SEQ ID NO: 7712093 - DNA, 22 bp, Homo sapiens
tggaatgaatatgttttaagga

SEQ ID NO: 7712094 - DNA, 22 bp, Homo sapiens
tggaatgaatttggcttcctcc

SEQ ID NO: 7712095 - DNA, 22 bp, Homo sapiens
tggaatgaaaagtacttcagaa

SEQ ID NO: 7712096 - DNA, 22 bp, Homo sapiens
tggaatgaagacatgttgtttg

SEQ ID NO: 7712097 - DNA, 22 bp, Homo sapiens
tggaatgaaaatggagatcttg

SEQ ID NO: 7712098 - DNA, 22 bp, Homo sapiens
tggaatgttgggatttaagtgt

SEQ ID NO: 7712099 - DNA, 22 bp, Homo sapiens
tggaatgttgtgtataggtcag

SEQ ID NO: 7712100 - DNA, 22 bp, Homo sapiens
tggaatgtttccccagcctgca

SEQ ID NO: 7712101 - DNA, 22 bp, Homo sapiens
tggaatgtttccccagcctgca

SEQ ID NO: 7712102 - DNA, 23 bp, Homo sapiens
tggaatgtttcttgtactgaatg

SEQ ID NO: 7712103 - DNA, 23 bp, Homo sapiens
tggaatgtttcttgtactgaatg

SEQ ID NO: 7712104 - DNA, 22 bp, Homo sapiens
tggaatgtttgacttattcagt

SEQ ID NO: 7712105 - DNA, 22 bp, Homo sapiens
tggaatgtttgacttattcagt

SEQ ID NO: 7712106 - DNA, 22 bp, Homo sapiens
tggaatgtttgacttattcagt

SEQ ID NO: 7712107 - DNA, 22 bp, Homo sapiens
tggaatgtttgacttattcagt

SEQ ID NO: 7712108 - DNA, 22 bp, Homo sapiens
tggaatgttgataaacataggc

SEQ ID NO: 7712109 - DNA, 22 bp, Homo sapiens
tggaatgttgataaacataggc

SEQ ID NO: 7712110 - DNA, 22 bp, Homo sapiens
tggaatgttgctctgccttgcg

SEQ ID NO: 7712111 - DNA, 22 bp, Homo sapiens
tggaatgttgcataagatctga

SEQ ID NO: 7712112 - DNA, 22 bp, Homo sapiens
tggaatgttgcataagatctga

SEQ ID NO: 7712113 - DNA, 22 bp, Homo sapiens
tggaatgttgcataagatctga

SEQ ID NO: 7712114 - DNA, 19 bp, Homo sapiens
tggaatgttccaaggaggc

SEQ ID NO: 7712115 - DNA, 19 bp, Homo sapiens
tggaatgttccaaggaggc

SEQ ID NO: 7712116 - DNA, 22 bp, Homo sapiens
tggaatgttatgatgatggtaa

SEQ ID NO: 7712117 - DNA, 22 bp, Homo sapiens
tggaatggaaacaaactgagga

SEQ ID NO: 7712118 - DNA, 22 bp, Homo sapiens
tggaatggaaacaaactgagga

SEQ ID NO: 7712119 - DNA, 22 bp, Homo sapiens
tggaattaataggggatataca

SEQ ID NO: 7712120 - DNA, 22 bp, Homo sapiens
tggaatgttttcctaaatcaga

SEQ ID NO: 7712121 - DNA, 22 bp, Homo sapiens
tggaattttgtattagctttga

SEQ ID NO: 7712122 - DNA, 22 bp, Homo sapiens
tggaatttagttaattccattt

SEQ ID NO: 7712123 - DNA, 22 bp, Homo sapiens
tggaattcttattctgacttca

SEQ ID NO: 7712124 - DNA, 22 bp, Homo sapiens
tggacaacatagtgagacctca

SEQ ID NO: 7712125 - DNA, 22 bp, Homo sapiens
tggacaacatagtgagacctca

SEQ ID NO: 7712126 - DNA, 22 bp, Homo sapiens
tggacaacatagtgagacctca

SEQ ID NO: 7712127 - DNA, 22 bp, Homo sapiens
tggacaacatagtgagacctca

SEQ ID NO: 7712128 - DNA, 22 bp, Homo sapiens
tggacaacatagtgagacctca

SEQ ID NO: 7712129 - DNA, 22 bp, Homo sapiens
tggacaaatagcatgacacttg

SEQ ID NO: 7712130 - DNA, 22 bp, Homo sapiens
tggacaaatagcatgacacttg

SEQ ID NO: 7712131 - DNA, 22 bp, Homo sapiens
tggaattttgtattagctttga

SEQ ID NO: 7712132 - DNA, 22 bp, Homo sapiens
tggaatttagttaattccattt

SEQ ID NO: 7712133 - DNA, 22 bp, Homo sapiens
tggacaaatagcatgacacttg

SEQ ID NO: 7712134 - DNA, 22 bp, Homo sapiens
tggacaaatgatttctaccttt

SEQ ID NO: 7712135 - DNA, 22 bp, Homo sapiens
tggacaaatgatttctaccttt

SEQ ID NO: 7712136 - DNA, 22 bp, Homo sapiens
tggacaaatagcatgacacttg

SEQ ID NO: 7712137 - DNA, 22 bp, Homo sapiens
tggaagtggcagaaaatgaaca

SEQ ID NO: 7712138 - DNA, 22 bp, Homo sapiens
tggaagtggcagaaaatgaaca

SEQ ID NO: 7712139 - DNA, 22 bp, Homo sapiens
tggaagtggcagaaaatgaaca

SEQ ID NO: 7712140 - DNA, 22 bp, Homo sapiens
tggaagtggcagaggaagtggt

SEQ ID NO: 7712141 - DNA, 22 bp, Homo sapiens
tggaagtggcagaggaagtggt

SEQ ID NO: 7712142 - DNA, 22 bp, Homo sapiens
tggaagtggcagaggaagtggt

SEQ ID NO: 7712143 - DNA, 22 bp, Homo sapiens
tggaagtgctcttctgaccaac

SEQ ID NO: 7712144 - DNA, 22 bp, Homo sapiens
tggaagtgctcttctgaccaac

SEQ ID NO: 7712145 - DNA, 22 bp, Homo sapiens
tggaagtgctaaactggagtgt

SEQ ID NO: 7712146 - DNA, 22 bp, Homo sapiens
tggaagtgctaaactggagtgt

SEQ ID NO: 7712147 - DNA, 22 bp, Homo sapiens
tggaagtgctaaactggagtgt

SEQ ID NO: 7712148 - DNA, 22 bp, Homo sapiens
tggaagtgctaaactggagtgt

SEQ ID NO: 7712149 - DNA, 22 bp, Homo sapiens
tggaagtgattacaatgtagta

SEQ ID NO: 7712150 - DNA, 22 bp, Homo sapiens
tggaagtgccttgctggctgtg

SEQ ID NO: 7712151 - DNA, 22 bp, Homo sapiens
tggaagtgatgctgaggtgacg

SEQ ID NO: 7712152 - DNA, 22 bp, Homo sapiens
tggaagtgatgctgaggtgacg

SEQ ID NO: 7712153 - DNA, 22 bp, Homo sapiens
tggaagtgatgctgaggtgacg

SEQ ID NO: 7712154 - DNA, 17 bp, Homo sapiens
tggaagtgaggacactg

SEQ ID NO: 7712155 - DNA, 17 bp, Homo sapiens
tggaagtgaggacactg

SEQ ID NO: 7712156 - DNA, 22 bp, Homo sapiens
tggaagtgagaagtttcctcag

SEQ ID NO: 7712157 - DNA, 17 bp, Homo sapiens
tggaagtgaggacactg

SEQ ID NO: 7712158 - DNA, 22 bp, Homo sapiens
tggaagtccctgtgtgtggcct

SEQ ID NO: 7712159 - DNA, 21 bp, Homo sapiens
tggaagtcttgagtagggggc

SEQ ID NO: 7712160 - DNA, 22 bp, Homo sapiens
tggaataaaatgtcagttctta

SEQ ID NO: 7712161 - DNA, 22 bp, Homo sapiens
tggaagttgaatctcagtcatg

SEQ ID NO: 7712162 - DNA, 22 bp, Homo sapiens
tggaagttgaatctcagtcatg

SEQ ID NO: 7712163 - DNA, 22 bp, Homo sapiens
tggaataaaatgtcagttctta

SEQ ID NO: 7712164 - DNA, 22 bp, Homo sapiens
tggaataactcaccaaggtcat

SEQ ID NO: 7712165 - DNA, 22 bp, Homo sapiens
tggaataactcaccaaggtcat

SEQ ID NO: 7712166 - DNA, 22 bp, Homo sapiens
tggaataaagcagctttagttc

SEQ ID NO: 7712167 - DNA, 22 bp, Homo sapiens
tggaataaagtaagtctctatt

SEQ ID NO: 7712168 - DNA, 22 bp, Homo sapiens
tggaataaagtgctttgatcag

SEQ ID NO: 7712169 - DNA, 17 bp, Homo sapiens
tggaataaatttccccc

SEQ ID NO: 7712170 - DNA, 21 bp, Homo sapiens
tggaagtggttcatttgctgc

SEQ ID NO: 7712171 - DNA, 22 bp, Homo sapiens
tggaagtgtcctcttctgagtc

SEQ ID NO: 7712172 - DNA, 22 bp, Homo sapiens
tggaagtgtcctcttctgagtc

SEQ ID NO: 7712173 - DNA, 22 bp, Homo sapiens
tggaagtggcagaggaagtggt

SEQ ID NO: 7712174 - DNA, 22 bp, Homo sapiens
tggaagtgtctacatgtggagt

SEQ ID NO: 7712175 - DNA, 22 bp, Homo sapiens
tggaagtgtctacatgtggagt

SEQ ID NO: 7712176 - DNA, 22 bp, Homo sapiens
tggaagtgtctacatgtggagt

SEQ ID NO: 7712177 - DNA, 23 bp, Homo sapiens
tggaagtgtcttgggtattccag

SEQ ID NO: 7712178 - DNA, 20 bp, Homo sapiens
tggaagttctgttgcattgg

SEQ ID NO: 7712179 - DNA, 23 bp, Homo sapiens
tggaagtgtcttgggtattccag

SEQ ID NO: 7712180 - DNA, 19 bp, Homo sapiens
tggaatcagcaagaatatt

SEQ ID NO: 7712181 - DNA, 22 bp, Homo sapiens
tggaatcagactcctgcatttt

SEQ ID NO: 7712182 - DNA, 23 bp, Homo sapiens
tggaatcagccttttttccaagg

SEQ ID NO: 7712183 - DNA, 22 bp, Homo sapiens
tggaatcacctgttggtttgca

SEQ ID NO: 7712184 - DNA, 22 bp, Homo sapiens
tggaatcagactcctgcatttt

SEQ ID NO: 7712185 - DNA, 19 bp, Homo sapiens
tggaatcagcaagaatatt

SEQ ID NO: 7712186 - DNA, 22 bp, Homo sapiens
tggaatcaagaactttggttat

SEQ ID NO: 7712187 - DNA, 22 bp, Homo sapiens
tggaatatactcagaacaggct

SEQ ID NO: 7712188 - DNA, 22 bp, Homo sapiens
tggaatatgcaattgcatttca

SEQ ID NO: 7712189 - DNA, 22 bp, Homo sapiens
tggaatatgcaattgcatttca

SEQ ID NO: 7712190 - DNA, 22 bp, Homo sapiens
tggaatactgtaaagaaaaatc

SEQ ID NO: 7712191 - DNA, 20 bp, Homo sapiens
tggaataagttaagttgttt

SEQ ID NO: 7712192 - DNA, 22 bp, Homo sapiens
tggaataaggaatctttcagaa

SEQ ID NO: 7712193 - DNA, 22 bp, Homo sapiens
tggaataactcaccaaggtcat

SEQ ID NO: 7712194 - DNA, 22 bp, Homo sapiens
tggaataactcaccaaggtcat

SEQ ID NO: 7712195 - DNA, 20 bp, Homo sapiens
tggaataagttaagttgttt

SEQ ID NO: 7712196 - DNA, 23 bp, Homo sapiens
tggaataataaggtacattaaca

SEQ ID NO: 7712197 - DNA, 22 bp, Homo sapiens
tggaataatgaccacagaaaca

SEQ ID NO: 7712198 - DNA, 23 bp, Homo sapiens
tggaataataaggtacattaaca

SEQ ID NO: 7712199 - DNA, 22 bp, Homo sapiens
tggaataatgaccacagaaaca

SEQ ID NO: 7712200 - DNA, 23 bp, Homo sapiens
tggaataataaggtacattaaca

SEQ ID NO: 7712201 - DNA, 23 bp, Homo sapiens
tggaataataaggtacattaaca

SEQ ID NO: 7712202 - DNA, 22 bp, Homo sapiens
tggaatctgtatgtatgtataa

SEQ ID NO: 7712203 - DNA, 23 bp, Homo sapiens
tggaatcttcgatattgattcag

SEQ ID NO: 7712204 - DNA, 22 bp, Homo sapiens
tggaatgaaaagtacttcagaa

SEQ ID NO: 7712205 - DNA, 23 bp, Homo sapiens
tggaatcagccttttttccaagg

SEQ ID NO: 7712206 - DNA, 22 bp, Homo sapiens
tggaatcagttacatgtggttg

SEQ ID NO: 7712207 - DNA, 22 bp, Homo sapiens
tggaatcagttacatgtggttg

SEQ ID NO: 7712208 - DNA, 22 bp, Homo sapiens
tggaatcattgctgtgttgctt

SEQ ID NO: 7712209 - DNA, 22 bp, Homo sapiens
tggaatcattggagagctgtaa

SEQ ID NO: 7712210 - DNA, 18 bp, Homo sapiens
tggaatcattgtcaccat

SEQ ID NO: 7712211 - DNA, 18 bp, Homo sapiens
tggaatcattgtcaccat

SEQ ID NO: 7712212 - DNA, 18 bp, Homo sapiens
tggaatcctgatgctggg

SEQ ID NO: 7712213 - DNA, 22 bp, Homo sapiens
tggaatcccgcaatggaggatt

SEQ ID NO: 7712214 - DNA, 22 bp, Homo sapiens
tggaatcccgcaatggaggatt

SEQ ID NO: 7712215 - DNA, 21 bp, Homo sapiens
tggaatccccaagaaagcagc

SEQ ID NO: 7712216 - DNA, 22 bp, Homo sapiens
tggaatcattggagagctgtaa

SEQ ID NO: 7712217 - DNA, 22 bp, Homo sapiens
tggaatccataaatgtcagatt

SEQ ID NO: 7712218 - DNA, 22 bp, Homo sapiens
tggaaggggccaggcgcggagt

SEQ ID NO: 7712219 - DNA, 22 bp, Homo sapiens
tggaaggggccaggcgcggagt

SEQ ID NO: 7712220 - DNA, 22 bp, Homo sapiens
tggaaggggagttgttccacgt

SEQ ID NO: 7712221 - DNA, 22 bp, Homo sapiens
tggaaggggccaggcgcggagt

SEQ ID NO: 7712222 - DNA, 22 bp, Homo sapiens
tggaaggggccaggcgcggagt

SEQ ID NO: 7712223 - DNA, 22 bp, Homo sapiens
tggaaggggagttgttccacgt

SEQ ID NO: 7712224 - DNA, 22 bp, Homo sapiens
tggaaggggagttgttccacgt

SEQ ID NO: 7712225 - DNA, 22 bp, Homo sapiens
tggaaggggagttgttccacgt

SEQ ID NO: 7712226 - DNA, 22 bp, Homo sapiens
tggaaggggccaggcgcggagt

SEQ ID NO: 7712227 - DNA, 22 bp, Homo sapiens
tggaaggggagctggaaagggg

SEQ ID NO: 7712228 - DNA, 22 bp, Homo sapiens
tggaaggggagctggaaagggg

SEQ ID NO: 7712229 - DNA, 22 bp, Homo sapiens
tggaaggggccaggcgcggagt

SEQ ID NO: 7712230 - DNA, 22 bp, Homo sapiens
tggaaggggccaggcgcggagt

SEQ ID NO: 7712231 - DNA, 22 bp, Homo sapiens
tggaaggggccaggcgcggagt

SEQ ID NO: 7712232 - DNA, 22 bp, Homo sapiens
tggaaggggccaggcgcggagt

SEQ ID NO: 7712233 - DNA, 22 bp, Homo sapiens
tggaagggggaagacagctctg

SEQ ID NO: 7712234 - DNA, 22 bp, Homo sapiens
tggaagggggaagacagctctg

SEQ ID NO: 7712235 - DNA, 22 bp, Homo sapiens
tggaagggggaagacagctctg

SEQ ID NO: 7712236 - DNA, 22 bp, Homo sapiens
tggaagggggaagacagctctg

SEQ ID NO: 7712237 - DNA, 22 bp, Homo sapiens
tggaagggggaagacagctctg

SEQ ID NO: 7712238 - DNA, 22 bp, Homo sapiens
tggaagggggaagacagctctg

SEQ ID NO: 7712239 - DNA, 22 bp, Homo sapiens
tggaaggggttacgcagcagga

SEQ ID NO: 7712240 - DNA, 22 bp, Homo sapiens
tggaaggggttacgcagcagga

SEQ ID NO: 7712241 - DNA, 22 bp, Homo sapiens
tggaaggggttacgcagcagga

SEQ ID NO: 7712242 - DNA, 22 bp, Homo sapiens
tggaaggggttacgcagcagga

SEQ ID NO: 7712243 - DNA, 22 bp, Homo sapiens
tggaaggtgtggcaggtctagt

SEQ ID NO: 7712244 - DNA, 22 bp, Homo sapiens
tggaaggtggatatcctagtca

SEQ ID NO: 7712245 - DNA, 20 bp, Homo sapiens
tggaaggtcccagaggaatt

SEQ ID NO: 7712246 - DNA, 20 bp, Homo sapiens
tggaaggtcccagaggaatt

SEQ ID NO: 7712247 - DNA, 22 bp, Homo sapiens
tggaaggggttacgcagcagga

SEQ ID NO: 7712248 - DNA, 22 bp, Homo sapiens
tggaaggggttacgcagcagga

SEQ ID NO: 7712249 - DNA, 16 bp, Homo sapiens
tggaaggggtctccgg

SEQ ID NO: 7712250 - DNA, 22 bp, Homo sapiens
tggaaggggttacgcagcagga

SEQ ID NO: 7712251 - DNA, 22 bp, Homo sapiens
tggaaggggttacgcagcagga

SEQ ID NO: 7712252 - DNA, 22 bp, Homo sapiens
tggaaggggttacgcagcagga

SEQ ID NO: 7712253 - DNA, 22 bp, Homo sapiens
tggaagggggaagacagctctg

SEQ ID NO: 7712254 - DNA, 16 bp, Homo sapiens
tggaaggggtctccgg

SEQ ID NO: 7712255 - DNA, 16 bp, Homo sapiens
tggaaggggtctccgg

SEQ ID NO: 7712256 - DNA, 16 bp, Homo sapiens
tggaaggggtctccgg

SEQ ID NO: 7712257 - DNA, 22 bp, Homo sapiens
tggaagggggaagacagctctg

SEQ ID NO: 7712258 - DNA, 22 bp, Homo sapiens
tggaagggggaagacagctctg

SEQ ID NO: 7712259 - DNA, 22 bp, Homo sapiens
tggaaggagactgggaagtgtg

SEQ ID NO: 7712260 - DNA, 22 bp, Homo sapiens
tggaaggagactgggaagtgtg

SEQ ID NO: 7712261 - DNA, 22 bp, Homo sapiens
tggaaggagctaaggacctggg

SEQ ID NO: 7712262 - DNA, 22 bp, Homo sapiens
tggaaggagactgggaagtgtg

SEQ ID NO: 7712263 - DNA, 22 bp, Homo sapiens
tggaaggagactgggaagtgtg

SEQ ID NO: 7712264 - DNA, 22 bp, Homo sapiens
tggaaggagctaaggacctggg

SEQ ID NO: 7712265 - DNA, 22 bp, Homo sapiens
tggaaggcaacggagtgagctg

SEQ ID NO: 7712266 - DNA, 22 bp, Homo sapiens
tggaaggagctaaggacctggg

SEQ ID NO: 7712267 - DNA, 22 bp, Homo sapiens
tggaaggagctaaggacctggg

SEQ ID NO: 7712268 - DNA, 22 bp, Homo sapiens
tggaaggagctaaggacctggg

SEQ ID NO: 7712269 - DNA, 22 bp, Homo sapiens
tggaaggaagccaaggaaggtt

SEQ ID NO: 7712270 - DNA, 22 bp, Homo sapiens
tggaaggagactgggaagtgtg

SEQ ID NO: 7712271 - DNA, 22 bp, Homo sapiens
tggaaggagactgggaagtgtg

SEQ ID NO: 7712272 - DNA, 22 bp, Homo sapiens
tggaaggagactgggaagtgtg

SEQ ID NO: 7712273 - DNA, 22 bp, Homo sapiens
tggaaggaagccaaggaaggtt

SEQ ID NO: 7712274 - DNA, 22 bp, Homo sapiens
tggaaggaagccaaggaaggtt

SEQ ID NO: 7712275 - DNA, 22 bp, Homo sapiens
tggaaggaagccaaggaaggtt

SEQ ID NO: 7712276 - DNA, 22 bp, Homo sapiens
tggaaggaagccaaggaaggtt

SEQ ID NO: 7712277 - DNA, 22 bp, Homo sapiens
tggaaggaagccaaggaaggtt

SEQ ID NO: 7712278 - DNA, 22 bp, Homo sapiens
tggaagggagtgacagtcagag

SEQ ID NO: 7712279 - DNA, 22 bp, Homo sapiens
tggaagggagtgacagtcagag

SEQ ID NO: 7712280 - DNA, 22 bp, Homo sapiens
tggaagggagtgacagtcagag

SEQ ID NO: 7712281 - DNA, 22 bp, Homo sapiens
tggaagggagtgacagtcagag

SEQ ID NO: 7712282 - DNA, 22 bp, Homo sapiens
tggaaggagactgggaagtgtg

SEQ ID NO: 7712283 - DNA, 22 bp, Homo sapiens
tggaaggcaacggagtgagctg

SEQ ID NO: 7712284 - DNA, 22 bp, Homo sapiens
tggaagggagtgacagtcagag

SEQ ID NO: 7712285 - DNA, 22 bp, Homo sapiens
tggaagggagtgacagtcagag

SEQ ID NO: 7712286 - DNA, 22 bp, Homo sapiens
tggaagggagtgacagtcagag

SEQ ID NO: 7712287 - DNA, 22 bp, Homo sapiens
tggaagggagtgacagtcagag

SEQ ID NO: 7712288 - DNA, 22 bp, Homo sapiens
tggaaggggagctggaaagggg

SEQ ID NO: 7712289 - DNA, 22 bp, Homo sapiens
tggaaggggagctggaaagggg

SEQ ID NO: 7712290 - DNA, 22 bp, Homo sapiens
tggaaggggagctggaaagggg

SEQ ID NO: 7712291 - DNA, 22 bp, Homo sapiens
tggaaggggagctggaaagggg

SEQ ID NO: 7712292 - DNA, 22 bp, Homo sapiens
tggaaggggagctggaaagggg

SEQ ID NO: 7712293 - DNA, 22 bp, Homo sapiens
tggaaggggagctggaaagggg

SEQ ID NO: 7712294 - DNA, 22 bp, Homo sapiens
tggaaggggagctggaaagggg

SEQ ID NO: 7712295 - DNA, 22 bp, Homo sapiens
tggaaggggagctggaaagggg

SEQ ID NO: 7712296 - DNA, 22 bp, Homo sapiens
tggaaggggagctggaaagggg

SEQ ID NO: 7712297 - DNA, 22 bp, Homo sapiens
tggaaggggagctggaaagggg

SEQ ID NO: 7712298 - DNA, 22 bp, Homo sapiens
tggaaggggagctggaaagggg

SEQ ID NO: 7712299 - DNA, 22 bp, Homo sapiens
tggaaggggagctggaaagggg

SEQ ID NO: 7712300 - DNA, 22 bp, Homo sapiens
tggaaggggagctggaaagggg

SEQ ID NO: 7712301 - DNA, 22 bp, Homo sapiens
tggaaggggagctggaaagggg

SEQ ID NO: 7712302 - DNA, 22 bp, Homo sapiens
tggaaggggagctggaaagggg

SEQ ID NO: 7712303 - DNA, 20 bp, Homo sapiens
tggaagaggagatgcctctg

SEQ ID NO: 7712304 - DNA, 20 bp, Homo sapiens
tggaagaggagatgcctctg

SEQ ID NO: 7712305 - DNA, 20 bp, Homo sapiens
tggaagaggagatgcctctg

SEQ ID NO: 7712306 - DNA, 19 bp, Homo sapiens
tggaagaggaagggaaata

SEQ ID NO: 7712307 - DNA, 20 bp, Homo sapiens
tggaagaggagatgcctctg

SEQ ID NO: 7712308 - DNA, 20 bp, Homo sapiens
tggaagaggagatgcctctg

SEQ ID NO: 7712309 - DNA, 20 bp, Homo sapiens
tggaagaggagatgcctctg

SEQ ID NO: 7712310 - DNA, 22 bp, Homo sapiens
tggaagaggccagaaagtggga

SEQ ID NO: 7712311 - DNA, 22 bp, Homo sapiens
tggaagaggccagaaagtggga

SEQ ID NO: 7712312 - DNA, 22 bp, Homo sapiens
tggaagaggccagaaagtggga

SEQ ID NO: 7712313 - DNA, 22 bp, Homo sapiens
tggaagaggcccatgactgcct

SEQ ID NO: 7712314 - DNA, 22 bp, Homo sapiens
tggaagaggcccatgactgcct

SEQ ID NO: 7712315 - DNA, 22 bp, Homo sapiens
tggaagaggcccatgactgcct

SEQ ID NO: 7712316 - DNA, 22 bp, Homo sapiens
tggaagaggccagaaagtggga

SEQ ID NO: 7712317 - DNA, 22 bp, Homo sapiens
tggaagaggccagaaagtggga

SEQ ID NO: 7712318 - DNA, 22 bp, Homo sapiens
tggaagaggccagaaagtggga

SEQ ID NO: 7712319 - DNA, 22 bp, Homo sapiens
tggaagaggccagaaagtggga

SEQ ID NO: 7712320 - DNA, 22 bp, Homo sapiens
tggaagagggagctgggtggcc

SEQ ID NO: 7712321 - DNA, 22 bp, Homo sapiens
tggaagaggcccatgactgcct

SEQ ID NO: 7712322 - DNA, 22 bp, Homo sapiens
tggaagagggagctgggtggcc

SEQ ID NO: 7712323 - DNA, 22 bp, Homo sapiens
tggaagaggcccatgactgcct

SEQ ID NO: 7712324 - DNA, 22 bp, Homo sapiens
tggaagaggcccatgactgcct

SEQ ID NO: 7712325 - DNA, 22 bp, Homo sapiens
tggaagaggcccatgactgcct

SEQ ID NO: 7712326 - DNA, 22 bp, Homo sapiens
tggaagatcaaccaggattgac

SEQ ID NO: 7712327 - DNA, 22 bp, Homo sapiens
tggaagatgaataaagattcta

SEQ ID NO: 7712328 - DNA, 22 bp, Homo sapiens
tggaagatatgctgattctctg

SEQ ID NO: 7712329 - DNA, 22 bp, Homo sapiens
tggaagataagagattgggaag

SEQ ID NO: 7712330 - DNA, 22 bp, Homo sapiens
tggaagaggtggaagtggcttc

SEQ ID NO: 7712331 - DNA, 22 bp, Homo sapiens
tggaagataagagattgggaag

SEQ ID NO: 7712332 - DNA, 22 bp, Homo sapiens
tggaagaggtggaagtggcttc

SEQ ID NO: 7712333 - DNA, 22 bp, Homo sapiens
tggaagaggtggaagtggcttc

SEQ ID NO: 7712334 - DNA, 22 bp, Homo sapiens
tggaagaggtggaagtggcttc

SEQ ID NO: 7712335 - DNA, 22 bp, Homo sapiens
tggaagaggcccatgactgcct

SEQ ID NO: 7712336 - DNA, 22 bp, Homo sapiens
tggaagaggtggaagtggcttc

SEQ ID NO: 7712337 - DNA, 22 bp, Homo sapiens
tggaagagggagctgggtggcc

SEQ ID NO: 7712338 - DNA, 22 bp, Homo sapiens
tggaagagggagctgggtggcc

SEQ ID NO: 7712339 - DNA, 22 bp, Homo sapiens
tggaagagggagctgggtggcc

SEQ ID NO: 7712340 - DNA, 22 bp, Homo sapiens
tggaagaggtggaagtggcttc

SEQ ID NO: 7712341 - DNA, 22 bp, Homo sapiens
tggaagaggtggaagtggcttc

SEQ ID NO: 7712342 - DNA, 22 bp, Homo sapiens
tggaagagggagctgggtggcc

SEQ ID NO: 7712343 - DNA, 22 bp, Homo sapiens
tggaagagggagctgggtggcc

SEQ ID NO: 7712344 - DNA, 22 bp, Homo sapiens
tggaagagacacttacattcag

SEQ ID NO: 7712345 - DNA, 22 bp, Homo sapiens
tggaagagaaaggagtggatct

SEQ ID NO: 7712346 - DNA, 22 bp, Homo sapiens
tggaagagaaaggagtggatct

SEQ ID NO: 7712347 - DNA, 22 bp, Homo sapiens
tggaagagaaaggagtggatct

SEQ ID NO: 7712348 - DNA, 22 bp, Homo sapiens
tggaagagaaaggagtggatct

SEQ ID NO: 7712349 - DNA, 22 bp, Homo sapiens
tggaagagaaaatccaccctta

SEQ ID NO: 7712350 - DNA, 22 bp, Homo sapiens
tggaagagaaaggagtggatct

SEQ ID NO: 7712351 - DNA, 22 bp, Homo sapiens
tggaagagaaaggagtggatct

SEQ ID NO: 7712352 - DNA, 22 bp, Homo sapiens
tggaagagaaaggagtggatct

SEQ ID NO: 7712353 - DNA, 22 bp, Homo sapiens
tggaagagcaggcagacaatgc

SEQ ID NO: 7712354 - DNA, 22 bp, Homo sapiens
tggaagagcaggcagacaatgc

SEQ ID NO: 7712355 - DNA, 22 bp, Homo sapiens
tggaagagcaggcagacaatgc

SEQ ID NO: 7712356 - DNA, 22 bp, Homo sapiens
tggaagagcaggcagacaatgc

SEQ ID NO: 7712357 - DNA, 22 bp, Homo sapiens
tggaagagcaggcagacaatgc

SEQ ID NO: 7712358 - DNA, 22 bp, Homo sapiens
tggaagagcaggcagacaatgc

SEQ ID NO: 7712359 - DNA, 19 bp, Homo sapiens
tggaagaggaagggaaata

SEQ ID NO: 7712360 - DNA, 19 bp, Homo sapiens
tggaagaggaagggaaata

SEQ ID NO: 7712361 - DNA, 19 bp, Homo sapiens
tggaagaggaagggaaata

SEQ ID NO: 7712362 - DNA, 19 bp, Homo sapiens
tggaagaggaagggaaata

SEQ ID NO: 7712363 - DNA, 22 bp, Homo sapiens
tggaagaccagacttcccgaac

SEQ ID NO: 7712364 - DNA, 22 bp, Homo sapiens
tggaagaccacaagcccttaac

SEQ ID NO: 7712365 - DNA, 22 bp, Homo sapiens
tggaagaccagacttcccgaac

SEQ ID NO: 7712366 - DNA, 22 bp, Homo sapiens
tggaagaccagacttcccgaac

SEQ ID NO: 7712367 - DNA, 22 bp, Homo sapiens
tggaagacggaaatctgtagat

SEQ ID NO: 7712368 - DNA, 20 bp, Homo sapiens
tggaagaagaactcaggctt

SEQ ID NO: 7712369 - DNA, 22 bp, Homo sapiens
tggaagacggaaatctgtagat

SEQ ID NO: 7712370 - DNA, 22 bp, Homo sapiens
tggaagacggaaatctgtagat

SEQ ID NO: 7712371 - DNA, 23 bp, Homo sapiens
tggaagactcctctcttggctgc

SEQ ID NO: 7712372 - DNA, 23 bp, Homo sapiens
tggaagactcctctcttggctgc

SEQ ID NO: 7712373 - DNA, 22 bp, Homo sapiens
tggaagagaaaatccaccctta

SEQ ID NO: 7712374 - DNA, 22 bp, Homo sapiens
tggaagactcaaggtggtgaat

SEQ ID NO: 7712375 - DNA, 22 bp, Homo sapiens
tggaagactatcccgtgatttt

SEQ ID NO: 7712376 - DNA, 22 bp, Homo sapiens
tggaagactcaaggtggtgaat

SEQ ID NO: 7712377 - DNA, 22 bp, Homo sapiens
tggaagactcaaggtggtgaat

SEQ ID NO: 7712378 - DNA, 20 bp, Homo sapiens
tggaagaagaactcaggctt

SEQ ID NO: 7712379 - DNA, 22 bp, Homo sapiens
tggaagacatactgttttctta

SEQ ID NO: 7712380 - DNA, 22 bp, Homo sapiens
tggaagacatactgttttctta

SEQ ID NO: 7712381 - DNA, 22 bp, Homo sapiens
tggaagacatactgttttctta

SEQ ID NO: 7712382 - DNA, 22 bp, Homo sapiens
tggaagacattattttgtttgt

SEQ ID NO: 7712383 - DNA, 22 bp, Homo sapiens
tggaagacattattttgtttgt

SEQ ID NO: 7712384 - DNA, 22 bp, Homo sapiens
tggaagaccagacttcccgaac

SEQ ID NO: 7712385 - DNA, 22 bp, Homo sapiens
tggaagacattttggaccttgg

SEQ ID NO: 7712386 - DNA, 22 bp, Homo sapiens
tggaagaccacaagcccttaac

SEQ ID NO: 7712387 - DNA, 22 bp, Homo sapiens
tggaagacattttggaccttgg

SEQ ID NO: 7712388 - DNA, 22 bp, Homo sapiens
tggaagacattttggaccttgg

SEQ ID NO: 7712389 - DNA, 22 bp, Homo sapiens
tggaagacattgctttcctttg

SEQ ID NO: 7712390 - DNA, 22 bp, Homo sapiens
tggaagacattgctttcctttg

SEQ ID NO: 7712391 - DNA, 17 bp, Homo sapiens
tggaagcttcatgttgg

SEQ ID NO: 7712392 - DNA, 22 bp, Homo sapiens
tggaagcttcctgttcttgagg

SEQ ID NO: 7712393 - DNA, 18 bp, Homo sapiens
tggaagctggtgagcaga

SEQ ID NO: 7712394 - DNA, 18 bp, Homo sapiens
tggaagctggtgagcaga

SEQ ID NO: 7712395 - DNA, 17 bp, Homo sapiens
tggaagcttcatgttgg

SEQ ID NO: 7712396 - DNA, 18 bp, Homo sapiens
tggaagctggtgagcaga

SEQ ID NO: 7712397 - DNA, 22 bp, Homo sapiens
tggaagctcaaggcagggtgag

SEQ ID NO: 7712398 - DNA, 18 bp, Homo sapiens
tggaagctggcagatttt

SEQ ID NO: 7712399 - DNA, 22 bp, Homo sapiens
tggaagctcaaggcagggtgag

SEQ ID NO: 7712400 - DNA, 22 bp, Homo sapiens
tggaagcccagaaggaagcaga

SEQ ID NO: 7712401 - DNA, 22 bp, Homo sapiens
tggaagcctcagtttgccttct

SEQ ID NO: 7712402 - DNA, 22 bp, Homo sapiens
tggaagcttttgagattgttgc

SEQ ID NO: 7712403 - DNA, 22 bp, Homo sapiens
tggaaggaaaggtagcagagaa

SEQ ID NO: 7712404 - DNA, 22 bp, Homo sapiens
tggaaggaaaggtagcagagaa

SEQ ID NO: 7712405 - DNA, 22 bp, Homo sapiens
tggaaggaaaggtagcagagaa

SEQ ID NO: 7712406 - DNA, 22 bp, Homo sapiens
tggaaggaaaggtagcagagaa

SEQ ID NO: 7712407 - DNA, 22 bp, Homo sapiens
tggaaggaaaggtagcagagaa

SEQ ID NO: 7712408 - DNA, 22 bp, Homo sapiens
tggaaggaaaggtagcagagaa

SEQ ID NO: 7712409 - DNA, 22 bp, Homo sapiens
tggaaggaaaggtagcagagaa

SEQ ID NO: 7712410 - DNA, 22 bp, Homo sapiens
tggaaggaaaggtagcagagaa

SEQ ID NO: 7712411 - DNA, 22 bp, Homo sapiens
tggaaggaacagagtttgaaac

SEQ ID NO: 7712412 - DNA, 22 bp, Homo sapiens
tggaaggaacagagtttgaaac

SEQ ID NO: 7712413 - DNA, 22 bp, Homo sapiens
tggaaggaacagagtttgaaac

SEQ ID NO: 7712414 - DNA, 22 bp, Homo sapiens
tggaaggaagccaaggaaggtt

SEQ ID NO: 7712415 - DNA, 22 bp, Homo sapiens
tggaaggaagccaaggaaggtt

SEQ ID NO: 7712416 - DNA, 22 bp, Homo sapiens
tggaaggaagccaaggaaggtt

SEQ ID NO: 7712417 - DNA, 22 bp, Homo sapiens
tggaaggaagccaaggaaggtt

SEQ ID NO: 7712418 - DNA, 22 bp, Homo sapiens
tggaagcatcacttcttgcctg

SEQ ID NO: 7712419 - DNA, 22 bp, Homo sapiens
tggaagccaaggtcagaaggag

SEQ ID NO: 7712420 - DNA, 22 bp, Homo sapiens
tggaagccaaggtcagaaggag

SEQ ID NO: 7712421 - DNA, 22 bp, Homo sapiens
tggaagccaaggtcagaaggag

SEQ ID NO: 7712422 - DNA, 22 bp, Homo sapiens
tggaagccagctgggcacctgc

SEQ ID NO: 7712423 - DNA, 22 bp, Homo sapiens
tggaagccaggaagcaggggtc

SEQ ID NO: 7712424 - DNA, 22 bp, Homo sapiens
tggaagccaggaagcaggggtc

SEQ ID NO: 7712425 - DNA, 22 bp, Homo sapiens
tggaagcccagaaggaagcaga

SEQ ID NO: 7712426 - DNA, 22 bp, Homo sapiens
tggaagcccagaaggaagcaga

SEQ ID NO: 7712427 - DNA, 22 bp, Homo sapiens
tggaagcccagaaggaagcaga

SEQ ID NO: 7712428 - DNA, 22 bp, Homo sapiens
tggaagccaggcccgctcctaa

SEQ ID NO: 7712429 - DNA, 22 bp, Homo sapiens
tggaagcagtgattcttgtctg

SEQ ID NO: 7712430 - DNA, 22 bp, Homo sapiens
tggaagcatacccccttagcac

SEQ ID NO: 7712431 - DNA, 23 bp, Homo sapiens
tggaagcagttccagcacaaata

SEQ ID NO: 7712432 - DNA, 22 bp, Homo sapiens
tggaagcagtgattcttgtctg

SEQ ID NO: 7712433 - DNA, 22 bp, Homo sapiens
tggaagcagtgattcttgtctg

SEQ ID NO: 7712434 - DNA, 22 bp, Homo sapiens
tggaagcatcacttcttgcctg

SEQ ID NO: 7712435 - DNA, 22 bp, Homo sapiens
tggaagcatagcagcgtgtgtg

SEQ ID NO: 7712436 - DNA, 22 bp, Homo sapiens
tggaagcacttgggttttgttg

SEQ ID NO: 7712437 - DNA, 23 bp, Homo sapiens
tggaagcagaagtttcaatatcc

SEQ ID NO: 7712438 - DNA, 22 bp, Homo sapiens
tggaagcacttgggttttgttg

SEQ ID NO: 7712439 - DNA, 22 bp, Homo sapiens
tggaagcagcattaatgagtta

SEQ ID NO: 7712440 - DNA, 22 bp, Homo sapiens
tggaagcagtcacttcctagtt

SEQ ID NO: 7712441 - DNA, 22 bp, Homo sapiens
tggaagcagtcacttcctagtt

SEQ ID NO: 7712442 - DNA, 22 bp, Homo sapiens
tggaagcagagagctatcacca

SEQ ID NO: 7712443 - DNA, 22 bp, Homo sapiens
tggaagcagagagctatcacca

SEQ ID NO: 7712444 - DNA, 23 bp, Homo sapiens
tggaagcaatcactgtagtgaat

SEQ ID NO: 7712445 - DNA, 23 bp, Homo sapiens
tggaagcaatcactgtagtgaat

SEQ ID NO: 7712446 - DNA, 22 bp, Homo sapiens
tggaagcaacaactatggacca

SEQ ID NO: 7712447 - DNA, 22 bp, Homo sapiens
tggaagcaacactcagctttac

SEQ ID NO: 7712448 - DNA, 22 bp, Homo sapiens
tggaagcactgaagagacaacc

SEQ ID NO: 7712449 - DNA, 22 bp, Homo sapiens
tggaagcactgaagagacaacc

SEQ ID NO: 7712450 - DNA, 22 bp, Homo sapiens
tggaagcactgaagagacaacc

SEQ ID NO: 7712451 - DNA, 22 bp, Homo sapiens
tggaagcacaggatcagtggaa

SEQ ID NO: 7712452 - DNA, 22 bp, Homo sapiens
tgaggtagaaaaagcttgtagt

SEQ ID NO: 7712453 - DNA, 22 bp, Homo sapiens
tgaggtaatgtgtacgttaatt

SEQ ID NO: 7712454 - DNA, 22 bp, Homo sapiens
tgaggtaaatagaaaaaccatg

SEQ ID NO: 7712455 - DNA, 22 bp, Homo sapiens
tgaggtaaattctggcccaaac

SEQ ID NO: 7712456 - DNA, 22 bp, Homo sapiens
tgaggtaataagtgtttgtttt

SEQ ID NO: 7712457 - DNA, 22 bp, Homo sapiens
tgaggtagagattgtgactgta

SEQ ID NO: 7712458 - DNA, 22 bp, Homo sapiens
tgaggtagaagttgggctgctt

SEQ ID NO: 7712459 - DNA, 22 bp, Homo sapiens
tgaggtaaatagaaaaaccatg

SEQ ID NO: 7712460 - DNA, 22 bp, Homo sapiens
tgaggtagaagcctgggttgag

SEQ ID NO: 7712461 - DNA, 22 bp, Homo sapiens
tgaggtagctgctatttgtagt

SEQ ID NO: 7712462 - DNA, 22 bp, Homo sapiens
tgaggtagagattgtgactgta

SEQ ID NO: 7712463 - DNA, 21 bp, Homo sapiens
tgaggtagccagtgagatgga

SEQ ID NO: 7712464 - DNA, 22 bp, Homo sapiens
tgaggtaggaatttgtattggg

SEQ ID NO: 7712465 - DNA, 22 bp, Homo sapiens
tgaggtagctgtttagaaagac

SEQ ID NO: 7712466 - DNA, 22 bp, Homo sapiens
tgagggtgtgcggcccagacag

SEQ ID NO: 7712467 - DNA, 22 bp, Homo sapiens
tgagggtttccgggcagtggac

SEQ ID NO: 7712468 - DNA, 22 bp, Homo sapiens
tgagggtttttgagcagtgatt

SEQ ID NO: 7712469 - DNA, 22 bp, Homo sapiens
tgagggtgtgcggcccagacag

SEQ ID NO: 7712470 - DNA, 22 bp, Homo sapiens
tgagggtgggcctgcaggaaga

SEQ ID NO: 7712471 - DNA, 22 bp, Homo sapiens
tgagggtgggcctgcaggaaga

SEQ ID NO: 7712472 - DNA, 22 bp, Homo sapiens
tgagggtgggcctgcaggaaga

SEQ ID NO: 7712473 - DNA, 22 bp, Homo sapiens
tgagggtgggcctgcaggaaga

SEQ ID NO: 7712474 - DNA, 22 bp, Homo sapiens
tgagggtgggcctgcaggaaga

SEQ ID NO: 7712475 - DNA, 22 bp, Homo sapiens
tgagggtgggccctgggcatct

SEQ ID NO: 7712476 - DNA, 22 bp, Homo sapiens
tgagggtggcacaggcacaaag

SEQ ID NO: 7712477 - DNA, 22 bp, Homo sapiens
tgagggtggcacaggcacaaag

SEQ ID NO: 7712478 - DNA, 22 bp, Homo sapiens
tgagggtggccttgtgtggact

SEQ ID NO: 7712479 - DNA, 22 bp, Homo sapiens
tgagggtggccttgtgtggact

SEQ ID NO: 7712480 - DNA, 22 bp, Homo sapiens
tgagggtggccttgtgtggact

SEQ ID NO: 7712481 - DNA, 22 bp, Homo sapiens
tgagggtgggccctgggcatct

SEQ ID NO: 7712482 - DNA, 22 bp, Homo sapiens
tgagggtgggccctgggcatct

SEQ ID NO: 7712483 - DNA, 22 bp, Homo sapiens
tgagggtggccttgtgtggact

SEQ ID NO: 7712484 - DNA, 22 bp, Homo sapiens
tgagggtgggccctgggcatct

SEQ ID NO: 7712485 - DNA, 22 bp, Homo sapiens
tgagggtggccttgtgtggact

SEQ ID NO: 7712486 - DNA, 22 bp, Homo sapiens
tgagggtgggccctgggcatct

SEQ ID NO: 7712487 - DNA, 22 bp, Homo sapiens
tgaggtaggagggtgatcagca

SEQ ID NO: 7712488 - DNA, 18 bp, Homo sapiens
tgaggtagctttcctcct

SEQ ID NO: 7712489 - DNA, 22 bp, Homo sapiens
tgaggtaggagggtgatcagca

SEQ ID NO: 7712490 - DNA, 22 bp, Homo sapiens
tgaggtaggataagacaatgag

SEQ ID NO: 7712491 - DNA, 22 bp, Homo sapiens
tgaggtctcagctgggaagact

SEQ ID NO: 7712492 - DNA, 22 bp, Homo sapiens
tgaggtctgcagggctgtgcat

SEQ ID NO: 7712493 - DNA, 22 bp, Homo sapiens
tgaggtctgctcaagtccctgg

SEQ ID NO: 7712494 - DNA, 22 bp, Homo sapiens
tgaggtctgctcaagtccctgg

SEQ ID NO: 7712495 - DNA, 22 bp, Homo sapiens
tgaggtgaagagtggagctcag

SEQ ID NO: 7712496 - DNA, 22 bp, Homo sapiens
tgaggtcttttatagtgtgtca

SEQ ID NO: 7712497 - DNA, 22 bp, Homo sapiens
tgaggtcttttatagtgtgtca

SEQ ID NO: 7712498 - DNA, 22 bp, Homo sapiens
tgaggtgaagagtggagctcag

SEQ ID NO: 7712499 - DNA, 22 bp, Homo sapiens
tgaggtcttttatagtgtgtca

SEQ ID NO: 7712500 - DNA, 22 bp, Homo sapiens
tgaggtgaagagtggagctcag

SEQ ID NO: 7712501 - DNA, 22 bp, Homo sapiens
tgaggtgaaggagttttaaagt

SEQ ID NO: 7712502 - DNA, 22 bp, Homo sapiens
tgaggtgaaggagttttaaagt

SEQ ID NO: 7712503 - DNA, 22 bp, Homo sapiens
tgaggtgaatggtgtccctgga

SEQ ID NO: 7712504 - DNA, 22 bp, Homo sapiens
tgaggtgaatggtgtccctgga

SEQ ID NO: 7712505 - DNA, 22 bp, Homo sapiens
tgaggtgagtcatgcattggag

SEQ ID NO: 7712506 - DNA, 22 bp, Homo sapiens
tgaggtgagtcagtttctgatg

SEQ ID NO: 7712507 - DNA, 22 bp, Homo sapiens
tgaggtgagtcatgcattggag

SEQ ID NO: 7712508 - DNA, 22 bp, Homo sapiens
tgaggtgagtcatgcattggag

SEQ ID NO: 7712509 - DNA, 22 bp, Homo sapiens
tgaggtgagtcatgcattggag

SEQ ID NO: 7712510 - DNA, 22 bp, Homo sapiens
tgaggtgaggttgaggaaagaa

SEQ ID NO: 7712511 - DNA, 22 bp, Homo sapiens
tgaggtgagtcagtttctgatg

SEQ ID NO: 7712512 - DNA, 22 bp, Homo sapiens
tgaggtgagcatctttatcttc

SEQ ID NO: 7712513 - DNA, 22 bp, Homo sapiens
tgaggtgagatggctaccccaa

SEQ ID NO: 7712514 - DNA, 22 bp, Homo sapiens
tgaggtgagcatctttatcttc

SEQ ID NO: 7712515 - DNA, 22 bp, Homo sapiens
tgaggtgagcatctttatcttc

SEQ ID NO: 7712516 - DNA, 22 bp, Homo sapiens
tgaggtgaggttgaggaaagaa

SEQ ID NO: 7712517 - DNA, 22 bp, Homo sapiens
tgaggtgaggttgaggaaagaa

SEQ ID NO: 7712518 - DNA, 22 bp, Homo sapiens
tgaggtgaggttgaggaaagaa

SEQ ID NO: 7712519 - DNA, 22 bp, Homo sapiens
tgaggtgaccgcagatgggaag

SEQ ID NO: 7712520 - DNA, 22 bp, Homo sapiens
tgaggtgagatggctaccccaa

SEQ ID NO: 7712521 - DNA, 22 bp, Homo sapiens
tgaggtgacacaatttactcca

SEQ ID NO: 7712522 - DNA, 22 bp, Homo sapiens
tgaggtgagatggctaccccaa

SEQ ID NO: 7712523 - DNA, 22 bp, Homo sapiens
tgaggtgacacaatttactcca

SEQ ID NO: 7712524 - DNA, 22 bp, Homo sapiens
tgaggtgacacaatttactcca

SEQ ID NO: 7712525 - DNA, 22 bp, Homo sapiens
tgaggtgaccgcagatgggaag

SEQ ID NO: 7712526 - DNA, 22 bp, Homo sapiens
tgaggtgaccgcagatgggaag

SEQ ID NO: 7712527 - DNA, 22 bp, Homo sapiens
tgaggtgacaattcattctcca

SEQ ID NO: 7712528 - DNA, 22 bp, Homo sapiens
tgaggtgacaattcattctcca

SEQ ID NO: 7712529 - DNA, 22 bp, Homo sapiens
tgaggtgacaattcattctcca

SEQ ID NO: 7712530 - DNA, 20 bp, Homo sapiens
tgaggtgaatgtcttttaga

SEQ ID NO: 7712531 - DNA, 20 bp, Homo sapiens
tgaggtgaatgtcttttaga

SEQ ID NO: 7712532 - DNA, 22 bp, Homo sapiens
tgaggtgaatggtgtccctgga

SEQ ID NO: 7712533 - DNA, 22 bp, Homo sapiens
tgaggtgaatggtgtccctgga

SEQ ID NO: 7712534 - DNA, 22 bp, Homo sapiens
tgaggggcgctggcaggttcct

SEQ ID NO: 7712535 - DNA, 22 bp, Homo sapiens
tgaggggccgcccaagcacttc

SEQ ID NO: 7712536 - DNA, 22 bp, Homo sapiens
tgaggggccgcccaagcacttc

SEQ ID NO: 7712537 - DNA, 22 bp, Homo sapiens
tgaggggcgctggcaggttcct

SEQ ID NO: 7712538 - DNA, 22 bp, Homo sapiens
tgaggggccgcccaagcacttc

SEQ ID NO: 7712539 - DNA, 22 bp, Homo sapiens
tgaggggccgcccaagcacttc

SEQ ID NO: 7712540 - DNA, 22 bp, Homo sapiens
tgaggggccgcccaagcacttc

SEQ ID NO: 7712541 - DNA, 22 bp, Homo sapiens
tgaggggccgcccaagcacttc

SEQ ID NO: 7712542 - DNA, 22 bp, Homo sapiens
tgaggggccgcccaagcacttc

SEQ ID NO: 7712543 - DNA, 22 bp, Homo sapiens
tgaggggccgcccaagcacttc

SEQ ID NO: 7712544 - DNA, 22 bp, Homo sapiens
tgaggggccagaccccacctag

SEQ ID NO: 7712545 - DNA, 22 bp, Homo sapiens
tgaggggccagaccccacctag

SEQ ID NO: 7712546 - DNA, 22 bp, Homo sapiens
tgaggggccagaccccacctag

SEQ ID NO: 7712547 - DNA, 22 bp, Homo sapiens
tgaggggcatgtgtttacacat

SEQ ID NO: 7712548 - DNA, 22 bp, Homo sapiens
tgaggggcatgtgtttacacat

SEQ ID NO: 7712549 - DNA, 22 bp, Homo sapiens
tgaggggcggcctgcagaggcc

SEQ ID NO: 7712550 - DNA, 19 bp, Homo sapiens
tgaggggctcacagtctca

SEQ ID NO: 7712551 - DNA, 22 bp, Homo sapiens
tgaggggcggcctgcagaggcc

SEQ ID NO: 7712552 - DNA, 22 bp, Homo sapiens
tgaggggcggcctgcagaggcc

SEQ ID NO: 7712553 - DNA, 19 bp, Homo sapiens
tgaggggctcacagtctca

SEQ ID NO: 7712554 - DNA, 19 bp, Homo sapiens
tgaggggctcacagtctca

SEQ ID NO: 7712555 - DNA, 19 bp, Homo sapiens
tgaggggctcacagtctca

SEQ ID NO: 7712556 - DNA, 19 bp, Homo sapiens
tgaggggctcacagtctca

SEQ ID NO: 7712557 - DNA, 19 bp, Homo sapiens
tgaggggctcacagtctca

SEQ ID NO: 7712558 - DNA, 22 bp, Homo sapiens
tgaggggcggcctgcagaggcc

SEQ ID NO: 7712559 - DNA, 22 bp, Homo sapiens
tgaggggcggcctgcagaggcc

SEQ ID NO: 7712560 - DNA, 22 bp, Homo sapiens
tgaggggcggcctgcagaggcc

SEQ ID NO: 7712561 - DNA, 22 bp, Homo sapiens
tgaggggcgctggcaggttcct

SEQ ID NO: 7712562 - DNA, 22 bp, Homo sapiens
tgaggggcgctggcaggttcct

SEQ ID NO: 7712563 - DNA, 22 bp, Homo sapiens
tgaggggcgctggcaggttcct

SEQ ID NO: 7712564 - DNA, 22 bp, Homo sapiens
tgaggggcgctggcaggttcct

SEQ ID NO: 7712565 - DNA, 22 bp, Homo sapiens
tgaggggcggcctgcagaggcc

SEQ ID NO: 7712566 - DNA, 22 bp, Homo sapiens
tgaggggcggcctgcagaggcc

SEQ ID NO: 7712567 - DNA, 22 bp, Homo sapiens
tgaggggcggcctgcagaggcc

SEQ ID NO: 7712568 - DNA, 22 bp, Homo sapiens
tgaggggcggcctgcagaggcc

SEQ ID NO: 7712569 - DNA, 22 bp, Homo sapiens
tgagggggttaattaggagagt

SEQ ID NO: 7712570 - DNA, 22 bp, Homo sapiens
tgagggggttaattaggagagt

SEQ ID NO: 7712571 - DNA, 22 bp, Homo sapiens
tgagggggttaattaggagagt

SEQ ID NO: 7712572 - DNA, 22 bp, Homo sapiens
tgagggggttaattaggagagt

SEQ ID NO: 7712573 - DNA, 22 bp, Homo sapiens
tgaggggtctaggctgcgcacc

SEQ ID NO: 7712574 - DNA, 22 bp, Homo sapiens
tgaggggtctaggctgcgcacc

SEQ ID NO: 7712575 - DNA, 22 bp, Homo sapiens
tgaggggttaccttggagttga

SEQ ID NO: 7712576 - DNA, 22 bp, Homo sapiens
tgaggggttaccttggagttga

SEQ ID NO: 7712577 - DNA, 22 bp, Homo sapiens
tgaggggtctaggctgcgcacc

SEQ ID NO: 7712578 - DNA, 19 bp, Homo sapiens
tgaggggctcacagtctca

SEQ ID NO: 7712579 - DNA, 22 bp, Homo sapiens
tgaggggggtaatcactgggtt

SEQ ID NO: 7712580 - DNA, 22 bp, Homo sapiens
tgaggggggtaatcactgggtt

SEQ ID NO: 7712581 - DNA, 22 bp, Homo sapiens
tgaggggggtaatcactgggtt

SEQ ID NO: 7712582 - DNA, 22 bp, Homo sapiens
tgaggggggtaatcactgggtt

SEQ ID NO: 7712583 - DNA, 22 bp, Homo sapiens
tgaggggggtaatcactgggtt

SEQ ID NO: 7712584 - DNA, 22 bp, Homo sapiens
tgaggggggtaatcactgggtt

SEQ ID NO: 7712585 - DNA, 22 bp, Homo sapiens
tgagggggttaattaggagagt

SEQ ID NO: 7712586 - DNA, 22 bp, Homo sapiens
tgagggggttaattaggagagt

SEQ ID NO: 7712587 - DNA, 22 bp, Homo sapiens
tgagggggttaattaggagagt

SEQ ID NO: 7712588 - DNA, 22 bp, Homo sapiens
tgaggggggtaatcactgggtt

SEQ ID NO: 7712589 - DNA, 22 bp, Homo sapiens
tgaggggttgtgagaaatgtag

SEQ ID NO: 7712590 - DNA, 21 bp, Homo sapiens
tgaggggttataacagggtgg

SEQ ID NO: 7712591 - DNA, 21 bp, Homo sapiens
tgaggggttataacagggtgg

SEQ ID NO: 7712592 - DNA, 22 bp, Homo sapiens
tgagggtatatattgtgtggag

SEQ ID NO: 7712593 - DNA, 22 bp, Homo sapiens
tgagggtatatattgtgtggag

SEQ ID NO: 7712594 - DNA, 22 bp, Homo sapiens
tgagggtagaggcaggagtgca

SEQ ID NO: 7712595 - DNA, 22 bp, Homo sapiens
tgagggtagaggcaggagtgca

SEQ ID NO: 7712596 - DNA, 22 bp, Homo sapiens
tgagggtggcacaggcacaaag

SEQ ID NO: 7712597 - DNA, 22 bp, Homo sapiens
tgagggtgcatttagcatgtag

SEQ ID NO: 7712598 - DNA, 22 bp, Homo sapiens
tgagggtctggaatctgggctt

SEQ ID NO: 7712599 - DNA, 22 bp, Homo sapiens
tgagggtctggaatctgggctt

SEQ ID NO: 7712600 - DNA, 19 bp, Homo sapiens
tgagggtgagctttggaga

SEQ ID NO: 7712601 - DNA, 21 bp, Homo sapiens
tgagtatttgaatttctgtca

SEQ ID NO: 7712602 - DNA, 22 bp, Homo sapiens
tgagtcacacatttcttcatac

SEQ ID NO: 7712603 - DNA, 22 bp, Homo sapiens
tgagtattttccctatcaatgt

SEQ ID NO: 7712604 - DNA, 22 bp, Homo sapiens
tgagtcacacatttcttcatac

SEQ ID NO: 7712605 - DNA, 22 bp, Homo sapiens
tgagtatcaattacatagttgt

SEQ ID NO: 7712606 - DNA, 22 bp, Homo sapiens
tgagtatattgagtttagggca

SEQ ID NO: 7712607 - DNA, 22 bp, Homo sapiens
tgagtatattttccctgggtgg

SEQ ID NO: 7712608 - DNA, 22 bp, Homo sapiens
tgagtattgaagcgatttcaat

SEQ ID NO: 7712609 - DNA, 22 bp, Homo sapiens
tgagtctgtatgtccagattta

SEQ ID NO: 7712610 - DNA, 22 bp, Homo sapiens
tgagtcactgggtaatctggat

SEQ ID NO: 7712611 - DNA, 22 bp, Homo sapiens
tgagtcagccagagctgccatg

SEQ ID NO: 7712612 - DNA, 22 bp, Homo sapiens
tgagtctgtatgtccagattta

SEQ ID NO: 7712613 - DNA, 22 bp, Homo sapiens
tgagtcttctgcctaaagaagt

SEQ ID NO: 7712614 - DNA, 23 bp, Homo sapiens
tgagtcttgagctttggattctg

SEQ ID NO: 7712615 - DNA, 23 bp, Homo sapiens
tgagtcttgagctttggattctg

SEQ ID NO: 7712616 - DNA, 21 bp, Homo sapiens
tgagtcttttaataggtgcac

SEQ ID NO: 7712617 - DNA, 21 bp, Homo sapiens
tgagtcttttaataggtgcac

SEQ ID NO: 7712618 - DNA, 22 bp, Homo sapiens
tgagtcaccttggtattggcag

SEQ ID NO: 7712619 - DNA, 22 bp, Homo sapiens
tgagtcactgggtaatctggat

SEQ ID NO: 7712620 - DNA, 22 bp, Homo sapiens
tgagtcactggcaaggctttga

SEQ ID NO: 7712621 - DNA, 22 bp, Homo sapiens
tgagtcacatccatttttgtgt

SEQ ID NO: 7712622 - DNA, 22 bp, Homo sapiens
tgagtcaccgacctggctggtt

SEQ ID NO: 7712623 - DNA, 22 bp, Homo sapiens
tgagtcacctctcagaagccac

SEQ ID NO: 7712624 - DNA, 22 bp, Homo sapiens
tgagtaacacagtatgcttaca

SEQ ID NO: 7712625 - DNA, 22 bp, Homo sapiens
tgagtaactctacatatgtaca

SEQ ID NO: 7712626 - DNA, 22 bp, Homo sapiens
tgagtaattcacaaaacagatg

SEQ ID NO: 7712627 - DNA, 22 bp, Homo sapiens
tgagtactttatgttagttatt

SEQ ID NO: 7712628 - DNA, 22 bp, Homo sapiens
tgagtactcttctcactacacc

SEQ ID NO: 7712629 - DNA, 22 bp, Homo sapiens
tgagtactcttctcactacacc

SEQ ID NO: 7712630 - DNA, 22 bp, Homo sapiens
tgagtactcttctcactacacc

SEQ ID NO: 7712631 - DNA, 22 bp, Homo sapiens
tgagtagagaattcagctaagg

SEQ ID NO: 7712632 - DNA, 22 bp, Homo sapiens
tgagtagagaattcagctaagg

SEQ ID NO: 7712633 - DNA, 17 bp, Homo sapiens
tgagtaaagcacatggt

SEQ ID NO: 7712634 - DNA, 22 bp, Homo sapiens
tgagtaaatacaaaatcacctc

SEQ ID NO: 7712635 - DNA, 22 bp, Homo sapiens
tgagtaaatatcagtattgtgc

SEQ ID NO: 7712636 - DNA, 22 bp, Homo sapiens
tgagtaaatatttatgactaga

SEQ ID NO: 7712637 - DNA, 22 bp, Homo sapiens
tgagtaaatatttatgactaga

SEQ ID NO: 7712638 - DNA, 22 bp, Homo sapiens
tgagtaaaaattctacatttcc

SEQ ID NO: 7712639 - DNA, 22 bp, Homo sapiens
tgagtaaaagtgaatcttatgt

SEQ ID NO: 7712640 - DNA, 22 bp, Homo sapiens
tgagtatatgatttgtgtttgc

SEQ ID NO: 7712641 - DNA, 22 bp, Homo sapiens
tgagtatattaatttgccagca

SEQ ID NO: 7712642 - DNA, 22 bp, Homo sapiens
tgagtatacaatggcactgcca

SEQ ID NO: 7712643 - DNA, 22 bp, Homo sapiens
tgagtatattaatttgccagca

SEQ ID NO: 7712644 - DNA, 22 bp, Homo sapiens
tgagtatagaaagtcacccttt

SEQ ID NO: 7712645 - DNA, 22 bp, Homo sapiens
tgagtatagcatgatgggccat

SEQ ID NO: 7712646 - DNA, 22 bp, Homo sapiens
tgagtatatacccagaagtgga

SEQ ID NO: 7712647 - DNA, 22 bp, Homo sapiens
tgagtatatacccagaagtgga

SEQ ID NO: 7712648 - DNA, 22 bp, Homo sapiens
tgagtataaaacatatacatca

SEQ ID NO: 7712649 - DNA, 22 bp, Homo sapiens
tgagtatacaatggcactgcca

SEQ ID NO: 7712650 - DNA, 22 bp, Homo sapiens
tgagtatacactcctaagggta

SEQ ID NO: 7712651 - DNA, 22 bp, Homo sapiens
tgagtaggtggttaagcatgga

SEQ ID NO: 7712652 - DNA, 22 bp, Homo sapiens
tgagtagagaattcagctaagg

SEQ ID NO: 7712653 - DNA, 22 bp, Homo sapiens
tgagtagcggctatgtgtaact

SEQ ID NO: 7712654 - DNA, 22 bp, Homo sapiens
tgagtaggatagggtggggctt

SEQ ID NO: 7712655 - DNA, 22 bp, Homo sapiens
tgagtagagaattcagctaagg

SEQ ID NO: 7712656 - DNA, 22 bp, Homo sapiens
tgagtagagaattcagctaagg

SEQ ID NO: 7712657 - DNA, 22 bp, Homo sapiens
tgaggtggctggatctcagcct

SEQ ID NO: 7712658 - DNA, 22 bp, Homo sapiens
tgaggtgggcttgtggatttgc

SEQ ID NO: 7712659 - DNA, 22 bp, Homo sapiens
tgaggtgggcttgtggatttgc

SEQ ID NO: 7712660 - DNA, 22 bp, Homo sapiens
tgaggtggctggatctcagcct

SEQ ID NO: 7712661 - DNA, 22 bp, Homo sapiens
tgaggtgggcttgtggatttgc

SEQ ID NO: 7712662 - DNA, 22 bp, Homo sapiens
tgaggtgggtggcttctgttat

SEQ ID NO: 7712663 - DNA, 22 bp, Homo sapiens
tgaggtgggtgtcaggtcagag

SEQ ID NO: 7712664 - DNA, 22 bp, Homo sapiens
tgaggtgggtgtcaggtcagag

SEQ ID NO: 7712665 - DNA, 22 bp, Homo sapiens
tgaggtgggtgtcaggtcagag

SEQ ID NO: 7712666 - DNA, 22 bp, Homo sapiens
tgaggtgggtgtcaggtcagag

SEQ ID NO: 7712667 - DNA, 22 bp, Homo sapiens
tgaggtgggtgtcaggtcagag

SEQ ID NO: 7712668 - DNA, 22 bp, Homo sapiens
tgaggtgggtggcttctgttat

SEQ ID NO: 7712669 - DNA, 22 bp, Homo sapiens
tgaggtggctagggaggcactc

SEQ ID NO: 7712670 - DNA, 22 bp, Homo sapiens
tgaggtggctagggaggcactc

SEQ ID NO: 7712671 - DNA, 22 bp, Homo sapiens
tgaggtggctagggaggcactc

SEQ ID NO: 7712672 - DNA, 22 bp, Homo sapiens
tgaggtggctagggaggcactc

SEQ ID NO: 7712673 - DNA, 22 bp, Homo sapiens
tgaggtggctagggaggcactc

SEQ ID NO: 7712674 - DNA, 22 bp, Homo sapiens
tgaggtggctagggaggcactc

SEQ ID NO: 7712675 - DNA, 22 bp, Homo sapiens
tgaggtggctggatctcagcct

SEQ ID NO: 7712676 - DNA, 22 bp, Homo sapiens
tgaggtggctggatctcagcct

SEQ ID NO: 7712677 - DNA, 22 bp, Homo sapiens
tgaggtggctagggaggcactc

SEQ ID NO: 7712678 - DNA, 22 bp, Homo sapiens
tgaggtggctggatctcagcct

SEQ ID NO: 7712679 - DNA, 22 bp, Homo sapiens
tgaggtggctagggaggcactc

SEQ ID NO: 7712680 - DNA, 22 bp, Homo sapiens
tgaggtggccgaggagcaggac

SEQ ID NO: 7712681 - DNA, 22 bp, Homo sapiens
tgaggtggccgaggagcaggac

SEQ ID NO: 7712682 - DNA, 22 bp, Homo sapiens
tgaggtggccgaggagcaggac

SEQ ID NO: 7712683 - DNA, 22 bp, Homo sapiens
tgaggtggccgaggagcaggac

SEQ ID NO: 7712684 - DNA, 22 bp, Homo sapiens
tgaggtggccgaggagcaggac

SEQ ID NO: 7712685 - DNA, 22 bp, Homo sapiens
tgaggtggccgaggagcaggac

SEQ ID NO: 7712686 - DNA, 22 bp, Homo sapiens
tgaggtggcacacacttcctgc

SEQ ID NO: 7712687 - DNA, 22 bp, Homo sapiens
tgaggtggctagggaggcactc

SEQ ID NO: 7712688 - DNA, 22 bp, Homo sapiens
tgaggtggctagggaggcactc

SEQ ID NO: 7712689 - DNA, 22 bp, Homo sapiens
tgaggtggctagggaggcactc

SEQ ID NO: 7712690 - DNA, 22 bp, Homo sapiens
tgaggtggctagggaggcactc

SEQ ID NO: 7712691 - DNA, 22 bp, Homo sapiens
tgaggtggaaggatcctttgaa

SEQ ID NO: 7712692 - DNA, 22 bp, Homo sapiens
tgaggtggcacacacttcctgc

SEQ ID NO: 7712693 - DNA, 22 bp, Homo sapiens
tgaggtggaaggatcctttgaa

SEQ ID NO: 7712694 - DNA, 22 bp, Homo sapiens
tgaggtggcacacacttcctgc

SEQ ID NO: 7712695 - DNA, 22 bp, Homo sapiens
tgaggtggcacacacttcctgc

SEQ ID NO: 7712696 - DNA, 22 bp, Homo sapiens
tgaggtgataataactccctgc

SEQ ID NO: 7712697 - DNA, 22 bp, Homo sapiens
tgaggtgataataactccctgc

SEQ ID NO: 7712698 - DNA, 22 bp, Homo sapiens
tgaggtgatacagaccctactt

SEQ ID NO: 7712699 - DNA, 22 bp, Homo sapiens
tgaggtgataataactccctgc

SEQ ID NO: 7712700 - DNA, 22 bp, Homo sapiens
tgaggtgatacagaccctactt

SEQ ID NO: 7712701 - DNA, 22 bp, Homo sapiens
tgaggtgatacagaccctactt

SEQ ID NO: 7712702 - DNA, 22 bp, Homo sapiens
tgaggtgccacccaagagcctt

SEQ ID NO: 7712703 - DNA, 22 bp, Homo sapiens
tgaggtgcagcaatcctcatgt

SEQ ID NO: 7712704 - DNA, 22 bp, Homo sapiens
tgaggtggaaggatcctttgaa

SEQ ID NO: 7712705 - DNA, 22 bp, Homo sapiens
tgaggtgccacccaagagcctt

SEQ ID NO: 7712706 - DNA, 22 bp, Homo sapiens
tgaggtggttactgtggtgctc

SEQ ID NO: 7712707 - DNA, 22 bp, Homo sapiens
tgaggtggttcaagagccttgt

SEQ ID NO: 7712708 - DNA, 22 bp, Homo sapiens
tgaggtggttactgtggtgctc

SEQ ID NO: 7712709 - DNA, 22 bp, Homo sapiens
tgaggtggttactgtggtgctc

SEQ ID NO: 7712710 - DNA, 22 bp, Homo sapiens
tgaggtggttactgtggtgctc

SEQ ID NO: 7712711 - DNA, 22 bp, Homo sapiens
tgaggtggttactgtggtgctc

SEQ ID NO: 7712712 - DNA, 22 bp, Homo sapiens
tgaggtggttcaagagccttgt

SEQ ID NO: 7712713 - DNA, 22 bp, Homo sapiens
tgaggtggttcaagagccttgt

SEQ ID NO: 7712714 - DNA, 22 bp, Homo sapiens
tgaggtggttcaagagccttgt

SEQ ID NO: 7712715 - DNA, 22 bp, Homo sapiens
tgaggtggtttgtatcactggg

SEQ ID NO: 7712716 - DNA, 22 bp, Homo sapiens
tgaggtggtttgtatcactggg

SEQ ID NO: 7712717 - DNA, 22 bp, Homo sapiens
tgaggtggtttgtatcactggg

SEQ ID NO: 7712718 - DNA, 22 bp, Homo sapiens
tgaggtggttcaagagccttgt

SEQ ID NO: 7712719 - DNA, 22 bp, Homo sapiens
tgaggtggttcaagagccttgt

SEQ ID NO: 7712720 - DNA, 22 bp, Homo sapiens
tgaggtggtttgtatcactggg

SEQ ID NO: 7712721 - DNA, 22 bp, Homo sapiens
tgaggtggtttgtatcactggg

SEQ ID NO: 7712722 - DNA, 22 bp, Homo sapiens
tgaggtggtttgtatcactggg

SEQ ID NO: 7712723 - DNA, 22 bp, Homo sapiens
tgaggtgtgtccccagggaggt

SEQ ID NO: 7712724 - DNA, 22 bp, Homo sapiens
tgaggttcagttcttggccaca

SEQ ID NO: 7712725 - DNA, 22 bp, Homo sapiens
tgaggttatttattatgcatga

SEQ ID NO: 7712726 - DNA, 22 bp, Homo sapiens
tgaggtggtccaaagactgttt

SEQ ID NO: 7712727 - DNA, 22 bp, Homo sapiens
tgaggtggtccaaagactgttt

SEQ ID NO: 7712728 - DNA, 22 bp, Homo sapiens
tgaggtggtccaaagactgttt

SEQ ID NO: 7712729 - DNA, 22 bp, Homo sapiens
tgaggtggtccaaagactgttt

SEQ ID NO: 7712730 - DNA, 22 bp, Homo sapiens
tgaggtggtccaaagactgttt

SEQ ID NO: 7712731 - DNA, 22 bp, Homo sapiens
tgaggtgggtgtcaggtcagag

SEQ ID NO: 7712732 - DNA, 22 bp, Homo sapiens
tgaggtgggtgtcaggtcagag

SEQ ID NO: 7712733 - DNA, 22 bp, Homo sapiens
tgaggtgggtgtcaggtcagag

SEQ ID NO: 7712734 - DNA, 22 bp, Homo sapiens
tgaggtggttactgtggtgctc

SEQ ID NO: 7712735 - DNA, 22 bp, Homo sapiens
tgaggtggttactgtggtgctc

SEQ ID NO: 7712736 - DNA, 22 bp, Homo sapiens
tgaggtggttactgtggtgctc

SEQ ID NO: 7712737 - DNA, 22 bp, Homo sapiens
tgaggtggttactgtggtgctc

SEQ ID NO: 7712738 - DNA, 22 bp, Homo sapiens
tgaggtggttactgtggtgctc

SEQ ID NO: 7712739 - DNA, 22 bp, Homo sapiens
tgaggtggttactgtggtgctc

SEQ ID NO: 7712740 - DNA, 22 bp, Homo sapiens
tgaggtggttactgtggtgctc

SEQ ID NO: 7712741 - DNA, 22 bp, Homo sapiens
tgaggtggtgctaatctctgct

SEQ ID NO: 7712742 - DNA, 22 bp, Homo sapiens
tgaggtggtgctaatctctgct

SEQ ID NO: 7712743 - DNA, 22 bp, Homo sapiens
tgaggtggtgctaatctctgct

SEQ ID NO: 7712744 - DNA, 22 bp, Homo sapiens
tgaggtggtgctaatctctgct

SEQ ID NO: 7712745 - DNA, 22 bp, Homo sapiens
tgaggtggtgctaatctctgct

SEQ ID NO: 7712746 - DNA, 22 bp, Homo sapiens
tgaggcctggagggaggagttt

SEQ ID NO: 7712747 - DNA, 22 bp, Homo sapiens
tgaggcctggagggaggagttt

SEQ ID NO: 7712748 - DNA, 22 bp, Homo sapiens
tgaggcctgggcacataacctc

SEQ ID NO: 7712749 - DNA, 22 bp, Homo sapiens
tgaggcctgggcacataacctc

SEQ ID NO: 7712750 - DNA, 22 bp, Homo sapiens
tgaggcctggactctgcatgga

SEQ ID NO: 7712751 - DNA, 22 bp, Homo sapiens
tgaggcctggactctgcatgga

SEQ ID NO: 7712752 - DNA, 22 bp, Homo sapiens
tgaggcctggagggaggagttt

SEQ ID NO: 7712753 - DNA, 22 bp, Homo sapiens
tgaggcctggagggaggagttt

SEQ ID NO: 7712754 - DNA, 22 bp, Homo sapiens
tgaggcctggagggaggagttt

SEQ ID NO: 7712755 - DNA, 22 bp, Homo sapiens
tgaggcctggagggaggagttt

SEQ ID NO: 7712756 - DNA, 22 bp, Homo sapiens
tgaggcctggagggaggagttt

SEQ ID NO: 7712757 - DNA, 22 bp, Homo sapiens
tgaggcctgccctggggaagtt

SEQ ID NO: 7712758 - DNA, 22 bp, Homo sapiens
tgaggcctgccctggggaagtt

SEQ ID NO: 7712759 - DNA, 22 bp, Homo sapiens
tgaggcctgccctggggaagtt

SEQ ID NO: 7712760 - DNA, 22 bp, Homo sapiens
tgaggcctgccctggggaagtt

SEQ ID NO: 7712761 - DNA, 22 bp, Homo sapiens
tgaggcctgccctggggaagtt

SEQ ID NO: 7712762 - DNA, 21 bp, Homo sapiens
tgaggcctgccagtctcagaa

SEQ ID NO: 7712763 - DNA, 21 bp, Homo sapiens
tgaggcctgccagtctcagaa

SEQ ID NO: 7712764 - DNA, 22 bp, Homo sapiens
tgaggcctgcttggaattgaat

SEQ ID NO: 7712765 - DNA, 22 bp, Homo sapiens
tgaggcctgcttggaattgaat

SEQ ID NO: 7712766 - DNA, 22 bp, Homo sapiens
tgaggcctgcttggaattgaat

SEQ ID NO: 7712767 - DNA, 22 bp, Homo sapiens
tgaggcctggactctgcatgga

SEQ ID NO: 7712768 - DNA, 22 bp, Homo sapiens
tgaggcctggactctgcatgga

SEQ ID NO: 7712769 - DNA, 22 bp, Homo sapiens
tgaggcctggactctgcatgga

SEQ ID NO: 7712770 - DNA, 22 bp, Homo sapiens
tgaggctcaagaatagacagta

SEQ ID NO: 7712771 - DNA, 22 bp, Homo sapiens
tgaggctcaagaatctgcattt

SEQ ID NO: 7712772 - DNA, 22 bp, Homo sapiens
tgaggctcaagaatagacagta

SEQ ID NO: 7712773 - DNA, 22 bp, Homo sapiens
tgaggctcaaggtctggtggag

SEQ ID NO: 7712774 - DNA, 22 bp, Homo sapiens
tgaggctcacaaatctgcattt

SEQ ID NO: 7712775 - DNA, 22 bp, Homo sapiens
tgaggctcaagaatctgcattt

SEQ ID NO: 7712776 - DNA, 22 bp, Homo sapiens
tgaggctcaaggtctggtggag

SEQ ID NO: 7712777 - DNA, 22 bp, Homo sapiens
tgaggctcaaggtctggtggag

SEQ ID NO: 7712778 - DNA, 22 bp, Homo sapiens
tgaggctcaagaaagatttgtt

SEQ ID NO: 7712779 - DNA, 22 bp, Homo sapiens
tgaggctcaagaaagatttgtt

SEQ ID NO: 7712780 - DNA, 22 bp, Homo sapiens
tgaggctaaaggtgaccagatt

SEQ ID NO: 7712781 - DNA, 22 bp, Homo sapiens
tgaggcgtctccctgagctcac

SEQ ID NO: 7712782 - DNA, 22 bp, Homo sapiens
tgaggccttttctgtctggcta

SEQ ID NO: 7712783 - DNA, 22 bp, Homo sapiens
tgaggccttttctgtctggcta

SEQ ID NO: 7712784 - DNA, 22 bp, Homo sapiens
tgaggccttttctgtctggcta

SEQ ID NO: 7712785 - DNA, 19 bp, Homo sapiens
tgaggccttggatgaaagg

SEQ ID NO: 7712786 - DNA, 19 bp, Homo sapiens
tgaggccttggatgaaagg

SEQ ID NO: 7712787 - DNA, 22 bp, Homo sapiens
tgaggccttttctgtctggcta

SEQ ID NO: 7712788 - DNA, 22 bp, Homo sapiens
tgaggcctgggcacataacctc

SEQ ID NO: 7712789 - DNA, 22 bp, Homo sapiens
tgaggcctgtcattgtcttgtt

SEQ ID NO: 7712790 - DNA, 22 bp, Homo sapiens
tgaggcctgtcattgtcttgtt

SEQ ID NO: 7712791 - DNA, 22 bp, Homo sapiens
tgaggccttagtaaccctgcac

SEQ ID NO: 7712792 - DNA, 22 bp, Homo sapiens
tgaggccttagtaaccctgcac

SEQ ID NO: 7712793 - DNA, 22 bp, Homo sapiens
tgaggccttagtaaccctgcac

SEQ ID NO: 7712794 - DNA, 22 bp, Homo sapiens
tgaggccttagtaaccctgcac

SEQ ID NO: 7712795 - DNA, 21 bp, Homo sapiens
tgaggctcatcttatgtggct

SEQ ID NO: 7712796 - DNA, 21 bp, Homo sapiens
tgaggctcatcttatgtggct

SEQ ID NO: 7712797 - DNA, 22 bp, Homo sapiens
tgaggctcagtgagccctgcag

SEQ ID NO: 7712798 - DNA, 22 bp, Homo sapiens
tgaggctcagagcacctgctcc

SEQ ID NO: 7712799 - DNA, 22 bp, Homo sapiens
tgaggctcagagcacctgctcc

SEQ ID NO: 7712800 - DNA, 18 bp, Homo sapiens
tgaggctcagctcctggt

SEQ ID NO: 7712801 - DNA, 18 bp, Homo sapiens
tgaggctcagctcctggt

SEQ ID NO: 7712802 - DNA, 20 bp, Homo sapiens
tgaggctcagagaggttgag

SEQ ID NO: 7712803 - DNA, 20 bp, Homo sapiens
tgaggctcagagaggttgag

SEQ ID NO: 7712804 - DNA, 22 bp, Homo sapiens
tgaggctcagagcacctgctcc

SEQ ID NO: 7712805 - DNA, 18 bp, Homo sapiens
tgaggctcagctcctggt

SEQ ID NO: 7712806 - DNA, 22 bp, Homo sapiens
tgaggctcattctgcatgccaa

SEQ ID NO: 7712807 - DNA, 21 bp, Homo sapiens
tgaggctcatcttatgtggct

SEQ ID NO: 7712808 - DNA, 22 bp, Homo sapiens
tgaggctcattctgcatgccaa

SEQ ID NO: 7712809 - DNA, 22 bp, Homo sapiens
tgaggctcagtgattaaagtgg

SEQ ID NO: 7712810 - DNA, 21 bp, Homo sapiens
tgaggctcatcttatgtggct

SEQ ID NO: 7712811 - DNA, 22 bp, Homo sapiens
tgaggctccttgtagagagtgg

SEQ ID NO: 7712812 - DNA, 22 bp, Homo sapiens
tgaggctccttgtagagagtgg

SEQ ID NO: 7712813 - DNA, 22 bp, Homo sapiens
tgaggctccagccaggccagca

SEQ ID NO: 7712814 - DNA, 22 bp, Homo sapiens
tgaggctccagccaggccagca

SEQ ID NO: 7712815 - DNA, 22 bp, Homo sapiens
tgaggctcagagaagtgctgtt

SEQ ID NO: 7712816 - DNA, 22 bp, Homo sapiens
tgaggctcagagaagtgctgtt

SEQ ID NO: 7712817 - DNA, 18 bp, Homo sapiens
tgaggctcagagacggtg

SEQ ID NO: 7712818 - DNA, 18 bp, Homo sapiens
tgaggctcagagacggtg

SEQ ID NO: 7712819 - DNA, 18 bp, Homo sapiens
tgaggctcagagacggtg

SEQ ID NO: 7712820 - DNA, 20 bp, Homo sapiens
tgaggctcagagaggttgag

SEQ ID NO: 7712821 - DNA, 22 bp, Homo sapiens
tgaggctcagagaagtgctgtt

SEQ ID NO: 7712822 - DNA, 22 bp, Homo sapiens
tgaggctcagagaagtgctgtt

SEQ ID NO: 7712823 - DNA, 22 bp, Homo sapiens
tgaggctcagagaagtgctgtt

SEQ ID NO: 7712824 - DNA, 22 bp, Homo sapiens
tgaggctcagagaagtgctgtt

SEQ ID NO: 7712825 - DNA, 22 bp, Homo sapiens
tgaggctcagagaacagtgact

SEQ ID NO: 7712826 - DNA, 22 bp, Homo sapiens
tgaggctcagaagtgccaagtg

SEQ ID NO: 7712827 - DNA, 22 bp, Homo sapiens
tgaggctcagaagtgccaagtg

SEQ ID NO: 7712828 - DNA, 22 bp, Homo sapiens
tgaggctcagagaacagtgact

SEQ ID NO: 7712829 - DNA, 22 bp, Homo sapiens
tgaggctcagaaatgtaagttt

SEQ ID NO: 7712830 - DNA, 22 bp, Homo sapiens
tgaggctcagaagtgccaagtg

SEQ ID NO: 7712831 - DNA, 22 bp, Homo sapiens
tgaggctcagaagtgccaagtg

SEQ ID NO: 7712832 - DNA, 22 bp, Homo sapiens
tgaggctcacgaacagaagact

SEQ ID NO: 7712833 - DNA, 22 bp, Homo sapiens
tgaggctcagaaatgtaagttt

SEQ ID NO: 7712834 - DNA, 22 bp, Homo sapiens
tgaggctcacgaacagaagact

SEQ ID NO: 7712835 - DNA, 22 bp, Homo sapiens
tgaggctcacaaatctgcattt

SEQ ID NO: 7712836 - DNA, 22 bp, Homo sapiens
tgaggctcacgaacagaagact

SEQ ID NO: 7712837 - DNA, 22 bp, Homo sapiens
tgaggcttagagaagatgggat

SEQ ID NO: 7712838 - DNA, 22 bp, Homo sapiens
tgaggcttagagaattaagtga

SEQ ID NO: 7712839 - DNA, 22 bp, Homo sapiens
tgaggcttccaacatgtgagaa

SEQ ID NO: 7712840 - DNA, 22 bp, Homo sapiens
tgaggcttccaacatgtgagaa

SEQ ID NO: 7712841 - DNA, 22 bp, Homo sapiens
tgaggcttagatttggtaactc

SEQ ID NO: 7712842 - DNA, 22 bp, Homo sapiens
tgaggcttccaacatgtgagaa

SEQ ID NO: 7712843 - DNA, 22 bp, Homo sapiens
tgaggcttccaacatgtgagaa

SEQ ID NO: 7712844 - DNA, 22 bp, Homo sapiens
tgaggcttgatttgcccgagag

SEQ ID NO: 7712845 - DNA, 22 bp, Homo sapiens
tgaggcttccaacatgtgagaa

SEQ ID NO: 7712846 - DNA, 22 bp, Homo sapiens
tgaggcttggagaggtcaggga

SEQ ID NO: 7712847 - DNA, 22 bp, Homo sapiens
tgaggcttggagaggtcaggga

SEQ ID NO: 7712848 - DNA, 22 bp, Homo sapiens
tgaggcttggagaggtcaggga

SEQ ID NO: 7712849 - DNA, 21 bp, Homo sapiens
tgaggctgttgtaccagggag

SEQ ID NO: 7712850 - DNA, 21 bp, Homo sapiens
tgaggctgttgtaccagggag

SEQ ID NO: 7712851 - DNA, 21 bp, Homo sapiens
tgaggctgttgtaccagggag

SEQ ID NO: 7712852 - DNA, 21 bp, Homo sapiens
tgaggctgttgtaccagggag

SEQ ID NO: 7712853 - DNA, 22 bp, Homo sapiens
tgaggcttagagaagatgggat

SEQ ID NO: 7712854 - DNA, 22 bp, Homo sapiens
tgaggcttagagaagatgggat

SEQ ID NO: 7712855 - DNA, 22 bp, Homo sapiens
tgaggcttagagaagatgggat

SEQ ID NO: 7712856 - DNA, 22 bp, Homo sapiens
tgaggctgttctaccagggcca

SEQ ID NO: 7712857 - DNA, 22 bp, Homo sapiens
tgaggctgttctaccagggcca

SEQ ID NO: 7712858 - DNA, 22 bp, Homo sapiens
tgaggctgttctaccagggcca

SEQ ID NO: 7712859 - DNA, 22 bp, Homo sapiens
tgaggctgttctaccagggcca

SEQ ID NO: 7712860 - DNA, 22 bp, Homo sapiens
tgaggctgttctaccagggcca

SEQ ID NO: 7712861 - DNA, 22 bp, Homo sapiens
tgaggctggcaaggctggtatt

SEQ ID NO: 7712862 - DNA, 21 bp, Homo sapiens
tgaggctgttgtaccagggag

SEQ ID NO: 7712863 - DNA, 21 bp, Homo sapiens
tgaggctgttgtaccagggag

SEQ ID NO: 7712864 - DNA, 21 bp, Homo sapiens
tgaggctgttgtaccagggag

SEQ ID NO: 7712865 - DNA, 21 bp, Homo sapiens
tgaggctgttgtaccagggag

SEQ ID NO: 7712866 - DNA, 21 bp, Homo sapiens
tgaggctgttgtaccagggag

SEQ ID NO: 7712867 - DNA, 21 bp, Homo sapiens
tgaggctgttgtaccagggag

SEQ ID NO: 7712868 - DNA, 22 bp, Homo sapiens
tgaggctgttctaccagggcca

SEQ ID NO: 7712869 - DNA, 22 bp, Homo sapiens
tgaggctgttctaccagggcca

SEQ ID NO: 7712870 - DNA, 22 bp, Homo sapiens
tgaggctggatgggatgcctcc

SEQ ID NO: 7712871 - DNA, 22 bp, Homo sapiens
tgaggctggatgggatgcctcc

SEQ ID NO: 7712872 - DNA, 22 bp, Homo sapiens
tgaggctggcaaggctggtatt

SEQ ID NO: 7712873 - DNA, 22 bp, Homo sapiens
tgaggctggcaaggctggtatt

SEQ ID NO: 7712874 - DNA, 22 bp, Homo sapiens
tgaggctggcaaggctggtatt

SEQ ID NO: 7712875 - DNA, 22 bp, Homo sapiens
tgaggctggcaaggctggtatt

SEQ ID NO: 7712876 - DNA, 22 bp, Homo sapiens
tgaggctggcaaggctggtatt

SEQ ID NO: 7712877 - DNA, 22 bp, Homo sapiens
tgaggctggatgggatgcctcc

SEQ ID NO: 7712878 - DNA, 22 bp, Homo sapiens
tgaggctggatgggatgcctcc

SEQ ID NO: 7712879 - DNA, 22 bp, Homo sapiens
tgaggctggatgggatgcctcc

SEQ ID NO: 7712880 - DNA, 22 bp, Homo sapiens
tgaggctggatgggatgcctcc

SEQ ID NO: 7712881 - DNA, 22 bp, Homo sapiens
tgaggctggatgggatgcctcc

SEQ ID NO: 7712882 - DNA, 22 bp, Homo sapiens
tgaggctgccttgggaagaggg

SEQ ID NO: 7712883 - DNA, 22 bp, Homo sapiens
tgaggctgccttgggaagaggg

SEQ ID NO: 7712884 - DNA, 17 bp, Homo sapiens
tgaggctcggtgaggag

SEQ ID NO: 7712885 - DNA, 17 bp, Homo sapiens
tgaggctcggtgaggag

SEQ ID NO: 7712886 - DNA, 17 bp, Homo sapiens
tgaggctcggtgaggag

SEQ ID NO: 7712887 - DNA, 17 bp, Homo sapiens
tgaggctcggtgaggag

SEQ ID NO: 7712888 - DNA, 17 bp, Homo sapiens
tgaggctcggtgaggag

SEQ ID NO: 7712889 - DNA, 22 bp, Homo sapiens
tgaggctctccaagcagatgag

SEQ ID NO: 7712890 - DNA, 22 bp, Homo sapiens
tgaggctctccaagcagatgag

SEQ ID NO: 7712891 - DNA, 22 bp, Homo sapiens
tgaggctctatgtggtagatta

SEQ ID NO: 7712892 - DNA, 22 bp, Homo sapiens
tgaggctctatgtggtagatta

SEQ ID NO: 7712893 - DNA, 22 bp, Homo sapiens
tgaggctctccaagcagatgag

SEQ ID NO: 7712894 - DNA, 22 bp, Homo sapiens
tgaggctctccaagcagatgag

SEQ ID NO: 7712895 - DNA, 21 bp, Homo sapiens
tgaggctctgttgtgcctgca

SEQ ID NO: 7712896 - DNA, 22 bp, Homo sapiens
tgaggctctgcttctgtggctc

SEQ ID NO: 7712897 - DNA, 21 bp, Homo sapiens
tgaggctctgttgtgcctgca

SEQ ID NO: 7712898 - DNA, 22 bp, Homo sapiens
tgaggctctgcttctgtggctc

SEQ ID NO: 7712899 - DNA, 22 bp, Homo sapiens
tgaggctctgcttctgtggctc

SEQ ID NO: 7712900 - DNA, 22 bp, Homo sapiens
tgaggctctgcttctgtggctc

SEQ ID NO: 7712901 - DNA, 22 bp, Homo sapiens
tgaggctgccttgggaagaggg

SEQ ID NO: 7712902 - DNA, 22 bp, Homo sapiens
tgaggctgccttgggaagaggg

SEQ ID NO: 7712903 - DNA, 22 bp, Homo sapiens
tgaggctgccttgggaagaggg

SEQ ID NO: 7712904 - DNA, 21 bp, Homo sapiens
tgaggctctgttgtgcctgca

SEQ ID NO: 7712905 - DNA, 22 bp, Homo sapiens
tgaggctcttcctcccctgctc

SEQ ID NO: 7712906 - DNA, 22 bp, Homo sapiens
tgaggctcttcctcccctgctc

SEQ ID NO: 7712907 - DNA, 22 bp, Homo sapiens
tgaggctcttctgtaaatgatc

SEQ ID NO: 7712908 - DNA, 22 bp, Homo sapiens
tgagggagtgtggatacagtag

SEQ ID NO: 7712909 - DNA, 22 bp, Homo sapiens
tgagggagtgtggatacagtag

SEQ ID NO: 7712910 - DNA, 22 bp, Homo sapiens
tgagggagtgtggatacagtag

SEQ ID NO: 7712911 - DNA, 22 bp, Homo sapiens
tgagggagtgtggatacagtag

SEQ ID NO: 7712912 - DNA, 22 bp, Homo sapiens
tgagggagtgtggatacagtag

SEQ ID NO: 7712913 - DNA, 22 bp, Homo sapiens
tgagggagtgtggatacagtag

SEQ ID NO: 7712914 - DNA, 22 bp, Homo sapiens
tgagggagtgtggatacagtag

SEQ ID NO: 7712915 - DNA, 22 bp, Homo sapiens
tgagggagtcatgattaaggaa

SEQ ID NO: 7712916 - DNA, 22 bp, Homo sapiens
tgagggagtcatgattaaggaa

SEQ ID NO: 7712917 - DNA, 22 bp, Homo sapiens
tgagggagtcatgattaaggaa

SEQ ID NO: 7712918 - DNA, 22 bp, Homo sapiens
tgagggagttgggtgtatagga

SEQ ID NO: 7712919 - DNA, 22 bp, Homo sapiens
tgagggagttgggtgtatagga

SEQ ID NO: 7712920 - DNA, 22 bp, Homo sapiens
tgagggagttgggtgtatagga

SEQ ID NO: 7712921 - DNA, 22 bp, Homo sapiens
tgagggagttgggtgtatagga

SEQ ID NO: 7712922 - DNA, 22 bp, Homo sapiens
tgagggagttgggtgtatagga

SEQ ID NO: 7712923 - DNA, 22 bp, Homo sapiens
tgagggagttgggtgtatagga

SEQ ID NO: 7712924 - DNA, 22 bp, Homo sapiens
tgagggagttgggtgtatagga

SEQ ID NO: 7712925 - DNA, 22 bp, Homo sapiens
tgagggagtgtggatacagtag

SEQ ID NO: 7712926 - DNA, 22 bp, Homo sapiens
tgagggagtgtggatacagtag

SEQ ID NO: 7712927 - DNA, 22 bp, Homo sapiens
tgagggagtgtggatacagtag

SEQ ID NO: 7712928 - DNA, 22 bp, Homo sapiens
tgaggggaactgatgcccattg

SEQ ID NO: 7712929 - DNA, 22 bp, Homo sapiens
tgaggggaactgatgcccattg

SEQ ID NO: 7712930 - DNA, 22 bp, Homo sapiens
tgaggggaactgatgcccattg

SEQ ID NO: 7712931 - DNA, 22 bp, Homo sapiens
tgaggggagaagcagcagcctg

SEQ ID NO: 7712932 - DNA, 22 bp, Homo sapiens
tgaggggagaagcagcagcctg

SEQ ID NO: 7712933 - DNA, 22 bp, Homo sapiens
tgaggggaaggcatgataaata

SEQ ID NO: 7712934 - DNA, 22 bp, Homo sapiens
tgaggggagaagcagcagcctg

SEQ ID NO: 7712935 - DNA, 22 bp, Homo sapiens
tgaggggagacagagtggactc

SEQ ID NO: 7712936 - DNA, 22 bp, Homo sapiens
tgaggggagacagagtggactc

SEQ ID NO: 7712937 - DNA, 22 bp, Homo sapiens
tgaggggagaagcagcagcctg

SEQ ID NO: 7712938 - DNA, 22 bp, Homo sapiens
tgaggggagaagcagcagcctg

SEQ ID NO: 7712939 - DNA, 22 bp, Homo sapiens
tgaggggagaagcagcagcctg

SEQ ID NO: 7712940 - DNA, 22 bp, Homo sapiens
tgaggggagaagcagcagcctg

SEQ ID NO: 7712941 - DNA, 22 bp, Homo sapiens
tgaggggagacagagtggactc

SEQ ID NO: 7712942 - DNA, 22 bp, Homo sapiens
tgaggggagacagagtggactc

SEQ ID NO: 7712943 - DNA, 22 bp, Homo sapiens
tgaggggagacagagtggactc

SEQ ID NO: 7712944 - DNA, 22 bp, Homo sapiens
tgaggggagacagagtggactc

SEQ ID NO: 7712945 - DNA, 22 bp, Homo sapiens
tgaggggagacagagtggactc

SEQ ID NO: 7712946 - DNA, 22 bp, Homo sapiens
tgaggggagacagagtggactc

SEQ ID NO: 7712947 - DNA, 22 bp, Homo sapiens
tgaggggagacagagtggactc

SEQ ID NO: 7712948 - DNA, 22 bp, Homo sapiens
tgaggggagctagcatgccttg

SEQ ID NO: 7712949 - DNA, 22 bp, Homo sapiens
tgaggggagctagcatgccttg

SEQ ID NO: 7712950 - DNA, 19 bp, Homo sapiens
tgaggggaggagaggcctg

SEQ ID NO: 7712951 - DNA, 19 bp, Homo sapiens
tgaggggaggagaggcctg

SEQ ID NO: 7712952 - DNA, 19 bp, Homo sapiens
tgaggggaggagaggcctg

SEQ ID NO: 7712953 - DNA, 19 bp, Homo sapiens
tgaggggaggagaggcctg

SEQ ID NO: 7712954 - DNA, 19 bp, Homo sapiens
tgaggggaggagaggcctg

SEQ ID NO: 7712955 - DNA, 19 bp, Homo sapiens
tgaggggaggagaggcctg

SEQ ID NO: 7712956 - DNA, 19 bp, Homo sapiens
tgaggggaggagaggcctg

SEQ ID NO: 7712957 - DNA, 19 bp, Homo sapiens
tgaggggaggagaggcctg

SEQ ID NO: 7712958 - DNA, 19 bp, Homo sapiens
tgaggggaggagaggcctg

SEQ ID NO: 7712959 - DNA, 19 bp, Homo sapiens
tgaggggaggagaggcctg

SEQ ID NO: 7712960 - DNA, 19 bp, Homo sapiens
tgaggggaggagaggcctg

SEQ ID NO: 7712961 - DNA, 22 bp, Homo sapiens
tgaggggagcccgccctggacg

SEQ ID NO: 7712962 - DNA, 22 bp, Homo sapiens
tgaggggagcccgccctggacg

SEQ ID NO: 7712963 - DNA, 22 bp, Homo sapiens
tgaggggagcccgccctggacg

SEQ ID NO: 7712964 - DNA, 22 bp, Homo sapiens
tgaggggagctagcatgccttg

SEQ ID NO: 7712965 - DNA, 22 bp, Homo sapiens
tgaggggagctagcatgccttg

SEQ ID NO: 7712966 - DNA, 22 bp, Homo sapiens
tgaggggagcccgccctggacg

SEQ ID NO: 7712967 - DNA, 22 bp, Homo sapiens
tgaggggagcccgccctggacg

SEQ ID NO: 7712968 - DNA, 22 bp, Homo sapiens
tgaggggagcccgccctggacg

SEQ ID NO: 7712969 - DNA, 22 bp, Homo sapiens
tgaggggatacggtacacattg

SEQ ID NO: 7712970 - DNA, 22 bp, Homo sapiens
tgaggggaggttggggcacatc

SEQ ID NO: 7712971 - DNA, 22 bp, Homo sapiens
tgaggggaggttggggcacatc

SEQ ID NO: 7712972 - DNA, 22 bp, Homo sapiens
tgaggggcagagaggtgtccag

SEQ ID NO: 7712973 - DNA, 22 bp, Homo sapiens
tgaggggcagagaggtgtccag

SEQ ID NO: 7712974 - DNA, 22 bp, Homo sapiens
tgaggggcagagaggtgtccag

SEQ ID NO: 7712975 - DNA, 22 bp, Homo sapiens
tgaggggatacggtacacattg

SEQ ID NO: 7712976 - DNA, 22 bp, Homo sapiens
tgaggggatacggtacacattg

SEQ ID NO: 7712977 - DNA, 22 bp, Homo sapiens
tgaggggatacggtacacattg

SEQ ID NO: 7712978 - DNA, 22 bp, Homo sapiens
tgaggggcagagaggtgtccag

SEQ ID NO: 7712979 - DNA, 22 bp, Homo sapiens
tgaggggcagagaggtgtccag

SEQ ID NO: 7712980 - DNA, 22 bp, Homo sapiens
tgaggggcagagaggtgtccag

SEQ ID NO: 7712981 - DNA, 19 bp, Homo sapiens
tgaggggaggagaggcctg

SEQ ID NO: 7712982 - DNA, 22 bp, Homo sapiens
tgaggggaggttggggcacatc

SEQ ID NO: 7712983 - DNA, 22 bp, Homo sapiens
tgaggggaggttggggcacatc

SEQ ID NO: 7712984 - DNA, 22 bp, Homo sapiens
tgaggggaggttggggcacatc

SEQ ID NO: 7712985 - DNA, 22 bp, Homo sapiens
tgaggggaggttggggcacatc

SEQ ID NO: 7712986 - DNA, 22 bp, Homo sapiens
tgaggggaggttggggcacatc

SEQ ID NO: 7712987 - DNA, 22 bp, Homo sapiens
tgaggggaggttggggcacatc

SEQ ID NO: 7712988 - DNA, 22 bp, Homo sapiens
tgaggggaggttggggcacatc

SEQ ID NO: 7712989 - DNA, 22 bp, Homo sapiens
tgaggggaggttggggcacatc

SEQ ID NO: 7712990 - DNA, 22 bp, Homo sapiens
tgaggggaggttggggcacatc

SEQ ID NO: 7712991 - DNA, 22 bp, Homo sapiens
tgaggggaggttggggcacatc

SEQ ID NO: 7712992 - DNA, 22 bp, Homo sapiens
tgaggggaggttggggcacatc

SEQ ID NO: 7712993 - DNA, 22 bp, Homo sapiens
tgagggagtcatgattaaggaa

SEQ ID NO: 7712994 - DNA, 22 bp, Homo sapiens
tgagggagtcatgattaaggaa

SEQ ID NO: 7712995 - DNA, 22 bp, Homo sapiens
tgagggagtcatgattaaggaa

SEQ ID NO: 7712996 - DNA, 22 bp, Homo sapiens
tgagggagtcatgattaaggaa

SEQ ID NO: 7712997 - DNA, 22 bp, Homo sapiens
tgagggagtcatgattaaggaa

SEQ ID NO: 7712998 - DNA, 20 bp, Homo sapiens
tgagggagtattgatttccc

SEQ ID NO: 7712999 - DNA, 20 bp, Homo sapiens
tgagggagtattgatttccc

SEQ ID NO: 7713000 - DNA, 20 bp, Homo sapiens
tgagggagtattgatttccc

SEQ ID NO: 7713001 - DNA, 20 bp, Homo sapiens
tgagggagtattgatttccc

SEQ ID NO: 7713002 - DNA, 20 bp, Homo sapiens
tgagggagtattgatttccc

SEQ ID NO: 7713003 - DNA, 20 bp, Homo sapiens
tgagggagtattgatttccc

SEQ ID NO: 7713004 - DNA, 22 bp, Homo sapiens
tgagggaggcctccatctgcca

SEQ ID NO: 7713005 - DNA, 22 bp, Homo sapiens
tgagggaggcctccatctgcca

SEQ ID NO: 7713006 - DNA, 22 bp, Homo sapiens
tgagggaggcctccatctgcca

SEQ ID NO: 7713007 - DNA, 22 bp, Homo sapiens
tgagggaggccctttgagcaga

SEQ ID NO: 7713008 - DNA, 22 bp, Homo sapiens
tgagggaggccctttgagcaga

SEQ ID NO: 7713009 - DNA, 22 bp, Homo sapiens
tgagggaggccctttgagcaga

SEQ ID NO: 7713010 - DNA, 22 bp, Homo sapiens
tgagggaggccctttgagcaga

SEQ ID NO: 7713011 - DNA, 22 bp, Homo sapiens
tgagggaggcctccatctgcca

SEQ ID NO: 7713012 - DNA, 22 bp, Homo sapiens
tgagggaggcctccatctgcca

SEQ ID NO: 7713013 - DNA, 22 bp, Homo sapiens
tgagggaggcctccatctgcca

SEQ ID NO: 7713014 - DNA, 22 bp, Homo sapiens
tgagggaggcctccatctgcca

SEQ ID NO: 7713015 - DNA, 22 bp, Homo sapiens
tgagggaggcctccatctgcca

SEQ ID NO: 7713016 - DNA, 22 bp, Homo sapiens
tgagggaggcctccatctgcca

SEQ ID NO: 7713017 - DNA, 22 bp, Homo sapiens
tgagggagctgacctttctgtg

SEQ ID NO: 7713018 - DNA, 22 bp, Homo sapiens
tgagggagctgacctttctgtg

SEQ ID NO: 7713019 - DNA, 22 bp, Homo sapiens
tgagggagctgacctttctgtg

SEQ ID NO: 7713020 - DNA, 22 bp, Homo sapiens
tgagggagctgacctttctgtg

SEQ ID NO: 7713021 - DNA, 22 bp, Homo sapiens
tgagggagctgacctttctgtg

SEQ ID NO: 7713022 - DNA, 22 bp, Homo sapiens
tgagggagcacacactgaagtg

SEQ ID NO: 7713023 - DNA, 22 bp, Homo sapiens
tgagggagcacacactgaagtg

SEQ ID NO: 7713024 - DNA, 22 bp, Homo sapiens
tgagggagcacacactgaagtg

SEQ ID NO: 7713025 - DNA, 22 bp, Homo sapiens
tgagggagcacacactgaagtg

SEQ ID NO: 7713026 - DNA, 22 bp, Homo sapiens
tgagggaggccctttgagcaga

SEQ ID NO: 7713027 - DNA, 22 bp, Homo sapiens
tgagggaggccctttgagcaga

SEQ ID NO: 7713028 - DNA, 22 bp, Homo sapiens
tgagggagctgacctttctgtg

SEQ ID NO: 7713029 - DNA, 22 bp, Homo sapiens
tgagggagctgacctttctgtg

SEQ ID NO: 7713030 - DNA, 22 bp, Homo sapiens
tgagggaggccctttgagcaga

SEQ ID NO: 7713031 - DNA, 22 bp, Homo sapiens
tgagggaggccctttgagcaga

SEQ ID NO: 7713032 - DNA, 22 bp, Homo sapiens
tgagggaggccctttgagcaga

SEQ ID NO: 7713033 - DNA, 22 bp, Homo sapiens
tgagggaggccctttgagcaga

SEQ ID NO: 7713034 - DNA, 22 bp, Homo sapiens
tgagggaggccctttgagcaga

SEQ ID NO: 7713035 - DNA, 22 bp, Homo sapiens
tgagggagagggcgaaaatgaa

SEQ ID NO: 7713036 - DNA, 22 bp, Homo sapiens
tgagggactgcatacccagctt

SEQ ID NO: 7713037 - DNA, 22 bp, Homo sapiens
tgagggagagggcgaaaatgaa

SEQ ID NO: 7713038 - DNA, 22 bp, Homo sapiens
tgagggagagggcgaaaatgaa

SEQ ID NO: 7713039 - DNA, 22 bp, Homo sapiens
tgagggagagggcgaaaatgaa

SEQ ID NO: 7713040 - DNA, 22 bp, Homo sapiens
tgagggagagggcgaaaatgaa

SEQ ID NO: 7713041 - DNA, 22 bp, Homo sapiens
tgagggactgcatacccagctt

SEQ ID NO: 7713042 - DNA, 22 bp, Homo sapiens
tgagggagcacacactgaagtg

SEQ ID NO: 7713043 - DNA, 22 bp, Homo sapiens
tgagggagcacacactgaagtg

SEQ ID NO: 7713044 - DNA, 22 bp, Homo sapiens
tgagggagcacacactgaagtg

SEQ ID NO: 7713045 - DNA, 22 bp, Homo sapiens
tgagggagcacacactgaagtg

SEQ ID NO: 7713046 - DNA, 22 bp, Homo sapiens
tgagggagcacacactgaagtg

SEQ ID NO: 7713047 - DNA, 22 bp, Homo sapiens
tgagggagagggcgaaaatgaa

SEQ ID NO: 7713048 - DNA, 22 bp, Homo sapiens
tgagggagcacacactgaagtg

SEQ ID NO: 7713049 - DNA, 22 bp, Homo sapiens
tgagggagagggcgaaaatgaa

SEQ ID NO: 7713050 - DNA, 22 bp, Homo sapiens
tgagggagagggcgaaaatgaa

SEQ ID NO: 7713051 - DNA, 22 bp, Homo sapiens
tgagggagagggcgaaaatgaa

SEQ ID NO: 7713052 - DNA, 22 bp, Homo sapiens
tgagggagagggcgaaaatgaa

SEQ ID NO: 7713053 - DNA, 22 bp, Homo sapiens
tgaggcttgtctcagatggggg

SEQ ID NO: 7713054 - DNA, 22 bp, Homo sapiens
tgaggcttgtctcagatggggg

SEQ ID NO: 7713055 - DNA, 22 bp, Homo sapiens
tgaggctttatgtaagggtgca

SEQ ID NO: 7713056 - DNA, 22 bp, Homo sapiens
tgaggcttgtctcagatggggg

SEQ ID NO: 7713057 - DNA, 22 bp, Homo sapiens
tgaggctttatgtaagggtgca

SEQ ID NO: 7713058 - DNA, 22 bp, Homo sapiens
tgaggctttatgtaagggtgca

SEQ ID NO: 7713059 - DNA, 22 bp, Homo sapiens
tgaggcttggagaggtcaggga

SEQ ID NO: 7713060 - DNA, 22 bp, Homo sapiens
tgaggcttggaggctccagtgg

SEQ ID NO: 7713061 - DNA, 22 bp, Homo sapiens
tgaggcttggcaaaagagtggt

SEQ ID NO: 7713062 - DNA, 22 bp, Homo sapiens
tgaggcttggcaaaagagtggt

SEQ ID NO: 7713063 - DNA, 22 bp, Homo sapiens
tgaggcttggcaaaagagtggt

SEQ ID NO: 7713064 - DNA, 22 bp, Homo sapiens
tgaggcttgtctcagatggggg

SEQ ID NO: 7713065 - DNA, 22 bp, Homo sapiens
tgagggaatattgatagatccg

SEQ ID NO: 7713066 - DNA, 22 bp, Homo sapiens
tgagggaatcctcacatcaatc

SEQ ID NO: 7713067 - DNA, 22 bp, Homo sapiens
tgagggaatcctcacatcaatc

SEQ ID NO: 7713068 - DNA, 19 bp, Homo sapiens
tgagggacattgggagcag

SEQ ID NO: 7713069 - DNA, 19 bp, Homo sapiens
tgagggacattgggagcag

SEQ ID NO: 7713070 - DNA, 22 bp, Homo sapiens
tgaggaaggaattgaggtttta

SEQ ID NO: 7713071 - DNA, 22 bp, Homo sapiens
tgaggaaggaattgaggtttta

SEQ ID NO: 7713072 - DNA, 22 bp, Homo sapiens
tgaggaaggaattgaggtttta

SEQ ID NO: 7713073 - DNA, 22 bp, Homo sapiens
tgaggaaggaattgaggtttta

SEQ ID NO: 7713074 - DNA, 22 bp, Homo sapiens
tgaggaagccaaacagctacac

SEQ ID NO: 7713075 - DNA, 22 bp, Homo sapiens
tgaggaagccaaacagctacac

SEQ ID NO: 7713076 - DNA, 22 bp, Homo sapiens
tgaggaagccaaacagctacac

SEQ ID NO: 7713077 - DNA, 22 bp, Homo sapiens
tgaggaagccaaacagctacac

SEQ ID NO: 7713078 - DNA, 22 bp, Homo sapiens
tgaggaagccaaacagctacac

SEQ ID NO: 7713079 - DNA, 22 bp, Homo sapiens
tgaggaagccaaacagctacac

SEQ ID NO: 7713080 - DNA, 22 bp, Homo sapiens
tgaggaagcaaaggcttgtgtg

SEQ ID NO: 7713081 - DNA, 22 bp, Homo sapiens
tgaggaagcaaaggcttgtgtg

SEQ ID NO: 7713082 - DNA, 22 bp, Homo sapiens
tgaggaagcaaaggcttgtgtg

SEQ ID NO: 7713083 - DNA, 22 bp, Homo sapiens
tgaggaagcaaaggcttgtgtg

SEQ ID NO: 7713084 - DNA, 22 bp, Homo sapiens
tgaggaagaacaagaatttaga

SEQ ID NO: 7713085 - DNA, 22 bp, Homo sapiens
tgaggaagcaaaggcttgtgtg

SEQ ID NO: 7713086 - DNA, 22 bp, Homo sapiens
tgaggaagcaaaggcttgtgtg

SEQ ID NO: 7713087 - DNA, 22 bp, Homo sapiens
tgaggaagcaaaggcttgtgtg

SEQ ID NO: 7713088 - DNA, 22 bp, Homo sapiens
tgaggaagccaaacagctacac

SEQ ID NO: 7713089 - DNA, 22 bp, Homo sapiens
tgaggaagccaaacagctacac

SEQ ID NO: 7713090 - DNA, 22 bp, Homo sapiens
tgaggaagcaaaggcttgtgtg

SEQ ID NO: 7713091 - DNA, 22 bp, Homo sapiens
tgaggaagcaaaggcttgtgtg

SEQ ID NO: 7713092 - DNA, 22 bp, Homo sapiens
tgaggaacaactcctgtgacta

SEQ ID NO: 7713093 - DNA, 22 bp, Homo sapiens
tgaggaaattgaggctcacaga

SEQ ID NO: 7713094 - DNA, 22 bp, Homo sapiens
tgaggaaattgaggctcacaga

SEQ ID NO: 7713095 - DNA, 22 bp, Homo sapiens
tgaggaagaacaagaatttaga

SEQ ID NO: 7713096 - DNA, 22 bp, Homo sapiens
tgaggaagaacaagaatttaga

SEQ ID NO: 7713097 - DNA, 22 bp, Homo sapiens
tgaggaagaacaagaatttaga

SEQ ID NO: 7713098 - DNA, 22 bp, Homo sapiens
tgaggaagaacaagaatttaga

SEQ ID NO: 7713099 - DNA, 22 bp, Homo sapiens
tgaggaactgccagactgtttt

SEQ ID NO: 7713100 - DNA, 22 bp, Homo sapiens
tgaggaactcaccaggcagaga

SEQ ID NO: 7713101 - DNA, 22 bp, Homo sapiens
tgaggaactcaccaggcagaga

SEQ ID NO: 7713102 - DNA, 22 bp, Homo sapiens
tgaggaactcaccaggcagaga

SEQ ID NO: 7713103 - DNA, 22 bp, Homo sapiens
tgaggaactcaccaggcagaga

SEQ ID NO: 7713104 - DNA, 22 bp, Homo sapiens
tgaggaaatatggtgaactctt

SEQ ID NO: 7713105 - DNA, 22 bp, Homo sapiens
tgaggaaatatggtgaactctt

SEQ ID NO: 7713106 - DNA, 22 bp, Homo sapiens
tgaggaaattgaggctcacaga

SEQ ID NO: 7713107 - DNA, 22 bp, Homo sapiens
tgaggaaattgaggctcacaga

SEQ ID NO: 7713108 - DNA, 22 bp, Homo sapiens
tgaggaaatatggtgaactctt

SEQ ID NO: 7713109 - DNA, 22 bp, Homo sapiens
tgaggaaatatggtgaactctt

SEQ ID NO: 7713110 - DNA, 22 bp, Homo sapiens
tgaggaaagaaaggcatgcatg

SEQ ID NO: 7713111 - DNA, 22 bp, Homo sapiens
tgaggaaacttacaaggcagaa

SEQ ID NO: 7713112 - DNA, 22 bp, Homo sapiens
tgaggaaacttacaaggcagaa

SEQ ID NO: 7713113 - DNA, 22 bp, Homo sapiens
tgaggaaagaaaggcatgcatg

SEQ ID NO: 7713114 - DNA, 22 bp, Homo sapiens
tgaggaaagaaaggcatgcatg

SEQ ID NO: 7713115 - DNA, 22 bp, Homo sapiens
tgaggaaagaaaggcatgcatg

SEQ ID NO: 7713116 - DNA, 22 bp, Homo sapiens
tgaggaaagaaaggcatgcatg

SEQ ID NO: 7713117 - DNA, 22 bp, Homo sapiens
tgaggaaagaaaggcatgcatg

SEQ ID NO: 7713118 - DNA, 22 bp, Homo sapiens
tgaggaagtggttgtatggttt

SEQ ID NO: 7713119 - DNA, 23 bp, Homo sapiens
tgaggaagtaattgtaaaggtct

SEQ ID NO: 7713120 - DNA, 22 bp, Homo sapiens
tgaggaagtggttgtatggttt

SEQ ID NO: 7713121 - DNA, 22 bp, Homo sapiens
tgaggaagtggttgtatggttt

SEQ ID NO: 7713122 - DNA, 22 bp, Homo sapiens
tgaggaagtggttgtatggttt

SEQ ID NO: 7713123 - DNA, 22 bp, Homo sapiens
tgaggaagtggttgtatggttt

SEQ ID NO: 7713124 - DNA, 22 bp, Homo sapiens
tgaggaagtggttgtatggttt

SEQ ID NO: 7713125 - DNA, 22 bp, Homo sapiens
tgaggaagttgatctcatcagt

SEQ ID NO: 7713126 - DNA, 22 bp, Homo sapiens
tgaggaagttgatctcatcagt

SEQ ID NO: 7713127 - DNA, 22 bp, Homo sapiens
tgaggaagttgatctcatcagt

SEQ ID NO: 7713128 - DNA, 22 bp, Homo sapiens
tgaggaagttgatctcatcagt

SEQ ID NO: 7713129 - DNA, 22 bp, Homo sapiens
tgaggaagtggttgtatggttt

SEQ ID NO: 7713130 - DNA, 22 bp, Homo sapiens
tgaggaagtggttgtatggttt

SEQ ID NO: 7713131 - DNA, 22 bp, Homo sapiens
tgaggaagttgatctcatcagt

SEQ ID NO: 7713132 - DNA, 22 bp, Homo sapiens
tgaggaagttgtttctcttcta

SEQ ID NO: 7713133 - DNA, 22 bp, Homo sapiens
tgaggaagttgatctcatcagt

SEQ ID NO: 7713134 - DNA, 22 bp, Homo sapiens
tgaggaagttgatctcatcagt

SEQ ID NO: 7713135 - DNA, 22 bp, Homo sapiens
tgaggaagttgtttctcttcta

SEQ ID NO: 7713136 - DNA, 22 bp, Homo sapiens
tgaggaagttgtttctcttcta

SEQ ID NO: 7713137 - DNA, 22 bp, Homo sapiens
tgaggagaaatgctcagagcca

SEQ ID NO: 7713138 - DNA, 22 bp, Homo sapiens
tgaggaagggtgtgacggcacc

SEQ ID NO: 7713139 - DNA, 22 bp, Homo sapiens
tgaggaagggtgtgacggcacc

SEQ ID NO: 7713140 - DNA, 22 bp, Homo sapiens
tgaggaagggtgtgacggcacc

SEQ ID NO: 7713141 - DNA, 22 bp, Homo sapiens
tgaggaagggtgtgacggcacc

SEQ ID NO: 7713142 - DNA, 18 bp, Homo sapiens
tgaggaaggggaagtatt

SEQ ID NO: 7713143 - DNA, 22 bp, Homo sapiens
tgaggaagggcacacggaccct

SEQ ID NO: 7713144 - DNA, 22 bp, Homo sapiens
tgaggaagggcacacggaccct

SEQ ID NO: 7713145 - DNA, 22 bp, Homo sapiens
tgaggaagggcacacggaccct

SEQ ID NO: 7713146 - DNA, 22 bp, Homo sapiens
tgaggaagggcacacggaccct

SEQ ID NO: 7713147 - DNA, 22 bp, Homo sapiens
tgaggaagggcacacggaccct

SEQ ID NO: 7713148 - DNA, 18 bp, Homo sapiens
tgaggaaggggaagtatt

SEQ ID NO: 7713149 - DNA, 18 bp, Homo sapiens
tgaggaaggggaagtatt

SEQ ID NO: 7713150 - DNA, 18 bp, Homo sapiens
tgaggaaggggaagtatt

SEQ ID NO: 7713151 - DNA, 18 bp, Homo sapiens
tgaggaaggggaagtatt

SEQ ID NO: 7713152 - DNA, 23 bp, Homo sapiens
tgaggaagtaattgtaaaggtct

SEQ ID NO: 7713153 - DNA, 23 bp, Homo sapiens
tgaggaagtaattgtaaaggtct

SEQ ID NO: 7713154 - DNA, 23 bp, Homo sapiens
tgaggaagtaattgtaaaggtct

SEQ ID NO: 7713155 - DNA, 23 bp, Homo sapiens
tgaggaagtaattgtaaaggtct

SEQ ID NO: 7713156 - DNA, 22 bp, Homo sapiens
tgaggaagggtgtgacggcacc

SEQ ID NO: 7713157 - DNA, 22 bp, Homo sapiens
tgaggaagggtgtgacggcacc

SEQ ID NO: 7713158 - DNA, 22 bp, Homo sapiens
tgaggaagggtgtgacggcacc

SEQ ID NO: 7713159 - DNA, 22 bp, Homo sapiens
tgaggatggaatgctgtgcaag

SEQ ID NO: 7713160 - DNA, 22 bp, Homo sapiens
tgaggatgagatgagataacac

SEQ ID NO: 7713161 - DNA, 22 bp, Homo sapiens
tgaggatgacgatggcaatggc

SEQ ID NO: 7713162 - DNA, 22 bp, Homo sapiens
tgaggagtttagatatagggaa

SEQ ID NO: 7713163 - DNA, 21 bp, Homo sapiens
tgaggataagtaaagctgaag

SEQ ID NO: 7713164 - DNA, 22 bp, Homo sapiens
tgaggatgacgatggcaatggc

SEQ ID NO: 7713165 - DNA, 22 bp, Homo sapiens
tgaggagtgtggatggagcttg

SEQ ID NO: 7713166 - DNA, 22 bp, Homo sapiens
tgaggagtgtggatggagcttg

SEQ ID NO: 7713167 - DNA, 22 bp, Homo sapiens
tgaggagtgtggatggagcttg

SEQ ID NO: 7713168 - DNA, 22 bp, Homo sapiens
tgaggagtgtggatggagcttg

SEQ ID NO: 7713169 - DNA, 22 bp, Homo sapiens
tgaggagtttttctagagctaa

SEQ ID NO: 7713170 - DNA, 22 bp, Homo sapiens
tgaggagtttttctagagctaa

SEQ ID NO: 7713171 - DNA, 22 bp, Homo sapiens
tgaggaggtgggcacacagagt

SEQ ID NO: 7713172 - DNA, 22 bp, Homo sapiens
tgaggaggtgggcacacagagt

SEQ ID NO: 7713173 - DNA, 22 bp, Homo sapiens
tgaggagtatggtggggtcatt

SEQ ID NO: 7713174 - DNA, 22 bp, Homo sapiens
tgaggagtatggtggggtcatt

SEQ ID NO: 7713175 - DNA, 22 bp, Homo sapiens
tgaggagtcgagaaggggtaat

SEQ ID NO: 7713176 - DNA, 22 bp, Homo sapiens
tgaggagtcgagaaggggtaat

SEQ ID NO: 7713177 - DNA, 22 bp, Homo sapiens
tgaggagtcgagaaggggtaat

SEQ ID NO: 7713178 - DNA, 22 bp, Homo sapiens
tgaggagtatggtggggtcatt

SEQ ID NO: 7713179 - DNA, 22 bp, Homo sapiens
tgaggatggcagtgtgctcagc

SEQ ID NO: 7713180 - DNA, 22 bp, Homo sapiens
tgaggatggcagtgtgctcagc

SEQ ID NO: 7713181 - DNA, 22 bp, Homo sapiens
tgaggatggcagtgtgctcagc

SEQ ID NO: 7713182 - DNA, 22 bp, Homo sapiens
tgaggatggaatgctgtgcaag

SEQ ID NO: 7713183 - DNA, 22 bp, Homo sapiens
tgaggatggaatgctgtgcaag

SEQ ID NO: 7713184 - DNA, 22 bp, Homo sapiens
tgaggatggcagtgtgctcagc

SEQ ID NO: 7713185 - DNA, 22 bp, Homo sapiens
tgaggatggcagtgtgctcagc

SEQ ID NO: 7713186 - DNA, 22 bp, Homo sapiens
tgaggatggcagtgtgctcagc

SEQ ID NO: 7713187 - DNA, 22 bp, Homo sapiens
tgaggatggtgttggagagggc

SEQ ID NO: 7713188 - DNA, 22 bp, Homo sapiens
tgaggatggtgttggagagggc

SEQ ID NO: 7713189 - DNA, 22 bp, Homo sapiens
tgaggatggtcccgaggacact

SEQ ID NO: 7713190 - DNA, 22 bp, Homo sapiens
tgaggatggtgttggagagggc

SEQ ID NO: 7713191 - DNA, 22 bp, Homo sapiens
tgaggatggtcccgaggacact

SEQ ID NO: 7713192 - DNA, 22 bp, Homo sapiens
tgaggatggtcccgaggacact

SEQ ID NO: 7713193 - DNA, 22 bp, Homo sapiens
tgaggatggggagatggtgtct

SEQ ID NO: 7713194 - DNA, 22 bp, Homo sapiens
tgaggatggggagatggtgtct

SEQ ID NO: 7713195 - DNA, 22 bp, Homo sapiens
tgaggatggggagatggtgtct

SEQ ID NO: 7713196 - DNA, 22 bp, Homo sapiens
tgaggagccactctagcagtca

SEQ ID NO: 7713197 - DNA, 23 bp, Homo sapiens
tgaggagcatagctgactgacag

SEQ ID NO: 7713198 - DNA, 22 bp, Homo sapiens
tgaggagccactctagcagtca

SEQ ID NO: 7713199 - DNA, 22 bp, Homo sapiens
tgaggagcgggcagggatgcag

SEQ ID NO: 7713200 - DNA, 22 bp, Homo sapiens
tgaggagcgggcagggatgcag

SEQ ID NO: 7713201 - DNA, 22 bp, Homo sapiens
tgaggagcgggcagggatgcag

SEQ ID NO: 7713202 - DNA, 22 bp, Homo sapiens
tgaggagcgggcagggatgcag

SEQ ID NO: 7713203 - DNA, 22 bp, Homo sapiens
tgaggagcttctggaaagtgca

SEQ ID NO: 7713204 - DNA, 22 bp, Homo sapiens
tgaggagcttctggaaagtgca

SEQ ID NO: 7713205 - DNA, 22 bp, Homo sapiens
tgaggagcttctggaaagtgca

SEQ ID NO: 7713206 - DNA, 19 bp, Homo sapiens
tgaggagcagctggttgat

SEQ ID NO: 7713207 - DNA, 22 bp, Homo sapiens
tgaggagaaatgctcagagcca

SEQ ID NO: 7713208 - DNA, 19 bp, Homo sapiens
tgaggagcagctggttgat

SEQ ID NO: 7713209 - DNA, 19 bp, Homo sapiens
tgaggagcagctggttgat

SEQ ID NO: 7713210 - DNA, 19 bp, Homo sapiens
tgaggagcagctggttgat

SEQ ID NO: 7713211 - DNA, 22 bp, Homo sapiens
tgaggagcagggtggcttactc

SEQ ID NO: 7713212 - DNA, 22 bp, Homo sapiens
tgaggagcagggtggcttactc

SEQ ID NO: 7713213 - DNA, 22 bp, Homo sapiens
tgaggagcagggtggcttactc

SEQ ID NO: 7713214 - DNA, 23 bp, Homo sapiens
tgaggagcatagctgactgacag

SEQ ID NO: 7713215 - DNA, 23 bp, Homo sapiens
tgaggagcatagctgactgacag

SEQ ID NO: 7713216 - DNA, 22 bp, Homo sapiens
tgaggagccactctagcagtca

SEQ ID NO: 7713217 - DNA, 23 bp, Homo sapiens
tgaggagcatagctgactgacag

SEQ ID NO: 7713218 - DNA, 22 bp, Homo sapiens
tgaggaggtcagagtctggctg

SEQ ID NO: 7713219 - DNA, 22 bp, Homo sapiens
tgaggaggtcagagtctggctg

SEQ ID NO: 7713220 - DNA, 22 bp, Homo sapiens
tgaggaggtcagagtctggctg

SEQ ID NO: 7713221 - DNA, 22 bp, Homo sapiens
tgaggaggcccaggttggggct

SEQ ID NO: 7713222 - DNA, 22 bp, Homo sapiens
tgaggaggcccaggttggggct

SEQ ID NO: 7713223 - DNA, 22 bp, Homo sapiens
tgaggaggcccaggttggggct

SEQ ID NO: 7713224 - DNA, 22 bp, Homo sapiens
tgaggagcttctggaaagtgca

SEQ ID NO: 7713225 - DNA, 22 bp, Homo sapiens
tgaggaggcccaggttggggct

SEQ ID NO: 7713226 - DNA, 22 bp, Homo sapiens
tgaggaggtcagagtctggctg

SEQ ID NO: 7713227 - DNA, 22 bp, Homo sapiens
tgaggaggtcagagtctggctg

SEQ ID NO: 7713228 - DNA, 22 bp, Homo sapiens
tgaggaggtgggcacacagagt

SEQ ID NO: 7713229 - DNA, 22 bp, Homo sapiens
tgaggaggtgggcacacagagt

SEQ ID NO: 7713230 - DNA, 22 bp, Homo sapiens
tgaggaggtgggcacacagagt

SEQ ID NO: 7713231 - DNA, 22 bp, Homo sapiens
tgaggaggtcagagtctggctg

SEQ ID NO: 7713232 - DNA, 22 bp, Homo sapiens
tgaggcaacagaaagggccaat

SEQ ID NO: 7713233 - DNA, 17 bp, Homo sapiens
tgaggcaaccatcacta

SEQ ID NO: 7713234 - DNA, 19 bp, Homo sapiens
tgaggcaagatggctctgg

SEQ ID NO: 7713235 - DNA, 19 bp, Homo sapiens
tgaggcaagatggctctgg

SEQ ID NO: 7713236 - DNA, 22 bp, Homo sapiens
tgaggcaagagtttgattagag

SEQ ID NO: 7713237 - DNA, 19 bp, Homo sapiens
tgaggcaagatggctctgg

SEQ ID NO: 7713238 - DNA, 17 bp, Homo sapiens
tgaggcaaccatcacta

SEQ ID NO: 7713239 - DNA, 22 bp, Homo sapiens
tgaggcaaagttcaagctgaaa

SEQ ID NO: 7713240 - DNA, 22 bp, Homo sapiens
tgaggcaaagacaaagcagcat

SEQ ID NO: 7713241 - DNA, 22 bp, Homo sapiens
tgaggcaaagacaaagcagcat

SEQ ID NO: 7713242 - DNA, 22 bp, Homo sapiens
tgaggcaaagttcaagctgaaa

SEQ ID NO: 7713243 - DNA, 22 bp, Homo sapiens
tgaggcaaagttcaagctgaaa

SEQ ID NO: 7713244 - DNA, 22 bp, Homo sapiens
tgaggcaaaaacactgattagg

SEQ ID NO: 7713245 - DNA, 22 bp, Homo sapiens
tgaggcaaaagttatgtggtag

SEQ ID NO: 7713246 - DNA, 22 bp, Homo sapiens
tgaggcaaagacaaagcagcat

SEQ ID NO: 7713247 - DNA, 22 bp, Homo sapiens
tgaggcaaagacaaagcagcat

SEQ ID NO: 7713248 - DNA, 22 bp, Homo sapiens
tgaggatttctatggttctttc

SEQ ID NO: 7713249 - DNA, 21 bp, Homo sapiens
tgaggatttcagtagatgcct

SEQ ID NO: 7713250 - DNA, 22 bp, Homo sapiens
tgaggatttaatgggactcatt

SEQ ID NO: 7713251 - DNA, 22 bp, Homo sapiens
tgaggattgagtcaagcagtat

SEQ ID NO: 7713252 - DNA, 22 bp, Homo sapiens
tgaggattggcaaaactcaggg

SEQ ID NO: 7713253 - DNA, 22 bp, Homo sapiens
tgaggattaaatgagctaataa

SEQ ID NO: 7713254 - DNA, 22 bp, Homo sapiens
tgaggattgagtcaagcagtat

SEQ ID NO: 7713255 - DNA, 22 bp, Homo sapiens
tgaggatggtgttggagagggc

SEQ ID NO: 7713256 - DNA, 22 bp, Homo sapiens
tgaggatgtctgtattttgcct

SEQ ID NO: 7713257 - DNA, 22 bp, Homo sapiens
tgaggatggtgttggagagggc

SEQ ID NO: 7713258 - DNA, 21 bp, Homo sapiens
tgaggatgtgcagcagcagga

SEQ ID NO: 7713259 - DNA, 21 bp, Homo sapiens
tgaggatgtgcagcagcagga

SEQ ID NO: 7713260 - DNA, 21 bp, Homo sapiens
tgaggatgtgcagcagcagga

SEQ ID NO: 7713261 - DNA, 21 bp, Homo sapiens
tgaggatgtgcagcagcagga

SEQ ID NO: 7713262 - DNA, 22 bp, Homo sapiens
tgaggcaatccctagggtaagg

SEQ ID NO: 7713263 - DNA, 22 bp, Homo sapiens
tgaggcaatgtccttcatcctt

SEQ ID NO: 7713264 - DNA, 22 bp, Homo sapiens
tgaggcacagaaaatggtaggg

SEQ ID NO: 7713265 - DNA, 22 bp, Homo sapiens
tgaggcaatgtccttcatcctt

SEQ ID NO: 7713266 - DNA, 22 bp, Homo sapiens
tgaggcacatccaggccagctc

SEQ ID NO: 7713267 - DNA, 19 bp, Homo sapiens
tgaggcacagtggtgaaat

SEQ ID NO: 7713268 - DNA, 19 bp, Homo sapiens
tgaggcacagtggtgaaat

SEQ ID NO: 7713269 - DNA, 22 bp, Homo sapiens
tgaggcaattggaaattttaac

SEQ ID NO: 7713270 - DNA, 22 bp, Homo sapiens
tgaggcactgggagagcacact

SEQ ID NO: 7713271 - DNA, 22 bp, Homo sapiens
tgaggcactgggagagcacact

SEQ ID NO: 7713272 - DNA, 22 bp, Homo sapiens
tgaggcactccaggatgctgtt

SEQ ID NO: 7713273 - DNA, 22 bp, Homo sapiens
tgaggcactccaggatgctgtt

SEQ ID NO: 7713274 - DNA, 22 bp, Homo sapiens
tgaggcactccaggatgctgtt

SEQ ID NO: 7713275 - DNA, 19 bp, Homo sapiens
tgaggcactagtctggtcc

SEQ ID NO: 7713276 - DNA, 22 bp, Homo sapiens
tgaggcactccaggatgctgtt

SEQ ID NO: 7713277 - DNA, 22 bp, Homo sapiens
tgaggcacatccaggccagctc

SEQ ID NO: 7713278 - DNA, 19 bp, Homo sapiens
tgaggcacatgataagaac

SEQ ID NO: 7713279 - DNA, 19 bp, Homo sapiens
tgaggcactagtctggtcc

SEQ ID NO: 7713280 - DNA, 22 bp, Homo sapiens
tgaggcaatccctagggtaagg

SEQ ID NO: 7713281 - DNA, 22 bp, Homo sapiens
tgaggcaagtctcaatctttga

SEQ ID NO: 7713282 - DNA, 22 bp, Homo sapiens
tgaggcaagtactttccctttt

SEQ ID NO: 7713283 - DNA, 21 bp, Homo sapiens
tgaggcaagtccttttatagc

SEQ ID NO: 7713284 - DNA, 22 bp, Homo sapiens
tgaggcaagtctcaatctttga

SEQ ID NO: 7713285 - DNA, 22 bp, Homo sapiens
tgaggcaagtactttccctttt

SEQ ID NO: 7713286 - DNA, 22 bp, Homo sapiens
tgaggcaagtactttccctttt

SEQ ID NO: 7713287 - DNA, 22 bp, Homo sapiens
tgaggcaaggctgaatgaaggc

SEQ ID NO: 7713288 - DNA, 22 bp, Homo sapiens
tgaggcaagggatggccccgtg

SEQ ID NO: 7713289 - DNA, 22 bp, Homo sapiens
tgaggcaaggctgaatgaaggc

SEQ ID NO: 7713290 - DNA, 19 bp, Homo sapiens
tgaggcaagctttttcttg

SEQ ID NO: 7713291 - DNA, 22 bp, Homo sapiens
tgaggcaagggatggccccgtg

SEQ ID NO: 7713292 - DNA, 22 bp, Homo sapiens
tgaggcaagctgggcccatgga

SEQ ID NO: 7713293 - DNA, 19 bp, Homo sapiens
tgaggcaagatggctctgg

SEQ ID NO: 7713294 - DNA, 22 bp, Homo sapiens
tgaggcaagctgggcccatgga

SEQ ID NO: 7713295 - DNA, 22 bp, Homo sapiens
tgaggcaagctgggcccatgga

SEQ ID NO: 7713296 - DNA, 22 bp, Homo sapiens
tgaggcaggaatggggaaaagt

SEQ ID NO: 7713297 - DNA, 22 bp, Homo sapiens
tgaggcaggaatggggaaaagt

SEQ ID NO: 7713298 - DNA, 22 bp, Homo sapiens
tgaggcaggaatggggaaaagt

SEQ ID NO: 7713299 - DNA, 22 bp, Homo sapiens
tgaggcaggacatggacaactg

SEQ ID NO: 7713300 - DNA, 22 bp, Homo sapiens
tgaggcaggaagttatataatg

SEQ ID NO: 7713301 - DNA, 22 bp, Homo sapiens
tgaggcaggaatggggaaaagt

SEQ ID NO: 7713302 - DNA, 22 bp, Homo sapiens
tgaggcaggaatggggaaaagt

SEQ ID NO: 7713303 - DNA, 22 bp, Homo sapiens
tgaggcaggaatggggaaaagt

SEQ ID NO: 7713304 - DNA, 22 bp, Homo sapiens
tgaggcaggacatggacaactg

SEQ ID NO: 7713305 - DNA, 22 bp, Homo sapiens
tgaggcaggacatggacaactg

SEQ ID NO: 7713306 - DNA, 22 bp, Homo sapiens
tgaggcaggactgagcgggatg

SEQ ID NO: 7713307 - DNA, 22 bp, Homo sapiens
tgaggcaggacatggacaactg

SEQ ID NO: 7713308 - DNA, 22 bp, Homo sapiens
tgaggcaggacatggacaactg

SEQ ID NO: 7713309 - DNA, 22 bp, Homo sapiens
tgaggcaggacatggacaactg

SEQ ID NO: 7713310 - DNA, 22 bp, Homo sapiens
tgaggcaggacatggacaactg

SEQ ID NO: 7713311 - DNA, 22 bp, Homo sapiens
tgaggcaggacatggacaactg

SEQ ID NO: 7713312 - DNA, 22 bp, Homo sapiens
tgaggcagctttttctgtgtgt

SEQ ID NO: 7713313 - DNA, 22 bp, Homo sapiens
tgaggcagctttttctgtgtgt

SEQ ID NO: 7713314 - DNA, 22 bp, Homo sapiens
tgaggcaggaagttatataatg

SEQ ID NO: 7713315 - DNA, 22 bp, Homo sapiens
tgaggcaggaagttatataatg

SEQ ID NO: 7713316 - DNA, 22 bp, Homo sapiens
tgaggcagctttttctgtgtgt

SEQ ID NO: 7713317 - DNA, 22 bp, Homo sapiens
tgaggcagctttttctgtgtgt

SEQ ID NO: 7713318 - DNA, 22 bp, Homo sapiens
tgaggcagctttttctgtgtgt

SEQ ID NO: 7713319 - DNA, 22 bp, Homo sapiens
tgaggcagcctgcattaaagag

SEQ ID NO: 7713320 - DNA, 22 bp, Homo sapiens
tgaggcagctttttctgtgtgt

SEQ ID NO: 7713321 - DNA, 22 bp, Homo sapiens
tgaggcagctttttctgtgtgt

SEQ ID NO: 7713322 - DNA, 22 bp, Homo sapiens
tgaggcagaaaatagcagttca

SEQ ID NO: 7713323 - DNA, 22 bp, Homo sapiens
tgaggcagctttttctgtgtgt

SEQ ID NO: 7713324 - DNA, 22 bp, Homo sapiens
tgaggcagaaaatagcagttca

SEQ ID NO: 7713325 - DNA, 22 bp, Homo sapiens
tgaggcagaaaatagcagttca

SEQ ID NO: 7713326 - DNA, 22 bp, Homo sapiens
tgaggcagaaaatagcagttca

SEQ ID NO: 7713327 - DNA, 22 bp, Homo sapiens
tgaggcagaaaatagcagttca

SEQ ID NO: 7713328 - DNA, 22 bp, Homo sapiens
tgaggcactgggagagcacact

SEQ ID NO: 7713329 - DNA, 22 bp, Homo sapiens
tgaggcaggactgagcgggatg

SEQ ID NO: 7713330 - DNA, 22 bp, Homo sapiens
tgaggcaggactgagcgggatg

SEQ ID NO: 7713331 - DNA, 22 bp, Homo sapiens
tgaggcaggactgagcgggatg

SEQ ID NO: 7713332 - DNA, 22 bp, Homo sapiens
tgaggcaggactgagcgggatg

SEQ ID NO: 7713333 - DNA, 22 bp, Homo sapiens
tgaggcaggactgagcgggatg

SEQ ID NO: 7713334 - DNA, 22 bp, Homo sapiens
tgaggcaggactgagcgggatg

SEQ ID NO: 7713335 - DNA, 22 bp, Homo sapiens
tgaggcaggactgagcgggatg

SEQ ID NO: 7713336 - DNA, 22 bp, Homo sapiens
tgaggcaggactgagcgggatg

SEQ ID NO: 7713337 - DNA, 22 bp, Homo sapiens
tgaggcaggactgagcgggatg

SEQ ID NO: 7713338 - DNA, 22 bp, Homo sapiens
tgaggcaggactgagcgggatg

SEQ ID NO: 7713339 - DNA, 22 bp, Homo sapiens
tgaggcaggactgagcgggatg

SEQ ID NO: 7713340 - DNA, 22 bp, Homo sapiens
tgaggcaggacttgcataaagt

SEQ ID NO: 7713341 - DNA, 22 bp, Homo sapiens
tgaggcaggacttgcataaagt

SEQ ID NO: 7713342 - DNA, 22 bp, Homo sapiens
tgaggcaggacttgcataaagt

SEQ ID NO: 7713343 - DNA, 22 bp, Homo sapiens
tgaggcaggacttgcataaagt

SEQ ID NO: 7713344 - DNA, 22 bp, Homo sapiens
tgaggcaggacttgcataaagt

SEQ ID NO: 7713345 - DNA, 22 bp, Homo sapiens
tgaggcaggagaatcacatgaa

SEQ ID NO: 7713346 - DNA, 22 bp, Homo sapiens
tgaggcaggagaatcacatgaa

SEQ ID NO: 7713347 - DNA, 22 bp, Homo sapiens
tgaggcaggagaatcacatgaa

SEQ ID NO: 7713348 - DNA, 22 bp, Homo sapiens
tgaggcaggagaatcacatgaa

SEQ ID NO: 7713349 - DNA, 22 bp, Homo sapiens
tgaggcaggagaatcacatgaa

SEQ ID NO: 7713350 - DNA, 22 bp, Homo sapiens
tgaggcaggagaatcacatgaa

SEQ ID NO: 7713351 - DNA, 22 bp, Homo sapiens
tgaggcaggagaatcacatgaa

SEQ ID NO: 7713352 - DNA, 22 bp, Homo sapiens
tgaggcaggacttgcataaagt

SEQ ID NO: 7713353 - DNA, 22 bp, Homo sapiens
tgaggcaggagaatcacatgaa

SEQ ID NO: 7713354 - DNA, 22 bp, Homo sapiens
tgaggcaggagaatcacatgaa

SEQ ID NO: 7713355 - DNA, 22 bp, Homo sapiens
tgaggcaggagaatcaccggaa

SEQ ID NO: 7713356 - DNA, 22 bp, Homo sapiens
tgaggcaggagaatcaccggaa

SEQ ID NO: 7713357 - DNA, 22 bp, Homo sapiens
tgaggcaggagaatcaccggaa

SEQ ID NO: 7713358 - DNA, 22 bp, Homo sapiens
tgaggcaggagaatcacatgaa

SEQ ID NO: 7713359 - DNA, 22 bp, Homo sapiens
tgaggcaggagaatcacatgaa

SEQ ID NO: 7713360 - DNA, 22 bp, Homo sapiens
tgaggcaggagaatcaccggaa

SEQ ID NO: 7713361 - DNA, 22 bp, Homo sapiens
tgaggcaggagaatcaccggaa

SEQ ID NO: 7713362 - DNA, 20 bp, Homo sapiens
tgaggcaggagaatggcatg

SEQ ID NO: 7713363 - DNA, 20 bp, Homo sapiens
tgaggcaggagaatggcatg

SEQ ID NO: 7713364 - DNA, 20 bp, Homo sapiens
tgaggcaggagaatggcatg

SEQ ID NO: 7713365 - DNA, 20 bp, Homo sapiens
tgaggcaggagaatggcatg

SEQ ID NO: 7713366 - DNA, 20 bp, Homo sapiens
tgaggcaggagaatggcatg

SEQ ID NO: 7713367 - DNA, 22 bp, Homo sapiens
tgaggcagggagagtggatatg

SEQ ID NO: 7713368 - DNA, 22 bp, Homo sapiens
tgaggcagggagagtggatatg

SEQ ID NO: 7713369 - DNA, 22 bp, Homo sapiens
tgaggcagggagagtggatatg

SEQ ID NO: 7713370 - DNA, 22 bp, Homo sapiens
tgaggcagggagtttaattgtc

SEQ ID NO: 7713371 - DNA, 22 bp, Homo sapiens
tgaggcagggagtttaattgtc

SEQ ID NO: 7713372 - DNA, 22 bp, Homo sapiens
tgaggcagggagagtggatatg

SEQ ID NO: 7713373 - DNA, 22 bp, Homo sapiens
tgaggcagggagagtggatatg

SEQ ID NO: 7713374 - DNA, 22 bp, Homo sapiens
tgaggcagggagagtggatatg

SEQ ID NO: 7713375 - DNA, 22 bp, Homo sapiens
tgaggcagggagagtggatatg

SEQ ID NO: 7713376 - DNA, 22 bp, Homo sapiens
tgaggcagggagagtggatatg

SEQ ID NO: 7713377 - DNA, 23 bp, Homo sapiens
tgaggcaggcggatcacgaggtc

SEQ ID NO: 7713378 - DNA, 23 bp, Homo sapiens
tgaggcaggcggatcacgaggtc

SEQ ID NO: 7713379 - DNA, 23 bp, Homo sapiens
tgaggcaggcggatcacgaggtc

SEQ ID NO: 7713380 - DNA, 23 bp, Homo sapiens
tgaggcaggcggatcacgaggtc

SEQ ID NO: 7713381 - DNA, 23 bp, Homo sapiens
tgaggcaggcggatcacgaggtc

SEQ ID NO: 7713382 - DNA, 23 bp, Homo sapiens
tgaggcaggcggatcacgaggtc

SEQ ID NO: 7713383 - DNA, 22 bp, Homo sapiens
tgaggcagggagtttaattgtc

SEQ ID NO: 7713384 - DNA, 21 bp, Homo sapiens
tgaggcaggggtgcttttgtc

SEQ ID NO: 7713385 - DNA, 22 bp, Homo sapiens
tgaggcagggagtttaattgtc

SEQ ID NO: 7713386 - DNA, 22 bp, Homo sapiens
tgaggcagggagtttaattgtc

SEQ ID NO: 7713387 - DNA, 21 bp, Homo sapiens
tgaggcaggggtgcttttgtc

SEQ ID NO: 7713388 - DNA, 22 bp, Homo sapiens
tgaggcagtgtgagataataaa

SEQ ID NO: 7713389 - DNA, 21 bp, Homo sapiens
tgaggcaggggtgcttttgtc

SEQ ID NO: 7713390 - DNA, 21 bp, Homo sapiens
tgaggcaggggtgcttttgtc

SEQ ID NO: 7713391 - DNA, 21 bp, Homo sapiens
tgaggcaggggtgcttttgtc

SEQ ID NO: 7713392 - DNA, 21 bp, Homo sapiens
tgaggcaggggtgcttttgtc

SEQ ID NO: 7713393 - DNA, 21 bp, Homo sapiens
tgaggcaggggtgcttttgtc

SEQ ID NO: 7713394 - DNA, 22 bp, Homo sapiens
tgaggcagttcttacttgtatt

SEQ ID NO: 7713395 - DNA, 22 bp, Homo sapiens
tgaggcagttgagcttcctgag

SEQ ID NO: 7713396 - DNA, 22 bp, Homo sapiens
tgaggcagttgagcttcctgag

SEQ ID NO: 7713397 - DNA, 22 bp, Homo sapiens
tgaggcagttgagcttcctgag

SEQ ID NO: 7713398 - DNA, 22 bp, Homo sapiens
tgaggcagttcttacttgtatt

SEQ ID NO: 7713399 - DNA, 22 bp, Homo sapiens
tgaggcagttcttacttgtatt

SEQ ID NO: 7713400 - DNA, 22 bp, Homo sapiens
tgaggcagtgtgagataataaa

SEQ ID NO: 7713401 - DNA, 22 bp, Homo sapiens
tgaggcagttcttacttgtatt

SEQ ID NO: 7713402 - DNA, 22 bp, Homo sapiens
tgaggcagttcttacttgtatt

SEQ ID NO: 7713403 - DNA, 22 bp, Homo sapiens
tgaggccaactagggagatgga

SEQ ID NO: 7713404 - DNA, 22 bp, Homo sapiens
tgaggccaactagggagatgga

SEQ ID NO: 7713405 - DNA, 22 bp, Homo sapiens
tgaggccaactagggagatgga

SEQ ID NO: 7713406 - DNA, 22 bp, Homo sapiens
tgaggcattaaagggaggtcaa

SEQ ID NO: 7713407 - DNA, 22 bp, Homo sapiens
tgaggccaactagggagatgga

SEQ ID NO: 7713408 - DNA, 22 bp, Homo sapiens
tgaggccaactagggagatgga

SEQ ID NO: 7713409 - DNA, 22 bp, Homo sapiens
tgaggccaaaatgactcaaatg

SEQ ID NO: 7713410 - DNA, 22 bp, Homo sapiens
tgaggccaaaatgactcaaatg

SEQ ID NO: 7713411 - DNA, 22 bp, Homo sapiens
tgaggcattaaagggaggtcaa

SEQ ID NO: 7713412 - DNA, 22 bp, Homo sapiens
tgaggcagttgagcttcctgag

SEQ ID NO: 7713413 - DNA, 22 bp, Homo sapiens
tgaggcagttgagcttcctgag

SEQ ID NO: 7713414 - DNA, 22 bp, Homo sapiens
tgaggcagttgagcttcctgag

SEQ ID NO: 7713415 - DNA, 22 bp, Homo sapiens
tgaggcagttgagcttcctgag

SEQ ID NO: 7713416 - DNA, 22 bp, Homo sapiens
tgaggcagttgagcttcctgag

SEQ ID NO: 7713417 - DNA, 22 bp, Homo sapiens
tgaggcagttgagcttcctgag

SEQ ID NO: 7713418 - DNA, 22 bp, Homo sapiens
tgaggcagttgagcttcctgag

SEQ ID NO: 7713419 - DNA, 22 bp, Homo sapiens
tgaggcatggtcctgagggagc

SEQ ID NO: 7713420 - DNA, 22 bp, Homo sapiens
tgaggcatggtcctgagggagc

SEQ ID NO: 7713421 - DNA, 19 bp, Homo sapiens
tgaggccaaggtcacagat

SEQ ID NO: 7713422 - DNA, 22 bp, Homo sapiens
tgaggccaagcctcctctgcca

SEQ ID NO: 7713423 - DNA, 22 bp, Homo sapiens
tgaggccaagcctcctctgcca

SEQ ID NO: 7713424 - DNA, 19 bp, Homo sapiens
tgaggccaaggtcacagat

SEQ ID NO: 7713425 - DNA, 19 bp, Homo sapiens
tgaggccaaggtcacagat

SEQ ID NO: 7713426 - DNA, 19 bp, Homo sapiens
tgaggccaaggtcacagat

SEQ ID NO: 7713427 - DNA, 22 bp, Homo sapiens
tgaggccaagaaaagctgggtg

SEQ ID NO: 7713428 - DNA, 22 bp, Homo sapiens
tgaggccaagaaaagctgggtg

SEQ ID NO: 7713429 - DNA, 22 bp, Homo sapiens
tgaggccaagcctcctctgcca

SEQ ID NO: 7713430 - DNA, 22 bp, Homo sapiens
tgaggccaagcctcctctgcca

SEQ ID NO: 7713431 - DNA, 22 bp, Homo sapiens
tgaggccaagcctcctctgcca

SEQ ID NO: 7713432 - DNA, 22 bp, Homo sapiens
tgaggccaactagggagatgga

SEQ ID NO: 7713433 - DNA, 22 bp, Homo sapiens
tgaggccaactagggagatgga

SEQ ID NO: 7713434 - DNA, 22 bp, Homo sapiens
tgaggccaactagggagatgga

SEQ ID NO: 7713435 - DNA, 22 bp, Homo sapiens
tgaggccaagaaaagctgggtg

SEQ ID NO: 7713436 - DNA, 22 bp, Homo sapiens
tgaggccaagaaaagctgggtg

SEQ ID NO: 7713437 - DNA, 22 bp, Homo sapiens
tgaggcaggagttaatgtgctc

SEQ ID NO: 7713438 - DNA, 22 bp, Homo sapiens
tgaggcaggagttaatgtgctc

SEQ ID NO: 7713439 - DNA, 22 bp, Homo sapiens
tgaggcaggagttaatgtgctc

SEQ ID NO: 7713440 - DNA, 22 bp, Homo sapiens
tgaggcaggagttaatgtgctc

SEQ ID NO: 7713441 - DNA, 22 bp, Homo sapiens
tgaggcaggagttaatgtgctc

SEQ ID NO: 7713442 - DNA, 22 bp, Homo sapiens
tgaggcaggagttcaggctgcg

SEQ ID NO: 7713443 - DNA, 22 bp, Homo sapiens
tgaggcaggagttcaggctgcg

SEQ ID NO: 7713444 - DNA, 22 bp, Homo sapiens
tgaggcaggagttcaggctgcg

SEQ ID NO: 7713445 - DNA, 22 bp, Homo sapiens
tgaggcaggagttaatgtgctc

SEQ ID NO: 7713446 - DNA, 22 bp, Homo sapiens
tgaggcaggagttcaggctgcg

SEQ ID NO: 7713447 - DNA, 22 bp, Homo sapiens
tgaggcaggagttcaggctgcg

SEQ ID NO: 7713448 - DNA, 22 bp, Homo sapiens
tgaggcaggagttcaggctgcg

SEQ ID NO: 7713449 - DNA, 22 bp, Homo sapiens
tgaggcaggagttcaggctgcg

SEQ ID NO: 7713450 - DNA, 22 bp, Homo sapiens
tgaggcaggagttcaggctgcg

SEQ ID NO: 7713451 - DNA, 22 bp, Homo sapiens
tgaggcaggagttcaggctgcg

SEQ ID NO: 7713452 - DNA, 22 bp, Homo sapiens
tgaggcaggagttcaggctgcg

SEQ ID NO: 7713453 - DNA, 22 bp, Homo sapiens
tgaggcaggagttcaggctgcg

SEQ ID NO: 7713454 - DNA, 22 bp, Homo sapiens
tgaggcaggagttcaggctgcg

SEQ ID NO: 7713455 - DNA, 22 bp, Homo sapiens
tgaggcaggagttcaggctgcg

SEQ ID NO: 7713456 - DNA, 22 bp, Homo sapiens
tgaggcaggagttcaggctgcg

SEQ ID NO: 7713457 - DNA, 22 bp, Homo sapiens
tgaggcaggagttcaggctgcg

SEQ ID NO: 7713458 - DNA, 22 bp, Homo sapiens
tgaggcaggatgcttgcacagg

SEQ ID NO: 7713459 - DNA, 22 bp, Homo sapiens
tgaggcaggatgcttgcacagg

SEQ ID NO: 7713460 - DNA, 22 bp, Homo sapiens
tgaggcaggatgcttgcacagg

SEQ ID NO: 7713461 - DNA, 22 bp, Homo sapiens
tgaggcaggatgcttgcacagg

SEQ ID NO: 7713462 - DNA, 22 bp, Homo sapiens
tgaggcaggatgcttgcacagg

SEQ ID NO: 7713463 - DNA, 22 bp, Homo sapiens
tgaggcaggagttcaggctgcg

SEQ ID NO: 7713464 - DNA, 23 bp, Homo sapiens
tgaggcaggcggatcacgaggtc

SEQ ID NO: 7713465 - DNA, 22 bp, Homo sapiens
tgaggcaggatgcttgcacagg

SEQ ID NO: 7713466 - DNA, 22 bp, Homo sapiens
tgaggcaggatgcttgcacagg

SEQ ID NO: 7713467 - DNA, 23 bp, Homo sapiens
tgaggcaggcggatcacgaggtc

SEQ ID NO: 7713468 - DNA, 23 bp, Homo sapiens
tgaggcaggcggatcacgaggtc

SEQ ID NO: 7713469 - DNA, 23 bp, Homo sapiens
tgaggcaggcggatcacgaggtc

SEQ ID NO: 7713470 - DNA, 23 bp, Homo sapiens
tgaggcaggcggatcacgaggtc

SEQ ID NO: 7713471 - DNA, 23 bp, Homo sapiens
tgaggcaggcggatcacgaggtc

SEQ ID NO: 7713472 - DNA, 23 bp, Homo sapiens
tgaggcaggcggatcacgaggtc

SEQ ID NO: 7713473 - DNA, 23 bp, Homo sapiens
tgaggcaggcggatcacgaggtc

SEQ ID NO: 7713474 - DNA, 23 bp, Homo sapiens
tgaggcaggcggatcacgaggtc

SEQ ID NO: 7713475 - DNA, 20 bp, Homo sapiens
tgaggcaggagaatggcatg

SEQ ID NO: 7713476 - DNA, 20 bp, Homo sapiens
tgaggcaggagaatggcatg

SEQ ID NO: 7713477 - DNA, 20 bp, Homo sapiens
tgaggcaggagaatggcatg

SEQ ID NO: 7713478 - DNA, 20 bp, Homo sapiens
tgaggcaggagaatggcatg

SEQ ID NO: 7713479 - DNA, 20 bp, Homo sapiens
tgaggcaggagaatggcatg

SEQ ID NO: 7713480 - DNA, 22 bp, Homo sapiens
tgaggcaggagaatggcgggaa

SEQ ID NO: 7713481 - DNA, 22 bp, Homo sapiens
tgaggcaggagaatggcgggaa

SEQ ID NO: 7713482 - DNA, 20 bp, Homo sapiens
tgaggcaggagaatggcatg

SEQ ID NO: 7713483 - DNA, 22 bp, Homo sapiens
tgaggcaggagaatggcgggaa

SEQ ID NO: 7713484 - DNA, 22 bp, Homo sapiens
tgaggcaggagaatggcgggaa

SEQ ID NO: 7713485 - DNA, 22 bp, Homo sapiens
tgaggcaggagaatggcgggaa

SEQ ID NO: 7713486 - DNA, 20 bp, Homo sapiens
tgaggcaggagaatggcatg

SEQ ID NO: 7713487 - DNA, 22 bp, Homo sapiens
tgaggcaggagaatggcgggaa

SEQ ID NO: 7713488 - DNA, 22 bp, Homo sapiens
tgaggcaggagaatggcgggaa

SEQ ID NO: 7713489 - DNA, 22 bp, Homo sapiens
tgaggcaggagaatggcgggaa

SEQ ID NO: 7713490 - DNA, 22 bp, Homo sapiens
tgaggcaggaggattgcaggat

SEQ ID NO: 7713491 - DNA, 22 bp, Homo sapiens
tgaggcaggaggattgcaggat

SEQ ID NO: 7713492 - DNA, 22 bp, Homo sapiens
tgaggcaggagaatggcgggaa

SEQ ID NO: 7713493 - DNA, 22 bp, Homo sapiens
tgaggcaggagaatggcgggaa

SEQ ID NO: 7713494 - DNA, 22 bp, Homo sapiens
tgaggcaggaggattgcaggat

SEQ ID NO: 7713495 - DNA, 22 bp, Homo sapiens
tgaggcaggaggattgcaggat

SEQ ID NO: 7713496 - DNA, 22 bp, Homo sapiens
tgaggcaggaggattgcaggat

SEQ ID NO: 7713497 - DNA, 22 bp, Homo sapiens
tgaggcaggaggttgagaactg

SEQ ID NO: 7713498 - DNA, 22 bp, Homo sapiens
tgaggcaggaggttgagaactg

SEQ ID NO: 7713499 - DNA, 22 bp, Homo sapiens
tgaggcaggaggattgcaggat

SEQ ID NO: 7713500 - DNA, 22 bp, Homo sapiens
tgaggcaggaggattgcaggat

SEQ ID NO: 7713501 - DNA, 22 bp, Homo sapiens
tgaggcaggaggttgagaactg

SEQ ID NO: 7713502 - DNA, 22 bp, Homo sapiens
tgaggcaggagttaatgtgctc

SEQ ID NO: 7713503 - DNA, 22 bp, Homo sapiens
tgaggcaggagttaatgtgctc

SEQ ID NO: 7713504 - DNA, 22 bp, Homo sapiens
tgaggcaggagttaatgtgctc

SEQ ID NO: 7713505 - DNA, 22 bp, Homo sapiens
tgaggcaggaggttgagaactg

SEQ ID NO: 7713506 - DNA, 22 bp, Homo sapiens
tgaggcaggaggttgagaactg

SEQ ID NO: 7713507 - DNA, 22 bp, Homo sapiens
tgaggcaggaggttgagaactg

SEQ ID NO: 7713508 - DNA, 22 bp, Homo sapiens
tgaggcaggaggttgagaactg

SEQ ID NO: 7713509 - DNA, 22 bp, Homo sapiens
tgaggcctcttggtatggtgtg

SEQ ID NO: 7713510 - DNA, 22 bp, Homo sapiens
tgaggcctcttggtatggtgtg

SEQ ID NO: 7713511 - DNA, 22 bp, Homo sapiens
tgaggcctgaagcctgaagtga

SEQ ID NO: 7713512 - DNA, 22 bp, Homo sapiens
tgaggcctgaagcctgaagtga

SEQ ID NO: 7713513 - DNA, 22 bp, Homo sapiens
tgaggcctgaagcctgaagtga

SEQ ID NO: 7713514 - DNA, 22 bp, Homo sapiens
tgaggcctgaagcctggagcct

SEQ ID NO: 7713515 - DNA, 22 bp, Homo sapiens
tgaggcctgaagcctgaagtga

SEQ ID NO: 7713516 - DNA, 22 bp, Homo sapiens
tgaggcctcttggtatggtgtg

SEQ ID NO: 7713517 - DNA, 22 bp, Homo sapiens
tgaggcctctgtgccatccagg

SEQ ID NO: 7713518 - DNA, 22 bp, Homo sapiens
tgaggcctctgtgccatccagg

SEQ ID NO: 7713519 - DNA, 22 bp, Homo sapiens
tgaggcctctgtgccatccagg

SEQ ID NO: 7713520 - DNA, 18 bp, Homo sapiens
tgaggcctctgctgggcc

SEQ ID NO: 7713521 - DNA, 18 bp, Homo sapiens
tgaggcctctgctgggcc

SEQ ID NO: 7713522 - DNA, 18 bp, Homo sapiens
tgaggcctctgctgggcc

SEQ ID NO: 7713523 - DNA, 22 bp, Homo sapiens
tgaggcctctgtgccatccagg

SEQ ID NO: 7713524 - DNA, 18 bp, Homo sapiens
tgaggcctctgctgggcc

SEQ ID NO: 7713525 - DNA, 18 bp, Homo sapiens
tgaggcctctgctgggcc

SEQ ID NO: 7713526 - DNA, 18 bp, Homo sapiens
tgaggcctctgctgggcc

SEQ ID NO: 7713527 - DNA, 18 bp, Homo sapiens
tgaggcctctgctgggcc

SEQ ID NO: 7713528 - DNA, 22 bp, Homo sapiens
tgaggcctctgaggcctaggct

SEQ ID NO: 7713529 - DNA, 22 bp, Homo sapiens
tgaggcctctgaggcctaggct

SEQ ID NO: 7713530 - DNA, 21 bp, Homo sapiens
tgaggcctctcctgggctggc

SEQ ID NO: 7713531 - DNA, 21 bp, Homo sapiens
tgaggcctctcctgggctggc

SEQ ID NO: 7713532 - DNA, 22 bp, Homo sapiens
tgaggcctctgaggcctaggct

SEQ ID NO: 7713533 - DNA, 22 bp, Homo sapiens
tgaggcctctgaggcctaggct

SEQ ID NO: 7713534 - DNA, 22 bp, Homo sapiens
tgaggcctgacagaccaagcct

SEQ ID NO: 7713535 - DNA, 22 bp, Homo sapiens
tgaggcctgaagcctggagcct

SEQ ID NO: 7713536 - DNA, 22 bp, Homo sapiens
tgaggcctgaagcctggagcct

SEQ ID NO: 7713537 - DNA, 22 bp, Homo sapiens
tgaggcctgaagcctggagcct

SEQ ID NO: 7713538 - DNA, 22 bp, Homo sapiens
tgaggcctgaagcctggagcct

SEQ ID NO: 7713539 - DNA, 22 bp, Homo sapiens
tgaggcctgaagcctggagcct

SEQ ID NO: 7713540 - DNA, 22 bp, Homo sapiens
tgaggcctgaagcctggagcct

SEQ ID NO: 7713541 - DNA, 22 bp, Homo sapiens
tgaggcctgacagaccaagcct

SEQ ID NO: 7713542 - DNA, 22 bp, Homo sapiens
tgaggcctgacagaccaagcct

SEQ ID NO: 7713543 - DNA, 17 bp, Homo sapiens
tgaggcctgcatcagtg

SEQ ID NO: 7713544 - DNA, 17 bp, Homo sapiens
tgaggcctgcatcagtg

SEQ ID NO: 7713545 - DNA, 17 bp, Homo sapiens
tgaggcctgcatcagtg

SEQ ID NO: 7713546 - DNA, 22 bp, Homo sapiens
tgaggcctgcattgaactagaa

SEQ ID NO: 7713547 - DNA, 22 bp, Homo sapiens
tgaggcctgcattgaactagaa

SEQ ID NO: 7713548 - DNA, 17 bp, Homo sapiens
tgaggcctgcatcagtg

SEQ ID NO: 7713549 - DNA, 17 bp, Homo sapiens
tgaggcctgcatcagtg

SEQ ID NO: 7713550 - DNA, 22 bp, Homo sapiens
tgaggcctgcattgaactagaa

SEQ ID NO: 7713551 - DNA, 22 bp, Homo sapiens
tgaggcctgcattgaactagaa

SEQ ID NO: 7713552 - DNA, 22 bp, Homo sapiens
tgaggcctgcattgaactagaa

SEQ ID NO: 7713553 - DNA, 21 bp, Homo sapiens
tgaggcctgccagtctcagaa

SEQ ID NO: 7713554 - DNA, 21 bp, Homo sapiens
tgaggcctgccagtctcagaa

SEQ ID NO: 7713555 - DNA, 22 bp, Homo sapiens
tgaggcctcataatgagatttc

SEQ ID NO: 7713556 - DNA, 22 bp, Homo sapiens
tgaggcctcatttagggagagg

SEQ ID NO: 7713557 - DNA, 22 bp, Homo sapiens
tgaggcctcatttagggagagg

SEQ ID NO: 7713558 - DNA, 22 bp, Homo sapiens
tgaggcctcatttagggagagg

SEQ ID NO: 7713559 - DNA, 22 bp, Homo sapiens
tgaggcctcataatgagatttc

SEQ ID NO: 7713560 - DNA, 22 bp, Homo sapiens
tgaggcctacccccctgtgttt

SEQ ID NO: 7713561 - DNA, 22 bp, Homo sapiens
tgaggcctacccccctgtgttt

SEQ ID NO: 7713562 - DNA, 22 bp, Homo sapiens
tgaggcctagagaggttaataa

SEQ ID NO: 7713563 - DNA, 22 bp, Homo sapiens
tgaggcctcataatgagatttc

SEQ ID NO: 7713564 - DNA, 22 bp, Homo sapiens
tgaggcctcatttagggagagg

SEQ ID NO: 7713565 - DNA, 22 bp, Homo sapiens
tgaggcctcatttagggagagg

SEQ ID NO: 7713566 - DNA, 21 bp, Homo sapiens
tgaggcctctcctgggctggc

SEQ ID NO: 7713567 - DNA, 21 bp, Homo sapiens
tgaggcctctcctgggctggc

SEQ ID NO: 7713568 - DNA, 21 bp, Homo sapiens
tgaggcctctcctgggctggc

SEQ ID NO: 7713569 - DNA, 22 bp, Homo sapiens
tgaggccggaagaaagggggca

SEQ ID NO: 7713570 - DNA, 22 bp, Homo sapiens
tgaggccggagacaagagactt

SEQ ID NO: 7713571 - DNA, 22 bp, Homo sapiens
tgaggcctacccccctgtgttt

SEQ ID NO: 7713572 - DNA, 22 bp, Homo sapiens
tgaggccctctgggctggtcct

SEQ ID NO: 7713573 - DNA, 22 bp, Homo sapiens
tgaggccctctgggctggtcct

SEQ ID NO: 7713574 - DNA, 22 bp, Homo sapiens
tgaggccctctgggctggtcct

SEQ ID NO: 7713575 - DNA, 22 bp, Homo sapiens
tgaggccctagggcatgggaga

SEQ ID NO: 7713576 - DNA, 22 bp, Homo sapiens
tgaggccctagggcatgggaga

SEQ ID NO: 7713577 - DNA, 22 bp, Homo sapiens
tgaggccaggatcccaggctct

SEQ ID NO: 7713578 - DNA, 22 bp, Homo sapiens
tgaggccaggatcccaggctct

SEQ ID NO: 7713579 - DNA, 22 bp, Homo sapiens
tgaggccaggatcccaggctct

SEQ ID NO: 7713580 - DNA, 22 bp, Homo sapiens
tgaggccaggatcccaggctct

SEQ ID NO: 7713581 - DNA, 22 bp, Homo sapiens
tgaggccaggatcccaggctct

SEQ ID NO: 7713582 - DNA, 22 bp, Homo sapiens
tgaggccaggacccccagcagg

SEQ ID NO: 7713583 - DNA, 22 bp, Homo sapiens
tgaggccaggacccccagcagg

SEQ ID NO: 7713584 - DNA, 22 bp, Homo sapiens
tgaggccctagggcatgggaga

SEQ ID NO: 7713585 - DNA, 22 bp, Homo sapiens
tgaggccctagggcatgggaga

SEQ ID NO: 7713586 - DNA, 18 bp, Homo sapiens
tgaggcccgcagaggtgg

SEQ ID NO: 7713587 - DNA, 22 bp, Homo sapiens
tgaggcccgggtggaggaatgc

SEQ ID NO: 7713588 - DNA, 22 bp, Homo sapiens
tgaggccccgaagctgaggttt

SEQ ID NO: 7713589 - DNA, 22 bp, Homo sapiens
tgaggccaggatcccaggctct

SEQ ID NO: 7713590 - DNA, 18 bp, Homo sapiens
tgaggcccgcagaggtgg

SEQ ID NO: 7713591 - DNA, 18 bp, Homo sapiens
tgaggcccgcagaggtgg

SEQ ID NO: 7713592 - DNA, 18 bp, Homo sapiens
tgaggcccgcagaggtgg

SEQ ID NO: 7713593 - DNA, 22 bp, Homo sapiens
tgaggccaggacccccagcagg

SEQ ID NO: 7713594 - DNA, 22 bp, Homo sapiens
tgaggccaggacccccagcagg

SEQ ID NO: 7713595 - DNA, 22 bp, Homo sapiens
tgaggccaggacccccagcagg

SEQ ID NO: 7713596 - DNA, 22 bp, Homo sapiens
tgaggccagcttcagcagtgga

SEQ ID NO: 7713597 - DNA, 22 bp, Homo sapiens
tgaggccagcttcagcagtgga

SEQ ID NO: 7713598 - DNA, 22 bp, Homo sapiens
tgaggccagcttcagcagtgga

SEQ ID NO: 7713599 - DNA, 22 bp, Homo sapiens
tgaggccagcttcagcagtgga

SEQ ID NO: 7713600 - DNA, 22 bp, Homo sapiens
tgaggccagcttcagcagtgga

SEQ ID NO: 7713601 - DNA, 22 bp, Homo sapiens
tgaggccagcttcagcagtgga

SEQ ID NO: 7713602 - DNA, 22 bp, Homo sapiens
tgaggccagcttcagcagtgga

SEQ ID NO: 7713603 - DNA, 19 bp, Homo sapiens
tgaggccagctggcatttt

SEQ ID NO: 7713604 - DNA, 22 bp, Homo sapiens
tgaggccagcttcagcagtgga

SEQ ID NO: 7713605 - DNA, 19 bp, Homo sapiens
tgaggccagctggcatttt

SEQ ID NO: 7713606 - DNA, 19 bp, Homo sapiens
tgaggccagctggcatttt

SEQ ID NO: 7713607 - DNA, 19 bp, Homo sapiens
tgaggccagctggcatttt

SEQ ID NO: 7713608 - DNA, 16 bp, Homo sapiens
tgaggccagccatttc

SEQ ID NO: 7713609 - DNA, 19 bp, Homo sapiens
tgaggccagctggcatttt

SEQ ID NO: 7713610 - DNA, 19 bp, Homo sapiens
tgaggccagctggcatttt

SEQ ID NO: 7713611 - DNA, 18 bp, Homo sapiens
tgaggccagagtgggcat

SEQ ID NO: 7713612 - DNA, 22 bp, Homo sapiens
tgaggccagagtttttaattcc

SEQ ID NO: 7713613 - DNA, 22 bp, Homo sapiens
tgaggccagagtttttaattcc

SEQ ID NO: 7713614 - DNA, 22 bp, Homo sapiens
tgaggccagccacagccaccct

SEQ ID NO: 7713615 - DNA, 22 bp, Homo sapiens
tgaggccagccacagccaccct

SEQ ID NO: 7713616 - DNA, 22 bp, Homo sapiens
tgaggccagccacagccaccct

SEQ ID NO: 7713617 - DNA, 16 bp, Homo sapiens
tgaggccagccatttc

SEQ ID NO: 7713618 - DNA, 22 bp, Homo sapiens
tgaggccagccacagccaccct

SEQ ID NO: 7713619 - DNA, 22 bp, Homo sapiens
tgaggccagccacagccaccct

SEQ ID NO: 7713620 - DNA, 22 bp, Homo sapiens
tgaggccagccacagccaccct

SEQ ID NO: 7713621 - DNA, 18 bp, Homo sapiens
tgaggccagagtgggcat

SEQ ID NO: 7713622 - DNA, 18 bp, Homo sapiens
tgaggccagagtgggcat

SEQ ID NO: 7713623 - DNA, 18 bp, Homo sapiens
tgaggccagagtgggcat

SEQ ID NO: 7713624 - DNA, 18 bp, Homo sapiens
tgaggccagagtgggcat

SEQ ID NO: 7713625 - DNA, 22 bp, Homo sapiens
tgaggccagagagtttgcattt

SEQ ID NO: 7713626 - DNA, 18 bp, Homo sapiens
tgaggccagagtgggcat

SEQ ID NO: 7713627 - DNA, 22 bp, Homo sapiens
tgaggccagagagtttgcattt

SEQ ID NO: 7713628 - DNA, 18 bp, Homo sapiens
tgaggccagagtgggcat

SEQ ID NO: 7713629 - DNA, 18 bp, Homo sapiens
tgaggccagagtgggcat

SEQ ID NO: 7713630 - DNA, 22 bp, Homo sapiens
tgaggccacttccccacagccc

SEQ ID NO: 7713631 - DNA, 22 bp, Homo sapiens
tgaggccacttccccacagccc

SEQ ID NO: 7713632 - DNA, 22 bp, Homo sapiens
tgaggccacttccccacagccc

SEQ ID NO: 7713633 - DNA, 22 bp, Homo sapiens
tgaggccacaggaaagggcccg

SEQ ID NO: 7713634 - DNA, 22 bp, Homo sapiens
tgaggccacagtatcagaacag

SEQ ID NO: 7713635 - DNA, 22 bp, Homo sapiens
tgaggccacagtatcagaacag

SEQ ID NO: 7713636 - DNA, 22 bp, Homo sapiens
tgaggccacagtatcagaacag

SEQ ID NO: 7713637 - DNA, 22 bp, Homo sapiens
tgaggccacttccccacagccc

SEQ ID NO: 7713638 - DNA, 22 bp, Homo sapiens
tgaggccacttccccacagccc

SEQ ID NO: 7713639 - DNA, 22 bp, Homo sapiens
tgaggccacttccccacagccc

SEQ ID NO: 7713640 - DNA, 22 bp, Homo sapiens
tgaggccagagagtttgcattt

SEQ ID NO: 7713641 - DNA, 22 bp, Homo sapiens
tgaggccagagagtttgcattt

SEQ ID NO: 7713642 - DNA, 22 bp, Homo sapiens
tgaggccagactgaaaccaaca

SEQ ID NO: 7713643 - DNA, 22 bp, Homo sapiens
tgaggccacttccccacagccc

SEQ ID NO: 7713644 - DNA, 22 bp, Homo sapiens
tgaggccagactgaaaccaaca

SEQ ID NO: 7713645 - DNA, 22 bp, Homo sapiens
tgaggccaatgaccctgggcag

SEQ ID NO: 7713646 - DNA, 22 bp, Homo sapiens
tgaggccaatgaccctgggcag

SEQ ID NO: 7713647 - DNA, 21 bp, Homo sapiens
tgaggccaatagcccctggac

SEQ ID NO: 7713648 - DNA, 21 bp, Homo sapiens
tgaggccaatagcccctggac

SEQ ID NO: 7713649 - DNA, 21 bp, Homo sapiens
tgaggccaatagcccctggac

SEQ ID NO: 7713650 - DNA, 19 bp, Homo sapiens
tgaggccaaggtcacagat

SEQ ID NO: 7713651 - DNA, 19 bp, Homo sapiens
tgaggccaaggtcacagat

SEQ ID NO: 7713652 - DNA, 19 bp, Homo sapiens
tgaggccaaggtcacagat

SEQ ID NO: 7713653 - DNA, 21 bp, Homo sapiens
tgaggccaatagcccctggac

SEQ ID NO: 7713654 - DNA, 21 bp, Homo sapiens
tgaggccaatagcccctggac

SEQ ID NO: 7713655 - DNA, 19 bp, Homo sapiens
tgaggccaaggtcacagat

SEQ ID NO: 7713656 - DNA, 22 bp, Homo sapiens
tgaggccaatgaccctgggcag

SEQ ID NO: 7713657 - DNA, 22 bp, Homo sapiens
tgaggccacaggaaagggcccg

SEQ ID NO: 7713658 - DNA, 22 bp, Homo sapiens
tgaggccacaggaaagggcccg

SEQ ID NO: 7713659 - DNA, 22 bp, Homo sapiens
tgaggccacaggaaagggcccg

SEQ ID NO: 7713660 - DNA, 22 bp, Homo sapiens
tgaggccaatgaccctgggcag

SEQ ID NO: 7713661 - DNA, 21 bp, Homo sapiens
tgaggccaatagcccctggac

SEQ ID NO: 7713662 - DNA, 22 bp, Homo sapiens
tgaggccaatgaccctgggcag

SEQ ID NO: 7713663 - DNA, 23 bp, Homo sapiens
tgagacactcattcatggagtat

SEQ ID NO: 7713664 - DNA, 22 bp, Homo sapiens
tgagacaatatcctttgtaacc

SEQ ID NO: 7713665 - DNA, 22 bp, Homo sapiens
tgagacaatattaacctatctt

SEQ ID NO: 7713666 - DNA, 22 bp, Homo sapiens
tgagacaatatcctttgtaacc

SEQ ID NO: 7713667 - DNA, 22 bp, Homo sapiens
tgagacaataaggctgagaagc

SEQ ID NO: 7713668 - DNA, 22 bp, Homo sapiens
tgagacaataaggctgagaagc

SEQ ID NO: 7713669 - DNA, 22 bp, Homo sapiens
tgagacaataaggctgagaagc

SEQ ID NO: 7713670 - DNA, 22 bp, Homo sapiens
tgagacaaagcagctgacagaa

SEQ ID NO: 7713671 - DNA, 22 bp, Homo sapiens
tgagacaaagcagctgacagaa

SEQ ID NO: 7713672 - DNA, 22 bp, Homo sapiens
tgagacaaaattgacagacaaa

SEQ ID NO: 7713673 - DNA, 22 bp, Homo sapiens
tgagacaacagcttgtgctgct

SEQ ID NO: 7713674 - DNA, 22 bp, Homo sapiens
tgagacaacagcttgtgctgct

SEQ ID NO: 7713675 - DNA, 20 bp, Homo sapiens
tgagacaaggctggagagac

SEQ ID NO: 7713676 - DNA, 22 bp, Homo sapiens
tgagacaacctaattaaacacc

SEQ ID NO: 7713677 - DNA, 22 bp, Homo sapiens
tgagacaacattgggcaagtcc

SEQ ID NO: 7713678 - DNA, 22 bp, Homo sapiens
tgagacaacattgggcaagtcc

SEQ ID NO: 7713679 - DNA, 22 bp, Homo sapiens
tgagacaacctaattaaacacc

SEQ ID NO: 7713680 - DNA, 22 bp, Homo sapiens
tgagacaacctaattaaacacc

SEQ ID NO: 7713681 - DNA, 19 bp, Homo sapiens
tgagacagaagatgagcct

SEQ ID NO: 7713682 - DNA, 20 bp, Homo sapiens
tgagacaaggctggagagac

SEQ ID NO: 7713683 - DNA, 19 bp, Homo sapiens
tgagacagaagatgagcct

SEQ ID NO: 7713684 - DNA, 19 bp, Homo sapiens
tgagacagaagatgagcct

SEQ ID NO: 7713685 - DNA, 19 bp, Homo sapiens
tgagacagagaccagttct

SEQ ID NO: 7713686 - DNA, 19 bp, Homo sapiens
tgagacagaagatgagcct

SEQ ID NO: 7713687 - DNA, 22 bp, Homo sapiens
tgagacagcagattagcaatga

SEQ ID NO: 7713688 - DNA, 22 bp, Homo sapiens
tgagacagcagattagcaatga

SEQ ID NO: 7713689 - DNA, 19 bp, Homo sapiens
tgagacagagaccagttct

SEQ ID NO: 7713690 - DNA, 19 bp, Homo sapiens
tgagacagagaccagttct

SEQ ID NO: 7713691 - DNA, 22 bp, Homo sapiens
tgagacagcagattagcaatga

SEQ ID NO: 7713692 - DNA, 22 bp, Homo sapiens
tgagacagcagtcagggaaata

SEQ ID NO: 7713693 - DNA, 22 bp, Homo sapiens
tgagacagcagtcagggaaata

SEQ ID NO: 7713694 - DNA, 22 bp, Homo sapiens
tgagacagcagattagcaatga

SEQ ID NO: 7713695 - DNA, 22 bp, Homo sapiens
tgagacagcagattagcaatga

SEQ ID NO: 7713696 - DNA, 22 bp, Homo sapiens
tgagaattttttgtcatgcatt

SEQ ID NO: 7713697 - DNA, 22 bp, Homo sapiens
tgagaatttttggcagaaacaa

SEQ ID NO: 7713698 - DNA, 22 bp, Homo sapiens
tgagacaaaattgacagacaaa

SEQ ID NO: 7713699 - DNA, 22 bp, Homo sapiens
tgagacaaaattgacagacaaa

SEQ ID NO: 7713700 - DNA, 22 bp, Homo sapiens
tgagaattttttgtcatgcatt

SEQ ID NO: 7713701 - DNA, 22 bp, Homo sapiens
tgagaattttttgtcatgcatt

SEQ ID NO: 7713702 - DNA, 22 bp, Homo sapiens
tgagacaaaattgacagacaaa

SEQ ID NO: 7713703 - DNA, 22 bp, Homo sapiens
tgagaatttgcatttctaacaa

SEQ ID NO: 7713704 - DNA, 22 bp, Homo sapiens
tgagaatttgtgaacttttctc

SEQ ID NO: 7713705 - DNA, 22 bp, Homo sapiens
tgagaattttcagtttcacttt

SEQ ID NO: 7713706 - DNA, 22 bp, Homo sapiens
tgagaattttcagtttcacttt

SEQ ID NO: 7713707 - DNA, 21 bp, Homo sapiens
tgagaatttactctggagagt

SEQ ID NO: 7713708 - DNA, 22 bp, Homo sapiens
tgagaatttgcatttctaacaa

SEQ ID NO: 7713709 - DNA, 22 bp, Homo sapiens
tgagaatttgcatttctaacaa

SEQ ID NO: 7713710 - DNA, 22 bp, Homo sapiens
tgagaattacaaatgagtcaca

SEQ ID NO: 7713711 - DNA, 22 bp, Homo sapiens
tgagaattctacaatagatcaa

SEQ ID NO: 7713712 - DNA, 22 bp, Homo sapiens
tgagaattctacaatagatcaa

SEQ ID NO: 7713713 - DNA, 22 bp, Homo sapiens
tgagaattctacaatagatcaa

SEQ ID NO: 7713714 - DNA, 23 bp, Homo sapiens
tgagaagccgccgggcagcctgg

SEQ ID NO: 7713715 - DNA, 20 bp, Homo sapiens
tgagaagctcctgtctcctc

SEQ ID NO: 7713716 - DNA, 20 bp, Homo sapiens
tgagaagctcctgtctcctc

SEQ ID NO: 7713717 - DNA, 22 bp, Homo sapiens
tgagaagctctgaaacagtatc

SEQ ID NO: 7713718 - DNA, 22 bp, Homo sapiens
tgagaagctctgaaacagtatc

SEQ ID NO: 7713719 - DNA, 22 bp, Homo sapiens
tgagaagctgctgacttagcct

SEQ ID NO: 7713720 - DNA, 22 bp, Homo sapiens
tgagaagctctgaaacagtatc

SEQ ID NO: 7713721 - DNA, 22 bp, Homo sapiens
tgagaagctgctgacttagcct

SEQ ID NO: 7713722 - DNA, 22 bp, Homo sapiens
tgagaagctgcttgtgctgtat

SEQ ID NO: 7713723 - DNA, 22 bp, Homo sapiens
tgagaagctgcttgtgctgtat

SEQ ID NO: 7713724 - DNA, 22 bp, Homo sapiens
tgagaaggaaacaatggctttt

SEQ ID NO: 7713725 - DNA, 22 bp, Homo sapiens
tgagaatgccataagagctatt

SEQ ID NO: 7713726 - DNA, 22 bp, Homo sapiens
tgagaatgtgcaatatccttcc

SEQ ID NO: 7713727 - DNA, 22 bp, Homo sapiens
tgagaattacaaatgagtcaca

SEQ ID NO: 7713728 - DNA, 18 bp, Homo sapiens
tgagaatgtaagaaatgg

SEQ ID NO: 7713729 - DNA, 18 bp, Homo sapiens
tgagaatgtaagaaatgg

SEQ ID NO: 7713730 - DNA, 22 bp, Homo sapiens
tgagacagggtcttgctctgtt

SEQ ID NO: 7713731 - DNA, 17 bp, Homo sapiens
tgagacagggcaggccc

SEQ ID NO: 7713732 - DNA, 22 bp, Homo sapiens
tgagacagggtcttgctctgtt

SEQ ID NO: 7713733 - DNA, 22 bp, Homo sapiens
tgagacagggtcttgctctgtt

SEQ ID NO: 7713734 - DNA, 22 bp, Homo sapiens
tgagacagggtcttgctctgtt

SEQ ID NO: 7713735 - DNA, 22 bp, Homo sapiens
tgagacagggtcttgctctgtt

SEQ ID NO: 7713736 - DNA, 22 bp, Homo sapiens
tgagacagtaattgtatagttt

SEQ ID NO: 7713737 - DNA, 22 bp, Homo sapiens
tgagacagggtcttgctctgtt

SEQ ID NO: 7713738 - DNA, 22 bp, Homo sapiens
tgagacagggtcttgctctgtt

SEQ ID NO: 7713739 - DNA, 22 bp, Homo sapiens
tgagacagggtcttgctctgtt

SEQ ID NO: 7713740 - DNA, 17 bp, Homo sapiens
tgagacagggcaggccc

SEQ ID NO: 7713741 - DNA, 22 bp, Homo sapiens
tgagacagggtcttgctctgtt

SEQ ID NO: 7713742 - DNA, 17 bp, Homo sapiens
tgagacagggcaggccc

SEQ ID NO: 7713743 - DNA, 17 bp, Homo sapiens
tgagacagggcaggccc

SEQ ID NO: 7713744 - DNA, 17 bp, Homo sapiens
tgagacagggcaggccc

SEQ ID NO: 7713745 - DNA, 17 bp, Homo sapiens
tgagacagggcaggccc

SEQ ID NO: 7713746 - DNA, 17 bp, Homo sapiens
tgagacagggcaggccc

SEQ ID NO: 7713747 - DNA, 17 bp, Homo sapiens
tgagacagggcaggccc

SEQ ID NO: 7713748 - DNA, 22 bp, Homo sapiens
tgagacagtcaccaggcaggcc

SEQ ID NO: 7713749 - DNA, 22 bp, Homo sapiens
tgagacagtcaccaggcaggcc

SEQ ID NO: 7713750 - DNA, 22 bp, Homo sapiens
tgagacagtcccatgatctgca

SEQ ID NO: 7713751 - DNA, 22 bp, Homo sapiens
tgagacagtcccatgatctgca

SEQ ID NO: 7713752 - DNA, 22 bp, Homo sapiens
tgagacagtcccatgatctgca

SEQ ID NO: 7713753 - DNA, 22 bp, Homo sapiens
tgagacagttctgcagctgggt

SEQ ID NO: 7713754 - DNA, 22 bp, Homo sapiens
tgagacagtcccatgatctgca

SEQ ID NO: 7713755 - DNA, 22 bp, Homo sapiens
tgagacagtcccatgatctgca

SEQ ID NO: 7713756 - DNA, 22 bp, Homo sapiens
tgagacagtatcgccccaaggc

SEQ ID NO: 7713757 - DNA, 22 bp, Homo sapiens
tgagacagtatcgccccaaggc

SEQ ID NO: 7713758 - DNA, 22 bp, Homo sapiens
tgagacagtaattgtatagttt

SEQ ID NO: 7713759 - DNA, 22 bp, Homo sapiens
tgagacagtaattgtatagttt

SEQ ID NO: 7713760 - DNA, 22 bp, Homo sapiens
tgagacagtatcgccccaaggc

SEQ ID NO: 7713761 - DNA, 22 bp, Homo sapiens
tgagacagtcaccaggcaggcc

SEQ ID NO: 7713762 - DNA, 22 bp, Homo sapiens
tgagacagtcaccaggcaggcc

SEQ ID NO: 7713763 - DNA, 22 bp, Homo sapiens
tgagacagtcaccaggcaggcc

SEQ ID NO: 7713764 - DNA, 22 bp, Homo sapiens
tgagacagtatcgccccaaggc

SEQ ID NO: 7713765 - DNA, 19 bp, Homo sapiens
tgagacagggattcaggtg

SEQ ID NO: 7713766 - DNA, 19 bp, Homo sapiens
tgagacagggattcaggtg

SEQ ID NO: 7713767 - DNA, 19 bp, Homo sapiens
tgagacagggattcaggtg

SEQ ID NO: 7713768 - DNA, 19 bp, Homo sapiens
tgagacagggattcaggtg

SEQ ID NO: 7713769 - DNA, 17 bp, Homo sapiens
tgagacagggcaggccc

SEQ ID NO: 7713770 - DNA, 19 bp, Homo sapiens
tgagacagggattcaggtg

SEQ ID NO: 7713771 - DNA, 19 bp, Homo sapiens
tgagacagggattcaggtg

SEQ ID NO: 7713772 - DNA, 22 bp, Homo sapiens
tgagacaggcttccttcttggg

SEQ ID NO: 7713773 - DNA, 22 bp, Homo sapiens
tgagacaggcttccttcttggg

SEQ ID NO: 7713774 - DNA, 18 bp, Homo sapiens
tgagacagctaccacttg

SEQ ID NO: 7713775 - DNA, 18 bp, Homo sapiens
tgagacagctaccacttg

SEQ ID NO: 7713776 - DNA, 22 bp, Homo sapiens
tgagacagcctctgcactcatg

SEQ ID NO: 7713777 - DNA, 18 bp, Homo sapiens
tgagacagctaccacttg

SEQ ID NO: 7713778 - DNA, 18 bp, Homo sapiens
tgagacagctaccacttg

SEQ ID NO: 7713779 - DNA, 22 bp, Homo sapiens
tgagacaggagaggcccctcct

SEQ ID NO: 7713780 - DNA, 22 bp, Homo sapiens
tgagacaggagaggcccctcct

SEQ ID NO: 7713781 - DNA, 22 bp, Homo sapiens
tgagacaggagaggcccctcct

SEQ ID NO: 7713782 - DNA, 22 bp, Homo sapiens
tgagacaggagaggcccctcct

SEQ ID NO: 7713783 - DNA, 22 bp, Homo sapiens
tgagacaggcttccttcttggg

SEQ ID NO: 7713784 - DNA, 22 bp, Homo sapiens
tgagacaggcttccttcttggg

SEQ ID NO: 7713785 - DNA, 22 bp, Homo sapiens
tgagacaggagaggcccctcct

SEQ ID NO: 7713786 - DNA, 22 bp, Homo sapiens
tgagacaggcttccttcttggg

SEQ ID NO: 7713787 - DNA, 22 bp, Homo sapiens
tgagacagcccttctgcacagg

SEQ ID NO: 7713788 - DNA, 22 bp, Homo sapiens
tgagacagcagtcagggaaata

SEQ ID NO: 7713789 - DNA, 22 bp, Homo sapiens
tgagacagcagtcagggaaata

SEQ ID NO: 7713790 - DNA, 22 bp, Homo sapiens
tgagacagcccttctgcacagg

SEQ ID NO: 7713791 - DNA, 22 bp, Homo sapiens
tgagacagcccttctgcacagg

SEQ ID NO: 7713792 - DNA, 22 bp, Homo sapiens
tgagacagcagtcagggaaata

SEQ ID NO: 7713793 - DNA, 22 bp, Homo sapiens
tgagacagcccttctgcacagg

SEQ ID NO: 7713794 - DNA, 22 bp, Homo sapiens
tgagacagcccttctgcacagg

SEQ ID NO: 7713795 - DNA, 22 bp, Homo sapiens
tgagacagcccttctgcacagg

SEQ ID NO: 7713796 - DNA, 22 bp, Homo sapiens
tgagacagcctctgcactcatg

SEQ ID NO: 7713797 - DNA, 22 bp, Homo sapiens
tgagacagcccttctgcacagg

SEQ ID NO: 7713798 - DNA, 22 bp, Homo sapiens
tgagacagcctctgcactcatg

SEQ ID NO: 7713799 - DNA, 22 bp, Homo sapiens
tgagacagcctctgcactcatg

SEQ ID NO: 7713800 - DNA, 22 bp, Homo sapiens
tgagacagcctctgcactcatg

SEQ ID NO: 7713801 - DNA, 22 bp, Homo sapiens
tgagacagcccttctgcacagg

SEQ ID NO: 7713802 - DNA, 22 bp, Homo sapiens
tgagacagcctctgcactcatg

SEQ ID NO: 7713803 - DNA, 22 bp, Homo sapiens
tgagacagcctctgcactcatg

SEQ ID NO: 7713804 - DNA, 22 bp, Homo sapiens
tgagacagcctctgcactcatg

SEQ ID NO: 7713805 - DNA, 22 bp, Homo sapiens
tgagacagcctctgcactcatg

SEQ ID NO: 7713806 - DNA, 22 bp, Homo sapiens
tgagaaacatatgagagatttg

SEQ ID NO: 7713807 - DNA, 22 bp, Homo sapiens
tgagaaacacaggcatgaatag

SEQ ID NO: 7713808 - DNA, 22 bp, Homo sapiens
tgagaaacacaggcatgaatag

SEQ ID NO: 7713809 - DNA, 22 bp, Homo sapiens
tgagaaacacaggcatgaatag

SEQ ID NO: 7713810 - DNA, 22 bp, Homo sapiens
tgagaaacacaggcatgaatag

SEQ ID NO: 7713811 - DNA, 22 bp, Homo sapiens
tgagaaagacagacattcctaa

SEQ ID NO: 7713812 - DNA, 22 bp, Homo sapiens
tgagaaagacagacattcctaa

SEQ ID NO: 7713813 - DNA, 22 bp, Homo sapiens
tgagaaacttgccaagcatctc

SEQ ID NO: 7713814 - DNA, 18 bp, Homo sapiens
tgagaaactgacacatgg

SEQ ID NO: 7713815 - DNA, 18 bp, Homo sapiens
tgagaaactgacacatgg

SEQ ID NO: 7713816 - DNA, 22 bp, Homo sapiens
tgagaaagcctttagtcccagg

SEQ ID NO: 7713817 - DNA, 22 bp, Homo sapiens
tgagaaagcctttagtcccagg

SEQ ID NO: 7713818 - DNA, 22 bp, Homo sapiens
tgagaaagacagacattcctaa

SEQ ID NO: 7713819 - DNA, 22 bp, Homo sapiens
tgagaaaggtatttcatgcact

SEQ ID NO: 7713820 - DNA, 22 bp, Homo sapiens
tgagaaaggtatttcatgcact

SEQ ID NO: 7713821 - DNA, 22 bp, Homo sapiens
tgagaaaggtatttcatgcact

SEQ ID NO: 7713822 - DNA, 22 bp, Homo sapiens
tgagaaaatccagaggctagtt

SEQ ID NO: 7713823 - DNA, 22 bp, Homo sapiens
tgagaaaatccagaggctagtt

SEQ ID NO: 7713824 - DNA, 22 bp, Homo sapiens
tgagaaaattactataattgtc

SEQ ID NO: 7713825 - DNA, 22 bp, Homo sapiens
tgagaaaattactataattgtc

SEQ ID NO: 7713826 - DNA, 22 bp, Homo sapiens
tgagaaaattactataattgtc

SEQ ID NO: 7713827 - DNA, 22 bp, Homo sapiens
tgagaaaattactataattgtc

SEQ ID NO: 7713828 - DNA, 22 bp, Homo sapiens
tgagaaaattactataattgtc

SEQ ID NO: 7713829 - DNA, 22 bp, Homo sapiens
tgagaaaattactataattgtc

SEQ ID NO: 7713830 - DNA, 22 bp, Homo sapiens
tgagaaaagtgtggaggtcaat

SEQ ID NO: 7713831 - DNA, 22 bp, Homo sapiens
tgagaaaagtgtggaggtcaat

SEQ ID NO: 7713832 - DNA, 22 bp, Homo sapiens
tgagaaaagtgtggaggtcaat

SEQ ID NO: 7713833 - DNA, 22 bp, Homo sapiens
tgagaaaagtgtggaggtcaat

SEQ ID NO: 7713834 - DNA, 22 bp, Homo sapiens
tgactttaaaataacaagttta

SEQ ID NO: 7713835 - DNA, 22 bp, Homo sapiens
tgagaaaatccagaggctagtt

SEQ ID NO: 7713836 - DNA, 22 bp, Homo sapiens
tgagaaaatccagaggctagtt

SEQ ID NO: 7713837 - DNA, 22 bp, Homo sapiens
tgagaaaagtgtggaggtcaat

SEQ ID NO: 7713838 - DNA, 22 bp, Homo sapiens
tgagaaaatccagaggctagtt

SEQ ID NO: 7713839 - DNA, 22 bp, Homo sapiens
tgagaaaatccagaggctagtt

SEQ ID NO: 7713840 - DNA, 22 bp, Homo sapiens
tgagaaaatccagaggctagtt

SEQ ID NO: 7713841 - DNA, 22 bp, Homo sapiens
tgagaaaatccagaggctagtt

SEQ ID NO: 7713842 - DNA, 22 bp, Homo sapiens
tgagaaatgggtctgctgaaga

SEQ ID NO: 7713843 - DNA, 22 bp, Homo sapiens
tgagaaatgggtctgctgaaga

SEQ ID NO: 7713844 - DNA, 22 bp, Homo sapiens
tgagaaatggcagcattactgg

SEQ ID NO: 7713845 - DNA, 22 bp, Homo sapiens
tgagaaatccagatgtgcagtt

SEQ ID NO: 7713846 - DNA, 22 bp, Homo sapiens
tgagaaatggcagcattactgg

SEQ ID NO: 7713847 - DNA, 22 bp, Homo sapiens
tgagaaatggcagcattactgg

SEQ ID NO: 7713848 - DNA, 22 bp, Homo sapiens
tgagaaatggcagcattactgg

SEQ ID NO: 7713849 - DNA, 22 bp, Homo sapiens
tgagaaatggcagcattactgg

SEQ ID NO: 7713850 - DNA, 23 bp, Homo sapiens
tgagaaattttgattcagtagga

SEQ ID NO: 7713851 - DNA, 22 bp, Homo sapiens
tgagaaattcgacatatattta

SEQ ID NO: 7713852 - DNA, 19 bp, Homo sapiens
tgagaaattccacaggatg

SEQ ID NO: 7713853 - DNA, 19 bp, Homo sapiens
tgagaaattccacaggatg

SEQ ID NO: 7713854 - DNA, 19 bp, Homo sapiens
tgagaaattccacaggatg

SEQ ID NO: 7713855 - DNA, 20 bp, Homo sapiens
tgagaaagtagagactcagg

SEQ ID NO: 7713856 - DNA, 22 bp, Homo sapiens
tgagaaagtgggtgcctagcaa

SEQ ID NO: 7713857 - DNA, 22 bp, Homo sapiens
tgagaaagtgggtgcctagcaa

SEQ ID NO: 7713858 - DNA, 22 bp, Homo sapiens
tgagaaatattgcacagtgagg

SEQ ID NO: 7713859 - DNA, 22 bp, Homo sapiens
tgagaaatattgcacagtgagg

SEQ ID NO: 7713860 - DNA, 22 bp, Homo sapiens
tgagaaagtgggtgcctagcaa

SEQ ID NO: 7713861 - DNA, 22 bp, Homo sapiens
tgagaaatattgcacagtgagg

SEQ ID NO: 7713862 - DNA, 22 bp, Homo sapiens
tgagaaaggtatttcatgcact

SEQ ID NO: 7713863 - DNA, 22 bp, Homo sapiens
tgagaaaggtatttcatgcact

SEQ ID NO: 7713864 - DNA, 22 bp, Homo sapiens
tgagaaaggtatttcatgcact

SEQ ID NO: 7713865 - DNA, 20 bp, Homo sapiens
tgagaaagtagagactcagg

SEQ ID NO: 7713866 - DNA, 20 bp, Homo sapiens
tgagaaagtagagactcagg

SEQ ID NO: 7713867 - DNA, 20 bp, Homo sapiens
tgagaaagtagagactcagg

SEQ ID NO: 7713868 - DNA, 20 bp, Homo sapiens
tgagaaagtagagactcagg

SEQ ID NO: 7713869 - DNA, 20 bp, Homo sapiens
tgagaaagtagagactcagg

SEQ ID NO: 7713870 - DNA, 20 bp, Homo sapiens
tgagaaagtagagactcagg

SEQ ID NO: 7713871 - DNA, 22 bp, Homo sapiens
tgagaagcagtttcagtaagaa

SEQ ID NO: 7713872 - DNA, 22 bp, Homo sapiens
tgagaagcagcttacaggtgtc

SEQ ID NO: 7713873 - DNA, 22 bp, Homo sapiens
tgagaagcagcttacaggtgtc

SEQ ID NO: 7713874 - DNA, 22 bp, Homo sapiens
tgagaagcagcttacaggtgtc

SEQ ID NO: 7713875 - DNA, 22 bp, Homo sapiens
tgagaagcacagctcactcacg

SEQ ID NO: 7713876 - DNA, 22 bp, Homo sapiens
tgagaagcagcttacaggtgtc

SEQ ID NO: 7713877 - DNA, 22 bp, Homo sapiens
tgagaagatttgctcttctgag

SEQ ID NO: 7713878 - DNA, 22 bp, Homo sapiens
tgagaagatttgctcttctgag

SEQ ID NO: 7713879 - DNA, 22 bp, Homo sapiens
tgagaagatttgctcttctgag

SEQ ID NO: 7713880 - DNA, 22 bp, Homo sapiens
tgagaagatttgctcttctgag

SEQ ID NO: 7713881 - DNA, 22 bp, Homo sapiens
tgagaagatttgctcttctgag

SEQ ID NO: 7713882 - DNA, 22 bp, Homo sapiens
tgagaagattgggcagagtgga

SEQ ID NO: 7713883 - DNA, 22 bp, Homo sapiens
tgagaagattgggcagagtgga

SEQ ID NO: 7713884 - DNA, 22 bp, Homo sapiens
tgagaagattgggcagagtgga

SEQ ID NO: 7713885 - DNA, 22 bp, Homo sapiens
tgagaagattgggcagagtgga

SEQ ID NO: 7713886 - DNA, 22 bp, Homo sapiens
tgagaagattgggcagagtgga

SEQ ID NO: 7713887 - DNA, 22 bp, Homo sapiens
tgagaagattgggcagagtgga

SEQ ID NO: 7713888 - DNA, 22 bp, Homo sapiens
tgagaagattgggcagagtgga

SEQ ID NO: 7713889 - DNA, 22 bp, Homo sapiens
tgagaagattgggcagagtgga

SEQ ID NO: 7713890 - DNA, 22 bp, Homo sapiens
tgagaagagcaaggaactggtt

SEQ ID NO: 7713891 - DNA, 22 bp, Homo sapiens
tgagaagagcaaggaactggtt

SEQ ID NO: 7713892 - DNA, 23 bp, Homo sapiens
tgagaagccaggggagcgtgagg

SEQ ID NO: 7713893 - DNA, 23 bp, Homo sapiens
tgagaagccattagagcaggtgg

SEQ ID NO: 7713894 - DNA, 23 bp, Homo sapiens
tgagaagccattagagcaggtgg

SEQ ID NO: 7713895 - DNA, 22 bp, Homo sapiens
tgagaagcattaggaagaacat

SEQ ID NO: 7713896 - DNA, 22 bp, Homo sapiens
tgagaagcagtttcagtaagaa

SEQ ID NO: 7713897 - DNA, 22 bp, Homo sapiens
tgagaagcagcttacaggtgtc

SEQ ID NO: 7713898 - DNA, 23 bp, Homo sapiens
tgagaagccattagagcaggtgg

SEQ ID NO: 7713899 - DNA, 23 bp, Homo sapiens
tgagaagccattagagcaggtgg

SEQ ID NO: 7713900 - DNA, 22 bp, Homo sapiens
tgagaagcccaagccgggtggt

SEQ ID NO: 7713901 - DNA, 22 bp, Homo sapiens
tgagaagcccacactctttcct

SEQ ID NO: 7713902 - DNA, 23 bp, Homo sapiens
tgagaagccgccgggcagcctgg

SEQ ID NO: 7713903 - DNA, 22 bp, Homo sapiens
tgagaagcccacactctttcct

SEQ ID NO: 7713904 - DNA, 22 bp, Homo sapiens
tgagaacttgtgctattgcaca

SEQ ID NO: 7713905 - DNA, 22 bp, Homo sapiens
tgagaacttgtgctattgcaca

SEQ ID NO: 7713906 - DNA, 22 bp, Homo sapiens
tgagaactggtttctattcatg

SEQ ID NO: 7713907 - DNA, 22 bp, Homo sapiens
tgagaactggtagcacttgtga

SEQ ID NO: 7713908 - DNA, 22 bp, Homo sapiens
tgagaactggtagcacttgtga

SEQ ID NO: 7713909 - DNA, 22 bp, Homo sapiens
tgagaactgaggatttgaattc

SEQ ID NO: 7713910 - DNA, 22 bp, Homo sapiens
tgagaaccaagaccaagggcct

SEQ ID NO: 7713911 - DNA, 22 bp, Homo sapiens
tgagaaccaagaccaagggcct

SEQ ID NO: 7713912 - DNA, 22 bp, Homo sapiens
tgagaaccacctggaggtgact

SEQ ID NO: 7713913 - DNA, 22 bp, Homo sapiens
tgagaaccacctggaggtgact

SEQ ID NO: 7713914 - DNA, 22 bp, Homo sapiens
tgagaaccatgaaaagctgtca

SEQ ID NO: 7713915 - DNA, 22 bp, Homo sapiens
tgagaaccacgactgtgcttaa

SEQ ID NO: 7713916 - DNA, 22 bp, Homo sapiens
tgagaaccacgactgtgcttaa

SEQ ID NO: 7713917 - DNA, 22 bp, Homo sapiens
tgagaaccatgaaaagctgtca

SEQ ID NO: 7713918 - DNA, 22 bp, Homo sapiens
tgagaaccatgaaaagctgtca

SEQ ID NO: 7713919 - DNA, 18 bp, Homo sapiens
tgagaactaggcattgca

SEQ ID NO: 7713920 - DNA, 22 bp, Homo sapiens
tgagaacctcgaagattttgcc

SEQ ID NO: 7713921 - DNA, 22 bp, Homo sapiens
tgagaacggatactaagggctg

SEQ ID NO: 7713922 - DNA, 22 bp, Homo sapiens
tgagaacggatactaagggctg

SEQ ID NO: 7713923 - DNA, 22 bp, Homo sapiens
tgagaaccatgaaaagctgtca

SEQ ID NO: 7713924 - DNA, 18 bp, Homo sapiens
tgagaaccatgttcattc

SEQ ID NO: 7713925 - DNA, 18 bp, Homo sapiens
tgagaaccatgttcattc

SEQ ID NO: 7713926 - DNA, 22 bp, Homo sapiens
tgagaacagttggaagcagtca

SEQ ID NO: 7713927 - DNA, 22 bp, Homo sapiens
tgagaacagttggaagcagtca

SEQ ID NO: 7713928 - DNA, 22 bp, Homo sapiens
tgagaacatacaaacagagaaa

SEQ ID NO: 7713929 - DNA, 23 bp, Homo sapiens
tgagaaattttgattcagtagga

SEQ ID NO: 7713930 - DNA, 22 bp, Homo sapiens
tgagaacaaagttgaaagtttg

SEQ ID NO: 7713931 - DNA, 22 bp, Homo sapiens
tgagaacaaagttgaaagtttg

SEQ ID NO: 7713932 - DNA, 23 bp, Homo sapiens
tgagaaattttgattcagtagga

SEQ ID NO: 7713933 - DNA, 23 bp, Homo sapiens
tgagaaattttgattcagtagga

SEQ ID NO: 7713934 - DNA, 22 bp, Homo sapiens
tgagaacattgggaaagctatg

SEQ ID NO: 7713935 - DNA, 22 bp, Homo sapiens
tgagaacagttggaagcagtca

SEQ ID NO: 7713936 - DNA, 22 bp, Homo sapiens
tgagaacatttgcagggagagt

SEQ ID NO: 7713937 - DNA, 22 bp, Homo sapiens
tgagatgggtcatcaggtttgg

SEQ ID NO: 7713938 - DNA, 22 bp, Homo sapiens
tgagatgggtggggagctcagg

SEQ ID NO: 7713939 - DNA, 22 bp, Homo sapiens
tgagatgggtggggagctcagg

SEQ ID NO: 7713940 - DNA, 22 bp, Homo sapiens
tgagatggggtcatgctttgtc

SEQ ID NO: 7713941 - DNA, 22 bp, Homo sapiens
tgagatggcaacaccagctttg

SEQ ID NO: 7713942 - DNA, 22 bp, Homo sapiens
tgagatggggagggctgcagaa

SEQ ID NO: 7713943 - DNA, 22 bp, Homo sapiens
tgagatggggagggctgcagaa

SEQ ID NO: 7713944 - DNA, 22 bp, Homo sapiens
tgagatggggagggctgcagaa

SEQ ID NO: 7713945 - DNA, 22 bp, Homo sapiens
tgagatgggatgtgcacttggc

SEQ ID NO: 7713946 - DNA, 22 bp, Homo sapiens
tgagatgggatgtgcacttggc

SEQ ID NO: 7713947 - DNA, 22 bp, Homo sapiens
tgagatggctgggccccaggag

SEQ ID NO: 7713948 - DNA, 22 bp, Homo sapiens
tgagatggcaacaccagctttg

SEQ ID NO: 7713949 - DNA, 22 bp, Homo sapiens
tgagatggctgggccccaggag

SEQ ID NO: 7713950 - DNA, 22 bp, Homo sapiens
tgagatgggtgtccagggagga

SEQ ID NO: 7713951 - DNA, 22 bp, Homo sapiens
tgagatgggtgtccagggagga

SEQ ID NO: 7713952 - DNA, 22 bp, Homo sapiens
tgagatgggtgtccagggagga

SEQ ID NO: 7713953 - DNA, 22 bp, Homo sapiens
tgagatggtgaagaagacagca

SEQ ID NO: 7713954 - DNA, 22 bp, Homo sapiens
tgagatgggtgtccagggagga

SEQ ID NO: 7713955 - DNA, 22 bp, Homo sapiens
tgagatggttcacagagaaggc

SEQ ID NO: 7713956 - DNA, 22 bp, Homo sapiens
tgagatggttcacagagaaggc

SEQ ID NO: 7713957 - DNA, 22 bp, Homo sapiens
tgagatggttcacagagaaggc

SEQ ID NO: 7713958 - DNA, 22 bp, Homo sapiens
tgagatggttcacagagaaggc

SEQ ID NO: 7713959 - DNA, 22 bp, Homo sapiens
tgagatgtaaggtatgcttact

SEQ ID NO: 7713960 - DNA, 22 bp, Homo sapiens
tgagatggttcacagagaaggc

SEQ ID NO: 7713961 - DNA, 22 bp, Homo sapiens
tgagatggttgaccagagagca

SEQ ID NO: 7713962 - DNA, 22 bp, Homo sapiens
tgagattttcctaaatataatg

SEQ ID NO: 7713963 - DNA, 22 bp, Homo sapiens
tgagattttcctaaatataatg

SEQ ID NO: 7713964 - DNA, 22 bp, Homo sapiens
tgagattttcctaaatataatg

SEQ ID NO: 7713965 - DNA, 22 bp, Homo sapiens
tgagattttcagcatcacttca

SEQ ID NO: 7713966 - DNA, 22 bp, Homo sapiens
tgagattttcagcatcacttca

SEQ ID NO: 7713967 - DNA, 21 bp, Homo sapiens
tgagcaaaatttagagtgatg

SEQ ID NO: 7713968 - DNA, 21 bp, Homo sapiens
tgagcaaaatttagagtgatg

SEQ ID NO: 7713969 - DNA, 22 bp, Homo sapiens
tgagcaaaagttgatggtgctt

SEQ ID NO: 7713970 - DNA, 22 bp, Homo sapiens
tgagcaaaagttgatggtgctt

SEQ ID NO: 7713971 - DNA, 21 bp, Homo sapiens
tgagcaaaatttagagtgatg

SEQ ID NO: 7713972 - DNA, 20 bp, Homo sapiens
tgagatttgtattataagtc

SEQ ID NO: 7713973 - DNA, 20 bp, Homo sapiens
tgagatttgtattataagtc

SEQ ID NO: 7713974 - DNA, 22 bp, Homo sapiens
tgagatttgttttataaaatag

SEQ ID NO: 7713975 - DNA, 22 bp, Homo sapiens
tgagattttaatattgagaaaa

SEQ ID NO: 7713976 - DNA, 22 bp, Homo sapiens
tgagattttcagcatcacttca

SEQ ID NO: 7713977 - DNA, 22 bp, Homo sapiens
tgagatttgttttataaaatag

SEQ ID NO: 7713978 - DNA, 22 bp, Homo sapiens
tgagatttgttttataaaatag

SEQ ID NO: 7713979 - DNA, 22 bp, Homo sapiens
tgagatttggaaaatttgatat

SEQ ID NO: 7713980 - DNA, 22 bp, Homo sapiens
tgagatttgggttgtttaacat

SEQ ID NO: 7713981 - DNA, 22 bp, Homo sapiens
tgagatttgagggttaatctga

SEQ ID NO: 7713982 - DNA, 22 bp, Homo sapiens
tgagatttggaaaatttgatat

SEQ ID NO: 7713983 - DNA, 19 bp, Homo sapiens
tgagatttcttaggtgatt

SEQ ID NO: 7713984 - DNA, 22 bp, Homo sapiens
tgagatttgagggttaatctga

SEQ ID NO: 7713985 - DNA, 19 bp, Homo sapiens
tgagatttcttaggtgatt

SEQ ID NO: 7713986 - DNA, 22 bp, Homo sapiens
tgagatttcgccgacagtattt

SEQ ID NO: 7713987 - DNA, 22 bp, Homo sapiens
tgagattcagttgattagtgat

SEQ ID NO: 7713988 - DNA, 22 bp, Homo sapiens
tgagatgtaaggtatgcttact

SEQ ID NO: 7713989 - DNA, 22 bp, Homo sapiens
tgagatgtaaggtatgcttact

SEQ ID NO: 7713990 - DNA, 22 bp, Homo sapiens
tgagatgtcatagttcagttca

SEQ ID NO: 7713991 - DNA, 22 bp, Homo sapiens
tgagatttcgccgacagtattt

SEQ ID NO: 7713992 - DNA, 22 bp, Homo sapiens
tgagatttcaggccaaggagtg

SEQ ID NO: 7713993 - DNA, 22 bp, Homo sapiens
tgagattctgtatttctgacag

SEQ ID NO: 7713994 - DNA, 22 bp, Homo sapiens
tgagatggagttctgctcttgt

SEQ ID NO: 7713995 - DNA, 22 bp, Homo sapiens
tgagatggagtcttgctctgtt

SEQ ID NO: 7713996 - DNA, 22 bp, Homo sapiens
tgagatggagttctgctcttgt

SEQ ID NO: 7713997 - DNA, 22 bp, Homo sapiens
tgagatggagtcttgctctgtt

SEQ ID NO: 7713998 - DNA, 22 bp, Homo sapiens
tgagatggagtcttgctctgtt

SEQ ID NO: 7713999 - DNA, 22 bp, Homo sapiens
tgagatggagtctcgctctgtt

SEQ ID NO: 7714000 - DNA, 22 bp, Homo sapiens
tgagatggaaggtgaggcagta

SEQ ID NO: 7714001 - DNA, 17 bp, Homo sapiens
tgagatggaagaagact

SEQ ID NO: 7714002 - DNA, 17 bp, Homo sapiens
tgagatggaagaagact

SEQ ID NO: 7714003 - DNA, 22 bp, Homo sapiens
tgagatgctgggaacaaggaag

SEQ ID NO: 7714004 - DNA, 22 bp, Homo sapiens
tgagatggaaggtgaggcagta

SEQ ID NO: 7714005 - DNA, 22 bp, Homo sapiens
tgagatggaaggtgaggcagta

SEQ ID NO: 7714006 - DNA, 22 bp, Homo sapiens
tgagatggagccactgcactct

SEQ ID NO: 7714007 - DNA, 22 bp, Homo sapiens
tgagatggagccactgcactct

SEQ ID NO: 7714008 - DNA, 22 bp, Homo sapiens
tgagatggagccactgcactct

SEQ ID NO: 7714009 - DNA, 22 bp, Homo sapiens
tgagatgctgctgtaacaaata

SEQ ID NO: 7714010 - DNA, 22 bp, Homo sapiens
tgagatgctgctgtaacaaata

SEQ ID NO: 7714011 - DNA, 22 bp, Homo sapiens
tgagatgctaaagggctgctca

SEQ ID NO: 7714012 - DNA, 19 bp, Homo sapiens
tgagatgccttccagccct

SEQ ID NO: 7714013 - DNA, 22 bp, Homo sapiens
tgagatgatgggataagagggc

SEQ ID NO: 7714014 - DNA, 22 bp, Homo sapiens
tgagatgaataactcctgctaa

SEQ ID NO: 7714015 - DNA, 22 bp, Homo sapiens
tgagatgaataactcctgctaa

SEQ ID NO: 7714016 - DNA, 22 bp, Homo sapiens
tgagatgaataactcctgctaa

SEQ ID NO: 7714017 - DNA, 22 bp, Homo sapiens
tgagatgaataactcctgctaa

SEQ ID NO: 7714018 - DNA, 22 bp, Homo sapiens
tgagatgaataactcctgctaa

SEQ ID NO: 7714019 - DNA, 22 bp, Homo sapiens
tgagatgaataactcctgctaa

SEQ ID NO: 7714020 - DNA, 22 bp, Homo sapiens
tgagatgaataactcctgctaa

SEQ ID NO: 7714021 - DNA, 22 bp, Homo sapiens
tgagatgaataactcctgctaa

SEQ ID NO: 7714022 - DNA, 22 bp, Homo sapiens
tgagatgaataactcctgctaa

SEQ ID NO: 7714023 - DNA, 22 bp, Homo sapiens
tgagatgatgggataagagggc

SEQ ID NO: 7714024 - DNA, 22 bp, Homo sapiens
tgagatacagcttgtgacttgg

SEQ ID NO: 7714025 - DNA, 22 bp, Homo sapiens
tgagatactgaaaatagctaac

SEQ ID NO: 7714026 - DNA, 22 bp, Homo sapiens
tgagataatcatgtgatttcat

SEQ ID NO: 7714027 - DNA, 22 bp, Homo sapiens
tgagataatacttcttagctgg

SEQ ID NO: 7714028 - DNA, 22 bp, Homo sapiens
tgagataatacttcttagctgg

SEQ ID NO: 7714029 - DNA, 22 bp, Homo sapiens
tgagaggtcaaagggcatggag

SEQ ID NO: 7714030 - DNA, 22 bp, Homo sapiens
tgagaggtcaaagggcatggag

SEQ ID NO: 7714031 - DNA, 22 bp, Homo sapiens
tgagaggtcaaagggcatggag

SEQ ID NO: 7714032 - DNA, 22 bp, Homo sapiens
tgagaggtcaaagggcatggag

SEQ ID NO: 7714033 - DNA, 22 bp, Homo sapiens
tgagatcaaaattggtattaga

SEQ ID NO: 7714034 - DNA, 22 bp, Homo sapiens
tgagatcacttacgtggctgca

SEQ ID NO: 7714035 - DNA, 22 bp, Homo sapiens
tgagatcattgacttgttcctg

SEQ ID NO: 7714036 - DNA, 22 bp, Homo sapiens
tgagatcattgacttgttcctg

SEQ ID NO: 7714037 - DNA, 23 bp, Homo sapiens
tgagataggtattattatcatgc

SEQ ID NO: 7714038 - DNA, 23 bp, Homo sapiens
tgagataggtattattatcatgc

SEQ ID NO: 7714039 - DNA, 22 bp, Homo sapiens
tgagatagtatgtagcacctga

SEQ ID NO: 7714040 - DNA, 22 bp, Homo sapiens
tgagatagtatatggaaagagt

SEQ ID NO: 7714041 - DNA, 22 bp, Homo sapiens
tgagatagtatgtagcacctga

SEQ ID NO: 7714042 - DNA, 22 bp, Homo sapiens
tgagatcttcgctcttcacaga

SEQ ID NO: 7714043 - DNA, 22 bp, Homo sapiens
tgagatgaaagcagaaagactt

SEQ ID NO: 7714044 - DNA, 22 bp, Homo sapiens
tgagatcatttatttacctttc

SEQ ID NO: 7714045 - DNA, 22 bp, Homo sapiens
tgagatcattgacttgttcctg

SEQ ID NO: 7714046 - DNA, 22 bp, Homo sapiens
tgagatcatttatttacctttc

SEQ ID NO: 7714047 - DNA, 22 bp, Homo sapiens
tgagatcattgacttgttcctg

SEQ ID NO: 7714048 - DNA, 22 bp, Homo sapiens
tgagatcattgacttgttcctg

SEQ ID NO: 7714049 - DNA, 22 bp, Homo sapiens
tgagatcattgacttgttcctg

SEQ ID NO: 7714050 - DNA, 23 bp, Homo sapiens
tgagatctacagatctcagatct

SEQ ID NO: 7714051 - DNA, 23 bp, Homo sapiens
tgagatcgcccagctggtaggca

SEQ ID NO: 7714052 - DNA, 22 bp, Homo sapiens
tgagatccccaggaaggacaac

SEQ ID NO: 7714053 - DNA, 18 bp, Homo sapiens
tgagagaatgttcatgct

SEQ ID NO: 7714054 - DNA, 18 bp, Homo sapiens
tgagagaatgttcatgct

SEQ ID NO: 7714055 - DNA, 22 bp, Homo sapiens
tgagagacacactgtgcatgta

SEQ ID NO: 7714056 - DNA, 18 bp, Homo sapiens
tgagagaatgttcatgct

SEQ ID NO: 7714057 - DNA, 22 bp, Homo sapiens
tgagagacacactgtgcatgta

SEQ ID NO: 7714058 - DNA, 22 bp, Homo sapiens
tgagagaaacgttccttacatc

SEQ ID NO: 7714059 - DNA, 22 bp, Homo sapiens
tgagacagttctgcagctgggt

SEQ ID NO: 7714060 - DNA, 22 bp, Homo sapiens
tgagacagttctgcagctgggt

SEQ ID NO: 7714061 - DNA, 22 bp, Homo sapiens
tgagacagttctgcagctgggt

SEQ ID NO: 7714062 - DNA, 22 bp, Homo sapiens
tgagacttgtgagtccttctag

SEQ ID NO: 7714063 - DNA, 22 bp, Homo sapiens
tgagagagcctgaatctcttac

SEQ ID NO: 7714064 - DNA, 22 bp, Homo sapiens
tgagagagcgcctgggatcatt

SEQ ID NO: 7714065 - DNA, 22 bp, Homo sapiens
tgagagagcgcctgggatcatt

SEQ ID NO: 7714066 - DNA, 22 bp, Homo sapiens
tgagagagcgcctgggatcatt

SEQ ID NO: 7714067 - DNA, 22 bp, Homo sapiens
tgagagagcgcctgggatcatt

SEQ ID NO: 7714068 - DNA, 22 bp, Homo sapiens
tgagagagcgcctgggatcatt

SEQ ID NO: 7714069 - DNA, 22 bp, Homo sapiens
tgagagagcctgaatctcttac

SEQ ID NO: 7714070 - DNA, 22 bp, Homo sapiens
tgagagagcctgaatctcttac

SEQ ID NO: 7714071 - DNA, 22 bp, Homo sapiens
tgagagagcctgaatctcttac

SEQ ID NO: 7714072 - DNA, 22 bp, Homo sapiens
tgagagagcctgaatctcttac

SEQ ID NO: 7714073 - DNA, 21 bp, Homo sapiens
tgagagactggtggatacagg

SEQ ID NO: 7714074 - DNA, 22 bp, Homo sapiens
tgagagagcgcctgggatcatt

SEQ ID NO: 7714075 - DNA, 22 bp, Homo sapiens
tgagagaggatgccctcatatt

SEQ ID NO: 7714076 - DNA, 22 bp, Homo sapiens
tgagagaggatgccctcatatt

SEQ ID NO: 7714077 - DNA, 22 bp, Homo sapiens
tgagagaggggactgcctgctt

SEQ ID NO: 7714078 - DNA, 22 bp, Homo sapiens
tgagagaggggactgcctgctt

SEQ ID NO: 7714079 - DNA, 22 bp, Homo sapiens
tgagagaggggactgcctgctt

SEQ ID NO: 7714080 - DNA, 22 bp, Homo sapiens
tgagagagggatgcaccctcct

SEQ ID NO: 7714081 - DNA, 21 bp, Homo sapiens
tgagagagtagcaggacatat

SEQ ID NO: 7714082 - DNA, 22 bp, Homo sapiens
tgagagagtaattgagtggtaa

SEQ ID NO: 7714083 - DNA, 22 bp, Homo sapiens
tgagagagtaattgagtggtaa

SEQ ID NO: 7714084 - DNA, 22 bp, Homo sapiens
tgagagagtaattgagtggtaa

SEQ ID NO: 7714085 - DNA, 22 bp, Homo sapiens
tgagagagtaattgagtggtaa

SEQ ID NO: 7714086 - DNA, 22 bp, Homo sapiens
tgagagagtaattgagtggtaa

SEQ ID NO: 7714087 - DNA, 22 bp, Homo sapiens
tgagagagtaattgagtggtaa

SEQ ID NO: 7714088 - DNA, 22 bp, Homo sapiens
tgagagagtaattgagtggtaa

SEQ ID NO: 7714089 - DNA, 22 bp, Homo sapiens
tgagagaggggactgcctgctt

SEQ ID NO: 7714090 - DNA, 22 bp, Homo sapiens
tgagagatgaactctgatatgt

SEQ ID NO: 7714091 - DNA, 21 bp, Homo sapiens
tgagagagtagcaggacatat

SEQ ID NO: 7714092 - DNA, 21 bp, Homo sapiens
tgagagagtagcaggacatat

SEQ ID NO: 7714093 - DNA, 21 bp, Homo sapiens
tgagagagtagcaggacatat

SEQ ID NO: 7714094 - DNA, 21 bp, Homo sapiens
tgagagagtagcaggacatat

SEQ ID NO: 7714095 - DNA, 21 bp, Homo sapiens
tgagagagtagcaggacatat

SEQ ID NO: 7714096 - DNA, 21 bp, Homo sapiens
tgagagagtagcaggacatat

SEQ ID NO: 7714097 - DNA, 21 bp, Homo sapiens
tgagagagtagcaggacatat

SEQ ID NO: 7714098 - DNA, 21 bp, Homo sapiens
tgagagagtagcaggacatat

SEQ ID NO: 7714099 - DNA, 22 bp, Homo sapiens
tgagagattttcatgagtgctt

SEQ ID NO: 7714100 - DNA, 22 bp, Homo sapiens
tgagagattgctgtatgttttg

SEQ ID NO: 7714101 - DNA, 22 bp, Homo sapiens
tgagagatgaagttagttgttc

SEQ ID NO: 7714102 - DNA, 22 bp, Homo sapiens
tgagagatgaagttagttgttc

SEQ ID NO: 7714103 - DNA, 22 bp, Homo sapiens
tgagagattgctgtatgttttg

SEQ ID NO: 7714104 - DNA, 22 bp, Homo sapiens
tgagagatgaagttagttgttc

SEQ ID NO: 7714105 - DNA, 22 bp, Homo sapiens
tgagagatgaactctgatatgt

SEQ ID NO: 7714106 - DNA, 22 bp, Homo sapiens
tgagagatgaagttagttgttc

SEQ ID NO: 7714107 - DNA, 23 bp, Homo sapiens
tgagagcctggcagcctgggttc

SEQ ID NO: 7714108 - DNA, 18 bp, Homo sapiens
tgagagcctgcttgtccc

SEQ ID NO: 7714109 - DNA, 22 bp, Homo sapiens
tgagagccagaagggcctgagg

SEQ ID NO: 7714110 - DNA, 22 bp, Homo sapiens
tgagagccaggatctgctctat

SEQ ID NO: 7714111 - DNA, 22 bp, Homo sapiens
tgagagccaggatctgctctat

SEQ ID NO: 7714112 - DNA, 22 bp, Homo sapiens
tgagagcctagtaggtggaaaa

SEQ ID NO: 7714113 - DNA, 22 bp, Homo sapiens
tgagagcagaggtgggcagcct

SEQ ID NO: 7714114 - DNA, 17 bp, Homo sapiens
tgagagcagggctgggc

SEQ ID NO: 7714115 - DNA, 17 bp, Homo sapiens
tgagagcagggctgggc

SEQ ID NO: 7714116 - DNA, 22 bp, Homo sapiens
tgagagcacagtgtggtctgga

SEQ ID NO: 7714117 - DNA, 17 bp, Homo sapiens
tgagagcagggctgggc

SEQ ID NO: 7714118 - DNA, 17 bp, Homo sapiens
tgagagcagggctgggc

SEQ ID NO: 7714119 - DNA, 22 bp, Homo sapiens
tgagagccagaagggcctgagg

SEQ ID NO: 7714120 - DNA, 22 bp, Homo sapiens
tgagagggcccagagcacacca

SEQ ID NO: 7714121 - DNA, 22 bp, Homo sapiens
tgagagggcccagagcacacca

SEQ ID NO: 7714122 - DNA, 19 bp, Homo sapiens
tgagaggcttaaggcagct

SEQ ID NO: 7714123 - DNA, 19 bp, Homo sapiens
tgagaggcttaaggcagct

SEQ ID NO: 7714124 - DNA, 19 bp, Homo sapiens
tgagaggcttaaggcagct

SEQ ID NO: 7714125 - DNA, 19 bp, Homo sapiens
tgagaggcttaaggcagct

SEQ ID NO: 7714126 - DNA, 19 bp, Homo sapiens
tgagaggcttaaggcagct

SEQ ID NO: 7714127 - DNA, 18 bp, Homo sapiens
tgagaggctattttttgc

SEQ ID NO: 7714128 - DNA, 22 bp, Homo sapiens
tgagagggttcccaggggtttc

SEQ ID NO: 7714129 - DNA, 22 bp, Homo sapiens
tgagagggttcccaggggtttc

SEQ ID NO: 7714130 - DNA, 22 bp, Homo sapiens
tgagaggtaggaaatgaacaag

SEQ ID NO: 7714131 - DNA, 22 bp, Homo sapiens
tgagaggtaggaaatgaacaag

SEQ ID NO: 7714132 - DNA, 22 bp, Homo sapiens
tgagagggcccagagcacacca

SEQ ID NO: 7714133 - DNA, 22 bp, Homo sapiens
tgagagggttcccaggggtttc

SEQ ID NO: 7714134 - DNA, 22 bp, Homo sapiens
tgagagggttcccaggggtttc

SEQ ID NO: 7714135 - DNA, 22 bp, Homo sapiens
tgagagggcccagagcacacca

SEQ ID NO: 7714136 - DNA, 22 bp, Homo sapiens
tgagagggcccagagcacacca

SEQ ID NO: 7714137 - DNA, 18 bp, Homo sapiens
tgagaggctattttttgc

SEQ ID NO: 7714138 - DNA, 18 bp, Homo sapiens
tgagaggctattttttgc

SEQ ID NO: 7714139 - DNA, 18 bp, Homo sapiens
tgagaggctattttttgc

SEQ ID NO: 7714140 - DNA, 22 bp, Homo sapiens
tgagaggctagatcagctctgt

SEQ ID NO: 7714141 - DNA, 22 bp, Homo sapiens
tgagaggctagatcagctctgt

SEQ ID NO: 7714142 - DNA, 22 bp, Homo sapiens
tgagaggctagatcagctctgt

SEQ ID NO: 7714143 - DNA, 18 bp, Homo sapiens
tgagaggctattttttgc

SEQ ID NO: 7714144 - DNA, 18 bp, Homo sapiens
tgagaggctattttttgc

SEQ ID NO: 7714145 - DNA, 18 bp, Homo sapiens
tgagaggctattttttgc

SEQ ID NO: 7714146 - DNA, 18 bp, Homo sapiens
tgagaggctattttttgc

SEQ ID NO: 7714147 - DNA, 18 bp, Homo sapiens
tgagaggctattttttgc

SEQ ID NO: 7714148 - DNA, 22 bp, Homo sapiens
tgagaggctagatcagctctgt

SEQ ID NO: 7714149 - DNA, 22 bp, Homo sapiens
tgagaggcgctcactctcaggt

SEQ ID NO: 7714150 - DNA, 22 bp, Homo sapiens
tgagaggcgctcactctcaggt

SEQ ID NO: 7714151 - DNA, 22 bp, Homo sapiens
tgagaggcgctcactctcaggt

SEQ ID NO: 7714152 - DNA, 18 bp, Homo sapiens
tgagaggcaggtagagga

SEQ ID NO: 7714153 - DNA, 18 bp, Homo sapiens
tgagaggcaggtagagga

SEQ ID NO: 7714154 - DNA, 22 bp, Homo sapiens
tgagaggccccagctcttggcc

SEQ ID NO: 7714155 - DNA, 22 bp, Homo sapiens
tgagaggccccagctcttggcc

SEQ ID NO: 7714156 - DNA, 22 bp, Homo sapiens
tgagaggccccagctcttggcc

SEQ ID NO: 7714157 - DNA, 22 bp, Homo sapiens
tgagagcctgtgttcaaatgcc

SEQ ID NO: 7714158 - DNA, 22 bp, Homo sapiens
tgagagctgaagatatgttaac

SEQ ID NO: 7714159 - DNA, 22 bp, Homo sapiens
tgagagctgccacgtgaccatg

SEQ ID NO: 7714160 - DNA, 22 bp, Homo sapiens
tgagagctgacagtaagctgca

SEQ ID NO: 7714161 - DNA, 22 bp, Homo sapiens
tgagagctgacagtaagctgca

SEQ ID NO: 7714162 - DNA, 22 bp, Homo sapiens
tgagagctgccacgtgaccatg

SEQ ID NO: 7714163 - DNA, 22 bp, Homo sapiens
tgagagctgctgagactgtcct

SEQ ID NO: 7714164 - DNA, 22 bp, Homo sapiens
tgagagctgccacgtgaccatg

SEQ ID NO: 7714165 - DNA, 22 bp, Homo sapiens
tgagagctgctgagactgtcct

SEQ ID NO: 7714166 - DNA, 22 bp, Homo sapiens
tgagaggaacaggcagtaggtt

SEQ ID NO: 7714167 - DNA, 22 bp, Homo sapiens
tgagaggaacaggcagtaggtt

SEQ ID NO: 7714168 - DNA, 22 bp, Homo sapiens
tgagaggaacaggcagtaggtt

SEQ ID NO: 7714169 - DNA, 22 bp, Homo sapiens
tgagaggaacaggcagtaggtt

SEQ ID NO: 7714170 - DNA, 22 bp, Homo sapiens
tgagaggaacaggcagtaggtt

SEQ ID NO: 7714171 - DNA, 22 bp, Homo sapiens
tgagagctgtccacctgtggga

SEQ ID NO: 7714172 - DNA, 22 bp, Homo sapiens
tgagagcttgagtatcactggc

SEQ ID NO: 7714173 - DNA, 22 bp, Homo sapiens
tgagagcttgagtatcactggc

SEQ ID NO: 7714174 - DNA, 22 bp, Homo sapiens
tgagagcttgagtatcactggc

SEQ ID NO: 7714175 - DNA, 22 bp, Homo sapiens
tgagaggatattttgggaggat

SEQ ID NO: 7714176 - DNA, 22 bp, Homo sapiens
tgagaggcagaatggtgcctgc

SEQ ID NO: 7714177 - DNA, 20 bp, Homo sapiens
tgagaggacatttttcatgt

SEQ ID NO: 7714178 - DNA, 22 bp, Homo sapiens
tgagaggagtgattgtaaaatt

SEQ ID NO: 7714179 - DNA, 22 bp, Homo sapiens
tgagaggatattttgggaggat

SEQ ID NO: 7714180 - DNA, 22 bp, Homo sapiens
tgagaggatattttgggaggat

SEQ ID NO: 7714181 - DNA, 22 bp, Homo sapiens
tgagaggatattttgggaggat

SEQ ID NO: 7714182 - DNA, 22 bp, Homo sapiens
tgagaggatattttgggaggat

SEQ ID NO: 7714183 - DNA, 22 bp, Homo sapiens
tgagaggatattttgggaggat

SEQ ID NO: 7714184 - DNA, 22 bp, Homo sapiens
tgagaggaacaggcagtaggtt

SEQ ID NO: 7714185 - DNA, 22 bp, Homo sapiens
tgagaggaacaggcagtaggtt

SEQ ID NO: 7714186 - DNA, 20 bp, Homo sapiens
tgagaggacatttttcatgt

SEQ ID NO: 7714187 - DNA, 20 bp, Homo sapiens
tgagaggacatttttcatgt

SEQ ID NO: 7714188 - DNA, 22 bp, Homo sapiens
tgagaggagtgattgtaaaatt

SEQ ID NO: 7714189 - DNA, 22 bp, Homo sapiens
tgagaggagtgattgtaaaatt

SEQ ID NO: 7714190 - DNA, 20 bp, Homo sapiens
tgagaggacatttttcatgt

SEQ ID NO: 7714191 - DNA, 22 bp, Homo sapiens
tgagaggagtgattgtaaaatt

SEQ ID NO: 7714192 - DNA, 22 bp, Homo sapiens
tgagcagggactttgagtgtag

SEQ ID NO: 7714193 - DNA, 22 bp, Homo sapiens
tgagcagggactttgagtgtag

SEQ ID NO: 7714194 - DNA, 22 bp, Homo sapiens
tgagcagggactttgagtgtag

SEQ ID NO: 7714195 - DNA, 22 bp, Homo sapiens
tgagcagggactttgagtgtag

SEQ ID NO: 7714196 - DNA, 22 bp, Homo sapiens
tgagcaggctcccacttcagtg

SEQ ID NO: 7714197 - DNA, 22 bp, Homo sapiens
tgagcagggactttgagtgtag

SEQ ID NO: 7714198 - DNA, 22 bp, Homo sapiens
tgagcagggactttgagtgtag

SEQ ID NO: 7714199 - DNA, 22 bp, Homo sapiens
tgagcaggctcccacttcagtg

SEQ ID NO: 7714200 - DNA, 22 bp, Homo sapiens
tgagcagggactttgagtgtag

SEQ ID NO: 7714201 - DNA, 22 bp, Homo sapiens
tgagcaggcgcagcaggaggtc

SEQ ID NO: 7714202 - DNA, 22 bp, Homo sapiens
tgagcaggctcccacttcagtg

SEQ ID NO: 7714203 - DNA, 22 bp, Homo sapiens
tgagcaggctcccacttcagtg

SEQ ID NO: 7714204 - DNA, 22 bp, Homo sapiens
tgagcaggcgcagcaggaggtc

SEQ ID NO: 7714205 - DNA, 22 bp, Homo sapiens
tgagcaggcgcagcaggaggtc

SEQ ID NO: 7714206 - DNA, 22 bp, Homo sapiens
tgagcaggcgcagcaggaggtc

SEQ ID NO: 7714207 - DNA, 22 bp, Homo sapiens
tgagcaggcgcagcaggaggtc

SEQ ID NO: 7714208 - DNA, 22 bp, Homo sapiens
tgagcaggcgcagcaggaggtc

SEQ ID NO: 7714209 - DNA, 22 bp, Homo sapiens
tgagcaggcgcagcaggaggtc

SEQ ID NO: 7714210 - DNA, 22 bp, Homo sapiens
tgagcaggcgcagcaggaggtc

SEQ ID NO: 7714211 - DNA, 22 bp, Homo sapiens
tgagcaggcgcagcaggaggtc

SEQ ID NO: 7714212 - DNA, 22 bp, Homo sapiens
tgagcaggcgcagcaggaggtc

SEQ ID NO: 7714213 - DNA, 22 bp, Homo sapiens
tgagcaggcgcagcaggaggtc

SEQ ID NO: 7714214 - DNA, 22 bp, Homo sapiens
tgagcaggcgcagcaggaggtc

SEQ ID NO: 7714215 - DNA, 22 bp, Homo sapiens
tgagcaggcgcagcaggaggtc

SEQ ID NO: 7714216 - DNA, 22 bp, Homo sapiens
tgagcaggcaaacaatggttat

SEQ ID NO: 7714217 - DNA, 22 bp, Homo sapiens
tgagcaggcaaacaatggttat

SEQ ID NO: 7714218 - DNA, 22 bp, Homo sapiens
tgagcaggattcgcctcttgca

SEQ ID NO: 7714219 - DNA, 22 bp, Homo sapiens
tgagcaggcaaacaatggttat

SEQ ID NO: 7714220 - DNA, 22 bp, Homo sapiens
tgagcaggcaaacaatggttat

SEQ ID NO: 7714221 - DNA, 22 bp, Homo sapiens
tgagcaggagataaacaggtag

SEQ ID NO: 7714222 - DNA, 22 bp, Homo sapiens
tgagcaggagataaacaggtag

SEQ ID NO: 7714223 - DNA, 22 bp, Homo sapiens
tgagcaggagataaacaggtag

SEQ ID NO: 7714224 - DNA, 21 bp, Homo sapiens
tgagcaggagtcatgggaatg

SEQ ID NO: 7714225 - DNA, 21 bp, Homo sapiens
tgagcaggagtcatgggaatg

SEQ ID NO: 7714226 - DNA, 21 bp, Homo sapiens
tgagcaggagtcatgggaatg

SEQ ID NO: 7714227 - DNA, 21 bp, Homo sapiens
tgagcaggagtcatgggaatg

SEQ ID NO: 7714228 - DNA, 21 bp, Homo sapiens
tgagcaggagtcatgggaatg

SEQ ID NO: 7714229 - DNA, 22 bp, Homo sapiens
tgagcagatgtgccaaactgta

SEQ ID NO: 7714230 - DNA, 22 bp, Homo sapiens
tgagcagatttgttctaggggt

SEQ ID NO: 7714231 - DNA, 22 bp, Homo sapiens
tgagcagatttgttctaggggt

SEQ ID NO: 7714232 - DNA, 22 bp, Homo sapiens
tgagcagatttgttctaggggt

SEQ ID NO: 7714233 - DNA, 22 bp, Homo sapiens
tgagcagatgtctaacttttac

SEQ ID NO: 7714234 - DNA, 22 bp, Homo sapiens
tgagcagatgtctaacttttac

SEQ ID NO: 7714235 - DNA, 22 bp, Homo sapiens
tgagcagatgtgccaaactgta

SEQ ID NO: 7714236 - DNA, 22 bp, Homo sapiens
tgagcagatgtgccaaactgta

SEQ ID NO: 7714237 - DNA, 22 bp, Homo sapiens
tgagcagatttgttctaggggt

SEQ ID NO: 7714238 - DNA, 22 bp, Homo sapiens
tgagcagatttgttctaggggt

SEQ ID NO: 7714239 - DNA, 22 bp, Homo sapiens
tgagcagatttgttctaggggt

SEQ ID NO: 7714240 - DNA, 22 bp, Homo sapiens
tgagcagcaactgtccatggca

SEQ ID NO: 7714241 - DNA, 22 bp, Homo sapiens
tgagcagcaactgtccatggca

SEQ ID NO: 7714242 - DNA, 22 bp, Homo sapiens
tgagcagcaactgtccatggca

SEQ ID NO: 7714243 - DNA, 22 bp, Homo sapiens
tgagcagcaactgtccatggca

SEQ ID NO: 7714244 - DNA, 22 bp, Homo sapiens
tgagcagcccttcctccggcca

SEQ ID NO: 7714245 - DNA, 22 bp, Homo sapiens
tgagcagcaggatcttctggta

SEQ ID NO: 7714246 - DNA, 22 bp, Homo sapiens
tgagcagcccttcctccggcca

SEQ ID NO: 7714247 - DNA, 22 bp, Homo sapiens
tgagcagcaggatcttctggta

SEQ ID NO: 7714248 - DNA, 22 bp, Homo sapiens
tgagcagcaactgtccatggca

SEQ ID NO: 7714249 - DNA, 22 bp, Homo sapiens
tgagcagcaggatcttctggta

SEQ ID NO: 7714250 - DNA, 22 bp, Homo sapiens
tgagcagcaggatcttctggta

SEQ ID NO: 7714251 - DNA, 23 bp, Homo sapiens
tgagcagctaaaggtgatgcggg

SEQ ID NO: 7714252 - DNA, 23 bp, Homo sapiens
tgagcagctaaaggtgatgcggg

SEQ ID NO: 7714253 - DNA, 22 bp, Homo sapiens
tgagcagctactgtgttcaggg

SEQ ID NO: 7714254 - DNA, 22 bp, Homo sapiens
tgagcagctactgtgttcaggg

SEQ ID NO: 7714255 - DNA, 22 bp, Homo sapiens
tgagcagcttctgtctgaaggc

SEQ ID NO: 7714256 - DNA, 22 bp, Homo sapiens
tgagcagcttctgtctgaaggc

SEQ ID NO: 7714257 - DNA, 22 bp, Homo sapiens
tgagcagcttgttccgagtgtt

SEQ ID NO: 7714258 - DNA, 22 bp, Homo sapiens
tgagcagcttgttccgagtgtt

SEQ ID NO: 7714259 - DNA, 22 bp, Homo sapiens
tgagcagcttgttccgagtgtt

SEQ ID NO: 7714260 - DNA, 22 bp, Homo sapiens
tgagcaggactcactgcagcct

SEQ ID NO: 7714261 - DNA, 22 bp, Homo sapiens
tgagcaggactcactgcagcct

SEQ ID NO: 7714262 - DNA, 22 bp, Homo sapiens
tgagcaggactcactgcagcct

SEQ ID NO: 7714263 - DNA, 22 bp, Homo sapiens
tgagcaggactcactgcagcct

SEQ ID NO: 7714264 - DNA, 22 bp, Homo sapiens
tgagcaggactcactgcagcct

SEQ ID NO: 7714265 - DNA, 22 bp, Homo sapiens
tgagcaggagataaacaggtag

SEQ ID NO: 7714266 - DNA, 22 bp, Homo sapiens
tgagcaggagataaacaggtag

SEQ ID NO: 7714267 - DNA, 22 bp, Homo sapiens
tgagcaggactgaccggcctta

SEQ ID NO: 7714268 - DNA, 22 bp, Homo sapiens
tgagcaggactgaccggcctta

SEQ ID NO: 7714269 - DNA, 22 bp, Homo sapiens
tgagcaggactgaccggcctta

SEQ ID NO: 7714270 - DNA, 22 bp, Homo sapiens
tgagcaggactcactgcagcct

SEQ ID NO: 7714271 - DNA, 22 bp, Homo sapiens
tgagcaggactcactgcagcct

SEQ ID NO: 7714272 - DNA, 22 bp, Homo sapiens
tgagcaggactcactgcagcct

SEQ ID NO: 7714273 - DNA, 22 bp, Homo sapiens
tgagcagatggaggcttctgca

SEQ ID NO: 7714274 - DNA, 22 bp, Homo sapiens
tgagcagagttgtttctcctga

SEQ ID NO: 7714275 - DNA, 22 bp, Homo sapiens
tgagcagatggaggcttctgca

SEQ ID NO: 7714276 - DNA, 22 bp, Homo sapiens
tgagcagatggaggcttctgca

SEQ ID NO: 7714277 - DNA, 22 bp, Homo sapiens
tgagcagatggaggcttctgca

SEQ ID NO: 7714278 - DNA, 22 bp, Homo sapiens
tgagcagagttgtttctcctga

SEQ ID NO: 7714279 - DNA, 22 bp, Homo sapiens
tgagcagatggaggcttctgca

SEQ ID NO: 7714280 - DNA, 22 bp, Homo sapiens
tgagcagatggaggcttctgca

SEQ ID NO: 7714281 - DNA, 22 bp, Homo sapiens
tgagcagatgtctaacttttac

SEQ ID NO: 7714282 - DNA, 22 bp, Homo sapiens
tgagcagagttgtttctcctga

SEQ ID NO: 7714283 - DNA, 22 bp, Homo sapiens
tgagcagagttgtttctcctga

SEQ ID NO: 7714284 - DNA, 22 bp, Homo sapiens
tgagcagagttgtttctcctga

SEQ ID NO: 7714285 - DNA, 22 bp, Homo sapiens
tgagcagagtcgctccagagtg

SEQ ID NO: 7714286 - DNA, 22 bp, Homo sapiens
tgagcagagtcgctccagagtg

SEQ ID NO: 7714287 - DNA, 22 bp, Homo sapiens
tgagcagagtcgctccagagtg

SEQ ID NO: 7714288 - DNA, 22 bp, Homo sapiens
tgagcagagtcgctccagagtg

SEQ ID NO: 7714289 - DNA, 22 bp, Homo sapiens
tgagcagagtcgctccagagtg

SEQ ID NO: 7714290 - DNA, 22 bp, Homo sapiens
tgagcagagtcgctccagagtg

SEQ ID NO: 7714291 - DNA, 22 bp, Homo sapiens
tgagcagagtcgctccagagtg

SEQ ID NO: 7714292 - DNA, 22 bp, Homo sapiens
tgagcagagtcgctccagagtg

SEQ ID NO: 7714293 - DNA, 18 bp, Homo sapiens
tgagcagagtaaggcttt

SEQ ID NO: 7714294 - DNA, 22 bp, Homo sapiens
tgagcagagtcgctccagagtg

SEQ ID NO: 7714295 - DNA, 18 bp, Homo sapiens
tgagcagagtaaggcttt

SEQ ID NO: 7714296 - DNA, 22 bp, Homo sapiens
tgagcagaggagtgacgtaggt

SEQ ID NO: 7714297 - DNA, 22 bp, Homo sapiens
tgagcagaggagtgacgtaggt

SEQ ID NO: 7714298 - DNA, 22 bp, Homo sapiens
tgagcagaggagtgacgtaggt

SEQ ID NO: 7714299 - DNA, 22 bp, Homo sapiens
tgagcagaggagtgacgtaggt

SEQ ID NO: 7714300 - DNA, 22 bp, Homo sapiens
tgagcagaggagtgacgtaggt

SEQ ID NO: 7714301 - DNA, 22 bp, Homo sapiens
tgagcagaggccagcacctggg

SEQ ID NO: 7714302 - DNA, 22 bp, Homo sapiens
tgagcagaggccagcacctggg

SEQ ID NO: 7714303 - DNA, 22 bp, Homo sapiens
tgagcagaggccagcacctggg

SEQ ID NO: 7714304 - DNA, 22 bp, Homo sapiens
tgagcagaggccagcacctggg

SEQ ID NO: 7714305 - DNA, 22 bp, Homo sapiens
tgagcagaggccagcacctggg

SEQ ID NO: 7714306 - DNA, 18 bp, Homo sapiens
tgagcagagtaaggcttt

SEQ ID NO: 7714307 - DNA, 22 bp, Homo sapiens
tgagcagaggaggctgccaact

SEQ ID NO: 7714308 - DNA, 22 bp, Homo sapiens
tgagcagaggaggctgccaact

SEQ ID NO: 7714309 - DNA, 22 bp, Homo sapiens
tgagcagaggaggctgccaact

SEQ ID NO: 7714310 - DNA, 22 bp, Homo sapiens
tgagcagaggaggctgccaact

SEQ ID NO: 7714311 - DNA, 22 bp, Homo sapiens
tgagcagaggaggctgccaact

SEQ ID NO: 7714312 - DNA, 22 bp, Homo sapiens
tgagcagagcagtaacaggagc

SEQ ID NO: 7714313 - DNA, 22 bp, Homo sapiens
tgagcagagcagtaacaggagc

SEQ ID NO: 7714314 - DNA, 22 bp, Homo sapiens
tgagcagagcagtaacaggagc

SEQ ID NO: 7714315 - DNA, 22 bp, Homo sapiens
tgagcagagcagtaacaggagc

SEQ ID NO: 7714316 - DNA, 22 bp, Homo sapiens
tgagcagagcagtaacaggagc

SEQ ID NO: 7714317 - DNA, 22 bp, Homo sapiens
tgagcagagatgactgggcatt

SEQ ID NO: 7714318 - DNA, 22 bp, Homo sapiens
tgagcagagatgactgggcatt

SEQ ID NO: 7714319 - DNA, 22 bp, Homo sapiens
tgagcaccaggcaccacagctc

SEQ ID NO: 7714320 - DNA, 22 bp, Homo sapiens
tgagcagagacttcaagggcag

SEQ ID NO: 7714321 - DNA, 22 bp, Homo sapiens
tgagcacatttcacatgacagg

SEQ ID NO: 7714322 - DNA, 21 bp, Homo sapiens
tgagcaccagctgcatgcccc

SEQ ID NO: 7714323 - DNA, 20 bp, Homo sapiens
tgagcaccaagaatcaagaa

SEQ ID NO: 7714324 - DNA, 22 bp, Homo sapiens
tgagcacatttcacatgacagg

SEQ ID NO: 7714325 - DNA, 22 bp, Homo sapiens
tgagcacatttcacatgacagg

SEQ ID NO: 7714326 - DNA, 22 bp, Homo sapiens
tgagcacatttcacatgacagg

SEQ ID NO: 7714327 - DNA, 22 bp, Homo sapiens
tgagcacatttcacatgacagg

SEQ ID NO: 7714328 - DNA, 22 bp, Homo sapiens
tgagcacatgccagcccttctc

SEQ ID NO: 7714329 - DNA, 22 bp, Homo sapiens
tgagcagagcaggctgcgccct

SEQ ID NO: 7714330 - DNA, 22 bp, Homo sapiens
tgagcagagcaggctgcgccct

SEQ ID NO: 7714331 - DNA, 22 bp, Homo sapiens
tgagcagagcaggctgcgccct

SEQ ID NO: 7714332 - DNA, 22 bp, Homo sapiens
tgagcagagcaataggactctc

SEQ ID NO: 7714333 - DNA, 22 bp, Homo sapiens
tgagcagagcaataggactctc

SEQ ID NO: 7714334 - DNA, 22 bp, Homo sapiens
tgagcagagcaataggactctc

SEQ ID NO: 7714335 - DNA, 22 bp, Homo sapiens
tgagcagagcaataggactctc

SEQ ID NO: 7714336 - DNA, 22 bp, Homo sapiens
tgagcagagcaataggactctc

SEQ ID NO: 7714337 - DNA, 22 bp, Homo sapiens
tgagcagagcaataggactctc

SEQ ID NO: 7714338 - DNA, 22 bp, Homo sapiens
tgagcagagcaataggactctc

SEQ ID NO: 7714339 - DNA, 22 bp, Homo sapiens
tgagcagagatgactgggcatt

SEQ ID NO: 7714340 - DNA, 22 bp, Homo sapiens
tgagcaagagaaactgactgta

SEQ ID NO: 7714341 - DNA, 22 bp, Homo sapiens
tgagcaagacccggcctctgcc

SEQ ID NO: 7714342 - DNA, 22 bp, Homo sapiens
tgagcaaggagcagtctttctt

SEQ ID NO: 7714343 - DNA, 22 bp, Homo sapiens
tgagcaagagaaactgactgta

SEQ ID NO: 7714344 - DNA, 22 bp, Homo sapiens
tgagcaagagaaactgactgta

SEQ ID NO: 7714345 - DNA, 23 bp, Homo sapiens
tgagcaagtgaccaactgtctgt

SEQ ID NO: 7714346 - DNA, 23 bp, Homo sapiens
tgagcaagtgaccaactgtctgt

SEQ ID NO: 7714347 - DNA, 19 bp, Homo sapiens
tgagcacacctgtacaccc

SEQ ID NO: 7714348 - DNA, 22 bp, Homo sapiens
tgagcacagctcgcaccagctt

SEQ ID NO: 7714349 - DNA, 19 bp, Homo sapiens
tgagcacacctgtacaccc

SEQ ID NO: 7714350 - DNA, 22 bp, Homo sapiens
tgagcacaagtttgcatgtgtg

SEQ ID NO: 7714351 - DNA, 22 bp, Homo sapiens
tgagcacaagtttgcatgtgtg

SEQ ID NO: 7714352 - DNA, 22 bp, Homo sapiens
tgagcacagctcgcaccagctt

SEQ ID NO: 7714353 - DNA, 22 bp, Homo sapiens
tgagcacagctttcactagaaa

SEQ ID NO: 7714354 - DNA, 22 bp, Homo sapiens
tgagcacagctttcactagaaa

SEQ ID NO: 7714355 - DNA, 22 bp, Homo sapiens
tgagcacagctttcactagaaa

SEQ ID NO: 7714356 - DNA, 22 bp, Homo sapiens
tgagcacagctttcactagaaa

SEQ ID NO: 7714357 - DNA, 22 bp, Homo sapiens
tgagcagggactttggagtctg

SEQ ID NO: 7714358 - DNA, 22 bp, Homo sapiens
tgagcagggactttggagtctg

SEQ ID NO: 7714359 - DNA, 22 bp, Homo sapiens
tgagcagggactttggagtctg

SEQ ID NO: 7714360 - DNA, 22 bp, Homo sapiens
tgagcagggactttggagtctg

SEQ ID NO: 7714361 - DNA, 22 bp, Homo sapiens
tgagcagggactttggagtctg

SEQ ID NO: 7714362 - DNA, 22 bp, Homo sapiens
tgagcagggactttggagtctg

SEQ ID NO: 7714363 - DNA, 22 bp, Homo sapiens
tgagcagggactttggagtctg

SEQ ID NO: 7714364 - DNA, 22 bp, Homo sapiens
tgagcagggactttgagtgtag

SEQ ID NO: 7714365 - DNA, 22 bp, Homo sapiens
tgagcagggactttgagtgtag

SEQ ID NO: 7714366 - DNA, 22 bp, Homo sapiens
tgagcagggagctgggctgagc

SEQ ID NO: 7714367 - DNA, 22 bp, Homo sapiens
tgagcagggagctgggctgagc

SEQ ID NO: 7714368 - DNA, 22 bp, Homo sapiens
tgagcagggagctgggctgagc

SEQ ID NO: 7714369 - DNA, 22 bp, Homo sapiens
tgagcagggagctgggctgagc

SEQ ID NO: 7714370 - DNA, 22 bp, Homo sapiens
tgagcagggagctgggctgagc

SEQ ID NO: 7714371 - DNA, 22 bp, Homo sapiens
tgagcagggagctgggctgagc

SEQ ID NO: 7714372 - DNA, 22 bp, Homo sapiens
tgagcagggagctgggctgagc

SEQ ID NO: 7714373 - DNA, 22 bp, Homo sapiens
tgagcagggactttggagtctg

SEQ ID NO: 7714374 - DNA, 22 bp, Homo sapiens
tgagcagggactttggagtctg

SEQ ID NO: 7714375 - DNA, 22 bp, Homo sapiens
tgagcagggagctgggctgagc

SEQ ID NO: 7714376 - DNA, 22 bp, Homo sapiens
tgagcagtggcaccaggtcacc

SEQ ID NO: 7714377 - DNA, 22 bp, Homo sapiens
tgagcagtgatgcgttttgttt

SEQ ID NO: 7714378 - DNA, 22 bp, Homo sapiens
tgagcagtggcaccaggtcacc

SEQ ID NO: 7714379 - DNA, 22 bp, Homo sapiens
tgagcagtggcaccaggtcacc

SEQ ID NO: 7714380 - DNA, 22 bp, Homo sapiens
tgagcagttcgacttcttcccc

SEQ ID NO: 7714381 - DNA, 22 bp, Homo sapiens
tgagcagtggtgtttttctatc

SEQ ID NO: 7714382 - DNA, 22 bp, Homo sapiens
tgagcatagcccttctagtgtt

SEQ ID NO: 7714383 - DNA, 22 bp, Homo sapiens
tgagcagtggtgtttttctatc

SEQ ID NO: 7714384 - DNA, 22 bp, Homo sapiens
tgagcagttcgacttcttcccc

SEQ ID NO: 7714385 - DNA, 22 bp, Homo sapiens
tgagcagtggggcctgcattct

SEQ ID NO: 7714386 - DNA, 22 bp, Homo sapiens
tgagcagtggggcctgcattct

SEQ ID NO: 7714387 - DNA, 22 bp, Homo sapiens
tgagcagtggctcctgctggac

SEQ ID NO: 7714388 - DNA, 22 bp, Homo sapiens
tgagcatggtgggtgcagagca

SEQ ID NO: 7714389 - DNA, 22 bp, Homo sapiens
tgagcatggtgggtgcagagca

SEQ ID NO: 7714390 - DNA, 22 bp, Homo sapiens
tgagcatcttcgtgaaagcttc

SEQ ID NO: 7714391 - DNA, 19 bp, Homo sapiens
tgagcatgcgagctgagaa

SEQ ID NO: 7714392 - DNA, 19 bp, Homo sapiens
tgagcatgcgagctgagaa

SEQ ID NO: 7714393 - DNA, 22 bp, Homo sapiens
tgagccagataagggctcacgc

SEQ ID NO: 7714394 - DNA, 22 bp, Homo sapiens
tgagccagataagggctcacgc

SEQ ID NO: 7714395 - DNA, 22 bp, Homo sapiens
tgagccagataagggctcacgc

SEQ ID NO: 7714396 - DNA, 22 bp, Homo sapiens
tgagccagagtggagtgtgcct

SEQ ID NO: 7714397 - DNA, 22 bp, Homo sapiens
tgagccagagtggagtgtgcct

SEQ ID NO: 7714398 - DNA, 22 bp, Homo sapiens
tgagccagagtggagtgtgcct

SEQ ID NO: 7714399 - DNA, 22 bp, Homo sapiens
tgagccagagtggagtgtgcct

SEQ ID NO: 7714400 - DNA, 22 bp, Homo sapiens
tgagccagagaggttgaggcta

SEQ ID NO: 7714401 - DNA, 22 bp, Homo sapiens
tgagccagaggaggctgtgtgg

SEQ ID NO: 7714402 - DNA, 22 bp, Homo sapiens
tgagccagagtggagtgtgcct

SEQ ID NO: 7714403 - DNA, 22 bp, Homo sapiens
tgagccagagtggagtgtgcct

SEQ ID NO: 7714404 - DNA, 22 bp, Homo sapiens
tgagccagagtggagtgtgcct

SEQ ID NO: 7714405 - DNA, 22 bp, Homo sapiens
tgagcattacctgaggccactg

SEQ ID NO: 7714406 - DNA, 22 bp, Homo sapiens
tgagcattggatcaaatgactt

SEQ ID NO: 7714407 - DNA, 22 bp, Homo sapiens
tgagcattggatcaaatgactt

SEQ ID NO: 7714408 - DNA, 22 bp, Homo sapiens
tgagccaagatcatgccgttgt

SEQ ID NO: 7714409 - DNA, 22 bp, Homo sapiens
tgagccaagcagcttcccaggg

SEQ ID NO: 7714410 - DNA, 22 bp, Homo sapiens
tgagccaaggcctcaagaattt

SEQ ID NO: 7714411 - DNA, 22 bp, Homo sapiens
tgagccaaggcctcaagaattt

SEQ ID NO: 7714412 - DNA, 22 bp, Homo sapiens
tgagccaagttcacaccattgc

SEQ ID NO: 7714413 - DNA, 22 bp, Homo sapiens
tgagccacagtgagagctcctg

SEQ ID NO: 7714414 - DNA, 22 bp, Homo sapiens
tgagccacagtgagagctcctg

SEQ ID NO: 7714415 - DNA, 22 bp, Homo sapiens
tgagccacagtgagagctcctg

SEQ ID NO: 7714416 - DNA, 22 bp, Homo sapiens
tgagccagagaggttgaggcta

SEQ ID NO: 7714417 - DNA, 22 bp, Homo sapiens
tgagccagagaggttgaggcta

SEQ ID NO: 7714418 - DNA, 22 bp, Homo sapiens
tgagccagcaggcctccagtgg

SEQ ID NO: 7714419 - DNA, 22 bp, Homo sapiens
tgagccagataagggctcacgc

SEQ ID NO: 7714420 - DNA, 22 bp, Homo sapiens
tgagccagataagggctcacgc

SEQ ID NO: 7714421 - DNA, 22 bp, Homo sapiens
tgagccagcctcagaagtcacg

SEQ ID NO: 7714422 - DNA, 22 bp, Homo sapiens
tgagccagcaggcctccagtgg

SEQ ID NO: 7714423 - DNA, 22 bp, Homo sapiens
tgagccagcaggcctccagtgg

SEQ ID NO: 7714424 - DNA, 22 bp, Homo sapiens
tgagccagccttgcagctgtgc

SEQ ID NO: 7714425 - DNA, 22 bp, Homo sapiens
tgagccagcctcagaagtcacg

SEQ ID NO: 7714426 - DNA, 22 bp, Homo sapiens
tgagccagcctcagaagtcacg

SEQ ID NO: 7714427 - DNA, 22 bp, Homo sapiens
tgagccagcctcagaagtcacg

SEQ ID NO: 7714428 - DNA, 22 bp, Homo sapiens
tgagccagccttgcagctgtgc

SEQ ID NO: 7714429 - DNA, 22 bp, Homo sapiens
tgagccagccttgcagctgtgc

SEQ ID NO: 7714430 - DNA, 22 bp, Homo sapiens
tgagccagccttgcagctgtgc

SEQ ID NO: 7714431 - DNA, 22 bp, Homo sapiens
tgagccaggagtttgaggctgt

SEQ ID NO: 7714432 - DNA, 22 bp, Homo sapiens
tgagccaggagtttgaggctgt

SEQ ID NO: 7714433 - DNA, 22 bp, Homo sapiens
tgagccaggagtttgaggctgt

SEQ ID NO: 7714434 - DNA, 22 bp, Homo sapiens
tgagccaggagtttgaggctgt

SEQ ID NO: 7714435 - DNA, 22 bp, Homo sapiens
tgagccagctccttgcctgtca

SEQ ID NO: 7714436 - DNA, 22 bp, Homo sapiens
tgagccagctccttgcctgtca

SEQ ID NO: 7714437 - DNA, 22 bp, Homo sapiens
tgagccagctccttgcctgtca

SEQ ID NO: 7714438 - DNA, 22 bp, Homo sapiens
tgagccaggcactgctcctgga

SEQ ID NO: 7714439 - DNA, 22 bp, Homo sapiens
tgagccaggcactgctcctgga

SEQ ID NO: 7714440 - DNA, 22 bp, Homo sapiens
tgagccaggcactgctcctgga

SEQ ID NO: 7714441 - DNA, 22 bp, Homo sapiens
tgagccaggcactgctcctgga

SEQ ID NO: 7714442 - DNA, 22 bp, Homo sapiens
tgagccaggagtttgaggctgt

SEQ ID NO: 7714443 - DNA, 22 bp, Homo sapiens
tgagccaggcactgctcctgga

SEQ ID NO: 7714444 - DNA, 22 bp, Homo sapiens
tgagccaggagtttgaggctgt

SEQ ID NO: 7714445 - DNA, 22 bp, Homo sapiens
tgagccaggagtttgaggctgt

SEQ ID NO: 7714446 - DNA, 22 bp, Homo sapiens
tgagccaggctcaagtgatcct

SEQ ID NO: 7714447 - DNA, 20 bp, Homo sapiens
tgagccaggctaggaagggc

SEQ ID NO: 7714448 - DNA, 20 bp, Homo sapiens
tgagccaggctaggaagggc

SEQ ID NO: 7714449 - DNA, 22 bp, Homo sapiens
tgagccaggctccatgccacct

SEQ ID NO: 7714450 - DNA, 22 bp, Homo sapiens
tgagccaggctcaagtgatcct

SEQ ID NO: 7714451 - DNA, 20 bp, Homo sapiens
tgagccaggctaggaagggc

SEQ ID NO: 7714452 - DNA, 22 bp, Homo sapiens
tgagccaggcccagtggggtca

SEQ ID NO: 7714453 - DNA, 22 bp, Homo sapiens
tgagccaggcccagtggggtca

SEQ ID NO: 7714454 - DNA, 22 bp, Homo sapiens
tgagccaggcccagtggggtca

SEQ ID NO: 7714455 - DNA, 22 bp, Homo sapiens
tgagccaggcccagtggggtca

SEQ ID NO: 7714456 - DNA, 22 bp, Homo sapiens
tgagccaggcactgctcctgga

SEQ ID NO: 7714457 - DNA, 21 bp, Homo sapiens
tgagccaggctgacggctgtg

SEQ ID NO: 7714458 - DNA, 21 bp, Homo sapiens
tgagccaggctgacggctgtg

SEQ ID NO: 7714459 - DNA, 21 bp, Homo sapiens
tgagccaggctgacggctgtg

SEQ ID NO: 7714460 - DNA, 22 bp, Homo sapiens
tgagccaggctccatgccacct

SEQ ID NO: 7714461 - DNA, 22 bp, Homo sapiens
tgagccaggctccatgccacct

SEQ ID NO: 7714462 - DNA, 22 bp, Homo sapiens
tgagccaggctccatgccacct

SEQ ID NO: 7714463 - DNA, 19 bp, Homo sapiens
tgagccagggaggccatgc

SEQ ID NO: 7714464 - DNA, 21 bp, Homo sapiens
tgagccaggctgacggctgtg

SEQ ID NO: 7714465 - DNA, 19 bp, Homo sapiens
tgagccagggaggccatgc

SEQ ID NO: 7714466 - DNA, 19 bp, Homo sapiens
tgagccagggaggccatgc

SEQ ID NO: 7714467 - DNA, 22 bp, Homo sapiens
tgagccagggtttccggctgct

SEQ ID NO: 7714468 - DNA, 22 bp, Homo sapiens
tgaggaaaacgtattgaaagga

SEQ ID NO: 7714469 - DNA, 22 bp, Homo sapiens
tgaggaaaacgtattgaaagga

SEQ ID NO: 7714470 - DNA, 22 bp, Homo sapiens
tgaggaaaatgtcttatagatt

SEQ ID NO: 7714471 - DNA, 22 bp, Homo sapiens
tgaggaaaatgtcttatagatt

SEQ ID NO: 7714472 - DNA, 22 bp, Homo sapiens
tgaggaaaacgtattgaaagga

SEQ ID NO: 7714473 - DNA, 22 bp, Homo sapiens
tgaggaaaatgtcttatagatt

SEQ ID NO: 7714474 - DNA, 22 bp, Homo sapiens
tgaggaaaatgtcttatagatt

SEQ ID NO: 7714475 - DNA, 22 bp, Homo sapiens
tgaggaaactgaggcacagatg

SEQ ID NO: 7714476 - DNA, 22 bp, Homo sapiens
tgaggaaactgaggcacagatg

SEQ ID NO: 7714477 - DNA, 22 bp, Homo sapiens
tgaggaaactgaggcacagatg

SEQ ID NO: 7714478 - DNA, 22 bp, Homo sapiens
tgaggaaactgaggcacagatg

SEQ ID NO: 7714479 - DNA, 22 bp, Homo sapiens
tgaggaaacttacaaggcagaa

SEQ ID NO: 7714480 - DNA, 22 bp, Homo sapiens
tgaggaaacttacaaggcagaa

SEQ ID NO: 7714481 - DNA, 22 bp, Homo sapiens
tgaggaaacttacaaggcagaa

SEQ ID NO: 7714482 - DNA, 22 bp, Homo sapiens
tgaggaaacttacaaggcagaa

SEQ ID NO: 7714483 - DNA, 22 bp, Homo sapiens
tgaggaaactgaggcacagatg

SEQ ID NO: 7714484 - DNA, 22 bp, Homo sapiens
tgaggaaactgaggcacagatg

SEQ ID NO: 7714485 - DNA, 22 bp, Homo sapiens
tgaggaaactgaggcacagatg

SEQ ID NO: 7714486 - DNA, 22 bp, Homo sapiens
tgagcttggaaggagaaacaga

SEQ ID NO: 7714487 - DNA, 22 bp, Homo sapiens
tgagctttcatgtatgaaaaga

SEQ ID NO: 7714488 - DNA, 22 bp, Homo sapiens
tgagcttggaaggagaaacaga

SEQ ID NO: 7714489 - DNA, 22 bp, Homo sapiens
tgagctttgttgttagtatatt

SEQ ID NO: 7714490 - DNA, 22 bp, Homo sapiens
tgagctttcatgtatgaaaaga

SEQ ID NO: 7714491 - DNA, 22 bp, Homo sapiens
tgagctttgtgggtaaagagag

SEQ ID NO: 7714492 - DNA, 22 bp, Homo sapiens
tgagcttcctccctgcatccat

SEQ ID NO: 7714493 - DNA, 22 bp, Homo sapiens
tgagcttctttatttggccaga

SEQ ID NO: 7714494 - DNA, 22 bp, Homo sapiens
tgagcttccctcctgcactaca

SEQ ID NO: 7714495 - DNA, 22 bp, Homo sapiens
tgagcttcctccctgcatccat

SEQ ID NO: 7714496 - DNA, 22 bp, Homo sapiens
tgagctgtgtcctgggggcagt

SEQ ID NO: 7714497 - DNA, 22 bp, Homo sapiens
tgagcttagagcctccaagttc

SEQ ID NO: 7714498 - DNA, 22 bp, Homo sapiens
tgagcttacttctgtacacaga

SEQ ID NO: 7714499 - DNA, 22 bp, Homo sapiens
tgagctgtttctctggtggctt

SEQ ID NO: 7714500 - DNA, 22 bp, Homo sapiens
tgagcttacgtgggaacagact

SEQ ID NO: 7714501 - DNA, 22 bp, Homo sapiens
tgagcttacgtgggaacagact

SEQ ID NO: 7714502 - DNA, 17 bp, Homo sapiens
tgagcttcaatcaggtg

SEQ ID NO: 7714503 - DNA, 20 bp, Homo sapiens
tgagcttcagatatcgtgca

SEQ ID NO: 7714504 - DNA, 22 bp, Homo sapiens
tgagcttcaaagttggatctga

SEQ ID NO: 7714505 - DNA, 22 bp, Homo sapiens
tgagcttcaaaatatgtgaatc

SEQ ID NO: 7714506 - DNA, 22 bp, Homo sapiens
tgagcttcaaagttggatctga

SEQ ID NO: 7714507 - DNA, 22 bp, Homo sapiens
tgagctgtctgaatggtgagga

SEQ ID NO: 7714508 - DNA, 22 bp, Homo sapiens
tgagctgtatattgttttaata

SEQ ID NO: 7714509 - DNA, 22 bp, Homo sapiens
tgagctgtactcctccccaggg

SEQ ID NO: 7714510 - DNA, 22 bp, Homo sapiens
tgagctgtactcctccccaggg

SEQ ID NO: 7714511 - DNA, 22 bp, Homo sapiens
tgagctggtcttgagtgtagct

SEQ ID NO: 7714512 - DNA, 22 bp, Homo sapiens
tgagctggtcttgagtgtagct

SEQ ID NO: 7714513 - DNA, 22 bp, Homo sapiens
tgagctggtcactccttctgaa

SEQ ID NO: 7714514 - DNA, 22 bp, Homo sapiens
tgagctggtcactccttctgaa

SEQ ID NO: 7714515 - DNA, 22 bp, Homo sapiens
tgagctggtcttgagtgtagct

SEQ ID NO: 7714516 - DNA, 22 bp, Homo sapiens
tgagctggtcttgagtgtagct

SEQ ID NO: 7714517 - DNA, 22 bp, Homo sapiens
tgagctggtcttgagtgtagct

SEQ ID NO: 7714518 - DNA, 22 bp, Homo sapiens
tgagctggtcttgagtgtagct

SEQ ID NO: 7714519 - DNA, 22 bp, Homo sapiens
tgagctggttcttgaggcatga

SEQ ID NO: 7714520 - DNA, 22 bp, Homo sapiens
tgagctggttcttgaggcatga

SEQ ID NO: 7714521 - DNA, 22 bp, Homo sapiens
tgagctggttcttgaggcatga

SEQ ID NO: 7714522 - DNA, 22 bp, Homo sapiens
tgagctggttcttgaggcatga

SEQ ID NO: 7714523 - DNA, 22 bp, Homo sapiens
tgagctggttcttgaggcatga

SEQ ID NO: 7714524 - DNA, 22 bp, Homo sapiens
tgagctggaggacaggagggta

SEQ ID NO: 7714525 - DNA, 22 bp, Homo sapiens
tgagctggaggacaggagggta

SEQ ID NO: 7714526 - DNA, 22 bp, Homo sapiens
tgagctggaggacaggagggta

SEQ ID NO: 7714527 - DNA, 22 bp, Homo sapiens
tgagctggagtcgtgagcaaag

SEQ ID NO: 7714528 - DNA, 22 bp, Homo sapiens
tgagctggaggacaggagggta

SEQ ID NO: 7714529 - DNA, 22 bp, Homo sapiens
tgagctggaggacaggagggta

SEQ ID NO: 7714530 - DNA, 22 bp, Homo sapiens
tgagctggaatcttcttgactg

SEQ ID NO: 7714531 - DNA, 22 bp, Homo sapiens
tgagctgcttcttataatgtgt

SEQ ID NO: 7714532 - DNA, 22 bp, Homo sapiens
tgagctgcttcttataatgtgt

SEQ ID NO: 7714533 - DNA, 19 bp, Homo sapiens
tgagctgctgctgcccatc

SEQ ID NO: 7714534 - DNA, 22 bp, Homo sapiens
tgagctgcttcttataatgtgt

SEQ ID NO: 7714535 - DNA, 22 bp, Homo sapiens
tgagctggaatcttcttgactg

SEQ ID NO: 7714536 - DNA, 22 bp, Homo sapiens
tgagctggagtcgtgagcaaag

SEQ ID NO: 7714537 - DNA, 22 bp, Homo sapiens
tgagctggagtctgtggctcct

SEQ ID NO: 7714538 - DNA, 22 bp, Homo sapiens
tgagctggagtctgtggctcct

SEQ ID NO: 7714539 - DNA, 22 bp, Homo sapiens
tgagctggagtctgtggctcct

SEQ ID NO: 7714540 - DNA, 22 bp, Homo sapiens
tgagctggagtctgtggctcct

SEQ ID NO: 7714541 - DNA, 22 bp, Homo sapiens
tgagctggcacttttcctggga

SEQ ID NO: 7714542 - DNA, 22 bp, Homo sapiens
tgagctggatccaactccgttt

SEQ ID NO: 7714543 - DNA, 22 bp, Homo sapiens
tgagctggatccaactccgttt

SEQ ID NO: 7714544 - DNA, 22 bp, Homo sapiens
tgagctggagtctgtggctcct

SEQ ID NO: 7714545 - DNA, 22 bp, Homo sapiens
tgagctgagtttaaaagctgct

SEQ ID NO: 7714546 - DNA, 22 bp, Homo sapiens
tgagctgataggctgtgagcct

SEQ ID NO: 7714547 - DNA, 22 bp, Homo sapiens
tgagctgatggcatccctgttt

SEQ ID NO: 7714548 - DNA, 22 bp, Homo sapiens
tgagctgcaagaaaatttcagt

SEQ ID NO: 7714549 - DNA, 22 bp, Homo sapiens
tgagctgcagagatctttgata

SEQ ID NO: 7714550 - DNA, 22 bp, Homo sapiens
tgagctgcattacagcctctgt

SEQ ID NO: 7714551 - DNA, 22 bp, Homo sapiens
tgagctgcagtgagctgagatg

SEQ ID NO: 7714552 - DNA, 22 bp, Homo sapiens
tgagctgcagtgagctgagatg

SEQ ID NO: 7714553 - DNA, 22 bp, Homo sapiens
tgagctgcagtgagctgagatg

SEQ ID NO: 7714554 - DNA, 22 bp, Homo sapiens
tgagctgcagagatctttgata

SEQ ID NO: 7714555 - DNA, 19 bp, Homo sapiens
tgagctgctgctgcccatc

SEQ ID NO: 7714556 - DNA, 19 bp, Homo sapiens
tgagctgctgctgcccatc

SEQ ID NO: 7714557 - DNA, 19 bp, Homo sapiens
tgagctgctgctgcccatc

SEQ ID NO: 7714558 - DNA, 19 bp, Homo sapiens
tgagctgctgctgcccatc

SEQ ID NO: 7714559 - DNA, 19 bp, Homo sapiens
tgagctgctgctgcccatc

SEQ ID NO: 7714560 - DNA, 19 bp, Homo sapiens
tgagctgctgctgcccatc

SEQ ID NO: 7714561 - DNA, 18 bp, Homo sapiens
tgagctgctctgtgaaga

SEQ ID NO: 7714562 - DNA, 18 bp, Homo sapiens
tgagctgctctgtgaaga

SEQ ID NO: 7714563 - DNA, 18 bp, Homo sapiens
tgagctgctctgtgaaga

SEQ ID NO: 7714564 - DNA, 22 bp, Homo sapiens
tgagctgctctaatctcgcctt

SEQ ID NO: 7714565 - DNA, 22 bp, Homo sapiens
tgagctgctctaatctcgcctt

SEQ ID NO: 7714566 - DNA, 22 bp, Homo sapiens
tgagctgctctaatctcgcctt

SEQ ID NO: 7714567 - DNA, 22 bp, Homo sapiens
tgagctgctagatgatttatga

SEQ ID NO: 7714568 - DNA, 22 bp, Homo sapiens
tgagctgctagatgatttatga

SEQ ID NO: 7714569 - DNA, 22 bp, Homo sapiens
tgagctgctagatgatttatga

SEQ ID NO: 7714570 - DNA, 22 bp, Homo sapiens
tgagctgcattacagcctctgt

SEQ ID NO: 7714571 - DNA, 22 bp, Homo sapiens
tgagctgcattctctttatcat

SEQ ID NO: 7714572 - DNA, 22 bp, Homo sapiens
tgagctgcattctctttatcat

SEQ ID NO: 7714573 - DNA, 22 bp, Homo sapiens
tgagctgccccctggcctgctc

SEQ ID NO: 7714574 - DNA, 19 bp, Homo sapiens
tgagctgccgtcttccctg

SEQ ID NO: 7714575 - DNA, 19 bp, Homo sapiens
tgagctgccgtcttccctg

SEQ ID NO: 7714576 - DNA, 22 bp, Homo sapiens
tgagctcttgatatccttgttt

SEQ ID NO: 7714577 - DNA, 22 bp, Homo sapiens
tgagctgacacccaatcatact

SEQ ID NO: 7714578 - DNA, 22 bp, Homo sapiens
tgagctcttctaactaattgtg

SEQ ID NO: 7714579 - DNA, 22 bp, Homo sapiens
tgagctctgttagggctggaac

SEQ ID NO: 7714580 - DNA, 22 bp, Homo sapiens
tgagctgacacccaatcatact

SEQ ID NO: 7714581 - DNA, 22 bp, Homo sapiens
tgagctgagtggcaggtctcag

SEQ ID NO: 7714582 - DNA, 22 bp, Homo sapiens
tgagctgagtggcaggtctcag

SEQ ID NO: 7714583 - DNA, 22 bp, Homo sapiens
tgagctcctggtcacaattatc

SEQ ID NO: 7714584 - DNA, 22 bp, Homo sapiens
tgagctccggcatatggaatta

SEQ ID NO: 7714585 - DNA, 22 bp, Homo sapiens
tgagctccggcatatggaatta

SEQ ID NO: 7714586 - DNA, 22 bp, Homo sapiens
tgagctcctggtcacaattatc

SEQ ID NO: 7714587 - DNA, 22 bp, Homo sapiens
tgagctctcattaatattattc

SEQ ID NO: 7714588 - DNA, 19 bp, Homo sapiens
tgagctctccacaatttcc

SEQ ID NO: 7714589 - DNA, 22 bp, Homo sapiens
tgagctctgttagggctggaac

SEQ ID NO: 7714590 - DNA, 19 bp, Homo sapiens
tgagctctccacaatttcc

SEQ ID NO: 7714591 - DNA, 22 bp, Homo sapiens
tgagctctgacttttgggaatt

SEQ ID NO: 7714592 - DNA, 22 bp, Homo sapiens
tgagcctggttgcagtgtctgg

SEQ ID NO: 7714593 - DNA, 22 bp, Homo sapiens
tgagcctggttgcagtgtctgg

SEQ ID NO: 7714594 - DNA, 22 bp, Homo sapiens
tgagcctgggtggtcgaggctg

SEQ ID NO: 7714595 - DNA, 22 bp, Homo sapiens
tgagcctgggtggtcgaggctg

SEQ ID NO: 7714596 - DNA, 22 bp, Homo sapiens
tgagcctggggcctgggcagcg

SEQ ID NO: 7714597 - DNA, 22 bp, Homo sapiens
tgagcctggggcctgggcagcg

SEQ ID NO: 7714598 - DNA, 22 bp, Homo sapiens
tgagcctgggctttctctggag

SEQ ID NO: 7714599 - DNA, 22 bp, Homo sapiens
tgagcctggggcctgggcagcg

SEQ ID NO: 7714600 - DNA, 22 bp, Homo sapiens
tgagcctggggcctgggcagcg

SEQ ID NO: 7714601 - DNA, 22 bp, Homo sapiens
tgagcctggggcctgggcagcg

SEQ ID NO: 7714602 - DNA, 22 bp, Homo sapiens
tgagcctgggagatggaggctg

SEQ ID NO: 7714603 - DNA, 22 bp, Homo sapiens
tgagcctgggagatggaggctg

SEQ ID NO: 7714604 - DNA, 22 bp, Homo sapiens
tgagcctgggagatggaggctg

SEQ ID NO: 7714605 - DNA, 22 bp, Homo sapiens
tgagcctgggagatggaggctg

SEQ ID NO: 7714606 - DNA, 22 bp, Homo sapiens
tgagctcatagctcttattatg

SEQ ID NO: 7714607 - DNA, 22 bp, Homo sapiens
tgagctaggtgtgcagatatga

SEQ ID NO: 7714608 - DNA, 22 bp, Homo sapiens
tgagctcatagctcttattatg

SEQ ID NO: 7714609 - DNA, 22 bp, Homo sapiens
tgagctaggtcctgtgtcagct

SEQ ID NO: 7714610 - DNA, 22 bp, Homo sapiens
tgagctagggctggtgaggagc

SEQ ID NO: 7714611 - DNA, 22 bp, Homo sapiens
tgagctacacactaggcatggg

SEQ ID NO: 7714612 - DNA, 22 bp, Homo sapiens
tgagctaagtactctcatcaag

SEQ ID NO: 7714613 - DNA, 22 bp, Homo sapiens
tgagcgtgcagtagtgttggta

SEQ ID NO: 7714614 - DNA, 22 bp, Homo sapiens
tgagcctgtcattattcagaga

SEQ ID NO: 7714615 - DNA, 22 bp, Homo sapiens
tgagcctgtcctgtgcatgtga

SEQ ID NO: 7714616 - DNA, 22 bp, Homo sapiens
tgagcctgtcctgtgcatgtga

SEQ ID NO: 7714617 - DNA, 22 bp, Homo sapiens
tgagcgtgcagtagtgttggta

SEQ ID NO: 7714618 - DNA, 23 bp, Homo sapiens
tgagcctgttaatactggctctg

SEQ ID NO: 7714619 - DNA, 23 bp, Homo sapiens
tgagcctgttaatactggctctg

SEQ ID NO: 7714620 - DNA, 23 bp, Homo sapiens
tgagcctgttaatactggctctg

SEQ ID NO: 7714621 - DNA, 22 bp, Homo sapiens
tgagcctgcaataagcacagcc

SEQ ID NO: 7714622 - DNA, 22 bp, Homo sapiens
tgagcctgcaataagcacagcc

SEQ ID NO: 7714623 - DNA, 22 bp, Homo sapiens
tgagcctgcaataagcacagcc

SEQ ID NO: 7714624 - DNA, 22 bp, Homo sapiens
tgagcctgcaataagcacagcc

SEQ ID NO: 7714625 - DNA, 22 bp, Homo sapiens
tgagcctgagttcaaggctgca

SEQ ID NO: 7714626 - DNA, 22 bp, Homo sapiens
tgagcctgagttcaaggctgca

SEQ ID NO: 7714627 - DNA, 22 bp, Homo sapiens
tgagcctgcctgcaggtgtgct

SEQ ID NO: 7714628 - DNA, 22 bp, Homo sapiens
tgagcctgcctgcaggtgtgct

SEQ ID NO: 7714629 - DNA, 22 bp, Homo sapiens
tgagcctgcctgcaggtgtgct

SEQ ID NO: 7714630 - DNA, 22 bp, Homo sapiens
tgagcctgcctgcaggtgtgct

SEQ ID NO: 7714631 - DNA, 22 bp, Homo sapiens
tgagcctgcctgcaggtgtgct

SEQ ID NO: 7714632 - DNA, 22 bp, Homo sapiens
tgagcctgcctgcaggtgtgct

SEQ ID NO: 7714633 - DNA, 20 bp, Homo sapiens
tgagcctgctgtaggaggcc

SEQ ID NO: 7714634 - DNA, 23 bp, Homo sapiens
tgagcctgctgatagacacaatt

SEQ ID NO: 7714635 - DNA, 23 bp, Homo sapiens
tgagcctgctgatagacacaatt

SEQ ID NO: 7714636 - DNA, 20 bp, Homo sapiens
tgagcctgctgtaggaggcc

SEQ ID NO: 7714637 - DNA, 22 bp, Homo sapiens
tgagcctggagtcgtggagggg

SEQ ID NO: 7714638 - DNA, 22 bp, Homo sapiens
tgagcctggagtcgtggagggg

SEQ ID NO: 7714639 - DNA, 22 bp, Homo sapiens
tgagcctggagcccagatgttt

SEQ ID NO: 7714640 - DNA, 22 bp, Homo sapiens
tgagcctggagtcgtggagggg

SEQ ID NO: 7714641 - DNA, 22 bp, Homo sapiens
tgagcctggagcccagatgttt

SEQ ID NO: 7714642 - DNA, 22 bp, Homo sapiens
tgagcctgctgtcgctggaccc

SEQ ID NO: 7714643 - DNA, 22 bp, Homo sapiens
tgagcctgctgtcgctggaccc

SEQ ID NO: 7714644 - DNA, 22 bp, Homo sapiens
tgagcctgctgtcgctggaccc

SEQ ID NO: 7714645 - DNA, 22 bp, Homo sapiens
tgagcctggcctgcagagacca

SEQ ID NO: 7714646 - DNA, 22 bp, Homo sapiens
tgagcctggagtcgtggagggg

SEQ ID NO: 7714647 - DNA, 22 bp, Homo sapiens
tgagcctggcggaagcagcgtg

SEQ ID NO: 7714648 - DNA, 22 bp, Homo sapiens
tgagcctggcggaagcagcgtg

SEQ ID NO: 7714649 - DNA, 22 bp, Homo sapiens
tgagcctggcctgcagagacca

SEQ ID NO: 7714650 - DNA, 22 bp, Homo sapiens
tgagcctggcctgcagagacca

SEQ ID NO: 7714651 - DNA, 22 bp, Homo sapiens
tgagcctggcggaagcagcgtg

SEQ ID NO: 7714652 - DNA, 22 bp, Homo sapiens
tgagccctaagggtcaagcagg

SEQ ID NO: 7714653 - DNA, 22 bp, Homo sapiens
tgagccctaagggtcaagcagg

SEQ ID NO: 7714654 - DNA, 22 bp, Homo sapiens
tgagccccggagtttcaggctg

SEQ ID NO: 7714655 - DNA, 22 bp, Homo sapiens
tgagccctacctgctcatctcc

SEQ ID NO: 7714656 - DNA, 22 bp, Homo sapiens
tgagccctccaaacccaggatt

SEQ ID NO: 7714657 - DNA, 22 bp, Homo sapiens
tgagccctcggctggggcagag

SEQ ID NO: 7714658 - DNA, 22 bp, Homo sapiens
tgagcccatgtagcacttccat

SEQ ID NO: 7714659 - DNA, 22 bp, Homo sapiens
tgagcccatgctctttctacga

SEQ ID NO: 7714660 - DNA, 22 bp, Homo sapiens
tgagccagtggaagatggcagt

SEQ ID NO: 7714661 - DNA, 22 bp, Homo sapiens
tgagcccagtctgtctgacatg

SEQ ID NO: 7714662 - DNA, 23 bp, Homo sapiens
tgagcccagttttccctcttgcc

SEQ ID NO: 7714663 - DNA, 23 bp, Homo sapiens
tgagcccagttttccctcttgcc

SEQ ID NO: 7714664 - DNA, 23 bp, Homo sapiens
tgagcccagttttccctcttgcc

SEQ ID NO: 7714665 - DNA, 22 bp, Homo sapiens
tgagccccggagtttcaggctg

SEQ ID NO: 7714666 - DNA, 22 bp, Homo sapiens
tgagcccatgtagcacttccat

SEQ ID NO: 7714667 - DNA, 22 bp, Homo sapiens
tgagcccatgctctttctacga

SEQ ID NO: 7714668 - DNA, 22 bp, Homo sapiens
tgagcctctaccacaggtggaa

SEQ ID NO: 7714669 - DNA, 22 bp, Homo sapiens
tgagccgtggtctctgagggtg

SEQ ID NO: 7714670 - DNA, 22 bp, Homo sapiens
tgagccgtggtctctgagggtg

SEQ ID NO: 7714671 - DNA, 22 bp, Homo sapiens
tgagccgtggtctctgagggtg

SEQ ID NO: 7714672 - DNA, 22 bp, Homo sapiens
tgagccgtggtctctgagggtg

SEQ ID NO: 7714673 - DNA, 21 bp, Homo sapiens
tgagcccttgcctcagagccc

SEQ ID NO: 7714674 - DNA, 22 bp, Homo sapiens
tgagcccttgacatcgcccact

SEQ ID NO: 7714675 - DNA, 22 bp, Homo sapiens
tgagccctcggctggggcagag

SEQ ID NO: 7714676 - DNA, 22 bp, Homo sapiens
tgagccctcggctggggcagag

SEQ ID NO: 7714677 - DNA, 22 bp, Homo sapiens
tgagccctggagccctctgtta

SEQ ID NO: 7714678 - DNA, 22 bp, Homo sapiens
tgagccctgtgactgctttgag

SEQ ID NO: 7714679 - DNA, 22 bp, Homo sapiens
tgagccctgtgactgctttgag

SEQ ID NO: 7714680 - DNA, 18 bp, Homo sapiens
tgagcccttatctttggc

SEQ ID NO: 7714681 - DNA, 22 bp, Homo sapiens
tgagccagtggaagatggcagt

SEQ ID NO: 7714682 - DNA, 22 bp, Homo sapiens
tgagccagtctgtctgggtgaa

SEQ ID NO: 7714683 - DNA, 22 bp, Homo sapiens
tgagccagtggaagatggcagt

SEQ ID NO: 7714684 - DNA, 22 bp, Homo sapiens
tgagcccagtctgtctgacatg

SEQ ID NO: 7714685 - DNA, 22 bp, Homo sapiens
tgagccagtctgtctgggtgaa

SEQ ID NO: 7714686 - DNA, 22 bp, Homo sapiens
tgagcccagtctgtctgacatg

SEQ ID NO: 7714687 - DNA, 22 bp, Homo sapiens
tgagccagtctgtctgggtgaa

SEQ ID NO: 7714688 - DNA, 22 bp, Homo sapiens
tgagccagtctgtctgggtgaa

SEQ ID NO: 7714689 - DNA, 22 bp, Homo sapiens
tgagccagtctctcagaaccct

SEQ ID NO: 7714690 - DNA, 22 bp, Homo sapiens
tgagccagtctctcagaaccct

SEQ ID NO: 7714691 - DNA, 22 bp, Homo sapiens
tgagccagtctctcagaaccct

SEQ ID NO: 7714692 - DNA, 22 bp, Homo sapiens
tgagccaggttaagacaggagc

SEQ ID NO: 7714693 - DNA, 22 bp, Homo sapiens
tgagccaggtctcactcacctt

SEQ ID NO: 7714694 - DNA, 22 bp, Homo sapiens
tgagccaggtctcactcacctt

SEQ ID NO: 7714695 - DNA, 22 bp, Homo sapiens
tgagccaggttaagacaggagc

SEQ ID NO: 7714696 - DNA, 22 bp, Homo sapiens
tgagccaggttaagacaggagc

SEQ ID NO: 7714697 - DNA, 22 bp, Homo sapiens
tgagccaggttaagacaggagc

SEQ ID NO: 7714698 - DNA, 22 bp, Homo sapiens
tgagccaggttttccatcattc

SEQ ID NO: 7714699 - DNA, 22 bp, Homo sapiens
tgagccaggttaagacaggagc

SEQ ID NO: 7714700 - DNA, 22 bp, Homo sapiens
tgagccaggttttccatcattc

SEQ ID NO: 7714701 - DNA, 22 bp, Homo sapiens
tgagccaggttttccatcattc

SEQ ID NO: 7714702 - DNA, 20 bp, Homo sapiens
tgagccagtcaagctacatt

SEQ ID NO: 7714703 - DNA, 22 bp, Homo sapiens
tgagccaggttttccatcattc

SEQ ID NO: 7714704 - DNA, 20 bp, Homo sapiens
tgagccagtcaagctacatt

SEQ ID NO: 7714705 - DNA, 20 bp, Homo sapiens
tgagccagtcaagctacatt

SEQ ID NO: 7714706 - DNA, 22 bp, Homo sapiens
tgaagcgtgacccctcacctct

SEQ ID NO: 7714707 - DNA, 19 bp, Homo sapiens
tgaagcgtcgctcctcttc

SEQ ID NO: 7714708 - DNA, 17 bp, Homo sapiens
tgaagcgtgcctttgaa

SEQ ID NO: 7714709 - DNA, 22 bp, Homo sapiens
tgaagctacaaaagattattgc

SEQ ID NO: 7714710 - DNA, 22 bp, Homo sapiens
tgaagctagaatgtccatattt

SEQ ID NO: 7714711 - DNA, 22 bp, Homo sapiens
tgaagctagtcaagcttagata

SEQ ID NO: 7714712 - DNA, 22 bp, Homo sapiens
tgaagctagcaggaagagcagg

SEQ ID NO: 7714713 - DNA, 22 bp, Homo sapiens
tgaagctatataagttacagca

SEQ ID NO: 7714714 - DNA, 22 bp, Homo sapiens
tgaagctatataagttacagca

SEQ ID NO: 7714715 - DNA, 22 bp, Homo sapiens
tgaagccctgtgtcagcttcca

SEQ ID NO: 7714716 - DNA, 22 bp, Homo sapiens
tgaagcccctaagtcccaggca

SEQ ID NO: 7714717 - DNA, 22 bp, Homo sapiens
tgaagccctgtcttatggaaga

SEQ ID NO: 7714718 - DNA, 22 bp, Homo sapiens
tgaagccctgtgataggtccag

SEQ ID NO: 7714719 - DNA, 22 bp, Homo sapiens
tgaagccctgtgtcagcttcca

SEQ ID NO: 7714720 - DNA, 22 bp, Homo sapiens
tgaagcccttcatgcacagtca

SEQ ID NO: 7714721 - DNA, 22 bp, Homo sapiens
tgaagcccttcatgcacagtca

SEQ ID NO: 7714722 - DNA, 22 bp, Homo sapiens
tgaagcctcacctgctcagtat

SEQ ID NO: 7714723 - DNA, 21 bp, Homo sapiens
tgaagcctgaggcatagcccc

SEQ ID NO: 7714724 - DNA, 20 bp, Homo sapiens
tgaagccttgggcattgatg

SEQ ID NO: 7714725 - DNA, 20 bp, Homo sapiens
tgaagccttgggcattgatg

SEQ ID NO: 7714726 - DNA, 22 bp, Homo sapiens
tgaagccatccctcagatggcc

SEQ ID NO: 7714727 - DNA, 22 bp, Homo sapiens
tgaagccatccctcagatggcc

SEQ ID NO: 7714728 - DNA, 22 bp, Homo sapiens
tgaagccatcaggaagccagca

SEQ ID NO: 7714729 - DNA, 22 bp, Homo sapiens
tgaagccatcaggaagccagca

SEQ ID NO: 7714730 - DNA, 22 bp, Homo sapiens
tgaagccatcaggaagccagca

SEQ ID NO: 7714731 - DNA, 22 bp, Homo sapiens
tgaagcccaggaatctacattt

SEQ ID NO: 7714732 - DNA, 23 bp, Homo sapiens
tgaagcccagtgattttgtttca

SEQ ID NO: 7714733 - DNA, 23 bp, Homo sapiens
tgaagcccagtgattttgtttca

SEQ ID NO: 7714734 - DNA, 22 bp, Homo sapiens
tgaagcccaaggcactgtctga

SEQ ID NO: 7714735 - DNA, 22 bp, Homo sapiens
tgaagccattactgtgttaggg

SEQ ID NO: 7714736 - DNA, 22 bp, Homo sapiens
tgaagccatctcagagtcaaga

SEQ ID NO: 7714737 - DNA, 22 bp, Homo sapiens
tgaagcagttctcagaagtggg

SEQ ID NO: 7714738 - DNA, 22 bp, Homo sapiens
tgaagcagttctcagaagtggg

SEQ ID NO: 7714739 - DNA, 22 bp, Homo sapiens
tgaagcagttctcagaagtggg

SEQ ID NO: 7714740 - DNA, 22 bp, Homo sapiens
tgaagcataagagggttctttt

SEQ ID NO: 7714741 - DNA, 22 bp, Homo sapiens
tgaagcagttctcagaagtggg

SEQ ID NO: 7714742 - DNA, 22 bp, Homo sapiens
tgaagcagttctcagaagtggg

SEQ ID NO: 7714743 - DNA, 22 bp, Homo sapiens
tgaagccaaggatgcctttctc

SEQ ID NO: 7714744 - DNA, 22 bp, Homo sapiens
tgaagccaatctgccaggcaga

SEQ ID NO: 7714745 - DNA, 22 bp, Homo sapiens
tgaagcatctggtctgagaatt

SEQ ID NO: 7714746 - DNA, 22 bp, Homo sapiens
tgaagccacagagcatctgcct

SEQ ID NO: 7714747 - DNA, 22 bp, Homo sapiens
tgaagccacagagcatctgcct

SEQ ID NO: 7714748 - DNA, 22 bp, Homo sapiens
tgaagccacagagcatctgcct

SEQ ID NO: 7714749 - DNA, 22 bp, Homo sapiens
tgaagccacactagcttgtcct

SEQ ID NO: 7714750 - DNA, 22 bp, Homo sapiens
tgaagccacactagcttgtcct

SEQ ID NO: 7714751 - DNA, 22 bp, Homo sapiens
tgaagccaaggatgcctttctc

SEQ ID NO: 7714752 - DNA, 22 bp, Homo sapiens
tgaagccaaggatgcctttctc

SEQ ID NO: 7714753 - DNA, 22 bp, Homo sapiens
tgaagccaatctgccaggcaga

SEQ ID NO: 7714754 - DNA, 22 bp, Homo sapiens
tgaagccacactagcttgtcct

SEQ ID NO: 7714755 - DNA, 22 bp, Homo sapiens
tgaagccaatctgccaggcaga

SEQ ID NO: 7714756 - DNA, 22 bp, Homo sapiens
tgaagccaatctgccaggcaga

SEQ ID NO: 7714757 - DNA, 22 bp, Homo sapiens
tgaagccagtcaatgttaagtt

SEQ ID NO: 7714758 - DNA, 21 bp, Homo sapiens
tgaagccaggatcacgattct

SEQ ID NO: 7714759 - DNA, 22 bp, Homo sapiens
tgaagccagggactgacacttc

SEQ ID NO: 7714760 - DNA, 22 bp, Homo sapiens
tgaagccagggactgacacttc

SEQ ID NO: 7714761 - DNA, 22 bp, Homo sapiens
tgaagccataggacagaggata

SEQ ID NO: 7714762 - DNA, 22 bp, Homo sapiens
tgaagccactttccagaatcac

SEQ ID NO: 7714763 - DNA, 22 bp, Homo sapiens
tgaagccactttccagaatcac

SEQ ID NO: 7714764 - DNA, 22 bp, Homo sapiens
tgaagccactttccagaatcac

SEQ ID NO: 7714765 - DNA, 22 bp, Homo sapiens
tgaagccactttccagaatcac

SEQ ID NO: 7714766 - DNA, 22 bp, Homo sapiens
tgaagccacagagcatctgcct

SEQ ID NO: 7714767 - DNA, 22 bp, Homo sapiens
tgaagccaccgaaccagaagag

SEQ ID NO: 7714768 - DNA, 22 bp, Homo sapiens
tgaaggcacagtttaaccagta

SEQ ID NO: 7714769 - DNA, 22 bp, Homo sapiens
tgaaggcacgtgggtggatact

SEQ ID NO: 7714770 - DNA, 22 bp, Homo sapiens
tgaaggcacgtgggtggatact

SEQ ID NO: 7714771 - DNA, 22 bp, Homo sapiens
tgaaggcacttgcctaggggca

SEQ ID NO: 7714772 - DNA, 22 bp, Homo sapiens
tgaaggcacgtgggtggatact

SEQ ID NO: 7714773 - DNA, 22 bp, Homo sapiens
tgaaggcacgtgggtggatact

SEQ ID NO: 7714774 - DNA, 22 bp, Homo sapiens
tgaaggcacttgcctaggggca

SEQ ID NO: 7714775 - DNA, 22 bp, Homo sapiens
tgaaggcaacctctgtggtcct

SEQ ID NO: 7714776 - DNA, 22 bp, Homo sapiens
tgaaggcaacctctgtggtcct

SEQ ID NO: 7714777 - DNA, 22 bp, Homo sapiens
tgaaggcaactgagaaaaagca

SEQ ID NO: 7714778 - DNA, 22 bp, Homo sapiens
tgaaggcaactgagaaaaagca

SEQ ID NO: 7714779 - DNA, 22 bp, Homo sapiens
tgaaggcaaaacatgttacacc

SEQ ID NO: 7714780 - DNA, 22 bp, Homo sapiens
tgaaggcaaaacatgttacacc

SEQ ID NO: 7714781 - DNA, 22 bp, Homo sapiens
tgaaggagctgatgtaaggggt

SEQ ID NO: 7714782 - DNA, 22 bp, Homo sapiens
tgaaggaggaatgtggcctcca

SEQ ID NO: 7714783 - DNA, 22 bp, Homo sapiens
tgaaggagggaagaaggctctg

SEQ ID NO: 7714784 - DNA, 22 bp, Homo sapiens
tgaaggaggaatgtggcctcca

SEQ ID NO: 7714785 - DNA, 22 bp, Homo sapiens
tgaaggaggaatgtggcctcca

SEQ ID NO: 7714786 - DNA, 19 bp, Homo sapiens
tgaaggagggggatggcca

SEQ ID NO: 7714787 - DNA, 19 bp, Homo sapiens
tgaaggagggggatggcca

SEQ ID NO: 7714788 - DNA, 19 bp, Homo sapiens
tgaaggagggggatggcca

SEQ ID NO: 7714789 - DNA, 22 bp, Homo sapiens
tgaaggaggaatgtggcctcca

SEQ ID NO: 7714790 - DNA, 22 bp, Homo sapiens
tgaaggagggaagaaggctctg

SEQ ID NO: 7714791 - DNA, 22 bp, Homo sapiens
tgaaggagggaagaaggctctg

SEQ ID NO: 7714792 - DNA, 19 bp, Homo sapiens
tgaaggagggggatggcca

SEQ ID NO: 7714793 - DNA, 22 bp, Homo sapiens
tgaaggagggaagaaggctctg

SEQ ID NO: 7714794 - DNA, 22 bp, Homo sapiens
tgaagctgtaggcatgggcagc

SEQ ID NO: 7714795 - DNA, 22 bp, Homo sapiens
tgaagctgtgggcagtggagcc

SEQ ID NO: 7714796 - DNA, 22 bp, Homo sapiens
tgaagctgtgggcagtggagcc

SEQ ID NO: 7714797 - DNA, 22 bp, Homo sapiens
tgaagctgtccttgataggggc

SEQ ID NO: 7714798 - DNA, 22 bp, Homo sapiens
tgaagctgtccttgataggggc

SEQ ID NO: 7714799 - DNA, 22 bp, Homo sapiens
tgaagctgtgggcagtggagcc

SEQ ID NO: 7714800 - DNA, 22 bp, Homo sapiens
tgaagctgcctgctcacagcca

SEQ ID NO: 7714801 - DNA, 22 bp, Homo sapiens
tgaagctgcctgctcacagcca

SEQ ID NO: 7714802 - DNA, 22 bp, Homo sapiens
tgaagctgcctgctcacagcca

SEQ ID NO: 7714803 - DNA, 22 bp, Homo sapiens
tgaagctgcctgctcacagcca

SEQ ID NO: 7714804 - DNA, 22 bp, Homo sapiens
tgaagctggaagcatgcagact

SEQ ID NO: 7714805 - DNA, 22 bp, Homo sapiens
tgaagctggaagcatgcagact

SEQ ID NO: 7714806 - DNA, 22 bp, Homo sapiens
tgaagctggaagttaggtagac

SEQ ID NO: 7714807 - DNA, 22 bp, Homo sapiens
tgaagctggttgtatgactgga

SEQ ID NO: 7714808 - DNA, 22 bp, Homo sapiens
tgaagctggcttgacatggcct

SEQ ID NO: 7714809 - DNA, 22 bp, Homo sapiens
tgaaggagctgatgtaaggggt

SEQ ID NO: 7714810 - DNA, 22 bp, Homo sapiens
tgaaggagctgatgtaaggggt

SEQ ID NO: 7714811 - DNA, 22 bp, Homo sapiens
tgaaggagctcaggagatagtc

SEQ ID NO: 7714812 - DNA, 22 bp, Homo sapiens
tgaaggagctcaggagatagtc

SEQ ID NO: 7714813 - DNA, 22 bp, Homo sapiens
tgaaggagctcaggagatagtc

SEQ ID NO: 7714814 - DNA, 22 bp, Homo sapiens
tgaaggagctcaggagatagtc

SEQ ID NO: 7714815 - DNA, 22 bp, Homo sapiens
tgaaggagctcaatgatgatgc

SEQ ID NO: 7714816 - DNA, 22 bp, Homo sapiens
tgaaggagatttttagggaggc

SEQ ID NO: 7714817 - DNA, 22 bp, Homo sapiens
tgaagcttgtatttaaataagt

SEQ ID NO: 7714818 - DNA, 22 bp, Homo sapiens
tgaaggagatttttagggaggc

SEQ ID NO: 7714819 - DNA, 22 bp, Homo sapiens
tgaaggagatttttagggaggc

SEQ ID NO: 7714820 - DNA, 22 bp, Homo sapiens
tgaagcttgtatttaaataagt

SEQ ID NO: 7714821 - DNA, 22 bp, Homo sapiens
tgaagggcaaccccaggcccag

SEQ ID NO: 7714822 - DNA, 22 bp, Homo sapiens
tgaagggcaaccccaggcccag

SEQ ID NO: 7714823 - DNA, 22 bp, Homo sapiens
tgaaggcttggtggcagcctct

SEQ ID NO: 7714824 - DNA, 22 bp, Homo sapiens
tgaaggcttggtggcagcctct

SEQ ID NO: 7714825 - DNA, 22 bp, Homo sapiens
tgaaggcttggattggtcattt

SEQ ID NO: 7714826 - DNA, 22 bp, Homo sapiens
tgaaggcttggattggtcattt

SEQ ID NO: 7714827 - DNA, 22 bp, Homo sapiens
tgaaggcttggattggtcattt

SEQ ID NO: 7714828 - DNA, 22 bp, Homo sapiens
tgaaggcttggtggcagcctct

SEQ ID NO: 7714829 - DNA, 22 bp, Homo sapiens
tgaaggctgggctcagccagct

SEQ ID NO: 7714830 - DNA, 22 bp, Homo sapiens
tgaaggcctccccgagcattag

SEQ ID NO: 7714831 - DNA, 22 bp, Homo sapiens
tgaaggcttgactgaggcagga

SEQ ID NO: 7714832 - DNA, 22 bp, Homo sapiens
tgaaggcttgactgaggcagga

SEQ ID NO: 7714833 - DNA, 22 bp, Homo sapiens
tgaaggggttcagcatgggggt

SEQ ID NO: 7714834 - DNA, 22 bp, Homo sapiens
tgaaggggttcagcatgggggt

SEQ ID NO: 7714835 - DNA, 22 bp, Homo sapiens
tgaaggggttcagcatgggggt

SEQ ID NO: 7714836 - DNA, 22 bp, Homo sapiens
tgaaggggttcagcatgggggt

SEQ ID NO: 7714837 - DNA, 21 bp, Homo sapiens
tgaaggggtggcagtgtgctt

SEQ ID NO: 7714838 - DNA, 22 bp, Homo sapiens
tgaaggtaatggaatctcctga

SEQ ID NO: 7714839 - DNA, 22 bp, Homo sapiens
tgaaggtaaaggaaggaggctt

SEQ ID NO: 7714840 - DNA, 22 bp, Homo sapiens
tgaaggggttcagcatgggggt

SEQ ID NO: 7714841 - DNA, 21 bp, Homo sapiens
tgaaggggtggcagtgtgctt

SEQ ID NO: 7714842 - DNA, 21 bp, Homo sapiens
tgaagggcagcctcaggctcc

SEQ ID NO: 7714843 - DNA, 21 bp, Homo sapiens
tgaaggggtggcagtgtgctt

SEQ ID NO: 7714844 - DNA, 21 bp, Homo sapiens
tgaaggggtggcagtgtgctt

SEQ ID NO: 7714845 - DNA, 21 bp, Homo sapiens
tgaaggggccatcacaaaggc

SEQ ID NO: 7714846 - DNA, 21 bp, Homo sapiens
tgaaggggccatcacaaaggc

SEQ ID NO: 7714847 - DNA, 22 bp, Homo sapiens
tgaagggggagatatatgtgtg

SEQ ID NO: 7714848 - DNA, 22 bp, Homo sapiens
tgaagggggagatatatgtgtg

SEQ ID NO: 7714849 - DNA, 21 bp, Homo sapiens
tgaagggcagcctcaggctcc

SEQ ID NO: 7714850 - DNA, 21 bp, Homo sapiens
tgaagggcagcctcaggctcc

SEQ ID NO: 7714851 - DNA, 21 bp, Homo sapiens
tgaagggcagcctcaggctcc

SEQ ID NO: 7714852 - DNA, 22 bp, Homo sapiens
tgaagggcaaccccaggcccag

SEQ ID NO: 7714853 - DNA, 22 bp, Homo sapiens
tgaagggcaaccccaggcccag

SEQ ID NO: 7714854 - DNA, 22 bp, Homo sapiens
tgaaggcataaatcttgggaac

SEQ ID NO: 7714855 - DNA, 22 bp, Homo sapiens
tgaaggcataaatcttgggaac

SEQ ID NO: 7714856 - DNA, 22 bp, Homo sapiens
tgaaggcattgatgaaggaatc

SEQ ID NO: 7714857 - DNA, 22 bp, Homo sapiens
tgaaggcataaatcttgggaac

SEQ ID NO: 7714858 - DNA, 22 bp, Homo sapiens
tgaaggcataaatcttgggaac

SEQ ID NO: 7714859 - DNA, 22 bp, Homo sapiens
tgaaggcattgatgaaggaatc

SEQ ID NO: 7714860 - DNA, 22 bp, Homo sapiens
tgaaggcattgatgaaggaatc

SEQ ID NO: 7714861 - DNA, 22 bp, Homo sapiens
tgaaggcattgatgaaggaatc

SEQ ID NO: 7714862 - DNA, 22 bp, Homo sapiens
tgaaggcatttgagttggtgag

SEQ ID NO: 7714863 - DNA, 22 bp, Homo sapiens
tgaaggcatttgagttggtgag

SEQ ID NO: 7714864 - DNA, 22 bp, Homo sapiens
tgaaggcagtgagtttgtgttt

SEQ ID NO: 7714865 - DNA, 20 bp, Homo sapiens
tgaaggcaggtaagaaagat

SEQ ID NO: 7714866 - DNA, 22 bp, Homo sapiens
tgaaggcagcatgcacactagt

SEQ ID NO: 7714867 - DNA, 22 bp, Homo sapiens
tgaaggcagcatgcacactagt

SEQ ID NO: 7714868 - DNA, 22 bp, Homo sapiens
tgaaggcacttgcctaggggca

SEQ ID NO: 7714869 - DNA, 22 bp, Homo sapiens
tgaaggcagcatgcacactagt

SEQ ID NO: 7714870 - DNA, 23 bp, Homo sapiens
tgaaggccctggagccacgaggc

SEQ ID NO: 7714871 - DNA, 22 bp, Homo sapiens
tgaaggcctaacttccagtgct

SEQ ID NO: 7714872 - DNA, 23 bp, Homo sapiens
tgaaggccctggagccacgaggc

SEQ ID NO: 7714873 - DNA, 22 bp, Homo sapiens
tgaaggcccagccacagaatgg

SEQ ID NO: 7714874 - DNA, 22 bp, Homo sapiens
tgaaggcccagccacagaatgg

SEQ ID NO: 7714875 - DNA, 20 bp, Homo sapiens
tgaaggccctataattcaat

SEQ ID NO: 7714876 - DNA, 22 bp, Homo sapiens
tgaaggccacttcctgtgagct

SEQ ID NO: 7714877 - DNA, 22 bp, Homo sapiens
tgaaggccagcagagtgaaggc

SEQ ID NO: 7714878 - DNA, 22 bp, Homo sapiens
tgaaggccacttcctgtgagct

SEQ ID NO: 7714879 - DNA, 22 bp, Homo sapiens
tgaaggcatttgagttggtgag

SEQ ID NO: 7714880 - DNA, 22 bp, Homo sapiens
tgaaggccagggatttgcagcc

SEQ ID NO: 7714881 - DNA, 22 bp, Homo sapiens
tgaaggccagggatttgcagcc

SEQ ID NO: 7714882 - DNA, 20 bp, Homo sapiens
tgaaggccagcagcataggg

SEQ ID NO: 7714883 - DNA, 22 bp, Homo sapiens
tgaaggccagcagagtgaaggc

SEQ ID NO: 7714884 - DNA, 22 bp, Homo sapiens
tgaagtttgaactgtgttgctg

SEQ ID NO: 7714885 - DNA, 22 bp, Homo sapiens
tgaagtttggtggaaatttcct

SEQ ID NO: 7714886 - DNA, 22 bp, Homo sapiens
tgaagtttcctctgaggccagt

SEQ ID NO: 7714887 - DNA, 22 bp, Homo sapiens
tgaagtttcttgaatcttggag

SEQ ID NO: 7714888 - DNA, 22 bp, Homo sapiens
tgaagtttcttgaatcttggag

SEQ ID NO: 7714889 - DNA, 22 bp, Homo sapiens
tgaagtttcacgcgtcattcaa

SEQ ID NO: 7714890 - DNA, 22 bp, Homo sapiens
tgaagtttcacgcgtcattcaa

SEQ ID NO: 7714891 - DNA, 22 bp, Homo sapiens
tgaagtttaattttggacatga

SEQ ID NO: 7714892 - DNA, 22 bp, Homo sapiens
tgaagtttataacatagcctcc

SEQ ID NO: 7714893 - DNA, 22 bp, Homo sapiens
tgaagtttaaggttagataagt

SEQ ID NO: 7714894 - DNA, 22 bp, Homo sapiens
tgaagtttaaggttagataagt

SEQ ID NO: 7714895 - DNA, 22 bp, Homo sapiens
tgaagtttaaggttagataagt

SEQ ID NO: 7714896 - DNA, 22 bp, Homo sapiens
tgaaggtggggcttaggaatct

SEQ ID NO: 7714897 - DNA, 22 bp, Homo sapiens
tgaaggtgacctgacagtggct

SEQ ID NO: 7714898 - DNA, 22 bp, Homo sapiens
tgaaggtgaatgtctatgggga

SEQ ID NO: 7714899 - DNA, 22 bp, Homo sapiens
tgaaggtacagatattttgtaa

SEQ ID NO: 7714900 - DNA, 23 bp, Homo sapiens
tgaaggtattacctgagatgctc

SEQ ID NO: 7714901 - DNA, 22 bp, Homo sapiens
tgaaggtgaatgtctatgggga

SEQ ID NO: 7714902 - DNA, 22 bp, Homo sapiens
tgaaggtgaaagattgaagcca

SEQ ID NO: 7714903 - DNA, 22 bp, Homo sapiens
tgaaggtgggaattcaccaggt

SEQ ID NO: 7714904 - DNA, 22 bp, Homo sapiens
tgaaggtgggaattcaccaggt

SEQ ID NO: 7714905 - DNA, 22 bp, Homo sapiens
tgaaggtggcataggagagatg

SEQ ID NO: 7714906 - DNA, 22 bp, Homo sapiens
tgaaggtggcataggagagatg

SEQ ID NO: 7714907 - DNA, 22 bp, Homo sapiens
tgaaggtggcataggagagatg

SEQ ID NO: 7714908 - DNA, 22 bp, Homo sapiens
tgaaggtgattatgaatgtata

SEQ ID NO: 7714909 - DNA, 22 bp, Homo sapiens
tgaaggtgagcatttgctgatt

SEQ ID NO: 7714910 - DNA, 22 bp, Homo sapiens
tgaagttttactaggtgaattt

SEQ ID NO: 7714911 - DNA, 22 bp, Homo sapiens
tgaagttttactaggtgaattt

SEQ ID NO: 7714912 - DNA, 22 bp, Homo sapiens
tgaagttttacatcctctccaa

SEQ ID NO: 7714913 - DNA, 22 bp, Homo sapiens
tgaagttttacatcctctccaa

SEQ ID NO: 7714914 - DNA, 22 bp, Homo sapiens
tgaagtttggtggaaatttcct

SEQ ID NO: 7714915 - DNA, 22 bp, Homo sapiens
tgaagttttactaggtgaattt

SEQ ID NO: 7714916 - DNA, 22 bp, Homo sapiens
tgaagttttactaggtgaattt

SEQ ID NO: 7714917 - DNA, 22 bp, Homo sapiens
tgaagttttctggttgattaag

SEQ ID NO: 7714918 - DNA, 22 bp, Homo sapiens
tgaagttttctggttgattaag

SEQ ID NO: 7714919 - DNA, 22 bp, Homo sapiens
tgaagttttctggttgattaag

SEQ ID NO: 7714920 - DNA, 22 bp, Homo sapiens
tgaagttttctggttgattaag

SEQ ID NO: 7714921 - DNA, 22 bp, Homo sapiens
tgaagttttctggttgattaag

SEQ ID NO: 7714922 - DNA, 22 bp, Homo sapiens
tgaagtttttccagacaagtcc

SEQ ID NO: 7714923 - DNA, 22 bp, Homo sapiens
tgaataaactatgaggaggaat

SEQ ID NO: 7714924 - DNA, 22 bp, Homo sapiens
tgaagtttttccagacaagtcc

SEQ ID NO: 7714925 - DNA, 22 bp, Homo sapiens
tgaataaactatgaggaggaat

SEQ ID NO: 7714926 - DNA, 22 bp, Homo sapiens
tgaataaactatgaggaggaat

SEQ ID NO: 7714927 - DNA, 22 bp, Homo sapiens
tgaataaactatgaggaggaat

SEQ ID NO: 7714928 - DNA, 21 bp, Homo sapiens
tgaataaagctgctgtcgata

SEQ ID NO: 7714929 - DNA, 21 bp, Homo sapiens
tgaataaagctgctgtcgata

SEQ ID NO: 7714930 - DNA, 22 bp, Homo sapiens
tgaataaatcaaagactgccct

SEQ ID NO: 7714931 - DNA, 22 bp, Homo sapiens
tgaataaattgagagcgaatgt

SEQ ID NO: 7714932 - DNA, 22 bp, Homo sapiens
tgaataaattgagagcgaatgt

SEQ ID NO: 7714933 - DNA, 22 bp, Homo sapiens
tgaataaattgagagcgaatgt

SEQ ID NO: 7714934 - DNA, 22 bp, Homo sapiens
tgaataagaattattataatga

SEQ ID NO: 7714935 - DNA, 22 bp, Homo sapiens
tgaataatccacagtcattcat

SEQ ID NO: 7714936 - DNA, 22 bp, Homo sapiens
tgaataatccacagtcattcat

SEQ ID NO: 7714937 - DNA, 22 bp, Homo sapiens
tgaataatcatgtccatagtgt

SEQ ID NO: 7714938 - DNA, 22 bp, Homo sapiens
tgaataatcatgtccatagtgt

SEQ ID NO: 7714939 - DNA, 22 bp, Homo sapiens
tgaataagtgatgtcatatata

SEQ ID NO: 7714940 - DNA, 19 bp, Homo sapiens
tgaataacaataatggcta

SEQ ID NO: 7714941 - DNA, 22 bp, Homo sapiens
tgaataatccacagtcattcat

SEQ ID NO: 7714942 - DNA, 22 bp, Homo sapiens
tgaataatccacagtcattcat

SEQ ID NO: 7714943 - DNA, 22 bp, Homo sapiens
tgaataatcttgggtattaata

SEQ ID NO: 7714944 - DNA, 22 bp, Homo sapiens
tgaataatcttgggtattaata

SEQ ID NO: 7714945 - DNA, 22 bp, Homo sapiens
tgaataatcttgggtattaata

SEQ ID NO: 7714946 - DNA, 22 bp, Homo sapiens
tgaataatcttgggtattaata

SEQ ID NO: 7714947 - DNA, 22 bp, Homo sapiens
tgacaaagtgctagtcggtgaa

SEQ ID NO: 7714948 - DNA, 22 bp, Homo sapiens
tgacaaagtgaggtcttcagta

SEQ ID NO: 7714949 - DNA, 22 bp, Homo sapiens
tgacaaagtgaggtcttcagta

SEQ ID NO: 7714950 - DNA, 22 bp, Homo sapiens
tgacaaagtgaggtcttcagta

SEQ ID NO: 7714951 - DNA, 23 bp, Homo sapiens
tgacaaagtcatctctccttctt

SEQ ID NO: 7714952 - DNA, 23 bp, Homo sapiens
tgacaaagtcatctctccttctt

SEQ ID NO: 7714953 - DNA, 20 bp, Homo sapiens
tgacaaagtcccttcttttc

SEQ ID NO: 7714954 - DNA, 20 bp, Homo sapiens
tgacaaagtcccttcttttc

SEQ ID NO: 7714955 - DNA, 22 bp, Homo sapiens
tgacaaatacaataagatctgt

SEQ ID NO: 7714956 - DNA, 22 bp, Homo sapiens
tgacaaatacaataagatctgt

SEQ ID NO: 7714957 - DNA, 22 bp, Homo sapiens
tgacaaagtggttgtttggttg

SEQ ID NO: 7714958 - DNA, 22 bp, Homo sapiens
tgacaaagtggttgtttggttg

SEQ ID NO: 7714959 - DNA, 22 bp, Homo sapiens
tgacaaatacaataagatctgt

SEQ ID NO: 7714960 - DNA, 23 bp, Homo sapiens
tgacaaagtggtcgttcaaggtg

SEQ ID NO: 7714961 - DNA, 20 bp, Homo sapiens
tgacaaatgatctgattttc

SEQ ID NO: 7714962 - DNA, 20 bp, Homo sapiens
tgacaaatgatctgattttc

SEQ ID NO: 7714963 - DNA, 22 bp, Homo sapiens
tgacaaatatttgaagaggctg

SEQ ID NO: 7714964 - DNA, 22 bp, Homo sapiens
tgacaaatgttaattcagtgga

SEQ ID NO: 7714965 - DNA, 22 bp, Homo sapiens
tgacaaatgttaattcagtgga

SEQ ID NO: 7714966 - DNA, 22 bp, Homo sapiens
tgacaaatacaataagatctgt

SEQ ID NO: 7714967 - DNA, 22 bp, Homo sapiens
tgacaaatatttgaagaggctg

SEQ ID NO: 7714968 - DNA, 22 bp, Homo sapiens
tgacaaatatttgaagaggctg

SEQ ID NO: 7714969 - DNA, 20 bp, Homo sapiens
tgacacaaattgctttctca

SEQ ID NO: 7714970 - DNA, 20 bp, Homo sapiens
tgacacaaattgctttctca

SEQ ID NO: 7714971 - DNA, 22 bp, Homo sapiens
tgacacaattgagtggtactat

SEQ ID NO: 7714972 - DNA, 22 bp, Homo sapiens
tgacacaaacaagatatttgcc

SEQ ID NO: 7714973 - DNA, 22 bp, Homo sapiens
tgacacaaaggaaagcataatc

SEQ ID NO: 7714974 - DNA, 22 bp, Homo sapiens
tgacacaaaggaaagcataatc

SEQ ID NO: 7714975 - DNA, 22 bp, Homo sapiens
tgacacaaaggaaagcataatc

SEQ ID NO: 7714976 - DNA, 20 bp, Homo sapiens
tgacacaaattgctttctca

SEQ ID NO: 7714977 - DNA, 22 bp, Homo sapiens
tgacaaatgttaattcagtgga

SEQ ID NO: 7714978 - DNA, 22 bp, Homo sapiens
tgacaaattcatatttcagagg

SEQ ID NO: 7714979 - DNA, 22 bp, Homo sapiens
tgacaaattcatatttcagagg

SEQ ID NO: 7714980 - DNA, 22 bp, Homo sapiens
tgacaaatgttaattcagtgga

SEQ ID NO: 7714981 - DNA, 22 bp, Homo sapiens
tgacaaatgttaattcagtgga

SEQ ID NO: 7714982 - DNA, 22 bp, Homo sapiens
tgacaaattcatatttcagagg

SEQ ID NO: 7714983 - DNA, 22 bp, Homo sapiens
tgacaaattcatatttcagagg

SEQ ID NO: 7714984 - DNA, 22 bp, Homo sapiens
tgacaattgtgggcagtttgtg

SEQ ID NO: 7714985 - DNA, 22 bp, Homo sapiens
tgacaattgttgtgaattcttc

SEQ ID NO: 7714986 - DNA, 22 bp, Homo sapiens
tgacaaattcatatttcagagg

SEQ ID NO: 7714987 - DNA, 22 bp, Homo sapiens
tgacaatttggcagagtctggc

SEQ ID NO: 7714988 - DNA, 22 bp, Homo sapiens
tgacaatttggcagagtctggc

SEQ ID NO: 7714989 - DNA, 22 bp, Homo sapiens
tgacacaaacaagatatttgcc

SEQ ID NO: 7714990 - DNA, 22 bp, Homo sapiens
tgacacaaacaagatatttgcc

SEQ ID NO: 7714991 - DNA, 22 bp, Homo sapiens
tgacaaaccagtagcaataaag

SEQ ID NO: 7714992 - DNA, 22 bp, Homo sapiens
tgacaaaccagtagcaataaag

SEQ ID NO: 7714993 - DNA, 22 bp, Homo sapiens
tgacaaaccagtagcaataaag

SEQ ID NO: 7714994 - DNA, 22 bp, Homo sapiens
tgacaaagacaaagatatgtcc

SEQ ID NO: 7714995 - DNA, 22 bp, Homo sapiens
tgacaaaccctgcaaatagctc

SEQ ID NO: 7714996 - DNA, 22 bp, Homo sapiens
tgacaaaactgcaattactttt

SEQ ID NO: 7714997 - DNA, 22 bp, Homo sapiens
tgacaaaactgcaattactttt

SEQ ID NO: 7714998 - DNA, 23 bp, Homo sapiens
tgaattttggcatattctgaaat

SEQ ID NO: 7714999 - DNA, 22 bp, Homo sapiens
tgacaaaactgcaattactttt

SEQ ID NO: 7715000 - DNA, 22 bp, Homo sapiens
tgacaaaactgcaattactttt

SEQ ID NO: 7715001 - DNA, 22 bp, Homo sapiens
tgacaaaactgcaattactttt

SEQ ID NO: 7715002 - DNA, 22 bp, Homo sapiens
tgacaaaactgcaattactttt

SEQ ID NO: 7715003 - DNA, 22 bp, Homo sapiens
tgacaaaactgcaattactttt

SEQ ID NO: 7715004 - DNA, 22 bp, Homo sapiens
tgacaaaactgcaattactttt

SEQ ID NO: 7715005 - DNA, 22 bp, Homo sapiens
tgacaaaactgcaattactttt

SEQ ID NO: 7715006 - DNA, 22 bp, Homo sapiens
tgacaaaactgcaattactttt

SEQ ID NO: 7715007 - DNA, 22 bp, Homo sapiens
tgacaaaggtgttgccagaggg

SEQ ID NO: 7715008 - DNA, 22 bp, Homo sapiens
tgacaaaggcaggccagaagag

SEQ ID NO: 7715009 - DNA, 23 bp, Homo sapiens
tgacaaagcgagactccagctca

SEQ ID NO: 7715010 - DNA, 22 bp, Homo sapiens
tgacaaagcatgatggtgacag

SEQ ID NO: 7715011 - DNA, 22 bp, Homo sapiens
tgacaaagcatgatggtgacag

SEQ ID NO: 7715012 - DNA, 23 bp, Homo sapiens
tgacaaagcgagactccagctca

SEQ ID NO: 7715013 - DNA, 22 bp, Homo sapiens
tgacaaagcctcatccttcaga

SEQ ID NO: 7715014 - DNA, 22 bp, Homo sapiens
tgacaaagcctcatccttcaga

SEQ ID NO: 7715015 - DNA, 22 bp, Homo sapiens
tgacaaagaccttcaacaagat

SEQ ID NO: 7715016 - DNA, 22 bp, Homo sapiens
tgacaaagaccttcaacaagat

SEQ ID NO: 7715017 - DNA, 22 bp, Homo sapiens
tgacaaagaggaacagcagggg

SEQ ID NO: 7715018 - DNA, 22 bp, Homo sapiens
tgacaaagaggaacagcagggg

SEQ ID NO: 7715019 - DNA, 22 bp, Homo sapiens
tgacaaagaggaacagcagggg

SEQ ID NO: 7715020 - DNA, 22 bp, Homo sapiens
tgacaaagaggaacagcagggg

SEQ ID NO: 7715021 - DNA, 20 bp, Homo sapiens
tgacaaagagtaagaggagg

SEQ ID NO: 7715022 - DNA, 20 bp, Homo sapiens
tgacaaagagtaagaggagg

SEQ ID NO: 7715023 - DNA, 22 bp, Homo sapiens
tgacaaagcatgatggtgacag

SEQ ID NO: 7715024 - DNA, 22 bp, Homo sapiens
tgaatttggcttgaggcagata

SEQ ID NO: 7715025 - DNA, 23 bp, Homo sapiens
tgaattttggcatattctgaaat

SEQ ID NO: 7715026 - DNA, 23 bp, Homo sapiens
tgaattttggcatattctgaaat

SEQ ID NO: 7715027 - DNA, 23 bp, Homo sapiens
tgaattttggcatattctgaaat

SEQ ID NO: 7715028 - DNA, 23 bp, Homo sapiens
tgaattttggcatattctgaaat

SEQ ID NO: 7715029 - DNA, 23 bp, Homo sapiens
tgaattttggcatattctgaaat

SEQ ID NO: 7715030 - DNA, 23 bp, Homo sapiens
tgaattttggcatattctgaaat

SEQ ID NO: 7715031 - DNA, 21 bp, Homo sapiens
tgaatttccctctatcattct

SEQ ID NO: 7715032 - DNA, 23 bp, Homo sapiens
tgaatttggaactcagagaatta

SEQ ID NO: 7715033 - DNA, 21 bp, Homo sapiens
tgaatttcggtatggctataa

SEQ ID NO: 7715034 - DNA, 21 bp, Homo sapiens
tgaatttcggtatggctataa

SEQ ID NO: 7715035 - DNA, 21 bp, Homo sapiens
tgaatttccctctatcattct

SEQ ID NO: 7715036 - DNA, 22 bp, Homo sapiens
tgaatttatcaaagattcttaa

SEQ ID NO: 7715037 - DNA, 22 bp, Homo sapiens
tgaatttatcaaagattcttaa

SEQ ID NO: 7715038 - DNA, 22 bp, Homo sapiens
tgaatttatcaaagattcttaa

SEQ ID NO: 7715039 - DNA, 22 bp, Homo sapiens
tgaatttatcaaagattcttaa

SEQ ID NO: 7715040 - DNA, 22 bp, Homo sapiens
tgaatttatcaaagattcttaa

SEQ ID NO: 7715041 - DNA, 22 bp, Homo sapiens
tgaatttatcaaagattcttaa

SEQ ID NO: 7715042 - DNA, 22 bp, Homo sapiens
tgaatttaccttgcctatattt

SEQ ID NO: 7715043 - DNA, 22 bp, Homo sapiens
tgaatttaccttgcctatattt

SEQ ID NO: 7715044 - DNA, 22 bp, Homo sapiens
tgaatttaaaataaatgtagtt

SEQ ID NO: 7715045 - DNA, 22 bp, Homo sapiens
tgaatttaaaataaatgtagtt

SEQ ID NO: 7715046 - DNA, 22 bp, Homo sapiens
tgaatttaaaataaatgtagtt

SEQ ID NO: 7715047 - DNA, 22 bp, Homo sapiens
tgaattgtgacccctctgtatt

SEQ ID NO: 7715048 - DNA, 22 bp, Homo sapiens
tgaattgtggctttttccaatt

SEQ ID NO: 7715049 - DNA, 22 bp, Homo sapiens
tgaattgtacagtatgtgaatt

SEQ ID NO: 7715050 - DNA, 22 bp, Homo sapiens
tgaattgtacagtatgtgaatt

SEQ ID NO: 7715051 - DNA, 22 bp, Homo sapiens
tgaatttaagcactgatgttaa

SEQ ID NO: 7715052 - DNA, 22 bp, Homo sapiens
tgaatttaccttgcctatattt

SEQ ID NO: 7715053 - DNA, 22 bp, Homo sapiens
tgaatttaccttgcctatattt

SEQ ID NO: 7715054 - DNA, 22 bp, Homo sapiens
tgaattcttttagaattcagtg

SEQ ID NO: 7715055 - DNA, 22 bp, Homo sapiens
tgaattcttttagaattcagtg

SEQ ID NO: 7715056 - DNA, 22 bp, Homo sapiens
tgaattcttttagaattcagtg

SEQ ID NO: 7715057 - DNA, 22 bp, Homo sapiens
tgaattcttttagaattcagtg

SEQ ID NO: 7715058 - DNA, 22 bp, Homo sapiens
tgaattcttatgaaagtgcttg

SEQ ID NO: 7715059 - DNA, 22 bp, Homo sapiens
tgaattcttatctgggctgtgc

SEQ ID NO: 7715060 - DNA, 22 bp, Homo sapiens
tgaattcatacagtggatacca

SEQ ID NO: 7715061 - DNA, 22 bp, Homo sapiens
tgaattcatccatttatgcaag

SEQ ID NO: 7715062 - DNA, 22 bp, Homo sapiens
tgaattcatccatttatgcaag

SEQ ID NO: 7715063 - DNA, 22 bp, Homo sapiens
tgaattcataggacacagggtg

SEQ ID NO: 7715064 - DNA, 22 bp, Homo sapiens
tgaattcacctgaaagtctgga

SEQ ID NO: 7715065 - DNA, 22 bp, Homo sapiens
tgaattcaggggctattatatt

SEQ ID NO: 7715066 - DNA, 22 bp, Homo sapiens
tgaattcaggggctattatatt

SEQ ID NO: 7715067 - DNA, 22 bp, Homo sapiens
tgaattcaggggctattatatt

SEQ ID NO: 7715068 - DNA, 22 bp, Homo sapiens
tgaattcaggggctattatatt

SEQ ID NO: 7715069 - DNA, 22 bp, Homo sapiens
tgaattcacacttccaaagaga

SEQ ID NO: 7715070 - DNA, 22 bp, Homo sapiens
tgaattcacacttccaaagaga

SEQ ID NO: 7715071 - DNA, 22 bp, Homo sapiens
tgaattcaagttgttgagccat

SEQ ID NO: 7715072 - DNA, 17 bp, Homo sapiens
tgaattcaatctgcact

SEQ ID NO: 7715073 - DNA, 22 bp, Homo sapiens
tgaattcctaatctaaactaag

SEQ ID NO: 7715074 - DNA, 22 bp, Homo sapiens
tgaattccttgcatttttacct

SEQ ID NO: 7715075 - DNA, 22 bp, Homo sapiens
tgaattccttgcatttttacct

SEQ ID NO: 7715076 - DNA, 22 bp, Homo sapiens
tgaattctcacaagcctggaag

SEQ ID NO: 7715077 - DNA, 20 bp, Homo sapiens
tgaattctagatgactggag

SEQ ID NO: 7715078 - DNA, 22 bp, Homo sapiens
tgaattccattgccaaagtttt

SEQ ID NO: 7715079 - DNA, 22 bp, Homo sapiens
tgaattccattgccaaagtttt

SEQ ID NO: 7715080 - DNA, 22 bp, Homo sapiens
tgaattccaaatcctggaatta

SEQ ID NO: 7715081 - DNA, 22 bp, Homo sapiens
tgaattccatcctgttgcaacc

SEQ ID NO: 7715082 - DNA, 21 bp, Homo sapiens
tgaattcccatgtgagcagca

SEQ ID NO: 7715083 - DNA, 22 bp, Homo sapiens
tgaattccctaagacaggtctt

SEQ ID NO: 7715084 - DNA, 22 bp, Homo sapiens
tgaattccctgcaggcatcctc

SEQ ID NO: 7715085 - DNA, 22 bp, Homo sapiens
tgaattccctgcaggcatcctc

SEQ ID NO: 7715086 - DNA, 22 bp, Homo sapiens
tgaattctgctgtagcaagtcc

SEQ ID NO: 7715087 - DNA, 22 bp, Homo sapiens
tgaattctgctgtagcaagtcc

SEQ ID NO: 7715088 - DNA, 22 bp, Homo sapiens
tgaattctctttcctggagcat

SEQ ID NO: 7715089 - DNA, 22 bp, Homo sapiens
tgaattctcatctcctgacact

SEQ ID NO: 7715090 - DNA, 22 bp, Homo sapiens
tgaattctggccctctcactta

SEQ ID NO: 7715091 - DNA, 22 bp, Homo sapiens
tgaattctggccctctcactta

SEQ ID NO: 7715092 - DNA, 22 bp, Homo sapiens
tgaattctggccctctcactta

SEQ ID NO: 7715093 - DNA, 22 bp, Homo sapiens
tgaattcttaatgaaatctact

SEQ ID NO: 7715094 - DNA, 22 bp, Homo sapiens
tgaattcttaatgaaatctact

SEQ ID NO: 7715095 - DNA, 20 bp, Homo sapiens
tgaattctgggtttatctgc

SEQ ID NO: 7715096 - DNA, 22 bp, Homo sapiens
tgaattcttaatgaaatctact

SEQ ID NO: 7715097 - DNA, 22 bp, Homo sapiens
tgaattctgggtcagcagcttg

SEQ ID NO: 7715098 - DNA, 22 bp, Homo sapiens
tgaattctgggtcagcagcttg

SEQ ID NO: 7715099 - DNA, 22 bp, Homo sapiens
tgaattctgggtcagcagcttg

SEQ ID NO: 7715100 - DNA, 22 bp, Homo sapiens
tgaattctggctcttctgttta

SEQ ID NO: 7715101 - DNA, 22 bp, Homo sapiens
tgaatacaggaaaatatactga

SEQ ID NO: 7715102 - DNA, 22 bp, Homo sapiens
tgaatacaggaaaatatactga

SEQ ID NO: 7715103 - DNA, 22 bp, Homo sapiens
tgaatactatttcataatgtgg

SEQ ID NO: 7715104 - DNA, 22 bp, Homo sapiens
tgaatactatttcataatgtgg

SEQ ID NO: 7715105 - DNA, 22 bp, Homo sapiens
tgaatagactggggctgtgaag

SEQ ID NO: 7715106 - DNA, 22 bp, Homo sapiens
tgaatagagcttggcactagaa

SEQ ID NO: 7715107 - DNA, 22 bp, Homo sapiens
tgaatactatttcataatgtgg

SEQ ID NO: 7715108 - DNA, 22 bp, Homo sapiens
tgaatagacatctggccataga

SEQ ID NO: 7715109 - DNA, 22 bp, Homo sapiens
tgaatagacatctggccataga

SEQ ID NO: 7715110 - DNA, 22 bp, Homo sapiens
tgaatagagggcaggctttgta

SEQ ID NO: 7715111 - DNA, 22 bp, Homo sapiens
tgaatagataaaaattcctgct

SEQ ID NO: 7715112 - DNA, 22 bp, Homo sapiens
tgaatagatggtgacagtatga

SEQ ID NO: 7715113 - DNA, 22 bp, Homo sapiens
tgaatagtccttggaataactg

SEQ ID NO: 7715114 - DNA, 21 bp, Homo sapiens
tgaatagggccagaaccaaag

SEQ ID NO: 7715115 - DNA, 21 bp, Homo sapiens
tgaatagggccagaaccaaag

SEQ ID NO: 7715116 - DNA, 22 bp, Homo sapiens
tgaataattcctttttgtcaag

SEQ ID NO: 7715117 - DNA, 22 bp, Homo sapiens
tgaatacactaaaaatcacttt

SEQ ID NO: 7715118 - DNA, 22 bp, Homo sapiens
tgaatacactaaaaatcacttt

SEQ ID NO: 7715119 - DNA, 22 bp, Homo sapiens
tgaatacactaaaaatcacttt

SEQ ID NO: 7715120 - DNA, 22 bp, Homo sapiens
tgaatacactaaaaatcacttt

SEQ ID NO: 7715121 - DNA, 22 bp, Homo sapiens
tgaatacactaaaaatcacttt

SEQ ID NO: 7715122 - DNA, 22 bp, Homo sapiens
tgaataattcctttttgtcaag

SEQ ID NO: 7715123 - DNA, 22 bp, Homo sapiens
tgaataattcctttttgtcaag

SEQ ID NO: 7715124 - DNA, 22 bp, Homo sapiens
tgaataattcctttttgtcaag

SEQ ID NO: 7715125 - DNA, 22 bp, Homo sapiens
tgaataattatgggagtcctaa

SEQ ID NO: 7715126 - DNA, 19 bp, Homo sapiens
tgaatacagagatacagaa

SEQ ID NO: 7715127 - DNA, 19 bp, Homo sapiens
tgaatacagagatacagaa

SEQ ID NO: 7715128 - DNA, 22 bp, Homo sapiens
tgaatacactaaaaatcacttt

SEQ ID NO: 7715129 - DNA, 22 bp, Homo sapiens
tgaatacaggaaaatatactga

SEQ ID NO: 7715130 - DNA, 22 bp, Homo sapiens
tgaatacaggaaaatatactga

SEQ ID NO: 7715131 - DNA, 22 bp, Homo sapiens
tgaatacaggaaaatatactga

SEQ ID NO: 7715132 - DNA, 19 bp, Homo sapiens
tgaatacagagatacagaa

SEQ ID NO: 7715133 - DNA, 22 bp, Homo sapiens
tgaatacaggaaaatatactga

SEQ ID NO: 7715134 - DNA, 22 bp, Homo sapiens
tgaatacaggaaaatatactga

SEQ ID NO: 7715135 - DNA, 22 bp, Homo sapiens
tgaatccagagctatttcgtcc

SEQ ID NO: 7715136 - DNA, 22 bp, Homo sapiens
tgaatcattttgctgtttgaac

SEQ ID NO: 7715137 - DNA, 22 bp, Homo sapiens
tgaatcagtataaattctcaaa

SEQ ID NO: 7715138 - DNA, 22 bp, Homo sapiens
tgaatcagtataaattctcaaa

SEQ ID NO: 7715139 - DNA, 23 bp, Homo sapiens
tgaatcaattatgggattcaatg

SEQ ID NO: 7715140 - DNA, 22 bp, Homo sapiens
tgaatcaatgaattgcacttca

SEQ ID NO: 7715141 - DNA, 22 bp, Homo sapiens
tgaatcaatagttgcaagtatt

SEQ ID NO: 7715142 - DNA, 22 bp, Homo sapiens
tgaatcaatgaattgcacttca

SEQ ID NO: 7715143 - DNA, 22 bp, Homo sapiens
tgaatcaatgaattgcacttca

SEQ ID NO: 7715144 - DNA, 22 bp, Homo sapiens
tgaatcaattgtcttaagacat

SEQ ID NO: 7715145 - DNA, 23 bp, Homo sapiens
tgaatcaattatgggattcaatg

SEQ ID NO: 7715146 - DNA, 23 bp, Homo sapiens
tgaatcaattatgggattcaatg

SEQ ID NO: 7715147 - DNA, 22 bp, Homo sapiens
tgaatatgttcctcacaagttc

SEQ ID NO: 7715148 - DNA, 22 bp, Homo sapiens
tgaatatgttcctcacaagttc

SEQ ID NO: 7715149 - DNA, 22 bp, Homo sapiens
tgaatcaatagttgcaagtatt

SEQ ID NO: 7715150 - DNA, 22 bp, Homo sapiens
tgaatcaaagctgaagttttca

SEQ ID NO: 7715151 - DNA, 22 bp, Homo sapiens
tgaatatggcaactcttgtaac

SEQ ID NO: 7715152 - DNA, 22 bp, Homo sapiens
tgaatatgggcagcaggactag

SEQ ID NO: 7715153 - DNA, 22 bp, Homo sapiens
tgaatatgtatttcttatttac

SEQ ID NO: 7715154 - DNA, 22 bp, Homo sapiens
tgaatatgtgactttgatttca

SEQ ID NO: 7715155 - DNA, 22 bp, Homo sapiens
tgaatagttctactacttgaca

SEQ ID NO: 7715156 - DNA, 20 bp, Homo sapiens
tgaatatgaccttatttgga

SEQ ID NO: 7715157 - DNA, 20 bp, Homo sapiens
tgaatatgaccttatttgga

SEQ ID NO: 7715158 - DNA, 22 bp, Homo sapiens
tgaatagttatgttatatggca

SEQ ID NO: 7715159 - DNA, 22 bp, Homo sapiens
tgaatatggcaactcttgtaac

SEQ ID NO: 7715160 - DNA, 20 bp, Homo sapiens
tgaatatgaccttatttgga

SEQ ID NO: 7715161 - DNA, 22 bp, Homo sapiens
tgaatatgattgcaaatttggc

SEQ ID NO: 7715162 - DNA, 22 bp, Homo sapiens
tgaatatgattgcaaatttggc

SEQ ID NO: 7715163 - DNA, 19 bp, Homo sapiens
tgaattaaagattaaagtc

SEQ ID NO: 7715164 - DNA, 18 bp, Homo sapiens
tgaatgttttctggaccc

SEQ ID NO: 7715165 - DNA, 22 bp, Homo sapiens
tgaatgtttgatgagaaataga

SEQ ID NO: 7715166 - DNA, 18 bp, Homo sapiens
tgaatgttttctggaccc

SEQ ID NO: 7715167 - DNA, 22 bp, Homo sapiens
tgaatgtttgatgagaaataga

SEQ ID NO: 7715168 - DNA, 22 bp, Homo sapiens
tgaatgtttgatgagaaataga

SEQ ID NO: 7715169 - DNA, 23 bp, Homo sapiens
tgaatgtttattctcggtgcaga

SEQ ID NO: 7715170 - DNA, 22 bp, Homo sapiens
tgaatgttgatatgagtacaga

SEQ ID NO: 7715171 - DNA, 22 bp, Homo sapiens
tgaatgttgatatgagtacaga

SEQ ID NO: 7715172 - DNA, 22 bp, Homo sapiens
tgaatgtttatattggccaaaa

SEQ ID NO: 7715173 - DNA, 23 bp, Homo sapiens
tgaatgtttattctcggtgcaga

SEQ ID NO: 7715174 - DNA, 23 bp, Homo sapiens
tgaatgtttattctcggtgcaga

SEQ ID NO: 7715175 - DNA, 23 bp, Homo sapiens
tgaatgtttattctcggtgcaga

SEQ ID NO: 7715176 - DNA, 19 bp, Homo sapiens
tgaattaaagattaaagtc

SEQ ID NO: 7715177 - DNA, 19 bp, Homo sapiens
tgaattaaagattaaagtc

SEQ ID NO: 7715178 - DNA, 19 bp, Homo sapiens
tgaattagaattatcctct

SEQ ID NO: 7715179 - DNA, 22 bp, Homo sapiens
tgaattagcagtagacagactg

SEQ ID NO: 7715180 - DNA, 22 bp, Homo sapiens
tgaattcaaattgtgcctatta

SEQ ID NO: 7715181 - DNA, 22 bp, Homo sapiens
tgaattcaagttgttgagccat

SEQ ID NO: 7715182 - DNA, 22 bp, Homo sapiens
tgaattcaaattgtgcctatta

SEQ ID NO: 7715183 - DNA, 22 bp, Homo sapiens
tgaattcaaattgtgcctatta

SEQ ID NO: 7715184 - DNA, 18 bp, Homo sapiens
tgaattagtttgtggttt

SEQ ID NO: 7715185 - DNA, 18 bp, Homo sapiens
tgaattagtttgtggttt

SEQ ID NO: 7715186 - DNA, 22 bp, Homo sapiens
tgaatgtgatgctaaacatatg

SEQ ID NO: 7715187 - DNA, 22 bp, Homo sapiens
tgaatgtgatgctaaacatatg

SEQ ID NO: 7715188 - DNA, 22 bp, Homo sapiens
tgaatgtgggagagctggcaat

SEQ ID NO: 7715189 - DNA, 22 bp, Homo sapiens
tgaatgtgatgctaaacatatg

SEQ ID NO: 7715190 - DNA, 22 bp, Homo sapiens
tgaatgtgatgctaaacatatg

SEQ ID NO: 7715191 - DNA, 22 bp, Homo sapiens
tgaatgttgatatgagtacaga

SEQ ID NO: 7715192 - DNA, 22 bp, Homo sapiens
tgaatgttctctaaatactcct

SEQ ID NO: 7715193 - DNA, 22 bp, Homo sapiens
tgaatggtgattggtgcttctc

SEQ ID NO: 7715194 - DNA, 22 bp, Homo sapiens
tgaatgtaccttgaaggtgtaa

SEQ ID NO: 7715195 - DNA, 22 bp, Homo sapiens
tgaatgtaccttgaaggtgtaa

SEQ ID NO: 7715196 - DNA, 22 bp, Homo sapiens
tgaatgtaggcacatgcaaatg

SEQ ID NO: 7715197 - DNA, 22 bp, Homo sapiens
tgaatgtgatgctaaacatatg

SEQ ID NO: 7715198 - DNA, 22 bp, Homo sapiens
tgaatgtgatgctaaacatatg

SEQ ID NO: 7715199 - DNA, 22 bp, Homo sapiens
tgaatgtgatgctaaacatatg

SEQ ID NO: 7715200 - DNA, 22 bp, Homo sapiens
tgaatgtgatgctaaacatatg

SEQ ID NO: 7715201 - DNA, 22 bp, Homo sapiens
tgaatgtaggtctaatatccca

SEQ ID NO: 7715202 - DNA, 22 bp, Homo sapiens
tgaatgtatggtcctgtgaatt

SEQ ID NO: 7715203 - DNA, 22 bp, Homo sapiens
tgaatctatgttgccccataat

SEQ ID NO: 7715204 - DNA, 22 bp, Homo sapiens
tgaatctttttggaaataaaga

SEQ ID NO: 7715205 - DNA, 22 bp, Homo sapiens
tgaatgaactaaatcatagttc

SEQ ID NO: 7715206 - DNA, 22 bp, Homo sapiens
tgaatgaactaaatcatagttc

SEQ ID NO: 7715207 - DNA, 22 bp, Homo sapiens
tgaatgaactaaatcatagttc

SEQ ID NO: 7715208 - DNA, 22 bp, Homo sapiens
tgaatgaatcctaacaaagaca

SEQ ID NO: 7715209 - DNA, 22 bp, Homo sapiens
tgaatgaatcctaacaaagaca

SEQ ID NO: 7715210 - DNA, 22 bp, Homo sapiens
tgaatgaatcctaacaaagaca

SEQ ID NO: 7715211 - DNA, 22 bp, Homo sapiens
tgaatgaatgaattaatagagt

SEQ ID NO: 7715212 - DNA, 22 bp, Homo sapiens
tgaatgacctttgaggatggaa

SEQ ID NO: 7715213 - DNA, 22 bp, Homo sapiens
tgaatgacctttgaggatggaa

SEQ ID NO: 7715214 - DNA, 19 bp, Homo sapiens
tgaatgacgggcatgagca

SEQ ID NO: 7715215 - DNA, 22 bp, Homo sapiens
tgaatgagaacactgaaagagg

SEQ ID NO: 7715216 - DNA, 22 bp, Homo sapiens
tgaatgcttggagtcataaaat

SEQ ID NO: 7715217 - DNA, 22 bp, Homo sapiens
tgaatgagtgagttcagacctc

SEQ ID NO: 7715218 - DNA, 21 bp, Homo sapiens
tgaatgcttcgtcatcctggc

SEQ ID NO: 7715219 - DNA, 22 bp, Homo sapiens
tgaatggattcagaaaatgtgt

SEQ ID NO: 7715220 - DNA, 22 bp, Homo sapiens
tgaatggattcagaaaatgtgt

SEQ ID NO: 7715221 - DNA, 22 bp, Homo sapiens
tgaatggatataacaacagtgt

SEQ ID NO: 7715222 - DNA, 22 bp, Homo sapiens
tgaatgctttggagccttctaa

SEQ ID NO: 7715223 - DNA, 22 bp, Homo sapiens
tgaatgctttggagccttctaa

SEQ ID NO: 7715224 - DNA, 21 bp, Homo sapiens
tgaatgagcatctggactttt

SEQ ID NO: 7715225 - DNA, 21 bp, Homo sapiens
tgaatgaggaggatggcattt

SEQ ID NO: 7715226 - DNA, 21 bp, Homo sapiens
tgaatgaggaggatggcattt

SEQ ID NO: 7715227 - DNA, 21 bp, Homo sapiens
tgaatgagcatctggactttt

SEQ ID NO: 7715228 - DNA, 22 bp, Homo sapiens
tgaatgagaacactgaaagagg

SEQ ID NO: 7715229 - DNA, 21 bp, Homo sapiens
tgaatgagcatctggactttt

SEQ ID NO: 7715230 - DNA, 22 bp, Homo sapiens
tgaatgaggatccttgacctta

SEQ ID NO: 7715231 - DNA, 21 bp, Homo sapiens
tgaatgaggaggatggcattt

SEQ ID NO: 7715232 - DNA, 22 bp, Homo sapiens
tgaatgaggatccttgacctta

SEQ ID NO: 7715233 - DNA, 22 bp, Homo sapiens
tgaatgagtcaatcatttagct

SEQ ID NO: 7715234 - DNA, 22 bp, Homo sapiens
tgaatgagtcaatcatttagct

SEQ ID NO: 7715235 - DNA, 22 bp, Homo sapiens
tgaatgagtcaatcatttagct

SEQ ID NO: 7715236 - DNA, 22 bp, Homo sapiens
tgaatgagtcaatcatttagct

SEQ ID NO: 7715237 - DNA, 22 bp, Homo sapiens
tgacatttcggtgtatgtgatg

SEQ ID NO: 7715238 - DNA, 22 bp, Homo sapiens
tgacatttcggtgtatgtgatg

SEQ ID NO: 7715239 - DNA, 22 bp, Homo sapiens
tgacatttcggtgtatgtgatg

SEQ ID NO: 7715240 - DNA, 22 bp, Homo sapiens
tgacatttcctagtgctttgtg

SEQ ID NO: 7715241 - DNA, 22 bp, Homo sapiens
tgacatttcctagtgctttgtg

SEQ ID NO: 7715242 - DNA, 18 bp, Homo sapiens
tgacatttccagagtgta

SEQ ID NO: 7715243 - DNA, 18 bp, Homo sapiens
tgacatttccagagtgta

SEQ ID NO: 7715244 - DNA, 22 bp, Homo sapiens
tgacatttcctagtgctttgtg

SEQ ID NO: 7715245 - DNA, 22 bp, Homo sapiens
tgacatttcttgttgatataaa

SEQ ID NO: 7715246 - DNA, 22 bp, Homo sapiens
tgacatttcttgttgatataaa

SEQ ID NO: 7715247 - DNA, 22 bp, Homo sapiens
tgacatttcggtgtatgtgatg

SEQ ID NO: 7715248 - DNA, 22 bp, Homo sapiens
tgacatttcttgttgatataaa

SEQ ID NO: 7715249 - DNA, 22 bp, Homo sapiens
tgacatttcttgttgatataaa

SEQ ID NO: 7715250 - DNA, 22 bp, Homo sapiens
tgacatttgagagagatataca

SEQ ID NO: 7715251 - DNA, 22 bp, Homo sapiens
tgacatttgagagagatataca

SEQ ID NO: 7715252 - DNA, 22 bp, Homo sapiens
tgacatttgagagagatataca

SEQ ID NO: 7715253 - DNA, 22 bp, Homo sapiens
tgacatttgagagagatataca

SEQ ID NO: 7715254 - DNA, 22 bp, Homo sapiens
tgacatttcttgttgatataaa

SEQ ID NO: 7715255 - DNA, 22 bp, Homo sapiens
tgacatttgagagagatataca

SEQ ID NO: 7715256 - DNA, 22 bp, Homo sapiens
tgacatttgagagagatataca

SEQ ID NO: 7715257 - DNA, 22 bp, Homo sapiens
tgacatttgagagagatataca

SEQ ID NO: 7715258 - DNA, 22 bp, Homo sapiens
tgacatttgagagagatataca

SEQ ID NO: 7715259 - DNA, 22 bp, Homo sapiens
tgacatttgagcatacatgtaa

SEQ ID NO: 7715260 - DNA, 22 bp, Homo sapiens
tgacatttgagcatacatgtaa

SEQ ID NO: 7715261 - DNA, 22 bp, Homo sapiens
tgacatttgagagagatataca

SEQ ID NO: 7715262 - DNA, 22 bp, Homo sapiens
tgacatttgagcatacatgtaa

SEQ ID NO: 7715263 - DNA, 22 bp, Homo sapiens
tgacatttgagcatacatgtaa

SEQ ID NO: 7715264 - DNA, 22 bp, Homo sapiens
tgacatttgagcatacatgtaa

SEQ ID NO: 7715265 - DNA, 22 bp, Homo sapiens
tgacatttgagcatacatgtaa

SEQ ID NO: 7715266 - DNA, 22 bp, Homo sapiens
tgaccgtcttcccactttctgt

SEQ ID NO: 7715267 - DNA, 18 bp, Homo sapiens
tgaccctttctccctgtg

SEQ ID NO: 7715268 - DNA, 22 bp, Homo sapiens
tgacctattagatttccttgcc

SEQ ID NO: 7715269 - DNA, 22 bp, Homo sapiens
tgaccctttcattattctcatt

SEQ ID NO: 7715270 - DNA, 22 bp, Homo sapiens
tgacccttagaagctgcagcga

SEQ ID NO: 7715271 - DNA, 22 bp, Homo sapiens
tgaccctggcctggtggcggaa

SEQ ID NO: 7715272 - DNA, 22 bp, Homo sapiens
tgaccctggcctggtggcggaa

SEQ ID NO: 7715273 - DNA, 22 bp, Homo sapiens
tgaccctggcagcccactggcc

SEQ ID NO: 7715274 - DNA, 17 bp, Homo sapiens
tgaccctgttgggtgtt

SEQ ID NO: 7715275 - DNA, 23 bp, Homo sapiens
tgacccttgatggttgacgtgca

SEQ ID NO: 7715276 - DNA, 21 bp, Homo sapiens
tgacccttgccgagctacatt

SEQ ID NO: 7715277 - DNA, 21 bp, Homo sapiens
tgacatttggattcatagtaa

SEQ ID NO: 7715278 - DNA, 21 bp, Homo sapiens
tgacatttggattcatagtaa

SEQ ID NO: 7715279 - DNA, 21 bp, Homo sapiens
tgacatttggattcatagtaa

SEQ ID NO: 7715280 - DNA, 21 bp, Homo sapiens
tgacatttggattcatagtaa

SEQ ID NO: 7715281 - DNA, 22 bp, Homo sapiens
tgacattttatcaatatcacag

SEQ ID NO: 7715282 - DNA, 22 bp, Homo sapiens
tgacattttatcaatatcacag

SEQ ID NO: 7715283 - DNA, 22 bp, Homo sapiens
tgacattttatcaatatcacag

SEQ ID NO: 7715284 - DNA, 22 bp, Homo sapiens
tgacattttatcaatatcacag

SEQ ID NO: 7715285 - DNA, 22 bp, Homo sapiens
tgacattttatcaatatcacag

SEQ ID NO: 7715286 - DNA, 22 bp, Homo sapiens
tgacatttttataagagtcaaa

SEQ ID NO: 7715287 - DNA, 22 bp, Homo sapiens
tgacatttttataagagtcaaa

SEQ ID NO: 7715288 - DNA, 22 bp, Homo sapiens
tgacatttttataagagtcaaa

SEQ ID NO: 7715289 - DNA, 22 bp, Homo sapiens
tgacatttttaaaaccactagt

SEQ ID NO: 7715290 - DNA, 22 bp, Homo sapiens
tgacatttttataagagtcaaa

SEQ ID NO: 7715291 - DNA, 22 bp, Homo sapiens
tgaccctggcagcccactggcc

SEQ ID NO: 7715292 - DNA, 22 bp, Homo sapiens
tgacatttttaaaaccactagt

SEQ ID NO: 7715293 - DNA, 22 bp, Homo sapiens
tgacatttttaaaaccactagt

SEQ ID NO: 7715294 - DNA, 22 bp, Homo sapiens
tgacatttttaaaaccactagt

SEQ ID NO: 7715295 - DNA, 22 bp, Homo sapiens
tgacatttttaaaaccactagt

SEQ ID NO: 7715296 - DNA, 22 bp, Homo sapiens
tgacattttatcaatatcacag

SEQ ID NO: 7715297 - DNA, 22 bp, Homo sapiens
tgacatttttaaaaccactagt

SEQ ID NO: 7715298 - DNA, 22 bp, Homo sapiens
tgacatttactattcctggtta

SEQ ID NO: 7715299 - DNA, 22 bp, Homo sapiens
tgacatttactattcctggtta

SEQ ID NO: 7715300 - DNA, 21 bp, Homo sapiens
tgacatttagtagcattgtca

SEQ ID NO: 7715301 - DNA, 21 bp, Homo sapiens
tgacatttagtagcattgtca

SEQ ID NO: 7715302 - DNA, 21 bp, Homo sapiens
tgacatttagtagcattgtca

SEQ ID NO: 7715303 - DNA, 21 bp, Homo sapiens
tgacatttagtagcattgtca

SEQ ID NO: 7715304 - DNA, 21 bp, Homo sapiens
tgacatttagtagcattgtca

SEQ ID NO: 7715305 - DNA, 22 bp, Homo sapiens
tgacatttatcaaagaaatggt

SEQ ID NO: 7715306 - DNA, 22 bp, Homo sapiens
tgacatttatcaaagaaatggt

SEQ ID NO: 7715307 - DNA, 22 bp, Homo sapiens
tgacatttatcttctacaatga

SEQ ID NO: 7715308 - DNA, 22 bp, Homo sapiens
tgacatttatcttctacaatga

SEQ ID NO: 7715309 - DNA, 22 bp, Homo sapiens
tgacatttatcttctacaatga

SEQ ID NO: 7715310 - DNA, 22 bp, Homo sapiens
tgacatttatcttctacaatga

SEQ ID NO: 7715311 - DNA, 22 bp, Homo sapiens
tgacatttatcaaagaaatggt

SEQ ID NO: 7715312 - DNA, 22 bp, Homo sapiens
tgacatttatcaaagaaatggt

SEQ ID NO: 7715313 - DNA, 22 bp, Homo sapiens
tgacatttatcaaagaaatggt

SEQ ID NO: 7715314 - DNA, 22 bp, Homo sapiens
tgacatttcagatatggtattt

SEQ ID NO: 7715315 - DNA, 22 bp, Homo sapiens
tgacatttcagatatggtattt

SEQ ID NO: 7715316 - DNA, 22 bp, Homo sapiens
tgacatttcagatatggtattt

SEQ ID NO: 7715317 - DNA, 22 bp, Homo sapiens
tgacatttatcttctacaatga

SEQ ID NO: 7715318 - DNA, 22 bp, Homo sapiens
tgacatttcagatatggtattt

SEQ ID NO: 7715319 - DNA, 22 bp, Homo sapiens
tgacatttatcttctacaatga

SEQ ID NO: 7715320 - DNA, 18 bp, Homo sapiens
tgacatttccagagtgta

SEQ ID NO: 7715321 - DNA, 18 bp, Homo sapiens
tgacatttccagagtgta

SEQ ID NO: 7715322 - DNA, 21 bp, Homo sapiens
tgacatttccaatataaagcc

SEQ ID NO: 7715323 - DNA, 21 bp, Homo sapiens
tgacatttccaatataaagcc

SEQ ID NO: 7715324 - DNA, 21 bp, Homo sapiens
tgacatttccaatataaagcc

SEQ ID NO: 7715325 - DNA, 21 bp, Homo sapiens
tgacatttccaatataaagcc

SEQ ID NO: 7715326 - DNA, 21 bp, Homo sapiens
tgacatttccaatataaagcc

SEQ ID NO: 7715327 - DNA, 22 bp, Homo sapiens
tgacattgtgtgcatttaaagt

SEQ ID NO: 7715328 - DNA, 22 bp, Homo sapiens
tgacattggttgcaaggtactc

SEQ ID NO: 7715329 - DNA, 22 bp, Homo sapiens
tgacattgtgtgcatttaaagt

SEQ ID NO: 7715330 - DNA, 22 bp, Homo sapiens
tgacattccgcagtaaggttaa

SEQ ID NO: 7715331 - DNA, 22 bp, Homo sapiens
tgacattctgttaagtctcata

SEQ ID NO: 7715332 - DNA, 22 bp, Homo sapiens
tgacattccgcagtaaggttaa

SEQ ID NO: 7715333 - DNA, 22 bp, Homo sapiens
tgacatttaagcctctgatttc

SEQ ID NO: 7715334 - DNA, 22 bp, Homo sapiens
tgacatttaagcctctgatttc

SEQ ID NO: 7715335 - DNA, 22 bp, Homo sapiens
tgacatttaatccctaaatatt

SEQ ID NO: 7715336 - DNA, 22 bp, Homo sapiens
tgacatttaattaacgaatgct

SEQ ID NO: 7715337 - DNA, 22 bp, Homo sapiens
tgacatttaatccctaaatatt

SEQ ID NO: 7715338 - DNA, 22 bp, Homo sapiens
tgacatttaatccctaaatatt

SEQ ID NO: 7715339 - DNA, 22 bp, Homo sapiens
tgacatttaatccctaaatatt

SEQ ID NO: 7715340 - DNA, 22 bp, Homo sapiens
tgacatttaatccctaaatatt

SEQ ID NO: 7715341 - DNA, 22 bp, Homo sapiens
tgacatttaatccctaaatatt

SEQ ID NO: 7715342 - DNA, 22 bp, Homo sapiens
tgacatttaatccctaaatatt

SEQ ID NO: 7715343 - DNA, 22 bp, Homo sapiens
tgacattattatcatgtcacca

SEQ ID NO: 7715344 - DNA, 22 bp, Homo sapiens
tgacattagagttattgtctca

SEQ ID NO: 7715345 - DNA, 22 bp, Homo sapiens
tgacattattatcatgtcacca

SEQ ID NO: 7715346 - DNA, 22 bp, Homo sapiens
tgacatgtcctgagaagatggc

SEQ ID NO: 7715347 - DNA, 22 bp, Homo sapiens
tgacatgtatgttgttggcatg

SEQ ID NO: 7715348 - DNA, 22 bp, Homo sapiens
tgactgaggtttgatatatacc

SEQ ID NO: 7715349 - DNA, 22 bp, Homo sapiens
tgactgagggaggaagcaggtg

SEQ ID NO: 7715350 - DNA, 22 bp, Homo sapiens
tgactgatgcccactttgtctg

SEQ ID NO: 7715351 - DNA, 21 bp, Homo sapiens
tgactgaggcttcttcacaca

SEQ ID NO: 7715352 - DNA, 21 bp, Homo sapiens
tgactgaggcttcttcacaca

SEQ ID NO: 7715353 - DNA, 21 bp, Homo sapiens
tgactgaggcttcttcacaca

SEQ ID NO: 7715354 - DNA, 21 bp, Homo sapiens
tgactgaggcttcttcacaca

SEQ ID NO: 7715355 - DNA, 22 bp, Homo sapiens
tgactgagagagaactcagctt

SEQ ID NO: 7715356 - DNA, 22 bp, Homo sapiens
tgactgaaggactagattgatt

SEQ ID NO: 7715357 - DNA, 22 bp, Homo sapiens
tgactgaagaagccacattgga

SEQ ID NO: 7715358 - DNA, 22 bp, Homo sapiens
tgactgagagagaactcagctt

SEQ ID NO: 7715359 - DNA, 22 bp, Homo sapiens
tgactgaggaagaccaggtagc

SEQ ID NO: 7715360 - DNA, 22 bp, Homo sapiens
tgactgaggcagcctgagttat

SEQ ID NO: 7715361 - DNA, 22 bp, Homo sapiens
tgactgaggcagcctgagttat

SEQ ID NO: 7715362 - DNA, 22 bp, Homo sapiens
tgactgaggcctgataacagtt

SEQ ID NO: 7715363 - DNA, 22 bp, Homo sapiens
tgactgaggcctgataacagtt

SEQ ID NO: 7715364 - DNA, 22 bp, Homo sapiens
tgactgccccttccattcctgc

SEQ ID NO: 7715365 - DNA, 22 bp, Homo sapiens
tgactgcccccaccgcacaggc

SEQ ID NO: 7715366 - DNA, 22 bp, Homo sapiens
tgactgccgattgtccttctct

SEQ ID NO: 7715367 - DNA, 22 bp, Homo sapiens
tgactgccgattgtccttctct

SEQ ID NO: 7715368 - DNA, 22 bp, Homo sapiens
tgactgccgattgtccttctct

SEQ ID NO: 7715369 - DNA, 22 bp, Homo sapiens
tgactggagacctcagtagggt

SEQ ID NO: 7715370 - DNA, 22 bp, Homo sapiens
tgactgtgccgtgcccctagga

SEQ ID NO: 7715371 - DNA, 22 bp, Homo sapiens
tgactgtgccgtgcccctagga

SEQ ID NO: 7715372 - DNA, 22 bp, Homo sapiens
tgactgtgccgtgcccctagga

SEQ ID NO: 7715373 - DNA, 22 bp, Homo sapiens
tgactgtgcctgttgaatgaat

SEQ ID NO: 7715374 - DNA, 22 bp, Homo sapiens
tgactgtgtgattaaggcttca

SEQ ID NO: 7715375 - DNA, 22 bp, Homo sapiens
tgactgtgcctgttgaatgaat

SEQ ID NO: 7715376 - DNA, 22 bp, Homo sapiens
tgactgtgcaagcagagagcat

SEQ ID NO: 7715377 - DNA, 22 bp, Homo sapiens
tgactgtctctatggctctaaa

SEQ ID NO: 7715378 - DNA, 22 bp, Homo sapiens
tgactggattgtcattacgacg

SEQ ID NO: 7715379 - DNA, 22 bp, Homo sapiens
tgactggattgtcattacgacg

SEQ ID NO: 7715380 - DNA, 22 bp, Homo sapiens
tgactggattgtcattacgacg

SEQ ID NO: 7715381 - DNA, 20 bp, Homo sapiens
tgacttctgggatttgtggt

SEQ ID NO: 7715382 - DNA, 22 bp, Homo sapiens
tgacttctgattgcttctattt

SEQ ID NO: 7715383 - DNA, 22 bp, Homo sapiens
tgacttctgggtgagccagcat

SEQ ID NO: 7715384 - DNA, 22 bp, Homo sapiens
tgacttctgggtgagccagcat

SEQ ID NO: 7715385 - DNA, 22 bp, Homo sapiens
tgacttctctggcctggtgcag

SEQ ID NO: 7715386 - DNA, 22 bp, Homo sapiens
tgacttctgattgcttctattt

SEQ ID NO: 7715387 - DNA, 22 bp, Homo sapiens
tgacttctgattgcttctattt

SEQ ID NO: 7715388 - DNA, 22 bp, Homo sapiens
tgacttgaagcaaaatagaatt

SEQ ID NO: 7715389 - DNA, 22 bp, Homo sapiens
tgacttgaagcaaaatagaatt

SEQ ID NO: 7715390 - DNA, 22 bp, Homo sapiens
tgacttgaaacgtgaacagatc

SEQ ID NO: 7715391 - DNA, 20 bp, Homo sapiens
tgacttcttcatgctgtact

SEQ ID NO: 7715392 - DNA, 20 bp, Homo sapiens
tgacttcttcatgctgtact

SEQ ID NO: 7715393 - DNA, 22 bp, Homo sapiens
tgacttgtcaaagaaatgtgtg

SEQ ID NO: 7715394 - DNA, 22 bp, Homo sapiens
tgacttgtctctttgggagaca

SEQ ID NO: 7715395 - DNA, 22 bp, Homo sapiens
tgacttgtctctttgggagaca

SEQ ID NO: 7715396 - DNA, 22 bp, Homo sapiens
tgacttgtctctttgggagaca

SEQ ID NO: 7715397 - DNA, 22 bp, Homo sapiens
tgactttaaaataacaagttta

SEQ ID NO: 7715398 - DNA, 22 bp, Homo sapiens
tgactttaaaataacaagttta

SEQ ID NO: 7715399 - DNA, 22 bp, Homo sapiens
tgacttcctgcactcaggtgat

SEQ ID NO: 7715400 - DNA, 22 bp, Homo sapiens
tgacttctagcatttagcaacc

SEQ ID NO: 7715401 - DNA, 21 bp, Homo sapiens
tgacttcctaatcgccagctg

SEQ ID NO: 7715402 - DNA, 19 bp, Homo sapiens
tgacttcctcacttagcat

SEQ ID NO: 7715403 - DNA, 22 bp, Homo sapiens
tgacttcctgcactcaggtgat

SEQ ID NO: 7715404 - DNA, 22 bp, Homo sapiens
tgacttcctgcactcaggtgat

SEQ ID NO: 7715405 - DNA, 22 bp, Homo sapiens
tgacttactctagagaatgctg

SEQ ID NO: 7715406 - DNA, 22 bp, Homo sapiens
tgacttcaaaggctctactcct

SEQ ID NO: 7715407 - DNA, 17 bp, Homo sapiens
tgacttaacagcaaggc

SEQ ID NO: 7715408 - DNA, 22 bp, Homo sapiens
tgacttaagctgttctttagat

SEQ ID NO: 7715409 - DNA, 22 bp, Homo sapiens
tgactgtgtgattaaggcttca

SEQ ID NO: 7715410 - DNA, 22 bp, Homo sapiens
tgacttcaaggttcagcacctt

SEQ ID NO: 7715411 - DNA, 22 bp, Homo sapiens
tgacttccagcaacttcctcca

SEQ ID NO: 7715412 - DNA, 20 bp, Homo sapiens
tgacctcctgggctcaagcc

SEQ ID NO: 7715413 - DNA, 22 bp, Homo sapiens
tgacctcttgtcggagctccag

SEQ ID NO: 7715414 - DNA, 22 bp, Homo sapiens
tgacctgacatgaattaaaaac

SEQ ID NO: 7715415 - DNA, 22 bp, Homo sapiens
tgacctcttgtcggagctccag

SEQ ID NO: 7715416 - DNA, 22 bp, Homo sapiens
tgacctctgtcctgcagtctgg

SEQ ID NO: 7715417 - DNA, 22 bp, Homo sapiens
tgacctccaatacctttcttcc

SEQ ID NO: 7715418 - DNA, 22 bp, Homo sapiens
tgacctccaatacctttcttcc

SEQ ID NO: 7715419 - DNA, 23 bp, Homo sapiens
tgacctcatgatccgcccacctc

SEQ ID NO: 7715420 - DNA, 22 bp, Homo sapiens
tgacctttctttgagattcctg

SEQ ID NO: 7715421 - DNA, 22 bp, Homo sapiens
tgacctttcaacccttcttggc

SEQ ID NO: 7715422 - DNA, 22 bp, Homo sapiens
tgacctttcaacccttcttggc

SEQ ID NO: 7715423 - DNA, 22 bp, Homo sapiens
tgacctgggcattacaggtgca

SEQ ID NO: 7715424 - DNA, 22 bp, Homo sapiens
tgactacaacctccacctcccg

SEQ ID NO: 7715425 - DNA, 21 bp, Homo sapiens
tgactaattgtgataaagtgc

SEQ ID NO: 7715426 - DNA, 21 bp, Homo sapiens
tgactaattgtgataaagtgc

SEQ ID NO: 7715427 - DNA, 22 bp, Homo sapiens
tgactacaacctccacctcccg

SEQ ID NO: 7715428 - DNA, 22 bp, Homo sapiens
tgactacaacctccacctcccg

SEQ ID NO: 7715429 - DNA, 22 bp, Homo sapiens
tgactagaattgtatttagtgt

SEQ ID NO: 7715430 - DNA, 22 bp, Homo sapiens
tgactacaacctccacctcccg

SEQ ID NO: 7715431 - DNA, 22 bp, Homo sapiens
tgactacaacctccacctcccg

SEQ ID NO: 7715432 - DNA, 22 bp, Homo sapiens
tgacctttgtgctagaaacata

SEQ ID NO: 7715433 - DNA, 22 bp, Homo sapiens
tgactaaaataggacattaact

SEQ ID NO: 7715434 - DNA, 22 bp, Homo sapiens
tgactaaaataggacattaact

SEQ ID NO: 7715435 - DNA, 22 bp, Homo sapiens
tgaccttttagctgagtcccca

SEQ ID NO: 7715436 - DNA, 22 bp, Homo sapiens
tgacggtatttagggagcagcg

SEQ ID NO: 7715437 - DNA, 22 bp, Homo sapiens
tgacgtcaactgcaaaggcctt

SEQ ID NO: 7715438 - DNA, 22 bp, Homo sapiens
tgactaattatgttactaatca

SEQ ID NO: 7715439 - DNA, 22 bp, Homo sapiens
tgactaattatgttactaatca

SEQ ID NO: 7715440 - DNA, 22 bp, Homo sapiens
tgactaattgataactctgtaa

SEQ ID NO: 7715441 - DNA, 22 bp, Homo sapiens
tgactaaacgcatgaatagctc

SEQ ID NO: 7715442 - DNA, 22 bp, Homo sapiens
tgactaaaataggacattaact

SEQ ID NO: 7715443 - DNA, 22 bp, Homo sapiens
tgactaaatcacagttgcctca

SEQ ID NO: 7715444 - DNA, 22 bp, Homo sapiens
tgactcctggtatggatgacag

SEQ ID NO: 7715445 - DNA, 22 bp, Homo sapiens
tgactcctggtatggatgacag

SEQ ID NO: 7715446 - DNA, 21 bp, Homo sapiens
tgactccattctccatctgct

SEQ ID NO: 7715447 - DNA, 22 bp, Homo sapiens
tgactccacaatttgacttata

SEQ ID NO: 7715448 - DNA, 22 bp, Homo sapiens
tgactcaggaggaaagactcca

SEQ ID NO: 7715449 - DNA, 18 bp, Homo sapiens
tgactcaccctgtcagtg

SEQ ID NO: 7715450 - DNA, 22 bp, Homo sapiens
tgactcaccatcggagtttgaa

SEQ ID NO: 7715451 - DNA, 18 bp, Homo sapiens
tgactcaccctgtcagtg

SEQ ID NO: 7715452 - DNA, 22 bp, Homo sapiens
tgactcagtacatctggagttg

SEQ ID NO: 7715453 - DNA, 22 bp, Homo sapiens
tgactcagtacatctggagttg

SEQ ID NO: 7715454 - DNA, 22 bp, Homo sapiens
tgactcatatttcatggatacg

SEQ ID NO: 7715455 - DNA, 22 bp, Homo sapiens
tgactaggaataccatggtgga

SEQ ID NO: 7715456 - DNA, 22 bp, Homo sapiens
tgactaggagaaatattaaaat

SEQ ID NO: 7715457 - DNA, 22 bp, Homo sapiens
tgactatctagagtggggcaaa

SEQ ID NO: 7715458 - DNA, 22 bp, Homo sapiens
tgactattcacaattacaatag

SEQ ID NO: 7715459 - DNA, 22 bp, Homo sapiens
tgactattcacaattacaatag

SEQ ID NO: 7715460 - DNA, 20 bp, Homo sapiens
tgactattcccacatgagag

SEQ ID NO: 7715461 - DNA, 22 bp, Homo sapiens
tgactattttttatagattcca

SEQ ID NO: 7715462 - DNA, 22 bp, Homo sapiens
tgactcacagtggagaaagagg

SEQ ID NO: 7715463 - DNA, 22 bp, Homo sapiens
tgactcacagtggagaaagagg

SEQ ID NO: 7715464 - DNA, 22 bp, Homo sapiens
tgactctgaatttatgaaatgg

SEQ ID NO: 7715465 - DNA, 22 bp, Homo sapiens
tgactctgcccagccgcttgtc

SEQ ID NO: 7715466 - DNA, 22 bp, Homo sapiens
tgactctgctgtgaaagcattt

SEQ ID NO: 7715467 - DNA, 19 bp, Homo sapiens
tgactctgtggaacagaag

SEQ ID NO: 7715468 - DNA, 22 bp, Homo sapiens
tgactctgtacctgtctgcctt

SEQ ID NO: 7715469 - DNA, 22 bp, Homo sapiens
tgactctggggttgaccagatg

SEQ ID NO: 7715470 - DNA, 22 bp, Homo sapiens
tgactcttaaatatactgttga

SEQ ID NO: 7715471 - DNA, 19 bp, Homo sapiens
tgactctgtggaacagaag

SEQ ID NO: 7715472 - DNA, 19 bp, Homo sapiens
tgactctgtggaacagaag

SEQ ID NO: 7715473 - DNA, 22 bp, Homo sapiens
tgacagaaatagttcttaattt

SEQ ID NO: 7715474 - DNA, 22 bp, Homo sapiens
tgacagaaatagttcttaattt

SEQ ID NO: 7715475 - DNA, 22 bp, Homo sapiens
tgacagaacaggttgggagcaa

SEQ ID NO: 7715476 - DNA, 22 bp, Homo sapiens
tgacagaaagagtattaaagat

SEQ ID NO: 7715477 - DNA, 22 bp, Homo sapiens
tgacagaaagagtattaaagat

SEQ ID NO: 7715478 - DNA, 22 bp, Homo sapiens
tgacagaaagaatatgtcaatc

SEQ ID NO: 7715479 - DNA, 22 bp, Homo sapiens
tgacagaaatagttcttaattt

SEQ ID NO: 7715480 - DNA, 16 bp, Homo sapiens
tgacagaaagatctat

SEQ ID NO: 7715481 - DNA, 22 bp, Homo sapiens
tgacagaaagagtattaaagat

SEQ ID NO: 7715482 - DNA, 22 bp, Homo sapiens
tgacagaaagagtattaaagat

SEQ ID NO: 7715483 - DNA, 22 bp, Homo sapiens
tgacagaaagaatatgtcaatc

SEQ ID NO: 7715484 - DNA, 22 bp, Homo sapiens
tgacactttgtgactctgagaa

SEQ ID NO: 7715485 - DNA, 22 bp, Homo sapiens
tgacagaaagaatatgtcaatc

SEQ ID NO: 7715486 - DNA, 22 bp, Homo sapiens
tgacagaaagaatatgtcaatc

SEQ ID NO: 7715487 - DNA, 22 bp, Homo sapiens
tgacagaaaaatgtagctccat

SEQ ID NO: 7715488 - DNA, 22 bp, Homo sapiens
tgacagaaaaatgtagctccat

SEQ ID NO: 7715489 - DNA, 22 bp, Homo sapiens
tgacactgccgaaactgtagag

SEQ ID NO: 7715490 - DNA, 22 bp, Homo sapiens
tgacactgccgaaactgtagag

SEQ ID NO: 7715491 - DNA, 22 bp, Homo sapiens
tgacactgcatatattgaagtt

SEQ ID NO: 7715492 - DNA, 22 bp, Homo sapiens
tgacactgcatatattgaagtt

SEQ ID NO: 7715493 - DNA, 22 bp, Homo sapiens
tgacactgcaaatataaatatt

SEQ ID NO: 7715494 - DNA, 22 bp, Homo sapiens
tgacactgacctaaagacctgg

SEQ ID NO: 7715495 - DNA, 22 bp, Homo sapiens
tgacactagacttgaggcactg

SEQ ID NO: 7715496 - DNA, 22 bp, Homo sapiens
tgacactgacctaaagacctgg

SEQ ID NO: 7715497 - DNA, 22 bp, Homo sapiens
tgacacttgggctttgagaggt

SEQ ID NO: 7715498 - DNA, 18 bp, Homo sapiens
tgacagaacctggagcct

SEQ ID NO: 7715499 - DNA, 18 bp, Homo sapiens
tgacagaacctggagcct

SEQ ID NO: 7715500 - DNA, 22 bp, Homo sapiens
tgacagaactttttcacatctc

SEQ ID NO: 7715501 - DNA, 22 bp, Homo sapiens
tgacagaactcattctcaccaa

SEQ ID NO: 7715502 - DNA, 22 bp, Homo sapiens
tgacagaatgtgactctcagat

SEQ ID NO: 7715503 - DNA, 22 bp, Homo sapiens
tgacagaactttttcacatctc

SEQ ID NO: 7715504 - DNA, 22 bp, Homo sapiens
tgacagaactttttcacatctc

SEQ ID NO: 7715505 - DNA, 22 bp, Homo sapiens
tgacagaactttttcacatctc

SEQ ID NO: 7715506 - DNA, 22 bp, Homo sapiens
tgacagacagcttctcatttta

SEQ ID NO: 7715507 - DNA, 17 bp, Homo sapiens
tgacagacatcatgagc

SEQ ID NO: 7715508 - DNA, 22 bp, Homo sapiens
tgacagattttttctgagctaa

SEQ ID NO: 7715509 - DNA, 22 bp, Homo sapiens
tgacagattttttctgagctaa

SEQ ID NO: 7715510 - DNA, 22 bp, Homo sapiens
tgacagagttcggattgagttt

SEQ ID NO: 7715511 - DNA, 22 bp, Homo sapiens
tgacagattttgatggctaata

SEQ ID NO: 7715512 - DNA, 22 bp, Homo sapiens
tgacagcagcatagtgagcaat

SEQ ID NO: 7715513 - DNA, 21 bp, Homo sapiens
tgacagcacatgcaatcggag

SEQ ID NO: 7715514 - DNA, 22 bp, Homo sapiens
tgacagcagcatagtgagcaat

SEQ ID NO: 7715515 - DNA, 22 bp, Homo sapiens
tgacagcaataattttatcttc

SEQ ID NO: 7715516 - DNA, 21 bp, Homo sapiens
tgacagcacatgcaatcggag

SEQ ID NO: 7715517 - DNA, 21 bp, Homo sapiens
tgacagcacatgcaatcggag

SEQ ID NO: 7715518 - DNA, 23 bp, Homo sapiens
tgacagaccttcccagacagtca

SEQ ID NO: 7715519 - DNA, 22 bp, Homo sapiens
tgacagaccactgcaactctgt

SEQ ID NO: 7715520 - DNA, 22 bp, Homo sapiens
tgacagatgaagctggggacca

SEQ ID NO: 7715521 - DNA, 22 bp, Homo sapiens
tgacagagttcggattgagttt

SEQ ID NO: 7715522 - DNA, 23 bp, Homo sapiens
tgacagaccttcccagacagtca

SEQ ID NO: 7715523 - DNA, 22 bp, Homo sapiens
tgacagagttcggattgagttt

SEQ ID NO: 7715524 - DNA, 22 bp, Homo sapiens
tgacagaccactgcaactctgt

SEQ ID NO: 7715525 - DNA, 22 bp, Homo sapiens
tgacagaccactgcaactctgt

SEQ ID NO: 7715526 - DNA, 22 bp, Homo sapiens
tgacagacatggaagccagagt

SEQ ID NO: 7715527 - DNA, 22 bp, Homo sapiens
tgacagacatggaagccagagt

SEQ ID NO: 7715528 - DNA, 22 bp, Homo sapiens
tgacacactgccaggcgctcgg

SEQ ID NO: 7715529 - DNA, 22 bp, Homo sapiens
tgacacagaaattaagctgtca

SEQ ID NO: 7715530 - DNA, 22 bp, Homo sapiens
tgacacagaaattaagctgtca

SEQ ID NO: 7715531 - DNA, 22 bp, Homo sapiens
tgacacactaggaaaagcattt

SEQ ID NO: 7715532 - DNA, 22 bp, Homo sapiens
tgacacactaggaaaagcattt

SEQ ID NO: 7715533 - DNA, 22 bp, Homo sapiens
tgacacactaggaaaagcattt

SEQ ID NO: 7715534 - DNA, 22 bp, Homo sapiens
tgacacagaaattaagctgtca

SEQ ID NO: 7715535 - DNA, 22 bp, Homo sapiens
tgacacagaatttggctatcac

SEQ ID NO: 7715536 - DNA, 22 bp, Homo sapiens
tgacacagaatttggctatcac

SEQ ID NO: 7715537 - DNA, 22 bp, Homo sapiens
tgacacagaatttggctatcac

SEQ ID NO: 7715538 - DNA, 22 bp, Homo sapiens
tgacacagattagagacatacc

SEQ ID NO: 7715539 - DNA, 22 bp, Homo sapiens
tgacacagattagagacatacc

SEQ ID NO: 7715540 - DNA, 22 bp, Homo sapiens
tgacacagattagagacatacc

SEQ ID NO: 7715541 - DNA, 22 bp, Homo sapiens
tgacacagattagagacatacc

SEQ ID NO: 7715542 - DNA, 22 bp, Homo sapiens
tgacacagattagagacatacc

SEQ ID NO: 7715543 - DNA, 19 bp, Homo sapiens
tgacacagctaggtttgct

SEQ ID NO: 7715544 - DNA, 22 bp, Homo sapiens
tgacacagattagagacatacc

SEQ ID NO: 7715545 - DNA, 22 bp, Homo sapiens
tgacacaggtcaaatctacttt

SEQ ID NO: 7715546 - DNA, 22 bp, Homo sapiens
tgacacaggtcaaatctacttt

SEQ ID NO: 7715547 - DNA, 23 bp, Homo sapiens
tgacacaggtcaaaaataagatg

SEQ ID NO: 7715548 - DNA, 23 bp, Homo sapiens
tgacacaggtcaaaaataagatg

SEQ ID NO: 7715549 - DNA, 23 bp, Homo sapiens
tgacacaggtcaaaaataagatg

SEQ ID NO: 7715550 - DNA, 23 bp, Homo sapiens
tgacacaggtcaaaaataagatg

SEQ ID NO: 7715551 - DNA, 22 bp, Homo sapiens
tgacacaggggaaggagtctgg

SEQ ID NO: 7715552 - DNA, 22 bp, Homo sapiens
tgacacaggggaaggagtctgg

SEQ ID NO: 7715553 - DNA, 22 bp, Homo sapiens
tgacacagggcatgcagcagaa

SEQ ID NO: 7715554 - DNA, 22 bp, Homo sapiens
tgacacagggcatgcagcagaa

SEQ ID NO: 7715555 - DNA, 22 bp, Homo sapiens
tgacacagggcatgcagcagaa

SEQ ID NO: 7715556 - DNA, 22 bp, Homo sapiens
tgacacaggggaaggagtctgg

SEQ ID NO: 7715557 - DNA, 22 bp, Homo sapiens
tgacacaggggaaggagtctgg

SEQ ID NO: 7715558 - DNA, 22 bp, Homo sapiens
tgacacagggaaagcggatcca

SEQ ID NO: 7715559 - DNA, 22 bp, Homo sapiens
tgacacagggaaagcggatcca

SEQ ID NO: 7715560 - DNA, 22 bp, Homo sapiens
tgacacagggaaagcggatcca

SEQ ID NO: 7715561 - DNA, 22 bp, Homo sapiens
tgacacagggcatgcagcagaa

SEQ ID NO: 7715562 - DNA, 22 bp, Homo sapiens
tgacacagggcatgcagcagaa

SEQ ID NO: 7715563 - DNA, 22 bp, Homo sapiens
tgacacagggcatgcagcagaa

SEQ ID NO: 7715564 - DNA, 22 bp, Homo sapiens
tgacacagggaaagcggatcca

SEQ ID NO: 7715565 - DNA, 22 bp, Homo sapiens
tgacacaggcagctcccagcac

SEQ ID NO: 7715566 - DNA, 22 bp, Homo sapiens
tgacacaggcagctcccagcac

SEQ ID NO: 7715567 - DNA, 22 bp, Homo sapiens
tgacacaggcagctcccagcac

SEQ ID NO: 7715568 - DNA, 22 bp, Homo sapiens
tgacaccaaggaagtatcattt

SEQ ID NO: 7715569 - DNA, 22 bp, Homo sapiens
tgacaccaaggaagtatcattt

SEQ ID NO: 7715570 - DNA, 22 bp, Homo sapiens
tgacaccacaactagccattga

SEQ ID NO: 7715571 - DNA, 22 bp, Homo sapiens
tgacaccacaactagccattga

SEQ ID NO: 7715572 - DNA, 21 bp, Homo sapiens
tgacacccagagcctcctccc

SEQ ID NO: 7715573 - DNA, 21 bp, Homo sapiens
tgacacccagagcctcctccc

SEQ ID NO: 7715574 - DNA, 22 bp, Homo sapiens
tgacacccatctgtgccagtcc

SEQ ID NO: 7715575 - DNA, 21 bp, Homo sapiens
tgacacccagagcctcctccc

SEQ ID NO: 7715576 - DNA, 22 bp, Homo sapiens
tgacacccatctgtgccagtcc

SEQ ID NO: 7715577 - DNA, 22 bp, Homo sapiens
tgacacccattatctgtgtgac

SEQ ID NO: 7715578 - DNA, 22 bp, Homo sapiens
tgacacattaaatgctcacaaa

SEQ ID NO: 7715579 - DNA, 23 bp, Homo sapiens
tgacacatttcctttccactgca

SEQ ID NO: 7715580 - DNA, 22 bp, Homo sapiens
tgacacatgtgcttgtgggtag

SEQ ID NO: 7715581 - DNA, 22 bp, Homo sapiens
tgacacatgcaccagtctttaa

SEQ ID NO: 7715582 - DNA, 22 bp, Homo sapiens
tgacacattaaatgctcacaaa

SEQ ID NO: 7715583 - DNA, 22 bp, Homo sapiens
tgacacattaaatgctcacaaa

SEQ ID NO: 7715584 - DNA, 22 bp, Homo sapiens
tgacaccctctcctggagagag

SEQ ID NO: 7715585 - DNA, 22 bp, Homo sapiens
tgacacccattatctgtgtgac

SEQ ID NO: 7715586 - DNA, 23 bp, Homo sapiens
tgacaccctcattgtgtgtcgca

SEQ ID NO: 7715587 - DNA, 23 bp, Homo sapiens
tgacaccctcattgtgtgtcgca

SEQ ID NO: 7715588 - DNA, 22 bp, Homo sapiens
tgacaccttgctaaatggcacc

SEQ ID NO: 7715589 - DNA, 22 bp, Homo sapiens
tgacactaaatagctgtgtgcc

SEQ ID NO: 7715590 - DNA, 22 bp, Homo sapiens
tgacactaaatagctgtgtgcc

SEQ ID NO: 7715591 - DNA, 22 bp, Homo sapiens
tgacactatgtgtgcagccaga

SEQ ID NO: 7715592 - DNA, 22 bp, Homo sapiens
tgacactatgtgtgcagccaga

SEQ ID NO: 7715593 - DNA, 22 bp, Homo sapiens
tgacacagtagaaagatgatga

SEQ ID NO: 7715594 - DNA, 22 bp, Homo sapiens
tgacacagtagaaagatgatga

SEQ ID NO: 7715595 - DNA, 22 bp, Homo sapiens
tgacacagtagaaagatgatga

SEQ ID NO: 7715596 - DNA, 22 bp, Homo sapiens
tgacacagtagaaagatgatga

SEQ ID NO: 7715597 - DNA, 22 bp, Homo sapiens
tgacacagtatcaaacatgatt

SEQ ID NO: 7715598 - DNA, 22 bp, Homo sapiens
tgacacagtatcaaacatgatt

SEQ ID NO: 7715599 - DNA, 22 bp, Homo sapiens
tgacacagtgggggatcctttt

SEQ ID NO: 7715600 - DNA, 22 bp, Homo sapiens
tgacacagttgtcgactctaca

SEQ ID NO: 7715601 - DNA, 22 bp, Homo sapiens
tgacacagttgtcgactctaca

SEQ ID NO: 7715602 - DNA, 22 bp, Homo sapiens
tgacacagttgtcgactctaca

SEQ ID NO: 7715603 - DNA, 22 bp, Homo sapiens
tgacacataccgaaaatatttg

SEQ ID NO: 7715604 - DNA, 22 bp, Homo sapiens
tgacacataccgaaaatatttg

SEQ ID NO: 7715605 - DNA, 22 bp, Homo sapiens
tgacacataccgaaaatatttg

SEQ ID NO: 7715606 - DNA, 22 bp, Homo sapiens
tgacacatgcaccagtctttaa

SEQ ID NO: 7715607 - DNA, 22 bp, Homo sapiens
tgacacatgcaccagtctttaa

SEQ ID NO: 7715608 - DNA, 22 bp, Homo sapiens
tgacaggagggttgtggcaggg

SEQ ID NO: 7715609 - DNA, 22 bp, Homo sapiens
tgacaggagggttgtggcaggg

SEQ ID NO: 7715610 - DNA, 22 bp, Homo sapiens
tgacaggaggcttgaggccagg

SEQ ID NO: 7715611 - DNA, 22 bp, Homo sapiens
tgacaggagtggctagtgggag

SEQ ID NO: 7715612 - DNA, 22 bp, Homo sapiens
tgacaggagggttgtggcaggg

SEQ ID NO: 7715613 - DNA, 22 bp, Homo sapiens
tgacaggagggttgtggcaggg

SEQ ID NO: 7715614 - DNA, 22 bp, Homo sapiens
tgacaggatgatgagcaggggg

SEQ ID NO: 7715615 - DNA, 22 bp, Homo sapiens
tgacaggatgatgagcaggggg

SEQ ID NO: 7715616 - DNA, 22 bp, Homo sapiens
tgacaggatagtaggaagatct

SEQ ID NO: 7715617 - DNA, 22 bp, Homo sapiens
tgacaggatagtaggaagatct

SEQ ID NO: 7715618 - DNA, 22 bp, Homo sapiens
tgacaggagtggctagtgggag

SEQ ID NO: 7715619 - DNA, 22 bp, Homo sapiens
tgacaggagtggctagtgggag

SEQ ID NO: 7715620 - DNA, 22 bp, Homo sapiens
tgacaggatagtaggaagatct

SEQ ID NO: 7715621 - DNA, 22 bp, Homo sapiens
tgacaggatagtaggaagatct

SEQ ID NO: 7715622 - DNA, 22 bp, Homo sapiens
tgacaggattggttgcttctga

SEQ ID NO: 7715623 - DNA, 22 bp, Homo sapiens
tgacaggatgatgagcaggggg

SEQ ID NO: 7715624 - DNA, 22 bp, Homo sapiens
tgacaggatgatgagcaggggg

SEQ ID NO: 7715625 - DNA, 22 bp, Homo sapiens
tgacaggattggttgcttctga

SEQ ID NO: 7715626 - DNA, 22 bp, Homo sapiens
tgacaggattggttgcttctga

SEQ ID NO: 7715627 - DNA, 21 bp, Homo sapiens
tgacaggcaccctggctgtga

SEQ ID NO: 7715628 - DNA, 21 bp, Homo sapiens
tgacaggcaccctggctgtga

SEQ ID NO: 7715629 - DNA, 22 bp, Homo sapiens
tgacaggcaggacagaggtgtg

SEQ ID NO: 7715630 - DNA, 22 bp, Homo sapiens
tgacaggcaggacagaggtgtg

SEQ ID NO: 7715631 - DNA, 22 bp, Homo sapiens
tgacaggcaggacagaggtgtg

SEQ ID NO: 7715632 - DNA, 22 bp, Homo sapiens
tgacaggcactgctgtagtgct

SEQ ID NO: 7715633 - DNA, 22 bp, Homo sapiens
tgacaggcactgctgtagtgct

SEQ ID NO: 7715634 - DNA, 21 bp, Homo sapiens
tgacaggcaccctggctgtga

SEQ ID NO: 7715635 - DNA, 21 bp, Homo sapiens
tgacaggcaccctggctgtga

SEQ ID NO: 7715636 - DNA, 22 bp, Homo sapiens
tgacaggcagtgctgggcatgt

SEQ ID NO: 7715637 - DNA, 23 bp, Homo sapiens
tgacaggccagaagagcagctgg

SEQ ID NO: 7715638 - DNA, 23 bp, Homo sapiens
tgacaggccagaagagcagctgg

SEQ ID NO: 7715639 - DNA, 23 bp, Homo sapiens
tgacaggccagaagagcagctgg

SEQ ID NO: 7715640 - DNA, 23 bp, Homo sapiens
tgacaggccagaagagcagctgg

SEQ ID NO: 7715641 - DNA, 22 bp, Homo sapiens
tgacaggcagtgctgggcatgt

SEQ ID NO: 7715642 - DNA, 22 bp, Homo sapiens
tgacaggcagtgctgggcatgt

SEQ ID NO: 7715643 - DNA, 23 bp, Homo sapiens
tgacaggctgcttctggctgagg

SEQ ID NO: 7715644 - DNA, 23 bp, Homo sapiens
tgacaggctgcttctggctgagg

SEQ ID NO: 7715645 - DNA, 23 bp, Homo sapiens
tgacaggctgcttctggctgagg

SEQ ID NO: 7715646 - DNA, 22 bp, Homo sapiens
tgacaggctaggaggctgaagg

SEQ ID NO: 7715647 - DNA, 22 bp, Homo sapiens
tgacaggcgtttttctctagta

SEQ ID NO: 7715648 - DNA, 22 bp, Homo sapiens
tgacaggcgtttttctctagta

SEQ ID NO: 7715649 - DNA, 22 bp, Homo sapiens
tgacaggctaggaggctgaagg

SEQ ID NO: 7715650 - DNA, 22 bp, Homo sapiens
tgacagggacagtggagatgga

SEQ ID NO: 7715651 - DNA, 22 bp, Homo sapiens
tgacagggacagtggagatgga

SEQ ID NO: 7715652 - DNA, 22 bp, Homo sapiens
tgacaggcttgctaagacatag

SEQ ID NO: 7715653 - DNA, 23 bp, Homo sapiens
tgacaggctttgctccttctgcc

SEQ ID NO: 7715654 - DNA, 23 bp, Homo sapiens
tgacaggctttgctccttctgcc

SEQ ID NO: 7715655 - DNA, 23 bp, Homo sapiens
tgacaggctttgctccttctgcc

SEQ ID NO: 7715656 - DNA, 19 bp, Homo sapiens
tgacaggctgttgccttga

SEQ ID NO: 7715657 - DNA, 22 bp, Homo sapiens
tgacaggcttgctaagacatag

SEQ ID NO: 7715658 - DNA, 22 bp, Homo sapiens
tgacaggcttgctaagacatag

SEQ ID NO: 7715659 - DNA, 22 bp, Homo sapiens
tgacaggaaacatgcagtgatt

SEQ ID NO: 7715660 - DNA, 22 bp, Homo sapiens
tgacaggaaacatgcagtgatt

SEQ ID NO: 7715661 - DNA, 22 bp, Homo sapiens
tgacagctgcacaccccttcag

SEQ ID NO: 7715662 - DNA, 23 bp, Homo sapiens
tgacagctgcccagagggtttgg

SEQ ID NO: 7715663 - DNA, 22 bp, Homo sapiens
tgacagcttggacaggtccctc

SEQ ID NO: 7715664 - DNA, 22 bp, Homo sapiens
tgacagctgaggcccagagtac

SEQ ID NO: 7715665 - DNA, 22 bp, Homo sapiens
tgacaggaggcttgaggccagg

SEQ ID NO: 7715666 - DNA, 22 bp, Homo sapiens
tgacaggaggcttgaggccagg

SEQ ID NO: 7715667 - DNA, 22 bp, Homo sapiens
tgacaggaggcttgaggccagg

SEQ ID NO: 7715668 - DNA, 22 bp, Homo sapiens
tgacaggacagagaaatgacct

SEQ ID NO: 7715669 - DNA, 22 bp, Homo sapiens
tgacaggaaacatgcagtgatt

SEQ ID NO: 7715670 - DNA, 22 bp, Homo sapiens
tgacaggacagagaaatgacct

SEQ ID NO: 7715671 - DNA, 22 bp, Homo sapiens
tgacaggacagagaaatgacct

SEQ ID NO: 7715672 - DNA, 22 bp, Homo sapiens
tgacagcattactaatacatgt

SEQ ID NO: 7715673 - DNA, 22 bp, Homo sapiens
tgacagcatgaccacagggtct

SEQ ID NO: 7715674 - DNA, 22 bp, Homo sapiens
tgacagcatgaccacagggtct

SEQ ID NO: 7715675 - DNA, 22 bp, Homo sapiens
tgacagcatgaccacagggtct

SEQ ID NO: 7715676 - DNA, 22 bp, Homo sapiens
tgacagcattactaatacatgt

SEQ ID NO: 7715677 - DNA, 22 bp, Homo sapiens
tgacagcattactaatacatgt

SEQ ID NO: 7715678 - DNA, 22 bp, Homo sapiens
tgacagcattactaatacatgt

SEQ ID NO: 7715679 - DNA, 22 bp, Homo sapiens
tgacagcattactaatacatgt

SEQ ID NO: 7715680 - DNA, 22 bp, Homo sapiens
tgacagccatgatccttactgt

SEQ ID NO: 7715681 - DNA, 22 bp, Homo sapiens
tgacagcccacctcacaggatt

SEQ ID NO: 7715682 - DNA, 22 bp, Homo sapiens
tgacagcccacctcacaggatt

SEQ ID NO: 7715683 - DNA, 22 bp, Homo sapiens
tgacagctgaattccagggata

SEQ ID NO: 7715684 - DNA, 22 bp, Homo sapiens
tgacagctgagccccaggcaag

SEQ ID NO: 7715685 - DNA, 22 bp, Homo sapiens
tgacagctgagccccaggcaag

SEQ ID NO: 7715686 - DNA, 22 bp, Homo sapiens
tgacagcataacactggtcttg

SEQ ID NO: 7715687 - DNA, 22 bp, Homo sapiens
tgacagcagccacctctcaccc

SEQ ID NO: 7715688 - DNA, 23 bp, Homo sapiens
tgacagcaggaactgattatgta

SEQ ID NO: 7715689 - DNA, 22 bp, Homo sapiens
tgacagcagccacctctcaccc

SEQ ID NO: 7715690 - DNA, 23 bp, Homo sapiens
tgacagcaggaactgattatgta

SEQ ID NO: 7715691 - DNA, 22 bp, Homo sapiens
tgacagcagccacctctcaccc

SEQ ID NO: 7715692 - DNA, 22 bp, Homo sapiens
tgacagcagcatagtgagcaat

SEQ ID NO: 7715693 - DNA, 22 bp, Homo sapiens
tgacagcagcatagtgagcaat

SEQ ID NO: 7715694 - DNA, 22 bp, Homo sapiens
tgacagcagccacctctcaccc

SEQ ID NO: 7715695 - DNA, 22 bp, Homo sapiens
tgacagcagcatagtgagcaat

SEQ ID NO: 7715696 - DNA, 22 bp, Homo sapiens
tgacagcagcatagtgagcaat

SEQ ID NO: 7715697 - DNA, 19 bp, Homo sapiens
tgacagcatgaattaggac

SEQ ID NO: 7715698 - DNA, 21 bp, Homo sapiens
tgacagcatagagcagggagg

SEQ ID NO: 7715699 - DNA, 22 bp, Homo sapiens
tgacagcataacactggtcttg

SEQ ID NO: 7715700 - DNA, 22 bp, Homo sapiens
tgacagcataacactggtcttg

SEQ ID NO: 7715701 - DNA, 21 bp, Homo sapiens
tgacagcatagagcagggagg

SEQ ID NO: 7715702 - DNA, 22 bp, Homo sapiens
tgacagcataacactggtcttg

SEQ ID NO: 7715703 - DNA, 22 bp, Homo sapiens
tgacagcataacactggtcttg

SEQ ID NO: 7715704 - DNA, 22 bp, Homo sapiens
tgacagtgacagccaaaggctt

SEQ ID NO: 7715705 - DNA, 22 bp, Homo sapiens
tgacagtgaatgacaaggttct

SEQ ID NO: 7715706 - DNA, 22 bp, Homo sapiens
tgacagtctgcagttttaaaaa

SEQ ID NO: 7715707 - DNA, 22 bp, Homo sapiens
tgacagtattgatggcaggatt

SEQ ID NO: 7715708 - DNA, 22 bp, Homo sapiens
tgacagtgaacaggttaccact

SEQ ID NO: 7715709 - DNA, 22 bp, Homo sapiens
tgacagtagtgttagaactgat

SEQ ID NO: 7715710 - DNA, 22 bp, Homo sapiens
tgacagtaccactgaaagtctg

SEQ ID NO: 7715711 - DNA, 22 bp, Homo sapiens
tgacagtagaagatgctgttac

SEQ ID NO: 7715712 - DNA, 22 bp, Homo sapiens
tgacagtagtgttagaactgat

SEQ ID NO: 7715713 - DNA, 22 bp, Homo sapiens
tgacagtatacttgtgatggga

SEQ ID NO: 7715714 - DNA, 22 bp, Homo sapiens
tgacagtatacttgtgatggga

SEQ ID NO: 7715715 - DNA, 22 bp, Homo sapiens
tgacagtattgatggcaggatt

SEQ ID NO: 7715716 - DNA, 22 bp, Homo sapiens
tgacagtgcgggtacatcatag

SEQ ID NO: 7715717 - DNA, 22 bp, Homo sapiens
tgacagtgcatgtgacaaagga

SEQ ID NO: 7715718 - DNA, 22 bp, Homo sapiens
tgacagtgaatgacaaggttct

SEQ ID NO: 7715719 - DNA, 22 bp, Homo sapiens
tgacagtgacagccaaaggctt

SEQ ID NO: 7715720 - DNA, 22 bp, Homo sapiens
tgacagtgagcttggggtactt

SEQ ID NO: 7715721 - DNA, 22 bp, Homo sapiens
tgacaggtgctgggggcagtgt

SEQ ID NO: 7715722 - DNA, 22 bp, Homo sapiens
tgacaggttcgttagtcatgtt

SEQ ID NO: 7715723 - DNA, 22 bp, Homo sapiens
tgacaggttcgttagtcatgtt

SEQ ID NO: 7715724 - DNA, 22 bp, Homo sapiens
tgacaggtgctgggggcagtgt

SEQ ID NO: 7715725 - DNA, 19 bp, Homo sapiens
tgacaggttttatgtgttt

SEQ ID NO: 7715726 - DNA, 22 bp, Homo sapiens
tgacagtaattcactgggaccc

SEQ ID NO: 7715727 - DNA, 22 bp, Homo sapiens
tgacagtaccaccaaatctgat

SEQ ID NO: 7715728 - DNA, 22 bp, Homo sapiens
tgacagtaccactgaaagtctg

SEQ ID NO: 7715729 - DNA, 22 bp, Homo sapiens
tgacagtaccactgaaagtctg

SEQ ID NO: 7715730 - DNA, 22 bp, Homo sapiens
tgacaggttgtgtaggtggcca

SEQ ID NO: 7715731 - DNA, 21 bp, Homo sapiens
tgacaggtttaggattaaaat

SEQ ID NO: 7715732 - DNA, 22 bp, Homo sapiens
tgacagggaggtggaataagta

SEQ ID NO: 7715733 - DNA, 22 bp, Homo sapiens
tgacagggacagtggagatgga

SEQ ID NO: 7715734 - DNA, 22 bp, Homo sapiens
tgacagggacagtggagatgga

SEQ ID NO: 7715735 - DNA, 22 bp, Homo sapiens
tgacagggcaggcttactggtt

SEQ ID NO: 7715736 - DNA, 22 bp, Homo sapiens
tgacagggcaggcttactggtt

SEQ ID NO: 7715737 - DNA, 22 bp, Homo sapiens
tgacagggaggtggaataagta

SEQ ID NO: 7715738 - DNA, 22 bp, Homo sapiens
tgacagggcaggcttactggtt

SEQ ID NO: 7715739 - DNA, 22 bp, Homo sapiens
tgacagggccatgctgcactgc

SEQ ID NO: 7715740 - DNA, 22 bp, Homo sapiens
tgacagggccatgctgcactgc

SEQ ID NO: 7715741 - DNA, 22 bp, Homo sapiens
tgacagggctagaggcaatgca

SEQ ID NO: 7715742 - DNA, 22 bp, Homo sapiens
tgacagggctagaggcaatgca

SEQ ID NO: 7715743 - DNA, 22 bp, Homo sapiens
tgacagggctagaggcaatgca

SEQ ID NO: 7715744 - DNA, 22 bp, Homo sapiens
tgacagggcttccctttaatca

SEQ ID NO: 7715745 - DNA, 22 bp, Homo sapiens
tgacaggggctggtggataaat

SEQ ID NO: 7715746 - DNA, 22 bp, Homo sapiens
tgacagggcttccctttaatca

SEQ ID NO: 7715747 - DNA, 22 bp, Homo sapiens
tgacagggctgttctgttttag

SEQ ID NO: 7715748 - DNA, 22 bp, Homo sapiens
tgacagggggcagaggtggctg

SEQ ID NO: 7715749 - DNA, 22 bp, Homo sapiens
tgacaggggctggtggataaat

SEQ ID NO: 7715750 - DNA, 22 bp, Homo sapiens
tgacaggggctggtggataaat

SEQ ID NO: 7715751 - DNA, 22 bp, Homo sapiens
tgacagggacagtggagatgga

SEQ ID NO: 7715752 - DNA, 22 bp, Homo sapiens
tgacagggggcagaggtggctg

SEQ ID NO: 7715753 - DNA, 22 bp, Homo sapiens
tgacagggggcagaggtggctg

SEQ ID NO: 7715754 - DNA, 22 bp, Homo sapiens
tgacagggggcagaggtggctg

SEQ ID NO: 7715755 - DNA, 22 bp, Homo sapiens
tgacagggggcagaggtggctg

SEQ ID NO: 7715756 - DNA, 22 bp, Homo sapiens
tgacagggggcagaggtggctg

SEQ ID NO: 7715757 - DNA, 22 bp, Homo sapiens
tgacagggtcagagctgagctg

SEQ ID NO: 7715758 - DNA, 22 bp, Homo sapiens
tgacagggtcagagctgagctg

SEQ ID NO: 7715759 - DNA, 22 bp, Homo sapiens
tgacagggtcagagctgagctg

SEQ ID NO: 7715760 - DNA, 22 bp, Homo sapiens
tgacagggtcagagctgagctg

SEQ ID NO: 7715761 - DNA, 22 bp, Homo sapiens
tgacagggtcagagctgagctg

SEQ ID NO: 7715762 - DNA, 22 bp, Homo sapiens
tgacagggtcagagctgagctg

SEQ ID NO: 7715763 - DNA, 22 bp, Homo sapiens
tgacagggtcagagctgagctg

SEQ ID NO: 7715764 - DNA, 22 bp, Homo sapiens
tgacagggtcagagctgagctg

SEQ ID NO: 7715765 - DNA, 22 bp, Homo sapiens
tgacagggtgattatgagagct

SEQ ID NO: 7715766 - DNA, 22 bp, Homo sapiens
tgacagggtgtttgtgagacta

SEQ ID NO: 7715767 - DNA, 22 bp, Homo sapiens
tgacagggtgattatgagagct

SEQ ID NO: 7715768 - DNA, 22 bp, Homo sapiens
tgacagggtgattatgagagct

SEQ ID NO: 7715769 - DNA, 22 bp, Homo sapiens
tgacagggtgtttgtgagacta

SEQ ID NO: 7715770 - DNA, 22 bp, Homo sapiens
tgacagggtgtttgtgagacta

SEQ ID NO: 7715771 - DNA, 22 bp, Homo sapiens
tgacagggtgtttgtgagacta

SEQ ID NO: 7715772 - DNA, 21 bp, Homo sapiens
tgacaggtatttatctggaaa

SEQ ID NO: 7715773 - DNA, 22 bp, Homo sapiens
tgacaggtgattgtgaactaag

SEQ ID NO: 7715774 - DNA, 22 bp, Homo sapiens
tgaaagttaggatgtagtaatt

SEQ ID NO: 7715775 - DNA, 22 bp, Homo sapiens
tgaaagttacaggaaaacagat

SEQ ID NO: 7715776 - DNA, 22 bp, Homo sapiens
tgaaagttacaggaaaacagat

SEQ ID NO: 7715777 - DNA, 22 bp, Homo sapiens
tgaaagttaggatgtagtaatt

SEQ ID NO: 7715778 - DNA, 22 bp, Homo sapiens
tgaaagttattactgatgatgt

SEQ ID NO: 7715779 - DNA, 22 bp, Homo sapiens
tgaaagttattactgatgatgt

SEQ ID NO: 7715780 - DNA, 22 bp, Homo sapiens
tgaaagttgcacataagagaat

SEQ ID NO: 7715781 - DNA, 22 bp, Homo sapiens
tgaaagttgcacataagagaat

SEQ ID NO: 7715782 - DNA, 21 bp, Homo sapiens
tgaaagttggagtcaaatgta

SEQ ID NO: 7715783 - DNA, 21 bp, Homo sapiens
tgaaagttggagtcaaatgta

SEQ ID NO: 7715784 - DNA, 22 bp, Homo sapiens
tgaaagttcaataccaatttgg

SEQ ID NO: 7715785 - DNA, 22 bp, Homo sapiens
tgaaagttattactgatgatgt

SEQ ID NO: 7715786 - DNA, 23 bp, Homo sapiens
tgaaagttctgaagagatcatgc

SEQ ID NO: 7715787 - DNA, 23 bp, Homo sapiens
tgaaagttctgaagagatcatgc

SEQ ID NO: 7715788 - DNA, 22 bp, Homo sapiens
tgaaagttgcacataagagaat

SEQ ID NO: 7715789 - DNA, 22 bp, Homo sapiens
tgaaagttgcacataagagaat

SEQ ID NO: 7715790 - DNA, 22 bp, Homo sapiens
tgaaagttgcacataagagaat

SEQ ID NO: 7715791 - DNA, 22 bp, Homo sapiens
tgaaagtagcgcatttcactca

SEQ ID NO: 7715792 - DNA, 22 bp, Homo sapiens
tgaaagtatttgatttctatta

SEQ ID NO: 7715793 - DNA, 22 bp, Homo sapiens
tgaaagtctctgttatagagaa

SEQ ID NO: 7715794 - DNA, 22 bp, Homo sapiens
tgaaagtctctgttatagagaa

SEQ ID NO: 7715795 - DNA, 22 bp, Homo sapiens
tgaaagtgaatgtcactgttga

SEQ ID NO: 7715796 - DNA, 22 bp, Homo sapiens
tgaaagtgtcatagaaacccat

SEQ ID NO: 7715797 - DNA, 22 bp, Homo sapiens
tgaaaggttatttaggtctgct

SEQ ID NO: 7715798 - DNA, 20 bp, Homo sapiens
tgaaaggtgggaattgtggg

SEQ ID NO: 7715799 - DNA, 22 bp, Homo sapiens
tgaaaggttaaaagtagtattg

SEQ ID NO: 7715800 - DNA, 22 bp, Homo sapiens
tgaaaggtgacatttcttggat

SEQ ID NO: 7715801 - DNA, 20 bp, Homo sapiens
tgaaaggtgggaattgtggg

SEQ ID NO: 7715802 - DNA, 22 bp, Homo sapiens
tgaaaggtgtccaatatttctc

SEQ ID NO: 7715803 - DNA, 22 bp, Homo sapiens
tgaaagcacaagttctaacagg

SEQ ID NO: 7715804 - DNA, 23 bp, Homo sapiens
tgaaagcaatgggtctatagtat

SEQ ID NO: 7715805 - DNA, 22 bp, Homo sapiens
tgaaagcacaagttctaacagg

SEQ ID NO: 7715806 - DNA, 22 bp, Homo sapiens
tgaaagcacaagttctaacagg

SEQ ID NO: 7715807 - DNA, 23 bp, Homo sapiens
tgaaagcaatgggtctatagtat

SEQ ID NO: 7715808 - DNA, 23 bp, Homo sapiens
tgaaagcaatgggtctatagtat

SEQ ID NO: 7715809 - DNA, 23 bp, Homo sapiens
tgaaagcaatgggtctatagtat

SEQ ID NO: 7715810 - DNA, 23 bp, Homo sapiens
tgaaagcaatgggtctatagtat

SEQ ID NO: 7715811 - DNA, 23 bp, Homo sapiens
tgaaagcaatgggtctatagtat

SEQ ID NO: 7715812 - DNA, 22 bp, Homo sapiens
tgaaagcactcacttctgctct

SEQ ID NO: 7715813 - DNA, 22 bp, Homo sapiens
tgaaagcacaagttctaacagg

SEQ ID NO: 7715814 - DNA, 22 bp, Homo sapiens
tgaaagcactcacttctgctct

SEQ ID NO: 7715815 - DNA, 22 bp, Homo sapiens
tgaaagcactgattctcaactc

SEQ ID NO: 7715816 - DNA, 22 bp, Homo sapiens
tgaaaggtagctggcctcatag

SEQ ID NO: 7715817 - DNA, 22 bp, Homo sapiens
tgaaagcacaagttctaacagg

SEQ ID NO: 7715818 - DNA, 22 bp, Homo sapiens
tgaaagcactcacttctgctct

SEQ ID NO: 7715819 - DNA, 22 bp, Homo sapiens
tgaaagcactcacttctgctct

SEQ ID NO: 7715820 - DNA, 22 bp, Homo sapiens
tgaaagataagttattatgtac

SEQ ID NO: 7715821 - DNA, 22 bp, Homo sapiens
tgaaagagtttgacatgattct

SEQ ID NO: 7715822 - DNA, 22 bp, Homo sapiens
tgaaagataagttattatgtac

SEQ ID NO: 7715823 - DNA, 22 bp, Homo sapiens
tgaaagataagttattatgtac

SEQ ID NO: 7715824 - DNA, 22 bp, Homo sapiens
tgaaagatgaaagcaggctggt

SEQ ID NO: 7715825 - DNA, 22 bp, Homo sapiens
tgaaagatgaaagcaggctggt

SEQ ID NO: 7715826 - DNA, 22 bp, Homo sapiens
tgaaagagtttgacatgattct

SEQ ID NO: 7715827 - DNA, 22 bp, Homo sapiens
tgaaagagtttgacatgattct

SEQ ID NO: 7715828 - DNA, 22 bp, Homo sapiens
tgaaagagtgcaagtcaaggag

SEQ ID NO: 7715829 - DNA, 22 bp, Homo sapiens
tgaaagagtttgacatgattct

SEQ ID NO: 7715830 - DNA, 22 bp, Homo sapiens
tgaaagcaacctgtaacagtga

SEQ ID NO: 7715831 - DNA, 22 bp, Homo sapiens
tgaaagattgtgattcaatatg

SEQ ID NO: 7715832 - DNA, 22 bp, Homo sapiens
tgaaagcaacctgtaacagtga

SEQ ID NO: 7715833 - DNA, 22 bp, Homo sapiens
tgaaagcaacctgtaacagtga

SEQ ID NO: 7715834 - DNA, 22 bp, Homo sapiens
tgaaagatgctcaatgaatggt

SEQ ID NO: 7715835 - DNA, 22 bp, Homo sapiens
tgaaagatgctcaatgaatggt

SEQ ID NO: 7715836 - DNA, 22 bp, Homo sapiens
tgaaagatgctcaatgaatggt

SEQ ID NO: 7715837 - DNA, 22 bp, Homo sapiens
tgaaagatgctcaatgaatggt

SEQ ID NO: 7715838 - DNA, 22 bp, Homo sapiens
tgaaagatgctcaatgaatggt

SEQ ID NO: 7715839 - DNA, 20 bp, Homo sapiens
tgaaataaggagttgtcctt

SEQ ID NO: 7715840 - DNA, 20 bp, Homo sapiens
tgaaataaggagttgtcctt

SEQ ID NO: 7715841 - DNA, 22 bp, Homo sapiens
tgaaataacttttgggtgagtt

SEQ ID NO: 7715842 - DNA, 22 bp, Homo sapiens
tgaaataacttttgggtgagtt

SEQ ID NO: 7715843 - DNA, 21 bp, Homo sapiens
tgaaagttggagtcaaatgta

SEQ ID NO: 7715844 - DNA, 22 bp, Homo sapiens
tgaaataatatctggatcaatc

SEQ ID NO: 7715845 - DNA, 22 bp, Homo sapiens
tgaaataatatctggatcaatc

SEQ ID NO: 7715846 - DNA, 22 bp, Homo sapiens
tgaaatacacaaatttagtaag

SEQ ID NO: 7715847 - DNA, 22 bp, Homo sapiens
tgaaatacacaaatttagtaag

SEQ ID NO: 7715848 - DNA, 22 bp, Homo sapiens
tgaaatacacaaatttagtaag

SEQ ID NO: 7715849 - DNA, 22 bp, Homo sapiens
tgaaatacacaaatttagtaag

SEQ ID NO: 7715850 - DNA, 22 bp, Homo sapiens
tgaaatacacaaatttagtaag

SEQ ID NO: 7715851 - DNA, 22 bp, Homo sapiens
tgaaatacacaaatttagtaag

SEQ ID NO: 7715852 - DNA, 22 bp, Homo sapiens
tgaaatacacaaatttagtaag

SEQ ID NO: 7715853 - DNA, 22 bp, Homo sapiens
tgaaatactgagtgaaagaatt

SEQ ID NO: 7715854 - DNA, 22 bp, Homo sapiens
tgaaatactttggctctttgtt

SEQ ID NO: 7715855 - DNA, 22 bp, Homo sapiens
tgaaatagaaaaacaggcttct

SEQ ID NO: 7715856 - DNA, 22 bp, Homo sapiens
tgaaatactgagtgaaagaatt

SEQ ID NO: 7715857 - DNA, 22 bp, Homo sapiens
tgaaatactgagtgaaagaatt

SEQ ID NO: 7715858 - DNA, 22 bp, Homo sapiens
tgaaatactgagtgaaagaatt

SEQ ID NO: 7715859 - DNA, 22 bp, Homo sapiens
tgaaatactgagtgaaagaatt

SEQ ID NO: 7715860 - DNA, 22 bp, Homo sapiens
tgaaatactgagtgaaagaatt

SEQ ID NO: 7715861 - DNA, 22 bp, Homo sapiens
tgaaatagacttgcactatatg

SEQ ID NO: 7715862 - DNA, 22 bp, Homo sapiens
tgaaatagacacagtgctatac

SEQ ID NO: 7715863 - DNA, 20 bp, Homo sapiens
tgaaatagatactcagagat

SEQ ID NO: 7715864 - DNA, 20 bp, Homo sapiens
tgaaatagatactcagagat

SEQ ID NO: 7715865 - DNA, 22 bp, Homo sapiens
tgaaataggaaacagatgtttc

SEQ ID NO: 7715866 - DNA, 22 bp, Homo sapiens
tgaaataggaaacagatgtttc

SEQ ID NO: 7715867 - DNA, 22 bp, Homo sapiens
tgaaataggaaacagatgtttc

SEQ ID NO: 7715868 - DNA, 22 bp, Homo sapiens
tgaaatagtcaagtatttgaac

SEQ ID NO: 7715869 - DNA, 22 bp, Homo sapiens
tgaaatatcattttcatctccc

SEQ ID NO: 7715870 - DNA, 22 bp, Homo sapiens
tgaaatatcattttcatctccc

SEQ ID NO: 7715871 - DNA, 22 bp, Homo sapiens
tgaaatatcattttcatctccc

SEQ ID NO: 7715872 - DNA, 22 bp, Homo sapiens
tgaaatagtctaaaaaaccaga

SEQ ID NO: 7715873 - DNA, 22 bp, Homo sapiens
tgaaatagtctaaaaaaccaga

SEQ ID NO: 7715874 - DNA, 22 bp, Homo sapiens
tgaaatatccagcccagcagga

SEQ ID NO: 7715875 - DNA, 22 bp, Homo sapiens
tgaaatatccagcccagcagga

SEQ ID NO: 7715876 - DNA, 22 bp, Homo sapiens
tgaaatatcattttcatctccc

SEQ ID NO: 7715877 - DNA, 22 bp, Homo sapiens
tgaaatatccagcccagcagga

SEQ ID NO: 7715878 - DNA, 22 bp, Homo sapiens
tgaaatcagtggtataatcggg

SEQ ID NO: 7715879 - DNA, 22 bp, Homo sapiens
tgaaatcagtggtataatcggg

SEQ ID NO: 7715880 - DNA, 22 bp, Homo sapiens
tgaaatcataacagtttggctt

SEQ ID NO: 7715881 - DNA, 22 bp, Homo sapiens
tgaaatcatcaaaagagccatt

SEQ ID NO: 7715882 - DNA, 22 bp, Homo sapiens
tgaaatcatctgccaataagtt

SEQ ID NO: 7715883 - DNA, 22 bp, Homo sapiens
tgaaatcatctgccaataagtt

SEQ ID NO: 7715884 - DNA, 22 bp, Homo sapiens
tgaaatcagtatgtctttctca

SEQ ID NO: 7715885 - DNA, 22 bp, Homo sapiens
tgaaatcaattgcaatgtttat

SEQ ID NO: 7715886 - DNA, 22 bp, Homo sapiens
tgaaatcaattgcaatgtttat

SEQ ID NO: 7715887 - DNA, 22 bp, Homo sapiens
tgaaatcaattgcaatgtttat

SEQ ID NO: 7715888 - DNA, 17 bp, Homo sapiens
tgaaatcagcacccagg

SEQ ID NO: 7715889 - DNA, 22 bp, Homo sapiens
tgaaatcaactaggagacacca

SEQ ID NO: 7715890 - DNA, 22 bp, Homo sapiens
tgaaatcaactaggagacacca

SEQ ID NO: 7715891 - DNA, 22 bp, Homo sapiens
tgaaatcaactaggagacacca

SEQ ID NO: 7715892 - DNA, 22 bp, Homo sapiens
tgaaatatttagagagtaagtt

SEQ ID NO: 7715893 - DNA, 22 bp, Homo sapiens
tgaaatatttagagagtaagtt

SEQ ID NO: 7715894 - DNA, 22 bp, Homo sapiens
tgaaatcaataattggtgattg

SEQ ID NO: 7715895 - DNA, 22 bp, Homo sapiens
tgaaatcaattgcaatgtttat

SEQ ID NO: 7715896 - DNA, 22 bp, Homo sapiens
tgaaatcaatgtcttctgtctc

SEQ ID NO: 7715897 - DNA, 22 bp, Homo sapiens
tgaaatatgctcccattcactt

SEQ ID NO: 7715898 - DNA, 22 bp, Homo sapiens
tgaaatatgctcccattcactt

SEQ ID NO: 7715899 - DNA, 22 bp, Homo sapiens
tgaaatatgctcccattcactt

SEQ ID NO: 7715900 - DNA, 23 bp, Homo sapiens
tgaaatattcttttgcatgagct

SEQ ID NO: 7715901 - DNA, 23 bp, Homo sapiens
tgaaatattcttttgcatgagct

SEQ ID NO: 7715902 - DNA, 23 bp, Homo sapiens
tgaaatattcttttgcatgagct

SEQ ID NO: 7715903 - DNA, 23 bp, Homo sapiens
tgaaatattcttttgcatgagct

SEQ ID NO: 7715904 - DNA, 22 bp, Homo sapiens
tgaaatatttagagagtaagtt

SEQ ID NO: 7715905 - DNA, 22 bp, Homo sapiens
tgaaatatttagagagtaagtt

SEQ ID NO: 7715906 - DNA, 22 bp, Homo sapiens
tgaaatatttagagagtaagtt

SEQ ID NO: 7715907 - DNA, 22 bp, Homo sapiens
tgaaatgtttgggtccagaagt

SEQ ID NO: 7715908 - DNA, 22 bp, Homo sapiens
tgaaatgtttgggtccagaagt

SEQ ID NO: 7715909 - DNA, 22 bp, Homo sapiens
tgaaatgtttgggtccagaagt

SEQ ID NO: 7715910 - DNA, 22 bp, Homo sapiens
tgaaatgtttatctctcctgct

SEQ ID NO: 7715911 - DNA, 22 bp, Homo sapiens
tgaaatgtttatctctcctgct

SEQ ID NO: 7715912 - DNA, 22 bp, Homo sapiens
tgaaatgtttatctctcctgct

SEQ ID NO: 7715913 - DNA, 22 bp, Homo sapiens
tgaaatgtttgaagaccactga

SEQ ID NO: 7715914 - DNA, 22 bp, Homo sapiens
tgaaatgtttaggaccactaga

SEQ ID NO: 7715915 - DNA, 22 bp, Homo sapiens
tgaaatgttggtaattttatat

SEQ ID NO: 7715916 - DNA, 22 bp, Homo sapiens
tgaaatgttggtaattttatat

SEQ ID NO: 7715917 - DNA, 22 bp, Homo sapiens
tgaaatgtttaggaccactaga

SEQ ID NO: 7715918 - DNA, 22 bp, Homo sapiens
tgaaatgttggcatcggtacct

SEQ ID NO: 7715919 - DNA, 22 bp, Homo sapiens
tgaaatgttggtaattttatat

SEQ ID NO: 7715920 - DNA, 22 bp, Homo sapiens
tgaaatgttggtaattttatat

SEQ ID NO: 7715921 - DNA, 22 bp, Homo sapiens
tgaaatgttctggagtttctgt

SEQ ID NO: 7715922 - DNA, 22 bp, Homo sapiens
tgaaatgttaatcacacaaagg

SEQ ID NO: 7715923 - DNA, 22 bp, Homo sapiens
tgaaatgttgccatgaggtctc

SEQ ID NO: 7715924 - DNA, 22 bp, Homo sapiens
tgaaatgttgccatgaggtctc

SEQ ID NO: 7715925 - DNA, 22 bp, Homo sapiens
tgaaatgttaatcacacaaagg

SEQ ID NO: 7715926 - DNA, 22 bp, Homo sapiens
tgaaatgttaaacaagtggctc

SEQ ID NO: 7715927 - DNA, 22 bp, Homo sapiens
tgaaatgtgttctagtgttttg

SEQ ID NO: 7715928 - DNA, 22 bp, Homo sapiens
tgaaatgttaaacaagtggctc

SEQ ID NO: 7715929 - DNA, 22 bp, Homo sapiens
tgaaatgtgttctagtgttttg

SEQ ID NO: 7715930 - DNA, 22 bp, Homo sapiens
tgaaatgtgttctagtgttttg

SEQ ID NO: 7715931 - DNA, 22 bp, Homo sapiens
tgaaatgtgttctagtgttttg

SEQ ID NO: 7715932 - DNA, 22 bp, Homo sapiens
tgaaatgtggagatggtaagta

SEQ ID NO: 7715933 - DNA, 22 bp, Homo sapiens
tgaaatgtgatctgagcttggc

SEQ ID NO: 7715934 - DNA, 22 bp, Homo sapiens
tgaaatgtctttgcaattgaaa

SEQ ID NO: 7715935 - DNA, 22 bp, Homo sapiens
tgaaatgtctttgcaattgaaa

SEQ ID NO: 7715936 - DNA, 22 bp, Homo sapiens
tgaaatgtctttgcaattgaaa

SEQ ID NO: 7715937 - DNA, 22 bp, Homo sapiens
tgaaatgtctgaaagccaatct

SEQ ID NO: 7715938 - DNA, 22 bp, Homo sapiens
tgaaatgtgtccatgttatttc

SEQ ID NO: 7715939 - DNA, 22 bp, Homo sapiens
tgaaatgtgtccatgttatttc

SEQ ID NO: 7715940 - DNA, 22 bp, Homo sapiens
tgaaatgtgtccatgttatttc

SEQ ID NO: 7715941 - DNA, 22 bp, Homo sapiens
tgaaatgtgttatctgggcctg

SEQ ID NO: 7715942 - DNA, 22 bp, Homo sapiens
tgaaatgtgttatctgggcctg

SEQ ID NO: 7715943 - DNA, 22 bp, Homo sapiens
tgaaatgtcagtgttttataag

SEQ ID NO: 7715944 - DNA, 22 bp, Homo sapiens
tgaaatgtcagtgttttataag

SEQ ID NO: 7715945 - DNA, 22 bp, Homo sapiens
tgaaatgtcagtgttttataag

SEQ ID NO: 7715946 - DNA, 22 bp, Homo sapiens
tgaaatgtctcacttagacttt

SEQ ID NO: 7715947 - DNA, 22 bp, Homo sapiens
tgaaatgtcatcctttagccat

SEQ ID NO: 7715948 - DNA, 22 bp, Homo sapiens
tgaaatgtcatcctttagccat

SEQ ID NO: 7715949 - DNA, 22 bp, Homo sapiens
tgaaatgtacataaaaacgcac

SEQ ID NO: 7715950 - DNA, 23 bp, Homo sapiens
tgaaatgtagaggaattccacct

SEQ ID NO: 7715951 - DNA, 23 bp, Homo sapiens
tgaaatgtagaggaattccacct

SEQ ID NO: 7715952 - DNA, 22 bp, Homo sapiens
tgaaatgtagattaggcattct

SEQ ID NO: 7715953 - DNA, 22 bp, Homo sapiens
tgaaatgtagtgaagcatggaa

SEQ ID NO: 7715954 - DNA, 22 bp, Homo sapiens
tgaaatgtagtgaagcatggaa

SEQ ID NO: 7715955 - DNA, 22 bp, Homo sapiens
tgaaatgtatattgccagtgta

SEQ ID NO: 7715956 - DNA, 21 bp, Homo sapiens
tgaaatctgatgggacaaatg

SEQ ID NO: 7715957 - DNA, 21 bp, Homo sapiens
tgaaatctgatgggacaaatg

SEQ ID NO: 7715958 - DNA, 21 bp, Homo sapiens
tgaaatctgatgggacaaatg

SEQ ID NO: 7715959 - DNA, 21 bp, Homo sapiens
tgaaatctgatgggacaaatg

SEQ ID NO: 7715960 - DNA, 22 bp, Homo sapiens
tgaaatctgcatgcaaagtcct

SEQ ID NO: 7715961 - DNA, 22 bp, Homo sapiens
tgaaatctgcatgcaaagtcct

SEQ ID NO: 7715962 - DNA, 22 bp, Homo sapiens
tgaaatctgcatgcaaagtcct

SEQ ID NO: 7715963 - DNA, 21 bp, Homo sapiens
tgaaatctgatgggacaaatg

SEQ ID NO: 7715964 - DNA, 22 bp, Homo sapiens
tgaaatcttagccattctgcct

SEQ ID NO: 7715965 - DNA, 22 bp, Homo sapiens
tgaaatctgtcccactttagct

SEQ ID NO: 7715966 - DNA, 22 bp, Homo sapiens
tgaaatctgcatgcaaagtcct

SEQ ID NO: 7715967 - DNA, 22 bp, Homo sapiens
tgaaatctgtcccactttagct

SEQ ID NO: 7715968 - DNA, 22 bp, Homo sapiens
tgaaatctgtcccactttagct

SEQ ID NO: 7715969 - DNA, 22 bp, Homo sapiens
tgaaatcattggggttgaataa

SEQ ID NO: 7715970 - DNA, 22 bp, Homo sapiens
tgaaatcattggggttgaataa

SEQ ID NO: 7715971 - DNA, 22 bp, Homo sapiens
tgaaatcattggggttgaataa

SEQ ID NO: 7715972 - DNA, 21 bp, Homo sapiens
tgaaatctgatgggacaaatg

SEQ ID NO: 7715973 - DNA, 22 bp, Homo sapiens
tgaaatctcctctttatatatc

SEQ ID NO: 7715974 - DNA, 22 bp, Homo sapiens
tgaaatctcctctttatatatc

SEQ ID NO: 7715975 - DNA, 22 bp, Homo sapiens
tgaaatctaccctattcagggt

SEQ ID NO: 7715976 - DNA, 22 bp, Homo sapiens
tgaaatctaccctattcagggt

SEQ ID NO: 7715977 - DNA, 22 bp, Homo sapiens
tgaaatctaccctattcagggt

SEQ ID NO: 7715978 - DNA, 22 bp, Homo sapiens
tgaaatcatgagatagtgtcac

SEQ ID NO: 7715979 - DNA, 22 bp, Homo sapiens
tgaaatcatgagatagtgtcac

SEQ ID NO: 7715980 - DNA, 22 bp, Homo sapiens
tgaaatcatgagatagtgtcac

SEQ ID NO: 7715981 - DNA, 22 bp, Homo sapiens
tgaaatcatctgccaataagtt

SEQ ID NO: 7715982 - DNA, 22 bp, Homo sapiens
tgaaatcatctgccaataagtt

SEQ ID NO: 7715983 - DNA, 22 bp, Homo sapiens
tgaaatcatgaacaaggtaggt

SEQ ID NO: 7715984 - DNA, 22 bp, Homo sapiens
tgaaatcatgaacaaggtaggt

SEQ ID NO: 7715985 - DNA, 22 bp, Homo sapiens
tgaaatcatgtagttattgcaa

SEQ ID NO: 7715986 - DNA, 22 bp, Homo sapiens
tgaaatcatgtagttattgcaa

SEQ ID NO: 7715987 - DNA, 22 bp, Homo sapiens
tgaaatcattgccaagtattga

SEQ ID NO: 7715988 - DNA, 22 bp, Homo sapiens
tgaaatcattgccaagtattga

SEQ ID NO: 7715989 - DNA, 22 bp, Homo sapiens
tgaaatcattgccaagtattga

SEQ ID NO: 7715990 - DNA, 22 bp, Homo sapiens
tgaaatcattgccaagtattga

SEQ ID NO: 7715991 - DNA, 22 bp, Homo sapiens
tgaaatgaaacagaacatatca

SEQ ID NO: 7715992 - DNA, 22 bp, Homo sapiens
tgaaatgaaacagaacatatca

SEQ ID NO: 7715993 - DNA, 22 bp, Homo sapiens
tgaaatgcaacagttatttttg

SEQ ID NO: 7715994 - DNA, 22 bp, Homo sapiens
tgaaatgcaatggggatccatt

SEQ ID NO: 7715995 - DNA, 22 bp, Homo sapiens
tgaaatgcaatggggatccatt

SEQ ID NO: 7715996 - DNA, 22 bp, Homo sapiens
tgaaatgcacatattccataaa

SEQ ID NO: 7715997 - DNA, 22 bp, Homo sapiens
tgaaatgcctatgaagtcagga

SEQ ID NO: 7715998 - DNA, 22 bp, Homo sapiens
tgaaatcttatactttggtagt

SEQ ID NO: 7715999 - DNA, 22 bp, Homo sapiens
tgaaatcttcactaagtctctt

SEQ ID NO: 7716000 - DNA, 22 bp, Homo sapiens
tgaaatcttcactaagtctctt

SEQ ID NO: 7716001 - DNA, 22 bp, Homo sapiens
tgaaatcttcactaagtctctt

SEQ ID NO: 7716002 - DNA, 22 bp, Homo sapiens
tgaaatgctgtagagactgtat

SEQ ID NO: 7716003 - DNA, 22 bp, Homo sapiens
tgaaatgcctatgaagtcagga

SEQ ID NO: 7716004 - DNA, 22 bp, Homo sapiens
tgaaatgctgtagagactgtat

SEQ ID NO: 7716005 - DNA, 22 bp, Homo sapiens
tgaaatgctgtagagactgtat

SEQ ID NO: 7716006 - DNA, 22 bp, Homo sapiens
tgaaatgcttctctgaaaatac

SEQ ID NO: 7716007 - DNA, 22 bp, Homo sapiens
tgaaatgcttctctgaaaatac

SEQ ID NO: 7716008 - DNA, 22 bp, Homo sapiens
tgaaatgcttctctgaaaatac

SEQ ID NO: 7716009 - DNA, 22 bp, Homo sapiens
tgaaatgcttgggaccagaagt

SEQ ID NO: 7716010 - DNA, 22 bp, Homo sapiens
tgaaatgcttgggaccagaagt

SEQ ID NO: 7716011 - DNA, 22 bp, Homo sapiens
tgaaatgcttaggaccagaagg

SEQ ID NO: 7716012 - DNA, 22 bp, Homo sapiens
tgaaatgcttaggaccagaagg

SEQ ID NO: 7716013 - DNA, 22 bp, Homo sapiens
tgaaatgctgtagagactgtat

SEQ ID NO: 7716014 - DNA, 22 bp, Homo sapiens
tgaaatgctgtagagactgtat

SEQ ID NO: 7716015 - DNA, 22 bp, Homo sapiens
tgaaatgcttaggaccagaagg

SEQ ID NO: 7716016 - DNA, 22 bp, Homo sapiens
tgaaatggcaaggcagagcttt

SEQ ID NO: 7716017 - DNA, 22 bp, Homo sapiens
tgaaatggcaaggcagagcttt

SEQ ID NO: 7716018 - DNA, 22 bp, Homo sapiens
tgaaatggattgaagtggctta

SEQ ID NO: 7716019 - DNA, 22 bp, Homo sapiens
tgaaatggaggttttttctctc

SEQ ID NO: 7716020 - DNA, 19 bp, Homo sapiens
tgaaatggcagttgctaaa

SEQ ID NO: 7716021 - DNA, 22 bp, Homo sapiens
tgaaatggcaaggcagagcttt

SEQ ID NO: 7716022 - DNA, 22 bp, Homo sapiens
tgaaatggatgagagcagaggt

SEQ ID NO: 7716023 - DNA, 22 bp, Homo sapiens
tgaaatggatgagagcagaggt

SEQ ID NO: 7716024 - DNA, 22 bp, Homo sapiens
tgaaatggaattaatttgtatt

SEQ ID NO: 7716025 - DNA, 22 bp, Homo sapiens
tgaaatggaattaatttgtatt

SEQ ID NO: 7716026 - DNA, 22 bp, Homo sapiens
tgaaatgcttttacaggatatt

SEQ ID NO: 7716027 - DNA, 22 bp, Homo sapiens
tgaaatgcttgggaccagaagt

SEQ ID NO: 7716028 - DNA, 22 bp, Homo sapiens
tgaaatgcttttacaggatatt

SEQ ID NO: 7716029 - DNA, 22 bp, Homo sapiens
tgaaatgcttttacaggatatt

SEQ ID NO: 7716030 - DNA, 22 bp, Homo sapiens
tgaaatgtacataaaaacgcac

SEQ ID NO: 7716031 - DNA, 22 bp, Homo sapiens
tgaaatgtacaagtgctttttt

SEQ ID NO: 7716032 - DNA, 22 bp, Homo sapiens
tgaaatgtacaagtgctttttt

SEQ ID NO: 7716033 - DNA, 22 bp, Homo sapiens
tgaaatgtacaagtgctttttt

SEQ ID NO: 7716034 - DNA, 22 bp, Homo sapiens
tgaaatgtacaagtgctttttt

SEQ ID NO: 7716035 - DNA, 22 bp, Homo sapiens
tgaaatggtattctttttcaat

SEQ ID NO: 7716036 - DNA, 22 bp, Homo sapiens
tgaaatggcccaaacacccagt

SEQ ID NO: 7716037 - DNA, 22 bp, Homo sapiens
tgaaatgtaaataggactagaa

SEQ ID NO: 7716038 - DNA, 22 bp, Homo sapiens
tgaagaataagatagatggagc

SEQ ID NO: 7716039 - DNA, 22 bp, Homo sapiens
tgaagaataagatagatggagc

SEQ ID NO: 7716040 - DNA, 22 bp, Homo sapiens
tgaagaataaatggttgagact

SEQ ID NO: 7716041 - DNA, 22 bp, Homo sapiens
tgaagaataagatagatggagc

SEQ ID NO: 7716042 - DNA, 22 bp, Homo sapiens
tgaagaataagatagatggagc

SEQ ID NO: 7716043 - DNA, 22 bp, Homo sapiens
tgaagaataagatagatggagc

SEQ ID NO: 7716044 - DNA, 22 bp, Homo sapiens
tgaagaacgtgagatccagaaa

SEQ ID NO: 7716045 - DNA, 22 bp, Homo sapiens
tgaagaacctgatgagctgtgt

SEQ ID NO: 7716046 - DNA, 22 bp, Homo sapiens
tgaagaagccaattggtaggct

SEQ ID NO: 7716047 - DNA, 22 bp, Homo sapiens
tgaagaagccaattggtaggct

SEQ ID NO: 7716048 - DNA, 22 bp, Homo sapiens
tgaagaagccaattggtaggct

SEQ ID NO: 7716049 - DNA, 22 bp, Homo sapiens
tgaagaataaatggttgagact

SEQ ID NO: 7716050 - DNA, 22 bp, Homo sapiens
tgaagaaacgcagagaggtagg

SEQ ID NO: 7716051 - DNA, 22 bp, Homo sapiens
tgaagaaacgcagagaggtagg

SEQ ID NO: 7716052 - DNA, 22 bp, Homo sapiens
tgaagaaaggtgtgggatactc

SEQ ID NO: 7716053 - DNA, 22 bp, Homo sapiens
tgaagaaaggtgtgggatactc

SEQ ID NO: 7716054 - DNA, 22 bp, Homo sapiens
tgaagaaaggtgtgggatactc

SEQ ID NO: 7716055 - DNA, 22 bp, Homo sapiens
tgaagaaaggtgtgggatactc

SEQ ID NO: 7716056 - DNA, 22 bp, Homo sapiens
tgaagaaacagaccaagaggat

SEQ ID NO: 7716057 - DNA, 22 bp, Homo sapiens
tgaagaaacagaccaagaggat

SEQ ID NO: 7716058 - DNA, 22 bp, Homo sapiens
tgaagaaacagaccaagaggat

SEQ ID NO: 7716059 - DNA, 22 bp, Homo sapiens
tgaagaaacagaccaagaggat

SEQ ID NO: 7716060 - DNA, 22 bp, Homo sapiens
tgaagaaacgcagagaggtagg

SEQ ID NO: 7716061 - DNA, 22 bp, Homo sapiens
tgaagaaacgcagagaggtagg

SEQ ID NO: 7716062 - DNA, 22 bp, Homo sapiens
tgaagaaacgcagagaggtagg

SEQ ID NO: 7716063 - DNA, 22 bp, Homo sapiens
tgaagaaacgcagagaggtagg

SEQ ID NO: 7716064 - DNA, 22 bp, Homo sapiens
tgaagaaacgcagagaggtagg

SEQ ID NO: 7716065 - DNA, 22 bp, Homo sapiens
tgaagaaacagaccaagaggat

SEQ ID NO: 7716066 - DNA, 22 bp, Homo sapiens
tgaagaaaatatgattacccca

SEQ ID NO: 7716067 - DNA, 22 bp, Homo sapiens
tgaagaaaatatgattacccca

SEQ ID NO: 7716068 - DNA, 22 bp, Homo sapiens
tgaagaaaatatgattacccca

SEQ ID NO: 7716069 - DNA, 22 bp, Homo sapiens
tgaagaaaatatgattacccca

SEQ ID NO: 7716070 - DNA, 22 bp, Homo sapiens
tgaagaaaatatgattacccca

SEQ ID NO: 7716071 - DNA, 18 bp, Homo sapiens
tgaacttttcctgctgct

SEQ ID NO: 7716072 - DNA, 22 bp, Homo sapiens
tgaacttttatttgatgacagg

SEQ ID NO: 7716073 - DNA, 22 bp, Homo sapiens
tgaacttttatttgatgacagg

SEQ ID NO: 7716074 - DNA, 22 bp, Homo sapiens
tgaagacagggtctttaacgag

SEQ ID NO: 7716075 - DNA, 22 bp, Homo sapiens
tgaagacagggtctttaacgag

SEQ ID NO: 7716076 - DNA, 22 bp, Homo sapiens
tgaagacagaccaaggagaatg

SEQ ID NO: 7716077 - DNA, 22 bp, Homo sapiens
tgaagacagaccaaggagaatg

SEQ ID NO: 7716078 - DNA, 22 bp, Homo sapiens
tgaagacagggtctttaacgag

SEQ ID NO: 7716079 - DNA, 18 bp, Homo sapiens
tgaagacatgaggttagt

SEQ ID NO: 7716080 - DNA, 15 bp, Homo sapiens
tgaagacataaggtg

SEQ ID NO: 7716081 - DNA, 22 bp, Homo sapiens
tgaagacagttttactcatgag

SEQ ID NO: 7716082 - DNA, 22 bp, Homo sapiens
tgaagacagttttactcatgag

SEQ ID NO: 7716083 - DNA, 22 bp, Homo sapiens
tgaagacagttttactcatgag

SEQ ID NO: 7716084 - DNA, 22 bp, Homo sapiens
tgaagactcagaagctaagata

SEQ ID NO: 7716085 - DNA, 22 bp, Homo sapiens
tgaagactcagaagctaagata

SEQ ID NO: 7716086 - DNA, 22 bp, Homo sapiens
tgaagactcagaagctaagata

SEQ ID NO: 7716087 - DNA, 22 bp, Homo sapiens
tgaagactcagaagctaagata

SEQ ID NO: 7716088 - DNA, 22 bp, Homo sapiens
tgaagactcagaagctaagata

SEQ ID NO: 7716089 - DNA, 18 bp, Homo sapiens
tgaagacatgaggttagt

SEQ ID NO: 7716090 - DNA, 22 bp, Homo sapiens
tgaagactcagaagctaagata

SEQ ID NO: 7716091 - DNA, 22 bp, Homo sapiens
tgaagactcagaagctaagata

SEQ ID NO: 7716092 - DNA, 22 bp, Homo sapiens
tgaagactcagaagctaagata

SEQ ID NO: 7716093 - DNA, 22 bp, Homo sapiens
tgaagactcagaagctaagata

SEQ ID NO: 7716094 - DNA, 22 bp, Homo sapiens
tgaagacaaagtcaggcccaga

SEQ ID NO: 7716095 - DNA, 22 bp, Homo sapiens
tgaagacaaagtcaggcccaga

SEQ ID NO: 7716096 - DNA, 22 bp, Homo sapiens
tgaagacaagaaaacactgggg

SEQ ID NO: 7716097 - DNA, 22 bp, Homo sapiens
tgaagacaagaaaacactgggg

SEQ ID NO: 7716098 - DNA, 22 bp, Homo sapiens
tgaagacaaagtcaggcccaga

SEQ ID NO: 7716099 - DNA, 22 bp, Homo sapiens
tgaagacaagaaaacactgggg

SEQ ID NO: 7716100 - DNA, 22 bp, Homo sapiens
tgaagaatgttgcagtgagcat

SEQ ID NO: 7716101 - DNA, 22 bp, Homo sapiens
tgaagaatcccagggaatttgg

SEQ ID NO: 7716102 - DNA, 22 bp, Homo sapiens
tgaagacagaccaaggagaatg

SEQ ID NO: 7716103 - DNA, 22 bp, Homo sapiens
tgaagacacatacaagggaatg

SEQ ID NO: 7716104 - DNA, 22 bp, Homo sapiens
tgaagacacatacaagggaatg

SEQ ID NO: 7716105 - DNA, 22 bp, Homo sapiens
tgaagacacatacaagggaatg

SEQ ID NO: 7716106 - DNA, 22 bp, Homo sapiens
tgaagacaagtgtgctggtgtt

SEQ ID NO: 7716107 - DNA, 22 bp, Homo sapiens
tgaagacacatacaagggaatg

SEQ ID NO: 7716108 - DNA, 22 bp, Homo sapiens
tgaagacacatacaagggaatg

SEQ ID NO: 7716109 - DNA, 20 bp, Homo sapiens
tgaagattttgtgtttagaa

SEQ ID NO: 7716110 - DNA, 20 bp, Homo sapiens
tgaagattttgtgtttagaa

SEQ ID NO: 7716111 - DNA, 22 bp, Homo sapiens
tgaagattttgtagctttcagc

SEQ ID NO: 7716112 - DNA, 22 bp, Homo sapiens
tgaagattttgtagctttcagc

SEQ ID NO: 7716113 - DNA, 22 bp, Homo sapiens
tgaagattttcgggtacttgat

SEQ ID NO: 7716114 - DNA, 22 bp, Homo sapiens
tgaagagaagaaaattatcttt

SEQ ID NO: 7716115 - DNA, 22 bp, Homo sapiens
tgaagagaagaaaattatcttt

SEQ ID NO: 7716116 - DNA, 22 bp, Homo sapiens
tgaagcaaacgcttctgttcct

SEQ ID NO: 7716117 - DNA, 22 bp, Homo sapiens
tgaagcaaacgcttctgttcct

SEQ ID NO: 7716118 - DNA, 22 bp, Homo sapiens
tgaagcaaattgtttagcctga

SEQ ID NO: 7716119 - DNA, 22 bp, Homo sapiens
tgaagcaaattgtttagcctga

SEQ ID NO: 7716120 - DNA, 22 bp, Homo sapiens
tgaagcaaatttttctcagagt

SEQ ID NO: 7716121 - DNA, 22 bp, Homo sapiens
tgaagcaaatttttctcagagt

SEQ ID NO: 7716122 - DNA, 19 bp, Homo sapiens
tgaagcaataccatttttg

SEQ ID NO: 7716123 - DNA, 19 bp, Homo sapiens
tgaagcaataccatttttg

SEQ ID NO: 7716124 - DNA, 22 bp, Homo sapiens
tgaagcaagtctattgccctgg

SEQ ID NO: 7716125 - DNA, 22 bp, Homo sapiens
tgaagcaagatagaaagctgct

SEQ ID NO: 7716126 - DNA, 22 bp, Homo sapiens
tgaagcaagatagaaagctgct

SEQ ID NO: 7716127 - DNA, 22 bp, Homo sapiens
tgaagcaagatagaaagctgct

SEQ ID NO: 7716128 - DNA, 22 bp, Homo sapiens
tgaagcaactggacaagttggc

SEQ ID NO: 7716129 - DNA, 22 bp, Homo sapiens
tgaagcaactggacaagttggc

SEQ ID NO: 7716130 - DNA, 22 bp, Homo sapiens
tgaagcaactggacaagttggc

SEQ ID NO: 7716131 - DNA, 22 bp, Homo sapiens
tgaagcaaatttttctcagagt

SEQ ID NO: 7716132 - DNA, 22 bp, Homo sapiens
tgaagcagagaatttgacagtc

SEQ ID NO: 7716133 - DNA, 22 bp, Homo sapiens
tgaagcagagaatttgacagtc

SEQ ID NO: 7716134 - DNA, 22 bp, Homo sapiens
tgaagcagagaatttgacagtc

SEQ ID NO: 7716135 - DNA, 22 bp, Homo sapiens
tgaagcagaggggtcttgagct

SEQ ID NO: 7716136 - DNA, 22 bp, Homo sapiens
tgaagcagaggggtcttgagct

SEQ ID NO: 7716137 - DNA, 22 bp, Homo sapiens
tgaagcagaggggtcttgagct

SEQ ID NO: 7716138 - DNA, 22 bp, Homo sapiens
tgaagcagaggggtcttgagct

SEQ ID NO: 7716139 - DNA, 22 bp, Homo sapiens
tgaagcagaggggtcttgagct

SEQ ID NO: 7716140 - DNA, 22 bp, Homo sapiens
tgaagcagagtgaaggtgaatt

SEQ ID NO: 7716141 - DNA, 22 bp, Homo sapiens
tgaagcagagtgaaggtgaatt

SEQ ID NO: 7716142 - DNA, 22 bp, Homo sapiens
tgaagcaatgatcttttggtgg

SEQ ID NO: 7716143 - DNA, 22 bp, Homo sapiens
tgaagcaatgatcttttggtgg

SEQ ID NO: 7716144 - DNA, 22 bp, Homo sapiens
tgaagcacaggcatacacaacc

SEQ ID NO: 7716145 - DNA, 22 bp, Homo sapiens
tgaagcaatgatcttttggtgg

SEQ ID NO: 7716146 - DNA, 22 bp, Homo sapiens
tgaagcaatgatagcagaatga

SEQ ID NO: 7716147 - DNA, 22 bp, Homo sapiens
tgaagcaatgatagcagaatga

SEQ ID NO: 7716148 - DNA, 22 bp, Homo sapiens
tgaagcaatgatagcagaatga

SEQ ID NO: 7716149 - DNA, 22 bp, Homo sapiens
tgaagcaatgatagcagaatga

SEQ ID NO: 7716150 - DNA, 22 bp, Homo sapiens
tgaagcaatagagacaagacca

SEQ ID NO: 7716151 - DNA, 22 bp, Homo sapiens
tgaagcaatagagacaagacca

SEQ ID NO: 7716152 - DNA, 22 bp, Homo sapiens
tgaagcaatagagacaagacca

SEQ ID NO: 7716153 - DNA, 22 bp, Homo sapiens
tgaagcaggaaccagcagcatt

SEQ ID NO: 7716154 - DNA, 22 bp, Homo sapiens
tgaagcaggatcgtttgcttca

SEQ ID NO: 7716155 - DNA, 19 bp, Homo sapiens
tgaagcaggcagagaagat

SEQ ID NO: 7716156 - DNA, 22 bp, Homo sapiens
tgaagcaggatcgtttgcttca

SEQ ID NO: 7716157 - DNA, 19 bp, Homo sapiens
tgaagcaggcagagaagat

SEQ ID NO: 7716158 - DNA, 22 bp, Homo sapiens
tgaagcaggcattgactgatga

SEQ ID NO: 7716159 - DNA, 22 bp, Homo sapiens
tgaagcaggcattgactgatga

SEQ ID NO: 7716160 - DNA, 19 bp, Homo sapiens
tgaagcaggcagagaagat

SEQ ID NO: 7716161 - DNA, 22 bp, Homo sapiens
tgaagcagggtggccagattgt

SEQ ID NO: 7716162 - DNA, 22 bp, Homo sapiens
tgaagcaggcattgactgatga

SEQ ID NO: 7716163 - DNA, 22 bp, Homo sapiens
tgaagcaggcattgactgatga

SEQ ID NO: 7716164 - DNA, 22 bp, Homo sapiens
tgaagcaggtgaatggatgtcg

SEQ ID NO: 7716165 - DNA, 22 bp, Homo sapiens
tgaagcaggtgaatggatgtcg

SEQ ID NO: 7716166 - DNA, 22 bp, Homo sapiens
tgaagcaggtgaatggatgtcg

SEQ ID NO: 7716167 - DNA, 22 bp, Homo sapiens
tgaagcaggtgaatggatgtcg

SEQ ID NO: 7716168 - DNA, 22 bp, Homo sapiens
tgaagcagttactgggtgttaa

SEQ ID NO: 7716169 - DNA, 22 bp, Homo sapiens
tgaagcagttctcagaagtggg

SEQ ID NO: 7716170 - DNA, 22 bp, Homo sapiens
tgaagcagttctcagaagtggg

SEQ ID NO: 7716171 - DNA, 22 bp, Homo sapiens
tgaagcagcaaatgatgggaga

SEQ ID NO: 7716172 - DNA, 22 bp, Homo sapiens
tgaagcagcaaatgatgggaga

SEQ ID NO: 7716173 - DNA, 20 bp, Homo sapiens
tgaagcagccttgattctgt

SEQ ID NO: 7716174 - DNA, 20 bp, Homo sapiens
tgaagcagccttgattctgt

SEQ ID NO: 7716175 - DNA, 19 bp, Homo sapiens
tgaagcagcaaactctcag

SEQ ID NO: 7716176 - DNA, 19 bp, Homo sapiens
tgaagcagcaaactctcag

SEQ ID NO: 7716177 - DNA, 19 bp, Homo sapiens
tgaagcagcaaactctcag

SEQ ID NO: 7716178 - DNA, 22 bp, Homo sapiens
tgaagcagatggtctggtcatt

SEQ ID NO: 7716179 - DNA, 22 bp, Homo sapiens
tgaagcagatggtctggtcatt

SEQ ID NO: 7716180 - DNA, 20 bp, Homo sapiens
tgaagcagccttgattctgt

SEQ ID NO: 7716181 - DNA, 22 bp, Homo sapiens
tgaagcagcttctttctgtcaa

SEQ ID NO: 7716182 - DNA, 22 bp, Homo sapiens
tgaagcagcttctttctgtcaa

SEQ ID NO: 7716183 - DNA, 20 bp, Homo sapiens
tgaagcagccttgattctgt

SEQ ID NO: 7716184 - DNA, 22 bp, Homo sapiens
tgaagcaggaaacttcttgttt

SEQ ID NO: 7716185 - DNA, 22 bp, Homo sapiens
tgaagcaggaaacttcttgttt

SEQ ID NO: 7716186 - DNA, 22 bp, Homo sapiens
tgaagcaggaaccagcagcatt

SEQ ID NO: 7716187 - DNA, 22 bp, Homo sapiens
tgaagcaggaaacttcttgttt

SEQ ID NO: 7716188 - DNA, 22 bp, Homo sapiens
tgaacttagtgggaatatctct

SEQ ID NO: 7716189 - DNA, 22 bp, Homo sapiens
tgaacttagagtatatgaaagg

SEQ ID NO: 7716190 - DNA, 22 bp, Homo sapiens
tgaacttacaaattaaaagact

SEQ ID NO: 7716191 - DNA, 22 bp, Homo sapiens
tgaactgtggccagtaattaat

SEQ ID NO: 7716192 - DNA, 22 bp, Homo sapiens
tgaacttacaaattaaaagact

SEQ ID NO: 7716193 - DNA, 22 bp, Homo sapiens
tgaactgcaggaatctcagtgg

SEQ ID NO: 7716194 - DNA, 18 bp, Homo sapiens
tgaactggcatcagaatc

SEQ ID NO: 7716195 - DNA, 18 bp, Homo sapiens
tgaactttggtgtctctc

SEQ ID NO: 7716196 - DNA, 18 bp, Homo sapiens
tgaactttggtgtctctc

SEQ ID NO: 7716197 - DNA, 22 bp, Homo sapiens
tgaactttcacaagaatatgct

SEQ ID NO: 7716198 - DNA, 22 bp, Homo sapiens
tgaactttcacaagaatatgct

SEQ ID NO: 7716199 - DNA, 22 bp, Homo sapiens
tgaactgagcagtttcctggga

SEQ ID NO: 7716200 - DNA, 22 bp, Homo sapiens
tgaactctcccccattgccctc

SEQ ID NO: 7716201 - DNA, 22 bp, Homo sapiens
tgaactcctgacctcatgatcc

SEQ ID NO: 7716202 - DNA, 22 bp, Homo sapiens
tgaactcctgacctcatgatcc

SEQ ID NO: 7716203 - DNA, 22 bp, Homo sapiens
tgaactatacgataacatgatt

SEQ ID NO: 7716204 - DNA, 22 bp, Homo sapiens
tgaactacaaaaatcaacattt

SEQ ID NO: 7716205 - DNA, 22 bp, Homo sapiens
tgaacgcaggtccacatggctc

SEQ ID NO: 7716206 - DNA, 22 bp, Homo sapiens
tgaacgcaggtccacatggctc

SEQ ID NO: 7716207 - DNA, 22 bp, Homo sapiens
tgaacgcaggtccacatggctc

SEQ ID NO: 7716208 - DNA, 22 bp, Homo sapiens
tgaacatacaattattaagaac

SEQ ID NO: 7716209 - DNA, 22 bp, Homo sapiens
tgaacatacaattattaagaac

SEQ ID NO: 7716210 - DNA, 22 bp, Homo sapiens
tgaacatattcacctctaaata

SEQ ID NO: 7716211 - DNA, 22 bp, Homo sapiens
tgaacatattcacctctaaata

SEQ ID NO: 7716212 - DNA, 22 bp, Homo sapiens
tgaacatattcacctctaaata

SEQ ID NO: 7716213 - DNA, 22 bp, Homo sapiens
tgaacatgctgttgatggcctg

SEQ ID NO: 7716214 - DNA, 22 bp, Homo sapiens
tgaacatgctgttgatggcctg

SEQ ID NO: 7716215 - DNA, 22 bp, Homo sapiens
tgaacatgctgttgatggcctg

SEQ ID NO: 7716216 - DNA, 22 bp, Homo sapiens
tgaacattggcacaaggcagca

SEQ ID NO: 7716217 - DNA, 22 bp, Homo sapiens
tgaacattggcacaaggcagca

SEQ ID NO: 7716218 - DNA, 22 bp, Homo sapiens
tgaacattggcacaaggcagca

SEQ ID NO: 7716219 - DNA, 22 bp, Homo sapiens
tgaacattcctgaatgaagcat

SEQ ID NO: 7716220 - DNA, 22 bp, Homo sapiens
tgaacattcctgaatgaagcat

SEQ ID NO: 7716221 - DNA, 22 bp, Homo sapiens
tgaacatgctgttgatggcctg

SEQ ID NO: 7716222 - DNA, 22 bp, Homo sapiens
tgaacattagttgagtaaagtc

SEQ ID NO: 7716223 - DNA, 22 bp, Homo sapiens
tgaacattagttgagtaaagtc

SEQ ID NO: 7716224 - DNA, 22 bp, Homo sapiens
tgaacattgtcacattcctagc

SEQ ID NO: 7716225 - DNA, 22 bp, Homo sapiens
tgaacattgtcacattcctagc

SEQ ID NO: 7716226 - DNA, 22 bp, Homo sapiens
tgaaccacagaagtcaggagct

SEQ ID NO: 7716227 - DNA, 22 bp, Homo sapiens
tgaaccacaggagggttcatgt

SEQ ID NO: 7716228 - DNA, 22 bp, Homo sapiens
tgaaccacaggagggttcatgt

SEQ ID NO: 7716229 - DNA, 22 bp, Homo sapiens
tgaacattgtcacattcctagc

SEQ ID NO: 7716230 - DNA, 22 bp, Homo sapiens
tgaaccaggcacatttcctaca

SEQ ID NO: 7716231 - DNA, 22 bp, Homo sapiens
tgaaccaggaggcagccagcac

SEQ ID NO: 7716232 - DNA, 22 bp, Homo sapiens
tgaaccaggaggcagccagcac

SEQ ID NO: 7716233 - DNA, 22 bp, Homo sapiens
tgaaccacatgcaaagtgaata

SEQ ID NO: 7716234 - DNA, 22 bp, Homo sapiens
tgaaccagagtctccagtggtt

SEQ ID NO: 7716235 - DNA, 19 bp, Homo sapiens
tgaacgatgtctcagggca

SEQ ID NO: 7716236 - DNA, 22 bp, Homo sapiens
tgaacctgtttccaggctcatt

SEQ ID NO: 7716237 - DNA, 21 bp, Homo sapiens
tgaacccagagctcatgacca

SEQ ID NO: 7716238 - DNA, 22 bp, Homo sapiens
tgaaccatctggctccagaaga

SEQ ID NO: 7716239 - DNA, 22 bp, Homo sapiens
tgaaccatctggctccagaaga

SEQ ID NO: 7716240 - DNA, 21 bp, Homo sapiens
tgaacccagagctcatgacca

SEQ ID NO: 7716241 - DNA, 22 bp, Homo sapiens
tgaaccctgacctctggaagga

SEQ ID NO: 7716242 - DNA, 22 bp, Homo sapiens
tgaaattatgcattgttgtacc

SEQ ID NO: 7716243 - DNA, 22 bp, Homo sapiens
tgaaattagtgaagttacagtt

SEQ ID NO: 7716244 - DNA, 22 bp, Homo sapiens
tgaaattagtgaagttacagtt

SEQ ID NO: 7716245 - DNA, 22 bp, Homo sapiens
tgaaattagaaatatgtatggg

SEQ ID NO: 7716246 - DNA, 22 bp, Homo sapiens
tgaaattagtgaagttacagtt

SEQ ID NO: 7716247 - DNA, 22 bp, Homo sapiens
tgaaattagtgaagttacagtt

SEQ ID NO: 7716248 - DNA, 22 bp, Homo sapiens
tgaaattatgcattgttgtacc

SEQ ID NO: 7716249 - DNA, 22 bp, Homo sapiens
tgaaattatgcattgttgtacc

SEQ ID NO: 7716250 - DNA, 22 bp, Homo sapiens
tgaaattatgcattgttgtacc

SEQ ID NO: 7716251 - DNA, 22 bp, Homo sapiens
tgaaattcaaaacacatttgtc

SEQ ID NO: 7716252 - DNA, 22 bp, Homo sapiens
tgaaattattcttaccaaggtg

SEQ ID NO: 7716253 - DNA, 18 bp, Homo sapiens
tgaaattgcatccatgag

SEQ ID NO: 7716254 - DNA, 22 bp, Homo sapiens
tgaaatttaggtgcagataaat

SEQ ID NO: 7716255 - DNA, 22 bp, Homo sapiens
tgaaatttaggtgcagataaat

SEQ ID NO: 7716256 - DNA, 22 bp, Homo sapiens
tgaaatttaggtgcagataaat

SEQ ID NO: 7716257 - DNA, 22 bp, Homo sapiens
tgaaattccaggagagttaaaa

SEQ ID NO: 7716258 - DNA, 22 bp, Homo sapiens
tgaaattcattgttttatgtgt

SEQ ID NO: 7716259 - DNA, 22 bp, Homo sapiens
tgaaattcaaaacacatttgtc

SEQ ID NO: 7716260 - DNA, 23 bp, Homo sapiens
tgaacaaaggcaggagaaggcgg

SEQ ID NO: 7716261 - DNA, 22 bp, Homo sapiens
tgaaatttaggtgcagataaat

SEQ ID NO: 7716262 - DNA, 22 bp, Homo sapiens
tgaacaaactgcattcttcact

SEQ ID NO: 7716263 - DNA, 22 bp, Homo sapiens
tgaacaaactgcattcttcact

SEQ ID NO: 7716264 - DNA, 22 bp, Homo sapiens
tgaacaaactgcattcttcact

SEQ ID NO: 7716265 - DNA, 22 bp, Homo sapiens
tgaacaaactgcattcttcact

SEQ ID NO: 7716266 - DNA, 22 bp, Homo sapiens
tgaacaaactgcattcttcact

SEQ ID NO: 7716267 - DNA, 22 bp, Homo sapiens
tgaacaaactgcattcttcact

SEQ ID NO: 7716268 - DNA, 22 bp, Homo sapiens
tgaacacacacatcttaataat

SEQ ID NO: 7716269 - DNA, 22 bp, Homo sapiens
tgaacacaaatattttggggtt

SEQ ID NO: 7716270 - DNA, 22 bp, Homo sapiens
tgaacaacagatgtccattgtt

SEQ ID NO: 7716271 - DNA, 22 bp, Homo sapiens
tgaacacacacatcttaataat

SEQ ID NO: 7716272 - DNA, 22 bp, Homo sapiens
tgaacacacacatcttaataat

SEQ ID NO: 7716273 - DNA, 22 bp, Homo sapiens
tgaacacacacatcttaataat

SEQ ID NO: 7716274 - DNA, 22 bp, Homo sapiens
tgaacacacacatcttaataat

SEQ ID NO: 7716275 - DNA, 22 bp, Homo sapiens
tgaacacacacatcttaataat

SEQ ID NO: 7716276 - DNA, 22 bp, Homo sapiens
tgaacaactgcaaaaatctcca

SEQ ID NO: 7716277 - DNA, 22 bp, Homo sapiens
tgaacaaatggaaataaccagt

SEQ ID NO: 7716278 - DNA, 22 bp, Homo sapiens
tgaacaacagatgtccattgtt

SEQ ID NO: 7716279 - DNA, 22 bp, Homo sapiens
tgaacaaatggaaataaccagt

SEQ ID NO: 7716280 - DNA, 22 bp, Homo sapiens
tgaacaaatggaaataaccagt

SEQ ID NO: 7716281 - DNA, 22 bp, Homo sapiens
tgaacaaatggaaataaccagt

SEQ ID NO: 7716282 - DNA, 22 bp, Homo sapiens
tgaacaaatgaatcagtgtagc

SEQ ID NO: 7716283 - DNA, 22 bp, Homo sapiens
tgaacaaatgaatcagtgtagc

SEQ ID NO: 7716284 - DNA, 22 bp, Homo sapiens
tgaacaaatgaatcagtgtagc

SEQ ID NO: 7716285 - DNA, 21 bp, Homo sapiens
tgaacaaagttcttatcgtga

SEQ ID NO: 7716286 - DNA, 21 bp, Homo sapiens
tgaacaaagttcttatcgtga

SEQ ID NO: 7716287 - DNA, 22 bp, Homo sapiens
tgaacaaatggaaataaccagt

SEQ ID NO: 7716288 - DNA, 22 bp, Homo sapiens
tgaacaaatggaaataaccagt

SEQ ID NO: 7716289 - DNA, 22 bp, Homo sapiens
tgaacaaatggaaataaccagt

SEQ ID NO: 7716290 - DNA, 22 bp, Homo sapiens
tgaacaaatgaatcagtgtagc

SEQ ID NO: 7716291 - DNA, 22 bp, Homo sapiens
tgaacaaatggaaataaccagt

SEQ ID NO: 7716292 - DNA, 22 bp, Homo sapiens
tgaacacacacctatgtacaaa

SEQ ID NO: 7716293 - DNA, 22 bp, Homo sapiens
tgaacacacacctatgtacaaa

SEQ ID NO: 7716294 - DNA, 22 bp, Homo sapiens
tgaacacacacctatgtacaaa

SEQ ID NO: 7716295 - DNA, 22 bp, Homo sapiens
tgaacacacacctatgtacaaa

SEQ ID NO: 7716296 - DNA, 22 bp, Homo sapiens
tgaacagtggttcatgtcacgg

SEQ ID NO: 7716297 - DNA, 22 bp, Homo sapiens
tgaacagtgggcatgtgaagac

SEQ ID NO: 7716298 - DNA, 22 bp, Homo sapiens
tgaacagtgggcatgtgaagac

SEQ ID NO: 7716299 - DNA, 22 bp, Homo sapiens
tgaacagtgatctacatgtggc

SEQ ID NO: 7716300 - DNA, 22 bp, Homo sapiens
tgaacagtcatttagaatgtgc

SEQ ID NO: 7716301 - DNA, 22 bp, Homo sapiens
tgaacagtgatctacatgtggc

SEQ ID NO: 7716302 - DNA, 22 bp, Homo sapiens
tgaacatacaattattaagaac

SEQ ID NO: 7716303 - DNA, 22 bp, Homo sapiens
tgaacatacaattattaagaac

SEQ ID NO: 7716304 - DNA, 22 bp, Homo sapiens
tgaacagtttcaagaaaacttt

SEQ ID NO: 7716305 - DNA, 22 bp, Homo sapiens
tgaacagttactttgtagaaga

SEQ ID NO: 7716306 - DNA, 22 bp, Homo sapiens
tgaacagttactttgtagaaga

SEQ ID NO: 7716307 - DNA, 22 bp, Homo sapiens
tgaacagttactttgtagaaga

SEQ ID NO: 7716308 - DNA, 22 bp, Homo sapiens
tgaacagtgtgagggtgtgacc

SEQ ID NO: 7716309 - DNA, 22 bp, Homo sapiens
tgaacagtgtatctagatcatg

SEQ ID NO: 7716310 - DNA, 22 bp, Homo sapiens
tgaacagtgtatctagatcatg

SEQ ID NO: 7716311 - DNA, 22 bp, Homo sapiens
tgaacagtggttcatgtcacgg

SEQ ID NO: 7716312 - DNA, 22 bp, Homo sapiens
tcttttatcctacatttagctc

SEQ ID NO: 7716313 - DNA, 22 bp, Homo sapiens
tcttttatcctacatttagctc

SEQ ID NO: 7716314 - DNA, 22 bp, Homo sapiens
tcttttatcctacatttagctc

SEQ ID NO: 7716315 - DNA, 22 bp, Homo sapiens
tcttttatcctacatttagctc

SEQ ID NO: 7716316 - DNA, 22 bp, Homo sapiens
tcttttatcctacatttagctc

SEQ ID NO: 7716317 - DNA, 22 bp, Homo sapiens
tcttttatcctacatttagctc

SEQ ID NO: 7716318 - DNA, 22 bp, Homo sapiens
tcttttatcctacatttagctc

SEQ ID NO: 7716319 - DNA, 22 bp, Homo sapiens
tcttttatagtgaattttcttg

SEQ ID NO: 7716320 - DNA, 22 bp, Homo sapiens
tcttttatagtgaattttcttg

SEQ ID NO: 7716321 - DNA, 22 bp, Homo sapiens
tcttttatagtgaattttcttg

SEQ ID NO: 7716322 - DNA, 22 bp, Homo sapiens
tcttttatagtgaattttcttg

SEQ ID NO: 7716323 - DNA, 22 bp, Homo sapiens
tcttttatagtgaattttcttg

SEQ ID NO: 7716324 - DNA, 22 bp, Homo sapiens
tcttttagtaataaatatttgt

SEQ ID NO: 7716325 - DNA, 22 bp, Homo sapiens
tcttttagtaataaatatttgt

SEQ ID NO: 7716326 - DNA, 22 bp, Homo sapiens
tcttttagtaataaatatttgt

SEQ ID NO: 7716327 - DNA, 22 bp, Homo sapiens
tcttttagctctgcaaggaaag

SEQ ID NO: 7716328 - DNA, 22 bp, Homo sapiens
tcttttagagcatttctgattc

SEQ ID NO: 7716329 - DNA, 22 bp, Homo sapiens
tcttttagagcatttctgattc

SEQ ID NO: 7716330 - DNA, 22 bp, Homo sapiens
tcttttagagcatttctgattc

SEQ ID NO: 7716331 - DNA, 22 bp, Homo sapiens
tcttttaagcctctggcatagg

SEQ ID NO: 7716332 - DNA, 22 bp, Homo sapiens
tcttttaagcctctggcatagg

SEQ ID NO: 7716333 - DNA, 22 bp, Homo sapiens
tcttttaagcctctggcatagg

SEQ ID NO: 7716334 - DNA, 22 bp, Homo sapiens
tcttttaagcctctggcatagg

SEQ ID NO: 7716335 - DNA, 22 bp, Homo sapiens
tcttttaagcctctggcatagg

SEQ ID NO: 7716336 - DNA, 22 bp, Homo sapiens
tcttttaagcctctggcatagg

SEQ ID NO: 7716337 - DNA, 22 bp, Homo sapiens
tcttttaagcctctggcatagg

SEQ ID NO: 7716338 - DNA, 22 bp, Homo sapiens
tcttttaacctaactagcttgg

SEQ ID NO: 7716339 - DNA, 22 bp, Homo sapiens
tcttttaagcctctggcatagg

SEQ ID NO: 7716340 - DNA, 22 bp, Homo sapiens
tcttttagaaaagttgaatgta

SEQ ID NO: 7716341 - DNA, 22 bp, Homo sapiens
tcttttagaaaagttgaatgta

SEQ ID NO: 7716342 - DNA, 22 bp, Homo sapiens
tcttttagaaaagttgaatgta

SEQ ID NO: 7716343 - DNA, 21 bp, Homo sapiens
tcttttaacaccaggaattcc

SEQ ID NO: 7716344 - DNA, 21 bp, Homo sapiens
tcttttaacaccaggaattcc

SEQ ID NO: 7716345 - DNA, 21 bp, Homo sapiens
tcttttaacaccaggaattcc

SEQ ID NO: 7716346 - DNA, 21 bp, Homo sapiens
tcttttaacaccaggaattcc

SEQ ID NO: 7716347 - DNA, 22 bp, Homo sapiens
tcttttaacctaactagcttgg

SEQ ID NO: 7716348 - DNA, 22 bp, Homo sapiens
tcttttaacctaactagcttgg

SEQ ID NO: 7716349 - DNA, 22 bp, Homo sapiens
tcttttaacctaactagcttgg

SEQ ID NO: 7716350 - DNA, 22 bp, Homo sapiens
tcttttaacctaactagcttgg

SEQ ID NO: 7716351 - DNA, 22 bp, Homo sapiens
tcttttaacctaactagcttgg

SEQ ID NO: 7716352 - DNA, 22 bp, Homo sapiens
tcttttaacctaactagcttgg

SEQ ID NO: 7716353 - DNA, 20 bp, Homo sapiens
tctttgtgtcagatggacag

SEQ ID NO: 7716354 - DNA, 18 bp, Homo sapiens
tctttgtttccttcttgc

SEQ ID NO: 7716355 - DNA, 18 bp, Homo sapiens
tctttgtttccttcttgc

SEQ ID NO: 7716356 - DNA, 18 bp, Homo sapiens
tctttgtttccttcttgc

SEQ ID NO: 7716357 - DNA, 22 bp, Homo sapiens
tctttgtttgcctttatcaaga

SEQ ID NO: 7716358 - DNA, 22 bp, Homo sapiens
tctttgtttgcctttatcaaga

SEQ ID NO: 7716359 - DNA, 22 bp, Homo sapiens
tctttgtttgcctttatcaaga

SEQ ID NO: 7716360 - DNA, 22 bp, Homo sapiens
tctttgtttgtactgttagaat

SEQ ID NO: 7716361 - DNA, 22 bp, Homo sapiens
tctttgtttgtactgttagaat

SEQ ID NO: 7716362 - DNA, 22 bp, Homo sapiens
tctttgtttgcctttatcaaga

SEQ ID NO: 7716363 - DNA, 22 bp, Homo sapiens
tcttttaaaagccctgctgtct

SEQ ID NO: 7716364 - DNA, 22 bp, Homo sapiens
tcttttaaaagccctgctgtct

SEQ ID NO: 7716365 - DNA, 22 bp, Homo sapiens
tcttttaaaagccctgctgtct

SEQ ID NO: 7716366 - DNA, 21 bp, Homo sapiens
tcttttaacaccaggaattcc

SEQ ID NO: 7716367 - DNA, 21 bp, Homo sapiens
tcttttaacaccaggaattcc

SEQ ID NO: 7716368 - DNA, 21 bp, Homo sapiens
tcttttaacaccaggaattcc

SEQ ID NO: 7716369 - DNA, 21 bp, Homo sapiens
tcttttaacaccaggaattcc

SEQ ID NO: 7716370 - DNA, 22 bp, Homo sapiens
tcttttaaaagccctgctgtct

SEQ ID NO: 7716371 - DNA, 22 bp, Homo sapiens
tctttgtttgtactgttagaat

SEQ ID NO: 7716372 - DNA, 20 bp, Homo sapiens
tctttgtgtcagatggacag

SEQ ID NO: 7716373 - DNA, 22 bp, Homo sapiens
tctttgtgttcaggagccacgt

SEQ ID NO: 7716374 - DNA, 22 bp, Homo sapiens
tctttgtgttcaggagccacgt

SEQ ID NO: 7716375 - DNA, 20 bp, Homo sapiens
tctttgttaattttatctcc

SEQ ID NO: 7716376 - DNA, 20 bp, Homo sapiens
tctttgttaattttatctcc

SEQ ID NO: 7716377 - DNA, 20 bp, Homo sapiens
tctttgttaattttatctcc

SEQ ID NO: 7716378 - DNA, 20 bp, Homo sapiens
tctttgttaattttatctcc

SEQ ID NO: 7716379 - DNA, 20 bp, Homo sapiens
tctttgttaattttatctcc

SEQ ID NO: 7716380 - DNA, 22 bp, Homo sapiens
tctttgttattgctttatctat

SEQ ID NO: 7716381 - DNA, 22 bp, Homo sapiens
tctttgttattgctttatctat

SEQ ID NO: 7716382 - DNA, 18 bp, Homo sapiens
tctttgtttccttcttgc

SEQ ID NO: 7716383 - DNA, 22 bp, Homo sapiens
tctttgttattgctttatctat

SEQ ID NO: 7716384 - DNA, 22 bp, Homo sapiens
tctttgttattgctttatctat

SEQ ID NO: 7716385 - DNA, 22 bp, Homo sapiens
tctttgttattgctttatctat

SEQ ID NO: 7716386 - DNA, 22 bp, Homo sapiens
tcttttctagcaaatccaggag

SEQ ID NO: 7716387 - DNA, 22 bp, Homo sapiens
tcttttctagcaaatccaggag

SEQ ID NO: 7716388 - DNA, 22 bp, Homo sapiens
tcttttctagcaaatccaggag

SEQ ID NO: 7716389 - DNA, 21 bp, Homo sapiens
tcttttcctttctgtgtgcaa

SEQ ID NO: 7716390 - DNA, 21 bp, Homo sapiens
tcttttcctttctgtgtgcaa

SEQ ID NO: 7716391 - DNA, 21 bp, Homo sapiens
tcttttctcagctttgtggtt

SEQ ID NO: 7716392 - DNA, 22 bp, Homo sapiens
tcttttctagcaaatccaggag

SEQ ID NO: 7716393 - DNA, 21 bp, Homo sapiens
tcttttctcagctttgtggtt

SEQ ID NO: 7716394 - DNA, 21 bp, Homo sapiens
tcttttctcagctttgtggtt

SEQ ID NO: 7716395 - DNA, 21 bp, Homo sapiens
tcttttctcagctttgtggtt

SEQ ID NO: 7716396 - DNA, 21 bp, Homo sapiens
tcttttctcagctttgtggtt

SEQ ID NO: 7716397 - DNA, 21 bp, Homo sapiens
tcttttctcagctttgtggtt

SEQ ID NO: 7716398 - DNA, 22 bp, Homo sapiens
tcttttgttgatggaattaatg

SEQ ID NO: 7716399 - DNA, 22 bp, Homo sapiens
tcttttctgccacagcctgagc

SEQ ID NO: 7716400 - DNA, 21 bp, Homo sapiens
tcttttctctgcaggattcct

SEQ ID NO: 7716401 - DNA, 21 bp, Homo sapiens
tcttttctctgcaggattcct

SEQ ID NO: 7716402 - DNA, 21 bp, Homo sapiens
tcttttctctgcaggattcct

SEQ ID NO: 7716403 - DNA, 21 bp, Homo sapiens
tcttttctctgcaggattcct

SEQ ID NO: 7716404 - DNA, 22 bp, Homo sapiens
tcttttctccagacctgggatc

SEQ ID NO: 7716405 - DNA, 22 bp, Homo sapiens
tcttttctccagacctgggatc

SEQ ID NO: 7716406 - DNA, 21 bp, Homo sapiens
tcttttctcagctttgtggtt

SEQ ID NO: 7716407 - DNA, 22 bp, Homo sapiens
tcttttctccagacctgggatc

SEQ ID NO: 7716408 - DNA, 22 bp, Homo sapiens
tcttttctccagacctgggatc

SEQ ID NO: 7716409 - DNA, 22 bp, Homo sapiens
tcttttccttccctacagatct

SEQ ID NO: 7716410 - DNA, 22 bp, Homo sapiens
tcttttccttgatggttaaata

SEQ ID NO: 7716411 - DNA, 22 bp, Homo sapiens
tcttttccttgatggttaaata

SEQ ID NO: 7716412 - DNA, 22 bp, Homo sapiens
tcttttccttgatggttaaata

SEQ ID NO: 7716413 - DNA, 22 bp, Homo sapiens
tcttttccttgatggttaaata

SEQ ID NO: 7716414 - DNA, 21 bp, Homo sapiens
tcttttcctttctgtgtgcaa

SEQ ID NO: 7716415 - DNA, 21 bp, Homo sapiens
tcttttcctttctgtgtgcaa

SEQ ID NO: 7716416 - DNA, 22 bp, Homo sapiens
tcttttccttccctacagatct

SEQ ID NO: 7716417 - DNA, 18 bp, Homo sapiens
tcttttccttccacttcc

SEQ ID NO: 7716418 - DNA, 18 bp, Homo sapiens
tcttttccttccacttcc

SEQ ID NO: 7716419 - DNA, 22 bp, Homo sapiens
tcttttccttccctacagatct

SEQ ID NO: 7716420 - DNA, 22 bp, Homo sapiens
tcttttccttccctacagatct

SEQ ID NO: 7716421 - DNA, 22 bp, Homo sapiens
tcttttccttccctacagatct

SEQ ID NO: 7716422 - DNA, 22 bp, Homo sapiens
tcttttccttccctacagatct

SEQ ID NO: 7716423 - DNA, 22 bp, Homo sapiens
tcttttcattgagaacacactg

SEQ ID NO: 7716424 - DNA, 22 bp, Homo sapiens
tcttttcattgagaacacactg

SEQ ID NO: 7716425 - DNA, 22 bp, Homo sapiens
tcttttcctcctcttgttggcc

SEQ ID NO: 7716426 - DNA, 22 bp, Homo sapiens
tcttttcctcctcttgttggcc

SEQ ID NO: 7716427 - DNA, 22 bp, Homo sapiens
tcttttcctcctcttgttggcc

SEQ ID NO: 7716428 - DNA, 22 bp, Homo sapiens
tcttttcctcctcttgttggcc

SEQ ID NO: 7716429 - DNA, 18 bp, Homo sapiens
tcttttccttccacttcc

SEQ ID NO: 7716430 - DNA, 18 bp, Homo sapiens
tcttttccttccacttcc

SEQ ID NO: 7716431 - DNA, 18 bp, Homo sapiens
tcttttccttccacttcc

SEQ ID NO: 7716432 - DNA, 18 bp, Homo sapiens
tcttttccttccacttcc

SEQ ID NO: 7716433 - DNA, 18 bp, Homo sapiens
tcttttccttccacttcc

SEQ ID NO: 7716434 - DNA, 22 bp, Homo sapiens
tcttttatcctacatttagctc

SEQ ID NO: 7716435 - DNA, 22 bp, Homo sapiens
tcttttatctgttgtgtaacaa

SEQ ID NO: 7716436 - DNA, 22 bp, Homo sapiens
tcttttatctgttgtgtaacaa

SEQ ID NO: 7716437 - DNA, 22 bp, Homo sapiens
tcttttatctgttgtgtaacaa

SEQ ID NO: 7716438 - DNA, 22 bp, Homo sapiens
tcttttatctgttgtgtaacaa

SEQ ID NO: 7716439 - DNA, 22 bp, Homo sapiens
tcttttattaggctgaaatggg

SEQ ID NO: 7716440 - DNA, 22 bp, Homo sapiens
tcttttatctgttgtgtaacaa

SEQ ID NO: 7716441 - DNA, 22 bp, Homo sapiens
tcttttatctgttgtgtaacaa

SEQ ID NO: 7716442 - DNA, 22 bp, Homo sapiens
tcttttatctgttgtgtaacaa

SEQ ID NO: 7716443 - DNA, 22 bp, Homo sapiens
tcttttattaggctgaaatggg

SEQ ID NO: 7716444 - DNA, 22 bp, Homo sapiens
tcttttattaggctgaaatggg

SEQ ID NO: 7716445 - DNA, 22 bp, Homo sapiens
tcttttattaggctgaaatggg

SEQ ID NO: 7716446 - DNA, 20 bp, Homo sapiens
tcttttattggcagatcctg

SEQ ID NO: 7716447 - DNA, 20 bp, Homo sapiens
tcttttattggcagatcctg

SEQ ID NO: 7716448 - DNA, 20 bp, Homo sapiens
tcttttattggcagatcctg

SEQ ID NO: 7716449 - DNA, 20 bp, Homo sapiens
tcttttattggcagatcctg

SEQ ID NO: 7716450 - DNA, 20 bp, Homo sapiens
tcttttattggcagatcctg

SEQ ID NO: 7716451 - DNA, 22 bp, Homo sapiens
tcttttattaggctgaaatggg

SEQ ID NO: 7716452 - DNA, 22 bp, Homo sapiens
tcttttattaggctgaaatggg

SEQ ID NO: 7716453 - DNA, 22 bp, Homo sapiens
tcttttattaggctgaaatggg

SEQ ID NO: 7716454 - DNA, 22 bp, Homo sapiens
tcttttattaggctgaaatggg

SEQ ID NO: 7716455 - DNA, 22 bp, Homo sapiens
tcttttattaggctgaaatggg

SEQ ID NO: 7716456 - DNA, 22 bp, Homo sapiens
tcttttattaggctgaaatggg

SEQ ID NO: 7716457 - DNA, 22 bp, Homo sapiens
tcttttattaggctgaaatggg

SEQ ID NO: 7716458 - DNA, 22 bp, Homo sapiens
tcttttcacagacaaatggaga

SEQ ID NO: 7716459 - DNA, 20 bp, Homo sapiens
tcttttattggcagatcctg

SEQ ID NO: 7716460 - DNA, 23 bp, Homo sapiens
tcttttcaatggttctttatgtg

SEQ ID NO: 7716461 - DNA, 19 bp, Homo sapiens
tcttttcacgcattttgaa

SEQ ID NO: 7716462 - DNA, 22 bp, Homo sapiens
tcttttcacagacaaatggaga

SEQ ID NO: 7716463 - DNA, 22 bp, Homo sapiens
tcttttcaggaatggctctagt

SEQ ID NO: 7716464 - DNA, 22 bp, Homo sapiens
tcttttcatcatttaataggta

SEQ ID NO: 7716465 - DNA, 22 bp, Homo sapiens
tcttttcaggaatggctctagt

SEQ ID NO: 7716466 - DNA, 22 bp, Homo sapiens
tctttggaatgctagcattcta

SEQ ID NO: 7716467 - DNA, 22 bp, Homo sapiens
tctttggaatgctagcattcta

SEQ ID NO: 7716468 - DNA, 22 bp, Homo sapiens
tctttggaatgctagcattcta

SEQ ID NO: 7716469 - DNA, 22 bp, Homo sapiens
tctttggaattctctgcagccc

SEQ ID NO: 7716470 - DNA, 22 bp, Homo sapiens
tctttggaattctctgcagccc

SEQ ID NO: 7716471 - DNA, 22 bp, Homo sapiens
tctttggaattctctgcagccc

SEQ ID NO: 7716472 - DNA, 22 bp, Homo sapiens
tctttggaatttgctggaaata

SEQ ID NO: 7716473 - DNA, 22 bp, Homo sapiens
tctttggaatttgctggaaata

SEQ ID NO: 7716474 - DNA, 18 bp, Homo sapiens
tctttggacaactactgg

SEQ ID NO: 7716475 - DNA, 18 bp, Homo sapiens
tctttggacaactactgg

SEQ ID NO: 7716476 - DNA, 22 bp, Homo sapiens
tctttggacatgttgaggttgc

SEQ ID NO: 7716477 - DNA, 18 bp, Homo sapiens
tctttggacaactactgg

SEQ ID NO: 7716478 - DNA, 18 bp, Homo sapiens
tctttggacaactactgg

SEQ ID NO: 7716479 - DNA, 22 bp, Homo sapiens
tctttggactttccaatttgtt

SEQ ID NO: 7716480 - DNA, 23 bp, Homo sapiens
tctttggagtgctaggggttggg

SEQ ID NO: 7716481 - DNA, 22 bp, Homo sapiens
tctttggactttccaatttgtt

SEQ ID NO: 7716482 - DNA, 22 bp, Homo sapiens
tctttggatctcaaggtggcag

SEQ ID NO: 7716483 - DNA, 22 bp, Homo sapiens
tctttggatctcaaggtggcag

SEQ ID NO: 7716484 - DNA, 22 bp, Homo sapiens
tctttggatcccaactggctgg

SEQ ID NO: 7716485 - DNA, 22 bp, Homo sapiens
tctttggatgcgttacttttac

SEQ ID NO: 7716486 - DNA, 22 bp, Homo sapiens
tctttggatggaaaatgtattc

SEQ ID NO: 7716487 - DNA, 22 bp, Homo sapiens
tctttggatcccaactggctgg

SEQ ID NO: 7716488 - DNA, 22 bp, Homo sapiens
tctttggatatgtatggataga

SEQ ID NO: 7716489 - DNA, 22 bp, Homo sapiens
tctttggatatgtatggataga

SEQ ID NO: 7716490 - DNA, 22 bp, Homo sapiens
tctttggatatcgctagaccgt

SEQ ID NO: 7716491 - DNA, 22 bp, Homo sapiens
tctttggatatcgctagaccgt

SEQ ID NO: 7716492 - DNA, 22 bp, Homo sapiens
tctttggatatgtatggataga

SEQ ID NO: 7716493 - DNA, 22 bp, Homo sapiens
tctttggagtgttatcagtaat

SEQ ID NO: 7716494 - DNA, 22 bp, Homo sapiens
tctttggagtgttatcagtaat

SEQ ID NO: 7716495 - DNA, 22 bp, Homo sapiens
tctttggagtgttatcagtaat

SEQ ID NO: 7716496 - DNA, 22 bp, Homo sapiens
tctttggagtgttatcagtaat

SEQ ID NO: 7716497 - DNA, 22 bp, Homo sapiens
tctttgtctgaacagggacatt

SEQ ID NO: 7716498 - DNA, 22 bp, Homo sapiens
tctttgtggcgggcttaaatac

SEQ ID NO: 7716499 - DNA, 20 bp, Homo sapiens
tctttgtgtcagatggacag

SEQ ID NO: 7716500 - DNA, 22 bp, Homo sapiens
tctttgtgccatgcagtgaggc

SEQ ID NO: 7716501 - DNA, 22 bp, Homo sapiens
tctttgtgccatgcagtgaggc

SEQ ID NO: 7716502 - DNA, 22 bp, Homo sapiens
tctttgtctgaacagggacatt

SEQ ID NO: 7716503 - DNA, 22 bp, Homo sapiens
tctttgtaagacatgtaagtcc

SEQ ID NO: 7716504 - DNA, 22 bp, Homo sapiens
tctttgtaagttatatgtagta

SEQ ID NO: 7716505 - DNA, 19 bp, Homo sapiens
tctttgtacaagtctctgc

SEQ ID NO: 7716506 - DNA, 19 bp, Homo sapiens
tctttgtacaagtctctgc

SEQ ID NO: 7716507 - DNA, 22 bp, Homo sapiens
tctttgtactttctggctgtcc

SEQ ID NO: 7716508 - DNA, 22 bp, Homo sapiens
tctttgtacaggaaggcactgt

SEQ ID NO: 7716509 - DNA, 22 bp, Homo sapiens
tctttgtactttctggctgtcc

SEQ ID NO: 7716510 - DNA, 22 bp, Homo sapiens
tctttggcatcagggccagcta

SEQ ID NO: 7716511 - DNA, 22 bp, Homo sapiens
tctttggcatcagggccagcta

SEQ ID NO: 7716512 - DNA, 22 bp, Homo sapiens
tctttggcatttaggagcagga

SEQ ID NO: 7716513 - DNA, 22 bp, Homo sapiens
tctttggcatcagggccagcta

SEQ ID NO: 7716514 - DNA, 22 bp, Homo sapiens
tctttggcatcagggccagcta

SEQ ID NO: 7716515 - DNA, 22 bp, Homo sapiens
tctttggatggaaattggagtc

SEQ ID NO: 7716516 - DNA, 22 bp, Homo sapiens
tctttggattaaaatatttgta

SEQ ID NO: 7716517 - DNA, 22 bp, Homo sapiens
tctttggcacttctgttttaag

SEQ ID NO: 7716518 - DNA, 22 bp, Homo sapiens
tctttggcacttctgttttaag

SEQ ID NO: 7716519 - DNA, 22 bp, Homo sapiens
tctttggcatttaggagcagga

SEQ ID NO: 7716520 - DNA, 22 bp, Homo sapiens
tctttgtaactgtctattgaga

SEQ ID NO: 7716521 - DNA, 22 bp, Homo sapiens
tctttgtaactgtctattgaga

SEQ ID NO: 7716522 - DNA, 22 bp, Homo sapiens
tctttgtaagacatgtaagtcc

SEQ ID NO: 7716523 - DNA, 22 bp, Homo sapiens
tctttgtaagacatgtaagtcc

SEQ ID NO: 7716524 - DNA, 22 bp, Homo sapiens
tctttggaaaaaatggacaatc

SEQ ID NO: 7716525 - DNA, 22 bp, Homo sapiens
tctttggaaaaaatggacaatc

SEQ ID NO: 7716526 - DNA, 22 bp, Homo sapiens
tctttggaaatgctttgagaat

SEQ ID NO: 7716527 - DNA, 22 bp, Homo sapiens
tctttggaaatgctttgagaat

SEQ ID NO: 7716528 - DNA, 22 bp, Homo sapiens
tctttgctgagtacatctccaa

SEQ ID NO: 7716529 - DNA, 22 bp, Homo sapiens
tctttgctgagtacatctccaa

SEQ ID NO: 7716530 - DNA, 22 bp, Homo sapiens
tctttgctcttacacagttagt

SEQ ID NO: 7716531 - DNA, 22 bp, Homo sapiens
tctttgctcttacacagttagt

SEQ ID NO: 7716532 - DNA, 22 bp, Homo sapiens
tctttgctgagtacatctccaa

SEQ ID NO: 7716533 - DNA, 22 bp, Homo sapiens
tctttgctgagtacatctccaa

SEQ ID NO: 7716534 - DNA, 22 bp, Homo sapiens
tctttgctccacactctagaga

SEQ ID NO: 7716535 - DNA, 22 bp, Homo sapiens
tctttggaaaaaatggacaatc

SEQ ID NO: 7716536 - DNA, 22 bp, Homo sapiens
tctttggaagctttcagagaag

SEQ ID NO: 7716537 - DNA, 22 bp, Homo sapiens
tctttggaagctttcagagaag

SEQ ID NO: 7716538 - DNA, 22 bp, Homo sapiens
tctttggaaggagcagtttttg

SEQ ID NO: 7716539 - DNA, 22 bp, Homo sapiens
tctttggaatgctagcattcta

SEQ ID NO: 7716540 - DNA, 22 bp, Homo sapiens
tctttggaagtcaggggcatgg

SEQ ID NO: 7716541 - DNA, 22 bp, Homo sapiens
tctttggaatgctagcattcta

SEQ ID NO: 7716542 - DNA, 22 bp, Homo sapiens
tctttgcatgtgcttcttggcc

SEQ ID NO: 7716543 - DNA, 22 bp, Homo sapiens
tctttgctattgtgaatagtgc

SEQ ID NO: 7716544 - DNA, 22 bp, Homo sapiens
tctttgcattcctgtgtgcttt

SEQ ID NO: 7716545 - DNA, 22 bp, Homo sapiens
tctttgctattgtgaatagtgc

SEQ ID NO: 7716546 - DNA, 22 bp, Homo sapiens
tctttgctattgtgaatagtgc

SEQ ID NO: 7716547 - DNA, 22 bp, Homo sapiens
tctttgctattgtgagtagtgc

SEQ ID NO: 7716548 - DNA, 22 bp, Homo sapiens
tctttgcatcccttccatagtt

SEQ ID NO: 7716549 - DNA, 22 bp, Homo sapiens
tctttgcatcccttccatagtt

SEQ ID NO: 7716550 - DNA, 22 bp, Homo sapiens
tctttgcatcccttccatagtt

SEQ ID NO: 7716551 - DNA, 22 bp, Homo sapiens
tctttgcatcccttccatagtt

SEQ ID NO: 7716552 - DNA, 21 bp, Homo sapiens
tctttgcatcagttgttttct

SEQ ID NO: 7716553 - DNA, 22 bp, Homo sapiens
tctttgcatgcattttccctta

SEQ ID NO: 7716554 - DNA, 22 bp, Homo sapiens
tctttgcatgcattttccctta

SEQ ID NO: 7716555 - DNA, 22 bp, Homo sapiens
tctttgcatgcattttccctta

SEQ ID NO: 7716556 - DNA, 22 bp, Homo sapiens
tctttgcatggacatgtgtttt

SEQ ID NO: 7716557 - DNA, 22 bp, Homo sapiens
tctttgattttgttactaagac

SEQ ID NO: 7716558 - DNA, 22 bp, Homo sapiens
tctttgatttgacaatatcttg

SEQ ID NO: 7716559 - DNA, 22 bp, Homo sapiens
tctttgatttgacaatatcttg

SEQ ID NO: 7716560 - DNA, 22 bp, Homo sapiens
tctttgatttgacaatatcttg

SEQ ID NO: 7716561 - DNA, 22 bp, Homo sapiens
tctttgcaaaatacaacaatgg

SEQ ID NO: 7716562 - DNA, 22 bp, Homo sapiens
tctttgcaaaatacaacaatgg

SEQ ID NO: 7716563 - DNA, 22 bp, Homo sapiens
tctttgcaaactatggagtgtg

SEQ ID NO: 7716564 - DNA, 22 bp, Homo sapiens
tctttgcacacagcgattcttc

SEQ ID NO: 7716565 - DNA, 22 bp, Homo sapiens
tctttgcacacagcgattcttc

SEQ ID NO: 7716566 - DNA, 17 bp, Homo sapiens
tctttgcaatgagactg

SEQ ID NO: 7716567 - DNA, 22 bp, Homo sapiens
tctttgcacacatcccttcccg

SEQ ID NO: 7716568 - DNA, 22 bp, Homo sapiens
tctttgcactgtgcaagcagaa

SEQ ID NO: 7716569 - DNA, 22 bp, Homo sapiens
tctttgcactgtgcaagcagaa

SEQ ID NO: 7716570 - DNA, 22 bp, Homo sapiens
tctttgcaactcccatttccat

SEQ ID NO: 7716571 - DNA, 22 bp, Homo sapiens
tctttgcaactcccatttccat

SEQ ID NO: 7716572 - DNA, 22 bp, Homo sapiens
tctttgcaaatgttattatctt

SEQ ID NO: 7716573 - DNA, 22 bp, Homo sapiens
tctttgcagaacgatgaagatg

SEQ ID NO: 7716574 - DNA, 22 bp, Homo sapiens
tctttgcagaatttaactttgc

SEQ ID NO: 7716575 - DNA, 22 bp, Homo sapiens
tctttgcagaacgatgaagatg

SEQ ID NO: 7716576 - DNA, 22 bp, Homo sapiens
tctttgcagaatttaactttgc

SEQ ID NO: 7716577 - DNA, 22 bp, Homo sapiens
tctttgcaggagccctttgaac

SEQ ID NO: 7716578 - DNA, 22 bp, Homo sapiens
tctttgcagttctgattaaata

SEQ ID NO: 7716579 - DNA, 21 bp, Homo sapiens
tctttgcatcagttgttttct

SEQ ID NO: 7716580 - DNA, 22 bp, Homo sapiens
tctttgcagtggtgaataaaga

SEQ ID NO: 7716581 - DNA, 22 bp, Homo sapiens
tctttgcagttctgattaaata

SEQ ID NO: 7716582 - DNA, 22 bp, Homo sapiens
tctttgcagttctgattaaata

SEQ ID NO: 7716583 - DNA, 22 bp, Homo sapiens
tctttgcaggccaaattgttaa

SEQ ID NO: 7716584 - DNA, 22 bp, Homo sapiens
tctttgcagtctgggcttgttt

SEQ ID NO: 7716585 - DNA, 22 bp, Homo sapiens
tctttgcagtggtgaataaaga

SEQ ID NO: 7716586 - DNA, 22 bp, Homo sapiens
tgaaaaaacaagttggcccatt

SEQ ID NO: 7716587 - DNA, 22 bp, Homo sapiens
tgaaaaaacaagttggcccatt

SEQ ID NO: 7716588 - DNA, 22 bp, Homo sapiens
tgaaaaaacaagttggcccatt

SEQ ID NO: 7716589 - DNA, 22 bp, Homo sapiens
tgaaaaaacaagttggcccatt

SEQ ID NO: 7716590 - DNA, 22 bp, Homo sapiens
tgaaaaactgaatagttgagta

SEQ ID NO: 7716591 - DNA, 22 bp, Homo sapiens
tgaaaaacctcagtccgcttta

SEQ ID NO: 7716592 - DNA, 22 bp, Homo sapiens
tgaaaaacctcagtccgcttta

SEQ ID NO: 7716593 - DNA, 22 bp, Homo sapiens
tgaaaaacactaattggaaagc

SEQ ID NO: 7716594 - DNA, 22 bp, Homo sapiens
tgaaaaacactaattggaaagc

SEQ ID NO: 7716595 - DNA, 22 bp, Homo sapiens
tgaaaaacactaattggaaagc

SEQ ID NO: 7716596 - DNA, 22 bp, Homo sapiens
tgaaaaacactaattggaaagc

SEQ ID NO: 7716597 - DNA, 22 bp, Homo sapiens
tgaaaaacactaattggaaagc

SEQ ID NO: 7716598 - DNA, 22 bp, Homo sapiens
tgaaaacagaatccttgttttc

SEQ ID NO: 7716599 - DNA, 22 bp, Homo sapiens
tgaaaactccaagtttcatcag

SEQ ID NO: 7716600 - DNA, 22 bp, Homo sapiens
tgaaaacagaatccttgttttc

SEQ ID NO: 7716601 - DNA, 22 bp, Homo sapiens
tgaaaacagaatccttgttttc

SEQ ID NO: 7716602 - DNA, 22 bp, Homo sapiens
tgaaaacactttagtttaggtc

SEQ ID NO: 7716603 - DNA, 22 bp, Homo sapiens
tgaaaacagaatccttgttttc

SEQ ID NO: 7716604 - DNA, 22 bp, Homo sapiens
tgaaaacagaatccttgttttc

SEQ ID NO: 7716605 - DNA, 22 bp, Homo sapiens
tgaaaaactttaatccataaag

SEQ ID NO: 7716606 - DNA, 22 bp, Homo sapiens
tgaaaacactttagtttaggtc

SEQ ID NO: 7716607 - DNA, 22 bp, Homo sapiens
tgaaaacactttagtttaggtc

SEQ ID NO: 7716608 - DNA, 22 bp, Homo sapiens
tgaaaacactttagtttaggtc

SEQ ID NO: 7716609 - DNA, 22 bp, Homo sapiens
tgaaaaactgaatagttgagta

SEQ ID NO: 7716610 - DNA, 22 bp, Homo sapiens
tgaaaaactgaatagttgagta

SEQ ID NO: 7716611 - DNA, 22 bp, Homo sapiens
tgaaaaactttaatccataaag

SEQ ID NO: 7716612 - DNA, 22 bp, Homo sapiens
tgaaaaactttaatccataaag

SEQ ID NO: 7716613 - DNA, 22 bp, Homo sapiens
tgaaaaactttaatccataaag

SEQ ID NO: 7716614 - DNA, 22 bp, Homo sapiens
tgaaaaactttaatccataaag

SEQ ID NO: 7716615 - DNA, 22 bp, Homo sapiens
tgaaaaactttaatccataaag

SEQ ID NO: 7716616 - DNA, 22 bp, Homo sapiens
tcttttgttgcctacttattaa

SEQ ID NO: 7716617 - DNA, 22 bp, Homo sapiens
tcttttgttgcctacttattaa

SEQ ID NO: 7716618 - DNA, 22 bp, Homo sapiens
tcttttgttgcctacttattaa

SEQ ID NO: 7716619 - DNA, 22 bp, Homo sapiens
tcttttgttgcctacttattaa

SEQ ID NO: 7716620 - DNA, 23 bp, Homo sapiens
tctttttaagagatctagtgacg

SEQ ID NO: 7716621 - DNA, 23 bp, Homo sapiens
tctttttaagagatctagtgacg

SEQ ID NO: 7716622 - DNA, 23 bp, Homo sapiens
tctttttaagagatctagtgacg

SEQ ID NO: 7716623 - DNA, 23 bp, Homo sapiens
tctttttaagagatctagtgacg

SEQ ID NO: 7716624 - DNA, 22 bp, Homo sapiens
tcttttgttgcctacttattaa

SEQ ID NO: 7716625 - DNA, 22 bp, Homo sapiens
tctttttatattgacaaaaggt

SEQ ID NO: 7716626 - DNA, 23 bp, Homo sapiens
tctttttaagagatctagtgacg

SEQ ID NO: 7716627 - DNA, 22 bp, Homo sapiens
tctttttatattgacaaaaggt

SEQ ID NO: 7716628 - DNA, 22 bp, Homo sapiens
tctttttatattgacaaaaggt

SEQ ID NO: 7716629 - DNA, 22 bp, Homo sapiens
tctttttatattgacaaaaggt

SEQ ID NO: 7716630 - DNA, 22 bp, Homo sapiens
tctttttatattgacaaaaggt

SEQ ID NO: 7716631 - DNA, 22 bp, Homo sapiens
tctttttatattgacaaaaggt

SEQ ID NO: 7716632 - DNA, 22 bp, Homo sapiens
tctttttatattgacaaaaggt

SEQ ID NO: 7716633 - DNA, 22 bp, Homo sapiens
tctttttatattgacaaaaggt

SEQ ID NO: 7716634 - DNA, 22 bp, Homo sapiens
tctttttatattgacaaaaggt

SEQ ID NO: 7716635 - DNA, 22 bp, Homo sapiens
tctttttatattgacaaaaggt

SEQ ID NO: 7716636 - DNA, 22 bp, Homo sapiens
tctttttatattgacaaaaggt

SEQ ID NO: 7716637 - DNA, 22 bp, Homo sapiens
tctttttatattgacaaaaggt

SEQ ID NO: 7716638 - DNA, 22 bp, Homo sapiens
tctttttatattgacaaaaggt

SEQ ID NO: 7716639 - DNA, 22 bp, Homo sapiens
tctttttctgcacacgtgtccc

SEQ ID NO: 7716640 - DNA, 22 bp, Homo sapiens
tctttttcttattcccacactg

SEQ ID NO: 7716641 - DNA, 22 bp, Homo sapiens
tctttttcttctgtggaaggtg

SEQ ID NO: 7716642 - DNA, 22 bp, Homo sapiens
tctttttcttattcccacactg

SEQ ID NO: 7716643 - DNA, 22 bp, Homo sapiens
tctttttcttattcccacactg

SEQ ID NO: 7716644 - DNA, 22 bp, Homo sapiens
tctttttctgcacacgtgtccc

SEQ ID NO: 7716645 - DNA, 22 bp, Homo sapiens
tctttttctgcacacgtgtccc

SEQ ID NO: 7716646 - DNA, 22 bp, Homo sapiens
tgaaaaaacaagttggcccatt

SEQ ID NO: 7716647 - DNA, 22 bp, Homo sapiens
tgaaaaaacaagttggcccatt

SEQ ID NO: 7716648 - DNA, 22 bp, Homo sapiens
tgaaaaaacaagttggcccatt

SEQ ID NO: 7716649 - DNA, 22 bp, Homo sapiens
tctttttttcctgtgcagagct

SEQ ID NO: 7716650 - DNA, 22 bp, Homo sapiens
tctttttttcctgtgcagagct

SEQ ID NO: 7716651 - DNA, 22 bp, Homo sapiens
tctttttttcctgtgcagagct

SEQ ID NO: 7716652 - DNA, 22 bp, Homo sapiens
tctttttttcctgtgcagagct

SEQ ID NO: 7716653 - DNA, 22 bp, Homo sapiens
tctttttttcctgtgcagagct

SEQ ID NO: 7716654 - DNA, 22 bp, Homo sapiens
tctttttttcctgtgcagagct

SEQ ID NO: 7716655 - DNA, 22 bp, Homo sapiens
tctttttttcctgtgcagagct

SEQ ID NO: 7716656 - DNA, 22 bp, Homo sapiens
tctttttttcctgtgcagagct

SEQ ID NO: 7716657 - DNA, 22 bp, Homo sapiens
tctttttttcctgtgcagagct

SEQ ID NO: 7716658 - DNA, 22 bp, Homo sapiens
tgaaaatttccatcagttatat

SEQ ID NO: 7716659 - DNA, 22 bp, Homo sapiens
tgaaaatttccatcagttatat

SEQ ID NO: 7716660 - DNA, 22 bp, Homo sapiens
tgaaaatttccatcagttatat

SEQ ID NO: 7716661 - DNA, 22 bp, Homo sapiens
tgaaacaaaagtatgtagcttg

SEQ ID NO: 7716662 - DNA, 22 bp, Homo sapiens
tgaaacaaaagtatgtagcttg

SEQ ID NO: 7716663 - DNA, 22 bp, Homo sapiens
tgaaaattgttgtacttgataa

SEQ ID NO: 7716664 - DNA, 22 bp, Homo sapiens
tgaaaattgttgtacttgataa

SEQ ID NO: 7716665 - DNA, 22 bp, Homo sapiens
tgaaaattgttgtacttgataa

SEQ ID NO: 7716666 - DNA, 22 bp, Homo sapiens
tgaaaattgttgtacttgataa

SEQ ID NO: 7716667 - DNA, 22 bp, Homo sapiens
tgaaaattgttgtacttgataa

SEQ ID NO: 7716668 - DNA, 22 bp, Homo sapiens
tgaaaatttccatcagttatat

SEQ ID NO: 7716669 - DNA, 22 bp, Homo sapiens
tgaaaatttccatcagttatat

SEQ ID NO: 7716670 - DNA, 22 bp, Homo sapiens
tgaaaattgttgtacttgataa

SEQ ID NO: 7716671 - DNA, 22 bp, Homo sapiens
tgaaaatggcctgaagaagcaa

SEQ ID NO: 7716672 - DNA, 22 bp, Homo sapiens
tgaaaattaagcagatgaatga

SEQ ID NO: 7716673 - DNA, 22 bp, Homo sapiens
tgaaaatgccctctatgtctca

SEQ ID NO: 7716674 - DNA, 22 bp, Homo sapiens
tgaaaatgccctctatgtctca

SEQ ID NO: 7716675 - DNA, 22 bp, Homo sapiens
tgaaaatgccctctatgtctca

SEQ ID NO: 7716676 - DNA, 22 bp, Homo sapiens
tgaaaatggcctgaagaagcaa

SEQ ID NO: 7716677 - DNA, 22 bp, Homo sapiens
tgaaaatggcctgaagaagcaa

SEQ ID NO: 7716678 - DNA, 22 bp, Homo sapiens
tgaaaattcatctcatagcaga

SEQ ID NO: 7716679 - DNA, 22 bp, Homo sapiens
tgaaaattcatctcatagcaga

SEQ ID NO: 7716680 - DNA, 22 bp, Homo sapiens
tgaaaattaagcagatgaatga

SEQ ID NO: 7716681 - DNA, 22 bp, Homo sapiens
tgaaaattaagcagatgaatga

SEQ ID NO: 7716682 - DNA, 22 bp, Homo sapiens
tgaaaattctcaggctcacccc

SEQ ID NO: 7716683 - DNA, 22 bp, Homo sapiens
tgaaaattcatctcatagcaga

SEQ ID NO: 7716684 - DNA, 22 bp, Homo sapiens
tgaaaattcatctcatagcaga

SEQ ID NO: 7716685 - DNA, 22 bp, Homo sapiens
tgaaaatatagttttccagact

SEQ ID NO: 7716686 - DNA, 22 bp, Homo sapiens
tgaaaatatagttttccagact

SEQ ID NO: 7716687 - DNA, 22 bp, Homo sapiens
tgaaaatatagttttccagact

SEQ ID NO: 7716688 - DNA, 22 bp, Homo sapiens
tgaaaatgcacgctggaaagca

SEQ ID NO: 7716689 - DNA, 22 bp, Homo sapiens
tgaaaatgcacgctggaaagca

SEQ ID NO: 7716690 - DNA, 22 bp, Homo sapiens
tgaaaatgccctctatgtctca

SEQ ID NO: 7716691 - DNA, 22 bp, Homo sapiens
tgaaaatgcacgctggaaagca

SEQ ID NO: 7716692 - DNA, 22 bp, Homo sapiens
tgaaaatatagttttccagact

SEQ ID NO: 7716693 - DNA, 22 bp, Homo sapiens
tgaaaatatagttttccagact

SEQ ID NO: 7716694 - DNA, 22 bp, Homo sapiens
tgaaaatatagttttccagact

SEQ ID NO: 7716695 - DNA, 22 bp, Homo sapiens
tgaaaatatagttttccagact

SEQ ID NO: 7716696 - DNA, 22 bp, Homo sapiens
tgaaaatatagttttccagact

SEQ ID NO: 7716697 - DNA, 22 bp, Homo sapiens
tgaaaagtgatcatggattagg

SEQ ID NO: 7716698 - DNA, 22 bp, Homo sapiens
tgaaaagtcttatattgtctga

SEQ ID NO: 7716699 - DNA, 22 bp, Homo sapiens
tgaaaagtgatcatggattagg

SEQ ID NO: 7716700 - DNA, 22 bp, Homo sapiens
tgaaaagtcttatattgtctga

SEQ ID NO: 7716701 - DNA, 22 bp, Homo sapiens
tgaaaagtcttatattgtctga

SEQ ID NO: 7716702 - DNA, 22 bp, Homo sapiens
tgaaaagtcttatattgtctga

SEQ ID NO: 7716703 - DNA, 20 bp, Homo sapiens
tgaaaaggtcaggagacatg

SEQ ID NO: 7716704 - DNA, 20 bp, Homo sapiens
tgaaaaggtcaggagacatg

SEQ ID NO: 7716705 - DNA, 20 bp, Homo sapiens
tgaaaaggtcaggagacatg

SEQ ID NO: 7716706 - DNA, 22 bp, Homo sapiens
tgaaaagggtagatccctaagt

SEQ ID NO: 7716707 - DNA, 22 bp, Homo sapiens
tgaaaacttgacaagtgaggta

SEQ ID NO: 7716708 - DNA, 22 bp, Homo sapiens
tgaaaagactgcaagagagcat

SEQ ID NO: 7716709 - DNA, 22 bp, Homo sapiens
tgaaaactccaagtttcatcag

SEQ ID NO: 7716710 - DNA, 22 bp, Homo sapiens
tgaaaagactgcaagagagcat

SEQ ID NO: 7716711 - DNA, 22 bp, Homo sapiens
tgaaaagactgcaagagagcat

SEQ ID NO: 7716712 - DNA, 22 bp, Homo sapiens
tgaaaaggagtccttgttttca

SEQ ID NO: 7716713 - DNA, 22 bp, Homo sapiens
tgaaaaggagccttaggtaggt

SEQ ID NO: 7716714 - DNA, 22 bp, Homo sapiens
tgaaacataaagttatcttcag

SEQ ID NO: 7716715 - DNA, 22 bp, Homo sapiens
tgaaacataaagttatcttcag

SEQ ID NO: 7716716 - DNA, 22 bp, Homo sapiens
tgaaacataaagttatcttcag

SEQ ID NO: 7716717 - DNA, 22 bp, Homo sapiens
tgaaacataaagttatcttcag

SEQ ID NO: 7716718 - DNA, 22 bp, Homo sapiens
tgaaacataaagttatcttcag

SEQ ID NO: 7716719 - DNA, 22 bp, Homo sapiens
tgaaacataaagttatcttcag

SEQ ID NO: 7716720 - DNA, 22 bp, Homo sapiens
tgaaacattaggaaatcattat

SEQ ID NO: 7716721 - DNA, 22 bp, Homo sapiens
tgaaacattaggaaatcattat

SEQ ID NO: 7716722 - DNA, 22 bp, Homo sapiens
tgaaacattaggaaatcattat

SEQ ID NO: 7716723 - DNA, 22 bp, Homo sapiens
tgaaacattaggaaatcattat

SEQ ID NO: 7716724 - DNA, 22 bp, Homo sapiens
tgaaacattatagaatatttat

SEQ ID NO: 7716725 - DNA, 22 bp, Homo sapiens
tgaaacattatagaatatttat

SEQ ID NO: 7716726 - DNA, 22 bp, Homo sapiens
tgaaacattatagaatatttat

SEQ ID NO: 7716727 - DNA, 22 bp, Homo sapiens
tgaaacattatagaatatttat

SEQ ID NO: 7716728 - DNA, 22 bp, Homo sapiens
tgaaacattatagaatatttat

SEQ ID NO: 7716729 - DNA, 22 bp, Homo sapiens
tgaaacattatagaatatttat

SEQ ID NO: 7716730 - DNA, 22 bp, Homo sapiens
tgaaacattatagaatatttat

SEQ ID NO: 7716731 - DNA, 22 bp, Homo sapiens
tgaaacattaggaaatcattat

SEQ ID NO: 7716732 - DNA, 22 bp, Homo sapiens
tgaaacattaggaaatcattat

SEQ ID NO: 7716733 - DNA, 23 bp, Homo sapiens
tgaaacatttagggtagaatttc

SEQ ID NO: 7716734 - DNA, 23 bp, Homo sapiens
tgaaacatttagggtagaatttc

SEQ ID NO: 7716735 - DNA, 23 bp, Homo sapiens
tgaaacatttagggtagaatttc

SEQ ID NO: 7716736 - DNA, 22 bp, Homo sapiens
tgaaacattgcactgtatgaat

SEQ ID NO: 7716737 - DNA, 22 bp, Homo sapiens
tgaaacattgcactgtatgaat

SEQ ID NO: 7716738 - DNA, 22 bp, Homo sapiens
tgaaacattgcactgtatgaat

SEQ ID NO: 7716739 - DNA, 22 bp, Homo sapiens
tgaaacattgcactgtatgaat

SEQ ID NO: 7716740 - DNA, 22 bp, Homo sapiens
tgaaacattgcactgtatgaat

SEQ ID NO: 7716741 - DNA, 22 bp, Homo sapiens
tgaaacatttgatgatctttgg

SEQ ID NO: 7716742 - DNA, 22 bp, Homo sapiens
tgaaacatttgatgatctttgg

SEQ ID NO: 7716743 - DNA, 22 bp, Homo sapiens
tgaaacatttgatgatctttgg

SEQ ID NO: 7716744 - DNA, 22 bp, Homo sapiens
tgaaacatttgatgatctttgg

SEQ ID NO: 7716745 - DNA, 21 bp, Homo sapiens
tgaaacatttgatcaaagcac

SEQ ID NO: 7716746 - DNA, 21 bp, Homo sapiens
tgaaacatttgatcaaagcac

SEQ ID NO: 7716747 - DNA, 21 bp, Homo sapiens
tgaaacatttgatcaaagcac

SEQ ID NO: 7716748 - DNA, 22 bp, Homo sapiens
tgaaacagtctccagacttgga

SEQ ID NO: 7716749 - DNA, 22 bp, Homo sapiens
tgaaacaggcaaaactgcagat

SEQ ID NO: 7716750 - DNA, 22 bp, Homo sapiens
tgaaacagtagtctgtgggttt

SEQ ID NO: 7716751 - DNA, 22 bp, Homo sapiens
tgaaacagtattctcaaccttt

SEQ ID NO: 7716752 - DNA, 22 bp, Homo sapiens
tgaaacagtgcttcactcagcc

SEQ ID NO: 7716753 - DNA, 22 bp, Homo sapiens
tgaaacagtgcttcactcagcc

SEQ ID NO: 7716754 - DNA, 22 bp, Homo sapiens
tgaaacagtctccagacttgga

SEQ ID NO: 7716755 - DNA, 22 bp, Homo sapiens
tgaaacaggcaaaactgcagat

SEQ ID NO: 7716756 - DNA, 22 bp, Homo sapiens
tgaaacaggcaaaactgcagat

SEQ ID NO: 7716757 - DNA, 22 bp, Homo sapiens
tgaaacaggaagtaaacagaca

SEQ ID NO: 7716758 - DNA, 22 bp, Homo sapiens
tgaaacaggaagtaaacagaca

SEQ ID NO: 7716759 - DNA, 22 bp, Homo sapiens
tgaaacaggaagtaaacagaca

SEQ ID NO: 7716760 - DNA, 19 bp, Homo sapiens
tgaaacaaacttaaaagga

SEQ ID NO: 7716761 - DNA, 19 bp, Homo sapiens
tgaaacaaacttaaaagga

SEQ ID NO: 7716762 - DNA, 19 bp, Homo sapiens
tgaaacaaacttaaaagga

SEQ ID NO: 7716763 - DNA, 19 bp, Homo sapiens
tgaaacaaacttaaaagga

SEQ ID NO: 7716764 - DNA, 19 bp, Homo sapiens
tgaaacaaacttaaaagga

SEQ ID NO: 7716765 - DNA, 19 bp, Homo sapiens
tgaaacaaacttaaaagga

SEQ ID NO: 7716766 - DNA, 19 bp, Homo sapiens
tgaaacaaacttaaaagga

SEQ ID NO: 7716767 - DNA, 19 bp, Homo sapiens
tgaaacaaacttaaaagga

SEQ ID NO: 7716768 - DNA, 19 bp, Homo sapiens
tgaaacaaacttaaaagga

SEQ ID NO: 7716769 - DNA, 22 bp, Homo sapiens
tgaaacaaaccagtaattttgt

SEQ ID NO: 7716770 - DNA, 22 bp, Homo sapiens
tgaaacaaaccagtaattttgt

SEQ ID NO: 7716771 - DNA, 22 bp, Homo sapiens
tgaaacaaaccagtaattttgt

SEQ ID NO: 7716772 - DNA, 22 bp, Homo sapiens
tgaaacaaaccagtaattttgt

SEQ ID NO: 7716773 - DNA, 22 bp, Homo sapiens
tgaaacaaaattaagattctcg

SEQ ID NO: 7716774 - DNA, 22 bp, Homo sapiens
tgaaacaaaccagtaattttgt

SEQ ID NO: 7716775 - DNA, 22 bp, Homo sapiens
tgaaacaaaccagtaattttgt

SEQ ID NO: 7716776 - DNA, 22 bp, Homo sapiens
tgaaacaaaccagtaattttgt

SEQ ID NO: 7716777 - DNA, 22 bp, Homo sapiens
tgaaacaaaattaagattctcg

SEQ ID NO: 7716778 - DNA, 22 bp, Homo sapiens
tgaaacaaaccagtaattttgt

SEQ ID NO: 7716779 - DNA, 22 bp, Homo sapiens
tgaaacaaaattaagattctcg

SEQ ID NO: 7716780 - DNA, 22 bp, Homo sapiens
tgaaacaaaattaagattctcg

SEQ ID NO: 7716781 - DNA, 22 bp, Homo sapiens
tgaaacaaaattaagattctcg

SEQ ID NO: 7716782 - DNA, 22 bp, Homo sapiens
tgaaacaaaagtatgtagcttg

SEQ ID NO: 7716783 - DNA, 22 bp, Homo sapiens
tgaaagaagccttcgaggctcg

SEQ ID NO: 7716784 - DNA, 22 bp, Homo sapiens
tgaaagaagggtggaaaatgta

SEQ ID NO: 7716785 - DNA, 22 bp, Homo sapiens
tgaaagaagggtggaaaatgta

SEQ ID NO: 7716786 - DNA, 22 bp, Homo sapiens
tgaaagaagggtggaaaatgta

SEQ ID NO: 7716787 - DNA, 21 bp, Homo sapiens
tgaaagaaggtgcagtctgaa

SEQ ID NO: 7716788 - DNA, 21 bp, Homo sapiens
tgaaagaaggtgcagtctgaa

SEQ ID NO: 7716789 - DNA, 21 bp, Homo sapiens
tgaaagaaggtgcagtctgaa

SEQ ID NO: 7716790 - DNA, 22 bp, Homo sapiens
tgaaagaactagcatcttcaag

SEQ ID NO: 7716791 - DNA, 22 bp, Homo sapiens
tgaaagaactagcatcttcaag

SEQ ID NO: 7716792 - DNA, 22 bp, Homo sapiens
tgaaagaactagcatcttcaag

SEQ ID NO: 7716793 - DNA, 22 bp, Homo sapiens
tgaaagaactagcatcttcaag

SEQ ID NO: 7716794 - DNA, 22 bp, Homo sapiens
tgaaagaagccttcgaggctcg

SEQ ID NO: 7716795 - DNA, 22 bp, Homo sapiens
tgaaagaactagcatcttcaag

SEQ ID NO: 7716796 - DNA, 22 bp, Homo sapiens
tgaaagaagtgtcacattgcca

SEQ ID NO: 7716797 - DNA, 22 bp, Homo sapiens
tgaaagaagtgtcacattgcca

SEQ ID NO: 7716798 - DNA, 22 bp, Homo sapiens
tgaaagaagtgtcacattgcca

SEQ ID NO: 7716799 - DNA, 22 bp, Homo sapiens
tgaaagaagtgtcacattgcca

SEQ ID NO: 7716800 - DNA, 22 bp, Homo sapiens
tgaaagaagtgtcacattgcca

SEQ ID NO: 7716801 - DNA, 22 bp, Homo sapiens
tgaaagaagtgtcacattgcca

SEQ ID NO: 7716802 - DNA, 21 bp, Homo sapiens
tgaaagaaggtgcagtctgaa

SEQ ID NO: 7716803 - DNA, 21 bp, Homo sapiens
tgaaagaaggtgcagtctgaa

SEQ ID NO: 7716804 - DNA, 17 bp, Homo sapiens
tgaaagaatcagggaga

SEQ ID NO: 7716805 - DNA, 17 bp, Homo sapiens
tgaaagaatcagggaga

SEQ ID NO: 7716806 - DNA, 17 bp, Homo sapiens
tgaaagaatcagggaga

SEQ ID NO: 7716807 - DNA, 22 bp, Homo sapiens
tgaaagacaaggttttttcaga

SEQ ID NO: 7716808 - DNA, 22 bp, Homo sapiens
tgaaagacaaggttttttcaga

SEQ ID NO: 7716809 - DNA, 21 bp, Homo sapiens
tgaaagaggatgtggtcattc

SEQ ID NO: 7716810 - DNA, 22 bp, Homo sapiens
tgaaagagtgcaagtcaaggag

SEQ ID NO: 7716811 - DNA, 22 bp, Homo sapiens
tgaaaccattctcaggtacact

SEQ ID NO: 7716812 - DNA, 22 bp, Homo sapiens
tgaaaccattctcaggtacact

SEQ ID NO: 7716813 - DNA, 22 bp, Homo sapiens
tgaaaccccagattaccacaaa

SEQ ID NO: 7716814 - DNA, 22 bp, Homo sapiens
tgaaaccattctcaggtacact

SEQ ID NO: 7716815 - DNA, 22 bp, Homo sapiens
tgaaaccactgatggtaccaag

SEQ ID NO: 7716816 - DNA, 22 bp, Homo sapiens
tgaaacctacggagttcccaga

SEQ ID NO: 7716817 - DNA, 22 bp, Homo sapiens
tgaaacctcaaccaaaggttac

SEQ ID NO: 7716818 - DNA, 22 bp, Homo sapiens
tgaaacctcaaccaaaggttac

SEQ ID NO: 7716819 - DNA, 22 bp, Homo sapiens
tgaaaccttggatgtgtagaaa

SEQ ID NO: 7716820 - DNA, 22 bp, Homo sapiens
tgaaaccttggctagagattga

SEQ ID NO: 7716821 - DNA, 21 bp, Homo sapiens
tgaaactacctacaagctacc

SEQ ID NO: 7716822 - DNA, 21 bp, Homo sapiens
tgaaactacctacaagctacc

SEQ ID NO: 7716823 - DNA, 22 bp, Homo sapiens
tgaaacggaatgttctttatcg

SEQ ID NO: 7716824 - DNA, 22 bp, Homo sapiens
tgaaacttatatatcccaggtt

SEQ ID NO: 7716825 - DNA, 22 bp, Homo sapiens
tgaaacttataagaatatgaat

SEQ ID NO: 7716826 - DNA, 22 bp, Homo sapiens
tgaaacttataagaatatgaat

SEQ ID NO: 7716827 - DNA, 22 bp, Homo sapiens
tgaaactgaaaggtatttatag

SEQ ID NO: 7716828 - DNA, 22 bp, Homo sapiens
tgaaacttataagaatatgaat

SEQ ID NO: 7716829 - DNA, 21 bp, Homo sapiens
tgaaactacctacaagctacc

SEQ ID NO: 7716830 - DNA, 22 bp, Homo sapiens
tgaaactaggccaatcaaatta

SEQ ID NO: 7716831 - DNA, 22 bp, Homo sapiens
tgaaactaggccaatcaaatta

SEQ ID NO: 7716832 - DNA, 22 bp, Homo sapiens
tgaaactgaaaggtatttatag

SEQ ID NO: 7716833 - DNA, 22 bp, Homo sapiens
tgaaactgaaaggtatttatag

SEQ ID NO: 7716834 - DNA, 22 bp, Homo sapiens
tgaaactaggccaatcaaatta

SEQ ID NO: 7716835 - DNA, 22 bp, Homo sapiens
tgaaacttttgaggttcttcca

SEQ ID NO: 7716836 - DNA, 22 bp, Homo sapiens
tgaaacttttgaggttcttcca

SEQ ID NO: 7716837 - DNA, 22 bp, Homo sapiens
tgaaacttattcagtttctacc

SEQ ID NO: 7716838 - DNA, 22 bp, Homo sapiens
tgaaagaaacaggtatattggg

SEQ ID NO: 7716839 - DNA, 22 bp, Homo sapiens
tgaaagaaacaggtatattggg

SEQ ID NO: 7716840 - DNA, 22 bp, Homo sapiens
tgaaagaactagcatcttcaag

SEQ ID NO: 7716841 - DNA, 22 bp, Homo sapiens
tgaaagaaacaggtatattggg

SEQ ID NO: 7716842 - DNA, 22 bp, Homo sapiens
tgccatttataaccagtggcct

SEQ ID NO: 7716843 - DNA, 22 bp, Homo sapiens
tgccattatgacaattgaggaa

SEQ ID NO: 7716844 - DNA, 22 bp, Homo sapiens
tgccattcatttttaaggaagg

SEQ ID NO: 7716845 - DNA, 22 bp, Homo sapiens
tgccattacccaagagtaagat

SEQ ID NO: 7716846 - DNA, 19 bp, Homo sapiens
tgccatgtttaagcaattt

SEQ ID NO: 7716847 - DNA, 22 bp, Homo sapiens
tgccattgggcagtcattgaag

SEQ ID NO: 7716848 - DNA, 22 bp, Homo sapiens
tgccatggaatcacctccagct

SEQ ID NO: 7716849 - DNA, 22 bp, Homo sapiens
tgccatggattaagtgggtggc

SEQ ID NO: 7716850 - DNA, 22 bp, Homo sapiens
tgccatggagtgggtcaactat

SEQ ID NO: 7716851 - DNA, 20 bp, Homo sapiens
tgccatggtaacagagtgtg

SEQ ID NO: 7716852 - DNA, 22 bp, Homo sapiens
tgccatggcctagacctgtgat

SEQ ID NO: 7716853 - DNA, 22 bp, Homo sapiens
tgccatggtgactgcaggaggt

SEQ ID NO: 7716854 - DNA, 23 bp, Homo sapiens
tgccatttggaagttgggggtct

SEQ ID NO: 7716855 - DNA, 22 bp, Homo sapiens
tgccatttgctggttttctgat

SEQ ID NO: 7716856 - DNA, 22 bp, Homo sapiens
tgccatttgtaactatcattct

SEQ ID NO: 7716857 - DNA, 22 bp, Homo sapiens
tgccatttgttactatcaggac

SEQ ID NO: 7716858 - DNA, 23 bp, Homo sapiens
tgccattttccatctcatgcaga

SEQ ID NO: 7716859 - DNA, 22 bp, Homo sapiens
tgccatttgccccagcactgtc

SEQ ID NO: 7716860 - DNA, 22 bp, Homo sapiens
tgccatttctttcaatattctt

SEQ ID NO: 7716861 - DNA, 22 bp, Homo sapiens
tgccatttttgagtggggcctc

SEQ ID NO: 7716862 - DNA, 22 bp, Homo sapiens
tgcccaaacctctcctagctct

SEQ ID NO: 7716863 - DNA, 22 bp, Homo sapiens
tgcccaaactgacattggcagt

SEQ ID NO: 7716864 - DNA, 22 bp, Homo sapiens
tgcccaagattcttacatcatg

SEQ ID NO: 7716865 - DNA, 22 bp, Homo sapiens
tgcccaagatcctacatcctga

SEQ ID NO: 7716866 - DNA, 22 bp, Homo sapiens
tgcccaagatcctacatcctga

SEQ ID NO: 7716867 - DNA, 22 bp, Homo sapiens
tgcccaaactgacattggcagt

SEQ ID NO: 7716868 - DNA, 22 bp, Homo sapiens
tgcccaagccgagctctctgtt

SEQ ID NO: 7716869 - DNA, 22 bp, Homo sapiens
tgcccaagccgagctctctgtt

SEQ ID NO: 7716870 - DNA, 22 bp, Homo sapiens
tgcccaagattcttacatcatg

SEQ ID NO: 7716871 - DNA, 22 bp, Homo sapiens
tgcccaagcagaggagtgattc

SEQ ID NO: 7716872 - DNA, 22 bp, Homo sapiens
tgcccaagcagaggagtgattc

SEQ ID NO: 7716873 - DNA, 23 bp, Homo sapiens
tgcccacaaaagtaaagacattt

SEQ ID NO: 7716874 - DNA, 23 bp, Homo sapiens
tgcccacaaaagtaaagacattt

SEQ ID NO: 7716875 - DNA, 20 bp, Homo sapiens
tgcccacaattcacaatgcc

SEQ ID NO: 7716876 - DNA, 20 bp, Homo sapiens
tgcccacaattcacaatgcc

SEQ ID NO: 7716877 - DNA, 22 bp, Homo sapiens
tgcccaagtgtttggctgagtc

SEQ ID NO: 7716878 - DNA, 22 bp, Homo sapiens
tgcccaagtgtttggctgagtc

SEQ ID NO: 7716879 - DNA, 22 bp, Homo sapiens
tgcccaagtgtttggctgagtc

SEQ ID NO: 7716880 - DNA, 22 bp, Homo sapiens
tgcccaagtcctccaccgaggt

SEQ ID NO: 7716881 - DNA, 22 bp, Homo sapiens
tgcccaagtgtttggctgagtc

SEQ ID NO: 7716882 - DNA, 22 bp, Homo sapiens
tgcccaagtcctccaccgaggt

SEQ ID NO: 7716883 - DNA, 22 bp, Homo sapiens
tgcccaagtcctccaccgaggt

SEQ ID NO: 7716884 - DNA, 22 bp, Homo sapiens
tgcccaaggatccattggctgg

SEQ ID NO: 7716885 - DNA, 22 bp, Homo sapiens
tgcccaagccgagctctctgtt

SEQ ID NO: 7716886 - DNA, 22 bp, Homo sapiens
tgcccaaggatccattggctgg

SEQ ID NO: 7716887 - DNA, 20 bp, Homo sapiens
tgcccacatcactcaggagt

SEQ ID NO: 7716888 - DNA, 22 bp, Homo sapiens
tgcccacaggaagacaccagcg

SEQ ID NO: 7716889 - DNA, 20 bp, Homo sapiens
tgcccacatcactcaggagt

SEQ ID NO: 7716890 - DNA, 20 bp, Homo sapiens
tgcccacatcactcaggagt

SEQ ID NO: 7716891 - DNA, 22 bp, Homo sapiens
tgcccacagctcagggctgctc

SEQ ID NO: 7716892 - DNA, 22 bp, Homo sapiens
tgcccacaggaagacaccagcg

SEQ ID NO: 7716893 - DNA, 22 bp, Homo sapiens
tgcccacagctcagggctgctc

SEQ ID NO: 7716894 - DNA, 22 bp, Homo sapiens
tgcccacacctgggggaggctg

SEQ ID NO: 7716895 - DNA, 22 bp, Homo sapiens
tgcccacacctgggggaggctg

SEQ ID NO: 7716896 - DNA, 22 bp, Homo sapiens
tgcccacagatatgtgcagtct

SEQ ID NO: 7716897 - DNA, 22 bp, Homo sapiens
tgcccacacctgggggaggctg

SEQ ID NO: 7716898 - DNA, 22 bp, Homo sapiens
tgcccacagatatgtgcagtct

SEQ ID NO: 7716899 - DNA, 22 bp, Homo sapiens
tgcccacagcaaagaggtagga

SEQ ID NO: 7716900 - DNA, 21 bp, Homo sapiens
tgcccacagcaaatgcagagg

SEQ ID NO: 7716901 - DNA, 21 bp, Homo sapiens
tgcccacagcaaatgcagagg

SEQ ID NO: 7716902 - DNA, 22 bp, Homo sapiens
tgcccacagatatgtgcagtct

SEQ ID NO: 7716903 - DNA, 21 bp, Homo sapiens
tgcccacagcaaatgcagagg

SEQ ID NO: 7716904 - DNA, 20 bp, Homo sapiens
tgcccagcaagagtgcagtt

SEQ ID NO: 7716905 - DNA, 20 bp, Homo sapiens
tgcccagcaagagtgcagtt

SEQ ID NO: 7716906 - DNA, 20 bp, Homo sapiens
tgcccagcaagagtgcagtt

SEQ ID NO: 7716907 - DNA, 20 bp, Homo sapiens
tgcccagcaagagtgcagtt

SEQ ID NO: 7716908 - DNA, 20 bp, Homo sapiens
tgcccagcaagagtgcagtt

SEQ ID NO: 7716909 - DNA, 19 bp, Homo sapiens
tgcccagagtgtatgcgca

SEQ ID NO: 7716910 - DNA, 19 bp, Homo sapiens
tgcccagagtgtatgcgca

SEQ ID NO: 7716911 - DNA, 22 bp, Homo sapiens
tgcccagagcctgagaggatta

SEQ ID NO: 7716912 - DNA, 22 bp, Homo sapiens
tgcccagagcctgagaggatta

SEQ ID NO: 7716913 - DNA, 22 bp, Homo sapiens
tgcccagagcctcttacctcca

SEQ ID NO: 7716914 - DNA, 22 bp, Homo sapiens
tgcccagaatagatgggctgtg

SEQ ID NO: 7716915 - DNA, 22 bp, Homo sapiens
tgcccagaatagatgggctgtg

SEQ ID NO: 7716916 - DNA, 18 bp, Homo sapiens
tgcccagaaaagcaggga

SEQ ID NO: 7716917 - DNA, 22 bp, Homo sapiens
tgcccagaatagatgggctgtg

SEQ ID NO: 7716918 - DNA, 18 bp, Homo sapiens
tgcccagaaaagcaggga

SEQ ID NO: 7716919 - DNA, 18 bp, Homo sapiens
tgcccagaaaagcaggga

SEQ ID NO: 7716920 - DNA, 22 bp, Homo sapiens
tgcccacctaacagtgtttgga

SEQ ID NO: 7716921 - DNA, 18 bp, Homo sapiens
tgcccagaaaagcaggga

SEQ ID NO: 7716922 - DNA, 22 bp, Homo sapiens
tgcccacttcaaaatcttcatt

SEQ ID NO: 7716923 - DNA, 22 bp, Homo sapiens
tgcccactgtgtcaaagaaata

SEQ ID NO: 7716924 - DNA, 22 bp, Homo sapiens
tgcccactcttttgatttgtgt

SEQ ID NO: 7716925 - DNA, 22 bp, Homo sapiens
tgcccacatggtgccatggcca

SEQ ID NO: 7716926 - DNA, 22 bp, Homo sapiens
tgcccacatggtgccatggcca

SEQ ID NO: 7716927 - DNA, 22 bp, Homo sapiens
tgcccacatggtgccatggcca

SEQ ID NO: 7716928 - DNA, 22 bp, Homo sapiens
tgcccacatctgcttatttcat

SEQ ID NO: 7716929 - DNA, 22 bp, Homo sapiens
tgcccacatggtgccatggcca

SEQ ID NO: 7716930 - DNA, 22 bp, Homo sapiens
tgcccacattctgaagctccct

SEQ ID NO: 7716931 - DNA, 22 bp, Homo sapiens
tgcccacattctgaagctccct

SEQ ID NO: 7716932 - DNA, 22 bp, Homo sapiens
tgcccacattctgaagctccct

SEQ ID NO: 7716933 - DNA, 22 bp, Homo sapiens
tgcccacattcaaaaggtgatg

SEQ ID NO: 7716934 - DNA, 22 bp, Homo sapiens
tgcccacctttactgtgattta

SEQ ID NO: 7716935 - DNA, 22 bp, Homo sapiens
tgcccacctaacagtgtttgga

SEQ ID NO: 7716936 - DNA, 18 bp, Homo sapiens
tgcccaccagaagaggga

SEQ ID NO: 7716937 - DNA, 18 bp, Homo sapiens
tgcccaccagaagaggga

SEQ ID NO: 7716938 - DNA, 21 bp, Homo sapiens
tgcccaccaagctccacactg

SEQ ID NO: 7716939 - DNA, 18 bp, Homo sapiens
tgcccaccagaagaggga

SEQ ID NO: 7716940 - DNA, 22 bp, Homo sapiens
tgcccacattcaaaaggtgatg

SEQ ID NO: 7716941 - DNA, 22 bp, Homo sapiens
tgcccacattcaaaaggtgatg

SEQ ID NO: 7716942 - DNA, 21 bp, Homo sapiens
tgcccaccaagctccacactg

SEQ ID NO: 7716943 - DNA, 21 bp, Homo sapiens
tgcccaccaagctccacactg

SEQ ID NO: 7716944 - DNA, 21 bp, Homo sapiens
tgcccaccaagctccacactg

SEQ ID NO: 7716945 - DNA, 22 bp, Homo sapiens
tgcccagcacccagcatgatgc

SEQ ID NO: 7716946 - DNA, 22 bp, Homo sapiens
tgcccagcacccagcatgatgc

SEQ ID NO: 7716947 - DNA, 22 bp, Homo sapiens
tgcccagcaataaaccagaaga

SEQ ID NO: 7716948 - DNA, 22 bp, Homo sapiens
tgcccagcactgtgccagtcac

SEQ ID NO: 7716949 - DNA, 22 bp, Homo sapiens
tgcccagcactgtgccagtcac

SEQ ID NO: 7716950 - DNA, 22 bp, Homo sapiens
tgcccagcacccagcatgatgc

SEQ ID NO: 7716951 - DNA, 22 bp, Homo sapiens
tgcccagcaataaaccagaaga

SEQ ID NO: 7716952 - DNA, 20 bp, Homo sapiens
tgcccagcaagagtgcagtt

SEQ ID NO: 7716953 - DNA, 22 bp, Homo sapiens
tgcccagcaataaaccagaaga

SEQ ID NO: 7716954 - DNA, 22 bp, Homo sapiens
tgcccagcaataaaccagaaga

SEQ ID NO: 7716955 - DNA, 22 bp, Homo sapiens
tgcccagcaataaaccagaaga

SEQ ID NO: 7716956 - DNA, 20 bp, Homo sapiens
tgcccagcaagagtgcagtt

SEQ ID NO: 7716957 - DNA, 20 bp, Homo sapiens
tgcccagcaagagtgcagtt

SEQ ID NO: 7716958 - DNA, 22 bp, Homo sapiens
tgcccagcagggagctacctgg

SEQ ID NO: 7716959 - DNA, 22 bp, Homo sapiens
tgcccagcagggagctacctgg

SEQ ID NO: 7716960 - DNA, 22 bp, Homo sapiens
tgcccagcagggagctacctgg

SEQ ID NO: 7716961 - DNA, 22 bp, Homo sapiens
tgcccagcagggagctacctgg

SEQ ID NO: 7716962 - DNA, 22 bp, Homo sapiens
tgcccagcactgtgccagtcac

SEQ ID NO: 7716963 - DNA, 22 bp, Homo sapiens
tgcccagcagggagctacctgg

SEQ ID NO: 7716964 - DNA, 22 bp, Homo sapiens
tgcccagcagggagctacctgg

SEQ ID NO: 7716965 - DNA, 22 bp, Homo sapiens
tgcccagcagggagctacctgg

SEQ ID NO: 7716966 - DNA, 22 bp, Homo sapiens
tgcccagccaatttgttatgtt

SEQ ID NO: 7716967 - DNA, 22 bp, Homo sapiens
tgcccagccaatttgttatgtt

SEQ ID NO: 7716968 - DNA, 22 bp, Homo sapiens
tgcccaggatctggcgatgctc

SEQ ID NO: 7716969 - DNA, 22 bp, Homo sapiens
tgcccaggatctggcgatgctc

SEQ ID NO: 7716970 - DNA, 22 bp, Homo sapiens
tgcccagcactgtgccagtcac

SEQ ID NO: 7716971 - DNA, 22 bp, Homo sapiens
tgcccagcactgtgccagtcac

SEQ ID NO: 7716972 - DNA, 22 bp, Homo sapiens
tgcccagcactgtgccagtcac

SEQ ID NO: 7716973 - DNA, 22 bp, Homo sapiens
tgcccagcactgtgccagtcac

SEQ ID NO: 7716974 - DNA, 22 bp, Homo sapiens
tgcccagcactgtgccagtcac

SEQ ID NO: 7716975 - DNA, 22 bp, Homo sapiens
tgcccagcactgtgccagtcac

SEQ ID NO: 7716976 - DNA, 22 bp, Homo sapiens
tgcccagcactgtgccagtcac

SEQ ID NO: 7716977 - DNA, 22 bp, Homo sapiens
tgcccagcactgtgccagtcac

SEQ ID NO: 7716978 - DNA, 20 bp, Homo sapiens
tgccccaggcctgcacctgc

SEQ ID NO: 7716979 - DNA, 22 bp, Homo sapiens
tgccccagactctgctcacctc

SEQ ID NO: 7716980 - DNA, 20 bp, Homo sapiens
tgccccaggcctgcacctgc

SEQ ID NO: 7716981 - DNA, 20 bp, Homo sapiens
tgccccaggcctgcacctgc

SEQ ID NO: 7716982 - DNA, 22 bp, Homo sapiens
tgccccagactctgctcacctc

SEQ ID NO: 7716983 - DNA, 20 bp, Homo sapiens
tgccccaggcctgcacctgc

SEQ ID NO: 7716984 - DNA, 22 bp, Homo sapiens
tgccccaggtgctgaggttgga

SEQ ID NO: 7716985 - DNA, 22 bp, Homo sapiens
tgccccaggtgctgaggttgga

SEQ ID NO: 7716986 - DNA, 22 bp, Homo sapiens
tgccccaggtgctgaggttgga

SEQ ID NO: 7716987 - DNA, 20 bp, Homo sapiens
tgccccaggcctgcacctgc

SEQ ID NO: 7716988 - DNA, 20 bp, Homo sapiens
tgccccaggcctgcacctgc

SEQ ID NO: 7716989 - DNA, 22 bp, Homo sapiens
tgccccagacctactgaatggg

SEQ ID NO: 7716990 - DNA, 22 bp, Homo sapiens
tgccccagacctactgaatggg

SEQ ID NO: 7716991 - DNA, 22 bp, Homo sapiens
tgccccagactctgctcacctc

SEQ ID NO: 7716992 - DNA, 22 bp, Homo sapiens
tgccccagactctgctcacctc

SEQ ID NO: 7716993 - DNA, 22 bp, Homo sapiens
tgccccagactctgctcacctc

SEQ ID NO: 7716994 - DNA, 22 bp, Homo sapiens
tgccccagactctgctcacctc

SEQ ID NO: 7716995 - DNA, 22 bp, Homo sapiens
tgccccagacctactgaatggg

SEQ ID NO: 7716996 - DNA, 22 bp, Homo sapiens
tgccccagacctactgaatggg

SEQ ID NO: 7716997 - DNA, 22 bp, Homo sapiens
tgccccagacctactgaatggg

SEQ ID NO: 7716998 - DNA, 22 bp, Homo sapiens
tgccccagacctactgaatggg

SEQ ID NO: 7716999 - DNA, 22 bp, Homo sapiens
tgcccatgtttctctgtatccc

SEQ ID NO: 7717000 - DNA, 22 bp, Homo sapiens
tgcccattattcagccattaaa

SEQ ID NO: 7717001 - DNA, 22 bp, Homo sapiens
tgccccctggtggccagagccg

SEQ ID NO: 7717002 - DNA, 22 bp, Homo sapiens
tgccccctggtggccagagccg

SEQ ID NO: 7717003 - DNA, 22 bp, Homo sapiens
tgccccctggtggccagagccg

SEQ ID NO: 7717004 - DNA, 22 bp, Homo sapiens
tgcccccaggccctgtggttag

SEQ ID NO: 7717005 - DNA, 22 bp, Homo sapiens
tgcccccaggccctgtggttag

SEQ ID NO: 7717006 - DNA, 19 bp, Homo sapiens
tgcccccagcacctccctg

SEQ ID NO: 7717007 - DNA, 19 bp, Homo sapiens
tgcccccagcacctccctg

SEQ ID NO: 7717008 - DNA, 19 bp, Homo sapiens
tgcccccagcacctccctg

SEQ ID NO: 7717009 - DNA, 20 bp, Homo sapiens
tgccccaggcctgcacctgc

SEQ ID NO: 7717010 - DNA, 22 bp, Homo sapiens
tgccccaggtgctgaggttgga

SEQ ID NO: 7717011 - DNA, 22 bp, Homo sapiens
tgccccaggtgctgaggttgga

SEQ ID NO: 7717012 - DNA, 22 bp, Homo sapiens
tgcccccagacagaatccagtt

SEQ ID NO: 7717013 - DNA, 22 bp, Homo sapiens
tgcccccttttcttgttacact

SEQ ID NO: 7717014 - DNA, 22 bp, Homo sapiens
tgcccccttttcttgttacact

SEQ ID NO: 7717015 - DNA, 22 bp, Homo sapiens
tgcccctcagggaacgggtatc

SEQ ID NO: 7717016 - DNA, 22 bp, Homo sapiens
tgcccctcagggaacgggtatc

SEQ ID NO: 7717017 - DNA, 22 bp, Homo sapiens
tgcccctcgacgcaatgaaggg

SEQ ID NO: 7717018 - DNA, 22 bp, Homo sapiens
tgcccctcgacgcaatgaaggg

SEQ ID NO: 7717019 - DNA, 22 bp, Homo sapiens
tgcccctcagggaacgggtatc

SEQ ID NO: 7717020 - DNA, 22 bp, Homo sapiens
tgcccctctcctgtgatccaag

SEQ ID NO: 7717021 - DNA, 22 bp, Homo sapiens
tgcccctctcctgtgatccaag

SEQ ID NO: 7717022 - DNA, 22 bp, Homo sapiens
tgcccctcgacgcaatgaaggg

SEQ ID NO: 7717023 - DNA, 22 bp, Homo sapiens
tgcccctcgacgcaatgaaggg

SEQ ID NO: 7717024 - DNA, 22 bp, Homo sapiens
tgcccctctcctgtgatccaag

SEQ ID NO: 7717025 - DNA, 22 bp, Homo sapiens
tgcccctctcctgtgatccaag

SEQ ID NO: 7717026 - DNA, 22 bp, Homo sapiens
tgcccctctcctgtgatccaag

SEQ ID NO: 7717027 - DNA, 22 bp, Homo sapiens
tgcccagggtggagtgcagcgg

SEQ ID NO: 7717028 - DNA, 22 bp, Homo sapiens
tgcccagggtggagtgcagcgg

SEQ ID NO: 7717029 - DNA, 22 bp, Homo sapiens
tgcccagggtggagtgcagtgg

SEQ ID NO: 7717030 - DNA, 22 bp, Homo sapiens
tgcccagggtggagtgcagtgg

SEQ ID NO: 7717031 - DNA, 22 bp, Homo sapiens
tgcccagggtggagtgcagtgg

SEQ ID NO: 7717032 - DNA, 22 bp, Homo sapiens
tgcccagggtggagtgcagtgg

SEQ ID NO: 7717033 - DNA, 22 bp, Homo sapiens
tgcccagggtggagtgcagtgg

SEQ ID NO: 7717034 - DNA, 22 bp, Homo sapiens
tgcccagggtggagtgcagtgg

SEQ ID NO: 7717035 - DNA, 22 bp, Homo sapiens
tgcccagggtttctaagagcag

SEQ ID NO: 7717036 - DNA, 22 bp, Homo sapiens
tgcccagggtttctaagagcag

SEQ ID NO: 7717037 - DNA, 22 bp, Homo sapiens
tgcccaggtttgagtgcccaag

SEQ ID NO: 7717038 - DNA, 22 bp, Homo sapiens
tgcccagggtggagtgcagtgg

SEQ ID NO: 7717039 - DNA, 22 bp, Homo sapiens
tgcccagggtttctaagagcag

SEQ ID NO: 7717040 - DNA, 22 bp, Homo sapiens
tgcccagggtttctaagagcag

SEQ ID NO: 7717041 - DNA, 22 bp, Homo sapiens
tgcccagggtttctaagagcag

SEQ ID NO: 7717042 - DNA, 22 bp, Homo sapiens
tgcccagggtttctaagagcag

SEQ ID NO: 7717043 - DNA, 22 bp, Homo sapiens
tgcccaggtttgagtgcccaag

SEQ ID NO: 7717044 - DNA, 22 bp, Homo sapiens
tgcccaggtttgagtgcccaag

SEQ ID NO: 7717045 - DNA, 22 bp, Homo sapiens
tgcccaggtttgagtgcccaag

SEQ ID NO: 7717046 - DNA, 22 bp, Homo sapiens
tgcccaggtttgagtgcccaag

SEQ ID NO: 7717047 - DNA, 22 bp, Homo sapiens
tgcccagtctccgggccagccc

SEQ ID NO: 7717048 - DNA, 22 bp, Homo sapiens
tgcccagtctccgggccagccc

SEQ ID NO: 7717049 - DNA, 22 bp, Homo sapiens
tgcccaggtttgagtgcccaag

SEQ ID NO: 7717050 - DNA, 22 bp, Homo sapiens
tgcccaggtttgagtgcccaag

SEQ ID NO: 7717051 - DNA, 22 bp, Homo sapiens
tgcccaggtttgagtgcccaag

SEQ ID NO: 7717052 - DNA, 22 bp, Homo sapiens
tgcccatggaccaagcaagggg

SEQ ID NO: 7717053 - DNA, 22 bp, Homo sapiens
tgcccatggaccaagcaagggg

SEQ ID NO: 7717054 - DNA, 22 bp, Homo sapiens
tgcccatggcaggatttctgaa

SEQ ID NO: 7717055 - DNA, 22 bp, Homo sapiens
tgcccatgtttctctgtatccc

SEQ ID NO: 7717056 - DNA, 22 bp, Homo sapiens
tgcccatgcatgacagatggct

SEQ ID NO: 7717057 - DNA, 21 bp, Homo sapiens
tgcccatcagctccaggatgt

SEQ ID NO: 7717058 - DNA, 21 bp, Homo sapiens
tgcccatgagcagaagtcacc

SEQ ID NO: 7717059 - DNA, 21 bp, Homo sapiens
tgcccatgagcagaagtcacc

SEQ ID NO: 7717060 - DNA, 23 bp, Homo sapiens
tgcccagtgcctttgcccatgca

SEQ ID NO: 7717061 - DNA, 22 bp, Homo sapiens
tgcccaggattgtgaggtcagg

SEQ ID NO: 7717062 - DNA, 22 bp, Homo sapiens
tgcccaggattgtgaggtcagg

SEQ ID NO: 7717063 - DNA, 22 bp, Homo sapiens
tgcccaggattgtgaggtcagg

SEQ ID NO: 7717064 - DNA, 22 bp, Homo sapiens
tgcccaggattgtgaggtcagg

SEQ ID NO: 7717065 - DNA, 22 bp, Homo sapiens
tgcccaggattgtgaggtcagg

SEQ ID NO: 7717066 - DNA, 22 bp, Homo sapiens
tgcccaggattgtgaggtcagg

SEQ ID NO: 7717067 - DNA, 22 bp, Homo sapiens
tgcccaggattgtgaggtcagg

SEQ ID NO: 7717068 - DNA, 19 bp, Homo sapiens
tgcccaggccaggttgggc

SEQ ID NO: 7717069 - DNA, 19 bp, Homo sapiens
tgcccaggccaggttgggc

SEQ ID NO: 7717070 - DNA, 19 bp, Homo sapiens
tgcccaggccaggttgggc

SEQ ID NO: 7717071 - DNA, 19 bp, Homo sapiens
tgcccaggccaggttgggc

SEQ ID NO: 7717072 - DNA, 19 bp, Homo sapiens
tgcccaggccaggttgggc

SEQ ID NO: 7717073 - DNA, 19 bp, Homo sapiens
tgcccaggcctcccaaaag

SEQ ID NO: 7717074 - DNA, 19 bp, Homo sapiens
tgcccaggcctcccaaaag

SEQ ID NO: 7717075 - DNA, 19 bp, Homo sapiens
tgcccaggcctcccaaaag

SEQ ID NO: 7717076 - DNA, 19 bp, Homo sapiens
tgcccaggcctcccaaaag

SEQ ID NO: 7717077 - DNA, 19 bp, Homo sapiens
tgcccaggcctcccaaaag

SEQ ID NO: 7717078 - DNA, 22 bp, Homo sapiens
tgcccaggctcctcgcagcctt

SEQ ID NO: 7717079 - DNA, 22 bp, Homo sapiens
tgcccaggctcctcgcagcctt

SEQ ID NO: 7717080 - DNA, 22 bp, Homo sapiens
tgcccaggctcctcgcagcctt

SEQ ID NO: 7717081 - DNA, 22 bp, Homo sapiens
tgcccaggctcctcgcagcctt

SEQ ID NO: 7717082 - DNA, 22 bp, Homo sapiens
tgcccaggctcctcgcagcctt

SEQ ID NO: 7717083 - DNA, 22 bp, Homo sapiens
tgcccaggctggaatgcagtgg

SEQ ID NO: 7717084 - DNA, 22 bp, Homo sapiens
tgcccaggctggaatgcagtgg

SEQ ID NO: 7717085 - DNA, 22 bp, Homo sapiens
tgcccaggctcctcgcagcctt

SEQ ID NO: 7717086 - DNA, 22 bp, Homo sapiens
tgcccaggctcctcgcagcctt

SEQ ID NO: 7717087 - DNA, 22 bp, Homo sapiens
tgcccaggctcctcgcagcctt

SEQ ID NO: 7717088 - DNA, 22 bp, Homo sapiens
tgcccaggctggagtacagtgg

SEQ ID NO: 7717089 - DNA, 22 bp, Homo sapiens
tgcccaggctggagtacagtgg

SEQ ID NO: 7717090 - DNA, 22 bp, Homo sapiens
tgcccaggctggagtacagtgg

SEQ ID NO: 7717091 - DNA, 22 bp, Homo sapiens
tgcccaggctggagtacagtgg

SEQ ID NO: 7717092 - DNA, 22 bp, Homo sapiens
tgcccaggctggagtacagtgg

SEQ ID NO: 7717093 - DNA, 22 bp, Homo sapiens
tgcccaggctggagtacagtgg

SEQ ID NO: 7717094 - DNA, 22 bp, Homo sapiens
tgcccaggctggaatgcagtgg

SEQ ID NO: 7717095 - DNA, 22 bp, Homo sapiens
tgcccaggctggaatgcagtgg

SEQ ID NO: 7717096 - DNA, 22 bp, Homo sapiens
tgcccaggctggaatgcagtgg

SEQ ID NO: 7717097 - DNA, 22 bp, Homo sapiens
tgcccaggcttcaccctcagag

SEQ ID NO: 7717098 - DNA, 22 bp, Homo sapiens
tgcccaggcttcaccctcagag

SEQ ID NO: 7717099 - DNA, 22 bp, Homo sapiens
tgcccaggcttcaccctcagag

SEQ ID NO: 7717100 - DNA, 22 bp, Homo sapiens
tgcccaggcttcaccctcagag

SEQ ID NO: 7717101 - DNA, 22 bp, Homo sapiens
tgcccaggcttcaccctcagag

SEQ ID NO: 7717102 - DNA, 22 bp, Homo sapiens
tgcccaggcttcaccctcagag

SEQ ID NO: 7717103 - DNA, 22 bp, Homo sapiens
tgcccaggctggagtgcagtgg

SEQ ID NO: 7717104 - DNA, 22 bp, Homo sapiens
tgcccaggctggagtgcagtgg

SEQ ID NO: 7717105 - DNA, 22 bp, Homo sapiens
tgcccaggctggagtgcagtgg

SEQ ID NO: 7717106 - DNA, 22 bp, Homo sapiens
tgcccaggctggagtgcagtgg

SEQ ID NO: 7717107 - DNA, 22 bp, Homo sapiens
tgcccaggctggagtgcagtgg

SEQ ID NO: 7717108 - DNA, 22 bp, Homo sapiens
tgcccaggctggagtgcagagg

SEQ ID NO: 7717109 - DNA, 22 bp, Homo sapiens
tgcccaggctggagtgcagagg

SEQ ID NO: 7717110 - DNA, 22 bp, Homo sapiens
tgcccaggctggagtgcagagg

SEQ ID NO: 7717111 - DNA, 22 bp, Homo sapiens
tgcccaggctggagtgcagagg

SEQ ID NO: 7717112 - DNA, 22 bp, Homo sapiens
tgcccaggctggagtgcagagg

SEQ ID NO: 7717113 - DNA, 22 bp, Homo sapiens
tgcccaggctggagtgcagtgg

SEQ ID NO: 7717114 - DNA, 22 bp, Homo sapiens
tgcccaggctggagtgcagtgg

SEQ ID NO: 7717115 - DNA, 22 bp, Homo sapiens
tgcccaggctggagtgcagagg

SEQ ID NO: 7717116 - DNA, 22 bp, Homo sapiens
tgcccaggctggagtgcagagg

SEQ ID NO: 7717117 - DNA, 22 bp, Homo sapiens
tgcccaggctggagtgcagagg

SEQ ID NO: 7717118 - DNA, 22 bp, Homo sapiens
tgcccagggataagcctagaga

SEQ ID NO: 7717119 - DNA, 22 bp, Homo sapiens
tgcccaggcttcaccctcagag

SEQ ID NO: 7717120 - DNA, 22 bp, Homo sapiens
tgcccaggcttcaccctcagag

SEQ ID NO: 7717121 - DNA, 22 bp, Homo sapiens
tgcccaggcttcaccctcagag

SEQ ID NO: 7717122 - DNA, 22 bp, Homo sapiens
tgcccaggcttcaccctcagag

SEQ ID NO: 7717123 - DNA, 22 bp, Homo sapiens
tgcccaggcttcaccctcagag

SEQ ID NO: 7717124 - DNA, 22 bp, Homo sapiens
tgcccagggataagcctagaga

SEQ ID NO: 7717125 - DNA, 22 bp, Homo sapiens
tgcccagggataagcctagaga

SEQ ID NO: 7717126 - DNA, 22 bp, Homo sapiens
tgcccagggataagcctagaga

SEQ ID NO: 7717127 - DNA, 22 bp, Homo sapiens
tgcccagggataagcctagaga

SEQ ID NO: 7717128 - DNA, 22 bp, Homo sapiens
tgcccagggataagcctagaga

SEQ ID NO: 7717129 - DNA, 22 bp, Homo sapiens
tgcccagggataagcctagaga

SEQ ID NO: 7717130 - DNA, 22 bp, Homo sapiens
tgcccagggtggagtgcagcgg

SEQ ID NO: 7717131 - DNA, 22 bp, Homo sapiens
tgcccagggtggagtgcagcgg

SEQ ID NO: 7717132 - DNA, 22 bp, Homo sapiens
tgcccagggtggagtgcagcgg

SEQ ID NO: 7717133 - DNA, 22 bp, Homo sapiens
tgcccagggtggagtgcagcgg

SEQ ID NO: 7717134 - DNA, 22 bp, Homo sapiens
tgcccagggtggagtgcagcgg

SEQ ID NO: 7717135 - DNA, 22 bp, Homo sapiens
tgcccagggtggagtgcagcgg

SEQ ID NO: 7717136 - DNA, 22 bp, Homo sapiens
tgcccagggtggagtgcagcgg

SEQ ID NO: 7717137 - DNA, 22 bp, Homo sapiens
tgcccagggtggagtgcagcgg

SEQ ID NO: 7717138 - DNA, 22 bp, Homo sapiens
tgcccagggtggagtgcagcgg

SEQ ID NO: 7717139 - DNA, 21 bp, Homo sapiens
tgcccaggggccaaccgctgc

SEQ ID NO: 7717140 - DNA, 22 bp, Homo sapiens
tgcccagggataagcctagaga

SEQ ID NO: 7717141 - DNA, 21 bp, Homo sapiens
tgcccaggggccaaccgctgc

SEQ ID NO: 7717142 - DNA, 21 bp, Homo sapiens
tgcccaggggccaaccgctgc

SEQ ID NO: 7717143 - DNA, 21 bp, Homo sapiens
tgcccaggggccaaccgctgc

SEQ ID NO: 7717144 - DNA, 22 bp, Homo sapiens
tgccaggcaactgcccagccat

SEQ ID NO: 7717145 - DNA, 22 bp, Homo sapiens
tgccaggcaactgcccagccat

SEQ ID NO: 7717146 - DNA, 22 bp, Homo sapiens
tgccaggcaactgcccagccat

SEQ ID NO: 7717147 - DNA, 22 bp, Homo sapiens
tgccaggcaactgcccagccat

SEQ ID NO: 7717148 - DNA, 22 bp, Homo sapiens
tgccaggattgttgagatgatt

SEQ ID NO: 7717149 - DNA, 20 bp, Homo sapiens
tgccaggcacggagtgcatg

SEQ ID NO: 7717150 - DNA, 20 bp, Homo sapiens
tgccaggcacggagtgcatg

SEQ ID NO: 7717151 - DNA, 20 bp, Homo sapiens
tgccaggcacggagtgcatg

SEQ ID NO: 7717152 - DNA, 20 bp, Homo sapiens
tgccaggcacggagtgcatg

SEQ ID NO: 7717153 - DNA, 22 bp, Homo sapiens
tgccaggcaactgcccagccat

SEQ ID NO: 7717154 - DNA, 22 bp, Homo sapiens
tgccaggattgttgagatgatt

SEQ ID NO: 7717155 - DNA, 22 bp, Homo sapiens
tgccaggattgttgagatgatt

SEQ ID NO: 7717156 - DNA, 22 bp, Homo sapiens
tgccaggatgttgtttgagaat

SEQ ID NO: 7717157 - DNA, 22 bp, Homo sapiens
tgccaggatgttgtttgagaat

SEQ ID NO: 7717158 - DNA, 22 bp, Homo sapiens
tgccaggatggccagggggcca

SEQ ID NO: 7717159 - DNA, 22 bp, Homo sapiens
tgccaggatggccagggggcca

SEQ ID NO: 7717160 - DNA, 22 bp, Homo sapiens
tgccaggatggccagggggcca

SEQ ID NO: 7717161 - DNA, 22 bp, Homo sapiens
tgccagctcccttttctcctcc

SEQ ID NO: 7717162 - DNA, 22 bp, Homo sapiens
tgccagctcagagttaggactg

SEQ ID NO: 7717163 - DNA, 19 bp, Homo sapiens
tgccagctcacaggagctc

SEQ ID NO: 7717164 - DNA, 19 bp, Homo sapiens
tgccagctcacaggagctc

SEQ ID NO: 7717165 - DNA, 19 bp, Homo sapiens
tgccagctcacaggagctc

SEQ ID NO: 7717166 - DNA, 19 bp, Homo sapiens
tgccagctcacaggagctc

SEQ ID NO: 7717167 - DNA, 19 bp, Homo sapiens
tgccagctcacaggagctc

SEQ ID NO: 7717168 - DNA, 18 bp, Homo sapiens
tgccagccgactggcctg

SEQ ID NO: 7717169 - DNA, 18 bp, Homo sapiens
tgccagccgactggcctg

SEQ ID NO: 7717170 - DNA, 18 bp, Homo sapiens
tgccagccgactggcctg

SEQ ID NO: 7717171 - DNA, 22 bp, Homo sapiens
tgccagcccaccttggggcctc

SEQ ID NO: 7717172 - DNA, 18 bp, Homo sapiens
tgccagccgactggcctg

SEQ ID NO: 7717173 - DNA, 22 bp, Homo sapiens
tgccagcctggcctgagtcttt

SEQ ID NO: 7717174 - DNA, 18 bp, Homo sapiens
tgccagccgactggcctg

SEQ ID NO: 7717175 - DNA, 22 bp, Homo sapiens
tgccagcctggcctgagtcttt

SEQ ID NO: 7717176 - DNA, 22 bp, Homo sapiens
tgccagcctggcctgagtcttt

SEQ ID NO: 7717177 - DNA, 22 bp, Homo sapiens
tgccagcctggcctgagtcttt

SEQ ID NO: 7717178 - DNA, 19 bp, Homo sapiens
tgccagctcacaggagctc

SEQ ID NO: 7717179 - DNA, 22 bp, Homo sapiens
tgccagctagtcacatattaga

SEQ ID NO: 7717180 - DNA, 22 bp, Homo sapiens
tgccagctagtcacatattaga

SEQ ID NO: 7717181 - DNA, 22 bp, Homo sapiens
tgccagctagagaagctagaaa

SEQ ID NO: 7717182 - DNA, 22 bp, Homo sapiens
tgccagctagagaagctagaaa

SEQ ID NO: 7717183 - DNA, 17 bp, Homo sapiens
tgccagcctgtcccagg

SEQ ID NO: 7717184 - DNA, 22 bp, Homo sapiens
tgccagcgtgaagctgggcccc

SEQ ID NO: 7717185 - DNA, 22 bp, Homo sapiens
tgccagctactctgtaggctga

SEQ ID NO: 7717186 - DNA, 22 bp, Homo sapiens
tgccagctactctgtaggctga

SEQ ID NO: 7717187 - DNA, 22 bp, Homo sapiens
tgccagctactctgtaggctga

SEQ ID NO: 7717188 - DNA, 17 bp, Homo sapiens
tgccagcctgtcccagg

SEQ ID NO: 7717189 - DNA, 22 bp, Homo sapiens
tgccagcctggcctgagtcttt

SEQ ID NO: 7717190 - DNA, 17 bp, Homo sapiens
tgccagcctgtcccagg

SEQ ID NO: 7717191 - DNA, 17 bp, Homo sapiens
tgccagcctgtcccagg

SEQ ID NO: 7717192 - DNA, 22 bp, Homo sapiens
tgccagcctggcctgagtcttt

SEQ ID NO: 7717193 - DNA, 20 bp, Homo sapiens
tgccaggcacggagtgcatg

SEQ ID NO: 7717194 - DNA, 22 bp, Homo sapiens
tgccaggcacgtgagagtggcc

SEQ ID NO: 7717195 - DNA, 22 bp, Homo sapiens
tgccaggcacgtgagagtggcc

SEQ ID NO: 7717196 - DNA, 22 bp, Homo sapiens
tgccaggcacgtgagagtggcc

SEQ ID NO: 7717197 - DNA, 22 bp, Homo sapiens
tgccaggcacgtgagagtggcc

SEQ ID NO: 7717198 - DNA, 22 bp, Homo sapiens
tgccaggcacgtgagagtggcc

SEQ ID NO: 7717199 - DNA, 22 bp, Homo sapiens
tgccaggcaggaccctagaacc

SEQ ID NO: 7717200 - DNA, 22 bp, Homo sapiens
tgccaggcacgtgagagtggcc

SEQ ID NO: 7717201 - DNA, 22 bp, Homo sapiens
tgccaggcaggaccctagaacc

SEQ ID NO: 7717202 - DNA, 22 bp, Homo sapiens
tgccaggcaggaccctagaacc

SEQ ID NO: 7717203 - DNA, 22 bp, Homo sapiens
tgccaggcaggaccctagaacc

SEQ ID NO: 7717204 - DNA, 22 bp, Homo sapiens
tgccaggcaggaccctagaacc

SEQ ID NO: 7717205 - DNA, 22 bp, Homo sapiens
tgccaggcagtgtcagattgag

SEQ ID NO: 7717206 - DNA, 22 bp, Homo sapiens
tgccaggcagtgtcagattgag

SEQ ID NO: 7717207 - DNA, 22 bp, Homo sapiens
tgccaggcagtgtcagattgag

SEQ ID NO: 7717208 - DNA, 22 bp, Homo sapiens
tgccaggcatatggcctctttg

SEQ ID NO: 7717209 - DNA, 22 bp, Homo sapiens
tgccaggcatatggcctctttg

SEQ ID NO: 7717210 - DNA, 22 bp, Homo sapiens
tgccaggcatatggcctctttg

SEQ ID NO: 7717211 - DNA, 22 bp, Homo sapiens
tgccaggcatatggcctctttg

SEQ ID NO: 7717212 - DNA, 22 bp, Homo sapiens
tgccaggcatgtagtagacttg

SEQ ID NO: 7717213 - DNA, 22 bp, Homo sapiens
tgccaggcatatggcctctttg

SEQ ID NO: 7717214 - DNA, 22 bp, Homo sapiens
tgccaggcatgtagtagacttg

SEQ ID NO: 7717215 - DNA, 22 bp, Homo sapiens
tgccaggcatgtagtagacttg

SEQ ID NO: 7717216 - DNA, 22 bp, Homo sapiens
tgccaggcatgtagtagacttg

SEQ ID NO: 7717217 - DNA, 22 bp, Homo sapiens
tgccaggcatgtagtagacttg

SEQ ID NO: 7717218 - DNA, 22 bp, Homo sapiens
tgccaggccctcccacagatta

SEQ ID NO: 7717219 - DNA, 22 bp, Homo sapiens
tgccaggccctcccacagatta

SEQ ID NO: 7717220 - DNA, 22 bp, Homo sapiens
tgccaggccctcccacagatta

SEQ ID NO: 7717221 - DNA, 22 bp, Homo sapiens
tgccaggccctcccacagatta

SEQ ID NO: 7717222 - DNA, 22 bp, Homo sapiens
tgccaggcccagctccagagct

SEQ ID NO: 7717223 - DNA, 22 bp, Homo sapiens
tgccaggcccagctccagagct

SEQ ID NO: 7717224 - DNA, 22 bp, Homo sapiens
tgccaggccctgtgctggatgc

SEQ ID NO: 7717225 - DNA, 22 bp, Homo sapiens
tgccaggccctgcggggtccca

SEQ ID NO: 7717226 - DNA, 22 bp, Homo sapiens
tgccaggccctgcggggtccca

SEQ ID NO: 7717227 - DNA, 22 bp, Homo sapiens
tgccaggccctgcggggtccca

SEQ ID NO: 7717228 - DNA, 22 bp, Homo sapiens
tgccaggccctgcggggtccca

SEQ ID NO: 7717229 - DNA, 22 bp, Homo sapiens
tgccaggccctgcggggtccca

SEQ ID NO: 7717230 - DNA, 22 bp, Homo sapiens
tgccaggccctcccacagatta

SEQ ID NO: 7717231 - DNA, 22 bp, Homo sapiens
tgccaggccctgtgctggatgc

SEQ ID NO: 7717232 - DNA, 22 bp, Homo sapiens
tgccaggccctgtgctggatgc

SEQ ID NO: 7717233 - DNA, 22 bp, Homo sapiens
tgccaggccctgtgctggatgc

SEQ ID NO: 7717234 - DNA, 22 bp, Homo sapiens
tgccaggcctcaggagtctcca

SEQ ID NO: 7717235 - DNA, 22 bp, Homo sapiens
tgccaggccctgtgctggatgc

SEQ ID NO: 7717236 - DNA, 22 bp, Homo sapiens
tgccaggccctgtgctggatgc

SEQ ID NO: 7717237 - DNA, 22 bp, Homo sapiens
tgccaggccctgtgctggatgc

SEQ ID NO: 7717238 - DNA, 22 bp, Homo sapiens
tgccaggccctgtgctggatgc

SEQ ID NO: 7717239 - DNA, 22 bp, Homo sapiens
tgccaggctcagcccctatctt

SEQ ID NO: 7717240 - DNA, 22 bp, Homo sapiens
tgccaggctaagtggaggactt

SEQ ID NO: 7717241 - DNA, 22 bp, Homo sapiens
tgccaggctcaggatgtccctg

SEQ ID NO: 7717242 - DNA, 22 bp, Homo sapiens
tgccaggctcaggatgtccctg

SEQ ID NO: 7717243 - DNA, 22 bp, Homo sapiens
tgccaggctcagcccctatctt

SEQ ID NO: 7717244 - DNA, 22 bp, Homo sapiens
tgccaggctcaggatgtccctg

SEQ ID NO: 7717245 - DNA, 22 bp, Homo sapiens
tgccaggctcagcccctatctt

SEQ ID NO: 7717246 - DNA, 22 bp, Homo sapiens
tgccaggccaatgaaggcaggg

SEQ ID NO: 7717247 - DNA, 22 bp, Homo sapiens
tgccaggccaatgaaggcaggg

SEQ ID NO: 7717248 - DNA, 22 bp, Homo sapiens
tgccaggccaatgaaggcaggg

SEQ ID NO: 7717249 - DNA, 22 bp, Homo sapiens
tgccaggccaatgaaggcaggg

SEQ ID NO: 7717250 - DNA, 22 bp, Homo sapiens
tgccaggccaattctatttgac

SEQ ID NO: 7717251 - DNA, 22 bp, Homo sapiens
tgccaggccaattctatttgac

SEQ ID NO: 7717252 - DNA, 22 bp, Homo sapiens
tgccaggccaatgaaggcaggg

SEQ ID NO: 7717253 - DNA, 22 bp, Homo sapiens
tgccaggcatttgacagacact

SEQ ID NO: 7717254 - DNA, 22 bp, Homo sapiens
tgccaggcatttgacagacact

SEQ ID NO: 7717255 - DNA, 22 bp, Homo sapiens
tgccaggcatttgacagacact

SEQ ID NO: 7717256 - DNA, 22 bp, Homo sapiens
tgccaggcatttgacagacact

SEQ ID NO: 7717257 - DNA, 22 bp, Homo sapiens
tgccaggcatttgacagacact

SEQ ID NO: 7717258 - DNA, 22 bp, Homo sapiens
tgccaggcatttgacagacact

SEQ ID NO: 7717259 - DNA, 22 bp, Homo sapiens
tgccaggcccagctccagagct

SEQ ID NO: 7717260 - DNA, 22 bp, Homo sapiens
tgccaggcccagctccagagct

SEQ ID NO: 7717261 - DNA, 22 bp, Homo sapiens
tgccaggcccagctccagagct

SEQ ID NO: 7717262 - DNA, 22 bp, Homo sapiens
tgccaggcccagctccagagct

SEQ ID NO: 7717263 - DNA, 22 bp, Homo sapiens
tgccaggcccagcagggcggcc

SEQ ID NO: 7717264 - DNA, 22 bp, Homo sapiens
tgccaggcccagcagggcggcc

SEQ ID NO: 7717265 - DNA, 22 bp, Homo sapiens
tgccaggcccagcagggcggcc

SEQ ID NO: 7717266 - DNA, 22 bp, Homo sapiens
tgccaggcccagcagggcggcc

SEQ ID NO: 7717267 - DNA, 22 bp, Homo sapiens
tgccaggcccagcagggcggcc

SEQ ID NO: 7717268 - DNA, 22 bp, Homo sapiens
tgccaggccacgtagcttcaag

SEQ ID NO: 7717269 - DNA, 22 bp, Homo sapiens
tgccaggccacgtagcttcaag

SEQ ID NO: 7717270 - DNA, 22 bp, Homo sapiens
tgccaggccacgtagcttcaag

SEQ ID NO: 7717271 - DNA, 22 bp, Homo sapiens
tgccagggtgtcaggagagcta

SEQ ID NO: 7717272 - DNA, 22 bp, Homo sapiens
tgccagggtgtcaggagagcta

SEQ ID NO: 7717273 - DNA, 23 bp, Homo sapiens
tgccagggtttgtttgtggttca

SEQ ID NO: 7717274 - DNA, 22 bp, Homo sapiens
tgccaggtacacaagtagccag

SEQ ID NO: 7717275 - DNA, 22 bp, Homo sapiens
tgccagggtgtcaggagagcta

SEQ ID NO: 7717276 - DNA, 22 bp, Homo sapiens
tgccaggtacacaagtagccag

SEQ ID NO: 7717277 - DNA, 22 bp, Homo sapiens
tgccagtctcaccctgggtcct

SEQ ID NO: 7717278 - DNA, 22 bp, Homo sapiens
tgccatcactgaacttctgaaa

SEQ ID NO: 7717279 - DNA, 18 bp, Homo sapiens
tgccatccccagtcaagt

SEQ ID NO: 7717280 - DNA, 22 bp, Homo sapiens
tgccatccaacagttccatctt

SEQ ID NO: 7717281 - DNA, 22 bp, Homo sapiens
tgccatcctgtgtcatgctcat

SEQ ID NO: 7717282 - DNA, 22 bp, Homo sapiens
tgccatcctgtgtcatgctcat

SEQ ID NO: 7717283 - DNA, 22 bp, Homo sapiens
tgccatccttgaggaagggcaa

SEQ ID NO: 7717284 - DNA, 18 bp, Homo sapiens
tgccatccccagtcaagt

SEQ ID NO: 7717285 - DNA, 22 bp, Homo sapiens
tgccatccccatgtggtggaga

SEQ ID NO: 7717286 - DNA, 17 bp, Homo sapiens
tgccatcccccttgggc

SEQ ID NO: 7717287 - DNA, 22 bp, Homo sapiens
tgccatcctgtgtcatgctcat

SEQ ID NO: 7717288 - DNA, 22 bp, Homo sapiens
tgccatcctgtgtcatgctcat

SEQ ID NO: 7717289 - DNA, 22 bp, Homo sapiens
tgccatcctgtgtcatgctcat

SEQ ID NO: 7717290 - DNA, 22 bp, Homo sapiens
tgccatctgaaaattacatcct

SEQ ID NO: 7717291 - DNA, 22 bp, Homo sapiens
tgccatctgaaaattacatcct

SEQ ID NO: 7717292 - DNA, 22 bp, Homo sapiens
tgccatctcttcctcgtgctgc

SEQ ID NO: 7717293 - DNA, 22 bp, Homo sapiens
tgccatctgcacccacctgccc

SEQ ID NO: 7717294 - DNA, 22 bp, Homo sapiens
tgccatctgcacccacctgccc

SEQ ID NO: 7717295 - DNA, 22 bp, Homo sapiens
tgccatgcccacctcccttctg

SEQ ID NO: 7717296 - DNA, 22 bp, Homo sapiens
tgccatggaagtggccagacct

SEQ ID NO: 7717297 - DNA, 22 bp, Homo sapiens
tgccatggaatcacctccagct

SEQ ID NO: 7717298 - DNA, 22 bp, Homo sapiens
tgccagggtcctgagggccttg

SEQ ID NO: 7717299 - DNA, 22 bp, Homo sapiens
tgccagggtcctgagggccttg

SEQ ID NO: 7717300 - DNA, 22 bp, Homo sapiens
tgccagggtcctgagggccttg

SEQ ID NO: 7717301 - DNA, 22 bp, Homo sapiens
tgccagggtcctgagggccttg

SEQ ID NO: 7717302 - DNA, 22 bp, Homo sapiens
tgccagggtcctgagggccttg

SEQ ID NO: 7717303 - DNA, 22 bp, Homo sapiens
tgccagggtgtcaggagagcta

SEQ ID NO: 7717304 - DNA, 22 bp, Homo sapiens
tgccagggtgtcaggagagcta

SEQ ID NO: 7717305 - DNA, 22 bp, Homo sapiens
tgccagggtgtcaggagagcta

SEQ ID NO: 7717306 - DNA, 22 bp, Homo sapiens
tgccaggggacctagggatgtc

SEQ ID NO: 7717307 - DNA, 22 bp, Homo sapiens
tgccaggggacctagggatgtc

SEQ ID NO: 7717308 - DNA, 22 bp, Homo sapiens
tgccagggtcagctgcagctct

SEQ ID NO: 7717309 - DNA, 22 bp, Homo sapiens
tgccagggtcagctgcagctct

SEQ ID NO: 7717310 - DNA, 22 bp, Homo sapiens
tgccagggtcagctgcagctct

SEQ ID NO: 7717311 - DNA, 22 bp, Homo sapiens
tgccagggtcagctgcagctct

SEQ ID NO: 7717312 - DNA, 22 bp, Homo sapiens
tgccagggtcagctgcagctct

SEQ ID NO: 7717313 - DNA, 22 bp, Homo sapiens
tgccagggtcagctgcagctct

SEQ ID NO: 7717314 - DNA, 22 bp, Homo sapiens
tgccagggccatagggagtcta

SEQ ID NO: 7717315 - DNA, 22 bp, Homo sapiens
tgccagggccatagggagtcta

SEQ ID NO: 7717316 - DNA, 22 bp, Homo sapiens
tgccagggccatagggagtcta

SEQ ID NO: 7717317 - DNA, 22 bp, Homo sapiens
tgccagggccatagggagtcta

SEQ ID NO: 7717318 - DNA, 22 bp, Homo sapiens
tgccagggccatagggagtcta

SEQ ID NO: 7717319 - DNA, 22 bp, Homo sapiens
tgccagggccatagggagtcta

SEQ ID NO: 7717320 - DNA, 22 bp, Homo sapiens
tgccagggccatagggagtcta

SEQ ID NO: 7717321 - DNA, 20 bp, Homo sapiens
tgccagggccagcagaggct

SEQ ID NO: 7717322 - DNA, 22 bp, Homo sapiens
tgccagggctgctactggctga

SEQ ID NO: 7717323 - DNA, 23 bp, Homo sapiens
tgccagggccctgtgtgcaatgc

SEQ ID NO: 7717324 - DNA, 22 bp, Homo sapiens
tgccagggctgctactggctga

SEQ ID NO: 7717325 - DNA, 23 bp, Homo sapiens
tgccagggccctgtgtgcaatgc

SEQ ID NO: 7717326 - DNA, 23 bp, Homo sapiens
tgccagggccctgtgtgcaatgc

SEQ ID NO: 7717327 - DNA, 22 bp, Homo sapiens
tgccaggggacctagggatgtc

SEQ ID NO: 7717328 - DNA, 22 bp, Homo sapiens
tgccaggggacctagggatgtc

SEQ ID NO: 7717329 - DNA, 22 bp, Homo sapiens
tgccagggctgctactggctga

SEQ ID NO: 7717330 - DNA, 22 bp, Homo sapiens
tgccagggagccctgctgacca

SEQ ID NO: 7717331 - DNA, 22 bp, Homo sapiens
tgccagggagccctgctgacca

SEQ ID NO: 7717332 - DNA, 22 bp, Homo sapiens
tgccagggaccctgtcggccct

SEQ ID NO: 7717333 - DNA, 22 bp, Homo sapiens
tgccagggaccctgtcggccct

SEQ ID NO: 7717334 - DNA, 22 bp, Homo sapiens
tgccagggaccctgtcggccct

SEQ ID NO: 7717335 - DNA, 22 bp, Homo sapiens
tgccaggctttggtcaaaggct

SEQ ID NO: 7717336 - DNA, 22 bp, Homo sapiens
tgccaggctttggtcaaaggct

SEQ ID NO: 7717337 - DNA, 22 bp, Homo sapiens
tgccaggctttggtcaaaggct

SEQ ID NO: 7717338 - DNA, 22 bp, Homo sapiens
tgccaggctttggtcaaaggct

SEQ ID NO: 7717339 - DNA, 22 bp, Homo sapiens
tgccaggcttagagcaggggct

SEQ ID NO: 7717340 - DNA, 22 bp, Homo sapiens
tgccaggcttagagcaggggct

SEQ ID NO: 7717341 - DNA, 22 bp, Homo sapiens
tgccaggcttagagcaggggct

SEQ ID NO: 7717342 - DNA, 21 bp, Homo sapiens
tgccagggatttacagagcct

SEQ ID NO: 7717343 - DNA, 22 bp, Homo sapiens
tgccagggagccctgctgacca

SEQ ID NO: 7717344 - DNA, 22 bp, Homo sapiens
tgccagggagccctgctgacca

SEQ ID NO: 7717345 - DNA, 22 bp, Homo sapiens
tgccagggagccctgctgacca

SEQ ID NO: 7717346 - DNA, 22 bp, Homo sapiens
tgccagggagccctgctgacca

SEQ ID NO: 7717347 - DNA, 22 bp, Homo sapiens
tgccagggagccctgctgacca

SEQ ID NO: 7717348 - DNA, 21 bp, Homo sapiens
tgccagggatttacagagcct

SEQ ID NO: 7717349 - DNA, 21 bp, Homo sapiens
tgccagggatttacagagcct

SEQ ID NO: 7717350 - DNA, 20 bp, Homo sapiens
tgccagggccagcagaggct

SEQ ID NO: 7717351 - DNA, 20 bp, Homo sapiens
tgccagggccagcagaggct

SEQ ID NO: 7717352 - DNA, 20 bp, Homo sapiens
tgccagggccagcagaggct

SEQ ID NO: 7717353 - DNA, 20 bp, Homo sapiens
tgccagggccagcagaggct

SEQ ID NO: 7717354 - DNA, 20 bp, Homo sapiens
tgccagggccagcagaggct

SEQ ID NO: 7717355 - DNA, 20 bp, Homo sapiens
tgccagggccagcagaggct

SEQ ID NO: 7717356 - DNA, 21 bp, Homo sapiens
tgccagggatttacagagcct

SEQ ID NO: 7717357 - DNA, 22 bp, Homo sapiens
tgccaggctgccctccagtctg

SEQ ID NO: 7717358 - DNA, 22 bp, Homo sapiens
tgccaggctgccctccagtctg

SEQ ID NO: 7717359 - DNA, 22 bp, Homo sapiens
tgccaggctgccctccagtctg

SEQ ID NO: 7717360 - DNA, 22 bp, Homo sapiens
tgccaggctgtcaattcaccca

SEQ ID NO: 7717361 - DNA, 22 bp, Homo sapiens
tgccaggctgccctccagtctg

SEQ ID NO: 7717362 - DNA, 20 bp, Homo sapiens
tgccaggctgcacgcctgcc

SEQ ID NO: 7717363 - DNA, 20 bp, Homo sapiens
tgccaggctgcacgcctgcc

SEQ ID NO: 7717364 - DNA, 22 bp, Homo sapiens
tgccaggctgtcctgggcctgg

SEQ ID NO: 7717365 - DNA, 22 bp, Homo sapiens
tgccaggctgtcctgggcctgg

SEQ ID NO: 7717366 - DNA, 22 bp, Homo sapiens
tgccaggctgtcaattcaccca

SEQ ID NO: 7717367 - DNA, 22 bp, Homo sapiens
tgccaggctgtcctgggcctgg

SEQ ID NO: 7717368 - DNA, 22 bp, Homo sapiens
tgccaggctgtcctgggcctgg

SEQ ID NO: 7717369 - DNA, 22 bp, Homo sapiens
tgccaggctgtcctgggcctgg

SEQ ID NO: 7717370 - DNA, 22 bp, Homo sapiens
tgccaggctgtcctgggcctgg

SEQ ID NO: 7717371 - DNA, 22 bp, Homo sapiens
tgccaggctgtcctgggcctgg

SEQ ID NO: 7717372 - DNA, 20 bp, Homo sapiens
tgccaggctgcacgcctgcc

SEQ ID NO: 7717373 - DNA, 20 bp, Homo sapiens
tgccaggctgcacgcctgcc

SEQ ID NO: 7717374 - DNA, 20 bp, Homo sapiens
tgccaggctgcacgcctgcc

SEQ ID NO: 7717375 - DNA, 20 bp, Homo sapiens
tgccaggctgcacgcctgcc

SEQ ID NO: 7717376 - DNA, 22 bp, Homo sapiens
tgccaggctgaacagggtctta

SEQ ID NO: 7717377 - DNA, 22 bp, Homo sapiens
tgccaggctgaacagggtctta

SEQ ID NO: 7717378 - DNA, 22 bp, Homo sapiens
tgccaggctgaacagggtctta

SEQ ID NO: 7717379 - DNA, 22 bp, Homo sapiens
tgccaggctgaacagggtctta

SEQ ID NO: 7717380 - DNA, 22 bp, Homo sapiens
tgccaggctccggaacgacagt

SEQ ID NO: 7717381 - DNA, 22 bp, Homo sapiens
tgccaggctccggaacgacagt

SEQ ID NO: 7717382 - DNA, 22 bp, Homo sapiens
tgccaggctccggaacgacagt

SEQ ID NO: 7717383 - DNA, 22 bp, Homo sapiens
tgccaggctccggaacgacagt

SEQ ID NO: 7717384 - DNA, 21 bp, Homo sapiens
tgcctatatgaaaggggtgtt

SEQ ID NO: 7717385 - DNA, 22 bp, Homo sapiens
tgcctattcaatatatgcattt

SEQ ID NO: 7717386 - DNA, 20 bp, Homo sapiens
tgcctataaagggccaggta

SEQ ID NO: 7717387 - DNA, 22 bp, Homo sapiens
tgcctagttctgtatttacagt

SEQ ID NO: 7717388 - DNA, 22 bp, Homo sapiens
tgcctaggtcacacctcatacc

SEQ ID NO: 7717389 - DNA, 22 bp, Homo sapiens
tgcctagtggccttatgagtat

SEQ ID NO: 7717390 - DNA, 22 bp, Homo sapiens
tgcctagttctgtatttacagt

SEQ ID NO: 7717391 - DNA, 22 bp, Homo sapiens
tgcctcaagccctccactgcac

SEQ ID NO: 7717392 - DNA, 22 bp, Homo sapiens
tgcctcaagccctccactgcac

SEQ ID NO: 7717393 - DNA, 22 bp, Homo sapiens
tgcctatttacttcacagttga

SEQ ID NO: 7717394 - DNA, 23 bp, Homo sapiens
tgcctattcagcagagtgatagc

SEQ ID NO: 7717395 - DNA, 22 bp, Homo sapiens
tgcctatttacttcacagttga

SEQ ID NO: 7717396 - DNA, 22 bp, Homo sapiens
tgcctcagagacctgacagtac

SEQ ID NO: 7717397 - DNA, 22 bp, Homo sapiens
tgcctcagagacctgacagtac

SEQ ID NO: 7717398 - DNA, 22 bp, Homo sapiens
tgcctcagagacctgacagtac

SEQ ID NO: 7717399 - DNA, 22 bp, Homo sapiens
tgcctcagagacctgacagtac

SEQ ID NO: 7717400 - DNA, 22 bp, Homo sapiens
tgcctcagagacctgacagtac

SEQ ID NO: 7717401 - DNA, 22 bp, Homo sapiens
tgcctcagagacctgacagtac

SEQ ID NO: 7717402 - DNA, 22 bp, Homo sapiens
tgcctcagagacctgacagtac

SEQ ID NO: 7717403 - DNA, 22 bp, Homo sapiens
tgcctcagagtgggcttgctat

SEQ ID NO: 7717404 - DNA, 22 bp, Homo sapiens
tgcctcagagtgggcttgctat

SEQ ID NO: 7717405 - DNA, 22 bp, Homo sapiens
tgcctagtagggttgttgtagg

SEQ ID NO: 7717406 - DNA, 22 bp, Homo sapiens
tgcctagggcctaaccagagcc

SEQ ID NO: 7717407 - DNA, 22 bp, Homo sapiens
tgcctagggcctaaccagagcc

SEQ ID NO: 7717408 - DNA, 22 bp, Homo sapiens
tgcctaggctggagtgtagtgg

SEQ ID NO: 7717409 - DNA, 22 bp, Homo sapiens
tgcctaggctggagtgtagtgg

SEQ ID NO: 7717410 - DNA, 22 bp, Homo sapiens
tgcctagggcctaaccagagcc

SEQ ID NO: 7717411 - DNA, 22 bp, Homo sapiens
tgcctaggctggagtgtagtgg

SEQ ID NO: 7717412 - DNA, 22 bp, Homo sapiens
tgcctaggctggagtgtagtgg

SEQ ID NO: 7717413 - DNA, 22 bp, Homo sapiens
tgcctaggctggagtgtagtgg

SEQ ID NO: 7717414 - DNA, 22 bp, Homo sapiens
tgcctaggctggagtgtagtgg

SEQ ID NO: 7717415 - DNA, 22 bp, Homo sapiens
tgcctactagtactattttgtg

SEQ ID NO: 7717416 - DNA, 22 bp, Homo sapiens
tgcctagaactttattctttat

SEQ ID NO: 7717417 - DNA, 22 bp, Homo sapiens
tgcctaggaaacctcatgcttc

SEQ ID NO: 7717418 - DNA, 22 bp, Homo sapiens
tgcctaggaaacctcatgcttc

SEQ ID NO: 7717419 - DNA, 22 bp, Homo sapiens
tgcctaggctggagtgcagtga

SEQ ID NO: 7717420 - DNA, 22 bp, Homo sapiens
tgcctaggctggagtgcagtga

SEQ ID NO: 7717421 - DNA, 22 bp, Homo sapiens
tgcctaggctggagtgcaatgg

SEQ ID NO: 7717422 - DNA, 22 bp, Homo sapiens
tgcctaggaaacctcatgcttc

SEQ ID NO: 7717423 - DNA, 22 bp, Homo sapiens
tgcctaggaaacctcatgcttc

SEQ ID NO: 7717424 - DNA, 22 bp, Homo sapiens
tgcctagaactttattctttat

SEQ ID NO: 7717425 - DNA, 22 bp, Homo sapiens
tgccgcagtgcggggagggccc

SEQ ID NO: 7717426 - DNA, 22 bp, Homo sapiens
tgccgcagtgcggggagggccc

SEQ ID NO: 7717427 - DNA, 22 bp, Homo sapiens
tgccgcagtgcggggagggccc

SEQ ID NO: 7717428 - DNA, 22 bp, Homo sapiens
tgccgcagtgcggggagggccc

SEQ ID NO: 7717429 - DNA, 22 bp, Homo sapiens
tgccgcagtgcggggagggccc

SEQ ID NO: 7717430 - DNA, 22 bp, Homo sapiens
tgccgcctggtttctccgcccc

SEQ ID NO: 7717431 - DNA, 22 bp, Homo sapiens
tgccgtgcccatattgtgggtg

SEQ ID NO: 7717432 - DNA, 22 bp, Homo sapiens
tgccgtggggctgaggctggag

SEQ ID NO: 7717433 - DNA, 22 bp, Homo sapiens
tgccgtggggctgaggctggag

SEQ ID NO: 7717434 - DNA, 22 bp, Homo sapiens
tgccgtggggctgaggctggag

SEQ ID NO: 7717435 - DNA, 19 bp, Homo sapiens
tgccgctcgaggctctggg

SEQ ID NO: 7717436 - DNA, 22 bp, Homo sapiens
tgccgctgtcgccaccatggct

SEQ ID NO: 7717437 - DNA, 20 bp, Homo sapiens
tgccgggcagcctgaggagt

SEQ ID NO: 7717438 - DNA, 22 bp, Homo sapiens
tgccgctccaggtctcgcggtg

SEQ ID NO: 7717439 - DNA, 22 bp, Homo sapiens
tgccgctccaggtctcgcggtg

SEQ ID NO: 7717440 - DNA, 22 bp, Homo sapiens
tgccgctccaggtctcgcggtg

SEQ ID NO: 7717441 - DNA, 22 bp, Homo sapiens
tgccgctccaggtctcgcggtg

SEQ ID NO: 7717442 - DNA, 22 bp, Homo sapiens
tgccgctccaggtctcgcggtg

SEQ ID NO: 7717443 - DNA, 22 bp, Homo sapiens
tgcctacccatggttagacata

SEQ ID NO: 7717444 - DNA, 22 bp, Homo sapiens
tgcctaccctgcccgcagacac

SEQ ID NO: 7717445 - DNA, 22 bp, Homo sapiens
tgcctaccagtgttctcccttc

SEQ ID NO: 7717446 - DNA, 22 bp, Homo sapiens
tgcctactagtactattttgtg

SEQ ID NO: 7717447 - DNA, 22 bp, Homo sapiens
tgcctactagtactattttgtg

SEQ ID NO: 7717448 - DNA, 22 bp, Homo sapiens
tgcctaaaccattccccttcct

SEQ ID NO: 7717449 - DNA, 22 bp, Homo sapiens
tgcctaactccaccaggcaggt

SEQ ID NO: 7717450 - DNA, 22 bp, Homo sapiens
tgcctaactccaccaggcaggt

SEQ ID NO: 7717451 - DNA, 22 bp, Homo sapiens
tgccgtgtcccattgtgctctg

SEQ ID NO: 7717452 - DNA, 23 bp, Homo sapiens
tgccgtgttagaaatgttttaca

SEQ ID NO: 7717453 - DNA, 22 bp, Homo sapiens
tgccgtggggctgaggctggag

SEQ ID NO: 7717454 - DNA, 22 bp, Homo sapiens
tgccgtggggctgaggctggag

SEQ ID NO: 7717455 - DNA, 22 bp, Homo sapiens
tgccgtggggctgaggctggag

SEQ ID NO: 7717456 - DNA, 22 bp, Homo sapiens
tgccctgtctaagctgtcagta

SEQ ID NO: 7717457 - DNA, 22 bp, Homo sapiens
tgccctgtctaagctgtcagta

SEQ ID NO: 7717458 - DNA, 22 bp, Homo sapiens
tgccctgtctaagctgtcagta

SEQ ID NO: 7717459 - DNA, 22 bp, Homo sapiens
tgccctgtctaagctgtcagta

SEQ ID NO: 7717460 - DNA, 22 bp, Homo sapiens
tgccctgtcgctcactcccacc

SEQ ID NO: 7717461 - DNA, 22 bp, Homo sapiens
tgccctgtcgctcactcccacc

SEQ ID NO: 7717462 - DNA, 22 bp, Homo sapiens
tgccctgggagttggagctgct

SEQ ID NO: 7717463 - DNA, 22 bp, Homo sapiens
tgccctgggagttggagctgct

SEQ ID NO: 7717464 - DNA, 22 bp, Homo sapiens
tgccctgggacatgcagcggag

SEQ ID NO: 7717465 - DNA, 22 bp, Homo sapiens
tgccctgggagttggagctgct

SEQ ID NO: 7717466 - DNA, 22 bp, Homo sapiens
tgccctgggaggctttcctgtt

SEQ ID NO: 7717467 - DNA, 22 bp, Homo sapiens
tgccctgggacatgcagcggag

SEQ ID NO: 7717468 - DNA, 22 bp, Homo sapiens
tgccctgggacatgcagcggag

SEQ ID NO: 7717469 - DNA, 22 bp, Homo sapiens
tgccctgggacatgcagcggag

SEQ ID NO: 7717470 - DNA, 22 bp, Homo sapiens
tgccctgggaacacagatgcca

SEQ ID NO: 7717471 - DNA, 22 bp, Homo sapiens
tgccctgggaggctttcctgtt

SEQ ID NO: 7717472 - DNA, 22 bp, Homo sapiens
tgccctgggaggctttcctgtt

SEQ ID NO: 7717473 - DNA, 22 bp, Homo sapiens
tgccctgggacatgcagcggag

SEQ ID NO: 7717474 - DNA, 22 bp, Homo sapiens
tgccctgggacatgcagcggag

SEQ ID NO: 7717475 - DNA, 22 bp, Homo sapiens
tgccctgggaacacagatgcca

SEQ ID NO: 7717476 - DNA, 22 bp, Homo sapiens
tgccctgggaacacagatgcca

SEQ ID NO: 7717477 - DNA, 22 bp, Homo sapiens
tgccctgggaacacagatgcca

SEQ ID NO: 7717478 - DNA, 22 bp, Homo sapiens
tgccctgggaacacagatgcca

SEQ ID NO: 7717479 - DNA, 22 bp, Homo sapiens
tgccctgggaacacagatgcca

SEQ ID NO: 7717480 - DNA, 22 bp, Homo sapiens
tgccctgggaacacagatgcca

SEQ ID NO: 7717481 - DNA, 22 bp, Homo sapiens
tgccctgggaacacagatgcca

SEQ ID NO: 7717482 - DNA, 22 bp, Homo sapiens
tgccctgggaacacagatgcca

SEQ ID NO: 7717483 - DNA, 22 bp, Homo sapiens
tgccctgggaacacagatgcca

SEQ ID NO: 7717484 - DNA, 22 bp, Homo sapiens
tgccctgggaacacagatgcca

SEQ ID NO: 7717485 - DNA, 22 bp, Homo sapiens
tgccctggcttcagctttggct

SEQ ID NO: 7717486 - DNA, 22 bp, Homo sapiens
tgccctggcttcagctttggct

SEQ ID NO: 7717487 - DNA, 22 bp, Homo sapiens
tgccctggcttcagctttggct

SEQ ID NO: 7717488 - DNA, 22 bp, Homo sapiens
tgccctggcttcagctttggct

SEQ ID NO: 7717489 - DNA, 22 bp, Homo sapiens
tgccctggctggagtgcagtgg

SEQ ID NO: 7717490 - DNA, 22 bp, Homo sapiens
tgccctggctggagtgcagtgg

SEQ ID NO: 7717491 - DNA, 22 bp, Homo sapiens
tgccctggctcttcttgttcca

SEQ ID NO: 7717492 - DNA, 22 bp, Homo sapiens
tgccctggctggagtgcagtgg

SEQ ID NO: 7717493 - DNA, 22 bp, Homo sapiens
tgccctggctggagtgcagtgg

SEQ ID NO: 7717494 - DNA, 22 bp, Homo sapiens
tgccctggctggagtgcagtgg

SEQ ID NO: 7717495 - DNA, 22 bp, Homo sapiens
tgccctggctcttcttgttcca

SEQ ID NO: 7717496 - DNA, 22 bp, Homo sapiens
tgccctttatttctggggcaga

SEQ ID NO: 7717497 - DNA, 22 bp, Homo sapiens
tgcccttggtgggcccaatagg

SEQ ID NO: 7717498 - DNA, 22 bp, Homo sapiens
tgccgcactcggctcctgattt

SEQ ID NO: 7717499 - DNA, 22 bp, Homo sapiens
tgccgcactcggccaccagctg

SEQ ID NO: 7717500 - DNA, 22 bp, Homo sapiens
tgcccttgggtaacttgctgat

SEQ ID NO: 7717501 - DNA, 22 bp, Homo sapiens
tgcccttgggtaacttgctgat

SEQ ID NO: 7717502 - DNA, 22 bp, Homo sapiens
tgcccttgaaatacgcttgggg

SEQ ID NO: 7717503 - DNA, 22 bp, Homo sapiens
tgcccttgaggacagctcccag

SEQ ID NO: 7717504 - DNA, 22 bp, Homo sapiens
tgcccttgaggacagctcccag

SEQ ID NO: 7717505 - DNA, 22 bp, Homo sapiens
tgcccttgggatttaggtaagg

SEQ ID NO: 7717506 - DNA, 22 bp, Homo sapiens
tgcccttataaaggaggcctga

SEQ ID NO: 7717507 - DNA, 22 bp, Homo sapiens
tgcccttaggaaggctcaccaa

SEQ ID NO: 7717508 - DNA, 22 bp, Homo sapiens
tgcccttatgaaagaggcccaa

SEQ ID NO: 7717509 - DNA, 22 bp, Homo sapiens
tgcccttcctctggattgcctt

SEQ ID NO: 7717510 - DNA, 22 bp, Homo sapiens
tgcccttgaaatacgcttgggg

SEQ ID NO: 7717511 - DNA, 22 bp, Homo sapiens
tgccctgttcctgcctccagct

SEQ ID NO: 7717512 - DNA, 22 bp, Homo sapiens
tgccctgttcctgcctccagct

SEQ ID NO: 7717513 - DNA, 22 bp, Homo sapiens
tgccctgttcctgcctccagct

SEQ ID NO: 7717514 - DNA, 22 bp, Homo sapiens
tgccctgttcctgcctccagct

SEQ ID NO: 7717515 - DNA, 22 bp, Homo sapiens
tgccctgttcctgcctccagct

SEQ ID NO: 7717516 - DNA, 22 bp, Homo sapiens
tgccctgttcctgcctccagct

SEQ ID NO: 7717517 - DNA, 22 bp, Homo sapiens
tgccctgtgggtatctgatggc

SEQ ID NO: 7717518 - DNA, 22 bp, Homo sapiens
tgccctgtgggtatctgatggc

SEQ ID NO: 7717519 - DNA, 22 bp, Homo sapiens
tgccctgtgtgtgcaagcactg

SEQ ID NO: 7717520 - DNA, 22 bp, Homo sapiens
tgccctgtgtgtgcaagcactg

SEQ ID NO: 7717521 - DNA, 22 bp, Homo sapiens
tgccctgttcacttcatggttc

SEQ ID NO: 7717522 - DNA, 22 bp, Homo sapiens
tgccctgttatcttggaagagt

SEQ ID NO: 7717523 - DNA, 22 bp, Homo sapiens
tgccctgtgttgggaatccaca

SEQ ID NO: 7717524 - DNA, 22 bp, Homo sapiens
tgccctgtgttgggaatccaca

SEQ ID NO: 7717525 - DNA, 22 bp, Homo sapiens
tgccctgtgttgggaatccaca

SEQ ID NO: 7717526 - DNA, 17 bp, Homo sapiens
tgccctgtgcctggtgt

SEQ ID NO: 7717527 - DNA, 17 bp, Homo sapiens
tgccctgtgcctggtgt

SEQ ID NO: 7717528 - DNA, 22 bp, Homo sapiens
tgccctgtgccagacttcctgg

SEQ ID NO: 7717529 - DNA, 22 bp, Homo sapiens
tgccctgtctaagctgtcagta

SEQ ID NO: 7717530 - DNA, 22 bp, Homo sapiens
tgccctgtgccagacttcctgg

SEQ ID NO: 7717531 - DNA, 22 bp, Homo sapiens
tgccctgtggggatttccagcc

SEQ ID NO: 7717532 - DNA, 22 bp, Homo sapiens
tgccctgtggggatttccagcc

SEQ ID NO: 7717533 - DNA, 20 bp, Homo sapiens
tgccctgtggaggggaaagg

SEQ ID NO: 7717534 - DNA, 20 bp, Homo sapiens
tgccctgtggaggggaaagg

SEQ ID NO: 7717535 - DNA, 22 bp, Homo sapiens
tgccctgtgctggaatcttccc

SEQ ID NO: 7717536 - DNA, 17 bp, Homo sapiens
tgccctgtgcctggtgt

SEQ ID NO: 7717537 - DNA, 22 bp, Homo sapiens
tgccctggaaccatctacagtc

SEQ ID NO: 7717538 - DNA, 22 bp, Homo sapiens
tgccctggaaatgagaggtgtg

SEQ ID NO: 7717539 - DNA, 22 bp, Homo sapiens
tgccctggaaatgagaggtgtg

SEQ ID NO: 7717540 - DNA, 22 bp, Homo sapiens
tgccctggaaatgagaggtgtg

SEQ ID NO: 7717541 - DNA, 22 bp, Homo sapiens
tgccctgcttctcttgggacag

SEQ ID NO: 7717542 - DNA, 22 bp, Homo sapiens
tgccctggaaatgagaggtgtg

SEQ ID NO: 7717543 - DNA, 22 bp, Homo sapiens
tgccctggaaatgagaggtgtg

SEQ ID NO: 7717544 - DNA, 22 bp, Homo sapiens
tgccctggaaatgagaggtgtg

SEQ ID NO: 7717545 - DNA, 22 bp, Homo sapiens
tgccctggaaatgagaggtgtg

SEQ ID NO: 7717546 - DNA, 22 bp, Homo sapiens
tgccctggaaatgagaggtgtg

SEQ ID NO: 7717547 - DNA, 22 bp, Homo sapiens
tgccctgctgtgcctggagcca

SEQ ID NO: 7717548 - DNA, 22 bp, Homo sapiens
tgccctgctgtggctctgccca

SEQ ID NO: 7717549 - DNA, 22 bp, Homo sapiens
tgccctgctgtggctctgccca

SEQ ID NO: 7717550 - DNA, 22 bp, Homo sapiens
tgccctgctgtggctctgccca

SEQ ID NO: 7717551 - DNA, 22 bp, Homo sapiens
tgccctgctgtggctctgccca

SEQ ID NO: 7717552 - DNA, 22 bp, Homo sapiens
tgccctgctgtggctctgccca

SEQ ID NO: 7717553 - DNA, 22 bp, Homo sapiens
tgccctggaggggcttacagtc

SEQ ID NO: 7717554 - DNA, 22 bp, Homo sapiens
tgccctggaggggcttacagtc

SEQ ID NO: 7717555 - DNA, 22 bp, Homo sapiens
tgccctggaggggcttacagtc

SEQ ID NO: 7717556 - DNA, 22 bp, Homo sapiens
tgccctggaggggcttacagtc

SEQ ID NO: 7717557 - DNA, 22 bp, Homo sapiens
tgccctggaaccatctacagtc

SEQ ID NO: 7717558 - DNA, 22 bp, Homo sapiens
tgccctggagtcagtggctatt

SEQ ID NO: 7717559 - DNA, 22 bp, Homo sapiens
tgccctggagtcagtggctatt

SEQ ID NO: 7717560 - DNA, 22 bp, Homo sapiens
tgccctggagtcagtggctatt

SEQ ID NO: 7717561 - DNA, 22 bp, Homo sapiens
tgccctggaggggcttacagtc

SEQ ID NO: 7717562 - DNA, 22 bp, Homo sapiens
tgccctggagtcagtggctatt

SEQ ID NO: 7717563 - DNA, 22 bp, Homo sapiens
tgccctggagtcagtggctatt

SEQ ID NO: 7717564 - DNA, 22 bp, Homo sapiens
tgccctggagtcagtggctatt

SEQ ID NO: 7717565 - DNA, 22 bp, Homo sapiens
tgccctggaaccatctacagtc

SEQ ID NO: 7717566 - DNA, 22 bp, Homo sapiens
tgccctggaaccatctacagtc

SEQ ID NO: 7717567 - DNA, 22 bp, Homo sapiens
tgccctggaaccatctacagtc

SEQ ID NO: 7717568 - DNA, 22 bp, Homo sapiens
tgccctggaaccatctacagtc

SEQ ID NO: 7717569 - DNA, 22 bp, Homo sapiens
tgccctggaaccatctacagtc

SEQ ID NO: 7717570 - DNA, 22 bp, Homo sapiens
tgccctggaaccatctacagtc

SEQ ID NO: 7717571 - DNA, 22 bp, Homo sapiens
tgccctggaaccatctacagtc

SEQ ID NO: 7717572 - DNA, 22 bp, Homo sapiens
tgccctggctcctcccacgctg

SEQ ID NO: 7717573 - DNA, 22 bp, Homo sapiens
tgccctggcgctgtctctatgg

SEQ ID NO: 7717574 - DNA, 22 bp, Homo sapiens
tgccctggcgctgtctctatgg

SEQ ID NO: 7717575 - DNA, 22 bp, Homo sapiens
tgccctggcgctgtctctatgg

SEQ ID NO: 7717576 - DNA, 22 bp, Homo sapiens
tgccctggctcctcccacgctg

SEQ ID NO: 7717577 - DNA, 22 bp, Homo sapiens
tgccctggctcctcccacgctg

SEQ ID NO: 7717578 - DNA, 22 bp, Homo sapiens
tgccctggctcctcccacgctg

SEQ ID NO: 7717579 - DNA, 22 bp, Homo sapiens
tgccctggctcctcccacgctg

SEQ ID NO: 7717580 - DNA, 22 bp, Homo sapiens
tgccctggctcctcccacgctg

SEQ ID NO: 7717581 - DNA, 22 bp, Homo sapiens
tgccctggctctccactagttt

SEQ ID NO: 7717582 - DNA, 22 bp, Homo sapiens
tgccctggctctccactagttt

SEQ ID NO: 7717583 - DNA, 22 bp, Homo sapiens
tgccctggctcttcttgttcca

SEQ ID NO: 7717584 - DNA, 22 bp, Homo sapiens
tgccctggctcttcttgttcca

SEQ ID NO: 7717585 - DNA, 22 bp, Homo sapiens
tgccctggctctccactagttt

SEQ ID NO: 7717586 - DNA, 22 bp, Homo sapiens
tgccctggctcctcccacgctg

SEQ ID NO: 7717587 - DNA, 22 bp, Homo sapiens
tgccctggctctccactagttt

SEQ ID NO: 7717588 - DNA, 22 bp, Homo sapiens
tgccctggctctccactagttt

SEQ ID NO: 7717589 - DNA, 22 bp, Homo sapiens
tgccctggctctccactagttt

SEQ ID NO: 7717590 - DNA, 22 bp, Homo sapiens
tgccctggctctccactagttt

SEQ ID NO: 7717591 - DNA, 22 bp, Homo sapiens
tgccctggctctccactagttt

SEQ ID NO: 7717592 - DNA, 22 bp, Homo sapiens
tgccctggcacacacacagctg

SEQ ID NO: 7717593 - DNA, 22 bp, Homo sapiens
tgccctggcacacacacagctg

SEQ ID NO: 7717594 - DNA, 22 bp, Homo sapiens
tgccctggcacacacacagctg

SEQ ID NO: 7717595 - DNA, 22 bp, Homo sapiens
tgccctggcacacacacagctg

SEQ ID NO: 7717596 - DNA, 22 bp, Homo sapiens
tgccctggatgctgcaggtgtg

SEQ ID NO: 7717597 - DNA, 22 bp, Homo sapiens
tgccctggcacacacacagctg

SEQ ID NO: 7717598 - DNA, 22 bp, Homo sapiens
tgccctggatgctgcaggtgtg

SEQ ID NO: 7717599 - DNA, 22 bp, Homo sapiens
tgccctggatgctgcaggtgtg

SEQ ID NO: 7717600 - DNA, 22 bp, Homo sapiens
tgccctggatgctgcaggtgtg

SEQ ID NO: 7717601 - DNA, 22 bp, Homo sapiens
tgccctggagtcagtggctatt

SEQ ID NO: 7717602 - DNA, 22 bp, Homo sapiens
tgccctggatgctgcaggtgtg

SEQ ID NO: 7717603 - DNA, 22 bp, Homo sapiens
tgccctggatgctgcaggtgtg

SEQ ID NO: 7717604 - DNA, 22 bp, Homo sapiens
tgccctggatgctgcaggtgtg

SEQ ID NO: 7717605 - DNA, 22 bp, Homo sapiens
tgccctggatgctgcaggtgtg

SEQ ID NO: 7717606 - DNA, 22 bp, Homo sapiens
tgccctggatgctgcaggtgtg

SEQ ID NO: 7717607 - DNA, 22 bp, Homo sapiens
tgccctggcattgggttggata

SEQ ID NO: 7717608 - DNA, 22 bp, Homo sapiens
tgccctggcattgggttggata

SEQ ID NO: 7717609 - DNA, 22 bp, Homo sapiens
tgccctggcattgggttggata

SEQ ID NO: 7717610 - DNA, 22 bp, Homo sapiens
tgccctggcattgggttggata

SEQ ID NO: 7717611 - DNA, 22 bp, Homo sapiens
tgccctggcgctgtctctatgg

SEQ ID NO: 7717612 - DNA, 22 bp, Homo sapiens
tgccctggcattgggttggata

SEQ ID NO: 7717613 - DNA, 22 bp, Homo sapiens
tgccctggcattgggttggata

SEQ ID NO: 7717614 - DNA, 22 bp, Homo sapiens
tgccctggcacacacacagctg

SEQ ID NO: 7717615 - DNA, 22 bp, Homo sapiens
tgccctggcacacacacagctg

SEQ ID NO: 7717616 - DNA, 22 bp, Homo sapiens
tgccctggcacacacacagctg

SEQ ID NO: 7717617 - DNA, 22 bp, Homo sapiens
tgccctggcacacacacagctg

SEQ ID NO: 7717618 - DNA, 22 bp, Homo sapiens
tgcccctgacctcaggcgaagg

SEQ ID NO: 7717619 - DNA, 22 bp, Homo sapiens
tgcccctgatgcctagaacaga

SEQ ID NO: 7717620 - DNA, 19 bp, Homo sapiens
tgcccctgcagtctaccca

SEQ ID NO: 7717621 - DNA, 19 bp, Homo sapiens
tgcccctgcagtctaccca

SEQ ID NO: 7717622 - DNA, 19 bp, Homo sapiens
tgccccttaagagtttctc

SEQ ID NO: 7717623 - DNA, 21 bp, Homo sapiens
tgcccctttatgggctcccta

SEQ ID NO: 7717624 - DNA, 22 bp, Homo sapiens
tgcccgctgctgctcagtctgt

SEQ ID NO: 7717625 - DNA, 21 bp, Homo sapiens
tgcccctttatgggctcccta

SEQ ID NO: 7717626 - DNA, 22 bp, Homo sapiens
tgccccttctacccgtctctgt

SEQ ID NO: 7717627 - DNA, 22 bp, Homo sapiens
tgccccttcaccttcagtcttg

SEQ ID NO: 7717628 - DNA, 22 bp, Homo sapiens
tgccccttctacccgtctctgt

SEQ ID NO: 7717629 - DNA, 22 bp, Homo sapiens
tgcccctcttgctggccctgtc

SEQ ID NO: 7717630 - DNA, 22 bp, Homo sapiens
tgcccctcttgctggccctgtc

SEQ ID NO: 7717631 - DNA, 22 bp, Homo sapiens
tgcccctcttgctggccctgtc

SEQ ID NO: 7717632 - DNA, 22 bp, Homo sapiens
tgcccctcttgctggccctgtc

SEQ ID NO: 7717633 - DNA, 22 bp, Homo sapiens
tgcccctcttgagaagctcagc

SEQ ID NO: 7717634 - DNA, 22 bp, Homo sapiens
tgcccctcttgagaagctcagc

SEQ ID NO: 7717635 - DNA, 22 bp, Homo sapiens
tgcccctcttgagaagctcagc

SEQ ID NO: 7717636 - DNA, 22 bp, Homo sapiens
tgcccctcttgctggccctgtc

SEQ ID NO: 7717637 - DNA, 22 bp, Homo sapiens
tgcccctcttgctggccctgtc

SEQ ID NO: 7717638 - DNA, 22 bp, Homo sapiens
tgccctgcagaccctgcagtgt

SEQ ID NO: 7717639 - DNA, 22 bp, Homo sapiens
tgccctcagaattgctccctgc

SEQ ID NO: 7717640 - DNA, 19 bp, Homo sapiens
tgccctgcacgctgtcctg

SEQ ID NO: 7717641 - DNA, 22 bp, Homo sapiens
tgccctcagaattgctccctgc

SEQ ID NO: 7717642 - DNA, 22 bp, Homo sapiens
tgccctcagaattgctccctgc

SEQ ID NO: 7717643 - DNA, 22 bp, Homo sapiens
tgccctcagaattgctccctgc

SEQ ID NO: 7717644 - DNA, 22 bp, Homo sapiens
tgccctcagaattgctccctgc

SEQ ID NO: 7717645 - DNA, 19 bp, Homo sapiens
tgccctaggggatgcgggg

SEQ ID NO: 7717646 - DNA, 22 bp, Homo sapiens
tgcccctgatgcctagaacaga

SEQ ID NO: 7717647 - DNA, 19 bp, Homo sapiens
tgccctaggggatgcgggg

SEQ ID NO: 7717648 - DNA, 22 bp, Homo sapiens
tgcccgtggcctggggcagctt

SEQ ID NO: 7717649 - DNA, 22 bp, Homo sapiens
tgcccgtggcctggggcagctt

SEQ ID NO: 7717650 - DNA, 22 bp, Homo sapiens
tgcccgttcattcatacttaac

SEQ ID NO: 7717651 - DNA, 22 bp, Homo sapiens
tgccctgcagaccctgcagtgt

SEQ ID NO: 7717652 - DNA, 22 bp, Homo sapiens
tgccctgcagtgagtgcgtctg

SEQ ID NO: 7717653 - DNA, 22 bp, Homo sapiens
tgccctgcagaccctgcagtgt

SEQ ID NO: 7717654 - DNA, 22 bp, Homo sapiens
tgccctgcagaccctgcagtgt

SEQ ID NO: 7717655 - DNA, 22 bp, Homo sapiens
tgccctgcagaccctgcagtgt

SEQ ID NO: 7717656 - DNA, 22 bp, Homo sapiens
tgccctgcatgcagggagctgt

SEQ ID NO: 7717657 - DNA, 22 bp, Homo sapiens
tgccctgcagtgagtgcgtctg

SEQ ID NO: 7717658 - DNA, 22 bp, Homo sapiens
tgccctgccaagactgagtggt

SEQ ID NO: 7717659 - DNA, 22 bp, Homo sapiens
tgccctgccaagactgagtggt

SEQ ID NO: 7717660 - DNA, 22 bp, Homo sapiens
tgccctgcccatctaccctgtc

SEQ ID NO: 7717661 - DNA, 22 bp, Homo sapiens
tgccctgccaagactgagtggt

SEQ ID NO: 7717662 - DNA, 22 bp, Homo sapiens
tgccctgcccatctaccctgtc

SEQ ID NO: 7717663 - DNA, 22 bp, Homo sapiens
tgccctgcccatctaccctgtc

SEQ ID NO: 7717664 - DNA, 19 bp, Homo sapiens
tgccctgcccgcagccttg

SEQ ID NO: 7717665 - DNA, 22 bp, Homo sapiens
tgccctgccaagaccaagtggt

SEQ ID NO: 7717666 - DNA, 22 bp, Homo sapiens
tgccctgccaagactcagtggt

SEQ ID NO: 7717667 - DNA, 22 bp, Homo sapiens
tgccctgccaagactcagtggt

SEQ ID NO: 7717668 - DNA, 22 bp, Homo sapiens
tgccctgccaagactcagtggt

SEQ ID NO: 7717669 - DNA, 22 bp, Homo sapiens
tgccctgccaagactcagtggt

SEQ ID NO: 7717670 - DNA, 22 bp, Homo sapiens
tgccctgcatgcagggagctgt

SEQ ID NO: 7717671 - DNA, 22 bp, Homo sapiens
tgccctgccaagaccaagtggt

SEQ ID NO: 7717672 - DNA, 22 bp, Homo sapiens
tgccctgccaagaccaagtggt

SEQ ID NO: 7717673 - DNA, 22 bp, Homo sapiens
tgccctgcctgagagacagtaa

SEQ ID NO: 7717674 - DNA, 19 bp, Homo sapiens
tgccctgcccgcagccttg

SEQ ID NO: 7717675 - DNA, 19 bp, Homo sapiens
tgccctgcccgcagccttg

SEQ ID NO: 7717676 - DNA, 22 bp, Homo sapiens
tgccctgcggctatctagatga

SEQ ID NO: 7717677 - DNA, 22 bp, Homo sapiens
tgccctgcggctatctagatga

SEQ ID NO: 7717678 - DNA, 22 bp, Homo sapiens
tgccctgcctgagagacagtaa

SEQ ID NO: 7717679 - DNA, 22 bp, Homo sapiens
tgccctgcggctatctagatga

SEQ ID NO: 7717680 - DNA, 22 bp, Homo sapiens
tgccctgcggctatctagatga

SEQ ID NO: 7717681 - DNA, 22 bp, Homo sapiens
tgccctgctaaatataggtagc

SEQ ID NO: 7717682 - DNA, 22 bp, Homo sapiens
tgccctgctgtgcctggagcca

SEQ ID NO: 7717683 - DNA, 22 bp, Homo sapiens
tgccctgctaaccttggttcca

SEQ ID NO: 7717684 - DNA, 22 bp, Homo sapiens
tgccctgctgtgcctggagcca

SEQ ID NO: 7717685 - DNA, 22 bp, Homo sapiens
tgccctgctgtgcctggagcca

SEQ ID NO: 7717686 - DNA, 22 bp, Homo sapiens
tgccctgctgtgcctggagcca

SEQ ID NO: 7717687 - DNA, 22 bp, Homo sapiens
tgccctgctgtgcctggagcca

SEQ ID NO: 7717688 - DNA, 22 bp, Homo sapiens
tgcctcagctgaggccgctcca

SEQ ID NO: 7717689 - DNA, 22 bp, Homo sapiens
tgcctcagctgaggccgctcca

SEQ ID NO: 7717690 - DNA, 22 bp, Homo sapiens
tgcctcagctgaggccgctcca

SEQ ID NO: 7717691 - DNA, 22 bp, Homo sapiens
tgcctcagagttgtccctacca

SEQ ID NO: 7717692 - DNA, 22 bp, Homo sapiens
tgcctcagagttgtccctacca

SEQ ID NO: 7717693 - DNA, 22 bp, Homo sapiens
tgcctcagagtgggcttgctat

SEQ ID NO: 7717694 - DNA, 22 bp, Homo sapiens
tgcctcagagtgggcttgctat

SEQ ID NO: 7717695 - DNA, 22 bp, Homo sapiens
tgcctcagagtgggcttgctat

SEQ ID NO: 7717696 - DNA, 22 bp, Homo sapiens
tgcctcagagttgtccctacca

SEQ ID NO: 7717697 - DNA, 22 bp, Homo sapiens
tgcctcagagtgggcttgctat

SEQ ID NO: 7717698 - DNA, 22 bp, Homo sapiens
tgcctcagagtgggcttgctat

SEQ ID NO: 7717699 - DNA, 22 bp, Homo sapiens
tgcctcaggcacctggcaggtt

SEQ ID NO: 7717700 - DNA, 22 bp, Homo sapiens
tgcctcaggcacctggcaggtt

SEQ ID NO: 7717701 - DNA, 22 bp, Homo sapiens
tgcctcaggcacctggcaggtt

SEQ ID NO: 7717702 - DNA, 22 bp, Homo sapiens
tgcctcaggcacctggcaggtt

SEQ ID NO: 7717703 - DNA, 22 bp, Homo sapiens
tgcctcaggcacctggcaggtt

SEQ ID NO: 7717704 - DNA, 22 bp, Homo sapiens
tgcctcagctgaggccgctcca

SEQ ID NO: 7717705 - DNA, 22 bp, Homo sapiens
tgcctcagctgaggccgctcca

SEQ ID NO: 7717706 - DNA, 22 bp, Homo sapiens
tgcctcagctgaggccgctcca

SEQ ID NO: 7717707 - DNA, 22 bp, Homo sapiens
tgcctcagctgaggccgctcca

SEQ ID NO: 7717708 - DNA, 22 bp, Homo sapiens
tgcctccattcctgggtcattg

SEQ ID NO: 7717709 - DNA, 22 bp, Homo sapiens
tgcctcagtctaaagtctctca

SEQ ID NO: 7717710 - DNA, 22 bp, Homo sapiens
tgcctccctctctgccactgga

SEQ ID NO: 7717711 - DNA, 22 bp, Homo sapiens
tgcctccctctctgccactgga

SEQ ID NO: 7717712 - DNA, 22 bp, Homo sapiens
tgcctccattcctgggtcattg

SEQ ID NO: 7717713 - DNA, 22 bp, Homo sapiens
tgcctcagtctaaagtctctca

SEQ ID NO: 7717714 - DNA, 22 bp, Homo sapiens
tgcctcagtctaaagtctctca

SEQ ID NO: 7717715 - DNA, 22 bp, Homo sapiens
tgcctcagtctaaagtctctca

SEQ ID NO: 7717716 - DNA, 22 bp, Homo sapiens
tgcctcagtcagcttccctggg

SEQ ID NO: 7717717 - DNA, 22 bp, Homo sapiens
tgcctcagtcagcttccctggg

SEQ ID NO: 7717718 - DNA, 22 bp, Homo sapiens
tgcctcagtctaaagtctctca

SEQ ID NO: 7717719 - DNA, 22 bp, Homo sapiens
tgcctcagtcagcttccctggg

SEQ ID NO: 7717720 - DNA, 19 bp, Homo sapiens
tgcctcagggctttgagga

SEQ ID NO: 7717721 - DNA, 19 bp, Homo sapiens
tgcctcagggctttgagga

SEQ ID NO: 7717722 - DNA, 22 bp, Homo sapiens
tgcctcaggcacctggcaggtt

SEQ ID NO: 7717723 - DNA, 22 bp, Homo sapiens
tgcctcagtcagcttccctggg

SEQ ID NO: 7717724 - DNA, 22 bp, Homo sapiens
tgcctcagtcagcttccctggg

SEQ ID NO: 7717725 - DNA, 22 bp, Homo sapiens
tgcctcagtcagcttccctggg

SEQ ID NO: 7717726 - DNA, 19 bp, Homo sapiens
tgcctcagggctttgagga

SEQ ID NO: 7717727 - DNA, 19 bp, Homo sapiens
tgcctcagggctttgagga

SEQ ID NO: 7717728 - DNA, 19 bp, Homo sapiens
tgcctcagggctttgagga

SEQ ID NO: 7717729 - DNA, 22 bp, Homo sapiens
tgcctccctggcaagtctctcc

SEQ ID NO: 7717730 - DNA, 22 bp, Homo sapiens
tgcctcctctttgccaaggtca

SEQ ID NO: 7717731 - DNA, 22 bp, Homo sapiens
tgcctccttcaggagggcccgg

SEQ ID NO: 7717732 - DNA, 22 bp, Homo sapiens
tgcctccttcaggagggcccgg

SEQ ID NO: 7717733 - DNA, 22 bp, Homo sapiens
tgcctccttcaggagggcccgg

SEQ ID NO: 7717734 - DNA, 22 bp, Homo sapiens
tgcctcctctttgccaaggtca

SEQ ID NO: 7717735 - DNA, 22 bp, Homo sapiens
tgcctctaaagtcatgatttat

SEQ ID NO: 7717736 - DNA, 22 bp, Homo sapiens
tgcctctctaacccatgcccaa

SEQ ID NO: 7717737 - DNA, 22 bp, Homo sapiens
tgcctccttcaggagggcccgg

SEQ ID NO: 7717738 - DNA, 22 bp, Homo sapiens
tgcctccttcaggagggcccgg

SEQ ID NO: 7717739 - DNA, 22 bp, Homo sapiens
tgcctccttcaggagggcccgg

SEQ ID NO: 7717740 - DNA, 22 bp, Homo sapiens
tgcctccctctctgccactgga

SEQ ID NO: 7717741 - DNA, 22 bp, Homo sapiens
tgcctccattcctgggtcattg

SEQ ID NO: 7717742 - DNA, 22 bp, Homo sapiens
tgcctccctctctgccactgga

SEQ ID NO: 7717743 - DNA, 22 bp, Homo sapiens
tgcctccctctctgccactgga

SEQ ID NO: 7717744 - DNA, 22 bp, Homo sapiens
tgcctccctctctgccactgga

SEQ ID NO: 7717745 - DNA, 22 bp, Homo sapiens
tgcctccctggcaagtctctcc

SEQ ID NO: 7717746 - DNA, 22 bp, Homo sapiens
tgcctccctctctgccactgga

SEQ ID NO: 7717747 - DNA, 22 bp, Homo sapiens
tgcctccctggcaagtctctcc

SEQ ID NO: 7717748 - DNA, 22 bp, Homo sapiens
tgcctccctggcaagtctctcc

SEQ ID NO: 7717749 - DNA, 22 bp, Homo sapiens
tgcctccctggcaagtctctcc

SEQ ID NO: 7717750 - DNA, 22 bp, Homo sapiens
tgcctctgctgcatattcacct

SEQ ID NO: 7717751 - DNA, 23 bp, Homo sapiens
tgcctctgcctccctagtctgca

SEQ ID NO: 7717752 - DNA, 23 bp, Homo sapiens
tgcctctgcctccctagtctgca

SEQ ID NO: 7717753 - DNA, 22 bp, Homo sapiens
tgcctctgctgctgtggcatca

SEQ ID NO: 7717754 - DNA, 22 bp, Homo sapiens
tgcctctgctgcatattcacct

SEQ ID NO: 7717755 - DNA, 22 bp, Homo sapiens
tgcctctgctgcatattcacct

SEQ ID NO: 7717756 - DNA, 22 bp, Homo sapiens
tgcctctgctgctgtggcatca

SEQ ID NO: 7717757 - DNA, 22 bp, Homo sapiens
tgcctctgctgctgtggcatca

SEQ ID NO: 7717758 - DNA, 22 bp, Homo sapiens
tgcctctgctgctgtggcatca

SEQ ID NO: 7717759 - DNA, 22 bp, Homo sapiens
tgcctctgaggaagattgtgtt

SEQ ID NO: 7717760 - DNA, 22 bp, Homo sapiens
tgcctctctaacccatgcccaa

SEQ ID NO: 7717761 - DNA, 22 bp, Homo sapiens
tgcctctctaacccatgcccaa

SEQ ID NO: 7717762 - DNA, 22 bp, Homo sapiens
tgcctctgaggaagattgtgtt

SEQ ID NO: 7717763 - DNA, 23 bp, Homo sapiens
tgcctctgcctccctagtctgca

SEQ ID NO: 7717764 - DNA, 23 bp, Homo sapiens
tgcctctgcctccctagtctgca

SEQ ID NO: 7717765 - DNA, 22 bp, Homo sapiens
tgcctctgcctccattgttagt

SEQ ID NO: 7717766 - DNA, 22 bp, Homo sapiens
tgcctctgtggaaatggtggtc

SEQ ID NO: 7717767 - DNA, 22 bp, Homo sapiens
tgcctctggttatctggtacct

SEQ ID NO: 7717768 - DNA, 22 bp, Homo sapiens
tgcctctgtggaaatggtggtc

SEQ ID NO: 7717769 - DNA, 22 bp, Homo sapiens
tgcctctggttatctggtacct

SEQ ID NO: 7717770 - DNA, 22 bp, Homo sapiens
tgcctctggttatctggtacct

SEQ ID NO: 7717771 - DNA, 22 bp, Homo sapiens
tgcctctgggtgaccaaggagc

SEQ ID NO: 7717772 - DNA, 22 bp, Homo sapiens
tgcctctgggtgaccaaggagc

SEQ ID NO: 7717773 - DNA, 22 bp, Homo sapiens
tgcctctggttatctggtacct

SEQ ID NO: 7717774 - DNA, 22 bp, Homo sapiens
tgcctctggcctttggtgccca

SEQ ID NO: 7717775 - DNA, 22 bp, Homo sapiens
tgcctctggcctttggtgccca

SEQ ID NO: 7717776 - DNA, 22 bp, Homo sapiens
tgcctctggcctttggtgccca

SEQ ID NO: 7717777 - DNA, 22 bp, Homo sapiens
tgcctctgctgctgtggcatca

SEQ ID NO: 7717778 - DNA, 22 bp, Homo sapiens
tgcctctgtgtgcaggtgagca

SEQ ID NO: 7717779 - DNA, 22 bp, Homo sapiens
tgcctctgtgggccttcctggc

SEQ ID NO: 7717780 - DNA, 22 bp, Homo sapiens
tgcctctgtgggccttcctggc

SEQ ID NO: 7717781 - DNA, 22 bp, Homo sapiens
tgcctctgtgggccttcctggc

SEQ ID NO: 7717782 - DNA, 22 bp, Homo sapiens
tgcctctgtgggccttcctggc

SEQ ID NO: 7717783 - DNA, 22 bp, Homo sapiens
tgcctctgtgggccttcctggc

SEQ ID NO: 7717784 - DNA, 22 bp, Homo sapiens
tgcctctgtgggcagagctgcc

SEQ ID NO: 7717785 - DNA, 22 bp, Homo sapiens
tgcctctgtgggcagagctgcc

SEQ ID NO: 7717786 - DNA, 22 bp, Homo sapiens
tgcctctgtgggcagagctgcc

SEQ ID NO: 7717787 - DNA, 22 bp, Homo sapiens
tgcctctgtgggcagagctgcc

SEQ ID NO: 7717788 - DNA, 22 bp, Homo sapiens
tgcctctgtgggcagagctgcc

SEQ ID NO: 7717789 - DNA, 22 bp, Homo sapiens
tgcctctgtgggcagagctgcc

SEQ ID NO: 7717790 - DNA, 22 bp, Homo sapiens
tgcctctgtgggcagagctgcc

SEQ ID NO: 7717791 - DNA, 22 bp, Homo sapiens
tgcctctgtgggccttcctggc

SEQ ID NO: 7717792 - DNA, 22 bp, Homo sapiens
tgcctctgtgggcagagctgcc

SEQ ID NO: 7717793 - DNA, 22 bp, Homo sapiens
tgcctctgtgggcagagctgcc

SEQ ID NO: 7717794 - DNA, 22 bp, Homo sapiens
tgcctctgtgggcagagctgcc

SEQ ID NO: 7717795 - DNA, 22 bp, Homo sapiens
tgcctctgtgggcagagctgcc

SEQ ID NO: 7717796 - DNA, 22 bp, Homo sapiens
tgcctgaagaaaacttgcagca

SEQ ID NO: 7717797 - DNA, 22 bp, Homo sapiens
tgcctgaatgatcagtcagatt

SEQ ID NO: 7717798 - DNA, 22 bp, Homo sapiens
tgcctgaattcaattcctggct

SEQ ID NO: 7717799 - DNA, 22 bp, Homo sapiens
tgcctgaaataccatcatgagt

SEQ ID NO: 7717800 - DNA, 22 bp, Homo sapiens
tgcctgaacatgaatagtttat

SEQ ID NO: 7717801 - DNA, 22 bp, Homo sapiens
tgcctgaaataccatcatgagt

SEQ ID NO: 7717802 - DNA, 22 bp, Homo sapiens
tgcctcttggagcctttcctct

SEQ ID NO: 7717803 - DNA, 22 bp, Homo sapiens
tgcctctgttgagccttggctg

SEQ ID NO: 7717804 - DNA, 22 bp, Homo sapiens
tgcctctgttgagccttggctg

SEQ ID NO: 7717805 - DNA, 22 bp, Homo sapiens
tgcctctgttgagccttggctg

SEQ ID NO: 7717806 - DNA, 22 bp, Homo sapiens
tgcctctgtgtgcaggtgagca

SEQ ID NO: 7717807 - DNA, 22 bp, Homo sapiens
tgcctctgtgtgcaggtgagca

SEQ ID NO: 7717808 - DNA, 22 bp, Homo sapiens
tgcctgagtttaaccctcagag

SEQ ID NO: 7717809 - DNA, 22 bp, Homo sapiens
tgcctgagtttaaccctcagag

SEQ ID NO: 7717810 - DNA, 22 bp, Homo sapiens
tgcctgagtttaaccctcagag

SEQ ID NO: 7717811 - DNA, 22 bp, Homo sapiens
tgcctgagtgatgtggcagcca

SEQ ID NO: 7717812 - DNA, 22 bp, Homo sapiens
tgcctgagtgatgtggcagcca

SEQ ID NO: 7717813 - DNA, 22 bp, Homo sapiens
tgcctgagtgatgtggcagcca

SEQ ID NO: 7717814 - DNA, 22 bp, Homo sapiens
tgcctgagtgatgtggcagcca

SEQ ID NO: 7717815 - DNA, 22 bp, Homo sapiens
tgcctgaggtggtctgcaaatg

SEQ ID NO: 7717816 - DNA, 22 bp, Homo sapiens
tgcctgagtgatgtggcagcca

SEQ ID NO: 7717817 - DNA, 22 bp, Homo sapiens
tgcctgaggtggtctgcaaatg

SEQ ID NO: 7717818 - DNA, 22 bp, Homo sapiens
tgcctgagggagtaagagtcct

SEQ ID NO: 7717819 - DNA, 22 bp, Homo sapiens
tgcctgaggtggtctgcaaatg

SEQ ID NO: 7717820 - DNA, 22 bp, Homo sapiens
tgcctgagggagtaagagtcct

SEQ ID NO: 7717821 - DNA, 22 bp, Homo sapiens
tgcctgagggagtaagagtcct

SEQ ID NO: 7717822 - DNA, 22 bp, Homo sapiens
tgcctgaggagtcagggcaggt

SEQ ID NO: 7717823 - DNA, 22 bp, Homo sapiens
tgcctgaggagtcagggcaggt

SEQ ID NO: 7717824 - DNA, 22 bp, Homo sapiens
tgcctgaggagtcagggcaggt

SEQ ID NO: 7717825 - DNA, 22 bp, Homo sapiens
tgcctgaggagtcagggcaggt

SEQ ID NO: 7717826 - DNA, 22 bp, Homo sapiens
tgcctgaggagtcagggcaggt

SEQ ID NO: 7717827 - DNA, 20 bp, Homo sapiens
tgcctgacttcagcatcagt

SEQ ID NO: 7717828 - DNA, 20 bp, Homo sapiens
tgcctgacttcagcatcagt

SEQ ID NO: 7717829 - DNA, 22 bp, Homo sapiens
tgcctgactgctgccaccacta

SEQ ID NO: 7717830 - DNA, 22 bp, Homo sapiens
tgcctgactgctgccaccacta

SEQ ID NO: 7717831 - DNA, 22 bp, Homo sapiens
tgcctggcactcctggagctca

SEQ ID NO: 7717832 - DNA, 22 bp, Homo sapiens
tgcctggcactcctggagctca

SEQ ID NO: 7717833 - DNA, 22 bp, Homo sapiens
tgcctggcaccccagtctgcac

SEQ ID NO: 7717834 - DNA, 22 bp, Homo sapiens
tgcctggcaccccagtctgcac

SEQ ID NO: 7717835 - DNA, 22 bp, Homo sapiens
tgcctggcaccccagtctgcac

SEQ ID NO: 7717836 - DNA, 22 bp, Homo sapiens
tgcctggcactcctggagctca

SEQ ID NO: 7717837 - DNA, 22 bp, Homo sapiens
tgcctggcagcttgaaagaaat

SEQ ID NO: 7717838 - DNA, 22 bp, Homo sapiens
tgcctggcagcttgaaagaaat

SEQ ID NO: 7717839 - DNA, 22 bp, Homo sapiens
tgcctggcactcctggagctca

SEQ ID NO: 7717840 - DNA, 22 bp, Homo sapiens
tgcctggcactcctggagctca

SEQ ID NO: 7717841 - DNA, 22 bp, Homo sapiens
tgcctggcatgttatagacaca

SEQ ID NO: 7717842 - DNA, 22 bp, Homo sapiens
tgcctggcatctagccctggga

SEQ ID NO: 7717843 - DNA, 22 bp, Homo sapiens
tgcctggcatctagccctggga

SEQ ID NO: 7717844 - DNA, 22 bp, Homo sapiens
tgcctggcatctagccctggga

SEQ ID NO: 7717845 - DNA, 22 bp, Homo sapiens
tgcctggcatctagccctggga

SEQ ID NO: 7717846 - DNA, 22 bp, Homo sapiens
tgcctggcatctagccctggga

SEQ ID NO: 7717847 - DNA, 22 bp, Homo sapiens
tgcctggcatctagccctggga

SEQ ID NO: 7717848 - DNA, 22 bp, Homo sapiens
tgcctggcatctagccctggga

SEQ ID NO: 7717849 - DNA, 22 bp, Homo sapiens
tgcctggcatctagccctggga

SEQ ID NO: 7717850 - DNA, 22 bp, Homo sapiens
tgcctggcatctagccctggga

SEQ ID NO: 7717851 - DNA, 22 bp, Homo sapiens
tgcctggcatctagccctggga

SEQ ID NO: 7717852 - DNA, 22 bp, Homo sapiens
tgcctggcagcttgaaagaaat

SEQ ID NO: 7717853 - DNA, 22 bp, Homo sapiens
tgcctggcagcttgaaagaaat

SEQ ID NO: 7717854 - DNA, 19 bp, Homo sapiens
tgcctggcaccagctccac

SEQ ID NO: 7717855 - DNA, 19 bp, Homo sapiens
tgcctggcaccagctccac

SEQ ID NO: 7717856 - DNA, 22 bp, Homo sapiens
tgcctggcacagagcaggtggc

SEQ ID NO: 7717857 - DNA, 22 bp, Homo sapiens
tgcctggcacagagcaggtggc

SEQ ID NO: 7717858 - DNA, 22 bp, Homo sapiens
tgcctggcacagagcaggtggc

SEQ ID NO: 7717859 - DNA, 22 bp, Homo sapiens
tgcctggcacagagcaggtggc

SEQ ID NO: 7717860 - DNA, 22 bp, Homo sapiens
tgcctggcacagagcaggtggc

SEQ ID NO: 7717861 - DNA, 22 bp, Homo sapiens
tgcctggcacagagcaggtggc

SEQ ID NO: 7717862 - DNA, 22 bp, Homo sapiens
tgcctggcacagagcaggtggc

SEQ ID NO: 7717863 - DNA, 22 bp, Homo sapiens
tgcctggcaatgccagaagcca

SEQ ID NO: 7717864 - DNA, 22 bp, Homo sapiens
tgcctggcaccccagtctgcac

SEQ ID NO: 7717865 - DNA, 22 bp, Homo sapiens
tgcctggcaccccagtctgcac

SEQ ID NO: 7717866 - DNA, 22 bp, Homo sapiens
tgcctggcaccccagtctgcac

SEQ ID NO: 7717867 - DNA, 22 bp, Homo sapiens
tgcctggcaccccagtctgcac

SEQ ID NO: 7717868 - DNA, 22 bp, Homo sapiens
tgcctggcaccccagtctgcac

SEQ ID NO: 7717869 - DNA, 19 bp, Homo sapiens
tgcctggcaccagctccac

SEQ ID NO: 7717870 - DNA, 19 bp, Homo sapiens
tgcctggcaccagctccac

SEQ ID NO: 7717871 - DNA, 19 bp, Homo sapiens
tgcctggcaccagctccac

SEQ ID NO: 7717872 - DNA, 19 bp, Homo sapiens
tgcctggcaccagctccac

SEQ ID NO: 7717873 - DNA, 19 bp, Homo sapiens
tgcctggcaccagctccac

SEQ ID NO: 7717874 - DNA, 19 bp, Homo sapiens
tgcctggcaccagctccac

SEQ ID NO: 7717875 - DNA, 22 bp, Homo sapiens
tgcctggcaactgtggtgggct

SEQ ID NO: 7717876 - DNA, 22 bp, Homo sapiens
tgcctggcaagaggggctggct

SEQ ID NO: 7717877 - DNA, 22 bp, Homo sapiens
tgcctggcaagaggggctggct

SEQ ID NO: 7717878 - DNA, 22 bp, Homo sapiens
tgcctggcaagaggggctggct

SEQ ID NO: 7717879 - DNA, 22 bp, Homo sapiens
tgcctggcaactgtggtgggct

SEQ ID NO: 7717880 - DNA, 22 bp, Homo sapiens
tgcctggattcggttgttgtca

SEQ ID NO: 7717881 - DNA, 22 bp, Homo sapiens
tgcctggattcaaagctcatgt

SEQ ID NO: 7717882 - DNA, 22 bp, Homo sapiens
tgcctggcaatgccagaagcca

SEQ ID NO: 7717883 - DNA, 22 bp, Homo sapiens
tgcctggcaatgccagaagcca

SEQ ID NO: 7717884 - DNA, 22 bp, Homo sapiens
tgcctggcaagaggggctggct

SEQ ID NO: 7717885 - DNA, 22 bp, Homo sapiens
tgcctggcaatgccagaagcca

SEQ ID NO: 7717886 - DNA, 22 bp, Homo sapiens
tgcctggcaatgccagaagcca

SEQ ID NO: 7717887 - DNA, 22 bp, Homo sapiens
tgcctggcaatgccagaagcca

SEQ ID NO: 7717888 - DNA, 22 bp, Homo sapiens
tgcctggcaagaggggctggct

SEQ ID NO: 7717889 - DNA, 22 bp, Homo sapiens
tgcctggcaagaggggctggct

SEQ ID NO: 7717890 - DNA, 22 bp, Homo sapiens
tgcctggcaagaggggctggct

SEQ ID NO: 7717891 - DNA, 22 bp, Homo sapiens
tgcctggcaagaggggctggct

SEQ ID NO: 7717892 - DNA, 22 bp, Homo sapiens
tgcctggatggctctgagcagg

SEQ ID NO: 7717893 - DNA, 22 bp, Homo sapiens
tgcctggatctgaggacccatt

SEQ ID NO: 7717894 - DNA, 22 bp, Homo sapiens
tgcctggatggctctgagcagg

SEQ ID NO: 7717895 - DNA, 22 bp, Homo sapiens
tgcctggatggctctgagcagg

SEQ ID NO: 7717896 - DNA, 22 bp, Homo sapiens
tgcctggatctgaggacccatt

SEQ ID NO: 7717897 - DNA, 22 bp, Homo sapiens
tgcctggatctgaggacccatt

SEQ ID NO: 7717898 - DNA, 22 bp, Homo sapiens
tgcctggattcaaagctcatgt

SEQ ID NO: 7717899 - DNA, 22 bp, Homo sapiens
tgcctggatgtgctggcctcac

SEQ ID NO: 7717900 - DNA, 19 bp, Homo sapiens
tgcctggagcataacaggc

SEQ ID NO: 7717901 - DNA, 22 bp, Homo sapiens
tgcctggagtccccaagtccat

SEQ ID NO: 7717902 - DNA, 22 bp, Homo sapiens
tgcctggagtccccaagtccat

SEQ ID NO: 7717903 - DNA, 22 bp, Homo sapiens
tgcctggagaaggcaccatctg

SEQ ID NO: 7717904 - DNA, 22 bp, Homo sapiens
tgcctggatctgaggacccatt

SEQ ID NO: 7717905 - DNA, 22 bp, Homo sapiens
tgcctggatactcattaatttc

SEQ ID NO: 7717906 - DNA, 17 bp, Homo sapiens
tgcctgccagcattgga

SEQ ID NO: 7717907 - DNA, 22 bp, Homo sapiens
tgcctgcagcgtctccagcagg

SEQ ID NO: 7717908 - DNA, 17 bp, Homo sapiens
tgcctgccagcattgga

SEQ ID NO: 7717909 - DNA, 22 bp, Homo sapiens
tgcctgccaggcaacctgggag

SEQ ID NO: 7717910 - DNA, 22 bp, Homo sapiens
tgcctgccaggcaacctgggag

SEQ ID NO: 7717911 - DNA, 17 bp, Homo sapiens
tgcctgccagcattgga

SEQ ID NO: 7717912 - DNA, 22 bp, Homo sapiens
tgcctgccaggcaacctgggag

SEQ ID NO: 7717913 - DNA, 17 bp, Homo sapiens
tgcctgccagcattgga

SEQ ID NO: 7717914 - DNA, 22 bp, Homo sapiens
tgcctgccaatgatgcttgtgt

SEQ ID NO: 7717915 - DNA, 22 bp, Homo sapiens
tgcctgccacgcttgctaccac

SEQ ID NO: 7717916 - DNA, 22 bp, Homo sapiens
tgcctgccacgcttgctaccac

SEQ ID NO: 7717917 - DNA, 22 bp, Homo sapiens
tgcctgccatgcagaaagctga

SEQ ID NO: 7717918 - DNA, 22 bp, Homo sapiens
tgcctgccatgcagaaagctga

SEQ ID NO: 7717919 - DNA, 22 bp, Homo sapiens
tgcctgccatgcagaaagctga

SEQ ID NO: 7717920 - DNA, 22 bp, Homo sapiens
tgcctgccaggcaacctgggag

SEQ ID NO: 7717921 - DNA, 22 bp, Homo sapiens
tgcctgccaggtgcttcttcat

SEQ ID NO: 7717922 - DNA, 22 bp, Homo sapiens
tgcctgccaggtgcttcttcat

SEQ ID NO: 7717923 - DNA, 20 bp, Homo sapiens
tgcctgcccaggtcctgcac

SEQ ID NO: 7717924 - DNA, 22 bp, Homo sapiens
tgcctgcccacgactacagcag

SEQ ID NO: 7717925 - DNA, 22 bp, Homo sapiens
tgcctgcccacgactacagcag

SEQ ID NO: 7717926 - DNA, 22 bp, Homo sapiens
tgcctgcccacgactacagcag

SEQ ID NO: 7717927 - DNA, 22 bp, Homo sapiens
tgcctgcccacgactacagcag

SEQ ID NO: 7717928 - DNA, 22 bp, Homo sapiens
tgcctgcatcttggaggcccca

SEQ ID NO: 7717929 - DNA, 22 bp, Homo sapiens
tgcctgcatcttggaggcccca

SEQ ID NO: 7717930 - DNA, 22 bp, Homo sapiens
tgcctgcatcttggaggcccca

SEQ ID NO: 7717931 - DNA, 22 bp, Homo sapiens
tgcctgcatcttggaggcccca

SEQ ID NO: 7717932 - DNA, 22 bp, Homo sapiens
tgcctgcatcttggaggcccca

SEQ ID NO: 7717933 - DNA, 22 bp, Homo sapiens
tgcctgcagcgtctccagcagg

SEQ ID NO: 7717934 - DNA, 22 bp, Homo sapiens
tgcctgcaagagttggggctac

SEQ ID NO: 7717935 - DNA, 22 bp, Homo sapiens
tgcctgcattttgtggctggct

SEQ ID NO: 7717936 - DNA, 22 bp, Homo sapiens
tgcctgcattttgtggctggct

SEQ ID NO: 7717937 - DNA, 22 bp, Homo sapiens
tgcctgcattttgtggctggct

SEQ ID NO: 7717938 - DNA, 22 bp, Homo sapiens
tgcctgccaatgatgcttgtgt

SEQ ID NO: 7717939 - DNA, 22 bp, Homo sapiens
tgcctgccaatgatgcttgtgt

SEQ ID NO: 7717940 - DNA, 21 bp, Homo sapiens
tgcctgcattctatcagacca

SEQ ID NO: 7717941 - DNA, 21 bp, Homo sapiens
tgcctgcattctatcagacca

SEQ ID NO: 7717942 - DNA, 22 bp, Homo sapiens
tgcctgatgcaggagtatcaga

SEQ ID NO: 7717943 - DNA, 22 bp, Homo sapiens
tgcctgatgcaggagtatcaga

SEQ ID NO: 7717944 - DNA, 22 bp, Homo sapiens
tgcctgatgcaggagtatcaga

SEQ ID NO: 7717945 - DNA, 22 bp, Homo sapiens
tgcctgatgcaggagtatcaga

SEQ ID NO: 7717946 - DNA, 22 bp, Homo sapiens
tgcctgagtttaaccctcagag

SEQ ID NO: 7717947 - DNA, 22 bp, Homo sapiens
tgcctgagtttaaccctcagag

SEQ ID NO: 7717948 - DNA, 22 bp, Homo sapiens
tgcctgctttctcctcaactca

SEQ ID NO: 7717949 - DNA, 22 bp, Homo sapiens
tgcctgctttctcctcaactca

SEQ ID NO: 7717950 - DNA, 22 bp, Homo sapiens
tgcctgctttctgggctgccat

SEQ ID NO: 7717951 - DNA, 18 bp, Homo sapiens
tgcctggaaggaacagga

SEQ ID NO: 7717952 - DNA, 22 bp, Homo sapiens
tgcctggaaggcccatgggaag

SEQ ID NO: 7717953 - DNA, 18 bp, Homo sapiens
tgcctggaaggaacagga

SEQ ID NO: 7717954 - DNA, 18 bp, Homo sapiens
tgcctggaaggaacagga

SEQ ID NO: 7717955 - DNA, 19 bp, Homo sapiens
tgcctggacaaatgtgggg

SEQ ID NO: 7717956 - DNA, 22 bp, Homo sapiens
tgcctggaaggcccatgggaag

SEQ ID NO: 7717957 - DNA, 22 bp, Homo sapiens
tgcctggagaaggcaccatctg

SEQ ID NO: 7717958 - DNA, 23 bp, Homo sapiens
tgcctggagaagcatgaaatgta

SEQ ID NO: 7717959 - DNA, 22 bp, Homo sapiens
tgcctggaccccacctccggaa

SEQ ID NO: 7717960 - DNA, 22 bp, Homo sapiens
tgcctgcttgtttacctactcc

SEQ ID NO: 7717961 - DNA, 22 bp, Homo sapiens
tgcctgcttgtgtacctggtga

SEQ ID NO: 7717962 - DNA, 22 bp, Homo sapiens
tgcctgctgccactgctgttac

SEQ ID NO: 7717963 - DNA, 20 bp, Homo sapiens
tgcctgcccaggtcctgcac

SEQ ID NO: 7717964 - DNA, 20 bp, Homo sapiens
tgcctgcccaggtcctgcac

SEQ ID NO: 7717965 - DNA, 20 bp, Homo sapiens
tgcctgcccaggtcctgcac

SEQ ID NO: 7717966 - DNA, 20 bp, Homo sapiens
tgcctgcccaggtcctgcac

SEQ ID NO: 7717967 - DNA, 22 bp, Homo sapiens
tgcctgctgattggagttgaat

SEQ ID NO: 7717968 - DNA, 22 bp, Homo sapiens
tgccagcaagaatagacagtaa

SEQ ID NO: 7717969 - DNA, 22 bp, Homo sapiens
tgccagagttacatgagggtca

SEQ ID NO: 7717970 - DNA, 23 bp, Homo sapiens
tgccagaggcagtcacagtggtg

SEQ ID NO: 7717971 - DNA, 23 bp, Homo sapiens
tgccagaggcagtcacagtggtg

SEQ ID NO: 7717972 - DNA, 22 bp, Homo sapiens
tgccagagttacatgagggtca

SEQ ID NO: 7717973 - DNA, 22 bp, Homo sapiens
tgccagagttacatgagggtca

SEQ ID NO: 7717974 - DNA, 22 bp, Homo sapiens
tgccagagttacatgagggtca

SEQ ID NO: 7717975 - DNA, 22 bp, Homo sapiens
tgccagcacttctggctgtctg

SEQ ID NO: 7717976 - DNA, 22 bp, Homo sapiens
tgccagcacttctggctgtctg

SEQ ID NO: 7717977 - DNA, 22 bp, Homo sapiens
tgccagcacttctggctgtctg

SEQ ID NO: 7717978 - DNA, 22 bp, Homo sapiens
tgccagcacttctggctgtctg

SEQ ID NO: 7717979 - DNA, 22 bp, Homo sapiens
tgccagcacttctggctgtctg

SEQ ID NO: 7717980 - DNA, 22 bp, Homo sapiens
tgccagcacaagttaagagatc

SEQ ID NO: 7717981 - DNA, 22 bp, Homo sapiens
tgccagcaccttcctgctccct

SEQ ID NO: 7717982 - DNA, 22 bp, Homo sapiens
tgccagcaccttcctgctccct

SEQ ID NO: 7717983 - DNA, 22 bp, Homo sapiens
tgccagcacaagttaagagatc

SEQ ID NO: 7717984 - DNA, 22 bp, Homo sapiens
tgccagcacaagttaagagatc

SEQ ID NO: 7717985 - DNA, 23 bp, Homo sapiens
tgccagaggcagtcacagtggtg

SEQ ID NO: 7717986 - DNA, 22 bp, Homo sapiens
tgccagagccaggctttaggaa

SEQ ID NO: 7717987 - DNA, 23 bp, Homo sapiens
tgccagaggcagtcacagtggtg

SEQ ID NO: 7717988 - DNA, 23 bp, Homo sapiens
tgccagaggcagtcacagtggtg

SEQ ID NO: 7717989 - DNA, 23 bp, Homo sapiens
tgccagaggcagtcacagtggtg

SEQ ID NO: 7717990 - DNA, 22 bp, Homo sapiens
tgccagagatttcacactgcta

SEQ ID NO: 7717991 - DNA, 22 bp, Homo sapiens
tgccagagatttcacactgcta

SEQ ID NO: 7717992 - DNA, 22 bp, Homo sapiens
tgccagagatttcacactgcta

SEQ ID NO: 7717993 - DNA, 22 bp, Homo sapiens
tgccagagcaaaatgcccttaa

SEQ ID NO: 7717994 - DNA, 22 bp, Homo sapiens
tgccagagatttcacactgcta

SEQ ID NO: 7717995 - DNA, 22 bp, Homo sapiens
tgccagagagtggctgggtgtc

SEQ ID NO: 7717996 - DNA, 19 bp, Homo sapiens
tgccagagatactcccaga

SEQ ID NO: 7717997 - DNA, 19 bp, Homo sapiens
tgccagagatactcccaga

SEQ ID NO: 7717998 - DNA, 22 bp, Homo sapiens
tgccagagagtggctgggtgtc

SEQ ID NO: 7717999 - DNA, 22 bp, Homo sapiens
tgccagagagtggctgggtgtc

SEQ ID NO: 7718000 - DNA, 22 bp, Homo sapiens
tgccagagaggagaaagcattt

SEQ ID NO: 7718001 - DNA, 22 bp, Homo sapiens
tgccagagagtggctgggtgtc

SEQ ID NO: 7718002 - DNA, 22 bp, Homo sapiens
tgccagagaatcacctctcctt

SEQ ID NO: 7718003 - DNA, 22 bp, Homo sapiens
tgccagagaagacccagtcact

SEQ ID NO: 7718004 - DNA, 22 bp, Homo sapiens
tgccagagaagacccagtcact

SEQ ID NO: 7718005 - DNA, 22 bp, Homo sapiens
tgccagagaggagaaagcattt

SEQ ID NO: 7718006 - DNA, 22 bp, Homo sapiens
tgccagccaggttctgaggcta

SEQ ID NO: 7718007 - DNA, 22 bp, Homo sapiens
tgccagccaggttctgaggcta

SEQ ID NO: 7718008 - DNA, 22 bp, Homo sapiens
tgccagccagggaagctcaccc

SEQ ID NO: 7718009 - DNA, 22 bp, Homo sapiens
tgccagcaagaatagacagtaa

SEQ ID NO: 7718010 - DNA, 22 bp, Homo sapiens
tgccagccagggaagctcaccc

SEQ ID NO: 7718011 - DNA, 22 bp, Homo sapiens
tgccagccagggaagctcaccc

SEQ ID NO: 7718012 - DNA, 19 bp, Homo sapiens
tgccagcattaggctgaag

SEQ ID NO: 7718013 - DNA, 19 bp, Homo sapiens
tgccagcattaggctgaag

SEQ ID NO: 7718014 - DNA, 19 bp, Homo sapiens
tgccagcattaggctgaag

SEQ ID NO: 7718015 - DNA, 19 bp, Homo sapiens
tgccagcattaggctgaag

SEQ ID NO: 7718016 - DNA, 22 bp, Homo sapiens
tgccagcccaccttggggcctc

SEQ ID NO: 7718017 - DNA, 22 bp, Homo sapiens
tgccagcccaccttggggcctc

SEQ ID NO: 7718018 - DNA, 22 bp, Homo sapiens
tgccagcccaccttggggcctc

SEQ ID NO: 7718019 - DNA, 22 bp, Homo sapiens
tgccagccaggttctgaggcta

SEQ ID NO: 7718020 - DNA, 22 bp, Homo sapiens
tgccagccagggaagctcaccc

SEQ ID NO: 7718021 - DNA, 22 bp, Homo sapiens
tgccagccaggttctgaggcta

SEQ ID NO: 7718022 - DNA, 22 bp, Homo sapiens
tgccagccaggttctgaggcta

SEQ ID NO: 7718023 - DNA, 22 bp, Homo sapiens
tgccagccaggttctgaggcta

SEQ ID NO: 7718024 - DNA, 19 bp, Homo sapiens
tgccagcattaggctgaag

SEQ ID NO: 7718025 - DNA, 19 bp, Homo sapiens
tgccagcattaggctgaag

SEQ ID NO: 7718026 - DNA, 19 bp, Homo sapiens
tgccagcattaggctgaag

SEQ ID NO: 7718027 - DNA, 19 bp, Homo sapiens
tgccagcattaggctgaag

SEQ ID NO: 7718028 - DNA, 21 bp, Homo sapiens
tgccagcattaaacagtcatt

SEQ ID NO: 7718029 - DNA, 21 bp, Homo sapiens
tgccagcatgtaggctagttg

SEQ ID NO: 7718030 - DNA, 21 bp, Homo sapiens
tgccagcatgtaggctagttg

SEQ ID NO: 7718031 - DNA, 21 bp, Homo sapiens
tgccagcatgtaggctagttg

SEQ ID NO: 7718032 - DNA, 22 bp, Homo sapiens
tgccagcagaaataaatacttg

SEQ ID NO: 7718033 - DNA, 22 bp, Homo sapiens
tgccagcagaaataaatacttg

SEQ ID NO: 7718034 - DNA, 23 bp, Homo sapiens
tgccagcagggaatgggaaggac

SEQ ID NO: 7718035 - DNA, 23 bp, Homo sapiens
tgccagcagggaatgggaaggac

SEQ ID NO: 7718036 - DNA, 23 bp, Homo sapiens
tgccagcagggaatgggaaggac

SEQ ID NO: 7718037 - DNA, 21 bp, Homo sapiens
tgccagcatgtaggctagttg

SEQ ID NO: 7718038 - DNA, 22 bp, Homo sapiens
tgccagcagtagcagtaggcca

SEQ ID NO: 7718039 - DNA, 22 bp, Homo sapiens
tgccagcagtagcagtaggcca

SEQ ID NO: 7718040 - DNA, 22 bp, Homo sapiens
tgccagcagtagcagtaggcca

SEQ ID NO: 7718041 - DNA, 22 bp, Homo sapiens
tgccactggctcaatggtgcag

SEQ ID NO: 7718042 - DNA, 22 bp, Homo sapiens
tgccactggctcaatggtgcag

SEQ ID NO: 7718043 - DNA, 22 bp, Homo sapiens
tgccactggctcaatggtgcag

SEQ ID NO: 7718044 - DNA, 22 bp, Homo sapiens
tgccaccttgtgcagcaggagg

SEQ ID NO: 7718045 - DNA, 22 bp, Homo sapiens
tgccactggacccagaactctt

SEQ ID NO: 7718046 - DNA, 22 bp, Homo sapiens
tgccactgggcatgcagatgtc

SEQ ID NO: 7718047 - DNA, 22 bp, Homo sapiens
tgccactgggcatgcagatgtc

SEQ ID NO: 7718048 - DNA, 22 bp, Homo sapiens
tgccactggggctaggactgtt

SEQ ID NO: 7718049 - DNA, 22 bp, Homo sapiens
tgccactggggctaggactgtt

SEQ ID NO: 7718050 - DNA, 22 bp, Homo sapiens
tgccagactctggggtgctaga

SEQ ID NO: 7718051 - DNA, 22 bp, Homo sapiens
tgccagactttaatttgatgat

SEQ ID NO: 7718052 - DNA, 22 bp, Homo sapiens
tgccagagaagacccagtcact

SEQ ID NO: 7718053 - DNA, 22 bp, Homo sapiens
tgccagagaagacccagtcact

SEQ ID NO: 7718054 - DNA, 22 bp, Homo sapiens
tgccagagaagacccagtcact

SEQ ID NO: 7718055 - DNA, 22 bp, Homo sapiens
tgccagaagtgctttataagtg

SEQ ID NO: 7718056 - DNA, 22 bp, Homo sapiens
tgccagaagattctctatcaga

SEQ ID NO: 7718057 - DNA, 22 bp, Homo sapiens
tgccagaaccattcaatgtgaa

SEQ ID NO: 7718058 - DNA, 22 bp, Homo sapiens
tgccaccctggcggcagcctgc

SEQ ID NO: 7718059 - DNA, 22 bp, Homo sapiens
tgccaccctggcggcagcctgc

SEQ ID NO: 7718060 - DNA, 22 bp, Homo sapiens
tgccaccctggcggcagcctgc

SEQ ID NO: 7718061 - DNA, 22 bp, Homo sapiens
tgccaccctctctgctacccgc

SEQ ID NO: 7718062 - DNA, 22 bp, Homo sapiens
tgccaccctctctgctacccgc

SEQ ID NO: 7718063 - DNA, 22 bp, Homo sapiens
tgccacccctctgcaccctcag

SEQ ID NO: 7718064 - DNA, 22 bp, Homo sapiens
tgccaccctctctgctacccgc

SEQ ID NO: 7718065 - DNA, 22 bp, Homo sapiens
tgccaccctctctgctacccgc

SEQ ID NO: 7718066 - DNA, 22 bp, Homo sapiens
tgccacccctctgcaccctcag

SEQ ID NO: 7718067 - DNA, 22 bp, Homo sapiens
tgccacccctctgcaccctcag

SEQ ID NO: 7718068 - DNA, 22 bp, Homo sapiens
tgccacccctctgcaccctcag

SEQ ID NO: 7718069 - DNA, 22 bp, Homo sapiens
tgccaccccggcccagagagca

SEQ ID NO: 7718070 - DNA, 22 bp, Homo sapiens
tgccaccccggcccagagagca

SEQ ID NO: 7718071 - DNA, 22 bp, Homo sapiens
tgccaccccggcccagagagca

SEQ ID NO: 7718072 - DNA, 23 bp, Homo sapiens
tgccacccttctcttcccagctt

SEQ ID NO: 7718073 - DNA, 23 bp, Homo sapiens
tgccacccttctcttcccagctt

SEQ ID NO: 7718074 - DNA, 23 bp, Homo sapiens
tgccacccttctcttcccagctt

SEQ ID NO: 7718075 - DNA, 23 bp, Homo sapiens
tgccacccttctcttcccagctt

SEQ ID NO: 7718076 - DNA, 22 bp, Homo sapiens
tgccacctagtggtctttagtc

SEQ ID NO: 7718077 - DNA, 22 bp, Homo sapiens
tgccacctcctctaacaagtgg

SEQ ID NO: 7718078 - DNA, 22 bp, Homo sapiens
tgccacctcctctaacaagtgg

SEQ ID NO: 7718079 - DNA, 22 bp, Homo sapiens
tgccacctgtacatgctatctg

SEQ ID NO: 7718080 - DNA, 22 bp, Homo sapiens
tgccaccatctggctgtgttga

SEQ ID NO: 7718081 - DNA, 22 bp, Homo sapiens
tgccaccatctggctgtgttga

SEQ ID NO: 7718082 - DNA, 22 bp, Homo sapiens
tgccacccagccaggagtggga

SEQ ID NO: 7718083 - DNA, 22 bp, Homo sapiens
tgccaccccggaccccgaagtg

SEQ ID NO: 7718084 - DNA, 22 bp, Homo sapiens
tgccacccatcatggctataat

SEQ ID NO: 7718085 - DNA, 22 bp, Homo sapiens
tgccaccccggaccccgaagtg

SEQ ID NO: 7718086 - DNA, 22 bp, Homo sapiens
tgccaccatctggctgtgttga

SEQ ID NO: 7718087 - DNA, 22 bp, Homo sapiens
tgccaccaggagaaccagtgca

SEQ ID NO: 7718088 - DNA, 22 bp, Homo sapiens
tgccaccaggagaaccagtgca

SEQ ID NO: 7718089 - DNA, 22 bp, Homo sapiens
tgccaccaggagaaccagtgca

SEQ ID NO: 7718090 - DNA, 22 bp, Homo sapiens
tgccacagtttcatggattctg

SEQ ID NO: 7718091 - DNA, 22 bp, Homo sapiens
tgccaccaggagaaccagtgca

SEQ ID NO: 7718092 - DNA, 22 bp, Homo sapiens
tgccaccaggagaaccagtgca

SEQ ID NO: 7718093 - DNA, 22 bp, Homo sapiens
tgccacagttgtttgtgctcta

SEQ ID NO: 7718094 - DNA, 22 bp, Homo sapiens
tgccacagttgtttgtgctcta

SEQ ID NO: 7718095 - DNA, 22 bp, Homo sapiens
tgccacagttgtttgtgctcta

SEQ ID NO: 7718096 - DNA, 22 bp, Homo sapiens
tgccacagttgtttgtgctcta

SEQ ID NO: 7718097 - DNA, 22 bp, Homo sapiens
tgccacagttgtttgtgctcta

SEQ ID NO: 7718098 - DNA, 22 bp, Homo sapiens
tgccacatggtgcatttcctag

SEQ ID NO: 7718099 - DNA, 22 bp, Homo sapiens
tgccacatggtgcatttcctag

SEQ ID NO: 7718100 - DNA, 22 bp, Homo sapiens
tgccacagtttcatggattctg

SEQ ID NO: 7718101 - DNA, 22 bp, Homo sapiens
tgccacagttgtttgtgctcta

SEQ ID NO: 7718102 - DNA, 22 bp, Homo sapiens
tgccacagttgtttgtgctcta

SEQ ID NO: 7718103 - DNA, 22 bp, Homo sapiens
tgccacagttgtttgtgctcta

SEQ ID NO: 7718104 - DNA, 22 bp, Homo sapiens
tgccacagttgtttgtgctcta

SEQ ID NO: 7718105 - DNA, 22 bp, Homo sapiens
tgccacagggtcctcaggccag

SEQ ID NO: 7718106 - DNA, 22 bp, Homo sapiens
tgccacagggtcctcaggccag

SEQ ID NO: 7718107 - DNA, 22 bp, Homo sapiens
tgccacagggtcctcaggccag

SEQ ID NO: 7718108 - DNA, 22 bp, Homo sapiens
tgccacagggtcctcaggccag

SEQ ID NO: 7718109 - DNA, 22 bp, Homo sapiens
tgccacagggtcctcaggccag

SEQ ID NO: 7718110 - DNA, 22 bp, Homo sapiens
tgccacaggcaatccctgcacg

SEQ ID NO: 7718111 - DNA, 22 bp, Homo sapiens
tgccacaggcaatccctgcacg

SEQ ID NO: 7718112 - DNA, 22 bp, Homo sapiens
tgccacaggcaatccctgcacg

SEQ ID NO: 7718113 - DNA, 22 bp, Homo sapiens
tgccacaggcaatccctgcacg

SEQ ID NO: 7718114 - DNA, 22 bp, Homo sapiens
tgccacaggcaatccctgcacg

SEQ ID NO: 7718115 - DNA, 22 bp, Homo sapiens
tgccaaattgccctataaatga

SEQ ID NO: 7718116 - DNA, 22 bp, Homo sapiens
tgccaaattgaattacataatt

SEQ ID NO: 7718117 - DNA, 22 bp, Homo sapiens
tgccaaattgaattacataatt

SEQ ID NO: 7718118 - DNA, 17 bp, Homo sapiens
tgccaagaagagcagag

SEQ ID NO: 7718119 - DNA, 17 bp, Homo sapiens
tgccaagaagagcagag

SEQ ID NO: 7718120 - DNA, 22 bp, Homo sapiens
tgcatttgagttgggagcaggc

SEQ ID NO: 7718121 - DNA, 22 bp, Homo sapiens
tgcatttgagttgggagcaggc

SEQ ID NO: 7718122 - DNA, 22 bp, Homo sapiens
tgcatttgaagtcagacaggct

SEQ ID NO: 7718123 - DNA, 22 bp, Homo sapiens
tgcatttgaagtcagacaggct

SEQ ID NO: 7718124 - DNA, 22 bp, Homo sapiens
tgcatttgaagtcagacaggct

SEQ ID NO: 7718125 - DNA, 22 bp, Homo sapiens
tgcatttgctggggatgtgatt

SEQ ID NO: 7718126 - DNA, 23 bp, Homo sapiens
tgcatttgcaattgcagtaaggt

SEQ ID NO: 7718127 - DNA, 22 bp, Homo sapiens
tgcatttgagttgggagcaggc

SEQ ID NO: 7718128 - DNA, 21 bp, Homo sapiens
tgcatttctaactagttgacc

SEQ ID NO: 7718129 - DNA, 22 bp, Homo sapiens
tgcatttccagatttctggagt

SEQ ID NO: 7718130 - DNA, 22 bp, Homo sapiens
tgcatttcagaagaaaattcgg

SEQ ID NO: 7718131 - DNA, 22 bp, Homo sapiens
tgcatttccagatttctggagt

SEQ ID NO: 7718132 - DNA, 22 bp, Homo sapiens
tgcatttcagaagaaaattcgg

SEQ ID NO: 7718133 - DNA, 22 bp, Homo sapiens
tgcatttagttttaataaagga

SEQ ID NO: 7718134 - DNA, 22 bp, Homo sapiens
tgcatttagttttaataaagga

SEQ ID NO: 7718135 - DNA, 22 bp, Homo sapiens
tgcatttagttttaataaagga

SEQ ID NO: 7718136 - DNA, 22 bp, Homo sapiens
tgcatttatggagcaaggcagt

SEQ ID NO: 7718137 - DNA, 22 bp, Homo sapiens
tgcatttatggagcaaggcagt

SEQ ID NO: 7718138 - DNA, 22 bp, Homo sapiens
tgcatttatggagcaaggcagt

SEQ ID NO: 7718139 - DNA, 22 bp, Homo sapiens
tgcatttatggagttacctcat

SEQ ID NO: 7718140 - DNA, 22 bp, Homo sapiens
tgcatttatggagttacctcat

SEQ ID NO: 7718141 - DNA, 22 bp, Homo sapiens
tgcatttattaccaggctttca

SEQ ID NO: 7718142 - DNA, 22 bp, Homo sapiens
tgcatttatttgaattgatcta

SEQ ID NO: 7718143 - DNA, 22 bp, Homo sapiens
tgcatttatttgaattgatcta

SEQ ID NO: 7718144 - DNA, 22 bp, Homo sapiens
tgcatttattaccaggctttca

SEQ ID NO: 7718145 - DNA, 22 bp, Homo sapiens
tgcatttcagaagaaaattcgg

SEQ ID NO: 7718146 - DNA, 22 bp, Homo sapiens
tgcatttatttgaattgatcta

SEQ ID NO: 7718147 - DNA, 22 bp, Homo sapiens
tgcatttatttgaattgatcta

SEQ ID NO: 7718148 - DNA, 22 bp, Homo sapiens
tgcattttcttccaccaatatc

SEQ ID NO: 7718149 - DNA, 22 bp, Homo sapiens
tgcattttcttccaccaatatc

SEQ ID NO: 7718150 - DNA, 22 bp, Homo sapiens
tgcattttcttccaccaatatc

SEQ ID NO: 7718151 - DNA, 22 bp, Homo sapiens
tgcattttcttccaccaatatc

SEQ ID NO: 7718152 - DNA, 22 bp, Homo sapiens
tgcatttttaacaaggctaatt

SEQ ID NO: 7718153 - DNA, 22 bp, Homo sapiens
tgcatttttaacaaggctaatt

SEQ ID NO: 7718154 - DNA, 22 bp, Homo sapiens
tgcatttgttcagtgaaatgtt

SEQ ID NO: 7718155 - DNA, 22 bp, Homo sapiens
tgcatttgttcagtgaaatgtt

SEQ ID NO: 7718156 - DNA, 22 bp, Homo sapiens
tgcattttacttacctgttagt

SEQ ID NO: 7718157 - DNA, 22 bp, Homo sapiens
tgcattttacttacctgttagt

SEQ ID NO: 7718158 - DNA, 22 bp, Homo sapiens
tgcattttacttacctgttagt

SEQ ID NO: 7718159 - DNA, 22 bp, Homo sapiens
tgcattttacttacctgttagt

SEQ ID NO: 7718160 - DNA, 22 bp, Homo sapiens
tgcatttgtaacattcaagaat

SEQ ID NO: 7718161 - DNA, 22 bp, Homo sapiens
tgcatttggggcagactagcag

SEQ ID NO: 7718162 - DNA, 20 bp, Homo sapiens
tgcatttgttatttgtactc

SEQ ID NO: 7718163 - DNA, 20 bp, Homo sapiens
tgcatttgttatttgtactc

SEQ ID NO: 7718164 - DNA, 22 bp, Homo sapiens
tgcatttgttaccttattgcag

SEQ ID NO: 7718165 - DNA, 22 bp, Homo sapiens
tgcatttgtcttgtctcatgaa

SEQ ID NO: 7718166 - DNA, 22 bp, Homo sapiens
tgcatttgttcagtgaaatgtt

SEQ ID NO: 7718167 - DNA, 22 bp, Homo sapiens
tgccaaaatgggctttataccg

SEQ ID NO: 7718168 - DNA, 22 bp, Homo sapiens
tgcatttttgataactgtgtac

SEQ ID NO: 7718169 - DNA, 22 bp, Homo sapiens
tgccaaaatggccaaaagctag

SEQ ID NO: 7718170 - DNA, 22 bp, Homo sapiens
tgccaaaatggccaaaagctag

SEQ ID NO: 7718171 - DNA, 22 bp, Homo sapiens
tgccaaaatggccaaaagctag

SEQ ID NO: 7718172 - DNA, 22 bp, Homo sapiens
tgcatttttgataactgtgtac

SEQ ID NO: 7718173 - DNA, 22 bp, Homo sapiens
tgcatttttgataactgtgtac

SEQ ID NO: 7718174 - DNA, 22 bp, Homo sapiens
tgcatttttgaggttaactcaa

SEQ ID NO: 7718175 - DNA, 22 bp, Homo sapiens
tgcatttttgaggttaactcaa

SEQ ID NO: 7718176 - DNA, 22 bp, Homo sapiens
tgcatttttgaggttaactcaa

SEQ ID NO: 7718177 - DNA, 19 bp, Homo sapiens
tgccaaatccatgcccagg

SEQ ID NO: 7718178 - DNA, 22 bp, Homo sapiens
tgccaaattagagttcccaggc

SEQ ID NO: 7718179 - DNA, 22 bp, Homo sapiens
tgccaaatgccaccacagctgc

SEQ ID NO: 7718180 - DNA, 23 bp, Homo sapiens
tgccaaagtttacctaacactgg

SEQ ID NO: 7718181 - DNA, 22 bp, Homo sapiens
tgccaaaatgggctttataccg

SEQ ID NO: 7718182 - DNA, 22 bp, Homo sapiens
tgcattgggttgacatactaaa

SEQ ID NO: 7718183 - DNA, 22 bp, Homo sapiens
tgcattgggttgacatactaaa

SEQ ID NO: 7718184 - DNA, 22 bp, Homo sapiens
tgcattggaaactcagcagcac

SEQ ID NO: 7718185 - DNA, 22 bp, Homo sapiens
tgcattgggagtcagtgctgaa

SEQ ID NO: 7718186 - DNA, 22 bp, Homo sapiens
tgcattgggagagattagggca

SEQ ID NO: 7718187 - DNA, 22 bp, Homo sapiens
tgcattggtcatttagaaaata

SEQ ID NO: 7718188 - DNA, 22 bp, Homo sapiens
tgcattggtcatttagaaaata

SEQ ID NO: 7718189 - DNA, 22 bp, Homo sapiens
tgcattggtaaaatacatacac

SEQ ID NO: 7718190 - DNA, 22 bp, Homo sapiens
tgcattggtcttaatcttcagg

SEQ ID NO: 7718191 - DNA, 22 bp, Homo sapiens
tgcattggtcatttgaaaatat

SEQ ID NO: 7718192 - DNA, 22 bp, Homo sapiens
tgcattggtcttaatcttcagg

SEQ ID NO: 7718193 - DNA, 22 bp, Homo sapiens
tgcattggaaactcagcagcac

SEQ ID NO: 7718194 - DNA, 22 bp, Homo sapiens
tgcattgcctctattcattata

SEQ ID NO: 7718195 - DNA, 22 bp, Homo sapiens
tgcattggaaaactatggctca

SEQ ID NO: 7718196 - DNA, 22 bp, Homo sapiens
tgcattggaaaactatggctca

SEQ ID NO: 7718197 - DNA, 19 bp, Homo sapiens
tgcattgagggctgtctca

SEQ ID NO: 7718198 - DNA, 22 bp, Homo sapiens
tgcattgagtcatttcagtatg

SEQ ID NO: 7718199 - DNA, 22 bp, Homo sapiens
tgcattgatagaaaaacatgga

SEQ ID NO: 7718200 - DNA, 22 bp, Homo sapiens
tgcattctgacttagttaatat

SEQ ID NO: 7718201 - DNA, 22 bp, Homo sapiens
tgcattctgacttagttaatat

SEQ ID NO: 7718202 - DNA, 22 bp, Homo sapiens
tgcattctgaacgtaaatgtga

SEQ ID NO: 7718203 - DNA, 22 bp, Homo sapiens
tgcattcttggaagaagctctc

SEQ ID NO: 7718204 - DNA, 22 bp, Homo sapiens
tgcattcttggaagaagctctc

SEQ ID NO: 7718205 - DNA, 22 bp, Homo sapiens
tgcattcttggaagaagctctc

SEQ ID NO: 7718206 - DNA, 22 bp, Homo sapiens
tgcattgagaatttctcaggga

SEQ ID NO: 7718207 - DNA, 22 bp, Homo sapiens
tgcattgagattttaaaattca

SEQ ID NO: 7718208 - DNA, 21 bp, Homo sapiens
tgcattcctccatccaacagg

SEQ ID NO: 7718209 - DNA, 22 bp, Homo sapiens
tgcattcctccacctcctgcac

SEQ ID NO: 7718210 - DNA, 21 bp, Homo sapiens
tgcattcctccatccaacagg

SEQ ID NO: 7718211 - DNA, 22 bp, Homo sapiens
tgcattcctttagcagatttga

SEQ ID NO: 7718212 - DNA, 22 bp, Homo sapiens
tgcattcctttagcagatttga

SEQ ID NO: 7718213 - DNA, 22 bp, Homo sapiens
tgcattcctttctaggatagct

SEQ ID NO: 7718214 - DNA, 22 bp, Homo sapiens
tgcattcctttgtctgttaaag

SEQ ID NO: 7718215 - DNA, 22 bp, Homo sapiens
tgcatttacctggaggtcattt

SEQ ID NO: 7718216 - DNA, 22 bp, Homo sapiens
tgcatttacctggaggtcattt

SEQ ID NO: 7718217 - DNA, 22 bp, Homo sapiens
tgcatttacctggaggtcattt

SEQ ID NO: 7718218 - DNA, 20 bp, Homo sapiens
tgcatttacagtgtggatac

SEQ ID NO: 7718219 - DNA, 18 bp, Homo sapiens
tgcatttagtacatctag

SEQ ID NO: 7718220 - DNA, 18 bp, Homo sapiens
tgcatttagtacatctag

SEQ ID NO: 7718221 - DNA, 18 bp, Homo sapiens
tgcatttagtacatctag

SEQ ID NO: 7718222 - DNA, 22 bp, Homo sapiens
tgcatttacctggaggtcattt

SEQ ID NO: 7718223 - DNA, 22 bp, Homo sapiens
tgcatttacggtacaacagcag

SEQ ID NO: 7718224 - DNA, 22 bp, Homo sapiens
tgcatttagttatgagaaaaac

SEQ ID NO: 7718225 - DNA, 22 bp, Homo sapiens
tgcatttagttatgagaaaaac

SEQ ID NO: 7718226 - DNA, 22 bp, Homo sapiens
tgcatttagttatgagaaaaac

SEQ ID NO: 7718227 - DNA, 22 bp, Homo sapiens
tgcatttagttatgagaaaaac

SEQ ID NO: 7718228 - DNA, 22 bp, Homo sapiens
tgcatttagttttaataaagga

SEQ ID NO: 7718229 - DNA, 22 bp, Homo sapiens
tgcatttagttttaataaagga

SEQ ID NO: 7718230 - DNA, 22 bp, Homo sapiens
tgcatttagttttaataaagga

SEQ ID NO: 7718231 - DNA, 18 bp, Homo sapiens
tgcatttagtacatctag

SEQ ID NO: 7718232 - DNA, 18 bp, Homo sapiens
tgcatttagtacatctag

SEQ ID NO: 7718233 - DNA, 18 bp, Homo sapiens
tgcatttagtacatctag

SEQ ID NO: 7718234 - DNA, 22 bp, Homo sapiens
tgcatttagttatgagaaaaac

SEQ ID NO: 7718235 - DNA, 22 bp, Homo sapiens
tgcatttagttatgagaaaaac

SEQ ID NO: 7718236 - DNA, 22 bp, Homo sapiens
tgcatttaagaaaacatgagtc

SEQ ID NO: 7718237 - DNA, 22 bp, Homo sapiens
tgcatttaagaaaacatgagtc

SEQ ID NO: 7718238 - DNA, 22 bp, Homo sapiens
tgcatttaagaaaacatgagtc

SEQ ID NO: 7718239 - DNA, 22 bp, Homo sapiens
tgcatttaactagaatattaat

SEQ ID NO: 7718240 - DNA, 22 bp, Homo sapiens
tgcatttaactagaatattaat

SEQ ID NO: 7718241 - DNA, 22 bp, Homo sapiens
tgcatttaactagaatattaat

SEQ ID NO: 7718242 - DNA, 22 bp, Homo sapiens
tgcatttaactagaatattaat

SEQ ID NO: 7718243 - DNA, 22 bp, Homo sapiens
tgcatttaagaaaacatgagtc

SEQ ID NO: 7718244 - DNA, 22 bp, Homo sapiens
tgcatttaatagatgctccctg

SEQ ID NO: 7718245 - DNA, 20 bp, Homo sapiens
tgcatttacagtgtggatac

SEQ ID NO: 7718246 - DNA, 17 bp, Homo sapiens
tgcattgttggaaattt

SEQ ID NO: 7718247 - DNA, 21 bp, Homo sapiens
tgcatttaacagaaacaggaa

SEQ ID NO: 7718248 - DNA, 21 bp, Homo sapiens
tgcatttaacagaaacaggaa

SEQ ID NO: 7718249 - DNA, 21 bp, Homo sapiens
tgcatttaacagaaacaggaa

SEQ ID NO: 7718250 - DNA, 22 bp, Homo sapiens
tgcattgttgatgagttgaata

SEQ ID NO: 7718251 - DNA, 22 bp, Homo sapiens
tgcattgttgaccagttgtgca

SEQ ID NO: 7718252 - DNA, 22 bp, Homo sapiens
tgcattgggagagattagggca

SEQ ID NO: 7718253 - DNA, 22 bp, Homo sapiens
tgcatctttgcttggctccttc

SEQ ID NO: 7718254 - DNA, 22 bp, Homo sapiens
tgcatgaacggagggtaagctg

SEQ ID NO: 7718255 - DNA, 22 bp, Homo sapiens
tgcatctgttcattcgttccca

SEQ ID NO: 7718256 - DNA, 22 bp, Homo sapiens
tgcatctgttcagagctgtcga

SEQ ID NO: 7718257 - DNA, 22 bp, Homo sapiens
tgcatctgttcagagctgtcga

SEQ ID NO: 7718258 - DNA, 22 bp, Homo sapiens
tgcatcttagcaatgaccgagt

SEQ ID NO: 7718259 - DNA, 21 bp, Homo sapiens
tgcatcttcaaggttggcagg

SEQ ID NO: 7718260 - DNA, 22 bp, Homo sapiens
tgcatcttacgttttgaaaggg

SEQ ID NO: 7718261 - DNA, 19 bp, Homo sapiens
tgcatcttgcatgggtgag

SEQ ID NO: 7718262 - DNA, 22 bp, Homo sapiens
tgcatcttcagtaggaactctc

SEQ ID NO: 7718263 - DNA, 22 bp, Homo sapiens
tgcatcttggaagattgcacaa

SEQ ID NO: 7718264 - DNA, 22 bp, Homo sapiens
tgcatctttctgcatatgtaaa

SEQ ID NO: 7718265 - DNA, 22 bp, Homo sapiens
tgcatgcaaagtgtctgctttg

SEQ ID NO: 7718266 - DNA, 22 bp, Homo sapiens
tgcatgcaacaattcttctata

SEQ ID NO: 7718267 - DNA, 22 bp, Homo sapiens
tgcatgcaaaaaaatctgcatt

SEQ ID NO: 7718268 - DNA, 22 bp, Homo sapiens
tgcatgatagagatggtattag

SEQ ID NO: 7718269 - DNA, 22 bp, Homo sapiens
tgcatgatagagatggtattag

SEQ ID NO: 7718270 - DNA, 22 bp, Homo sapiens
tgcatgatagagatggtattag

SEQ ID NO: 7718271 - DNA, 22 bp, Homo sapiens
tgcatgatgttaaacatcaggt

SEQ ID NO: 7718272 - DNA, 22 bp, Homo sapiens
tgcatgatggtttagatggggt

SEQ ID NO: 7718273 - DNA, 22 bp, Homo sapiens
tgcatgatgactaaggtggtga

SEQ ID NO: 7718274 - DNA, 22 bp, Homo sapiens
tgcatgatgactaaggtggtga

SEQ ID NO: 7718275 - DNA, 22 bp, Homo sapiens
tgcatgcacgtgctatgtatga

SEQ ID NO: 7718276 - DNA, 22 bp, Homo sapiens
tgcatgcactatctagatgatg

SEQ ID NO: 7718277 - DNA, 22 bp, Homo sapiens
tgcatgcacttggctggcacgt

SEQ ID NO: 7718278 - DNA, 22 bp, Homo sapiens
tgcatgcagcatatgaggcctc

SEQ ID NO: 7718279 - DNA, 22 bp, Homo sapiens
tgcatgcacttggctggcacgt

SEQ ID NO: 7718280 - DNA, 22 bp, Homo sapiens
tgcatgcacttggctggcacgt

SEQ ID NO: 7718281 - DNA, 22 bp, Homo sapiens
tgcatgcacgtgctatgtatga

SEQ ID NO: 7718282 - DNA, 22 bp, Homo sapiens
tgcatgcacgtatctgcgtgtg

SEQ ID NO: 7718283 - DNA, 22 bp, Homo sapiens
tgcatgcacgtatctgcgtgtg

SEQ ID NO: 7718284 - DNA, 22 bp, Homo sapiens
tgcatgcaaaaaaatctgcatt

SEQ ID NO: 7718285 - DNA, 22 bp, Homo sapiens
tgcatgcacccagccgggtatt

SEQ ID NO: 7718286 - DNA, 22 bp, Homo sapiens
tgcatgcaacaattcttctata

SEQ ID NO: 7718287 - DNA, 22 bp, Homo sapiens
tgcatgcaacaattcttctata

SEQ ID NO: 7718288 - DNA, 22 bp, Homo sapiens
tgcatgcaatgtgaagaaagct

SEQ ID NO: 7718289 - DNA, 22 bp, Homo sapiens
tgcatgcacatgtaggtatggt

SEQ ID NO: 7718290 - DNA, 22 bp, Homo sapiens
tgcatgctaagaaatagcagct

SEQ ID NO: 7718291 - DNA, 22 bp, Homo sapiens
tgcatgctaagaaatagcagct

SEQ ID NO: 7718292 - DNA, 21 bp, Homo sapiens
tgcatgctatgtttttatttc

SEQ ID NO: 7718293 - DNA, 21 bp, Homo sapiens
tgcatgctatgtttttatttc

SEQ ID NO: 7718294 - DNA, 22 bp, Homo sapiens
tgcatgcgttagttggcgtgtt

SEQ ID NO: 7718295 - DNA, 22 bp, Homo sapiens
tgcatgcatgtttttacccaca

SEQ ID NO: 7718296 - DNA, 22 bp, Homo sapiens
tgcatgcgttagttggcgtgtt

SEQ ID NO: 7718297 - DNA, 17 bp, Homo sapiens
tgcatgcgtctgtgata

SEQ ID NO: 7718298 - DNA, 17 bp, Homo sapiens
tgcatgcgtctgtgata

SEQ ID NO: 7718299 - DNA, 22 bp, Homo sapiens
tgcatgcatgtgagcatgcata

SEQ ID NO: 7718300 - DNA, 22 bp, Homo sapiens
tgcatgcatgtttttacccaca

SEQ ID NO: 7718301 - DNA, 22 bp, Homo sapiens
tgcatgcatgtgagcatgcata

SEQ ID NO: 7718302 - DNA, 22 bp, Homo sapiens
tgcatgcatgctactgggaggt

SEQ ID NO: 7718303 - DNA, 22 bp, Homo sapiens
tgcatgcatgatgtttggtagc

SEQ ID NO: 7718304 - DNA, 22 bp, Homo sapiens
tgcatgcatgctactgggaggt

SEQ ID NO: 7718305 - DNA, 22 bp, Homo sapiens
tgcatgcatgctactgggaggt

SEQ ID NO: 7718306 - DNA, 22 bp, Homo sapiens
tgcatgcatgatgtttggtagc

SEQ ID NO: 7718307 - DNA, 22 bp, Homo sapiens
tgcatgcataaatgtacacaca

SEQ ID NO: 7718308 - DNA, 22 bp, Homo sapiens
tgcatgcataaatgtacacaca

SEQ ID NO: 7718309 - DNA, 22 bp, Homo sapiens
tgcatgcataaatgtacacaca

SEQ ID NO: 7718310 - DNA, 22 bp, Homo sapiens
tgcatgcagctggtgataagaa

SEQ ID NO: 7718311 - DNA, 22 bp, Homo sapiens
tgcatgcagctggtgataagaa

SEQ ID NO: 7718312 - DNA, 22 bp, Homo sapiens
tgcatgcagcatatgaggcctc

SEQ ID NO: 7718313 - DNA, 22 bp, Homo sapiens
tgcatgcagctggtcgggcgcc

SEQ ID NO: 7718314 - DNA, 22 bp, Homo sapiens
tgcatgcttcaggctggctctg

SEQ ID NO: 7718315 - DNA, 22 bp, Homo sapiens
tgcatgcttcctgtaagtacct

SEQ ID NO: 7718316 - DNA, 22 bp, Homo sapiens
tgcatgctttattttcatgtgt

SEQ ID NO: 7718317 - DNA, 22 bp, Homo sapiens
tgcatgctgcacacatgcgtag

SEQ ID NO: 7718318 - DNA, 22 bp, Homo sapiens
tgcatgcttcccttctcccagc

SEQ ID NO: 7718319 - DNA, 22 bp, Homo sapiens
tgcatgcttcctgtaagtacct

SEQ ID NO: 7718320 - DNA, 21 bp, Homo sapiens
tgcatgctatgtttttatttc

SEQ ID NO: 7718321 - DNA, 22 bp, Homo sapiens
tgcatgctctgtagaaagcagg

SEQ ID NO: 7718322 - DNA, 22 bp, Homo sapiens
tgcatggaacggtctcctggtc

SEQ ID NO: 7718323 - DNA, 22 bp, Homo sapiens
tgcatggaattatgggagtggt

SEQ ID NO: 7718324 - DNA, 22 bp, Homo sapiens
tgcatggagatatactatttga

SEQ ID NO: 7718325 - DNA, 22 bp, Homo sapiens
tgcatggagatatactatttga

SEQ ID NO: 7718326 - DNA, 22 bp, Homo sapiens
tgcatggagatatactatttga

SEQ ID NO: 7718327 - DNA, 22 bp, Homo sapiens
tgcatggactcatcagacaaga

SEQ ID NO: 7718328 - DNA, 22 bp, Homo sapiens
tgcatgtcaaggcactcaggat

SEQ ID NO: 7718329 - DNA, 22 bp, Homo sapiens
tgcatgtatgtgctcacatgtg

SEQ ID NO: 7718330 - DNA, 22 bp, Homo sapiens
tgcatgtatttaaagttgcaat

SEQ ID NO: 7718331 - DNA, 23 bp, Homo sapiens
tgcatgtgaattcatacttgttt

SEQ ID NO: 7718332 - DNA, 17 bp, Homo sapiens
tgcatgtcctttgttcc

SEQ ID NO: 7718333 - DNA, 17 bp, Homo sapiens
tgcatgtcctttgttcc

SEQ ID NO: 7718334 - DNA, 17 bp, Homo sapiens
tgcatgtcctttgttcc

SEQ ID NO: 7718335 - DNA, 22 bp, Homo sapiens
tgcatgtggacccctggtgcct

SEQ ID NO: 7718336 - DNA, 22 bp, Homo sapiens
tgcatgtggacccctggtgcct

SEQ ID NO: 7718337 - DNA, 23 bp, Homo sapiens
tgcatgtgaattcatacttgttt

SEQ ID NO: 7718338 - DNA, 22 bp, Homo sapiens
tgcatgtgcccactctggctta

SEQ ID NO: 7718339 - DNA, 22 bp, Homo sapiens
tgcatgtctttagcatttgtta

SEQ ID NO: 7718340 - DNA, 17 bp, Homo sapiens
tgcatgtcctttgttcc

SEQ ID NO: 7718341 - DNA, 22 bp, Homo sapiens
tgcatggaggaagatgaatgca

SEQ ID NO: 7718342 - DNA, 21 bp, Homo sapiens
tgcatggaggaaagttataga

SEQ ID NO: 7718343 - DNA, 22 bp, Homo sapiens
tgcatggataaaagtatattat

SEQ ID NO: 7718344 - DNA, 22 bp, Homo sapiens
tgcatggagtaattgatgcttg

SEQ ID NO: 7718345 - DNA, 22 bp, Homo sapiens
tgcatggaggataataattgag

SEQ ID NO: 7718346 - DNA, 22 bp, Homo sapiens
tgcatggaggataataattgag

SEQ ID NO: 7718347 - DNA, 22 bp, Homo sapiens
tgcatggaggataataattgag

SEQ ID NO: 7718348 - DNA, 22 bp, Homo sapiens
tgcatggttatatactactagt

SEQ ID NO: 7718349 - DNA, 22 bp, Homo sapiens
tgcatggtaaccaggatgtcta

SEQ ID NO: 7718350 - DNA, 23 bp, Homo sapiens
tgcatggggctatactgctgttc

SEQ ID NO: 7718351 - DNA, 22 bp, Homo sapiens
tgcatggtgaatacagttcatt

SEQ ID NO: 7718352 - DNA, 23 bp, Homo sapiens
tgcatggggctatactgctgttc

SEQ ID NO: 7718353 - DNA, 20 bp, Homo sapiens
tgcatggcgcacatctgtgg

SEQ ID NO: 7718354 - DNA, 22 bp, Homo sapiens
tgcatgtgtgacaaggacagtt

SEQ ID NO: 7718355 - DNA, 22 bp, Homo sapiens
tgcatgtgtcgggcctgtgcta

SEQ ID NO: 7718356 - DNA, 22 bp, Homo sapiens
tgcatgtgtcgggcctgtgcta

SEQ ID NO: 7718357 - DNA, 22 bp, Homo sapiens
tgcatgtggatcatatgtccta

SEQ ID NO: 7718358 - DNA, 22 bp, Homo sapiens
tgcatgtggacccctggtgcct

SEQ ID NO: 7718359 - DNA, 22 bp, Homo sapiens
tgcatgtggatcatatgtccta

SEQ ID NO: 7718360 - DNA, 22 bp, Homo sapiens
tgcatgtgtcgggcctgtgcta

SEQ ID NO: 7718361 - DNA, 22 bp, Homo sapiens
tgcatgtgtgtgtatttataaa

SEQ ID NO: 7718362 - DNA, 22 bp, Homo sapiens
tgcatgtgtttcccagcaagct

SEQ ID NO: 7718363 - DNA, 22 bp, Homo sapiens
tgcatgtgtttcccagcaagct

SEQ ID NO: 7718364 - DNA, 22 bp, Homo sapiens
tgcattccacagaagggaaaac

SEQ ID NO: 7718365 - DNA, 22 bp, Homo sapiens
tgcattccacacccatagagat

SEQ ID NO: 7718366 - DNA, 22 bp, Homo sapiens
tgcattccacagtagtattttg

SEQ ID NO: 7718367 - DNA, 22 bp, Homo sapiens
tgcattccacataaagcgataa

SEQ ID NO: 7718368 - DNA, 22 bp, Homo sapiens
tgcattccacagaagggaaaac

SEQ ID NO: 7718369 - DNA, 22 bp, Homo sapiens
tgcattccatgtgtttcctgag

SEQ ID NO: 7718370 - DNA, 22 bp, Homo sapiens
tgcattccatgtgtttcctgag

SEQ ID NO: 7718371 - DNA, 22 bp, Homo sapiens
tgcattccatgtgtttcctgag

SEQ ID NO: 7718372 - DNA, 23 bp, Homo sapiens
tgcattcctcacagggcagaaga

SEQ ID NO: 7718373 - DNA, 22 bp, Homo sapiens
tgcattcctccacctcctgcac

SEQ ID NO: 7718374 - DNA, 22 bp, Homo sapiens
tgcatgtgtttgccacagtgag

SEQ ID NO: 7718375 - DNA, 22 bp, Homo sapiens
tgcatgttatagaattttaact

SEQ ID NO: 7718376 - DNA, 22 bp, Homo sapiens
tgcatgttaagaaaatattgag

SEQ ID NO: 7718377 - DNA, 22 bp, Homo sapiens
tgcatgtttataacagatgagg

SEQ ID NO: 7718378 - DNA, 22 bp, Homo sapiens
tgcatgtttctgtatgttaatg

SEQ ID NO: 7718379 - DNA, 22 bp, Homo sapiens
tgcatgtttataacagatgagg

SEQ ID NO: 7718380 - DNA, 22 bp, Homo sapiens
tgcatgttccaactccatcact

SEQ ID NO: 7718381 - DNA, 20 bp, Homo sapiens
tgcatagttgctgcagttga

SEQ ID NO: 7718382 - DNA, 22 bp, Homo sapiens
tgcatatacccgcatttacata

SEQ ID NO: 7718383 - DNA, 22 bp, Homo sapiens
tgcatatacccgcatttacata

SEQ ID NO: 7718384 - DNA, 22 bp, Homo sapiens
tgcatagtcgctctgtgcttca

SEQ ID NO: 7718385 - DNA, 22 bp, Homo sapiens
tgcataggtgccaagtgggctt

SEQ ID NO: 7718386 - DNA, 22 bp, Homo sapiens
tgcatagaggatccagtgtggt

SEQ ID NO: 7718387 - DNA, 22 bp, Homo sapiens
tgcatagaggatccagtgtggt

SEQ ID NO: 7718388 - DNA, 22 bp, Homo sapiens
tgcatagggaacctcatgcatt

SEQ ID NO: 7718389 - DNA, 22 bp, Homo sapiens
tgcatagggttcaaaggctgta

SEQ ID NO: 7718390 - DNA, 22 bp, Homo sapiens
tgcatagggaacctcatgcatt

SEQ ID NO: 7718391 - DNA, 22 bp, Homo sapiens
tgcatacatgtttgtgtatttt

SEQ ID NO: 7718392 - DNA, 20 bp, Homo sapiens
tgcatacgtatgtatttgga

SEQ ID NO: 7718393 - DNA, 22 bp, Homo sapiens
tgcatactgaacagcatgctaa

SEQ ID NO: 7718394 - DNA, 22 bp, Homo sapiens
tgcatactgaatctgccatcac

SEQ ID NO: 7718395 - DNA, 22 bp, Homo sapiens
tgcatactgctgggggagctct

SEQ ID NO: 7718396 - DNA, 22 bp, Homo sapiens
tgcatacttgtatgtgttacat

SEQ ID NO: 7718397 - DNA, 22 bp, Homo sapiens
tgcatacttttaatgactgttt

SEQ ID NO: 7718398 - DNA, 22 bp, Homo sapiens
tgcatactgtggagatttttca

SEQ ID NO: 7718399 - DNA, 22 bp, Homo sapiens
tgcatacttggggcctccactc

SEQ ID NO: 7718400 - DNA, 22 bp, Homo sapiens
tgcatagaggatccagtgtggt

SEQ ID NO: 7718401 - DNA, 22 bp, Homo sapiens
tgcatagaggatccagtgtggt

SEQ ID NO: 7718402 - DNA, 22 bp, Homo sapiens
tgcatacataatcgagaccagt

SEQ ID NO: 7718403 - DNA, 22 bp, Homo sapiens
tgcatacataaagtgctatcat

SEQ ID NO: 7718404 - DNA, 22 bp, Homo sapiens
tgcatacataatcgagaccagt

SEQ ID NO: 7718405 - DNA, 22 bp, Homo sapiens
tgcatacataatcgagaccagt

SEQ ID NO: 7718406 - DNA, 22 bp, Homo sapiens
tgcatacataaagtgctatcat

SEQ ID NO: 7718407 - DNA, 22 bp, Homo sapiens
tgcatacataaagtgctatcat

SEQ ID NO: 7718408 - DNA, 22 bp, Homo sapiens
tgcatacacacataggtatggg

SEQ ID NO: 7718409 - DNA, 22 bp, Homo sapiens
tgcatacacaagcatacatgta

SEQ ID NO: 7718410 - DNA, 22 bp, Homo sapiens
tgcatacacaagcatacatgta

SEQ ID NO: 7718411 - DNA, 22 bp, Homo sapiens
tgcatacacaagcatacatgta

SEQ ID NO: 7718412 - DNA, 19 bp, Homo sapiens
tgcataaattatatacttt

SEQ ID NO: 7718413 - DNA, 19 bp, Homo sapiens
tgcataaattatatacttt

SEQ ID NO: 7718414 - DNA, 22 bp, Homo sapiens
tgcataatgctggacttttcaa

SEQ ID NO: 7718415 - DNA, 22 bp, Homo sapiens
tgcataactagagtaattacag

SEQ ID NO: 7718416 - DNA, 22 bp, Homo sapiens
tgcatctgattctcaggcagaa

SEQ ID NO: 7718417 - DNA, 22 bp, Homo sapiens
tgcatctggcctttgctggcta

SEQ ID NO: 7718418 - DNA, 22 bp, Homo sapiens
tgcatctgtagtggaaacctta

SEQ ID NO: 7718419 - DNA, 22 bp, Homo sapiens
tgcatctgtgctccctcttcta

SEQ ID NO: 7718420 - DNA, 22 bp, Homo sapiens
tgcatctgtagtggaaacctta

SEQ ID NO: 7718421 - DNA, 22 bp, Homo sapiens
tgcatccttaaccagcatcact

SEQ ID NO: 7718422 - DNA, 22 bp, Homo sapiens
tgcatccttaaccagcatcact

SEQ ID NO: 7718423 - DNA, 22 bp, Homo sapiens
tgcatctaagtggctaacaacc

SEQ ID NO: 7718424 - DNA, 22 bp, Homo sapiens
tgcatcgagggtattttatttg

SEQ ID NO: 7718425 - DNA, 22 bp, Homo sapiens
tgcatcgaacagtggagacaat

SEQ ID NO: 7718426 - DNA, 22 bp, Homo sapiens
tgcatcctgttctaggtttggg

SEQ ID NO: 7718427 - DNA, 22 bp, Homo sapiens
tgcatcctgttctaggtttggg

SEQ ID NO: 7718428 - DNA, 22 bp, Homo sapiens
tgcatcctcctttgtcctcttg

SEQ ID NO: 7718429 - DNA, 23 bp, Homo sapiens
tgcatcctcatttttcacacgag

SEQ ID NO: 7718430 - DNA, 18 bp, Homo sapiens
tgcatatactgcctatct

SEQ ID NO: 7718431 - DNA, 22 bp, Homo sapiens
tgcatcagagtttgctgctgct

SEQ ID NO: 7718432 - DNA, 22 bp, Homo sapiens
tgcatcagagtttgctgctgct

SEQ ID NO: 7718433 - DNA, 22 bp, Homo sapiens
tgcatcagctgtgcttcttgac

SEQ ID NO: 7718434 - DNA, 22 bp, Homo sapiens
tgcatcatataatgtctatgga

SEQ ID NO: 7718435 - DNA, 22 bp, Homo sapiens
tgcatcagtgactgaatatgag

SEQ ID NO: 7718436 - DNA, 22 bp, Homo sapiens
tgcatcatataatgtctatgga

SEQ ID NO: 7718437 - DNA, 22 bp, Homo sapiens
tgcatcagtgactgggagataa

SEQ ID NO: 7718438 - DNA, 22 bp, Homo sapiens
tgcatcatttataatgtctttg

SEQ ID NO: 7718439 - DNA, 22 bp, Homo sapiens
tgcatcctagggaaggcactga

SEQ ID NO: 7718440 - DNA, 18 bp, Homo sapiens
tgcatcatttatgggtca

SEQ ID NO: 7718441 - DNA, 19 bp, Homo sapiens
tgcatccaaagccccacca

SEQ ID NO: 7718442 - DNA, 22 bp, Homo sapiens
tgcatcatttataatgtctttg

SEQ ID NO: 7718443 - DNA, 22 bp, Homo sapiens
tgcagttttatcacatatatag

SEQ ID NO: 7718444 - DNA, 20 bp, Homo sapiens
tgcagtttgtcaaggttcct

SEQ ID NO: 7718445 - DNA, 20 bp, Homo sapiens
tgcagtttgtcaaggttcct

SEQ ID NO: 7718446 - DNA, 22 bp, Homo sapiens
tgcagtttgccctttgctcact

SEQ ID NO: 7718447 - DNA, 22 bp, Homo sapiens
tgcagtttgccctttgctcact

SEQ ID NO: 7718448 - DNA, 22 bp, Homo sapiens
tgcagtttgccctttgctcact

SEQ ID NO: 7718449 - DNA, 22 bp, Homo sapiens
tgcagtttatctagtcatccat

SEQ ID NO: 7718450 - DNA, 22 bp, Homo sapiens
tgcagtttatctagtcatccat

SEQ ID NO: 7718451 - DNA, 22 bp, Homo sapiens
tgcagtttaaacttggcaactt

SEQ ID NO: 7718452 - DNA, 22 bp, Homo sapiens
tgcagtttcctggtctctactt

SEQ ID NO: 7718453 - DNA, 22 bp, Homo sapiens
tgcagtttcctggtctctactt

SEQ ID NO: 7718454 - DNA, 22 bp, Homo sapiens
tgcagtttcctttctagtcttt

SEQ ID NO: 7718455 - DNA, 22 bp, Homo sapiens
tgcagtttcctggtctctactt

SEQ ID NO: 7718456 - DNA, 22 bp, Homo sapiens
tgcagtttcctttctagtcttt

SEQ ID NO: 7718457 - DNA, 22 bp, Homo sapiens
tgcagtttcctttctagtcttt

SEQ ID NO: 7718458 - DNA, 22 bp, Homo sapiens
tgcagttcaaggttgtacagct

SEQ ID NO: 7718459 - DNA, 22 bp, Homo sapiens
tgcagttcaaggttgtacagct

SEQ ID NO: 7718460 - DNA, 22 bp, Homo sapiens
tgcagttcaaggttgtacagct

SEQ ID NO: 7718461 - DNA, 22 bp, Homo sapiens
tgcagttcaaggttgtacagct

SEQ ID NO: 7718462 - DNA, 22 bp, Homo sapiens
tgcagtttaaacttggcaactt

SEQ ID NO: 7718463 - DNA, 22 bp, Homo sapiens
tgcagtttaaacttggcaactt

SEQ ID NO: 7718464 - DNA, 22 bp, Homo sapiens
tgcagttgaccatgctttatat

SEQ ID NO: 7718465 - DNA, 22 bp, Homo sapiens
tgcagttctatcacccaccccg

SEQ ID NO: 7718466 - DNA, 22 bp, Homo sapiens
tgcagttctatcacccaccccg

SEQ ID NO: 7718467 - DNA, 22 bp, Homo sapiens
tgcagttctaagtagacaagtc

SEQ ID NO: 7718468 - DNA, 21 bp, Homo sapiens
tgcagttcaagtcaatctact

SEQ ID NO: 7718469 - DNA, 21 bp, Homo sapiens
tgcagttcaagtcaatctact

SEQ ID NO: 7718470 - DNA, 22 bp, Homo sapiens
tgcagttctaagtagacaagtc

SEQ ID NO: 7718471 - DNA, 22 bp, Homo sapiens
tgcagttttccttcaacattgt

SEQ ID NO: 7718472 - DNA, 22 bp, Homo sapiens
tgcagttttccttcaacattgt

SEQ ID NO: 7718473 - DNA, 22 bp, Homo sapiens
tgcagttttctcacccccacaa

SEQ ID NO: 7718474 - DNA, 22 bp, Homo sapiens
tgcagttttccttcaacattgt

SEQ ID NO: 7718475 - DNA, 22 bp, Homo sapiens
tgcagttttcaaaagtttacag

SEQ ID NO: 7718476 - DNA, 22 bp, Homo sapiens
tgcagttttcaaaagtttacag

SEQ ID NO: 7718477 - DNA, 22 bp, Homo sapiens
tgcagttttatcacatatatag

SEQ ID NO: 7718478 - DNA, 22 bp, Homo sapiens
tgcagttttatcacatatatag

SEQ ID NO: 7718479 - DNA, 22 bp, Homo sapiens
tgcagttttcaaaagtttacag

SEQ ID NO: 7718480 - DNA, 22 bp, Homo sapiens
tgcagttttggccattgaaggc

SEQ ID NO: 7718481 - DNA, 21 bp, Homo sapiens
tgcagttttgcttgatctctg

SEQ ID NO: 7718482 - DNA, 21 bp, Homo sapiens
tgcagttttgcttgatctctg

SEQ ID NO: 7718483 - DNA, 21 bp, Homo sapiens
tgcagttttgcttgatctctg

SEQ ID NO: 7718484 - DNA, 22 bp, Homo sapiens
tgcagttttgccaggcaatgga

SEQ ID NO: 7718485 - DNA, 22 bp, Homo sapiens
tgcagttttctcacccccacaa

SEQ ID NO: 7718486 - DNA, 22 bp, Homo sapiens
tgcagttttgccaggcaatgga

SEQ ID NO: 7718487 - DNA, 22 bp, Homo sapiens
tgcagttttgccaggcaatgga

SEQ ID NO: 7718488 - DNA, 22 bp, Homo sapiens
tgcataaaacaccagcagggtg

SEQ ID NO: 7718489 - DNA, 22 bp, Homo sapiens
tgcataaaacatgatttctgct

SEQ ID NO: 7718490 - DNA, 22 bp, Homo sapiens
tgcataaaacaccagcagggtg

SEQ ID NO: 7718491 - DNA, 22 bp, Homo sapiens
tgcataaaatatgagaaatgta

SEQ ID NO: 7718492 - DNA, 22 bp, Homo sapiens
tgcataaaacatgatttctgct

SEQ ID NO: 7718493 - DNA, 22 bp, Homo sapiens
tgcataaaaaccacatacaagg

SEQ ID NO: 7718494 - DNA, 22 bp, Homo sapiens
tgcataaaaaccacatacaagg

SEQ ID NO: 7718495 - DNA, 22 bp, Homo sapiens
tgcagttttggccattgaaggc

SEQ ID NO: 7718496 - DNA, 22 bp, Homo sapiens
tgcagttttggccattgaaggc

SEQ ID NO: 7718497 - DNA, 22 bp, Homo sapiens
tgcataaaaaccacatacaagg

SEQ ID NO: 7718498 - DNA, 22 bp, Homo sapiens
tgcagttttggccattgaaggc

SEQ ID NO: 7718499 - DNA, 19 bp, Homo sapiens
tgcataaattatatacttt

SEQ ID NO: 7718500 - DNA, 22 bp, Homo sapiens
tgcataaatcttggaagttgtt

SEQ ID NO: 7718501 - DNA, 22 bp, Homo sapiens
tgcataaatagtacctgctttt

SEQ ID NO: 7718502 - DNA, 22 bp, Homo sapiens
tgcataaatattgttgggagta

SEQ ID NO: 7718503 - DNA, 22 bp, Homo sapiens
tgcataaatattgttgggagta

SEQ ID NO: 7718504 - DNA, 22 bp, Homo sapiens
tgcataaatattgttgggagta

SEQ ID NO: 7718505 - DNA, 22 bp, Homo sapiens
tgcataaatcttggaagttgtt

SEQ ID NO: 7718506 - DNA, 22 bp, Homo sapiens
tgcataaatcttggaagttgtt

SEQ ID NO: 7718507 - DNA, 19 bp, Homo sapiens
tgcataaattatatacttt

SEQ ID NO: 7718508 - DNA, 19 bp, Homo sapiens
tgcataaattatatacttt

SEQ ID NO: 7718509 - DNA, 19 bp, Homo sapiens
tgcataaattatatacttt

SEQ ID NO: 7718510 - DNA, 19 bp, Homo sapiens
tgcataaattatatacttt

SEQ ID NO: 7718511 - DNA, 17 bp, Homo sapiens
tgcataaagggtgagca

SEQ ID NO: 7718512 - DNA, 17 bp, Homo sapiens
tgcataaagggtgagca

SEQ ID NO: 7718513 - DNA, 22 bp, Homo sapiens
tgcataaagtgccatagtatta

SEQ ID NO: 7718514 - DNA, 22 bp, Homo sapiens
tgcataaagtgccatagtatta

SEQ ID NO: 7718515 - DNA, 22 bp, Homo sapiens
tgcataaagtgccatagtatta

SEQ ID NO: 7718516 - DNA, 22 bp, Homo sapiens
tgcataaagtgccatagtatta

SEQ ID NO: 7718517 - DNA, 22 bp, Homo sapiens
tgcataaagtgccatagtatta

SEQ ID NO: 7718518 - DNA, 22 bp, Homo sapiens
tgcataaatagtacctgctttt

SEQ ID NO: 7718519 - DNA, 22 bp, Homo sapiens
tgcataaaatatgagaaatgta

SEQ ID NO: 7718520 - DNA, 22 bp, Homo sapiens
tgcataaaatatgagaaatgta

SEQ ID NO: 7718521 - DNA, 22 bp, Homo sapiens
tgcataaaatatgagaaatgta

SEQ ID NO: 7718522 - DNA, 22 bp, Homo sapiens
tgcataaaatatgagaaatgta

SEQ ID NO: 7718523 - DNA, 22 bp, Homo sapiens
tgcataaaatatgagaaatgta

SEQ ID NO: 7718524 - DNA, 22 bp, Homo sapiens
tgcataaacagatacttcatgt

SEQ ID NO: 7718525 - DNA, 22 bp, Homo sapiens
tgcataaacagatacttcatgt

SEQ ID NO: 7718526 - DNA, 22 bp, Homo sapiens
tgcataaacagatacttcatgt

SEQ ID NO: 7718527 - DNA, 22 bp, Homo sapiens
tgcataaacagatacttcatgt

SEQ ID NO: 7718528 - DNA, 21 bp, Homo sapiens
tgcataaagaaatacaaatac

SEQ ID NO: 7718529 - DNA, 21 bp, Homo sapiens
tgcataaagaaatacaaatac

SEQ ID NO: 7718530 - DNA, 21 bp, Homo sapiens
tgcataaagaaatacaaatac

SEQ ID NO: 7718531 - DNA, 21 bp, Homo sapiens
tgcataaagaaatacaaatac

SEQ ID NO: 7718532 - DNA, 21 bp, Homo sapiens
tgcataaagaaatacaaatac

SEQ ID NO: 7718533 - DNA, 21 bp, Homo sapiens
tgcataaagaaatacaaatac

SEQ ID NO: 7718534 - DNA, 21 bp, Homo sapiens
tgcataaagaaatacaaatac

SEQ ID NO: 7718535 - DNA, 21 bp, Homo sapiens
tgcataaagaaatacaaatac

SEQ ID NO: 7718536 - DNA, 22 bp, Homo sapiens
tgcataaacttctctggtgtga

SEQ ID NO: 7718537 - DNA, 22 bp, Homo sapiens
tgcataaacttctctggtgtga

SEQ ID NO: 7718538 - DNA, 22 bp, Homo sapiens
tgcataaacttctctggtgtga

SEQ ID NO: 7718539 - DNA, 22 bp, Homo sapiens
tgcataaagaaagcctggagag

SEQ ID NO: 7718540 - DNA, 22 bp, Homo sapiens
tgcataaagaaagcctggagag

SEQ ID NO: 7718541 - DNA, 21 bp, Homo sapiens
tgcagtatgtatttgtatcca

SEQ ID NO: 7718542 - DNA, 23 bp, Homo sapiens
tgcagtcaactctaactgctaag

SEQ ID NO: 7718543 - DNA, 22 bp, Homo sapiens
tgcagtccaagagtctcctggt

SEQ ID NO: 7718544 - DNA, 22 bp, Homo sapiens
tgcagtcctaaatatatagctg

SEQ ID NO: 7718545 - DNA, 22 bp, Homo sapiens
tgcagtcctaaatatatagctg

SEQ ID NO: 7718546 - DNA, 22 bp, Homo sapiens
tgcagtctcaccagacctattt

SEQ ID NO: 7718547 - DNA, 22 bp, Homo sapiens
tgcagtctccacctcctgggtg

SEQ ID NO: 7718548 - DNA, 21 bp, Homo sapiens
tgcagtcctttgacatgattc

SEQ ID NO: 7718549 - DNA, 21 bp, Homo sapiens
tgcagtcctttgacatgattc

SEQ ID NO: 7718550 - DNA, 22 bp, Homo sapiens
tgcagtcctggtgaggggacat

SEQ ID NO: 7718551 - DNA, 22 bp, Homo sapiens
tgcagtcctggtgaggggacat

SEQ ID NO: 7718552 - DNA, 20 bp, Homo sapiens
tgcaggtgttggagaaggta

SEQ ID NO: 7718553 - DNA, 20 bp, Homo sapiens
tgcaggtgttggagaaggta

SEQ ID NO: 7718554 - DNA, 22 bp, Homo sapiens
tgcaggttctgaccagccaact

SEQ ID NO: 7718555 - DNA, 20 bp, Homo sapiens
tgcaggtgttggagaaggta

SEQ ID NO: 7718556 - DNA, 22 bp, Homo sapiens
tgcaggttctgaccagccaact

SEQ ID NO: 7718557 - DNA, 23 bp, Homo sapiens
tgcagtaggatggggctgggcct

SEQ ID NO: 7718558 - DNA, 21 bp, Homo sapiens
tgcagtatgtatttgtatcca

SEQ ID NO: 7718559 - DNA, 22 bp, Homo sapiens
tgcagtggtgtccaggtgtact

SEQ ID NO: 7718560 - DNA, 22 bp, Homo sapiens
tgcagtggtggtaaagatgctc

SEQ ID NO: 7718561 - DNA, 22 bp, Homo sapiens
tgcagtggtggtaaagatgctc

SEQ ID NO: 7718562 - DNA, 22 bp, Homo sapiens
tgcagtgggccggaggccaggg

SEQ ID NO: 7718563 - DNA, 22 bp, Homo sapiens
tgcagtctctagtttctgaatg

SEQ ID NO: 7718564 - DNA, 22 bp, Homo sapiens
tgcagtctctagtttctgaatg

SEQ ID NO: 7718565 - DNA, 22 bp, Homo sapiens
tgcagtgggccggaggccaggg

SEQ ID NO: 7718566 - DNA, 22 bp, Homo sapiens
tgcagtgggccggaggccaggg

SEQ ID NO: 7718567 - DNA, 22 bp, Homo sapiens
tgcagtggttgagagcccagac

SEQ ID NO: 7718568 - DNA, 22 bp, Homo sapiens
tgcagtggttgagagcccagac

SEQ ID NO: 7718569 - DNA, 22 bp, Homo sapiens
tgcagtggttgagagcccagac

SEQ ID NO: 7718570 - DNA, 22 bp, Homo sapiens
tgcagtgtagaaaaagagtgag

SEQ ID NO: 7718571 - DNA, 22 bp, Homo sapiens
tgcagtggttgagagcccagac

SEQ ID NO: 7718572 - DNA, 21 bp, Homo sapiens
tgcagtgtccctaacagtggt

SEQ ID NO: 7718573 - DNA, 22 bp, Homo sapiens
tgcagtgtgacctgtagcgagc

SEQ ID NO: 7718574 - DNA, 22 bp, Homo sapiens
tgcagtgtgattttctggctga

SEQ ID NO: 7718575 - DNA, 22 bp, Homo sapiens
tgcagtgtagaaaaagagtgag

SEQ ID NO: 7718576 - DNA, 22 bp, Homo sapiens
tgcagtgtcttgtggacttgag

SEQ ID NO: 7718577 - DNA, 20 bp, Homo sapiens
tgcagtgtcctcacttgtca

SEQ ID NO: 7718578 - DNA, 21 bp, Homo sapiens
tgcagtgtccctaacagtggt

SEQ ID NO: 7718579 - DNA, 20 bp, Homo sapiens
tgcagtgtcctcacttgtca

SEQ ID NO: 7718580 - DNA, 23 bp, Homo sapiens
tgcagtgtttaacaatgacttga

SEQ ID NO: 7718581 - DNA, 23 bp, Homo sapiens
tgcagtgtttaacaatgacttga

SEQ ID NO: 7718582 - DNA, 22 bp, Homo sapiens
tgcagtgttcctgtgggtttat

SEQ ID NO: 7718583 - DNA, 23 bp, Homo sapiens
tgcagtgtcgctgcgagcccggc

SEQ ID NO: 7718584 - DNA, 22 bp, Homo sapiens
tgcagtgttcctgtagcctgcc

SEQ ID NO: 7718585 - DNA, 22 bp, Homo sapiens
tgcagtgtttggatgctgagtc

SEQ ID NO: 7718586 - DNA, 22 bp, Homo sapiens
tgcagtgtttttcagggcatat

SEQ ID NO: 7718587 - DNA, 22 bp, Homo sapiens
tgcagtgtgctagatttggact

SEQ ID NO: 7718588 - DNA, 22 bp, Homo sapiens
tgcagtgtggccatgtcagcta

SEQ ID NO: 7718589 - DNA, 22 bp, Homo sapiens
tgcagtgtggccatgtcagcta

SEQ ID NO: 7718590 - DNA, 22 bp, Homo sapiens
tgcagtgtggccatgtcagcta

SEQ ID NO: 7718591 - DNA, 22 bp, Homo sapiens
tgcagtgttcctgtagcctgcc

SEQ ID NO: 7718592 - DNA, 22 bp, Homo sapiens
tgcaggtgtgggcaggggagca

SEQ ID NO: 7718593 - DNA, 22 bp, Homo sapiens
tgcaggtgtgggcaggggagca

SEQ ID NO: 7718594 - DNA, 23 bp, Homo sapiens
tgcaggtgtgcagagggctcttg

SEQ ID NO: 7718595 - DNA, 22 bp, Homo sapiens
tgcaggtgtctgggggcaacag

SEQ ID NO: 7718596 - DNA, 23 bp, Homo sapiens
tgcaggtgtgcagagggctcttg

SEQ ID NO: 7718597 - DNA, 23 bp, Homo sapiens
tgcaggtgtgcagagggctcttg

SEQ ID NO: 7718598 - DNA, 22 bp, Homo sapiens
tgcaggtgtgggcaggggagca

SEQ ID NO: 7718599 - DNA, 22 bp, Homo sapiens
tgcaggtgtgggcaggggagca

SEQ ID NO: 7718600 - DNA, 22 bp, Homo sapiens
tgcaggtgtctctgtctagcgt

SEQ ID NO: 7718601 - DNA, 22 bp, Homo sapiens
tgcaggtgtctctgtctagcgt

SEQ ID NO: 7718602 - DNA, 22 bp, Homo sapiens
tgcaggtgtctctgtctagcgt

SEQ ID NO: 7718603 - DNA, 22 bp, Homo sapiens
tgcaggtgtctgggggcaacag

SEQ ID NO: 7718604 - DNA, 22 bp, Homo sapiens
tgcaggtgtctctgtctagcgt

SEQ ID NO: 7718605 - DNA, 22 bp, Homo sapiens
tgcaggtgtctgggggcaacag

SEQ ID NO: 7718606 - DNA, 22 bp, Homo sapiens
tgcaggtgtgtgcaagggaggg

SEQ ID NO: 7718607 - DNA, 22 bp, Homo sapiens
tgcaggtgtgtgcaagggaggg

SEQ ID NO: 7718608 - DNA, 20 bp, Homo sapiens
tgcaggtgtgtccaagcact

SEQ ID NO: 7718609 - DNA, 20 bp, Homo sapiens
tgcaggtgttggagaaggta

SEQ ID NO: 7718610 - DNA, 22 bp, Homo sapiens
tgcaggtgtgtgcaagggaggg

SEQ ID NO: 7718611 - DNA, 22 bp, Homo sapiens
tgcaggtgtggttcctcagcca

SEQ ID NO: 7718612 - DNA, 20 bp, Homo sapiens
tgcaggtgtgtccaagcact

SEQ ID NO: 7718613 - DNA, 22 bp, Homo sapiens
tgcaggtgtggttcctcagcca

SEQ ID NO: 7718614 - DNA, 22 bp, Homo sapiens
tgcaggtgtgggcaggggagca

SEQ ID NO: 7718615 - DNA, 22 bp, Homo sapiens
tgcaggtgtgggcaggggagca

SEQ ID NO: 7718616 - DNA, 22 bp, Homo sapiens
tgcaggtgtgggcaggggagca

SEQ ID NO: 7718617 - DNA, 22 bp, Homo sapiens
tgcaggtgtgggcaggggagca

SEQ ID NO: 7718618 - DNA, 22 bp, Homo sapiens
tgcaggtggtttggacactgct

SEQ ID NO: 7718619 - DNA, 22 bp, Homo sapiens
tgcaggtggtttggacactgct

SEQ ID NO: 7718620 - DNA, 22 bp, Homo sapiens
tgcaggtggtttggacactgct

SEQ ID NO: 7718621 - DNA, 22 bp, Homo sapiens
tgcaggtgtaaattttcaagag

SEQ ID NO: 7718622 - DNA, 22 bp, Homo sapiens
tgcaggtgtagagttgggctcc

SEQ ID NO: 7718623 - DNA, 22 bp, Homo sapiens
tgcaggtgtagagttgggctcc

SEQ ID NO: 7718624 - DNA, 22 bp, Homo sapiens
tgcaggtgtagagttgggctcc

SEQ ID NO: 7718625 - DNA, 22 bp, Homo sapiens
tgcaggtgtagagttgggctcc

SEQ ID NO: 7718626 - DNA, 22 bp, Homo sapiens
tgcaggtgtctccagggcaggt

SEQ ID NO: 7718627 - DNA, 22 bp, Homo sapiens
tgcaggtgtctccagggcaggt

SEQ ID NO: 7718628 - DNA, 22 bp, Homo sapiens
tgcaggtgtagagttgggctcc

SEQ ID NO: 7718629 - DNA, 22 bp, Homo sapiens
tgcaggtgtctccagggcaggt

SEQ ID NO: 7718630 - DNA, 22 bp, Homo sapiens
tgcaggtgtctccagggcaggt

SEQ ID NO: 7718631 - DNA, 22 bp, Homo sapiens
tgcaggtgtctccagggcaggt

SEQ ID NO: 7718632 - DNA, 22 bp, Homo sapiens
tgcaggtgtctccagggcaggt

SEQ ID NO: 7718633 - DNA, 22 bp, Homo sapiens
tgcaggtgtctccagggcaggt

SEQ ID NO: 7718634 - DNA, 20 bp, Homo sapiens
tgcaggtgggcccttctggg

SEQ ID NO: 7718635 - DNA, 22 bp, Homo sapiens
tgcaggtggctccagggactgc

SEQ ID NO: 7718636 - DNA, 20 bp, Homo sapiens
tgcaggtgggcccttctggg

SEQ ID NO: 7718637 - DNA, 20 bp, Homo sapiens
tgcaggtgggcccttctggg

SEQ ID NO: 7718638 - DNA, 20 bp, Homo sapiens
tgcaggtgggcccttctggg

SEQ ID NO: 7718639 - DNA, 22 bp, Homo sapiens
tgcaggtggtacttctttttct

SEQ ID NO: 7718640 - DNA, 22 bp, Homo sapiens
tgcaggtggtccatttgggaac

SEQ ID NO: 7718641 - DNA, 22 bp, Homo sapiens
tgcaggtggtccttcctctgct

SEQ ID NO: 7718642 - DNA, 22 bp, Homo sapiens
tgcaggtggtccttcctctgct

SEQ ID NO: 7718643 - DNA, 22 bp, Homo sapiens
tgcaggtggtttggacactgct

SEQ ID NO: 7718644 - DNA, 22 bp, Homo sapiens
tgcaggtggtccttcctctgct

SEQ ID NO: 7718645 - DNA, 22 bp, Homo sapiens
tgcaggtggtccttcctctgct

SEQ ID NO: 7718646 - DNA, 22 bp, Homo sapiens
tgcaggtacttgacaacttggg

SEQ ID NO: 7718647 - DNA, 22 bp, Homo sapiens
tgcaggtaaatttgtggaggat

SEQ ID NO: 7718648 - DNA, 23 bp, Homo sapiens
tgcagggtgttcctgcctttgct

SEQ ID NO: 7718649 - DNA, 23 bp, Homo sapiens
tgcagggtgttcctgcctttgct

SEQ ID NO: 7718650 - DNA, 22 bp, Homo sapiens
tgcagggtgtccggaggatcac

SEQ ID NO: 7718651 - DNA, 22 bp, Homo sapiens
tgcagggtgtccggaggatcac

SEQ ID NO: 7718652 - DNA, 22 bp, Homo sapiens
tgcagggtgtccggaggatcac

SEQ ID NO: 7718653 - DNA, 22 bp, Homo sapiens
tgcagggtgtccggaggatcac

SEQ ID NO: 7718654 - DNA, 22 bp, Homo sapiens
tgcagggtgtccggaggatcac

SEQ ID NO: 7718655 - DNA, 23 bp, Homo sapiens
tgcaggtagggcccagcagtctt

SEQ ID NO: 7718656 - DNA, 22 bp, Homo sapiens
tgcaggtacttgacaacttggg

SEQ ID NO: 7718657 - DNA, 22 bp, Homo sapiens
tgcaggtgaaaattatgaggat

SEQ ID NO: 7718658 - DNA, 22 bp, Homo sapiens
tgcaggtgaaaattatgaggat

SEQ ID NO: 7718659 - DNA, 22 bp, Homo sapiens
tgcaggtctccattggcagact

SEQ ID NO: 7718660 - DNA, 22 bp, Homo sapiens
tgcaggtctctgcaaggcctat

SEQ ID NO: 7718661 - DNA, 22 bp, Homo sapiens
tgcaggtgagtgcaggggctca

SEQ ID NO: 7718662 - DNA, 22 bp, Homo sapiens
tgcaggtgagtgcaggggctca

SEQ ID NO: 7718663 - DNA, 22 bp, Homo sapiens
tgcaggtgagtgcaggggctca

SEQ ID NO: 7718664 - DNA, 22 bp, Homo sapiens
tgcaggtgagtgcaggggctca

SEQ ID NO: 7718665 - DNA, 22 bp, Homo sapiens
tgcaggtgagtgcaggggctca

SEQ ID NO: 7718666 - DNA, 22 bp, Homo sapiens
tgcaggtgacaccactcttcct

SEQ ID NO: 7718667 - DNA, 22 bp, Homo sapiens
tgcaggtgaaaattatgaggat

SEQ ID NO: 7718668 - DNA, 22 bp, Homo sapiens
tgcaggtgagtgcaggggctca

SEQ ID NO: 7718669 - DNA, 22 bp, Homo sapiens
tgcaggtggctccagggactgc

SEQ ID NO: 7718670 - DNA, 22 bp, Homo sapiens
tgcaggtggctccagggactgc

SEQ ID NO: 7718671 - DNA, 22 bp, Homo sapiens
tgcaggtggctccagggactgc

SEQ ID NO: 7718672 - DNA, 22 bp, Homo sapiens
tgcaggtggctccagggactgc

SEQ ID NO: 7718673 - DNA, 22 bp, Homo sapiens
tgcaggtggctccagggactgc

SEQ ID NO: 7718674 - DNA, 22 bp, Homo sapiens
tgcaggtggctccagggactgc

SEQ ID NO: 7718675 - DNA, 22 bp, Homo sapiens
tgcaggtggccatcttcgttct

SEQ ID NO: 7718676 - DNA, 22 bp, Homo sapiens
tgcaggtggcagcggggcacca

SEQ ID NO: 7718677 - DNA, 22 bp, Homo sapiens
tgcaggtggcagcggggcacca

SEQ ID NO: 7718678 - DNA, 22 bp, Homo sapiens
tgcaggtggcagcggggcacca

SEQ ID NO: 7718679 - DNA, 22 bp, Homo sapiens
tgcaggtggatatctcatcaga

SEQ ID NO: 7718680 - DNA, 22 bp, Homo sapiens
tgcaggtggattcaatgtggga

SEQ ID NO: 7718681 - DNA, 22 bp, Homo sapiens
tgcaggtggattcaatgtggga

SEQ ID NO: 7718682 - DNA, 22 bp, Homo sapiens
tgcaggtggattcaatgtggga

SEQ ID NO: 7718683 - DNA, 22 bp, Homo sapiens
tgcaggtggacacgggagacgg

SEQ ID NO: 7718684 - DNA, 22 bp, Homo sapiens
tgcaggtggacacgggagacgg

SEQ ID NO: 7718685 - DNA, 22 bp, Homo sapiens
tgcaggtgcagcgatactgtga

SEQ ID NO: 7718686 - DNA, 22 bp, Homo sapiens
tgcaggtggacacgggagacgg

SEQ ID NO: 7718687 - DNA, 22 bp, Homo sapiens
tgcaggtgcagcgatactgtga

SEQ ID NO: 7718688 - DNA, 22 bp, Homo sapiens
tgcaggtgattctgatgcagtt

SEQ ID NO: 7718689 - DNA, 23 bp, Homo sapiens
tgcaggtgattaatccagtttca

SEQ ID NO: 7718690 - DNA, 22 bp, Homo sapiens
tgcaggtgattctgatgcagtt

SEQ ID NO: 7718691 - DNA, 22 bp, Homo sapiens
tgcaggtgattctgatgcagtt

SEQ ID NO: 7718692 - DNA, 22 bp, Homo sapiens
tgcaggtgattctgatgcagtt

SEQ ID NO: 7718693 - DNA, 22 bp, Homo sapiens
tgcaggtgattctgatgcagtt

SEQ ID NO: 7718694 - DNA, 22 bp, Homo sapiens
tgcaggtgagtgcaggggctca

SEQ ID NO: 7718695 - DNA, 20 bp, Homo sapiens
tgcagggctctgcttctctc

SEQ ID NO: 7718696 - DNA, 20 bp, Homo sapiens
tgcagggctctgcttctctc

SEQ ID NO: 7718697 - DNA, 20 bp, Homo sapiens
tgcagggctgcctcccagct

SEQ ID NO: 7718698 - DNA, 19 bp, Homo sapiens
tgcagggctgcgcctgggg

SEQ ID NO: 7718699 - DNA, 19 bp, Homo sapiens
tgcagggctgcgcctgggg

SEQ ID NO: 7718700 - DNA, 20 bp, Homo sapiens
tgcagggctgcctcccagct

SEQ ID NO: 7718701 - DNA, 20 bp, Homo sapiens
tgcagggctgcctcccagct

SEQ ID NO: 7718702 - DNA, 20 bp, Homo sapiens
tgcagggctgcctcccagct

SEQ ID NO: 7718703 - DNA, 22 bp, Homo sapiens
tgcagggcttcctcttggagtt

SEQ ID NO: 7718704 - DNA, 22 bp, Homo sapiens
tgcagggcttcctcttggagtt

SEQ ID NO: 7718705 - DNA, 19 bp, Homo sapiens
tgcagggctgcgcctgggg

SEQ ID NO: 7718706 - DNA, 19 bp, Homo sapiens
tgcagggctgcgcctgggg

SEQ ID NO: 7718707 - DNA, 19 bp, Homo sapiens
tgcagggctgcgcctgggg

SEQ ID NO: 7718708 - DNA, 19 bp, Homo sapiens
tgcagggctgcgcctgggg

SEQ ID NO: 7718709 - DNA, 22 bp, Homo sapiens
tgcagggcttcctcttggagtt

SEQ ID NO: 7718710 - DNA, 22 bp, Homo sapiens
tgcagggcttcctcttggagtt

SEQ ID NO: 7718711 - DNA, 22 bp, Homo sapiens
tgcagggcttcctcttggagtt

SEQ ID NO: 7718712 - DNA, 23 bp, Homo sapiens
tgcaggggaggcttaaagcaggt

SEQ ID NO: 7718713 - DNA, 22 bp, Homo sapiens
tgcagggcttcctcttggagtt

SEQ ID NO: 7718714 - DNA, 23 bp, Homo sapiens
tgcaggggaggcttaaagcaggt

SEQ ID NO: 7718715 - DNA, 23 bp, Homo sapiens
tgcaggggaggcttaaagcaggt

SEQ ID NO: 7718716 - DNA, 22 bp, Homo sapiens
tgcagggtcccgaagggaagac

SEQ ID NO: 7718717 - DNA, 22 bp, Homo sapiens
tgcagggtcccgaagggaagac

SEQ ID NO: 7718718 - DNA, 22 bp, Homo sapiens
tgcagggtcccgaagggaagac

SEQ ID NO: 7718719 - DNA, 22 bp, Homo sapiens
tgcagggtcccgaagggaagac

SEQ ID NO: 7718720 - DNA, 22 bp, Homo sapiens
tgcagggtatccttgtctctgc

SEQ ID NO: 7718721 - DNA, 22 bp, Homo sapiens
tgcagggtatccttgtctctgc

SEQ ID NO: 7718722 - DNA, 22 bp, Homo sapiens
tgcagggtatccttgtctctgc

SEQ ID NO: 7718723 - DNA, 22 bp, Homo sapiens
tgcagggtagatgcaggctgtg

SEQ ID NO: 7718724 - DNA, 22 bp, Homo sapiens
tgcagggtagatgcaggctgtg

SEQ ID NO: 7718725 - DNA, 22 bp, Homo sapiens
tgcagggtagatgcaggctgtg

SEQ ID NO: 7718726 - DNA, 22 bp, Homo sapiens
tgcagggtagatgcaggctgtg

SEQ ID NO: 7718727 - DNA, 22 bp, Homo sapiens
tgcagggtgcacagtggggtgc

SEQ ID NO: 7718728 - DNA, 22 bp, Homo sapiens
tgcagggtgcacagtggggtgc

SEQ ID NO: 7718729 - DNA, 22 bp, Homo sapiens
tgcagggtgcacagtggggtgc

SEQ ID NO: 7718730 - DNA, 22 bp, Homo sapiens
tgcagggtctctgcaaatgagg

SEQ ID NO: 7718731 - DNA, 22 bp, Homo sapiens
tgcagggtggagcggaagcgga

SEQ ID NO: 7718732 - DNA, 22 bp, Homo sapiens
tgcagggtggagcggaagcgga

SEQ ID NO: 7718733 - DNA, 22 bp, Homo sapiens
tgcagggtggtttgaagggtct

SEQ ID NO: 7718734 - DNA, 22 bp, Homo sapiens
tgcagggtggtttgaagggtct

SEQ ID NO: 7718735 - DNA, 22 bp, Homo sapiens
tgcaggggcttgtctgggcctg

SEQ ID NO: 7718736 - DNA, 22 bp, Homo sapiens
tgcaggggcttgtctgggcctg

SEQ ID NO: 7718737 - DNA, 22 bp, Homo sapiens
tgcagggtagacaggtgaggtc

SEQ ID NO: 7718738 - DNA, 22 bp, Homo sapiens
tgcagggtagacaggtgaggtc

SEQ ID NO: 7718739 - DNA, 22 bp, Homo sapiens
tgcagggtagacaggtgaggtc

SEQ ID NO: 7718740 - DNA, 22 bp, Homo sapiens
tgcaggggcttgtctgggcctg

SEQ ID NO: 7718741 - DNA, 22 bp, Homo sapiens
tgcaggggcttgtctgggcctg

SEQ ID NO: 7718742 - DNA, 22 bp, Homo sapiens
tgcaggggcttgtctgggcctg

SEQ ID NO: 7718743 - DNA, 22 bp, Homo sapiens
tgcaggggcttgtctgggcctg

SEQ ID NO: 7718744 - DNA, 23 bp, Homo sapiens
tgcaggggaggcttaaagcaggt

SEQ ID NO: 7718745 - DNA, 22 bp, Homo sapiens
tgcaggggcttgtctgggcctg

SEQ ID NO: 7718746 - DNA, 22 bp, Homo sapiens
tgcaggggcttgtctgggcctg

SEQ ID NO: 7718747 - DNA, 22 bp, Homo sapiens
tgcaggggcttgtctgggcctg

SEQ ID NO: 7718748 - DNA, 22 bp, Homo sapiens
tgcaggggcttgtctgggcctg

SEQ ID NO: 7718749 - DNA, 22 bp, Homo sapiens
tgcagggccatggtggcggctg

SEQ ID NO: 7718750 - DNA, 22 bp, Homo sapiens
tgcagggcccctctgcatgagt

SEQ ID NO: 7718751 - DNA, 22 bp, Homo sapiens
tgcagggccatggtggcggctg

SEQ ID NO: 7718752 - DNA, 22 bp, Homo sapiens
tgcagggccatggtggcggctg

SEQ ID NO: 7718753 - DNA, 22 bp, Homo sapiens
tgcagggccatggtggcggctg

SEQ ID NO: 7718754 - DNA, 22 bp, Homo sapiens
tgcagggccagactgggttgga

SEQ ID NO: 7718755 - DNA, 22 bp, Homo sapiens
tgcagggccatggtggcggctg

SEQ ID NO: 7718756 - DNA, 22 bp, Homo sapiens
tgcagggccatggtggcggctg

SEQ ID NO: 7718757 - DNA, 22 bp, Homo sapiens
tgcagggccagactgggttgga

SEQ ID NO: 7718758 - DNA, 22 bp, Homo sapiens
tgcagggccagactgggttgga

SEQ ID NO: 7718759 - DNA, 22 bp, Homo sapiens
tgcagggcagtttgtttcggca

SEQ ID NO: 7718760 - DNA, 22 bp, Homo sapiens
tgcagggcatagggtccagttt

SEQ ID NO: 7718761 - DNA, 22 bp, Homo sapiens
tgcagggcatagggtccagttt

SEQ ID NO: 7718762 - DNA, 22 bp, Homo sapiens
tgcagggcatctttgaagtgtg

SEQ ID NO: 7718763 - DNA, 22 bp, Homo sapiens
tgcagggcatagggtccagttt

SEQ ID NO: 7718764 - DNA, 22 bp, Homo sapiens
tgcagggcatagggtccagttt

SEQ ID NO: 7718765 - DNA, 22 bp, Homo sapiens
tgcagggcatctttgaagtgtg

SEQ ID NO: 7718766 - DNA, 22 bp, Homo sapiens
tgcagggcatctttgaagtgtg

SEQ ID NO: 7718767 - DNA, 22 bp, Homo sapiens
tgcagggcatctttgaagtgtg

SEQ ID NO: 7718768 - DNA, 22 bp, Homo sapiens
tgcagggccagactgggttgga

SEQ ID NO: 7718769 - DNA, 22 bp, Homo sapiens
tgcagggcatctttgaagtgtg

SEQ ID NO: 7718770 - DNA, 22 bp, Homo sapiens
tgcagggcatctttgaagtgtg

SEQ ID NO: 7718771 - DNA, 22 bp, Homo sapiens
tgcagggccgctggaggtcatg

SEQ ID NO: 7718772 - DNA, 22 bp, Homo sapiens
tgcagggcccttggggttgaac

SEQ ID NO: 7718773 - DNA, 22 bp, Homo sapiens
tgcagggcccttggggttgaac

SEQ ID NO: 7718774 - DNA, 22 bp, Homo sapiens
tgcagggcccttggggttgaac

SEQ ID NO: 7718775 - DNA, 22 bp, Homo sapiens
tgcagggcccctctgcatgagt

SEQ ID NO: 7718776 - DNA, 22 bp, Homo sapiens
tgcagggcccctctgcatgagt

SEQ ID NO: 7718777 - DNA, 22 bp, Homo sapiens
tgcagggcccctctgcatgagt

SEQ ID NO: 7718778 - DNA, 22 bp, Homo sapiens
tgcagggcccctctgcatgagt

SEQ ID NO: 7718779 - DNA, 22 bp, Homo sapiens
tgcagggcccctctgcatgagt

SEQ ID NO: 7718780 - DNA, 22 bp, Homo sapiens
tgcagggcccctctgcatgagt

SEQ ID NO: 7718781 - DNA, 22 bp, Homo sapiens
tgcagggccctcattcctgtcc

SEQ ID NO: 7718782 - DNA, 22 bp, Homo sapiens
tgcagggccctcattcctgtcc

SEQ ID NO: 7718783 - DNA, 22 bp, Homo sapiens
tgcagggccctcattcctgtcc

SEQ ID NO: 7718784 - DNA, 22 bp, Homo sapiens
tgcagggctacaggactacaac

SEQ ID NO: 7718785 - DNA, 22 bp, Homo sapiens
tgcagggctacaggactacaac

SEQ ID NO: 7718786 - DNA, 22 bp, Homo sapiens
tgcagggccgctggaggtcatg

SEQ ID NO: 7718787 - DNA, 22 bp, Homo sapiens
tgcagggccgctggaggtcatg

SEQ ID NO: 7718788 - DNA, 22 bp, Homo sapiens
tgcagggccgctggaggtcatg

SEQ ID NO: 7718789 - DNA, 22 bp, Homo sapiens
tgcagggccgctggaggtcatg

SEQ ID NO: 7718790 - DNA, 22 bp, Homo sapiens
tgcagggctataactccattct

SEQ ID NO: 7718791 - DNA, 22 bp, Homo sapiens
tgcagggctataactccattct

SEQ ID NO: 7718792 - DNA, 22 bp, Homo sapiens
tgcagggctcctggctccaatc

SEQ ID NO: 7718793 - DNA, 22 bp, Homo sapiens
tgcagggctcctggctccaatc

SEQ ID NO: 7718794 - DNA, 22 bp, Homo sapiens
tgcagggctcctggctccaatc

SEQ ID NO: 7718795 - DNA, 22 bp, Homo sapiens
tgcagggcacggtgcgcgtggg

SEQ ID NO: 7718796 - DNA, 22 bp, Homo sapiens
tgcagggcacggtgcgcgtggg

SEQ ID NO: 7718797 - DNA, 22 bp, Homo sapiens
tgcagggcacggtgcgcgtggg

SEQ ID NO: 7718798 - DNA, 22 bp, Homo sapiens
tgcagggcacggtgcgcgtggg

SEQ ID NO: 7718799 - DNA, 22 bp, Homo sapiens
tgcagggcagatatgactgtag

SEQ ID NO: 7718800 - DNA, 22 bp, Homo sapiens
tgcagggcagatatgactgtag

SEQ ID NO: 7718801 - DNA, 22 bp, Homo sapiens
tgcagggcagatatgactgtag

SEQ ID NO: 7718802 - DNA, 22 bp, Homo sapiens
tgcagggcagatatgactgtag

SEQ ID NO: 7718803 - DNA, 22 bp, Homo sapiens
tgcagggcacacgcacgggtgt

SEQ ID NO: 7718804 - DNA, 22 bp, Homo sapiens
tgcagggcacacgcacgggtgt

SEQ ID NO: 7718805 - DNA, 22 bp, Homo sapiens
tgcagggcacacgcacgggtgt

SEQ ID NO: 7718806 - DNA, 22 bp, Homo sapiens
tgcagggcacacgcacgggtgt

SEQ ID NO: 7718807 - DNA, 22 bp, Homo sapiens
tgcagggcacggtgcgcgtggg

SEQ ID NO: 7718808 - DNA, 22 bp, Homo sapiens
tgcagggcacggtgcgcgtggg

SEQ ID NO: 7718809 - DNA, 22 bp, Homo sapiens
tgcagggcagctagggagcttt

SEQ ID NO: 7718810 - DNA, 22 bp, Homo sapiens
tgcagggcagtggaggttgagt

SEQ ID NO: 7718811 - DNA, 22 bp, Homo sapiens
tgcagggcagtggaggttgagt

SEQ ID NO: 7718812 - DNA, 22 bp, Homo sapiens
tgcagggcagtggaggttgagt

SEQ ID NO: 7718813 - DNA, 22 bp, Homo sapiens
tgcagggcagtggaggttgagt

SEQ ID NO: 7718814 - DNA, 22 bp, Homo sapiens
tgcagggcagtggaggttgagt

SEQ ID NO: 7718815 - DNA, 22 bp, Homo sapiens
tgcagggcagctagggagcttt

SEQ ID NO: 7718816 - DNA, 22 bp, Homo sapiens
tgcagggcagatatgactgtag

SEQ ID NO: 7718817 - DNA, 22 bp, Homo sapiens
tgcagggcagctagggagcttt

SEQ ID NO: 7718818 - DNA, 22 bp, Homo sapiens
tgcagggcagctagggagcttt

SEQ ID NO: 7718819 - DNA, 22 bp, Homo sapiens
tgcagggcagctagggagcttt

SEQ ID NO: 7718820 - DNA, 22 bp, Homo sapiens
tgcagggcagctagggagcttt

SEQ ID NO: 7718821 - DNA, 22 bp, Homo sapiens
tgcagggcagctagggagcttt

SEQ ID NO: 7718822 - DNA, 22 bp, Homo sapiens
tgcagggattagaggccgggga

SEQ ID NO: 7718823 - DNA, 22 bp, Homo sapiens
tgcagggattagaggccgggga

SEQ ID NO: 7718824 - DNA, 22 bp, Homo sapiens
tgcagggattagaggccgggga

SEQ ID NO: 7718825 - DNA, 22 bp, Homo sapiens
tgcagggattagaggccgggga

SEQ ID NO: 7718826 - DNA, 22 bp, Homo sapiens
tgcagggattatgtaggggttg

SEQ ID NO: 7718827 - DNA, 21 bp, Homo sapiens
tgcagggatctttctgcctga

SEQ ID NO: 7718828 - DNA, 21 bp, Homo sapiens
tgcagggatctttctgcctga

SEQ ID NO: 7718829 - DNA, 21 bp, Homo sapiens
tgcagggatctttctgcctga

SEQ ID NO: 7718830 - DNA, 21 bp, Homo sapiens
tgcagggatctttctgcctga

SEQ ID NO: 7718831 - DNA, 22 bp, Homo sapiens
tgcagggatgctagaggtaaga

SEQ ID NO: 7718832 - DNA, 22 bp, Homo sapiens
tgcagggatgctagaggtaaga

SEQ ID NO: 7718833 - DNA, 22 bp, Homo sapiens
tgcagggatgctagaggtaaga

SEQ ID NO: 7718834 - DNA, 22 bp, Homo sapiens
tgcagggatgctagaggtaaga

SEQ ID NO: 7718835 - DNA, 22 bp, Homo sapiens
tgcagggatgctagaggtaaga

SEQ ID NO: 7718836 - DNA, 22 bp, Homo sapiens
tgcagggatgctagaggtaaga

SEQ ID NO: 7718837 - DNA, 22 bp, Homo sapiens
tgcagggcacacgcacgggtgt

SEQ ID NO: 7718838 - DNA, 23 bp, Homo sapiens
tgcagggcaagttagagacccca

SEQ ID NO: 7718839 - DNA, 23 bp, Homo sapiens
tgcagggcaagttagagacccca

SEQ ID NO: 7718840 - DNA, 23 bp, Homo sapiens
tgcagggcaagttagagacccca

SEQ ID NO: 7718841 - DNA, 23 bp, Homo sapiens
tgcagggcaagttagagacccca

SEQ ID NO: 7718842 - DNA, 22 bp, Homo sapiens
tgcagggattgttggcatccat

SEQ ID NO: 7718843 - DNA, 22 bp, Homo sapiens
tgcagggattatgtaggggttg

SEQ ID NO: 7718844 - DNA, 22 bp, Homo sapiens
tgcagggattatgtaggggttg

SEQ ID NO: 7718845 - DNA, 22 bp, Homo sapiens
tgcagggattatgtaggggttg

SEQ ID NO: 7718846 - DNA, 22 bp, Homo sapiens
tgcagggattgttggcatccat

SEQ ID NO: 7718847 - DNA, 22 bp, Homo sapiens
tgcagggattgttggcatccat

SEQ ID NO: 7718848 - DNA, 22 bp, Homo sapiens
tgcagggattgttggcatccat

SEQ ID NO: 7718849 - DNA, 22 bp, Homo sapiens
tgcagggattgttggcatccat

SEQ ID NO: 7718850 - DNA, 22 bp, Homo sapiens
tgcaggctctctgctgccagat

SEQ ID NO: 7718851 - DNA, 17 bp, Homo sapiens
tgcaggctcctgtccct

SEQ ID NO: 7718852 - DNA, 22 bp, Homo sapiens
tgcaggctctctgctgccagat

SEQ ID NO: 7718853 - DNA, 22 bp, Homo sapiens
tgcaggctctctgctgccagat

SEQ ID NO: 7718854 - DNA, 22 bp, Homo sapiens
tgcaggctctctgctgccagat

SEQ ID NO: 7718855 - DNA, 22 bp, Homo sapiens
tgcaggctctctgctgccagat

SEQ ID NO: 7718856 - DNA, 22 bp, Homo sapiens
tgcaggctctctgctgccagat

SEQ ID NO: 7718857 - DNA, 22 bp, Homo sapiens
tgcaggctctggtttatagtgc

SEQ ID NO: 7718858 - DNA, 22 bp, Homo sapiens
tgcaggctccatgaggacaggc

SEQ ID NO: 7718859 - DNA, 17 bp, Homo sapiens
tgcaggctcctgtccct

SEQ ID NO: 7718860 - DNA, 17 bp, Homo sapiens
tgcaggctcctgtccct

SEQ ID NO: 7718861 - DNA, 17 bp, Homo sapiens
tgcaggctcctgtccct

SEQ ID NO: 7718862 - DNA, 22 bp, Homo sapiens
tgcaggctccatgaggacaggc

SEQ ID NO: 7718863 - DNA, 22 bp, Homo sapiens
tgcaggctccatgaggacaggc

SEQ ID NO: 7718864 - DNA, 22 bp, Homo sapiens
tgcaggctccatgaggacaggc

SEQ ID NO: 7718865 - DNA, 22 bp, Homo sapiens
tgcaggctccatgaggacaggc

SEQ ID NO: 7718866 - DNA, 22 bp, Homo sapiens
tgcaggctctgtgtgtgcctgg

SEQ ID NO: 7718867 - DNA, 22 bp, Homo sapiens
tgcaggctcttggtgacgtggg

SEQ ID NO: 7718868 - DNA, 22 bp, Homo sapiens
tgcaggctcttggtgacgtggg

SEQ ID NO: 7718869 - DNA, 22 bp, Homo sapiens
tgcaggctgaggctggctcaac

SEQ ID NO: 7718870 - DNA, 22 bp, Homo sapiens
tgcaggctctgtgtgtgcctgg

SEQ ID NO: 7718871 - DNA, 22 bp, Homo sapiens
tgcaggctctgtgtgtgcctgg

SEQ ID NO: 7718872 - DNA, 22 bp, Homo sapiens
tgcaggctctgtgtgtgcctgg

SEQ ID NO: 7718873 - DNA, 22 bp, Homo sapiens
tgcaggctctgtgtgtgcctgg

SEQ ID NO: 7718874 - DNA, 22 bp, Homo sapiens
tgcaggctctgtgtgtgcctgg

SEQ ID NO: 7718875 - DNA, 22 bp, Homo sapiens
tgcaggctgcacccctgccctg

SEQ ID NO: 7718876 - DNA, 22 bp, Homo sapiens
tgcaggctgcacccctgccctg

SEQ ID NO: 7718877 - DNA, 22 bp, Homo sapiens
tgcaggctgaggctggctcaac

SEQ ID NO: 7718878 - DNA, 22 bp, Homo sapiens
tgcaggctgaggctggctcaac

SEQ ID NO: 7718879 - DNA, 22 bp, Homo sapiens
tgcaggctgaggctggctcaac

SEQ ID NO: 7718880 - DNA, 22 bp, Homo sapiens
tgcaggctgcagtctcaggtgg

SEQ ID NO: 7718881 - DNA, 22 bp, Homo sapiens
tgcaggctgcagtctcaggtgg

SEQ ID NO: 7718882 - DNA, 22 bp, Homo sapiens
tgcaggctgcagtctcaggtgg

SEQ ID NO: 7718883 - DNA, 22 bp, Homo sapiens
tgcaggctggcagtgctgaaat

SEQ ID NO: 7718884 - DNA, 22 bp, Homo sapiens
tgcaggctgggaagagggacaa

SEQ ID NO: 7718885 - DNA, 22 bp, Homo sapiens
tgcaggctgggaagagggacaa

SEQ ID NO: 7718886 - DNA, 22 bp, Homo sapiens
tgcaggctgggaagagggacaa

SEQ ID NO: 7718887 - DNA, 22 bp, Homo sapiens
tgcaggctgggaagagggacaa

SEQ ID NO: 7718888 - DNA, 22 bp, Homo sapiens
tgcaggctgggaagagggacaa

SEQ ID NO: 7718889 - DNA, 22 bp, Homo sapiens
tgcaggctggggaggcagactt

SEQ ID NO: 7718890 - DNA, 22 bp, Homo sapiens
tgcaggctggggaggcagactt

SEQ ID NO: 7718891 - DNA, 22 bp, Homo sapiens
tgcaggctggggaggcagactt

SEQ ID NO: 7718892 - DNA, 22 bp, Homo sapiens
tgcaggctggggaggcagactt

SEQ ID NO: 7718893 - DNA, 22 bp, Homo sapiens
tgcaggctggggaggcagactt

SEQ ID NO: 7718894 - DNA, 22 bp, Homo sapiens
tgcaggctggggaggcagactt

SEQ ID NO: 7718895 - DNA, 22 bp, Homo sapiens
tgcaggctggggaggcagactt

SEQ ID NO: 7718896 - DNA, 18 bp, Homo sapiens
tgcaggctggggttcctc

SEQ ID NO: 7718897 - DNA, 18 bp, Homo sapiens
tgcaggctggggttcctc

SEQ ID NO: 7718898 - DNA, 22 bp, Homo sapiens
tgcaggctgtaatctgaggcta

SEQ ID NO: 7718899 - DNA, 22 bp, Homo sapiens
tgcaggctgtaatctgaggcta

SEQ ID NO: 7718900 - DNA, 22 bp, Homo sapiens
tgcaggctgtaatctgaggcta

SEQ ID NO: 7718901 - DNA, 22 bp, Homo sapiens
tgcaggctgtaatctgaggcta

SEQ ID NO: 7718902 - DNA, 22 bp, Homo sapiens
tgcaggctgtaatctgaggcta

SEQ ID NO: 7718903 - DNA, 22 bp, Homo sapiens
tgcaggctgctggcagtagctt

SEQ ID NO: 7718904 - DNA, 22 bp, Homo sapiens
tgcaggctgccttcacagagcc

SEQ ID NO: 7718905 - DNA, 22 bp, Homo sapiens
tgcaggctgccttcacagagcc

SEQ ID NO: 7718906 - DNA, 22 bp, Homo sapiens
tgcaggctgccttcacagagcc

SEQ ID NO: 7718907 - DNA, 22 bp, Homo sapiens
tgcaggctgccttcacagagcc

SEQ ID NO: 7718908 - DNA, 22 bp, Homo sapiens
tgcaggctgccttcacagagcc

SEQ ID NO: 7718909 - DNA, 22 bp, Homo sapiens
tgcaggctggcagtgctgaaat

SEQ ID NO: 7718910 - DNA, 22 bp, Homo sapiens
tgcaggctggcagatatctcat

SEQ ID NO: 7718911 - DNA, 22 bp, Homo sapiens
tgcaggctggcagtgctgaaat

SEQ ID NO: 7718912 - DNA, 22 bp, Homo sapiens
tgcaggctggcagtgctgaaat

SEQ ID NO: 7718913 - DNA, 22 bp, Homo sapiens
tgcaggctggcagatatctcat

SEQ ID NO: 7718914 - DNA, 22 bp, Homo sapiens
tgcaggctggaggagggactaa

SEQ ID NO: 7718915 - DNA, 22 bp, Homo sapiens
tgcaggctggatttgcttttgt

SEQ ID NO: 7718916 - DNA, 22 bp, Homo sapiens
tgcaggctggaggagggactaa

SEQ ID NO: 7718917 - DNA, 22 bp, Homo sapiens
tgcaggctggaggagggactaa

SEQ ID NO: 7718918 - DNA, 22 bp, Homo sapiens
tgcaggctggaggagggactaa

SEQ ID NO: 7718919 - DNA, 22 bp, Homo sapiens
tgcaggctgctggcagtagctt

SEQ ID NO: 7718920 - DNA, 22 bp, Homo sapiens
tgcagggaagtcccagctcctg

SEQ ID NO: 7718921 - DNA, 22 bp, Homo sapiens
tgcagggaagtcccagctcctg

SEQ ID NO: 7718922 - DNA, 22 bp, Homo sapiens
tgcagggaagtcccagctcctg

SEQ ID NO: 7718923 - DNA, 22 bp, Homo sapiens
tgcagggaagcaagggtggctc

SEQ ID NO: 7718924 - DNA, 22 bp, Homo sapiens
tgcagggaagcaagggtggctc

SEQ ID NO: 7718925 - DNA, 22 bp, Homo sapiens
tgcagggaagcaagggtggctc

SEQ ID NO: 7718926 - DNA, 22 bp, Homo sapiens
tgcagggaagcaagggtggctc

SEQ ID NO: 7718927 - DNA, 22 bp, Homo sapiens
tgcagggaatccagtctagggt

SEQ ID NO: 7718928 - DNA, 22 bp, Homo sapiens
tgcagggatcctagctgaagag

SEQ ID NO: 7718929 - DNA, 22 bp, Homo sapiens
tgcagggaatccagtctagggt

SEQ ID NO: 7718930 - DNA, 22 bp, Homo sapiens
tgcagggaatccagtctagggt

SEQ ID NO: 7718931 - DNA, 22 bp, Homo sapiens
tgcagggaagtcccagctcctg

SEQ ID NO: 7718932 - DNA, 22 bp, Homo sapiens
tgcagggaagtcccagctcctg

SEQ ID NO: 7718933 - DNA, 22 bp, Homo sapiens
tgcagggaatccagtctagggt

SEQ ID NO: 7718934 - DNA, 22 bp, Homo sapiens
tgcagggaatccagtctagggt

SEQ ID NO: 7718935 - DNA, 22 bp, Homo sapiens
tgcagggaatccagtctagggt

SEQ ID NO: 7718936 - DNA, 22 bp, Homo sapiens
tgcagggaacttggacagctag

SEQ ID NO: 7718937 - DNA, 22 bp, Homo sapiens
tgcagggaacttggacagctag

SEQ ID NO: 7718938 - DNA, 22 bp, Homo sapiens
tgcagggaacttggacagctag

SEQ ID NO: 7718939 - DNA, 22 bp, Homo sapiens
tgcagggaacttggacagctag

SEQ ID NO: 7718940 - DNA, 22 bp, Homo sapiens
tgcagggaacttggacagctag

SEQ ID NO: 7718941 - DNA, 22 bp, Homo sapiens
tgcagggaaagtgttggcagca

SEQ ID NO: 7718942 - DNA, 22 bp, Homo sapiens
tgcagggaacttggacagctag

SEQ ID NO: 7718943 - DNA, 22 bp, Homo sapiens
tgcagggaacttggacagctag

SEQ ID NO: 7718944 - DNA, 22 bp, Homo sapiens
tgcagggaacttggacagctag

SEQ ID NO: 7718945 - DNA, 22 bp, Homo sapiens
tgcagggaaagggcactgggct

SEQ ID NO: 7718946 - DNA, 22 bp, Homo sapiens
tgcagggaaagggcactgggct

SEQ ID NO: 7718947 - DNA, 22 bp, Homo sapiens
tgcagggaaagggcactgggct

SEQ ID NO: 7718948 - DNA, 22 bp, Homo sapiens
tgcagggaaagtgttggcagca

SEQ ID NO: 7718949 - DNA, 22 bp, Homo sapiens
tgcagggaaagtgttggcagca

SEQ ID NO: 7718950 - DNA, 22 bp, Homo sapiens
tgcagggaaagtgttggcagca

SEQ ID NO: 7718951 - DNA, 22 bp, Homo sapiens
tgcagggaaagtgttggcagca

SEQ ID NO: 7718952 - DNA, 22 bp, Homo sapiens
tgcagggaaaacccaggatgct

SEQ ID NO: 7718953 - DNA, 22 bp, Homo sapiens
tgcagggaaaacccaggatgct

SEQ ID NO: 7718954 - DNA, 22 bp, Homo sapiens
tgcagggaaaacccaggatgct

SEQ ID NO: 7718955 - DNA, 22 bp, Homo sapiens
tgcagggaaaacccaggatgct

SEQ ID NO: 7718956 - DNA, 22 bp, Homo sapiens
tgcaggctttagccccatggct

SEQ ID NO: 7718957 - DNA, 22 bp, Homo sapiens
tgcagggaaaacccaggatgct

SEQ ID NO: 7718958 - DNA, 22 bp, Homo sapiens
tgcagggaaaacccaggatgct

SEQ ID NO: 7718959 - DNA, 22 bp, Homo sapiens
tgcaggctttagccccatggct

SEQ ID NO: 7718960 - DNA, 22 bp, Homo sapiens
tgcaggctttagccccatggct

SEQ ID NO: 7718961 - DNA, 22 bp, Homo sapiens
tgcaggctttagccccatggct

SEQ ID NO: 7718962 - DNA, 22 bp, Homo sapiens
tgcaggctttagccccatggct

SEQ ID NO: 7718963 - DNA, 22 bp, Homo sapiens
tgcaggcttggatcacatctcc

SEQ ID NO: 7718964 - DNA, 22 bp, Homo sapiens
tgcaggcttggatcacatctcc

SEQ ID NO: 7718965 - DNA, 20 bp, Homo sapiens
tgcaggcttcgctctaggag

SEQ ID NO: 7718966 - DNA, 20 bp, Homo sapiens
tgcaggcttcgctctaggag

SEQ ID NO: 7718967 - DNA, 22 bp, Homo sapiens
tgcaggctgtttggtggatctc

SEQ ID NO: 7718968 - DNA, 22 bp, Homo sapiens
tgcaggcttggatcacatctcc

SEQ ID NO: 7718969 - DNA, 17 bp, Homo sapiens
tgcaggctgttatagcc

SEQ ID NO: 7718970 - DNA, 18 bp, Homo sapiens
tgcaggctgttgaaactg

SEQ ID NO: 7718971 - DNA, 17 bp, Homo sapiens
tgcaggctgttatagcc

SEQ ID NO: 7718972 - DNA, 17 bp, Homo sapiens
tgcaggctgttatagcc

SEQ ID NO: 7718973 - DNA, 17 bp, Homo sapiens
tgcaggctgttatagcc

SEQ ID NO: 7718974 - DNA, 21 bp, Homo sapiens
tgcaggctgtttaagaggcaa

SEQ ID NO: 7718975 - DNA, 22 bp, Homo sapiens
tgcaggctgtttggtggatctc

SEQ ID NO: 7718976 - DNA, 21 bp, Homo sapiens
tgcaggctgtttaagaggcaa

SEQ ID NO: 7718977 - DNA, 21 bp, Homo sapiens
tgcaggctgtttaagaggcaa

SEQ ID NO: 7718978 - DNA, 21 bp, Homo sapiens
tgcaggctgtgcgctcctgcc

SEQ ID NO: 7718979 - DNA, 21 bp, Homo sapiens
tgcaggctgtgcgctcctgcc

SEQ ID NO: 7718980 - DNA, 21 bp, Homo sapiens
tgcaggctgtgcgctcctgcc

SEQ ID NO: 7718981 - DNA, 21 bp, Homo sapiens
tgcaggctgtgcgctcctgcc

SEQ ID NO: 7718982 - DNA, 21 bp, Homo sapiens
tgcaggctgtgcgctcctgcc

SEQ ID NO: 7718983 - DNA, 21 bp, Homo sapiens
tgcaggctgtgcgctcctgcc

SEQ ID NO: 7718984 - DNA, 21 bp, Homo sapiens
tgcaggctgtgcgctcctgcc

SEQ ID NO: 7718985 - DNA, 21 bp, Homo sapiens
tgcaggctgtgcgctcctgcc

SEQ ID NO: 7718986 - DNA, 21 bp, Homo sapiens
tgcaggctgtgcgctcctgcc

SEQ ID NO: 7718987 - DNA, 22 bp, Homo sapiens
tgcaggctgtaatctgaggcta

SEQ ID NO: 7718988 - DNA, 22 bp, Homo sapiens
tgatcaaaacattactccacca

SEQ ID NO: 7718989 - DNA, 22 bp, Homo sapiens
tgatcaaaacattactccacca

SEQ ID NO: 7718990 - DNA, 22 bp, Homo sapiens
tgatcaaaacattactccacca

SEQ ID NO: 7718991 - DNA, 22 bp, Homo sapiens
tgatcaaaacattactccacca

SEQ ID NO: 7718992 - DNA, 22 bp, Homo sapiens
tgatcaaaacattactccacca

SEQ ID NO: 7718993 - DNA, 22 bp, Homo sapiens
tgatcaaaacattactccacca

SEQ ID NO: 7718994 - DNA, 22 bp, Homo sapiens
tgatattttatgagctttcata

SEQ ID NO: 7718995 - DNA, 22 bp, Homo sapiens
tgatattttatgagctttcata

SEQ ID NO: 7718996 - DNA, 22 bp, Homo sapiens
tgatcacaagtctgaagaatga

SEQ ID NO: 7718997 - DNA, 22 bp, Homo sapiens
tgatcacaagtctgaagaatga

SEQ ID NO: 7718998 - DNA, 22 bp, Homo sapiens
tgatcacaagtctgaagaatga

SEQ ID NO: 7718999 - DNA, 22 bp, Homo sapiens
tgatcaaaacattactccacca

SEQ ID NO: 7719000 - DNA, 22 bp, Homo sapiens
tgatcaaaacattactccacca

SEQ ID NO: 7719001 - DNA, 22 bp, Homo sapiens
tgatcaaaacattactccacca

SEQ ID NO: 7719002 - DNA, 22 bp, Homo sapiens
tgatcaaaacattactccacca

SEQ ID NO: 7719003 - DNA, 22 bp, Homo sapiens
tgatcagcatcttcccagctcg

SEQ ID NO: 7719004 - DNA, 22 bp, Homo sapiens
tgatcagcatcttcccagctcg

SEQ ID NO: 7719005 - DNA, 22 bp, Homo sapiens
tgatcagcatcttcccagctcg

SEQ ID NO: 7719006 - DNA, 22 bp, Homo sapiens
tgatcaggtctgaacagggagg

SEQ ID NO: 7719007 - DNA, 22 bp, Homo sapiens
tgatcactttggaagttggggg

SEQ ID NO: 7719008 - DNA, 21 bp, Homo sapiens
tgatcacatgaaaaccatgca

SEQ ID NO: 7719009 - DNA, 21 bp, Homo sapiens
tgatcacatgaaaaccatgca

SEQ ID NO: 7719010 - DNA, 21 bp, Homo sapiens
tgatcacatgaaaaccatgca

SEQ ID NO: 7719011 - DNA, 22 bp, Homo sapiens
tgatcacaagtctgaagaatga

SEQ ID NO: 7719012 - DNA, 22 bp, Homo sapiens
tgatcagacagttatgtgcatg

SEQ ID NO: 7719013 - DNA, 22 bp, Homo sapiens
tgatcactttggaagttggggg

SEQ ID NO: 7719014 - DNA, 22 bp, Homo sapiens
tgatcagacagttatgtgcatg

SEQ ID NO: 7719015 - DNA, 22 bp, Homo sapiens
tgatcagacagttatgtgcatg

SEQ ID NO: 7719016 - DNA, 22 bp, Homo sapiens
tgatcagacagttatgtgcatg

SEQ ID NO: 7719017 - DNA, 21 bp, Homo sapiens
tgatcatttgtgtaaaggaga

SEQ ID NO: 7719018 - DNA, 21 bp, Homo sapiens
tgatcatttgtgtaaaggaga

SEQ ID NO: 7719019 - DNA, 21 bp, Homo sapiens
tgatcatttgtgtaaaggaga

SEQ ID NO: 7719020 - DNA, 22 bp, Homo sapiens
tgatccatatgtgttacttctc

SEQ ID NO: 7719021 - DNA, 22 bp, Homo sapiens
tgatccatatgtgttacttctc

SEQ ID NO: 7719022 - DNA, 22 bp, Homo sapiens
tgatcagtgttggttctatcta

SEQ ID NO: 7719023 - DNA, 22 bp, Homo sapiens
tgatcagtaaccaatcacatca

SEQ ID NO: 7719024 - DNA, 22 bp, Homo sapiens
tgatcagtaaccaatcacatca

SEQ ID NO: 7719025 - DNA, 20 bp, Homo sapiens
tgatcatgtgaaagtcatgt

SEQ ID NO: 7719026 - DNA, 20 bp, Homo sapiens
tgatcatgtgaaagtcatgt

SEQ ID NO: 7719027 - DNA, 22 bp, Homo sapiens
tgatcattatcaaactggtcat

SEQ ID NO: 7719028 - DNA, 22 bp, Homo sapiens
tgatcgtaccacttcactcaag

SEQ ID NO: 7719029 - DNA, 21 bp, Homo sapiens
tgatcctttcccccatgttgc

SEQ ID NO: 7719030 - DNA, 22 bp, Homo sapiens
tgatcccttctccttcccttgg

SEQ ID NO: 7719031 - DNA, 21 bp, Homo sapiens
tgatcctaggcagtgtgattc

SEQ ID NO: 7719032 - DNA, 22 bp, Homo sapiens
tgatccttccccttgaggatgg

SEQ ID NO: 7719033 - DNA, 22 bp, Homo sapiens
tgatctaggttggcttcaactg

SEQ ID NO: 7719034 - DNA, 22 bp, Homo sapiens
tgatctaggttggcttcaactg

SEQ ID NO: 7719035 - DNA, 22 bp, Homo sapiens
tgatctcctgaccttgtaatcc

SEQ ID NO: 7719036 - DNA, 22 bp, Homo sapiens
tgatcccaatctttcctgctcc

SEQ ID NO: 7719037 - DNA, 22 bp, Homo sapiens
tgatcccatgggatggcatcag

SEQ ID NO: 7719038 - DNA, 22 bp, Homo sapiens
tgatcccagatctgagagggtt

SEQ ID NO: 7719039 - DNA, 22 bp, Homo sapiens
tgatccattaaaatccaagagt

SEQ ID NO: 7719040 - DNA, 22 bp, Homo sapiens
tgatcccaatctttcctgctcc

SEQ ID NO: 7719041 - DNA, 20 bp, Homo sapiens
tgatccctggcggcctttcc

SEQ ID NO: 7719042 - DNA, 20 bp, Homo sapiens
tgatccctggcggcctttcc

SEQ ID NO: 7719043 - DNA, 22 bp, Homo sapiens
tgatccctcacttctctttggg

SEQ ID NO: 7719044 - DNA, 22 bp, Homo sapiens
tgatccctgattgccttgactc

SEQ ID NO: 7719045 - DNA, 22 bp, Homo sapiens
tgatccctggacttgagtaagt

SEQ ID NO: 7719046 - DNA, 22 bp, Homo sapiens
tgatctggtcctactgtgggca

SEQ ID NO: 7719047 - DNA, 22 bp, Homo sapiens
tgatctggtcctactgtgggca

SEQ ID NO: 7719048 - DNA, 22 bp, Homo sapiens
tgatctggtcctactgtgggca

SEQ ID NO: 7719049 - DNA, 22 bp, Homo sapiens
tgatctggtcctactgtgggca

SEQ ID NO: 7719050 - DNA, 19 bp, Homo sapiens
tgatctggaaggaaccagg

SEQ ID NO: 7719051 - DNA, 22 bp, Homo sapiens
tgatctggaattccctgtggta

SEQ ID NO: 7719052 - DNA, 22 bp, Homo sapiens
tgatctttcctcttgtttgtct

SEQ ID NO: 7719053 - DNA, 18 bp, Homo sapiens
tgatctttcatgattcca

SEQ ID NO: 7719054 - DNA, 18 bp, Homo sapiens
tgatctttcatgattcca

SEQ ID NO: 7719055 - DNA, 18 bp, Homo sapiens
tgatctttcatgattcca

SEQ ID NO: 7719056 - DNA, 22 bp, Homo sapiens
tgatctttactgctgtttataa

SEQ ID NO: 7719057 - DNA, 22 bp, Homo sapiens
tgatctttactgctgtttataa

SEQ ID NO: 7719058 - DNA, 22 bp, Homo sapiens
tgatctttactgctgtttataa

SEQ ID NO: 7719059 - DNA, 22 bp, Homo sapiens
tgatctttactgctgtttataa

SEQ ID NO: 7719060 - DNA, 22 bp, Homo sapiens
tgatctttactgctgtttataa

SEQ ID NO: 7719061 - DNA, 22 bp, Homo sapiens
tgatcttcaccttgttctttgg

SEQ ID NO: 7719062 - DNA, 22 bp, Homo sapiens
tgatagaagcagaagcatacca

SEQ ID NO: 7719063 - DNA, 22 bp, Homo sapiens
tgatagaatcagataaaaggat

SEQ ID NO: 7719064 - DNA, 22 bp, Homo sapiens
tgatagaatcagataaaaggat

SEQ ID NO: 7719065 - DNA, 22 bp, Homo sapiens
tgatagaaaggaaattaattgg

SEQ ID NO: 7719066 - DNA, 22 bp, Homo sapiens
tgatagaaaggaaattaattgg

SEQ ID NO: 7719067 - DNA, 22 bp, Homo sapiens
tgatagaaaggaaattaattgg

SEQ ID NO: 7719068 - DNA, 22 bp, Homo sapiens
tgatagaaaggaaattaattgg

SEQ ID NO: 7719069 - DNA, 21 bp, Homo sapiens
tgatagggtttgggcaattat

SEQ ID NO: 7719070 - DNA, 22 bp, Homo sapiens
tgataggtcctcgggcactgga

SEQ ID NO: 7719071 - DNA, 23 bp, Homo sapiens
tgatagatgtcatggtcttgagt

SEQ ID NO: 7719072 - DNA, 22 bp, Homo sapiens
tgatagagcactaagtagtgta

SEQ ID NO: 7719073 - DNA, 22 bp, Homo sapiens
tgatagtattggtgatttatag

SEQ ID NO: 7719074 - DNA, 22 bp, Homo sapiens
tgatagtatctgattatttcac

SEQ ID NO: 7719075 - DNA, 17 bp, Homo sapiens
tgatagttcattttaag

SEQ ID NO: 7719076 - DNA, 22 bp, Homo sapiens
tgatataagaagtagtatggat

SEQ ID NO: 7719077 - DNA, 22 bp, Homo sapiens
tgatacatgattggtatggcga

SEQ ID NO: 7719078 - DNA, 22 bp, Homo sapiens
tgatactagcagtattttttac

SEQ ID NO: 7719079 - DNA, 22 bp, Homo sapiens
tgatacttttcttttagactaa

SEQ ID NO: 7719080 - DNA, 22 bp, Homo sapiens
tgatacttttcttttagactaa

SEQ ID NO: 7719081 - DNA, 22 bp, Homo sapiens
tgatactttggagacttgagta

SEQ ID NO: 7719082 - DNA, 22 bp, Homo sapiens
tgagttctgactgtgatgccag

SEQ ID NO: 7719083 - DNA, 22 bp, Homo sapiens
tgagttctccaggaagcagact

SEQ ID NO: 7719084 - DNA, 22 bp, Homo sapiens
tgagttctccaagagaaggtat

SEQ ID NO: 7719085 - DNA, 22 bp, Homo sapiens
tgagttctagtggctgcagatt

SEQ ID NO: 7719086 - DNA, 22 bp, Homo sapiens
tgagttctcacccattcttctt

SEQ ID NO: 7719087 - DNA, 22 bp, Homo sapiens
tgagttctcatgaaatctagtt

SEQ ID NO: 7719088 - DNA, 22 bp, Homo sapiens
tgagttctccaagagaaggtaa

SEQ ID NO: 7719089 - DNA, 23 bp, Homo sapiens
tgagttctaggcttaaaactagc

SEQ ID NO: 7719090 - DNA, 22 bp, Homo sapiens
tgagttctaggcttaaaactaa

SEQ ID NO: 7719091 - DNA, 23 bp, Homo sapiens
tgagttctaggcttaaaactagc

SEQ ID NO: 7719092 - DNA, 22 bp, Homo sapiens
tgagttctagtggctgcagatt

SEQ ID NO: 7719093 - DNA, 22 bp, Homo sapiens
tgagttctcacccattcttctt

SEQ ID NO: 7719094 - DNA, 22 bp, Homo sapiens
tgatatttaagcaaaaatatgg

SEQ ID NO: 7719095 - DNA, 20 bp, Homo sapiens
tgatatttctggaagtggag

SEQ ID NO: 7719096 - DNA, 22 bp, Homo sapiens
tgatatttgctgactgcattgt

SEQ ID NO: 7719097 - DNA, 22 bp, Homo sapiens
tgatatttgctgactgcattgt

SEQ ID NO: 7719098 - DNA, 22 bp, Homo sapiens
tgatattttatgagctttcata

SEQ ID NO: 7719099 - DNA, 22 bp, Homo sapiens
tgatatttgctgactgcattgt

SEQ ID NO: 7719100 - DNA, 22 bp, Homo sapiens
tgatatgtgaagctattagttc

SEQ ID NO: 7719101 - DNA, 22 bp, Homo sapiens
tgatatgttggatctgttggtt

SEQ ID NO: 7719102 - DNA, 22 bp, Homo sapiens
tgatatgtgaagctattagttc

SEQ ID NO: 7719103 - DNA, 22 bp, Homo sapiens
tgatatttaagcaaaaatatgg

SEQ ID NO: 7719104 - DNA, 23 bp, Homo sapiens
tgatattcaggatgggtgatggg

SEQ ID NO: 7719105 - DNA, 22 bp, Homo sapiens
tgatatttaagcaaaaatatgg

SEQ ID NO: 7719106 - DNA, 22 bp, Homo sapiens
tgatatgcatgtaagggagaca

SEQ ID NO: 7719107 - DNA, 22 bp, Homo sapiens
tgatatctgaagtgtataaaca

SEQ ID NO: 7719108 - DNA, 22 bp, Homo sapiens
tgatatgcatgtaagggagaca

SEQ ID NO: 7719109 - DNA, 20 bp, Homo sapiens
tgatatggtttggctgtgtt

SEQ ID NO: 7719110 - DNA, 22 bp, Homo sapiens
tgatatgtaactactccttata

SEQ ID NO: 7719111 - DNA, 22 bp, Homo sapiens
tgatatgtaactactccttata

SEQ ID NO: 7719112 - DNA, 20 bp, Homo sapiens
tgatatggtttggctgtgtt

SEQ ID NO: 7719113 - DNA, 22 bp, Homo sapiens
tgatatgggaaaagggctcgga

SEQ ID NO: 7719114 - DNA, 20 bp, Homo sapiens
tgatatggtttggctgtgtt

SEQ ID NO: 7719115 - DNA, 22 bp, Homo sapiens
tgatatgggaaaagggctcgga

SEQ ID NO: 7719116 - DNA, 20 bp, Homo sapiens
tgatatggtttggctgtgtt

SEQ ID NO: 7719117 - DNA, 22 bp, Homo sapiens
tgatatgggaaaagggctcgga

SEQ ID NO: 7719118 - DNA, 22 bp, Homo sapiens
tgatatgggaaaagggctcgga

SEQ ID NO: 7719119 - DNA, 22 bp, Homo sapiens
tgagtgatgagcatgattttag

SEQ ID NO: 7719120 - DNA, 22 bp, Homo sapiens
tgagtgatgagcatgattttag

SEQ ID NO: 7719121 - DNA, 22 bp, Homo sapiens
tgagtgattaggtttttccttc

SEQ ID NO: 7719122 - DNA, 22 bp, Homo sapiens
tgagtgagttttcacggtcagc

SEQ ID NO: 7719123 - DNA, 22 bp, Homo sapiens
tgagtgagttttcacggtcagc

SEQ ID NO: 7719124 - DNA, 22 bp, Homo sapiens
tgagtgagttttcacggtcagc

SEQ ID NO: 7719125 - DNA, 22 bp, Homo sapiens
tgagtgatctcagatgccgcat

SEQ ID NO: 7719126 - DNA, 20 bp, Homo sapiens
tgagtgagtttgtggcagga

SEQ ID NO: 7719127 - DNA, 20 bp, Homo sapiens
tgagtgagtttgtggcagga

SEQ ID NO: 7719128 - DNA, 22 bp, Homo sapiens
tgagtgaggtgcttagggcaca

SEQ ID NO: 7719129 - DNA, 22 bp, Homo sapiens
tgagtgaggctgggcagtccct

SEQ ID NO: 7719130 - DNA, 20 bp, Homo sapiens
tgagtgagtttgtggcagga

SEQ ID NO: 7719131 - DNA, 20 bp, Homo sapiens
tgagtgagtttgtggcagga

SEQ ID NO: 7719132 - DNA, 20 bp, Homo sapiens
tgagtgagtttgtggcagga

SEQ ID NO: 7719133 - DNA, 20 bp, Homo sapiens
tgagtgagtttgtggcagga

SEQ ID NO: 7719134 - DNA, 21 bp, Homo sapiens
tgagtgccacctgctggccaa

SEQ ID NO: 7719135 - DNA, 21 bp, Homo sapiens
tgagtgccacctgctggccaa

SEQ ID NO: 7719136 - DNA, 22 bp, Homo sapiens
tgagtgcctacggcacaggcgc

SEQ ID NO: 7719137 - DNA, 22 bp, Homo sapiens
tgagtgcctacggcacaggcgc

SEQ ID NO: 7719138 - DNA, 22 bp, Homo sapiens
tgagtgcctacggcacaggcgc

SEQ ID NO: 7719139 - DNA, 22 bp, Homo sapiens
tgagtgcctgcaacggaccaga

SEQ ID NO: 7719140 - DNA, 20 bp, Homo sapiens
tgagtgctccattctgccca

SEQ ID NO: 7719141 - DNA, 22 bp, Homo sapiens
tgagtgctctgtatgtgccaga

SEQ ID NO: 7719142 - DNA, 22 bp, Homo sapiens
tgagtgagacatcctgtcttaa

SEQ ID NO: 7719143 - DNA, 22 bp, Homo sapiens
tgagtgagacaccaaaggctgt

SEQ ID NO: 7719144 - DNA, 22 bp, Homo sapiens
tgagtgagacaccaaaggctgt

SEQ ID NO: 7719145 - DNA, 22 bp, Homo sapiens
tgagtgagctggggagccggtg

SEQ ID NO: 7719146 - DNA, 22 bp, Homo sapiens
tgagtgagctggggagccggtg

SEQ ID NO: 7719147 - DNA, 22 bp, Homo sapiens
tgagtgagacaccaaaggctgt

SEQ ID NO: 7719148 - DNA, 22 bp, Homo sapiens
tgagtgagctggggagccggtg

SEQ ID NO: 7719149 - DNA, 22 bp, Homo sapiens
tgagtgaggtgcttagggcaca

SEQ ID NO: 7719150 - DNA, 22 bp, Homo sapiens
tgagtgaggctgggcagtccct

SEQ ID NO: 7719151 - DNA, 22 bp, Homo sapiens
tgagtgaggaagcggtggagga

SEQ ID NO: 7719152 - DNA, 22 bp, Homo sapiens
tgagtgaggaagcggtggagga

SEQ ID NO: 7719153 - DNA, 22 bp, Homo sapiens
tgagtgaggctgggcagtccct

SEQ ID NO: 7719154 - DNA, 22 bp, Homo sapiens
tgagtgaggaagcggtggagga

SEQ ID NO: 7719155 - DNA, 22 bp, Homo sapiens
tgagtgaggaagcggtggagga

SEQ ID NO: 7719156 - DNA, 21 bp, Homo sapiens
tgagtcttttgcacaaggaat

SEQ ID NO: 7719157 - DNA, 22 bp, Homo sapiens
tgagtcttttatcctgggaatg

SEQ ID NO: 7719158 - DNA, 19 bp, Homo sapiens
tgagtgaaggccgtggtgg

SEQ ID NO: 7719159 - DNA, 22 bp, Homo sapiens
tgagtgaattcaagtaaagggc

SEQ ID NO: 7719160 - DNA, 22 bp, Homo sapiens
tgagtgaccagaagtccccctc

SEQ ID NO: 7719161 - DNA, 22 bp, Homo sapiens
tgagtgactccactggggcaga

SEQ ID NO: 7719162 - DNA, 20 bp, Homo sapiens
tgagtggccactgggtcgca

SEQ ID NO: 7719163 - DNA, 19 bp, Homo sapiens
tgagtggagtgcaatgaag

SEQ ID NO: 7719164 - DNA, 20 bp, Homo sapiens
tgagtggccactgggtcgca

SEQ ID NO: 7719165 - DNA, 22 bp, Homo sapiens
tgagtggagactgtgtgtagag

SEQ ID NO: 7719166 - DNA, 22 bp, Homo sapiens
tgagtggagtagtgaatgcatt

SEQ ID NO: 7719167 - DNA, 22 bp, Homo sapiens
tgagtggagtagtgaatgcatt

SEQ ID NO: 7719168 - DNA, 22 bp, Homo sapiens
tgagtgggacctgcgtgtgtca

SEQ ID NO: 7719169 - DNA, 17 bp, Homo sapiens
tgagtggccgggggaca

SEQ ID NO: 7719170 - DNA, 22 bp, Homo sapiens
tgagtgggacctgcgtgtgtca

SEQ ID NO: 7719171 - DNA, 19 bp, Homo sapiens
tgagtgggagcccaggtat

SEQ ID NO: 7719172 - DNA, 19 bp, Homo sapiens
tgagtgggagcccaggtat

SEQ ID NO: 7719173 - DNA, 19 bp, Homo sapiens
tgagtgggagcccaggtat

SEQ ID NO: 7719174 - DNA, 16 bp, Homo sapiens
tgagtgggagaagggg

SEQ ID NO: 7719175 - DNA, 16 bp, Homo sapiens
tgagtgggagaagggg

SEQ ID NO: 7719176 - DNA, 22 bp, Homo sapiens
tgagtgggatgagttagaggtg

SEQ ID NO: 7719177 - DNA, 22 bp, Homo sapiens
tgagtgggattaaatgaggtga

SEQ ID NO: 7719178 - DNA, 22 bp, Homo sapiens
tgagtgggattaaatgaggtga

SEQ ID NO: 7719179 - DNA, 22 bp, Homo sapiens
tgagtgggattaaatgaggtga

SEQ ID NO: 7719180 - DNA, 22 bp, Homo sapiens
tgagtggacacctgcttcttta

SEQ ID NO: 7719181 - DNA, 22 bp, Homo sapiens
tgagtggacacctgcttcttta

SEQ ID NO: 7719182 - DNA, 22 bp, Homo sapiens
tgagtggacacctgcttcttta

SEQ ID NO: 7719183 - DNA, 22 bp, Homo sapiens
tgagtggacacctgcttcttta

SEQ ID NO: 7719184 - DNA, 22 bp, Homo sapiens
tgagtggagaacagaggctctc

SEQ ID NO: 7719185 - DNA, 22 bp, Homo sapiens
tgagtggacgtgaggctgagta

SEQ ID NO: 7719186 - DNA, 22 bp, Homo sapiens
tgagtggacgtgaggctgagta

SEQ ID NO: 7719187 - DNA, 22 bp, Homo sapiens
tgagtggagaacagaggctctc

SEQ ID NO: 7719188 - DNA, 22 bp, Homo sapiens
tgagtggagaacagaggctctc

SEQ ID NO: 7719189 - DNA, 22 bp, Homo sapiens
tgagtggacgtgaggctgagta

SEQ ID NO: 7719190 - DNA, 22 bp, Homo sapiens
tgagtggagaacagaggctctc

SEQ ID NO: 7719191 - DNA, 22 bp, Homo sapiens
tgagtgctggctaaatagaaaa

SEQ ID NO: 7719192 - DNA, 22 bp, Homo sapiens
tgagtgctgcattagcagatat

SEQ ID NO: 7719193 - DNA, 22 bp, Homo sapiens
tgagtgctttaaatgttatttt

SEQ ID NO: 7719194 - DNA, 22 bp, Homo sapiens
tgagtggacacctgcttcttta

SEQ ID NO: 7719195 - DNA, 22 bp, Homo sapiens
tgagtggacacctgcttcttta

SEQ ID NO: 7719196 - DNA, 22 bp, Homo sapiens
tgagtggacacctgcttcttta

SEQ ID NO: 7719197 - DNA, 22 bp, Homo sapiens
tgagtggacacctgcttcttta

SEQ ID NO: 7719198 - DNA, 18 bp, Homo sapiens
tgagtggaatgagggggc

SEQ ID NO: 7719199 - DNA, 18 bp, Homo sapiens
tgagtggaatgagggggc

SEQ ID NO: 7719200 - DNA, 22 bp, Homo sapiens
tgagtgctggctaaatagaaaa

SEQ ID NO: 7719201 - DNA, 18 bp, Homo sapiens
tgagtggaatgagggggc

SEQ ID NO: 7719202 - DNA, 22 bp, Homo sapiens
tgagtgtatatgaaggttgtaa

SEQ ID NO: 7719203 - DNA, 19 bp, Homo sapiens
tgagtgtcacgtcagtgcc

SEQ ID NO: 7719204 - DNA, 22 bp, Homo sapiens
tgagtgggttatcaggaaaggt

SEQ ID NO: 7719205 - DNA, 23 bp, Homo sapiens
tgagtgtgaaaatcctggagatg

SEQ ID NO: 7719206 - DNA, 23 bp, Homo sapiens
tgagtgtgaaaatcctggagatg

SEQ ID NO: 7719207 - DNA, 22 bp, Homo sapiens
tgagtgtatatcaggagagagc

SEQ ID NO: 7719208 - DNA, 19 bp, Homo sapiens
tgagtgtcacgtcagtgcc

SEQ ID NO: 7719209 - DNA, 22 bp, Homo sapiens
tgagtgtccttaaggttgttct

SEQ ID NO: 7719210 - DNA, 22 bp, Homo sapiens
tgagtgtctggtcatggcaggc

SEQ ID NO: 7719211 - DNA, 22 bp, Homo sapiens
tgagtgggttatcaggaaaggt

SEQ ID NO: 7719212 - DNA, 22 bp, Homo sapiens
tgagtgggttatcaggaaaggt

SEQ ID NO: 7719213 - DNA, 22 bp, Homo sapiens
tgagtgggttatcaggaaaggt

SEQ ID NO: 7719214 - DNA, 22 bp, Homo sapiens
tgagtgggttatcaggaaaggt

SEQ ID NO: 7719215 - DNA, 19 bp, Homo sapiens
tgagtgggcccctgcagac

SEQ ID NO: 7719216 - DNA, 19 bp, Homo sapiens
tgagtgggcccctgcagac

SEQ ID NO: 7719217 - DNA, 22 bp, Homo sapiens
tgagtgggattaaatgaggtga

SEQ ID NO: 7719218 - DNA, 19 bp, Homo sapiens
tgagtgggagcccaggtat

SEQ ID NO: 7719219 - DNA, 22 bp, Homo sapiens
tgagtgggattaaatgaggtga

SEQ ID NO: 7719220 - DNA, 22 bp, Homo sapiens
tgagtgggattaaatgaggtga

SEQ ID NO: 7719221 - DNA, 19 bp, Homo sapiens
tgagtgggcccctgcagac

SEQ ID NO: 7719222 - DNA, 22 bp, Homo sapiens
tgagtgtggggaatgtcatgag

SEQ ID NO: 7719223 - DNA, 22 bp, Homo sapiens
tgagtgtggggaatgtcatgag

SEQ ID NO: 7719224 - DNA, 22 bp, Homo sapiens
tgagtgtgctaggtgtctcggt

SEQ ID NO: 7719225 - DNA, 22 bp, Homo sapiens
tgagtgtgctaggtgtctcggt

SEQ ID NO: 7719226 - DNA, 22 bp, Homo sapiens
tgagtgtgctaggtgtctcggt

SEQ ID NO: 7719227 - DNA, 22 bp, Homo sapiens
tgagtgtgaggtgggagcttgg

SEQ ID NO: 7719228 - DNA, 22 bp, Homo sapiens
tgagtgtgaggtgggagcttgg

SEQ ID NO: 7719229 - DNA, 22 bp, Homo sapiens
tgagtgtgcagggaagtggcgg

SEQ ID NO: 7719230 - DNA, 22 bp, Homo sapiens
tgagtgtggggaatgtcatgag

SEQ ID NO: 7719231 - DNA, 22 bp, Homo sapiens
tgagtgtggggaatgtcatgag

SEQ ID NO: 7719232 - DNA, 23 bp, Homo sapiens
tgagtgtggggacagtggtttgc

SEQ ID NO: 7719233 - DNA, 19 bp, Homo sapiens
tgagtgtgtgtttctctaa

SEQ ID NO: 7719234 - DNA, 22 bp, Homo sapiens
tgagtgtgtattatgtatcagg

SEQ ID NO: 7719235 - DNA, 22 bp, Homo sapiens
tgagtgtgtattatgtatcagg

SEQ ID NO: 7719236 - DNA, 22 bp, Homo sapiens
tgagtgtgtattatgtatcagg

SEQ ID NO: 7719237 - DNA, 22 bp, Homo sapiens
tgagttattgcagcttcctcct

SEQ ID NO: 7719238 - DNA, 22 bp, Homo sapiens
tgagttattgcagcttcctcct

SEQ ID NO: 7719239 - DNA, 22 bp, Homo sapiens
tgagttcaaagacaggtatagg

SEQ ID NO: 7719240 - DNA, 22 bp, Homo sapiens
tgagttatggagaataaagtca

SEQ ID NO: 7719241 - DNA, 22 bp, Homo sapiens
tgagttattgagaaataactgc

SEQ ID NO: 7719242 - DNA, 22 bp, Homo sapiens
tgagttatctaaaatagtcaaa

SEQ ID NO: 7719243 - DNA, 22 bp, Homo sapiens
tgagttatctaaaatagtcaaa

SEQ ID NO: 7719244 - DNA, 22 bp, Homo sapiens
tgagttatctaaaatagtcaaa

SEQ ID NO: 7719245 - DNA, 22 bp, Homo sapiens
tgagttatatatactggctctg

SEQ ID NO: 7719246 - DNA, 22 bp, Homo sapiens
tgagttatggagaataaagtca

SEQ ID NO: 7719247 - DNA, 22 bp, Homo sapiens
tgagttcagatcctggctctgc

SEQ ID NO: 7719248 - DNA, 22 bp, Homo sapiens
tgagttcaggctcttggccagg

SEQ ID NO: 7719249 - DNA, 22 bp, Homo sapiens
tgagttcatatagttcaagata

SEQ ID NO: 7719250 - DNA, 18 bp, Homo sapiens
tgagttcattagacttcc

SEQ ID NO: 7719251 - DNA, 22 bp, Homo sapiens
tgagttcatttgagtgaacact

SEQ ID NO: 7719252 - DNA, 22 bp, Homo sapiens
tgagttcatttgagtgaacact

SEQ ID NO: 7719253 - DNA, 20 bp, Homo sapiens
tgagttcatttgcatgtggt

SEQ ID NO: 7719254 - DNA, 22 bp, Homo sapiens
tgagttctaggcttaaaactaa

SEQ ID NO: 7719255 - DNA, 22 bp, Homo sapiens
tgagttcaaattttggctctgc

SEQ ID NO: 7719256 - DNA, 22 bp, Homo sapiens
tgagttattgagaaataactgc

SEQ ID NO: 7719257 - DNA, 22 bp, Homo sapiens
tgagttcaagtccaagttgctg

SEQ ID NO: 7719258 - DNA, 22 bp, Homo sapiens
tgagttcaagtccaagttgctg

SEQ ID NO: 7719259 - DNA, 22 bp, Homo sapiens
tgagttcaagtccaagttgctg

SEQ ID NO: 7719260 - DNA, 22 bp, Homo sapiens
tgagttataatgaatatttgaa

SEQ ID NO: 7719261 - DNA, 22 bp, Homo sapiens
tgagttataacatattcgtagt

SEQ ID NO: 7719262 - DNA, 22 bp, Homo sapiens
tgagttatatatactggctctg

SEQ ID NO: 7719263 - DNA, 22 bp, Homo sapiens
tgagttataatgaatatttgaa

SEQ ID NO: 7719264 - DNA, 22 bp, Homo sapiens
tgagttactgcctagtaacttg

SEQ ID NO: 7719265 - DNA, 22 bp, Homo sapiens
tgagttaagcaggtagcaagct

SEQ ID NO: 7719266 - DNA, 17 bp, Homo sapiens
tgagttaagtttagatc

SEQ ID NO: 7719267 - DNA, 22 bp, Homo sapiens
tgagttaagaagtcccaggctg

SEQ ID NO: 7719268 - DNA, 22 bp, Homo sapiens
tgagttaaatgagaacatgaaa

SEQ ID NO: 7719269 - DNA, 23 bp, Homo sapiens
tgagtgtgttccctgtgagattt

SEQ ID NO: 7719270 - DNA, 19 bp, Homo sapiens
tgagtgtgtgtttctctaa

SEQ ID NO: 7719271 - DNA, 19 bp, Homo sapiens
tgagtgtgtgtttctctaa

SEQ ID NO: 7719272 - DNA, 21 bp, Homo sapiens
tgagttaaaatgtcagtgcca

SEQ ID NO: 7719273 - DNA, 22 bp, Homo sapiens
tgagttaaatgagaacatgaaa

SEQ ID NO: 7719274 - DNA, 22 bp, Homo sapiens
tgatggtattaggaggtgaggc

SEQ ID NO: 7719275 - DNA, 22 bp, Homo sapiens
tgatggtattaggaggtgaggc

SEQ ID NO: 7719276 - DNA, 22 bp, Homo sapiens
tgatggtatgggattaccatgt

SEQ ID NO: 7719277 - DNA, 22 bp, Homo sapiens
tgatggtagtttatcaaaaaga

SEQ ID NO: 7719278 - DNA, 22 bp, Homo sapiens
tgatggtcaggatgcatggaga

SEQ ID NO: 7719279 - DNA, 20 bp, Homo sapiens
tgatggtattaggaggtgtg

SEQ ID NO: 7719280 - DNA, 22 bp, Homo sapiens
tgatggtagtttatcaaaaaga

SEQ ID NO: 7719281 - DNA, 22 bp, Homo sapiens
tgatggtagggatactacagga

SEQ ID NO: 7719282 - DNA, 22 bp, Homo sapiens
tgatggtaaatccatatacctt

SEQ ID NO: 7719283 - DNA, 22 bp, Homo sapiens
tgatggtaaatccatatacctt

SEQ ID NO: 7719284 - DNA, 22 bp, Homo sapiens
tgatggtaaacaaagacattta

SEQ ID NO: 7719285 - DNA, 22 bp, Homo sapiens
tgatgggaggtgctgcaggacc

SEQ ID NO: 7719286 - DNA, 23 bp, Homo sapiens
tgatgggaaggaacgactaccac

SEQ ID NO: 7719287 - DNA, 22 bp, Homo sapiens
tgatgggaaaatgaggcctggg

SEQ ID NO: 7719288 - DNA, 23 bp, Homo sapiens
tgatgggaaggaacgactaccac

SEQ ID NO: 7719289 - DNA, 22 bp, Homo sapiens
tgatgggaaaatgaggcctggg

SEQ ID NO: 7719290 - DNA, 22 bp, Homo sapiens
tgatgggaaaatgaggcctggg

SEQ ID NO: 7719291 - DNA, 22 bp, Homo sapiens
tgatgggactgccagctgctga

SEQ ID NO: 7719292 - DNA, 22 bp, Homo sapiens
tgatgggactgccagctgctga

SEQ ID NO: 7719293 - DNA, 22 bp, Homo sapiens
tgatgggactgccagctgctga

SEQ ID NO: 7719294 - DNA, 22 bp, Homo sapiens
tgatgggaggtgctgcaggacc

SEQ ID NO: 7719295 - DNA, 22 bp, Homo sapiens
tgatgggaggtgctgcaggacc

SEQ ID NO: 7719296 - DNA, 22 bp, Homo sapiens
tgatggatgtggctctggagct

SEQ ID NO: 7719297 - DNA, 23 bp, Homo sapiens
tgatggccgccctttgccctgtc

SEQ ID NO: 7719298 - DNA, 22 bp, Homo sapiens
tgatggcgggtggttggcactt

SEQ ID NO: 7719299 - DNA, 22 bp, Homo sapiens
tgatggctatccctggaagggc

SEQ ID NO: 7719300 - DNA, 22 bp, Homo sapiens
tgatggctatccctggaagggc

SEQ ID NO: 7719301 - DNA, 18 bp, Homo sapiens
tgatggaggagggctggt

SEQ ID NO: 7719302 - DNA, 18 bp, Homo sapiens
tgatggaggagggctggt

SEQ ID NO: 7719303 - DNA, 22 bp, Homo sapiens
tgatggatgtggctctggagct

SEQ ID NO: 7719304 - DNA, 22 bp, Homo sapiens
tgatggccagtcgcactggagg

SEQ ID NO: 7719305 - DNA, 22 bp, Homo sapiens
tgatggccagtcgcactggagg

SEQ ID NO: 7719306 - DNA, 22 bp, Homo sapiens
tgatggctcatgtttggggatg

SEQ ID NO: 7719307 - DNA, 22 bp, Homo sapiens
tgatggctcccatgggcatatg

SEQ ID NO: 7719308 - DNA, 22 bp, Homo sapiens
tgatggctccttcattatgggt

SEQ ID NO: 7719309 - DNA, 19 bp, Homo sapiens
tgatggctggaactatact

SEQ ID NO: 7719310 - DNA, 22 bp, Homo sapiens
tgatggctgtagggtccggggc

SEQ ID NO: 7719311 - DNA, 22 bp, Homo sapiens
tgatggcttagtggcagggcga

SEQ ID NO: 7719312 - DNA, 22 bp, Homo sapiens
tgatggcttagtggcagggcga

SEQ ID NO: 7719313 - DNA, 22 bp, Homo sapiens
tgatggcttatggagagagcaa

SEQ ID NO: 7719314 - DNA, 22 bp, Homo sapiens
tgatggcttatggagagagcaa

SEQ ID NO: 7719315 - DNA, 22 bp, Homo sapiens
tgatggcttcggacctgggcag

SEQ ID NO: 7719316 - DNA, 18 bp, Homo sapiens
tgatggaggagggctggt

SEQ ID NO: 7719317 - DNA, 22 bp, Homo sapiens
tgatggaggacccagcgtggga

SEQ ID NO: 7719318 - DNA, 22 bp, Homo sapiens
tgatggaggacccagcgtggga

SEQ ID NO: 7719319 - DNA, 22 bp, Homo sapiens
tgatggagcatgtgtgcttcct

SEQ ID NO: 7719320 - DNA, 22 bp, Homo sapiens
tgatggagcatgtgtgcttcct

SEQ ID NO: 7719321 - DNA, 22 bp, Homo sapiens
tgatggagcatgtgtgcttcct

SEQ ID NO: 7719322 - DNA, 22 bp, Homo sapiens
tgatggaatggaggacatgtgg

SEQ ID NO: 7719323 - DNA, 19 bp, Homo sapiens
tgatggaatttgacattcc

SEQ ID NO: 7719324 - DNA, 22 bp, Homo sapiens
tgatggaaggtttctcggtgat

SEQ ID NO: 7719325 - DNA, 22 bp, Homo sapiens
tgatggaagagctaacaatatc

SEQ ID NO: 7719326 - DNA, 22 bp, Homo sapiens
tgatggaatggaggacatgtgg

SEQ ID NO: 7719327 - DNA, 22 bp, Homo sapiens
tgatggaagtgactgtcagttc

SEQ ID NO: 7719328 - DNA, 22 bp, Homo sapiens
tgatggaatataccttcgggag

SEQ ID NO: 7719329 - DNA, 22 bp, Homo sapiens
tgatggaaatattgacaccaca

SEQ ID NO: 7719330 - DNA, 22 bp, Homo sapiens
tgatggaaatgttctgtatctg

SEQ ID NO: 7719331 - DNA, 23 bp, Homo sapiens
tgatggaaatgatctgggtctgt

SEQ ID NO: 7719332 - DNA, 22 bp, Homo sapiens
tgatggaaatgttctgtatctg

SEQ ID NO: 7719333 - DNA, 22 bp, Homo sapiens
tgatggaaatttgggaagcttt

SEQ ID NO: 7719334 - DNA, 22 bp, Homo sapiens
tgatggaacagcctttgccaaa

SEQ ID NO: 7719335 - DNA, 22 bp, Homo sapiens
tgatggaaaataaatcttattc

SEQ ID NO: 7719336 - DNA, 22 bp, Homo sapiens
tgatggaaacttgggtaagtca

SEQ ID NO: 7719337 - DNA, 21 bp, Homo sapiens
tgatggaaaggattttgggtc

SEQ ID NO: 7719338 - DNA, 22 bp, Homo sapiens
tgatggaaataaaagcatagct

SEQ ID NO: 7719339 - DNA, 22 bp, Homo sapiens
tgatggaaatattgacaccaca

SEQ ID NO: 7719340 - DNA, 22 bp, Homo sapiens
tgatggaaatatgtaatctggt

SEQ ID NO: 7719341 - DNA, 22 bp, Homo sapiens
tgatgctttaagattaatctgg

SEQ ID NO: 7719342 - DNA, 22 bp, Homo sapiens
tgatgctgtgtacctcatggga

SEQ ID NO: 7719343 - DNA, 22 bp, Homo sapiens
tgatgctgttccagttatattg

SEQ ID NO: 7719344 - DNA, 22 bp, Homo sapiens
tgatgctgtcaaggaggtgaac

SEQ ID NO: 7719345 - DNA, 22 bp, Homo sapiens
tgatgctgtcaaggaggtgaac

SEQ ID NO: 7719346 - DNA, 22 bp, Homo sapiens
tgatgctgtgtacctcatggga

SEQ ID NO: 7719347 - DNA, 22 bp, Homo sapiens
tgatgctgtgtacctcatggga

SEQ ID NO: 7719348 - DNA, 22 bp, Homo sapiens
tgatgctgctgggagtggtgct

SEQ ID NO: 7719349 - DNA, 22 bp, Homo sapiens
tgatgctgagcctgggactgac

SEQ ID NO: 7719350 - DNA, 22 bp, Homo sapiens
tgatgctctcctaatatgaaaa

SEQ ID NO: 7719351 - DNA, 22 bp, Homo sapiens
tgatgctctcctaatatgaaaa

SEQ ID NO: 7719352 - DNA, 22 bp, Homo sapiens
tgatgcctatgaattgtaatgt

SEQ ID NO: 7719353 - DNA, 22 bp, Homo sapiens
tgatgcctaatatacttcaatt

SEQ ID NO: 7719354 - DNA, 22 bp, Homo sapiens
tgatgcctatgaattgtaatgt

SEQ ID NO: 7719355 - DNA, 22 bp, Homo sapiens
tgatgcaatcctttagaagtaa

SEQ ID NO: 7719356 - DNA, 22 bp, Homo sapiens
tgatgcacaaagtcagcatcct

SEQ ID NO: 7719357 - DNA, 22 bp, Homo sapiens
tgatgcaattagattgtaattt

SEQ ID NO: 7719358 - DNA, 22 bp, Homo sapiens
tgatgcaatgtttacatcttga

SEQ ID NO: 7719359 - DNA, 22 bp, Homo sapiens
tgatgcaatgtttacatcttga

SEQ ID NO: 7719360 - DNA, 22 bp, Homo sapiens
tgatgatttgaaaccagtttct

SEQ ID NO: 7719361 - DNA, 22 bp, Homo sapiens
tgatgattgggagacatttggg

SEQ ID NO: 7719362 - DNA, 22 bp, Homo sapiens
tgatgattgggagacatttggg

SEQ ID NO: 7719363 - DNA, 22 bp, Homo sapiens
tgatgatttcatttctagctgt

SEQ ID NO: 7719364 - DNA, 22 bp, Homo sapiens
tgatgcattgccgacttactgg

SEQ ID NO: 7719365 - DNA, 22 bp, Homo sapiens
tgatgcagaatcctagagtgtc

SEQ ID NO: 7719366 - DNA, 22 bp, Homo sapiens
tgatgcacaaagtcagcatcct

SEQ ID NO: 7719367 - DNA, 22 bp, Homo sapiens
tgatgcccccaaatctggctca

SEQ ID NO: 7719368 - DNA, 22 bp, Homo sapiens
tgatgcatcattttcataaatt

SEQ ID NO: 7719369 - DNA, 19 bp, Homo sapiens
tgatgccctgacctgagcc

SEQ ID NO: 7719370 - DNA, 22 bp, Homo sapiens
tgatgcattgccgacttactgg

SEQ ID NO: 7719371 - DNA, 22 bp, Homo sapiens
tgatctttgggccattaataaa

SEQ ID NO: 7719372 - DNA, 22 bp, Homo sapiens
tgatctttggtagtacgataat

SEQ ID NO: 7719373 - DNA, 22 bp, Homo sapiens
tgatctttggtaatctggcaca

SEQ ID NO: 7719374 - DNA, 22 bp, Homo sapiens
tgatctttgggccattaataaa

SEQ ID NO: 7719375 - DNA, 22 bp, Homo sapiens
tgatctttgggccattaataaa

SEQ ID NO: 7719376 - DNA, 18 bp, Homo sapiens
tgatctttgagtataatg

SEQ ID NO: 7719377 - DNA, 18 bp, Homo sapiens
tgatctttgagtataatg

SEQ ID NO: 7719378 - DNA, 22 bp, Homo sapiens
tgatctttcctcttgtttgtct

SEQ ID NO: 7719379 - DNA, 22 bp, Homo sapiens
tgatctttcctcttgtttgtct

SEQ ID NO: 7719380 - DNA, 22 bp, Homo sapiens
tgatgaaaaccagaactctcat

SEQ ID NO: 7719381 - DNA, 22 bp, Homo sapiens
tgatgaaaaccagaactctcat

SEQ ID NO: 7719382 - DNA, 22 bp, Homo sapiens
tgatgaaaaccagaactctcat

SEQ ID NO: 7719383 - DNA, 22 bp, Homo sapiens
tgatgaaaaccagaactctcat

SEQ ID NO: 7719384 - DNA, 22 bp, Homo sapiens
tgatctttttggtcatttgggt

SEQ ID NO: 7719385 - DNA, 22 bp, Homo sapiens
tgatgaaaatgttcagcaatta

SEQ ID NO: 7719386 - DNA, 22 bp, Homo sapiens
tgatgaaaatatgattctgagg

SEQ ID NO: 7719387 - DNA, 22 bp, Homo sapiens
tgatgaaaatgttcagcaatta

SEQ ID NO: 7719388 - DNA, 22 bp, Homo sapiens
tgatgaaaatatgattctgagg

SEQ ID NO: 7719389 - DNA, 22 bp, Homo sapiens
tgatcttttctatttatggtag

SEQ ID NO: 7719390 - DNA, 22 bp, Homo sapiens
tgatcttttcaaagacaagctt

SEQ ID NO: 7719391 - DNA, 22 bp, Homo sapiens
tgatctttggtagtacgataat

SEQ ID NO: 7719392 - DNA, 22 bp, Homo sapiens
tgatctttttggtcatttgggt

SEQ ID NO: 7719393 - DNA, 22 bp, Homo sapiens
tgatgagtaaataaggttgagt

SEQ ID NO: 7719394 - DNA, 22 bp, Homo sapiens
tgatgaatgtcatacataatga

SEQ ID NO: 7719395 - DNA, 22 bp, Homo sapiens
tgatgaggtggattcaaagcag

SEQ ID NO: 7719396 - DNA, 22 bp, Homo sapiens
tgatgaataaacttgagagtca

SEQ ID NO: 7719397 - DNA, 22 bp, Homo sapiens
tgatgaaagttcagtagtgaat

SEQ ID NO: 7719398 - DNA, 22 bp, Homo sapiens
tgatgaaagttcagtagtgaat

SEQ ID NO: 7719399 - DNA, 22 bp, Homo sapiens
tgatgaaagttcagtagtgaat

SEQ ID NO: 7719400 - DNA, 22 bp, Homo sapiens
tgatgaaagtgtttactcacct

SEQ ID NO: 7719401 - DNA, 22 bp, Homo sapiens
tgatgaaagttcagtagtgaat

SEQ ID NO: 7719402 - DNA, 22 bp, Homo sapiens
tgatgaaagttcagtagtgaat

SEQ ID NO: 7719403 - DNA, 22 bp, Homo sapiens
tgatgaaaatgttcagcaatta

SEQ ID NO: 7719404 - DNA, 22 bp, Homo sapiens
tgatgaaactgaggttccaaga

SEQ ID NO: 7719405 - DNA, 22 bp, Homo sapiens
tgatgaaagtgtttactcacct

SEQ ID NO: 7719406 - DNA, 22 bp, Homo sapiens
tgatgaaaatgttcagcaatta

SEQ ID NO: 7719407 - DNA, 22 bp, Homo sapiens
tgatgaaagtgtttactcacct

SEQ ID NO: 7719408 - DNA, 22 bp, Homo sapiens
tgatgaaagtgtttactcacct

SEQ ID NO: 7719409 - DNA, 22 bp, Homo sapiens
tgattaaaatttaacttagtta

SEQ ID NO: 7719410 - DNA, 22 bp, Homo sapiens
tgattaaaatttaacttagtta

SEQ ID NO: 7719411 - DNA, 22 bp, Homo sapiens
tgatgtttaatactatgctttt

SEQ ID NO: 7719412 - DNA, 22 bp, Homo sapiens
tgatgtttaatactatgctttt

SEQ ID NO: 7719413 - DNA, 22 bp, Homo sapiens
tgattaaaatttaacttagtta

SEQ ID NO: 7719414 - DNA, 22 bp, Homo sapiens
tgattaaaatttaacttagtta

SEQ ID NO: 7719415 - DNA, 22 bp, Homo sapiens
tgatgtttaatactatgctttt

SEQ ID NO: 7719416 - DNA, 22 bp, Homo sapiens
tgattaaaggtggaaggcaggt

SEQ ID NO: 7719417 - DNA, 22 bp, Homo sapiens
tgattaaattaattaagatgag

SEQ ID NO: 7719418 - DNA, 22 bp, Homo sapiens
tgatgtttaatactatgctttt

SEQ ID NO: 7719419 - DNA, 22 bp, Homo sapiens
tgatgtttaatactatgctttt

SEQ ID NO: 7719420 - DNA, 22 bp, Homo sapiens
tgatgttctgtatatcatatag

SEQ ID NO: 7719421 - DNA, 22 bp, Homo sapiens
tgatgttctgtatatcatatag

SEQ ID NO: 7719422 - DNA, 22 bp, Homo sapiens
tgatgttcagtgaagaggaccg

SEQ ID NO: 7719423 - DNA, 22 bp, Homo sapiens
tgatgttcaacaagtacatatt

SEQ ID NO: 7719424 - DNA, 22 bp, Homo sapiens
tgatgttcagtgaagaggaccg

SEQ ID NO: 7719425 - DNA, 22 bp, Homo sapiens
tgatgttcagtgaagaggaccg

SEQ ID NO: 7719426 - DNA, 22 bp, Homo sapiens
tgatgttattagatacaaacca

SEQ ID NO: 7719427 - DNA, 22 bp, Homo sapiens
tgatgttcaacaagtacatatt

SEQ ID NO: 7719428 - DNA, 22 bp, Homo sapiens
tgatgttatggtactattcatt

SEQ ID NO: 7719429 - DNA, 22 bp, Homo sapiens
tgatgttatggtactattcatt

SEQ ID NO: 7719430 - DNA, 22 bp, Homo sapiens
tgatgtcaggcaagatacttaa

SEQ ID NO: 7719431 - DNA, 22 bp, Homo sapiens
tgatggtagtttatcaaaaaga

SEQ ID NO: 7719432 - DNA, 22 bp, Homo sapiens
tgatgtaagagatacacttgat

SEQ ID NO: 7719433 - DNA, 22 bp, Homo sapiens
tgatgtagctggtattcacgtg

SEQ ID NO: 7719434 - DNA, 22 bp, Homo sapiens
tgatgtaggacattattatttc

SEQ ID NO: 7719435 - DNA, 22 bp, Homo sapiens
tgatggtgggtctgatctcata

SEQ ID NO: 7719436 - DNA, 22 bp, Homo sapiens
tgatgtggccccacttagctgt

SEQ ID NO: 7719437 - DNA, 22 bp, Homo sapiens
tgatgtctgccagggtcctggg

SEQ ID NO: 7719438 - DNA, 22 bp, Homo sapiens
tgatgtctagtacatacaagag

SEQ ID NO: 7719439 - DNA, 22 bp, Homo sapiens
tgattaaattaattaagatgag

SEQ ID NO: 7719440 - DNA, 22 bp, Homo sapiens
tgattaactgtctattaatcat

SEQ ID NO: 7719441 - DNA, 22 bp, Homo sapiens
tgattaatatcaccaccattgg

SEQ ID NO: 7719442 - DNA, 22 bp, Homo sapiens
tgattaatatcaccaccattgg

SEQ ID NO: 7719443 - DNA, 22 bp, Homo sapiens
tgattaagttcaaaatatagaa

SEQ ID NO: 7719444 - DNA, 22 bp, Homo sapiens
tgattaagttcaaaatatagaa

SEQ ID NO: 7719445 - DNA, 22 bp, Homo sapiens
tgattacaacagagtcatccat

SEQ ID NO: 7719446 - DNA, 22 bp, Homo sapiens
tgattacaaaagattgtttgaa

SEQ ID NO: 7719447 - DNA, 22 bp, Homo sapiens
tgattacaaaagattgtttgaa

SEQ ID NO: 7719448 - DNA, 22 bp, Homo sapiens
tgattacaacagagtcatccat

SEQ ID NO: 7719449 - DNA, 23 bp, Homo sapiens
tgattacaagggccaaagaaagg

SEQ ID NO: 7719450 - DNA, 22 bp, Homo sapiens
tgattacaattgtcttagattt

SEQ ID NO: 7719451 - DNA, 22 bp, Homo sapiens
tgattacacaccacagtgctcc

SEQ ID NO: 7719452 - DNA, 23 bp, Homo sapiens
tgattacaagggccaaagaaagg

SEQ ID NO: 7719453 - DNA, 23 bp, Homo sapiens
tgattacaagggccaaagaaagg

SEQ ID NO: 7719454 - DNA, 23 bp, Homo sapiens
tgattcagaaggttgttattgct

SEQ ID NO: 7719455 - DNA, 22 bp, Homo sapiens
tgattcagacctgtcagacttc

SEQ ID NO: 7719456 - DNA, 22 bp, Homo sapiens
tgattcagacctgtcagacttc

SEQ ID NO: 7719457 - DNA, 22 bp, Homo sapiens
tgattcacgtaataagaaaaag

SEQ ID NO: 7719458 - DNA, 22 bp, Homo sapiens
tgattcaattatctgatgcttt

SEQ ID NO: 7719459 - DNA, 22 bp, Homo sapiens
tgattcaagctactgttactgg

SEQ ID NO: 7719460 - DNA, 18 bp, Homo sapiens
tgattcaagttgccctcc

SEQ ID NO: 7719461 - DNA, 22 bp, Homo sapiens
tgattcaataggaattgagtag

SEQ ID NO: 7719462 - DNA, 22 bp, Homo sapiens
tgattcaataggaattgagtag

SEQ ID NO: 7719463 - DNA, 22 bp, Homo sapiens
tgattcaataggaattgagtag

SEQ ID NO: 7719464 - DNA, 22 bp, Homo sapiens
tgattcagaggctattctcctt

SEQ ID NO: 7719465 - DNA, 22 bp, Homo sapiens
tgattcagacctgtcagacttc

SEQ ID NO: 7719466 - DNA, 23 bp, Homo sapiens
tgattcagcaagtccacttctgg

SEQ ID NO: 7719467 - DNA, 23 bp, Homo sapiens
tgattcagcaagtccacttctgg

SEQ ID NO: 7719468 - DNA, 23 bp, Homo sapiens
tgattcagcaagtccacttctgg

SEQ ID NO: 7719469 - DNA, 22 bp, Homo sapiens
tgattcagtactttctctaact

SEQ ID NO: 7719470 - DNA, 22 bp, Homo sapiens
tgattcagtactttctctaact

SEQ ID NO: 7719471 - DNA, 23 bp, Homo sapiens
tgattcagcaagtccacttctgg

SEQ ID NO: 7719472 - DNA, 22 bp, Homo sapiens
tgattcagtctcttcaggagaa

SEQ ID NO: 7719473 - DNA, 22 bp, Homo sapiens
tgattcagtctcttcaggagaa

SEQ ID NO: 7719474 - DNA, 22 bp, Homo sapiens
tgattcagttggttttgttcag

SEQ ID NO: 7719475 - DNA, 22 bp, Homo sapiens
tgattcagttggttttgttcag

SEQ ID NO: 7719476 - DNA, 22 bp, Homo sapiens
tgattcagtctcttcaggagaa

SEQ ID NO: 7719477 - DNA, 22 bp, Homo sapiens
tgattcagttggttttgttcag

SEQ ID NO: 7719478 - DNA, 22 bp, Homo sapiens
tgattcatatgtaacatccctg

SEQ ID NO: 7719479 - DNA, 22 bp, Homo sapiens
tgattcatcagaataggagttt

SEQ ID NO: 7719480 - DNA, 22 bp, Homo sapiens
tgattcatcagaataggagttt

SEQ ID NO: 7719481 - DNA, 22 bp, Homo sapiens
tgattgtatgattgaaatattt

SEQ ID NO: 7719482 - DNA, 22 bp, Homo sapiens
tgattgtatgattgaaatattt

SEQ ID NO: 7719483 - DNA, 22 bp, Homo sapiens
tgattgtatgattgaaatattt

SEQ ID NO: 7719484 - DNA, 22 bp, Homo sapiens
tgattgtttcctatgtacacct

SEQ ID NO: 7719485 - DNA, 22 bp, Homo sapiens
tgattgttttagttccctgatg

SEQ ID NO: 7719486 - DNA, 22 bp, Homo sapiens
tgatttaaaagaaacattgtct

SEQ ID NO: 7719487 - DNA, 22 bp, Homo sapiens
tgatttaaaagaaacattgtct

SEQ ID NO: 7719488 - DNA, 22 bp, Homo sapiens
tgatttaaaagaaacattgtct

SEQ ID NO: 7719489 - DNA, 22 bp, Homo sapiens
tgatttaaaagaaacattgtct

SEQ ID NO: 7719490 - DNA, 22 bp, Homo sapiens
tgattgtataggggttattaat

SEQ ID NO: 7719491 - DNA, 22 bp, Homo sapiens
tgattgcacacctgcactcaag

SEQ ID NO: 7719492 - DNA, 22 bp, Homo sapiens
tgattgtataggggttattaat

SEQ ID NO: 7719493 - DNA, 22 bp, Homo sapiens
tgattggtcaggctgtggtgac

SEQ ID NO: 7719494 - DNA, 22 bp, Homo sapiens
tgattgcctactatgtgccatg

SEQ ID NO: 7719495 - DNA, 22 bp, Homo sapiens
tgattgctgaattttaggaact

SEQ ID NO: 7719496 - DNA, 22 bp, Homo sapiens
tgattgcttctttgctatctgt

SEQ ID NO: 7719497 - DNA, 22 bp, Homo sapiens
tgattgcttctttgctatctgt

SEQ ID NO: 7719498 - DNA, 22 bp, Homo sapiens
tgattgctgaattttaggaact

SEQ ID NO: 7719499 - DNA, 22 bp, Homo sapiens
tgattgatggaggtgatttacc

SEQ ID NO: 7719500 - DNA, 22 bp, Homo sapiens
tgattgatacaactcaatccaa

SEQ ID NO: 7719501 - DNA, 21 bp, Homo sapiens
tgattgatatttgcaaacaga

SEQ ID NO: 7719502 - DNA, 22 bp, Homo sapiens
tgattgaattcaaatgcaatct

SEQ ID NO: 7719503 - DNA, 22 bp, Homo sapiens
tgattgaattcaaatgcaatct

SEQ ID NO: 7719504 - DNA, 22 bp, Homo sapiens
tgattgatacaactcaatccaa

SEQ ID NO: 7719505 - DNA, 22 bp, Homo sapiens
tgattctttctccaccaattca

SEQ ID NO: 7719506 - DNA, 22 bp, Homo sapiens
tgattctttgaccaaaaaattg

SEQ ID NO: 7719507 - DNA, 21 bp, Homo sapiens
tgattctgttttatcatcagc

SEQ ID NO: 7719508 - DNA, 18 bp, Homo sapiens
tgattctgtgatgtggtc

SEQ ID NO: 7719509 - DNA, 22 bp, Homo sapiens
tgattctgtgaattagttgggt

SEQ ID NO: 7719510 - DNA, 22 bp, Homo sapiens
tgattctgtctccttcactccg

SEQ ID NO: 7719511 - DNA, 22 bp, Homo sapiens
tgattctgtaagtcatattgtt

SEQ ID NO: 7719512 - DNA, 22 bp, Homo sapiens
tgattctgtaagtcatattgtt

SEQ ID NO: 7719513 - DNA, 22 bp, Homo sapiens
tgattctttggagagctatata

SEQ ID NO: 7719514 - DNA, 22 bp, Homo sapiens
tgattctttggagagctatata

SEQ ID NO: 7719515 - DNA, 22 bp, Homo sapiens
tgattctttggagagctatata

SEQ ID NO: 7719516 - DNA, 23 bp, Homo sapiens
tgattgaaatgaggagtatttgt

SEQ ID NO: 7719517 - DNA, 23 bp, Homo sapiens
tgattgaaatgaggagtatttgt

SEQ ID NO: 7719518 - DNA, 23 bp, Homo sapiens
tgattgaaatgaggagtatttgt

SEQ ID NO: 7719519 - DNA, 22 bp, Homo sapiens
tgattgaattcaaatgcaatct

SEQ ID NO: 7719520 - DNA, 23 bp, Homo sapiens
tgattgaaagcctgagaaagctg

SEQ ID NO: 7719521 - DNA, 21 bp, Homo sapiens
tgattccctaatcccagcacc

SEQ ID NO: 7719522 - DNA, 22 bp, Homo sapiens
tgattccatggtcaattccagg

SEQ ID NO: 7719523 - DNA, 22 bp, Homo sapiens
tgattccatggtcaattccagg

SEQ ID NO: 7719524 - DNA, 22 bp, Homo sapiens
tgattccagcaacccaggaatt

SEQ ID NO: 7719525 - DNA, 22 bp, Homo sapiens
tgattccagcaacccaggaatt

SEQ ID NO: 7719526 - DNA, 22 bp, Homo sapiens
tgattccactctgaggatcgta

SEQ ID NO: 7719527 - DNA, 22 bp, Homo sapiens
tgattccagataatagtactga

SEQ ID NO: 7719528 - DNA, 22 bp, Homo sapiens
tgattcgattcctttgtcttca

SEQ ID NO: 7719529 - DNA, 22 bp, Homo sapiens
tgattctaggtccattatttgc

SEQ ID NO: 7719530 - DNA, 22 bp, Homo sapiens
tgattctaggtccattatttgc

SEQ ID NO: 7719531 - DNA, 22 bp, Homo sapiens
tgattctaggtccattatttgc

SEQ ID NO: 7719532 - DNA, 22 bp, Homo sapiens
tgattcctaggcactcttctcc

SEQ ID NO: 7719533 - DNA, 21 bp, Homo sapiens
tgattccctaatcccagcacc

SEQ ID NO: 7719534 - DNA, 22 bp, Homo sapiens
tgattccatgcagtaaaaggca

SEQ ID NO: 7719535 - DNA, 22 bp, Homo sapiens
tgattcctgtgcttattccagt

SEQ ID NO: 7719536 - DNA, 22 bp, Homo sapiens
tgattccaaagaatttaagttc

SEQ ID NO: 7719537 - DNA, 22 bp, Homo sapiens
tgattccaaagaatttaagttc

SEQ ID NO: 7719538 - DNA, 22 bp, Homo sapiens
tgattcatcagaataggagttt

SEQ ID NO: 7719539 - DNA, 19 bp, Homo sapiens
tgattcatctaactgcctc

SEQ ID NO: 7719540 - DNA, 22 bp, Homo sapiens
tgattccaaattcacatgcttt

SEQ ID NO: 7719541 - DNA, 22 bp, Homo sapiens
tgattccaaattcacatgcttt

SEQ ID NO: 7719542 - DNA, 22 bp, Homo sapiens
tgattccaagacctattctatt

SEQ ID NO: 7719543 - DNA, 22 bp, Homo sapiens
tgattccaagacctattctatt

SEQ ID NO: 7719544 - DNA, 21 bp, Homo sapiens
tgattctgcatttctaacagg

SEQ ID NO: 7719545 - DNA, 21 bp, Homo sapiens
tgattctgcatttctaacagg

SEQ ID NO: 7719546 - DNA, 22 bp, Homo sapiens
tgattctgccacgtactggctg

SEQ ID NO: 7719547 - DNA, 22 bp, Homo sapiens
tgattctgccccttggctctgg

SEQ ID NO: 7719548 - DNA, 22 bp, Homo sapiens
tgattctgatcatcatcatggt

SEQ ID NO: 7719549 - DNA, 22 bp, Homo sapiens
tgattctgatcatcatcatggt

SEQ ID NO: 7719550 - DNA, 22 bp, Homo sapiens
tgattctgcttatgggtggatt

SEQ ID NO: 7719551 - DNA, 22 bp, Homo sapiens
tgattctgccctttcttctgac

SEQ ID NO: 7719552 - DNA, 23 bp, Homo sapiens
tgattctgctttgagaatcatgg

SEQ ID NO: 7719553 - DNA, 22 bp, Homo sapiens
tgattctgccctttcttctgac

SEQ ID NO: 7719554 - DNA, 22 bp, Homo sapiens
tgattctcttagatgatgtgtt

SEQ ID NO: 7719555 - DNA, 21 bp, Homo sapiens
tgattctctgactgtcggaca

SEQ ID NO: 7719556 - DNA, 22 bp, Homo sapiens
tgattctctgatggagaaagac

SEQ ID NO: 7719557 - DNA, 22 bp, Homo sapiens
tgattctcttgtaagctatgtt

SEQ ID NO: 7719558 - DNA, 22 bp, Homo sapiens
tgattctgaggaccctgtgacg

SEQ ID NO: 7719559 - DNA, 22 bp, Homo sapiens
tgattctgagggagcattctgc

SEQ ID NO: 7719560 - DNA, 22 bp, Homo sapiens
tgattctcaaaggtagactggg

SEQ ID NO: 7719561 - DNA, 22 bp, Homo sapiens
tgattctcaaaggtagactggg

SEQ ID NO: 7719562 - DNA, 22 bp, Homo sapiens
tgattctcacagtgggacctca

SEQ ID NO: 7719563 - DNA, 22 bp, Homo sapiens
tgattctcattatcttggggtg

SEQ ID NO: 7719564 - DNA, 22 bp, Homo sapiens
tgattctatggaaggcataagg

SEQ ID NO: 7719565 - DNA, 22 bp, Homo sapiens
tgatttacacacctatgattta

SEQ ID NO: 7719566 - DNA, 22 bp, Homo sapiens
tgatttacacacctatgattta

SEQ ID NO: 7719567 - DNA, 22 bp, Homo sapiens
tgatttacacatcaaagcagca

SEQ ID NO: 7719568 - DNA, 22 bp, Homo sapiens
tgatttacagtagtgtctaaac

SEQ ID NO: 7719569 - DNA, 22 bp, Homo sapiens
tgatttacacatcaaagcagca

SEQ ID NO: 7719570 - DNA, 22 bp, Homo sapiens
tgatttacagtagtgtctaaac

SEQ ID NO: 7719571 - DNA, 22 bp, Homo sapiens
tgatttacagtagtgtctaaac

SEQ ID NO: 7719572 - DNA, 22 bp, Homo sapiens
tgatttaccagttactatcttg

SEQ ID NO: 7719573 - DNA, 22 bp, Homo sapiens
tgatttaccagttactatcttg

SEQ ID NO: 7719574 - DNA, 22 bp, Homo sapiens
tgatttaccagttactatcttg

SEQ ID NO: 7719575 - DNA, 22 bp, Homo sapiens
tgatttaccagttactatcttg

SEQ ID NO: 7719576 - DNA, 22 bp, Homo sapiens
tgatttaaaagaaacattgtct

SEQ ID NO: 7719577 - DNA, 22 bp, Homo sapiens
tgatttaaaagaaacattgtct

SEQ ID NO: 7719578 - DNA, 22 bp, Homo sapiens
tgatttacaattgtaaaagttt

SEQ ID NO: 7719579 - DNA, 22 bp, Homo sapiens
tgatttacaattgtaaaagttt

SEQ ID NO: 7719580 - DNA, 22 bp, Homo sapiens
tgatttacaattgtaaaagttt

SEQ ID NO: 7719581 - DNA, 22 bp, Homo sapiens
tgatttacacacctatgattta

SEQ ID NO: 7719582 - DNA, 22 bp, Homo sapiens
tgatttacacacctatgattta

SEQ ID NO: 7719583 - DNA, 22 bp, Homo sapiens
tgatttacacacctatgattta

SEQ ID NO: 7719584 - DNA, 22 bp, Homo sapiens
tgatttacttctggataaatcc

SEQ ID NO: 7719585 - DNA, 22 bp, Homo sapiens
tgatttacttctggataaatcc

SEQ ID NO: 7719586 - DNA, 22 bp, Homo sapiens
tgatttacttctggataaatcc

SEQ ID NO: 7719587 - DNA, 22 bp, Homo sapiens
tgatttacttctggataaatcc

SEQ ID NO: 7719588 - DNA, 22 bp, Homo sapiens
tgatttaggaaacagctacagg

SEQ ID NO: 7719589 - DNA, 22 bp, Homo sapiens
tgatttacccgtaactatttct

SEQ ID NO: 7719590 - DNA, 22 bp, Homo sapiens
tgatttacccgtaactatttct

SEQ ID NO: 7719591 - DNA, 22 bp, Homo sapiens
tgatttacccgtccaggcccta

SEQ ID NO: 7719592 - DNA, 22 bp, Homo sapiens
tgatttactcccacttagagcc

SEQ ID NO: 7719593 - DNA, 22 bp, Homo sapiens
tgatttacttcccagctgggtt

SEQ ID NO: 7719594 - DNA, 22 bp, Homo sapiens
tgatttatgaccaagttagaat

SEQ ID NO: 7719595 - DNA, 17 bp, Homo sapiens
tgatttagtaagctgcc

SEQ ID NO: 7719596 - DNA, 22 bp, Homo sapiens
tgatttatgaccaagttagaat

SEQ ID NO: 7719597 - DNA, 22 bp, Homo sapiens
tgatttatgaccaagttagaat

SEQ ID NO: 7719598 - DNA, 17 bp, Homo sapiens
tgatttagtaagctgcc

SEQ ID NO: 7719599 - DNA, 22 bp, Homo sapiens
tgatttacttctggataaatcc

SEQ ID NO: 7719600 - DNA, 22 bp, Homo sapiens
tgatttatgcattatactgttg

SEQ ID NO: 7719601 - DNA, 22 bp, Homo sapiens
tgatttatgaccaagttagaat

SEQ ID NO: 7719602 - DNA, 22 bp, Homo sapiens
tgatttatgaccaagttagaat

SEQ ID NO: 7719603 - DNA, 22 bp, Homo sapiens
tgatttatgaccaagttagaat

SEQ ID NO: 7719604 - DNA, 22 bp, Homo sapiens
tgatttatgaccaagttagaat

SEQ ID NO: 7719605 - DNA, 22 bp, Homo sapiens
tgatttcatagtatatacatga

SEQ ID NO: 7719606 - DNA, 22 bp, Homo sapiens
tgatttcatagtatatacatga

SEQ ID NO: 7719607 - DNA, 22 bp, Homo sapiens
tgatttcagtaatgaggatgaa

SEQ ID NO: 7719608 - DNA, 22 bp, Homo sapiens
tgatttcaagtagtgacatgct

SEQ ID NO: 7719609 - DNA, 22 bp, Homo sapiens
tgatttcaggaatgtcttagca

SEQ ID NO: 7719610 - DNA, 22 bp, Homo sapiens
tgatttcaggaatgtcttagca

SEQ ID NO: 7719611 - DNA, 22 bp, Homo sapiens
tgatttccaaaaggcttctaag

SEQ ID NO: 7719612 - DNA, 22 bp, Homo sapiens
tgatttccaataaggagaatgt

SEQ ID NO: 7719613 - DNA, 22 bp, Homo sapiens
tgatttatgcattatactgttg

SEQ ID NO: 7719614 - DNA, 22 bp, Homo sapiens
tgatttatgcattatactgttg

SEQ ID NO: 7719615 - DNA, 22 bp, Homo sapiens
tgatttatgcattatactgttg

SEQ ID NO: 7719616 - DNA, 22 bp, Homo sapiens
tgatttcaagccagggggcgtt

SEQ ID NO: 7719617 - DNA, 21 bp, Homo sapiens
tgatttatgcccaagtccctg

SEQ ID NO: 7719618 - DNA, 22 bp, Homo sapiens
tgatttcaagccagggggcgtt

SEQ ID NO: 7719619 - DNA, 22 bp, Homo sapiens
tgatttcaagccagggggcgtt

SEQ ID NO: 7719620 - DNA, 22 bp, Homo sapiens
tgatttcctaggtctggagaag

SEQ ID NO: 7719621 - DNA, 15 bp, Homo sapiens
tgatttcctactaac

SEQ ID NO: 7719622 - DNA, 22 bp, Homo sapiens
tgatttcctagctgacatgaaa

SEQ ID NO: 7719623 - DNA, 22 bp, Homo sapiens
tgatttccctgtagcctctgaa

SEQ ID NO: 7719624 - DNA, 22 bp, Homo sapiens
tgatttccctcatcataacaga

SEQ ID NO: 7719625 - DNA, 22 bp, Homo sapiens
tgatttccctcatcataacaga

SEQ ID NO: 7719626 - DNA, 22 bp, Homo sapiens
tgatttccctcatcataacaga

SEQ ID NO: 7719627 - DNA, 22 bp, Homo sapiens
tgatttccatgaagctgaaggc

SEQ ID NO: 7719628 - DNA, 22 bp, Homo sapiens
tgatttccatgaagctgaaggc

SEQ ID NO: 7719629 - DNA, 22 bp, Homo sapiens
tgatttccccagtcttgctgct

SEQ ID NO: 7719630 - DNA, 21 bp, Homo sapiens
tgatttccagaaaattggccc

SEQ ID NO: 7719631 - DNA, 23 bp, Homo sapiens
tgatttccagtgagtcagtggga

SEQ ID NO: 7719632 - DNA, 22 bp, Homo sapiens
tgatttccagttgctgggtgct

SEQ ID NO: 7719633 - DNA, 22 bp, Homo sapiens
tgatttccacagtcaggggtgc

SEQ ID NO: 7719634 - DNA, 22 bp, Homo sapiens
tgatttccacgtgcacccaggt

SEQ ID NO: 7719635 - DNA, 21 bp, Homo sapiens
tgatttccatcttaaaataaa

SEQ ID NO: 7719636 - DNA, 22 bp, Homo sapiens
tgcaaaaactgcaattgctttt

SEQ ID NO: 7719637 - DNA, 22 bp, Homo sapiens
tgcaaaaagagcgaggagccct

SEQ ID NO: 7719638 - DNA, 22 bp, Homo sapiens
tgcaaaaactgcaattgctttt

SEQ ID NO: 7719639 - DNA, 22 bp, Homo sapiens
tgcaaaaactgcaattgctttt

SEQ ID NO: 7719640 - DNA, 22 bp, Homo sapiens
tgcaaaaactgcaattgctttt

SEQ ID NO: 7719641 - DNA, 22 bp, Homo sapiens
tgcaaaaactgcaattgctttt

SEQ ID NO: 7719642 - DNA, 22 bp, Homo sapiens
tgcaaaaactgcaattgctttt

SEQ ID NO: 7719643 - DNA, 22 bp, Homo sapiens
tgcaaaaactgcaattgctttt

SEQ ID NO: 7719644 - DNA, 22 bp, Homo sapiens
tgcaaaaactgcaattgctttt

SEQ ID NO: 7719645 - DNA, 22 bp, Homo sapiens
tgcaaaaagagcgaggagccct

SEQ ID NO: 7719646 - DNA, 22 bp, Homo sapiens
tgcaaaaagagcgaggagccct

SEQ ID NO: 7719647 - DNA, 22 bp, Homo sapiens
tgcaaaaagagcgaggagccct

SEQ ID NO: 7719648 - DNA, 22 bp, Homo sapiens
tgcaaaaagagcgaggagccct

SEQ ID NO: 7719649 - DNA, 22 bp, Homo sapiens
tgcaaaaagagcgaggagccct

SEQ ID NO: 7719650 - DNA, 22 bp, Homo sapiens
tgcaaaaaggcagactggtgat

SEQ ID NO: 7719651 - DNA, 22 bp, Homo sapiens
tgcaaaaaggcagactggtgat

SEQ ID NO: 7719652 - DNA, 22 bp, Homo sapiens
tgcaaaaaggcagactggtgat

SEQ ID NO: 7719653 - DNA, 22 bp, Homo sapiens
tgcaaaaaggcagactggtgat

SEQ ID NO: 7719654 - DNA, 22 bp, Homo sapiens
tgcaaaaattgctggaatcttt

SEQ ID NO: 7719655 - DNA, 22 bp, Homo sapiens
tgcaaaaattgctggaatcttt

SEQ ID NO: 7719656 - DNA, 22 bp, Homo sapiens
tgcaaaaattgctggaatcttt

SEQ ID NO: 7719657 - DNA, 22 bp, Homo sapiens
tgcaaaaaggcagactggtgat

SEQ ID NO: 7719658 - DNA, 22 bp, Homo sapiens
tgcaaaaattgctggaatcttt

SEQ ID NO: 7719659 - DNA, 22 bp, Homo sapiens
tgcaaaacttctcagagccttt

SEQ ID NO: 7719660 - DNA, 22 bp, Homo sapiens
tgcaaaagaatatagatattgt

SEQ ID NO: 7719661 - DNA, 22 bp, Homo sapiens
tgcaaaagaatatagatattgt

SEQ ID NO: 7719662 - DNA, 22 bp, Homo sapiens
tgcaaaagaatatagatattgt

SEQ ID NO: 7719663 - DNA, 22 bp, Homo sapiens
tgcaaaagaatatagatattgt

SEQ ID NO: 7719664 - DNA, 22 bp, Homo sapiens
tgcaaaagaatatagatattgt

SEQ ID NO: 7719665 - DNA, 22 bp, Homo sapiens
tgcaaaagaatatagatattgt

SEQ ID NO: 7719666 - DNA, 22 bp, Homo sapiens
tgcaaaacttctcagagccttt

SEQ ID NO: 7719667 - DNA, 22 bp, Homo sapiens
tgcaaaagaatatagatattgt

SEQ ID NO: 7719668 - DNA, 22 bp, Homo sapiens
tgcaaaataatgaacgattttt

SEQ ID NO: 7719669 - DNA, 22 bp, Homo sapiens
tgcaaaataatgaacgattttt

SEQ ID NO: 7719670 - DNA, 22 bp, Homo sapiens
tgcaaaataatgaacgattttt

SEQ ID NO: 7719671 - DNA, 22 bp, Homo sapiens
tgcaaaatgacttctgaaaaga

SEQ ID NO: 7719672 - DNA, 22 bp, Homo sapiens
tgcaaaataatgaacgattttt

SEQ ID NO: 7719673 - DNA, 22 bp, Homo sapiens
tgcaaaatgacttctgaaaaga

SEQ ID NO: 7719674 - DNA, 22 bp, Homo sapiens
tgcaaaatgacttctgaaaaga

SEQ ID NO: 7719675 - DNA, 22 bp, Homo sapiens
tgcaaaatgacttctgaaaaga

SEQ ID NO: 7719676 - DNA, 22 bp, Homo sapiens
tgatttttagctattctgaaga

SEQ ID NO: 7719677 - DNA, 22 bp, Homo sapiens
tgatttttagctattctgaaga

SEQ ID NO: 7719678 - DNA, 22 bp, Homo sapiens
tgatttttagctattctgaaga

SEQ ID NO: 7719679 - DNA, 22 bp, Homo sapiens
tgatttttaaaattctccttgc

SEQ ID NO: 7719680 - DNA, 22 bp, Homo sapiens
tgatttttagctattctgaaga

SEQ ID NO: 7719681 - DNA, 22 bp, Homo sapiens
tgatttttagctattctgaaga

SEQ ID NO: 7719682 - DNA, 22 bp, Homo sapiens
tgatttttaaaattctccttgc

SEQ ID NO: 7719683 - DNA, 22 bp, Homo sapiens
tgatttttaaaattctccttgc

SEQ ID NO: 7719684 - DNA, 22 bp, Homo sapiens
tgatttttaaaattctccttgc

SEQ ID NO: 7719685 - DNA, 22 bp, Homo sapiens
tgatttttagctattctgaaga

SEQ ID NO: 7719686 - DNA, 22 bp, Homo sapiens
tgatttttagctattctgaaga

SEQ ID NO: 7719687 - DNA, 22 bp, Homo sapiens
tgatttttagctattctgaaga

SEQ ID NO: 7719688 - DNA, 22 bp, Homo sapiens
tgatttttaaaattctccttgc

SEQ ID NO: 7719689 - DNA, 22 bp, Homo sapiens
tgcaaaaacagccttgaggcct

SEQ ID NO: 7719690 - DNA, 22 bp, Homo sapiens
tgatttttggatctgagctgca

SEQ ID NO: 7719691 - DNA, 22 bp, Homo sapiens
tgatttttggatctgagctgca

SEQ ID NO: 7719692 - DNA, 22 bp, Homo sapiens
tgcaaaaacagccttgaggcct

SEQ ID NO: 7719693 - DNA, 22 bp, Homo sapiens
tgcaaaaacagccttgaggcct

SEQ ID NO: 7719694 - DNA, 22 bp, Homo sapiens
tgcaaaaacagccttgaggcct

SEQ ID NO: 7719695 - DNA, 22 bp, Homo sapiens
tgatttttagctattctgaaga

SEQ ID NO: 7719696 - DNA, 22 bp, Homo sapiens
tgatttttagctattctgaaga

SEQ ID NO: 7719697 - DNA, 22 bp, Homo sapiens
tgatttttggatctgagctgca

SEQ ID NO: 7719698 - DNA, 22 bp, Homo sapiens
tgatttttggatctgagctgca

SEQ ID NO: 7719699 - DNA, 22 bp, Homo sapiens
tgatttttggatctgagctgca

SEQ ID NO: 7719700 - DNA, 22 bp, Homo sapiens
tgatttttggatctgagctgca

SEQ ID NO: 7719701 - DNA, 22 bp, Homo sapiens
tgattttctccattgtaaattc

SEQ ID NO: 7719702 - DNA, 22 bp, Homo sapiens
tgattttctccattgtaaattc

SEQ ID NO: 7719703 - DNA, 22 bp, Homo sapiens
tgattttcatgggtgatctttg

SEQ ID NO: 7719704 - DNA, 22 bp, Homo sapiens
tgattttcatgggtgatctttg

SEQ ID NO: 7719705 - DNA, 22 bp, Homo sapiens
tgattttctccattgtaaattc

SEQ ID NO: 7719706 - DNA, 22 bp, Homo sapiens
tgattttctccattgtaaattc

SEQ ID NO: 7719707 - DNA, 22 bp, Homo sapiens
tgattttctccattgtaaattc

SEQ ID NO: 7719708 - DNA, 20 bp, Homo sapiens
tgattttctgaaacagcaca

SEQ ID NO: 7719709 - DNA, 20 bp, Homo sapiens
tgattttctgaaacagcaca

SEQ ID NO: 7719710 - DNA, 20 bp, Homo sapiens
tgattttctgaaacagcaca

SEQ ID NO: 7719711 - DNA, 22 bp, Homo sapiens
tgattttgtcatgtttctgata

SEQ ID NO: 7719712 - DNA, 22 bp, Homo sapiens
tgattttgtcatgtttctgata

SEQ ID NO: 7719713 - DNA, 22 bp, Homo sapiens
tgatttcctggctttggagttc

SEQ ID NO: 7719714 - DNA, 22 bp, Homo sapiens
tgattttcatgggtgatctttg

SEQ ID NO: 7719715 - DNA, 22 bp, Homo sapiens
tgattttcatgggtgatctttg

SEQ ID NO: 7719716 - DNA, 22 bp, Homo sapiens
tgattttcatgggtgatctttg

SEQ ID NO: 7719717 - DNA, 22 bp, Homo sapiens
tgattttcatgggtgatctttg

SEQ ID NO: 7719718 - DNA, 22 bp, Homo sapiens
tgatttcctggctttggagttc

SEQ ID NO: 7719719 - DNA, 22 bp, Homo sapiens
tgatttcctctactagcaatta

SEQ ID NO: 7719720 - DNA, 22 bp, Homo sapiens
tgcaaattgcatgatgtgtatc

SEQ ID NO: 7719721 - DNA, 22 bp, Homo sapiens
tgcaaattgcatgatgtgtatc

SEQ ID NO: 7719722 - DNA, 22 bp, Homo sapiens
tgcaaattgcgatttttattag

SEQ ID NO: 7719723 - DNA, 22 bp, Homo sapiens
tgcaaattgcgatttttattag

SEQ ID NO: 7719724 - DNA, 22 bp, Homo sapiens
tgcaaattgcgatttttattag

SEQ ID NO: 7719725 - DNA, 22 bp, Homo sapiens
tgcaaattggtgaggaccactt

SEQ ID NO: 7719726 - DNA, 22 bp, Homo sapiens
tgcaaatttatatggtgactgc

SEQ ID NO: 7719727 - DNA, 22 bp, Homo sapiens
tgcaaatttatatggtgactgc

SEQ ID NO: 7719728 - DNA, 22 bp, Homo sapiens
tgcaaatttaatgaaactatgt

SEQ ID NO: 7719729 - DNA, 22 bp, Homo sapiens
tgcaaatttaatgaaactatgt

SEQ ID NO: 7719730 - DNA, 22 bp, Homo sapiens
tgcaaatttaatgaaactatgt

SEQ ID NO: 7719731 - DNA, 22 bp, Homo sapiens
tgcaaatttaatgaaactatgt

SEQ ID NO: 7719732 - DNA, 22 bp, Homo sapiens
tgcaaatttaatgaaactatgt

SEQ ID NO: 7719733 - DNA, 22 bp, Homo sapiens
tgcaaattcagaagaactgccc

SEQ ID NO: 7719734 - DNA, 22 bp, Homo sapiens
tgcaaattcagaagaactgccc

SEQ ID NO: 7719735 - DNA, 19 bp, Homo sapiens
tgcaaattctaaaaactga

SEQ ID NO: 7719736 - DNA, 19 bp, Homo sapiens
tgcaaattctaaaaactga

SEQ ID NO: 7719737 - DNA, 22 bp, Homo sapiens
tgcaaattccatttaaacacta

SEQ ID NO: 7719738 - DNA, 22 bp, Homo sapiens
tgcaaattccatttaaacacta

SEQ ID NO: 7719739 - DNA, 19 bp, Homo sapiens
tgcaaattctaaaaactga

SEQ ID NO: 7719740 - DNA, 19 bp, Homo sapiens
tgcaaattctaaaaactga

SEQ ID NO: 7719741 - DNA, 19 bp, Homo sapiens
tgcaaattctaaaaactga

SEQ ID NO: 7719742 - DNA, 19 bp, Homo sapiens
tgcaaattctaaaaactga

SEQ ID NO: 7719743 - DNA, 22 bp, Homo sapiens
tgcaaattctttactctgtgat

SEQ ID NO: 7719744 - DNA, 22 bp, Homo sapiens
tgcaaatgggtgagggttagga

SEQ ID NO: 7719745 - DNA, 22 bp, Homo sapiens
tgcaaatgggcatctccaagtg

SEQ ID NO: 7719746 - DNA, 22 bp, Homo sapiens
tgcaaatgggcatctccaagtg

SEQ ID NO: 7719747 - DNA, 18 bp, Homo sapiens
tgcaaatggctgtttgat

SEQ ID NO: 7719748 - DNA, 22 bp, Homo sapiens
tgcaaatgggaaacccagcagt

SEQ ID NO: 7719749 - DNA, 18 bp, Homo sapiens
tgcaaatggctgtttgat

SEQ ID NO: 7719750 - DNA, 18 bp, Homo sapiens
tgcaaatggctgtttgat

SEQ ID NO: 7719751 - DNA, 22 bp, Homo sapiens
tgcaaatgtgtaggtttacata

SEQ ID NO: 7719752 - DNA, 22 bp, Homo sapiens
tgcaaatgtgtggtgaggcatt

SEQ ID NO: 7719753 - DNA, 22 bp, Homo sapiens
tgcaaatgtcaagggttagtgt

SEQ ID NO: 7719754 - DNA, 19 bp, Homo sapiens
tgcaaatgtaggaagaata

SEQ ID NO: 7719755 - DNA, 19 bp, Homo sapiens
tgcaaatgtaggaagaata

SEQ ID NO: 7719756 - DNA, 22 bp, Homo sapiens
tgcaaatgtgttttaaaccaaa

SEQ ID NO: 7719757 - DNA, 23 bp, Homo sapiens
tgcaaattaggccgggactcagc

SEQ ID NO: 7719758 - DNA, 22 bp, Homo sapiens
tgcaaagatatgagaagctgta

SEQ ID NO: 7719759 - DNA, 22 bp, Homo sapiens
tgcaaagatatgagaagctgta

SEQ ID NO: 7719760 - DNA, 22 bp, Homo sapiens
tgcaaagaaggggaggaggatt

SEQ ID NO: 7719761 - DNA, 22 bp, Homo sapiens
tgcaaagaaggggaggaggatt

SEQ ID NO: 7719762 - DNA, 22 bp, Homo sapiens
tgcaaagatgaaatattaaagg

SEQ ID NO: 7719763 - DNA, 22 bp, Homo sapiens
tgcaaagatgaaatattaaagg

SEQ ID NO: 7719764 - DNA, 22 bp, Homo sapiens
tgcaaagaagcaacatccttgt

SEQ ID NO: 7719765 - DNA, 22 bp, Homo sapiens
tgcaaagaagcctttgccttct

SEQ ID NO: 7719766 - DNA, 19 bp, Homo sapiens
tgcaaatgctgttgagaat

SEQ ID NO: 7719767 - DNA, 19 bp, Homo sapiens
tgcaaatgctgttgagaat

SEQ ID NO: 7719768 - DNA, 22 bp, Homo sapiens
tgcaaatggagcatgtataaga

SEQ ID NO: 7719769 - DNA, 22 bp, Homo sapiens
tgcaaatgcccatttattttct

SEQ ID NO: 7719770 - DNA, 22 bp, Homo sapiens
tgcaaatgcccatttattttct

SEQ ID NO: 7719771 - DNA, 22 bp, Homo sapiens
tgcaaatgcccatttattttct

SEQ ID NO: 7719772 - DNA, 22 bp, Homo sapiens
tgcaaatcatcctggattagag

SEQ ID NO: 7719773 - DNA, 22 bp, Homo sapiens
tgcaaatcatcctggattagag

SEQ ID NO: 7719774 - DNA, 22 bp, Homo sapiens
tgcaaatcataaacaatagtgt

SEQ ID NO: 7719775 - DNA, 22 bp, Homo sapiens
tgcaaatcctgtttggagtaag

SEQ ID NO: 7719776 - DNA, 22 bp, Homo sapiens
tgcaaatatttccttatagcca

SEQ ID NO: 7719777 - DNA, 22 bp, Homo sapiens
tgcaaatatttccttatagcca

SEQ ID NO: 7719778 - DNA, 22 bp, Homo sapiens
tgcaaagatttatctttctcca

SEQ ID NO: 7719779 - DNA, 22 bp, Homo sapiens
tgcaaatatttccttatagcca

SEQ ID NO: 7719780 - DNA, 22 bp, Homo sapiens
tgcaaatatttccttatagcca

SEQ ID NO: 7719781 - DNA, 22 bp, Homo sapiens
tgcaaatatttccttatagcca

SEQ ID NO: 7719782 - DNA, 20 bp, Homo sapiens
tgcaaacacagagtgtatga

SEQ ID NO: 7719783 - DNA, 20 bp, Homo sapiens
tgcaaacacagagtgtatga

SEQ ID NO: 7719784 - DNA, 20 bp, Homo sapiens
tgcaaacacagagtgtatga

SEQ ID NO: 7719785 - DNA, 22 bp, Homo sapiens
tgcaaacaatttcctataaagt

SEQ ID NO: 7719786 - DNA, 22 bp, Homo sapiens
tgcaaacaatttcctataaagt

SEQ ID NO: 7719787 - DNA, 20 bp, Homo sapiens
tgcaaacacagagtgtatga

SEQ ID NO: 7719788 - DNA, 20 bp, Homo sapiens
tgcaaacacagagtgtatga

SEQ ID NO: 7719789 - DNA, 20 bp, Homo sapiens
tgcaaacacagagtgtatga

SEQ ID NO: 7719790 - DNA, 22 bp, Homo sapiens
tgcaaacaccacagagacaatt

SEQ ID NO: 7719791 - DNA, 22 bp, Homo sapiens
tgcaaacaccacagagacaatt

SEQ ID NO: 7719792 - DNA, 20 bp, Homo sapiens
tgcaaacacagagtgtatga

SEQ ID NO: 7719793 - DNA, 22 bp, Homo sapiens
tgcaaacagaaaagctactttg

SEQ ID NO: 7719794 - DNA, 22 bp, Homo sapiens
tgcaaacagaaaagctactttg

SEQ ID NO: 7719795 - DNA, 22 bp, Homo sapiens
tgcaaacagaaagtttattgtg

SEQ ID NO: 7719796 - DNA, 22 bp, Homo sapiens
tgcaaacagaaagtttattgtg

SEQ ID NO: 7719797 - DNA, 22 bp, Homo sapiens
tgcaaacacttcaacgtgcatc

SEQ ID NO: 7719798 - DNA, 22 bp, Homo sapiens
tgcaaacacttcaacgtgcatc

SEQ ID NO: 7719799 - DNA, 22 bp, Homo sapiens
tgcaaacacttcaacgtgcatc

SEQ ID NO: 7719800 - DNA, 22 bp, Homo sapiens
tgcaaacagaaaagctactttg

SEQ ID NO: 7719801 - DNA, 22 bp, Homo sapiens
tgcaaacaccacagagacaatt

SEQ ID NO: 7719802 - DNA, 22 bp, Homo sapiens
tgcaaacaccacagagacaatt

SEQ ID NO: 7719803 - DNA, 22 bp, Homo sapiens
tgcaaacaccacagagacaatt

SEQ ID NO: 7719804 - DNA, 22 bp, Homo sapiens
tgcaaacacttcaacgtgcatc

SEQ ID NO: 7719805 - DNA, 22 bp, Homo sapiens
tgcaaacacttcaacgtgcatc

SEQ ID NO: 7719806 - DNA, 22 bp, Homo sapiens
tgcaaacacttcaacgtgcatc

SEQ ID NO: 7719807 - DNA, 22 bp, Homo sapiens
tgcaaacaactgtttaatgctg

SEQ ID NO: 7719808 - DNA, 22 bp, Homo sapiens
tgcaaacaactgtttaatgctg

SEQ ID NO: 7719809 - DNA, 22 bp, Homo sapiens
tgcaaacaactgtttaatgctg

SEQ ID NO: 7719810 - DNA, 22 bp, Homo sapiens
tgcaaacaactgtttaatgctg

SEQ ID NO: 7719811 - DNA, 23 bp, Homo sapiens
tgcaaaatttgcagagttcgatg

SEQ ID NO: 7719812 - DNA, 23 bp, Homo sapiens
tgcaaaatttgcagagttcgatg

SEQ ID NO: 7719813 - DNA, 22 bp, Homo sapiens
tgcaaacaatttcctataaagt

SEQ ID NO: 7719814 - DNA, 22 bp, Homo sapiens
tgcaaacaatttcctataaagt

SEQ ID NO: 7719815 - DNA, 22 bp, Homo sapiens
tgcaaacaatttcctataaagt

SEQ ID NO: 7719816 - DNA, 22 bp, Homo sapiens
tgcaaacaatttcctataaagt

SEQ ID NO: 7719817 - DNA, 22 bp, Homo sapiens
tgcaaacaatttcctataaagt

SEQ ID NO: 7719818 - DNA, 22 bp, Homo sapiens
tgcaaacaatttcctataaagt

SEQ ID NO: 7719819 - DNA, 17 bp, Homo sapiens
tgcaaacaatcacatat

SEQ ID NO: 7719820 - DNA, 22 bp, Homo sapiens
tgcaaacaatttcctataaagt

SEQ ID NO: 7719821 - DNA, 22 bp, Homo sapiens
tgcaaacaatttcctataaagt

SEQ ID NO: 7719822 - DNA, 17 bp, Homo sapiens
tgcaaacaatcacatat

SEQ ID NO: 7719823 - DNA, 17 bp, Homo sapiens
tgcaaacaatcacatat

SEQ ID NO: 7719824 - DNA, 17 bp, Homo sapiens
tgcaaacaatcacatat

SEQ ID NO: 7719825 - DNA, 17 bp, Homo sapiens
tgcaaacaatcacatat

SEQ ID NO: 7719826 - DNA, 22 bp, Homo sapiens
tgcaaactgggatactattcaa

SEQ ID NO: 7719827 - DNA, 23 bp, Homo sapiens
tgcaaagaaatctgggtcattgt

SEQ ID NO: 7719828 - DNA, 22 bp, Homo sapiens
tgcaaactattggtagagatgg

SEQ ID NO: 7719829 - DNA, 22 bp, Homo sapiens
tgcaaactattggtagagatgg

SEQ ID NO: 7719830 - DNA, 22 bp, Homo sapiens
tgcaaactgggacactattcaa

SEQ ID NO: 7719831 - DNA, 22 bp, Homo sapiens
tgcaaacatccgactgaaagcc

SEQ ID NO: 7719832 - DNA, 22 bp, Homo sapiens
tgcaaacatccgactgaaagcc

SEQ ID NO: 7719833 - DNA, 22 bp, Homo sapiens
tgcaaacatccgactgaaagcc

SEQ ID NO: 7719834 - DNA, 20 bp, Homo sapiens
tgcaaacattacttgggtgt

SEQ ID NO: 7719835 - DNA, 20 bp, Homo sapiens
tgcaaacattacttgggtgt

SEQ ID NO: 7719836 - DNA, 22 bp, Homo sapiens
tgcaaactattggtagagatgg

SEQ ID NO: 7719837 - DNA, 22 bp, Homo sapiens
tgcaaactagcatcaactagta

SEQ ID NO: 7719838 - DNA, 22 bp, Homo sapiens
tgcaaactattggtagagatgg

SEQ ID NO: 7719839 - DNA, 22 bp, Homo sapiens
tgcaaactagcatcaactagta

SEQ ID NO: 7719840 - DNA, 20 bp, Homo sapiens
tgcaaacattacttgggtgt

SEQ ID NO: 7719841 - DNA, 22 bp, Homo sapiens
tgcaaaccagttcaaccaatct

SEQ ID NO: 7719842 - DNA, 22 bp, Homo sapiens
tgcaaacaggcatttcacaaac

SEQ ID NO: 7719843 - DNA, 22 bp, Homo sapiens
tgcaaacaggcatttcacaaac

SEQ ID NO: 7719844 - DNA, 22 bp, Homo sapiens
tgcaaacaggcatttcacaaac

SEQ ID NO: 7719845 - DNA, 22 bp, Homo sapiens
tgcaaacagttaagatgcaggc

SEQ ID NO: 7719846 - DNA, 22 bp, Homo sapiens
tgcaaacagttaagatgcaggc

SEQ ID NO: 7719847 - DNA, 22 bp, Homo sapiens
tgcaaacagttaagatgcaggc

SEQ ID NO: 7719848 - DNA, 22 bp, Homo sapiens
tgcaaacagttaagatgcaggc

SEQ ID NO: 7719849 - DNA, 22 bp, Homo sapiens
tgcaaacagttaagatgcaggc

SEQ ID NO: 7719850 - DNA, 22 bp, Homo sapiens
tgcaaacatccgactgaaagcc

SEQ ID NO: 7719851 - DNA, 22 bp, Homo sapiens
tgcaaacatccgactgaaagcc

SEQ ID NO: 7719852 - DNA, 22 bp, Homo sapiens
tgcaaacatccgactgaaagcc

SEQ ID NO: 7719853 - DNA, 22 bp, Homo sapiens
tgcaaacatcaatggcctgagc

SEQ ID NO: 7719854 - DNA, 22 bp, Homo sapiens
tgcaaacatcaatggcctgagc

SEQ ID NO: 7719855 - DNA, 22 bp, Homo sapiens
tgcaaacatcaatggcctgagc

SEQ ID NO: 7719856 - DNA, 22 bp, Homo sapiens
tgcaaacatcaatggcctgagc

SEQ ID NO: 7719857 - DNA, 22 bp, Homo sapiens
tgcaaacagttaagatgcaggc

SEQ ID NO: 7719858 - DNA, 22 bp, Homo sapiens
tgcaaacagttaagatgcaggc

SEQ ID NO: 7719859 - DNA, 22 bp, Homo sapiens
tgcaaacagccttgaaagaggg

SEQ ID NO: 7719860 - DNA, 22 bp, Homo sapiens
tgcaaacagccttgaaagaggg

SEQ ID NO: 7719861 - DNA, 22 bp, Homo sapiens
tgcaaacagccttgaaagaggg

SEQ ID NO: 7719862 - DNA, 22 bp, Homo sapiens
tgcaaacagccttgaaagaggg

SEQ ID NO: 7719863 - DNA, 22 bp, Homo sapiens
tgcaaacagccttgaaagaggg

SEQ ID NO: 7719864 - DNA, 22 bp, Homo sapiens
tgcaaacagaaagtttattgtg

SEQ ID NO: 7719865 - DNA, 22 bp, Homo sapiens
tgcaaacagaaagtttattgtg

SEQ ID NO: 7719866 - DNA, 22 bp, Homo sapiens
tgcaaacaggagagtaagtata

SEQ ID NO: 7719867 - DNA, 22 bp, Homo sapiens
tgcaaacaggagagtaagtata

SEQ ID NO: 7719868 - DNA, 22 bp, Homo sapiens
tgcaaacaggagagtaagtata

SEQ ID NO: 7719869 - DNA, 22 bp, Homo sapiens
tgcaaacaggagagtaagtata

SEQ ID NO: 7719870 - DNA, 22 bp, Homo sapiens
tgcaaacaggcatttcacaaac

SEQ ID NO: 7719871 - DNA, 22 bp, Homo sapiens
tgcaaacaggcatttcacaaac

SEQ ID NO: 7719872 - DNA, 22 bp, Homo sapiens
tgcaatttcaggcatatattgt

SEQ ID NO: 7719873 - DNA, 22 bp, Homo sapiens
tgcaatttcaggcatatattgt

SEQ ID NO: 7719874 - DNA, 22 bp, Homo sapiens
tgcaatttgacgtcagcacagt

SEQ ID NO: 7719875 - DNA, 22 bp, Homo sapiens
tgcaatttggggaagaaagaga

SEQ ID NO: 7719876 - DNA, 22 bp, Homo sapiens
tgcaatttggggaagaaagaga

SEQ ID NO: 7719877 - DNA, 22 bp, Homo sapiens
tgcaatttgacgtcagcacagt

SEQ ID NO: 7719878 - DNA, 22 bp, Homo sapiens
tgcaatttcaaatatcagaaag

SEQ ID NO: 7719879 - DNA, 22 bp, Homo sapiens
tgcaatttcaaatatcagaaag

SEQ ID NO: 7719880 - DNA, 22 bp, Homo sapiens
tgcaatttcaaatatcagaaag

SEQ ID NO: 7719881 - DNA, 22 bp, Homo sapiens
tgcaatttatgtgcaagtggtt

SEQ ID NO: 7719882 - DNA, 22 bp, Homo sapiens
tgcaatttatgtgcaagtggtt

SEQ ID NO: 7719883 - DNA, 22 bp, Homo sapiens
tgcaatttatgtgcaagtggtt

SEQ ID NO: 7719884 - DNA, 22 bp, Homo sapiens
tgcaatttaatgtgtcccaatt

SEQ ID NO: 7719885 - DNA, 21 bp, Homo sapiens
tgcaatttagacttgaacatt

SEQ ID NO: 7719886 - DNA, 21 bp, Homo sapiens
tgcaatttagacttgaacatt

SEQ ID NO: 7719887 - DNA, 21 bp, Homo sapiens
tgcaatttagacttgaacatt

SEQ ID NO: 7719888 - DNA, 22 bp, Homo sapiens
tgcaattagcgtattagtttat

SEQ ID NO: 7719889 - DNA, 22 bp, Homo sapiens
tgcaattagcattgtattctta

SEQ ID NO: 7719890 - DNA, 22 bp, Homo sapiens
tgcaattaatttacatgcttaa

SEQ ID NO: 7719891 - DNA, 22 bp, Homo sapiens
tgcaattagcattgtattctta

SEQ ID NO: 7719892 - DNA, 22 bp, Homo sapiens
tgcaattagcattgtattctta

SEQ ID NO: 7719893 - DNA, 22 bp, Homo sapiens
tgcaatgtgttagatggtttta

SEQ ID NO: 7719894 - DNA, 22 bp, Homo sapiens
tgcaattaatttacatgcttaa

SEQ ID NO: 7719895 - DNA, 22 bp, Homo sapiens
tgcaatgtgttagatggtttta

SEQ ID NO: 7719896 - DNA, 23 bp, Homo sapiens
tgcaatggcatgatttcagctca

SEQ ID NO: 7719897 - DNA, 21 bp, Homo sapiens
tgcaatgcattgacagcagca

SEQ ID NO: 7719898 - DNA, 22 bp, Homo sapiens
tgcaatgagaatatattaacca

SEQ ID NO: 7719899 - DNA, 22 bp, Homo sapiens
tgcaatcttgtggtttcaagga

SEQ ID NO: 7719900 - DNA, 22 bp, Homo sapiens
tgcaatgaatatggtacattaa

SEQ ID NO: 7719901 - DNA, 22 bp, Homo sapiens
tgcaatctcggcactttgggag

SEQ ID NO: 7719902 - DNA, 22 bp, Homo sapiens
tgcaatctcggcactttgggag

SEQ ID NO: 7719903 - DNA, 22 bp, Homo sapiens
tgcaatctcggcactttgggag

SEQ ID NO: 7719904 - DNA, 22 bp, Homo sapiens
tgcaatccccgcctcaacagga

SEQ ID NO: 7719905 - DNA, 22 bp, Homo sapiens
tgcaatctcggcactttgggag

SEQ ID NO: 7719906 - DNA, 22 bp, Homo sapiens
tgcaatctcggcactttgggag

SEQ ID NO: 7719907 - DNA, 22 bp, Homo sapiens
tgcaattttaatacattagagg

SEQ ID NO: 7719908 - DNA, 22 bp, Homo sapiens
tgcaattttaatacattagagg

SEQ ID NO: 7719909 - DNA, 22 bp, Homo sapiens
tgcaatttggggaagaaagaga

SEQ ID NO: 7719910 - DNA, 22 bp, Homo sapiens
tgcaattttaatacattagagg

SEQ ID NO: 7719911 - DNA, 22 bp, Homo sapiens
tgcaattttaatacattagagg

SEQ ID NO: 7719912 - DNA, 22 bp, Homo sapiens
tgcaattttaatacattagagg

SEQ ID NO: 7719913 - DNA, 22 bp, Homo sapiens
tgcaattttcagaaattccaaa

SEQ ID NO: 7719914 - DNA, 22 bp, Homo sapiens
tgcaatttttatcaattcagca

SEQ ID NO: 7719915 - DNA, 22 bp, Homo sapiens
tgcaattttcagaaattccaaa

SEQ ID NO: 7719916 - DNA, 22 bp, Homo sapiens
tgcaatttttccatgacctaga

SEQ ID NO: 7719917 - DNA, 22 bp, Homo sapiens
tgcacaaacacagagaatagat

SEQ ID NO: 7719918 - DNA, 22 bp, Homo sapiens
tgcacaaacacagagaatagat

SEQ ID NO: 7719919 - DNA, 22 bp, Homo sapiens
tgcacaaacacagagaatagat

SEQ ID NO: 7719920 - DNA, 22 bp, Homo sapiens
tgcaattttttagcacaaggag

SEQ ID NO: 7719921 - DNA, 22 bp, Homo sapiens
tgcaattttttagcacaaggag

SEQ ID NO: 7719922 - DNA, 21 bp, Homo sapiens
tgcacaaactttctgtggctt

SEQ ID NO: 7719923 - DNA, 22 bp, Homo sapiens
tgcacaaagcattctagacgca

SEQ ID NO: 7719924 - DNA, 22 bp, Homo sapiens
tgcacaaagcattctagacgca

SEQ ID NO: 7719925 - DNA, 22 bp, Homo sapiens
tgcacaaacttgtgtcccaggg

SEQ ID NO: 7719926 - DNA, 22 bp, Homo sapiens
tgcacaaacttgtgtcccaggg

SEQ ID NO: 7719927 - DNA, 21 bp, Homo sapiens
tgcacaaactttctgtggctt

SEQ ID NO: 7719928 - DNA, 22 bp, Homo sapiens
tgcacaagtcagagtaacattt

SEQ ID NO: 7719929 - DNA, 17 bp, Homo sapiens
tgcacaagagacaatag

SEQ ID NO: 7719930 - DNA, 17 bp, Homo sapiens
tgcacaagagacaatag

SEQ ID NO: 7719931 - DNA, 22 bp, Homo sapiens
tgcacaaaggctccctgctgag

SEQ ID NO: 7719932 - DNA, 22 bp, Homo sapiens
tgcacaaatttgtgtatgctca

SEQ ID NO: 7719933 - DNA, 22 bp, Homo sapiens
tgcacaaatttgtgtatgctca

SEQ ID NO: 7719934 - DNA, 22 bp, Homo sapiens
tgcacaaatttgtgtatgctca

SEQ ID NO: 7719935 - DNA, 22 bp, Homo sapiens
tgcacaaatttgtgtatgctca

SEQ ID NO: 7719936 - DNA, 22 bp, Homo sapiens
tgcacacaagttggagaatgaa

SEQ ID NO: 7719937 - DNA, 22 bp, Homo sapiens
tgcacacaagttggagaatgaa

SEQ ID NO: 7719938 - DNA, 22 bp, Homo sapiens
tgcacacaagttggagaatgaa

SEQ ID NO: 7719939 - DNA, 22 bp, Homo sapiens
tgcacacaaatgtgaacgtgcc

SEQ ID NO: 7719940 - DNA, 22 bp, Homo sapiens
tgcacacaaatgtgaacgtgcc

SEQ ID NO: 7719941 - DNA, 22 bp, Homo sapiens
tgcacacacacgtagagaaaag

SEQ ID NO: 7719942 - DNA, 22 bp, Homo sapiens
tgcacacacggagataggcttt

SEQ ID NO: 7719943 - DNA, 22 bp, Homo sapiens
tgcacacacggagataggcttt

SEQ ID NO: 7719944 - DNA, 22 bp, Homo sapiens
tgcacacacggagataggcttt

SEQ ID NO: 7719945 - DNA, 22 bp, Homo sapiens
tgcacacacgcggcacatctgt

SEQ ID NO: 7719946 - DNA, 22 bp, Homo sapiens
tgcacacacgcggcacatctgt

SEQ ID NO: 7719947 - DNA, 22 bp, Homo sapiens
tgcacacacgcggcacatctgt

SEQ ID NO: 7719948 - DNA, 22 bp, Homo sapiens
tgcacacacgcggcacatctgt

SEQ ID NO: 7719949 - DNA, 22 bp, Homo sapiens
tgcacacacgcggcacatctgt

SEQ ID NO: 7719950 - DNA, 22 bp, Homo sapiens
tgcacacacgcggcacatctgt

SEQ ID NO: 7719951 - DNA, 22 bp, Homo sapiens
tgcacacaccgtgcttcactga

SEQ ID NO: 7719952 - DNA, 22 bp, Homo sapiens
tgcacacaccgtgcttcactga

SEQ ID NO: 7719953 - DNA, 22 bp, Homo sapiens
tgcacacaccgtgcttcactga

SEQ ID NO: 7719954 - DNA, 22 bp, Homo sapiens
tgcacacaccgtgcttcactga

SEQ ID NO: 7719955 - DNA, 22 bp, Homo sapiens
tgcacacaccgtgcttcactga

SEQ ID NO: 7719956 - DNA, 20 bp, Homo sapiens
tgcacacaccctgtcctcca

SEQ ID NO: 7719957 - DNA, 22 bp, Homo sapiens
tgcacacacacgtagagaaaag

SEQ ID NO: 7719958 - DNA, 22 bp, Homo sapiens
tgcacacacaggagtctcctcc

SEQ ID NO: 7719959 - DNA, 22 bp, Homo sapiens
tgcacacacaggagtctcctcc

SEQ ID NO: 7719960 - DNA, 22 bp, Homo sapiens
tgcacacacaggagtctcctcc

SEQ ID NO: 7719961 - DNA, 22 bp, Homo sapiens
tgcacacacaggagtctcctcc

SEQ ID NO: 7719962 - DNA, 22 bp, Homo sapiens
tgcacacacaggagtctcctcc

SEQ ID NO: 7719963 - DNA, 22 bp, Homo sapiens
tgcacacacaggagtctcctcc

SEQ ID NO: 7719964 - DNA, 22 bp, Homo sapiens
tgcacacacatgaagtagcatg

SEQ ID NO: 7719965 - DNA, 22 bp, Homo sapiens
tgcacacacatgaagtagcatg

SEQ ID NO: 7719966 - DNA, 22 bp, Homo sapiens
tgcacacacatgaagtagcatg

SEQ ID NO: 7719967 - DNA, 22 bp, Homo sapiens
tgcacacacatgaagtagcatg

SEQ ID NO: 7719968 - DNA, 20 bp, Homo sapiens
tgcacacaccctgtcctcca

SEQ ID NO: 7719969 - DNA, 20 bp, Homo sapiens
tgcacacaccctgtcctcca

SEQ ID NO: 7719970 - DNA, 22 bp, Homo sapiens
tgcacacacatgcagagggaga

SEQ ID NO: 7719971 - DNA, 22 bp, Homo sapiens
tgcacacacatgcagagggaga

SEQ ID NO: 7719972 - DNA, 22 bp, Homo sapiens
tgcacacacatgcagagggaga

SEQ ID NO: 7719973 - DNA, 22 bp, Homo sapiens
tgcacacacatgaagtagcatg

SEQ ID NO: 7719974 - DNA, 22 bp, Homo sapiens
tgcacacacatgaagtagcatg

SEQ ID NO: 7719975 - DNA, 19 bp, Homo sapiens
tgcacacagataagtatct

SEQ ID NO: 7719976 - DNA, 19 bp, Homo sapiens
tgcacacagataagtatct

SEQ ID NO: 7719977 - DNA, 19 bp, Homo sapiens
tgcacacagataagtatct

SEQ ID NO: 7719978 - DNA, 19 bp, Homo sapiens
tgcacacagataagtatct

SEQ ID NO: 7719979 - DNA, 20 bp, Homo sapiens
tgcacacagaaatttgcatt

SEQ ID NO: 7719980 - DNA, 20 bp, Homo sapiens
tgcacacagaaatttgcatt

SEQ ID NO: 7719981 - DNA, 20 bp, Homo sapiens
tgcacacagaaatttgcatt

SEQ ID NO: 7719982 - DNA, 22 bp, Homo sapiens
tgcacacactctgcatatactt

SEQ ID NO: 7719983 - DNA, 22 bp, Homo sapiens
tgcacacactctgcatatactt

SEQ ID NO: 7719984 - DNA, 22 bp, Homo sapiens
tgcacacactctgcatatactt

SEQ ID NO: 7719985 - DNA, 22 bp, Homo sapiens
tgcacacactctgcatatactt

SEQ ID NO: 7719986 - DNA, 22 bp, Homo sapiens
tgcacacactctgcatatactt

SEQ ID NO: 7719987 - DNA, 22 bp, Homo sapiens
tgcacacactctgcatatactt

SEQ ID NO: 7719988 - DNA, 22 bp, Homo sapiens
tgcacacactctgcatatactt

SEQ ID NO: 7719989 - DNA, 22 bp, Homo sapiens
tgcacacactctgcatatactt

SEQ ID NO: 7719990 - DNA, 22 bp, Homo sapiens
tgcacacactcgtgtatatgag

SEQ ID NO: 7719991 - DNA, 22 bp, Homo sapiens
tgcacacactcgtgtatatgag

SEQ ID NO: 7719992 - DNA, 22 bp, Homo sapiens
tgcacacactcgtgtatatgag

SEQ ID NO: 7719993 - DNA, 22 bp, Homo sapiens
tgcacacactcgtgtatatgag

SEQ ID NO: 7719994 - DNA, 22 bp, Homo sapiens
tgcacacaggtctaggacatgg

SEQ ID NO: 7719995 - DNA, 22 bp, Homo sapiens
tgcacacaggtctaggacatgg

SEQ ID NO: 7719996 - DNA, 22 bp, Homo sapiens
tgcacacaggtctaggacatgg

SEQ ID NO: 7719997 - DNA, 22 bp, Homo sapiens
tgcacacaggtctaggacatgg

SEQ ID NO: 7719998 - DNA, 22 bp, Homo sapiens
tgcacacaggtctaggacatgg

SEQ ID NO: 7719999 - DNA, 22 bp, Homo sapiens
tgcacacagtggacaagtcttg

SEQ ID NO: 7720000 - DNA, 22 bp, Homo sapiens
tgcacacagtggacaagtcttg

SEQ ID NO: 7720001 - DNA, 22 bp, Homo sapiens
tgcacacagtggacaagtcttg

SEQ ID NO: 7720002 - DNA, 22 bp, Homo sapiens
tgcacacagtggacaagtcttg

SEQ ID NO: 7720003 - DNA, 22 bp, Homo sapiens
tgcacacagatggtacatgcat

SEQ ID NO: 7720004 - DNA, 22 bp, Homo sapiens
tgcacacagatggtacatgcat

SEQ ID NO: 7720005 - DNA, 22 bp, Homo sapiens
tgcacacagatggtacatgcat

SEQ ID NO: 7720006 - DNA, 22 bp, Homo sapiens
tgcacacagatggtacatgcat

SEQ ID NO: 7720007 - DNA, 22 bp, Homo sapiens
tgcacacagatggtacatgcat

SEQ ID NO: 7720008 - DNA, 22 bp, Homo sapiens
tgcacacagatggtacatgcat

SEQ ID NO: 7720009 - DNA, 22 bp, Homo sapiens
tgcacacagccagtgagtggca

SEQ ID NO: 7720010 - DNA, 22 bp, Homo sapiens
tgcacacagctgggcctggctg

SEQ ID NO: 7720011 - DNA, 22 bp, Homo sapiens
tgcacacagctgggcctggctg

SEQ ID NO: 7720012 - DNA, 22 bp, Homo sapiens
tgcacacagctgggcctggctg

SEQ ID NO: 7720013 - DNA, 22 bp, Homo sapiens
tgcacacagctgggcctggctg

SEQ ID NO: 7720014 - DNA, 22 bp, Homo sapiens
tgcaagcaatccaggaaggcta

SEQ ID NO: 7720015 - DNA, 20 bp, Homo sapiens
tgcaagatgggtggggagaa

SEQ ID NO: 7720016 - DNA, 22 bp, Homo sapiens
tgcaagatattatctttgctgc

SEQ ID NO: 7720017 - DNA, 21 bp, Homo sapiens
tgcaagcagcagagatatggg

SEQ ID NO: 7720018 - DNA, 22 bp, Homo sapiens
tgcaagcactcaatgcaaacag

SEQ ID NO: 7720019 - DNA, 22 bp, Homo sapiens
tgcaagctgacatccagagaga

SEQ ID NO: 7720020 - DNA, 21 bp, Homo sapiens
tgcaagcagcagagatatggg

SEQ ID NO: 7720021 - DNA, 19 bp, Homo sapiens
tgcaagccgagcatcgcta

SEQ ID NO: 7720022 - DNA, 22 bp, Homo sapiens
tgcaaggatatttagtctagtg

SEQ ID NO: 7720023 - DNA, 22 bp, Homo sapiens
tgcaaggatatttagtctagtg

SEQ ID NO: 7720024 - DNA, 22 bp, Homo sapiens
tgcaaggatatttagtctagtg

SEQ ID NO: 7720025 - DNA, 22 bp, Homo sapiens
tgcaaggcacacagggggtaag

SEQ ID NO: 7720026 - DNA, 22 bp, Homo sapiens
tgcaaggcacccactctgcttt

SEQ ID NO: 7720027 - DNA, 22 bp, Homo sapiens
tgcaaggcacccactctgcttt

SEQ ID NO: 7720028 - DNA, 22 bp, Homo sapiens
tgcaaggcagcaccagctcttg

SEQ ID NO: 7720029 - DNA, 20 bp, Homo sapiens
tgcaaggaagcaggcaagtg

SEQ ID NO: 7720030 - DNA, 20 bp, Homo sapiens
tgcaaggaagcaggcaagtg

SEQ ID NO: 7720031 - DNA, 22 bp, Homo sapiens
tgcaaggctgcagagggtgcta

SEQ ID NO: 7720032 - DNA, 22 bp, Homo sapiens
tgcaaggctgcagagggtgcta

SEQ ID NO: 7720033 - DNA, 22 bp, Homo sapiens
tgcaaggcccagacaagagctc

SEQ ID NO: 7720034 - DNA, 22 bp, Homo sapiens
tgcaaggctattcacatgtatt

SEQ ID NO: 7720035 - DNA, 22 bp, Homo sapiens
tgcaaggcagcaccagctcttg

SEQ ID NO: 7720036 - DNA, 20 bp, Homo sapiens
tgcaaggccagggtcaggag

SEQ ID NO: 7720037 - DNA, 20 bp, Homo sapiens
tgcaaggccagggtcaggag

SEQ ID NO: 7720038 - DNA, 20 bp, Homo sapiens
tgcaaggccagggtcaggag

SEQ ID NO: 7720039 - DNA, 22 bp, Homo sapiens
tgcaaggcccagacaagagctc

SEQ ID NO: 7720040 - DNA, 22 bp, Homo sapiens
tgcaaggcccagacaagagctc

SEQ ID NO: 7720041 - DNA, 22 bp, Homo sapiens
tgcaaggctgcctctgaggacc

SEQ ID NO: 7720042 - DNA, 22 bp, Homo sapiens
tgcaaggctgcctctgaggacc

SEQ ID NO: 7720043 - DNA, 22 bp, Homo sapiens
tgcaaggctgcctctgaggacc

SEQ ID NO: 7720044 - DNA, 22 bp, Homo sapiens
tgcaaggctgcctctgaggacc

SEQ ID NO: 7720045 - DNA, 22 bp, Homo sapiens
tgcaaggctgcctctgaggacc

SEQ ID NO: 7720046 - DNA, 22 bp, Homo sapiens
tgcaaggcttgcaatggtgatc

SEQ ID NO: 7720047 - DNA, 22 bp, Homo sapiens
tgcaaggcttgcaatggtgatc

SEQ ID NO: 7720048 - DNA, 22 bp, Homo sapiens
tgcaagggcttagggggctgtg

SEQ ID NO: 7720049 - DNA, 22 bp, Homo sapiens
tgcaagggcttagggggctgtg

SEQ ID NO: 7720050 - DNA, 22 bp, Homo sapiens
tgcaagggcttagggggctgtg

SEQ ID NO: 7720051 - DNA, 22 bp, Homo sapiens
tgcaagggcttagggggctgtg

SEQ ID NO: 7720052 - DNA, 21 bp, Homo sapiens
tgcaatccagcctgggcgaca

SEQ ID NO: 7720053 - DNA, 21 bp, Homo sapiens
tgcaatccagcctgggcgaca

SEQ ID NO: 7720054 - DNA, 22 bp, Homo sapiens
tgcaagtaaccatcactatctc

SEQ ID NO: 7720055 - DNA, 22 bp, Homo sapiens
tgcaagtaaccatcactatctc

SEQ ID NO: 7720056 - DNA, 21 bp, Homo sapiens
tgcaatccagcctgggcgaca

SEQ ID NO: 7720057 - DNA, 21 bp, Homo sapiens
tgcaatccagcctgggcgaca

SEQ ID NO: 7720058 - DNA, 21 bp, Homo sapiens
tgcaatccagcctgggcgaca

SEQ ID NO: 7720059 - DNA, 21 bp, Homo sapiens
tgcaatccagcctgggcgaca

SEQ ID NO: 7720060 - DNA, 21 bp, Homo sapiens
tgcaatccagcctgggcgaca

SEQ ID NO: 7720061 - DNA, 21 bp, Homo sapiens
tgcaatccagcctgggcgaca

SEQ ID NO: 7720062 - DNA, 21 bp, Homo sapiens
tgcaatccagcctgggcgaca

SEQ ID NO: 7720063 - DNA, 21 bp, Homo sapiens
tgcaatccagcctgggcgaca

SEQ ID NO: 7720064 - DNA, 22 bp, Homo sapiens
tgcaagggtagaagtgatggca

SEQ ID NO: 7720065 - DNA, 22 bp, Homo sapiens
tgcaagggtagaagtgatggca

SEQ ID NO: 7720066 - DNA, 22 bp, Homo sapiens
tgcaagggtagaagtgatggca

SEQ ID NO: 7720067 - DNA, 22 bp, Homo sapiens
tgcaagggtagaagtgatggca

SEQ ID NO: 7720068 - DNA, 22 bp, Homo sapiens
tgcaagggcttagggggctgtg

SEQ ID NO: 7720069 - DNA, 22 bp, Homo sapiens
tgcaagggcttagggggctgtg

SEQ ID NO: 7720070 - DNA, 22 bp, Homo sapiens
tgcaaggggtttatgcagatga

SEQ ID NO: 7720071 - DNA, 22 bp, Homo sapiens
tgcaaggggtttatgcagatga

SEQ ID NO: 7720072 - DNA, 22 bp, Homo sapiens
tgcaaggggtttatgcagatga

SEQ ID NO: 7720073 - DNA, 22 bp, Homo sapiens
tgcaagggtgtttgagctgccc

SEQ ID NO: 7720074 - DNA, 22 bp, Homo sapiens
tgcaagggtgtttgagctgccc

SEQ ID NO: 7720075 - DNA, 19 bp, Homo sapiens
tgcaagggtggtctcctgg

SEQ ID NO: 7720076 - DNA, 19 bp, Homo sapiens
tgcaagggtggtctcctgg

SEQ ID NO: 7720077 - DNA, 22 bp, Homo sapiens
tgcaagggtgtttgagctgccc

SEQ ID NO: 7720078 - DNA, 22 bp, Homo sapiens
tgcaagggtgtttgagctgccc

SEQ ID NO: 7720079 - DNA, 22 bp, Homo sapiens
tgcaagggtgtttgagctgccc

SEQ ID NO: 7720080 - DNA, 19 bp, Homo sapiens
tgcaagggtggtctcctgg

SEQ ID NO: 7720081 - DNA, 22 bp, Homo sapiens
tgcaagggtgacaggttgctct

SEQ ID NO: 7720082 - DNA, 22 bp, Homo sapiens
tgcaagggtgacaggttgctct

SEQ ID NO: 7720083 - DNA, 22 bp, Homo sapiens
tgcaagggtgacaggttgctct

SEQ ID NO: 7720084 - DNA, 22 bp, Homo sapiens
tgcaagggtgacaggttgctct

SEQ ID NO: 7720085 - DNA, 22 bp, Homo sapiens
tgcaagggtagaagtgatggca

SEQ ID NO: 7720086 - DNA, 22 bp, Homo sapiens
tgcaagagctgtggcaaaagca

SEQ ID NO: 7720087 - DNA, 22 bp, Homo sapiens
tgcaagaggaattctagaagca

SEQ ID NO: 7720088 - DNA, 22 bp, Homo sapiens
tgcaagaggaattctagaagca

SEQ ID NO: 7720089 - DNA, 22 bp, Homo sapiens
tgcaagaggaattctagaagca

SEQ ID NO: 7720090 - DNA, 22 bp, Homo sapiens
tgcaagaggaattctagaagca

SEQ ID NO: 7720091 - DNA, 22 bp, Homo sapiens
tgcaagaggtaaaatgaaagga

SEQ ID NO: 7720092 - DNA, 22 bp, Homo sapiens
tgcaagagggtgttcagtttgt

SEQ ID NO: 7720093 - DNA, 22 bp, Homo sapiens
tgcaagagggtgttcagtttgt

SEQ ID NO: 7720094 - DNA, 22 bp, Homo sapiens
tgcaagaggattgtatcaataa

SEQ ID NO: 7720095 - DNA, 22 bp, Homo sapiens
tgcaagaggttggattttaaga

SEQ ID NO: 7720096 - DNA, 23 bp, Homo sapiens
tgcaagagttccaaactgttcaa

SEQ ID NO: 7720097 - DNA, 22 bp, Homo sapiens
tgcaagataacctgcttcttcc

SEQ ID NO: 7720098 - DNA, 21 bp, Homo sapiens
tgcaagaatcaggaagctgcc

SEQ ID NO: 7720099 - DNA, 22 bp, Homo sapiens
tgcaagaatgacccatctaccc

SEQ ID NO: 7720100 - DNA, 21 bp, Homo sapiens
tgcaagaatcaggaagctgcc

SEQ ID NO: 7720101 - DNA, 22 bp, Homo sapiens
tgcaagagacagacatgactca

SEQ ID NO: 7720102 - DNA, 22 bp, Homo sapiens
tgcaagacgtgaaattgagaca

SEQ ID NO: 7720103 - DNA, 22 bp, Homo sapiens
tgcaagacgtgaaattgagaca

SEQ ID NO: 7720104 - DNA, 22 bp, Homo sapiens
tgcaagagcagaaagaactgag

SEQ ID NO: 7720105 - DNA, 22 bp, Homo sapiens
tgcaagagcagaaagaactgag

SEQ ID NO: 7720106 - DNA, 22 bp, Homo sapiens
tgcaagagcagaaagaactgag

SEQ ID NO: 7720107 - DNA, 22 bp, Homo sapiens
tgcaagagacatgggttgtgtg

SEQ ID NO: 7720108 - DNA, 22 bp, Homo sapiens
tgcaagagcccaaactatatac

SEQ ID NO: 7720109 - DNA, 22 bp, Homo sapiens
tgcaagagcagaaagaactgag

SEQ ID NO: 7720110 - DNA, 22 bp, Homo sapiens
tgcaagagcagaaagaactgag

SEQ ID NO: 7720111 - DNA, 22 bp, Homo sapiens
tgcaagagcccagggccaggaa

SEQ ID NO: 7720112 - DNA, 22 bp, Homo sapiens
tgcaagagcccagggccaggaa

SEQ ID NO: 7720113 - DNA, 23 bp, Homo sapiens
tgcaactgtgtcagaagttagaa

SEQ ID NO: 7720114 - DNA, 22 bp, Homo sapiens
tgcaacttgtttggagagaaag

SEQ ID NO: 7720115 - DNA, 22 bp, Homo sapiens
tgcaactctggatcttctggta

SEQ ID NO: 7720116 - DNA, 18 bp, Homo sapiens
tgcaactgaaagctttgt

SEQ ID NO: 7720117 - DNA, 22 bp, Homo sapiens
tgcaactaggaggttcttagct

SEQ ID NO: 7720118 - DNA, 22 bp, Homo sapiens
tgcaactaggaggttcttagct

SEQ ID NO: 7720119 - DNA, 22 bp, Homo sapiens
tgcaactcaggaaatgtcattt

SEQ ID NO: 7720120 - DNA, 22 bp, Homo sapiens
tgcaacagtggggcatgctgaa

SEQ ID NO: 7720121 - DNA, 22 bp, Homo sapiens
tgcaacattattaaactaagca

SEQ ID NO: 7720122 - DNA, 22 bp, Homo sapiens
tgcaacattattaaactaagca

SEQ ID NO: 7720123 - DNA, 22 bp, Homo sapiens
tgcaaatttgacttcacacatc

SEQ ID NO: 7720124 - DNA, 22 bp, Homo sapiens
tgcaaatttgacttcacacatc

SEQ ID NO: 7720125 - DNA, 22 bp, Homo sapiens
tgcaaatttgacttcacacatc

SEQ ID NO: 7720126 - DNA, 22 bp, Homo sapiens
tgcaaatttgacttcacacatc

SEQ ID NO: 7720127 - DNA, 22 bp, Homo sapiens
tgcaaatttgagcagactgttc

SEQ ID NO: 7720128 - DNA, 22 bp, Homo sapiens
tgcaaatttgacttcacacatc

SEQ ID NO: 7720129 - DNA, 22 bp, Homo sapiens
tgcaaatttctttagtacataa

SEQ ID NO: 7720130 - DNA, 22 bp, Homo sapiens
tgcaaatttctttagtacataa

SEQ ID NO: 7720131 - DNA, 22 bp, Homo sapiens
tgcaaatttctttagtacataa

SEQ ID NO: 7720132 - DNA, 22 bp, Homo sapiens
tgcaaatttctttagtacataa

SEQ ID NO: 7720133 - DNA, 22 bp, Homo sapiens
tgcaaatttctttagtacataa

SEQ ID NO: 7720134 - DNA, 22 bp, Homo sapiens
tgcaaatttctttagtacataa

SEQ ID NO: 7720135 - DNA, 22 bp, Homo sapiens
tgcaacagactttattaactct

SEQ ID NO: 7720136 - DNA, 23 bp, Homo sapiens
tgcaacaatgaggaaagctactg

SEQ ID NO: 7720137 - DNA, 22 bp, Homo sapiens
tgcaacaaggcctcatttcttg

SEQ ID NO: 7720138 - DNA, 23 bp, Homo sapiens
tgcaacaatgaggaaagctactg

SEQ ID NO: 7720139 - DNA, 23 bp, Homo sapiens
tgcaacaatgaggaaagctactg

SEQ ID NO: 7720140 - DNA, 22 bp, Homo sapiens
tgcagaaataactcatattgca

SEQ ID NO: 7720141 - DNA, 22 bp, Homo sapiens
tgcagaaataaagatattatca

SEQ ID NO: 7720142 - DNA, 22 bp, Homo sapiens
tgcagaaataaagatattatca

SEQ ID NO: 7720143 - DNA, 22 bp, Homo sapiens
tgcagaaataaagatattatca

SEQ ID NO: 7720144 - DNA, 22 bp, Homo sapiens
tgcagaaagtcacattcccttt

SEQ ID NO: 7720145 - DNA, 22 bp, Homo sapiens
tgcagaaaggaggggtgggaat

SEQ ID NO: 7720146 - DNA, 22 bp, Homo sapiens
tgcagaaaggaggggtgggaat

SEQ ID NO: 7720147 - DNA, 21 bp, Homo sapiens
tgcagaaagcggcttgaagca

SEQ ID NO: 7720148 - DNA, 21 bp, Homo sapiens
tgcagaaagcggcttgaagca

SEQ ID NO: 7720149 - DNA, 22 bp, Homo sapiens
tgcagaaagcattgactcttcc

SEQ ID NO: 7720150 - DNA, 22 bp, Homo sapiens
tgcagaaagcattgactcttcc

SEQ ID NO: 7720151 - DNA, 22 bp, Homo sapiens
tgcagaaagcattgactcttcc

SEQ ID NO: 7720152 - DNA, 22 bp, Homo sapiens
tgcagaaaccaattcaagtaag

SEQ ID NO: 7720153 - DNA, 22 bp, Homo sapiens
tgcagaaaccaattcaagtaag

SEQ ID NO: 7720154 - DNA, 22 bp, Homo sapiens
tgcagaaagcattgactcttcc

SEQ ID NO: 7720155 - DNA, 22 bp, Homo sapiens
tgcagaaagcattgactcttcc

SEQ ID NO: 7720156 - DNA, 22 bp, Homo sapiens
tgcagaaaccaattcaagtaag

SEQ ID NO: 7720157 - DNA, 22 bp, Homo sapiens
tgcagaaagcattgactcttcc

SEQ ID NO: 7720158 - DNA, 22 bp, Homo sapiens
tgcagaaaccaattcaagtaag

SEQ ID NO: 7720159 - DNA, 22 bp, Homo sapiens
tgcagaaacagtcattaatgta

SEQ ID NO: 7720160 - DNA, 22 bp, Homo sapiens
tgcagaaacagtcattaatgta

SEQ ID NO: 7720161 - DNA, 22 bp, Homo sapiens
tgcagaaacagtcattaatgta

SEQ ID NO: 7720162 - DNA, 22 bp, Homo sapiens
tgcagaaataactcatattgca

SEQ ID NO: 7720163 - DNA, 22 bp, Homo sapiens
tgcagaaataaagatattatca

SEQ ID NO: 7720164 - DNA, 22 bp, Homo sapiens
tgcagaaataactcatattgca

SEQ ID NO: 7720165 - DNA, 22 bp, Homo sapiens
tgcagaaataactcatattgca

SEQ ID NO: 7720166 - DNA, 22 bp, Homo sapiens
tgcagaaataactcatattgca

SEQ ID NO: 7720167 - DNA, 22 bp, Homo sapiens
tgcagaaataactcatattgca

SEQ ID NO: 7720168 - DNA, 22 bp, Homo sapiens
tgcagaaataactcatattgca

SEQ ID NO: 7720169 - DNA, 22 bp, Homo sapiens
tgcagaaataactcatattgca

SEQ ID NO: 7720170 - DNA, 22 bp, Homo sapiens
tgcagaaataactcatattgca

SEQ ID NO: 7720171 - DNA, 21 bp, Homo sapiens
tgcagaaatggtttttctaag

SEQ ID NO: 7720172 - DNA, 22 bp, Homo sapiens
tgcagaaataactcatattgca

SEQ ID NO: 7720173 - DNA, 22 bp, Homo sapiens
tgcagaaataactcatattgca

SEQ ID NO: 7720174 - DNA, 22 bp, Homo sapiens
tgcagaaatcacatttaaccct

SEQ ID NO: 7720175 - DNA, 21 bp, Homo sapiens
tgcagaaatggtttttctaag

SEQ ID NO: 7720176 - DNA, 21 bp, Homo sapiens
tgcagaaatggtttttctaag

SEQ ID NO: 7720177 - DNA, 22 bp, Homo sapiens
tgcagaaattcagaaagcataa

SEQ ID NO: 7720178 - DNA, 22 bp, Homo sapiens
tgcagaaattcagaaagcataa

SEQ ID NO: 7720179 - DNA, 22 bp, Homo sapiens
tgcagaaattcagaaagcataa

SEQ ID NO: 7720180 - DNA, 22 bp, Homo sapiens
tgcagaaattcagaaagcataa

SEQ ID NO: 7720181 - DNA, 21 bp, Homo sapiens
tgcagaaatggtttttctaag

SEQ ID NO: 7720182 - DNA, 21 bp, Homo sapiens
tgcagaaatggtttttctaag

SEQ ID NO: 7720183 - DNA, 21 bp, Homo sapiens
tgcagaaatggtttttctaag

SEQ ID NO: 7720184 - DNA, 21 bp, Homo sapiens
tgcagaaatggtttttctaag

SEQ ID NO: 7720185 - DNA, 22 bp, Homo sapiens
tgcagaaattcagaaagcataa

SEQ ID NO: 7720186 - DNA, 22 bp, Homo sapiens
tgcagaaattcagaaagcataa

SEQ ID NO: 7720187 - DNA, 22 bp, Homo sapiens
tgcagaacagggccatgtcacc

SEQ ID NO: 7720188 - DNA, 22 bp, Homo sapiens
tgcagaacaatgagagctgaga

SEQ ID NO: 7720189 - DNA, 22 bp, Homo sapiens
tgcagaaattcagaaagcataa

SEQ ID NO: 7720190 - DNA, 22 bp, Homo sapiens
tgcagaacaatgagagctgaga

SEQ ID NO: 7720191 - DNA, 18 bp, Homo sapiens
tgcactagatgctggcag

SEQ ID NO: 7720192 - DNA, 22 bp, Homo sapiens
tgcactactgtgatacacagcc

SEQ ID NO: 7720193 - DNA, 22 bp, Homo sapiens
tgcactactgtgatacacagcc

SEQ ID NO: 7720194 - DNA, 22 bp, Homo sapiens
tgcactactgtgatacacagcc

SEQ ID NO: 7720195 - DNA, 21 bp, Homo sapiens
tgcactttgggggacaggctg

SEQ ID NO: 7720196 - DNA, 18 bp, Homo sapiens
tgcactagatgctggcag

SEQ ID NO: 7720197 - DNA, 21 bp, Homo sapiens
tgcactttgggggacaggctg

SEQ ID NO: 7720198 - DNA, 22 bp, Homo sapiens
tgcactttgcaggcatggaaac

SEQ ID NO: 7720199 - DNA, 22 bp, Homo sapiens
tgcagaaacagagttttgccat

SEQ ID NO: 7720200 - DNA, 22 bp, Homo sapiens
tgcagaaacagtcattaatgta

SEQ ID NO: 7720201 - DNA, 22 bp, Homo sapiens
tgcagaaacagtcattaatgta

SEQ ID NO: 7720202 - DNA, 22 bp, Homo sapiens
tgcagaaacagtcattaatgta

SEQ ID NO: 7720203 - DNA, 22 bp, Homo sapiens
tgcagaaacagagttttgccat

SEQ ID NO: 7720204 - DNA, 22 bp, Homo sapiens
tgcagaaacaagccatcattca

SEQ ID NO: 7720205 - DNA, 22 bp, Homo sapiens
tgcagaaacaagccatcattca

SEQ ID NO: 7720206 - DNA, 22 bp, Homo sapiens
tgcagaaacaagccatcattca

SEQ ID NO: 7720207 - DNA, 22 bp, Homo sapiens
tgcacttttatatcactctggc

SEQ ID NO: 7720208 - DNA, 22 bp, Homo sapiens
tgcagaaacaagccatcattca

SEQ ID NO: 7720209 - DNA, 22 bp, Homo sapiens
tgcagaaacaagccatcattca

SEQ ID NO: 7720210 - DNA, 22 bp, Homo sapiens
tgcagaaacaagccatcattca

SEQ ID NO: 7720211 - DNA, 22 bp, Homo sapiens
tgcacgtgggctctctgctctt

SEQ ID NO: 7720212 - DNA, 22 bp, Homo sapiens
tgcacgtgcaagcacagataga

SEQ ID NO: 7720213 - DNA, 22 bp, Homo sapiens
tgcaccttttagaagtcatttt

SEQ ID NO: 7720214 - DNA, 22 bp, Homo sapiens
tgcacgtgggctctctgctctt

SEQ ID NO: 7720215 - DNA, 22 bp, Homo sapiens
tgcacctttaaattcagcagta

SEQ ID NO: 7720216 - DNA, 22 bp, Homo sapiens
tgcacctttaaattcagcagta

SEQ ID NO: 7720217 - DNA, 22 bp, Homo sapiens
tgcaccttgttgcttttacgaa

SEQ ID NO: 7720218 - DNA, 22 bp, Homo sapiens
tgcacctttaaattcagcagta

SEQ ID NO: 7720219 - DNA, 22 bp, Homo sapiens
tgcaccttgttgcttttacgaa

SEQ ID NO: 7720220 - DNA, 22 bp, Homo sapiens
tgcaccttccacaagaactacc

SEQ ID NO: 7720221 - DNA, 22 bp, Homo sapiens
tgcaccttgtccatttttggcc

SEQ ID NO: 7720222 - DNA, 22 bp, Homo sapiens
tgcaccttcgatttggaagcct

SEQ ID NO: 7720223 - DNA, 22 bp, Homo sapiens
tgcaccttcgatttggaagcct

SEQ ID NO: 7720224 - DNA, 22 bp, Homo sapiens
tgcacgtgtgagcattcacatg

SEQ ID NO: 7720225 - DNA, 22 bp, Homo sapiens
tgcacgttgaagtcccaggttg

SEQ ID NO: 7720226 - DNA, 19 bp, Homo sapiens
tgcacgttggaatcacctg

SEQ ID NO: 7720227 - DNA, 22 bp, Homo sapiens
tgcacgtgtgagcattcacatg

SEQ ID NO: 7720228 - DNA, 22 bp, Homo sapiens
tgcacgtgtgagcattcacatg

SEQ ID NO: 7720229 - DNA, 22 bp, Homo sapiens
tgcacgtgtgagcattcacatg

SEQ ID NO: 7720230 - DNA, 22 bp, Homo sapiens
tgcacgtgggctctctgctctt

SEQ ID NO: 7720231 - DNA, 22 bp, Homo sapiens
tgcacgtgtgagcattcacatg

SEQ ID NO: 7720232 - DNA, 22 bp, Homo sapiens
tgcacgtgggctctctgctctt

SEQ ID NO: 7720233 - DNA, 22 bp, Homo sapiens
tgcagaagctgcaggtcagtgg

SEQ ID NO: 7720234 - DNA, 22 bp, Homo sapiens
tgcagaagctgcaggtcagtgg

SEQ ID NO: 7720235 - DNA, 22 bp, Homo sapiens
tgcagaagctgcaggtcagtgg

SEQ ID NO: 7720236 - DNA, 22 bp, Homo sapiens
tgcagaagcagagccggtggcc

SEQ ID NO: 7720237 - DNA, 22 bp, Homo sapiens
tgcagaagcagagagttgccaa

SEQ ID NO: 7720238 - DNA, 22 bp, Homo sapiens
tgcagaagcagagagttgccaa

SEQ ID NO: 7720239 - DNA, 22 bp, Homo sapiens
tgcagaagatggtctgagcacc

SEQ ID NO: 7720240 - DNA, 22 bp, Homo sapiens
tgcagaagatggtctgagcacc

SEQ ID NO: 7720241 - DNA, 22 bp, Homo sapiens
tgcagaagaccttccagggctg

SEQ ID NO: 7720242 - DNA, 22 bp, Homo sapiens
tgcagaagaccttccagggctg

SEQ ID NO: 7720243 - DNA, 22 bp, Homo sapiens
tgcagaagatggtctgagcacc

SEQ ID NO: 7720244 - DNA, 22 bp, Homo sapiens
tgcagaagcagagagttgccaa

SEQ ID NO: 7720245 - DNA, 22 bp, Homo sapiens
tgcagaagcagagagttgccaa

SEQ ID NO: 7720246 - DNA, 22 bp, Homo sapiens
tgcagaagcagagagttgccaa

SEQ ID NO: 7720247 - DNA, 22 bp, Homo sapiens
tgcagaagctgcaggtcagtgg

SEQ ID NO: 7720248 - DNA, 22 bp, Homo sapiens
tgcagaagaccttccagggctg

SEQ ID NO: 7720249 - DNA, 22 bp, Homo sapiens
tgcagaaggaggaggaaatcca

SEQ ID NO: 7720250 - DNA, 22 bp, Homo sapiens
tgcagaaggaggaggaaatcca

SEQ ID NO: 7720251 - DNA, 22 bp, Homo sapiens
tgcagaaggcctgacattgcac

SEQ ID NO: 7720252 - DNA, 22 bp, Homo sapiens
tgcagaagtgagtcatgaggaa

SEQ ID NO: 7720253 - DNA, 22 bp, Homo sapiens
tgcagaagtgagtcatgaggaa

SEQ ID NO: 7720254 - DNA, 22 bp, Homo sapiens
tgcagaagtgagtcatgaggaa

SEQ ID NO: 7720255 - DNA, 22 bp, Homo sapiens
tgcagaagtgagtcatgaggaa

SEQ ID NO: 7720256 - DNA, 22 bp, Homo sapiens
tgcagaaggcctgacattgcac

SEQ ID NO: 7720257 - DNA, 22 bp, Homo sapiens
tgcagaagtattccaggcccca

SEQ ID NO: 7720258 - DNA, 22 bp, Homo sapiens
tgcagaagtattccaggcccca

SEQ ID NO: 7720259 - DNA, 22 bp, Homo sapiens
tgcagaagtgagtcatgaggaa

SEQ ID NO: 7720260 - DNA, 20 bp, Homo sapiens
tgcagaagaacgttctggtt

SEQ ID NO: 7720261 - DNA, 20 bp, Homo sapiens
tgcagaagaacgttctggtt

SEQ ID NO: 7720262 - DNA, 22 bp, Homo sapiens
tgcagaacgggtcttctagcac

SEQ ID NO: 7720263 - DNA, 22 bp, Homo sapiens
tgcagaagaatgagcttggagt

SEQ ID NO: 7720264 - DNA, 22 bp, Homo sapiens
tgcagaagaatgagcttggagt

SEQ ID NO: 7720265 - DNA, 22 bp, Homo sapiens
tgcagaagaaaacagctgtgtg

SEQ ID NO: 7720266 - DNA, 22 bp, Homo sapiens
tgcagaagaaaacagctgtgtg

SEQ ID NO: 7720267 - DNA, 20 bp, Homo sapiens
tgcagaagaacgttctggtt

SEQ ID NO: 7720268 - DNA, 22 bp, Homo sapiens
tgcagaagaaaacagctgtgtg

SEQ ID NO: 7720269 - DNA, 22 bp, Homo sapiens
tgcagaaccccttcccaggccc

SEQ ID NO: 7720270 - DNA, 22 bp, Homo sapiens
tgcagaagaaaacagctgtgtg

SEQ ID NO: 7720271 - DNA, 22 bp, Homo sapiens
tgcagaagaaaacagctgtgtg

SEQ ID NO: 7720272 - DNA, 22 bp, Homo sapiens
tgcagaacgggtcttctagcac

SEQ ID NO: 7720273 - DNA, 22 bp, Homo sapiens
tgcagaagaaaacagctgtgtg

SEQ ID NO: 7720274 - DNA, 22 bp, Homo sapiens
tgcagaaccagtcctcagaccc

SEQ ID NO: 7720275 - DNA, 22 bp, Homo sapiens
tgcagaaccagtcctcagaccc

SEQ ID NO: 7720276 - DNA, 22 bp, Homo sapiens
tgcagaacagggccatgtcacc

SEQ ID NO: 7720277 - DNA, 22 bp, Homo sapiens
tgcagaaccagtcctcagaccc

SEQ ID NO: 7720278 - DNA, 22 bp, Homo sapiens
tgcagaacagggccatgtcacc

SEQ ID NO: 7720279 - DNA, 19 bp, Homo sapiens
tgcagaagacacagtggtg

SEQ ID NO: 7720280 - DNA, 19 bp, Homo sapiens
tgcagaagacacagtggtg

SEQ ID NO: 7720281 - DNA, 19 bp, Homo sapiens
tgcagaagacacagtggtg

SEQ ID NO: 7720282 - DNA, 22 bp, Homo sapiens
tgcagaagacacaaggtaacgt

SEQ ID NO: 7720283 - DNA, 19 bp, Homo sapiens
tgcagaagacacagtggtg

SEQ ID NO: 7720284 - DNA, 22 bp, Homo sapiens
tgcagaagaatgtaggcataag

SEQ ID NO: 7720285 - DNA, 22 bp, Homo sapiens
tgcagaagaatgtaggcataag

SEQ ID NO: 7720286 - DNA, 22 bp, Homo sapiens
tgcagaagaatgtaggcataag

SEQ ID NO: 7720287 - DNA, 22 bp, Homo sapiens
tgcagaagaatgagcttggagt

SEQ ID NO: 7720288 - DNA, 22 bp, Homo sapiens
tgcagaagaatgagcttggagt

SEQ ID NO: 7720289 - DNA, 21 bp, Homo sapiens
tgcacagggcccaggagagcc

SEQ ID NO: 7720290 - DNA, 21 bp, Homo sapiens
tgcacagggcccaggagagcc

SEQ ID NO: 7720291 - DNA, 21 bp, Homo sapiens
tgcacagggcccaggagagcc

SEQ ID NO: 7720292 - DNA, 21 bp, Homo sapiens
tgcacagggcccaggagagcc

SEQ ID NO: 7720293 - DNA, 21 bp, Homo sapiens
tgcacagggcccaggagagcc

SEQ ID NO: 7720294 - DNA, 21 bp, Homo sapiens
tgcacagggcccaggagagcc

SEQ ID NO: 7720295 - DNA, 22 bp, Homo sapiens
tgcacagggagggggccagctc

SEQ ID NO: 7720296 - DNA, 22 bp, Homo sapiens
tgcacaggccttgaagggagag

SEQ ID NO: 7720297 - DNA, 22 bp, Homo sapiens
tgcacagggagggggccagctc

SEQ ID NO: 7720298 - DNA, 22 bp, Homo sapiens
tgcacagggagggggccagctc

SEQ ID NO: 7720299 - DNA, 22 bp, Homo sapiens
tgcacagggagggggccagctc

SEQ ID NO: 7720300 - DNA, 22 bp, Homo sapiens
tgcacaggccttgaagggagag

SEQ ID NO: 7720301 - DNA, 22 bp, Homo sapiens
tgcacaggccttgaagggagag

SEQ ID NO: 7720302 - DNA, 22 bp, Homo sapiens
tgcacaggccttgaagggagag

SEQ ID NO: 7720303 - DNA, 22 bp, Homo sapiens
tgcacaggccttgaagggagag

SEQ ID NO: 7720304 - DNA, 20 bp, Homo sapiens
tgcacagggtgggaagcaac

SEQ ID NO: 7720305 - DNA, 22 bp, Homo sapiens
tgcacaggtatgcaaagcatgt

SEQ ID NO: 7720306 - DNA, 22 bp, Homo sapiens
tgcacaggtatgcaaagcatgt

SEQ ID NO: 7720307 - DNA, 20 bp, Homo sapiens
tgcacagggtgggaagcaac

SEQ ID NO: 7720308 - DNA, 20 bp, Homo sapiens
tgcacagggtgggaagcaac

SEQ ID NO: 7720309 - DNA, 20 bp, Homo sapiens
tgcacagggtgggaagcaac

SEQ ID NO: 7720310 - DNA, 20 bp, Homo sapiens
tgcacagggtgggaagcaac

SEQ ID NO: 7720311 - DNA, 20 bp, Homo sapiens
tgcacagggtgggaagcaac

SEQ ID NO: 7720312 - DNA, 22 bp, Homo sapiens
tgcacaggtgagactcaggaag

SEQ ID NO: 7720313 - DNA, 22 bp, Homo sapiens
tgcacaggtgagactcaggaag

SEQ ID NO: 7720314 - DNA, 22 bp, Homo sapiens
tgcacaggtgagactcaggaag

SEQ ID NO: 7720315 - DNA, 22 bp, Homo sapiens
tgcacaggtgagactcaggaag

SEQ ID NO: 7720316 - DNA, 22 bp, Homo sapiens
tgcacaggtgagactcaggaag

SEQ ID NO: 7720317 - DNA, 22 bp, Homo sapiens
tgcacaggtatgcaaagcatgt

SEQ ID NO: 7720318 - DNA, 22 bp, Homo sapiens
tgcacaggtatgcaaagcatgt

SEQ ID NO: 7720319 - DNA, 23 bp, Homo sapiens
tgcacaggacggccttataagta

SEQ ID NO: 7720320 - DNA, 23 bp, Homo sapiens
tgcacaggacggccttataagta

SEQ ID NO: 7720321 - DNA, 18 bp, Homo sapiens
tgcacagctgtgggctgg

SEQ ID NO: 7720322 - DNA, 18 bp, Homo sapiens
tgcacagctgtgggctgg

SEQ ID NO: 7720323 - DNA, 22 bp, Homo sapiens
tgcacaggaggctgtggagaag

SEQ ID NO: 7720324 - DNA, 22 bp, Homo sapiens
tgcacaggaggctgtggagaag

SEQ ID NO: 7720325 - DNA, 22 bp, Homo sapiens
tgcacaggaggctgtggagaag

SEQ ID NO: 7720326 - DNA, 22 bp, Homo sapiens
tgcacagctgcctcctctctgc

SEQ ID NO: 7720327 - DNA, 22 bp, Homo sapiens
tgcacagctgcctcctctctgc

SEQ ID NO: 7720328 - DNA, 22 bp, Homo sapiens
tgcacagcgggtgtctgtcagg

SEQ ID NO: 7720329 - DNA, 22 bp, Homo sapiens
tgcacagctgcctcctctctgc

SEQ ID NO: 7720330 - DNA, 22 bp, Homo sapiens
tgcacagctgcctcctctctgc

SEQ ID NO: 7720331 - DNA, 22 bp, Homo sapiens
tgcacagctggctctccttttc

SEQ ID NO: 7720332 - DNA, 22 bp, Homo sapiens
tgcacagctggctctccttttc

SEQ ID NO: 7720333 - DNA, 20 bp, Homo sapiens
tgcacagctgtgaataggat

SEQ ID NO: 7720334 - DNA, 20 bp, Homo sapiens
tgcacagctgtgaataggat

SEQ ID NO: 7720335 - DNA, 20 bp, Homo sapiens
tgcacagctgtgaataggat

SEQ ID NO: 7720336 - DNA, 22 bp, Homo sapiens
tgcacacagttctcaggaaaga

SEQ ID NO: 7720337 - DNA, 22 bp, Homo sapiens
tgcacacagtggacaagtcttg

SEQ ID NO: 7720338 - DNA, 22 bp, Homo sapiens
tgcacacagttctcaggaaaga

SEQ ID NO: 7720339 - DNA, 21 bp, Homo sapiens
tgcacagcaaaagttgagtaa

SEQ ID NO: 7720340 - DNA, 22 bp, Homo sapiens
tgcacacatacatgggaagtgc

SEQ ID NO: 7720341 - DNA, 22 bp, Homo sapiens
tgcacacatacatgggaagtgc

SEQ ID NO: 7720342 - DNA, 22 bp, Homo sapiens
tgcacacatacatgggaagtgc

SEQ ID NO: 7720343 - DNA, 22 bp, Homo sapiens
tgcacagcaaatattgactacc

SEQ ID NO: 7720344 - DNA, 21 bp, Homo sapiens
tgcacagccataccctccttg

SEQ ID NO: 7720345 - DNA, 22 bp, Homo sapiens
tgcacagcgcttgtcgggtgtg

SEQ ID NO: 7720346 - DNA, 21 bp, Homo sapiens
tgcacagccataccctccttg

SEQ ID NO: 7720347 - DNA, 22 bp, Homo sapiens
tgcacagcgggtgtctgtcagg

SEQ ID NO: 7720348 - DNA, 22 bp, Homo sapiens
tgcacagcaaatattgactacc

SEQ ID NO: 7720349 - DNA, 22 bp, Homo sapiens
tgcacagcgcttgtcgggtgtg

SEQ ID NO: 7720350 - DNA, 22 bp, Homo sapiens
tgcacagcgggtgtctgtcagg

SEQ ID NO: 7720351 - DNA, 22 bp, Homo sapiens
tgcacagcgggtgtctgtcagg

SEQ ID NO: 7720352 - DNA, 22 bp, Homo sapiens
tgcacagcgggtgtctgtcagg

SEQ ID NO: 7720353 - DNA, 19 bp, Homo sapiens
tgcacccatgtatgcatgc

SEQ ID NO: 7720354 - DNA, 22 bp, Homo sapiens
tgcacccagggggatcaggaat

SEQ ID NO: 7720355 - DNA, 22 bp, Homo sapiens
tgcacccatagcacacactcct

SEQ ID NO: 7720356 - DNA, 22 bp, Homo sapiens
tgcacccatagcacacactcct

SEQ ID NO: 7720357 - DNA, 20 bp, Homo sapiens
tgcacccagagcctgaagat

SEQ ID NO: 7720358 - DNA, 20 bp, Homo sapiens
tgcacccagagcctgaagat

SEQ ID NO: 7720359 - DNA, 22 bp, Homo sapiens
tgcacccacttagctgaagttc

SEQ ID NO: 7720360 - DNA, 22 bp, Homo sapiens
tgcaccctcatcagtcaaatgg

SEQ ID NO: 7720361 - DNA, 22 bp, Homo sapiens
tgcaccccattttacatttaca

SEQ ID NO: 7720362 - DNA, 22 bp, Homo sapiens
tgcaccccattttacatttaca

SEQ ID NO: 7720363 - DNA, 22 bp, Homo sapiens
tgcacccatgtctccacgtaca

SEQ ID NO: 7720364 - DNA, 22 bp, Homo sapiens
tgcaccccattttacatttaca

SEQ ID NO: 7720365 - DNA, 18 bp, Homo sapiens
tgcaccctaagggcccca

SEQ ID NO: 7720366 - DNA, 18 bp, Homo sapiens
tgcaccctaagggcccca

SEQ ID NO: 7720367 - DNA, 22 bp, Homo sapiens
tgcaccacccgtgggaggactg

SEQ ID NO: 7720368 - DNA, 22 bp, Homo sapiens
tgcaccacccgtgggaggactg

SEQ ID NO: 7720369 - DNA, 22 bp, Homo sapiens
tgcaccaagtctggcactgaat

SEQ ID NO: 7720370 - DNA, 22 bp, Homo sapiens
tgcaccagtttctcagagaatc

SEQ ID NO: 7720371 - DNA, 22 bp, Homo sapiens
tgcaccactgcactccagcctg

SEQ ID NO: 7720372 - DNA, 22 bp, Homo sapiens
tgcaccactgcattccagcctg

SEQ ID NO: 7720373 - DNA, 22 bp, Homo sapiens
tgcaccagagcagggtgcccaa

SEQ ID NO: 7720374 - DNA, 22 bp, Homo sapiens
tgcaccagagcagggtgcccaa

SEQ ID NO: 7720375 - DNA, 22 bp, Homo sapiens
tgcaccagtttctcagagaatc

SEQ ID NO: 7720376 - DNA, 22 bp, Homo sapiens
tgcaccatgtaagtggccacgt

SEQ ID NO: 7720377 - DNA, 22 bp, Homo sapiens
tgcaccatacccattcccctct

SEQ ID NO: 7720378 - DNA, 22 bp, Homo sapiens
tgcaccattaatttatgtgaga

SEQ ID NO: 7720379 - DNA, 22 bp, Homo sapiens
tgcaccattttgtcaggctact

SEQ ID NO: 7720380 - DNA, 22 bp, Homo sapiens
tgcaccctcatcagtcaaatgg

SEQ ID NO: 7720381 - DNA, 22 bp, Homo sapiens
tgcacctgcaatacctgtacct

SEQ ID NO: 7720382 - DNA, 22 bp, Homo sapiens
tgcacctgcaatacctgtacct

SEQ ID NO: 7720383 - DNA, 22 bp, Homo sapiens
tgcacctgctcagactcctgtc

SEQ ID NO: 7720384 - DNA, 22 bp, Homo sapiens
tgcacctgctcagactcctgtc

SEQ ID NO: 7720385 - DNA, 22 bp, Homo sapiens
tgcacctgctcagactcctgtc

SEQ ID NO: 7720386 - DNA, 22 bp, Homo sapiens
tgcacctggactaactaactca

SEQ ID NO: 7720387 - DNA, 22 bp, Homo sapiens
tgcaccctcatcagtcaaatgg

SEQ ID NO: 7720388 - DNA, 22 bp, Homo sapiens
tgcaccctctgctatgtgctcc

SEQ ID NO: 7720389 - DNA, 22 bp, Homo sapiens
tgcaccctgcctgcctgcgggt

SEQ ID NO: 7720390 - DNA, 22 bp, Homo sapiens
tgcaccgttgcactccagagtg

SEQ ID NO: 7720391 - DNA, 22 bp, Homo sapiens
tgcacctgagaggtctctgagg

SEQ ID NO: 7720392 - DNA, 22 bp, Homo sapiens
tgcacctgagaggtctctgagg

SEQ ID NO: 7720393 - DNA, 22 bp, Homo sapiens
tgcacctgtagtgagctgtgcc

SEQ ID NO: 7720394 - DNA, 22 bp, Homo sapiens
tgcacctgtagtgagctgtgcc

SEQ ID NO: 7720395 - DNA, 22 bp, Homo sapiens
tgcacctgtagtgagctgtgcc

SEQ ID NO: 7720396 - DNA, 21 bp, Homo sapiens
tgcacctgtgccccatccttc

SEQ ID NO: 7720397 - DNA, 21 bp, Homo sapiens
tgcacctgtgccccatccttc

SEQ ID NO: 7720398 - DNA, 21 bp, Homo sapiens
tgcacctgtgccccatccttc

SEQ ID NO: 7720399 - DNA, 21 bp, Homo sapiens
tgcacctgtgccccatccttc

SEQ ID NO: 7720400 - DNA, 21 bp, Homo sapiens
tgcacctgttcactgcagttc

SEQ ID NO: 7720401 - DNA, 21 bp, Homo sapiens
tgcacctgttcactgcagttc

SEQ ID NO: 7720402 - DNA, 21 bp, Homo sapiens
tgcacctgttcactgcagttc

SEQ ID NO: 7720403 - DNA, 22 bp, Homo sapiens
tgcaccttcattttaggcagct

SEQ ID NO: 7720404 - DNA, 22 bp, Homo sapiens
tgcaccttcattttaggcagct

SEQ ID NO: 7720405 - DNA, 22 bp, Homo sapiens
tgcaccttcattttaggcagct

SEQ ID NO: 7720406 - DNA, 22 bp, Homo sapiens
tgcacattagtgtttgagatgc

SEQ ID NO: 7720407 - DNA, 22 bp, Homo sapiens
tgcacatgtgcctgtggcacat

SEQ ID NO: 7720408 - DNA, 22 bp, Homo sapiens
tgcacattagtgtttgagatgc

SEQ ID NO: 7720409 - DNA, 22 bp, Homo sapiens
tgcacattagtgtttgagatgc

SEQ ID NO: 7720410 - DNA, 22 bp, Homo sapiens
tgcacattgaatgagcaaactg

SEQ ID NO: 7720411 - DNA, 22 bp, Homo sapiens
tgcacattgaaatgaccagctg

SEQ ID NO: 7720412 - DNA, 22 bp, Homo sapiens
tgcacattgaaatgaccagctg

SEQ ID NO: 7720413 - DNA, 22 bp, Homo sapiens
tgcacatggcaatgctgctccc

SEQ ID NO: 7720414 - DNA, 22 bp, Homo sapiens
tgcacatggcaatgctgctccc

SEQ ID NO: 7720415 - DNA, 22 bp, Homo sapiens
tgcacatggcaatgctgctccc

SEQ ID NO: 7720416 - DNA, 22 bp, Homo sapiens
tgcacatctttcagcatcatac

SEQ ID NO: 7720417 - DNA, 22 bp, Homo sapiens
tgcacagttggctacatcgtgg

SEQ ID NO: 7720418 - DNA, 22 bp, Homo sapiens
tgcacatggcctgagtgcctga

SEQ ID NO: 7720419 - DNA, 22 bp, Homo sapiens
tgcacatgtgcacatatatgtg

SEQ ID NO: 7720420 - DNA, 22 bp, Homo sapiens
tgcacatggcctgagtgcctga

SEQ ID NO: 7720421 - DNA, 20 bp, Homo sapiens
tgcacatggcagccatctag

SEQ ID NO: 7720422 - DNA, 22 bp, Homo sapiens
tgcacatctttcagcatcatac

SEQ ID NO: 7720423 - DNA, 20 bp, Homo sapiens
tgcacatggcagccatctag

SEQ ID NO: 7720424 - DNA, 20 bp, Homo sapiens
tgcacatggcagccatctag

SEQ ID NO: 7720425 - DNA, 22 bp, Homo sapiens
tgcacagtaaacatgactggag

SEQ ID NO: 7720426 - DNA, 22 bp, Homo sapiens
tgcacagtaaacatgactggag

SEQ ID NO: 7720427 - DNA, 22 bp, Homo sapiens
tgcacagtaaacatgactggag

SEQ ID NO: 7720428 - DNA, 22 bp, Homo sapiens
tgcacagtaaacatgactggag

SEQ ID NO: 7720429 - DNA, 22 bp, Homo sapiens
tgcacagtatgtggtcctttgt

SEQ ID NO: 7720430 - DNA, 22 bp, Homo sapiens
tgcacagtatgtggtcctttgt

SEQ ID NO: 7720431 - DNA, 22 bp, Homo sapiens
tgcacagtgaccactgagcaag

SEQ ID NO: 7720432 - DNA, 22 bp, Homo sapiens
tgcacagtgaccactgagcaag

SEQ ID NO: 7720433 - DNA, 22 bp, Homo sapiens
tgcacaggtggtccatctgcac

SEQ ID NO: 7720434 - DNA, 22 bp, Homo sapiens
tgcacaggtggtccatctgcac

SEQ ID NO: 7720435 - DNA, 22 bp, Homo sapiens
tgcacagtgtaatgaatcagaa

SEQ ID NO: 7720436 - DNA, 22 bp, Homo sapiens
tgcacagtgacccctggtgact

SEQ ID NO: 7720437 - DNA, 22 bp, Homo sapiens
tgcacagtgaccactgagcaag

SEQ ID NO: 7720438 - DNA, 22 bp, Homo sapiens
tgcacagtgaccactgagcaag

SEQ ID NO: 7720439 - DNA, 22 bp, Homo sapiens
tgcacagttcgccttctccaag

SEQ ID NO: 7720440 - DNA, 22 bp, Homo sapiens
tgcacagttcgccttctccaag

SEQ ID NO: 7720441 - DNA, 22 bp, Homo sapiens
tgcacagttggctacatcgtgg

SEQ ID NO: 7720442 - DNA, 22 bp, Homo sapiens
tgcacagttggctacatcgtgg

SEQ ID NO: 7720443 - DNA, 22 bp, Homo sapiens
tgcacagttggctacatcgtgg

SEQ ID NO: 7720444 - DNA, 22 bp, Homo sapiens
tgcacagttaatatgtgacaga

SEQ ID NO: 7720445 - DNA, 22 bp, Homo sapiens
tgcacagttaatatgtgacaga

SEQ ID NO: 7720446 - DNA, 22 bp, Homo sapiens
tgcacagtgtaatgaatcagaa

SEQ ID NO: 7720447 - DNA, 22 bp, Homo sapiens
tgcacagtgtaatgaatcagaa

SEQ ID NO: 7720448 - DNA, 22 bp, Homo sapiens
tgcagaggagtcagcctgggca

SEQ ID NO: 7720449 - DNA, 22 bp, Homo sapiens
tgcagaggagtcagcctgggca

SEQ ID NO: 7720450 - DNA, 22 bp, Homo sapiens
tgcagaggagtcagcctgggca

SEQ ID NO: 7720451 - DNA, 22 bp, Homo sapiens
tgcagaggagtcagcctgggca

SEQ ID NO: 7720452 - DNA, 22 bp, Homo sapiens
tgcagaggagtcagcctgggca

SEQ ID NO: 7720453 - DNA, 22 bp, Homo sapiens
tgcagaggagtcagcctgggca

SEQ ID NO: 7720454 - DNA, 22 bp, Homo sapiens
tgcagaggagctggaaggctgg

SEQ ID NO: 7720455 - DNA, 22 bp, Homo sapiens
tgcagaggagtcagcctgggca

SEQ ID NO: 7720456 - DNA, 22 bp, Homo sapiens
tgcagaggagtcagcctgggca

SEQ ID NO: 7720457 - DNA, 22 bp, Homo sapiens
tgcagaggagtcagcctgggca

SEQ ID NO: 7720458 - DNA, 22 bp, Homo sapiens
tgcagaggagtcagcctgggca

SEQ ID NO: 7720459 - DNA, 22 bp, Homo sapiens
tgcagaggagtcagcctgggca

SEQ ID NO: 7720460 - DNA, 22 bp, Homo sapiens
tgcagaggagtcagcctgggca

SEQ ID NO: 7720461 - DNA, 21 bp, Homo sapiens
tgcagaggcacaaacaagccc

SEQ ID NO: 7720462 - DNA, 21 bp, Homo sapiens
tgcagaggcacaaacaagccc

SEQ ID NO: 7720463 - DNA, 21 bp, Homo sapiens
tgcagaggcacaaacaagccc

SEQ ID NO: 7720464 - DNA, 21 bp, Homo sapiens
tgcagaggcacaaacaagccc

SEQ ID NO: 7720465 - DNA, 22 bp, Homo sapiens
tgcagaggagctggaaggctgg

SEQ ID NO: 7720466 - DNA, 22 bp, Homo sapiens
tgcagaggagctggaaggctgg

SEQ ID NO: 7720467 - DNA, 22 bp, Homo sapiens
tgcagaggagctggaaggctgg

SEQ ID NO: 7720468 - DNA, 22 bp, Homo sapiens
tgcagaggagctggaaggctgg

SEQ ID NO: 7720469 - DNA, 22 bp, Homo sapiens
tgcagaggagctggaaggctgg

SEQ ID NO: 7720470 - DNA, 22 bp, Homo sapiens
tgcagaggagctggaaggctgg

SEQ ID NO: 7720471 - DNA, 22 bp, Homo sapiens
tgcagaggagctggaaggctgg

SEQ ID NO: 7720472 - DNA, 22 bp, Homo sapiens
tgcagaggagctggaaggctgg

SEQ ID NO: 7720473 - DNA, 22 bp, Homo sapiens
tgcagaggagctggaaggctgg

SEQ ID NO: 7720474 - DNA, 22 bp, Homo sapiens
tgcagaggagctggaaggctgg

SEQ ID NO: 7720475 - DNA, 22 bp, Homo sapiens
tgcagaggagctggaaggctgg

SEQ ID NO: 7720476 - DNA, 22 bp, Homo sapiens
tgcagaggagctggaaggctgg

SEQ ID NO: 7720477 - DNA, 22 bp, Homo sapiens
tgcagaggagctggaaggctgg

SEQ ID NO: 7720478 - DNA, 22 bp, Homo sapiens
tgcagaggagctggaaggctgg

SEQ ID NO: 7720479 - DNA, 22 bp, Homo sapiens
tgcagaggagctggaaggctgg

SEQ ID NO: 7720480 - DNA, 22 bp, Homo sapiens
tgcagaggagctggaaggctgg

SEQ ID NO: 7720481 - DNA, 22 bp, Homo sapiens
tgcagaggagctggaaggctgg

SEQ ID NO: 7720482 - DNA, 22 bp, Homo sapiens
tgcagaggagctggaaggctgg

SEQ ID NO: 7720483 - DNA, 22 bp, Homo sapiens
tgcagaggcgccgtgggtgggg

SEQ ID NO: 7720484 - DNA, 22 bp, Homo sapiens
tgcagaggcgccgtgggtgggg

SEQ ID NO: 7720485 - DNA, 22 bp, Homo sapiens
tgcagaggcgccgtgggtgggg

SEQ ID NO: 7720486 - DNA, 22 bp, Homo sapiens
tgcagaggcgccgtgggtgggg

SEQ ID NO: 7720487 - DNA, 22 bp, Homo sapiens
tgcagaggcgccgtgggtgggg

SEQ ID NO: 7720488 - DNA, 22 bp, Homo sapiens
tgcagaggcgccgtgggtgggg

SEQ ID NO: 7720489 - DNA, 22 bp, Homo sapiens
tgcagaggcgccgtgggtgggg

SEQ ID NO: 7720490 - DNA, 22 bp, Homo sapiens
tgcagaggctggctcgccgggt

SEQ ID NO: 7720491 - DNA, 22 bp, Homo sapiens
tgcagaggcgccgtgggtgggg

SEQ ID NO: 7720492 - DNA, 22 bp, Homo sapiens
tgcagaggctggctcgccgggt

SEQ ID NO: 7720493 - DNA, 22 bp, Homo sapiens
tgcagagggaaaaggtgctcct

SEQ ID NO: 7720494 - DNA, 22 bp, Homo sapiens
tgcagaggctggctcgccgggt

SEQ ID NO: 7720495 - DNA, 22 bp, Homo sapiens
tgcagaggctggctcgccgggt

SEQ ID NO: 7720496 - DNA, 22 bp, Homo sapiens
tgcagaggctggctcgccgggt

SEQ ID NO: 7720497 - DNA, 22 bp, Homo sapiens
tgcagaggctggctcgccgggt

SEQ ID NO: 7720498 - DNA, 22 bp, Homo sapiens
tgcagaggctggctcgccgggt

SEQ ID NO: 7720499 - DNA, 21 bp, Homo sapiens
tgcagaggcacaaacaagccc

SEQ ID NO: 7720500 - DNA, 21 bp, Homo sapiens
tgcagaggcacaaacaagccc

SEQ ID NO: 7720501 - DNA, 23 bp, Homo sapiens
tgcagaggcatgatcactgctca

SEQ ID NO: 7720502 - DNA, 21 bp, Homo sapiens
tgcagaggcacaaacaagccc

SEQ ID NO: 7720503 - DNA, 23 bp, Homo sapiens
tgcagaggcatgatcactgctca

SEQ ID NO: 7720504 - DNA, 23 bp, Homo sapiens
tgcagaggcatgatcactgctca

SEQ ID NO: 7720505 - DNA, 23 bp, Homo sapiens
tgcagaggcatgatcactgctca

SEQ ID NO: 7720506 - DNA, 23 bp, Homo sapiens
tgcagaggcatgatcactgctca

SEQ ID NO: 7720507 - DNA, 23 bp, Homo sapiens
tgcagaggcatgatcactgctca

SEQ ID NO: 7720508 - DNA, 23 bp, Homo sapiens
tgcagaggcatgatcactgctca

SEQ ID NO: 7720509 - DNA, 23 bp, Homo sapiens
tgcagaggcatgatcactgctca

SEQ ID NO: 7720510 - DNA, 22 bp, Homo sapiens
tgcagaggcccagcggttcttc

SEQ ID NO: 7720511 - DNA, 22 bp, Homo sapiens
tgcagaggcccagcggttcttc

SEQ ID NO: 7720512 - DNA, 22 bp, Homo sapiens
tgcagaggcccagcggttcttc

SEQ ID NO: 7720513 - DNA, 22 bp, Homo sapiens
tgcagaggcccagcggttcttc

SEQ ID NO: 7720514 - DNA, 22 bp, Homo sapiens
tgcagaggcccagcggttcttc

SEQ ID NO: 7720515 - DNA, 22 bp, Homo sapiens
tgcagaggcatttattgatgta

SEQ ID NO: 7720516 - DNA, 22 bp, Homo sapiens
tgcagaggcatttattgatgta

SEQ ID NO: 7720517 - DNA, 22 bp, Homo sapiens
tgcagaggcatttattgatgta

SEQ ID NO: 7720518 - DNA, 22 bp, Homo sapiens
tgcagaggcatttattgatgta

SEQ ID NO: 7720519 - DNA, 22 bp, Homo sapiens
tgcagaggcatttattgatgta

SEQ ID NO: 7720520 - DNA, 22 bp, Homo sapiens
tgcagaggaccattgtcctgga

SEQ ID NO: 7720521 - DNA, 22 bp, Homo sapiens
tgcagaggaccattgtcctgga

SEQ ID NO: 7720522 - DNA, 22 bp, Homo sapiens
tgcagaggaccattgtcctgga

SEQ ID NO: 7720523 - DNA, 22 bp, Homo sapiens
tgcagaggaccattgtcctgga

SEQ ID NO: 7720524 - DNA, 22 bp, Homo sapiens
tgcagaggagctggaaggctgg

SEQ ID NO: 7720525 - DNA, 22 bp, Homo sapiens
tgcagaggagctggaaggctgg

SEQ ID NO: 7720526 - DNA, 22 bp, Homo sapiens
tgcagaggagctggaaggctgg

SEQ ID NO: 7720527 - DNA, 22 bp, Homo sapiens
tgcagaggagctggaaggctgg

SEQ ID NO: 7720528 - DNA, 22 bp, Homo sapiens
tgcagaggagctggaaggctgg

SEQ ID NO: 7720529 - DNA, 22 bp, Homo sapiens
tgcagaggagctggaaggctgg

SEQ ID NO: 7720530 - DNA, 22 bp, Homo sapiens
tgcagaggagctggaaggctgg

SEQ ID NO: 7720531 - DNA, 22 bp, Homo sapiens
tgcagaggagctggaaggctgg

SEQ ID NO: 7720532 - DNA, 22 bp, Homo sapiens
tgcagaggaccattgtcctgga

SEQ ID NO: 7720533 - DNA, 22 bp, Homo sapiens
tgcagaggaccattgtcctgga

SEQ ID NO: 7720534 - DNA, 22 bp, Homo sapiens
tgcagagcttcattgcataggc

SEQ ID NO: 7720535 - DNA, 22 bp, Homo sapiens
tgcagagcttcattgcataggc

SEQ ID NO: 7720536 - DNA, 22 bp, Homo sapiens
tgcagagcttcattgcataggc

SEQ ID NO: 7720537 - DNA, 20 bp, Homo sapiens
tgcagagctggctggctcct

SEQ ID NO: 7720538 - DNA, 20 bp, Homo sapiens
tgcagagctggctggctcct

SEQ ID NO: 7720539 - DNA, 20 bp, Homo sapiens
tgcagagctggctggctcct

SEQ ID NO: 7720540 - DNA, 22 bp, Homo sapiens
tgcagagatctgggcgtcggct

SEQ ID NO: 7720541 - DNA, 22 bp, Homo sapiens
tgcagagatctgggcgtcggct

SEQ ID NO: 7720542 - DNA, 22 bp, Homo sapiens
tgcagagatctgggcgtcggct

SEQ ID NO: 7720543 - DNA, 22 bp, Homo sapiens
tgcagagatttggctcttaaag

SEQ ID NO: 7720544 - DNA, 22 bp, Homo sapiens
tgcagagattgaacaagaagga

SEQ ID NO: 7720545 - DNA, 22 bp, Homo sapiens
tgcagagatttggctcttaaag

SEQ ID NO: 7720546 - DNA, 21 bp, Homo sapiens
tgcagagatttttacttgtct

SEQ ID NO: 7720547 - DNA, 21 bp, Homo sapiens
tgcagagatttttacttgtct

SEQ ID NO: 7720548 - DNA, 22 bp, Homo sapiens
tgcagagatttggctcttaaag

SEQ ID NO: 7720549 - DNA, 22 bp, Homo sapiens
tgcagagattgaacaagaagga

SEQ ID NO: 7720550 - DNA, 22 bp, Homo sapiens
tgcagagattgaacaagaagga

SEQ ID NO: 7720551 - DNA, 22 bp, Homo sapiens
tgcagagattgaacaagaagga

SEQ ID NO: 7720552 - DNA, 20 bp, Homo sapiens
tgcagagctgacattacctg

SEQ ID NO: 7720553 - DNA, 22 bp, Homo sapiens
tgcagagctcttggcacttcag

SEQ ID NO: 7720554 - DNA, 22 bp, Homo sapiens
tgcagagctcttggcacttcag

SEQ ID NO: 7720555 - DNA, 20 bp, Homo sapiens
tgcagagctgacattacctg

SEQ ID NO: 7720556 - DNA, 22 bp, Homo sapiens
tgcagagcagcaactgcgtgcg

SEQ ID NO: 7720557 - DNA, 22 bp, Homo sapiens
tgcagagcagcaactgcgtgcg

SEQ ID NO: 7720558 - DNA, 22 bp, Homo sapiens
tgcagagcagcaactgcgtgcg

SEQ ID NO: 7720559 - DNA, 22 bp, Homo sapiens
tgcagagcagcaactgcgtgcg

SEQ ID NO: 7720560 - DNA, 22 bp, Homo sapiens
tgcagagaaaccagtggaggac

SEQ ID NO: 7720561 - DNA, 22 bp, Homo sapiens
tgcagagaaaccagtggaggac

SEQ ID NO: 7720562 - DNA, 22 bp, Homo sapiens
tgcagagaaaccagtggaggac

SEQ ID NO: 7720563 - DNA, 22 bp, Homo sapiens
tgcagagaaaccagtggaggac

SEQ ID NO: 7720564 - DNA, 22 bp, Homo sapiens
tgcagagaaaactcctgggtac

SEQ ID NO: 7720565 - DNA, 22 bp, Homo sapiens
tgcagagaaaactcctgggtac

SEQ ID NO: 7720566 - DNA, 22 bp, Homo sapiens
tgcagacctcccatggctgcct

SEQ ID NO: 7720567 - DNA, 22 bp, Homo sapiens
tgcagacctcccatggctgcct

SEQ ID NO: 7720568 - DNA, 22 bp, Homo sapiens
tgcagagaaaactcctgggtac

SEQ ID NO: 7720569 - DNA, 22 bp, Homo sapiens
tgcagagatcctggactgagcg

SEQ ID NO: 7720570 - DNA, 22 bp, Homo sapiens
tgcagagatcctggactgagcg

SEQ ID NO: 7720571 - DNA, 21 bp, Homo sapiens
tgcagagatatctgaagcaga

SEQ ID NO: 7720572 - DNA, 22 bp, Homo sapiens
tgcagagatcctggactgagcg

SEQ ID NO: 7720573 - DNA, 22 bp, Homo sapiens
tgcagagaaaccagtggaggac

SEQ ID NO: 7720574 - DNA, 21 bp, Homo sapiens
tgcagagatatctgaagcaga

SEQ ID NO: 7720575 - DNA, 22 bp, Homo sapiens
tgcagacaagaagaaccaagga

SEQ ID NO: 7720576 - DNA, 22 bp, Homo sapiens
tgcagaatttagggaggcagca

SEQ ID NO: 7720577 - DNA, 22 bp, Homo sapiens
tgcagaatttagggaggcagca

SEQ ID NO: 7720578 - DNA, 22 bp, Homo sapiens
tgcagaattatggtgctggctt

SEQ ID NO: 7720579 - DNA, 22 bp, Homo sapiens
tgcagaattatggtgctggctt

SEQ ID NO: 7720580 - DNA, 22 bp, Homo sapiens
tgcagaattatggtgctggctt

SEQ ID NO: 7720581 - DNA, 22 bp, Homo sapiens
tgcagaattctcagtcagactc

SEQ ID NO: 7720582 - DNA, 22 bp, Homo sapiens
tgcagaattctcagtcagactc

SEQ ID NO: 7720583 - DNA, 21 bp, Homo sapiens
tgcagaattctgggagccccc

SEQ ID NO: 7720584 - DNA, 21 bp, Homo sapiens
tgcagaattctgggagccccc

SEQ ID NO: 7720585 - DNA, 22 bp, Homo sapiens
tgcagaatattctggtgacaat

SEQ ID NO: 7720586 - DNA, 22 bp, Homo sapiens
tgcagaagtgagtcatgaggaa

SEQ ID NO: 7720587 - DNA, 22 bp, Homo sapiens
tgcagaatattctggtgacaat

SEQ ID NO: 7720588 - DNA, 20 bp, Homo sapiens
tgcagaatcctgtgatcagt

SEQ ID NO: 7720589 - DNA, 20 bp, Homo sapiens
tgcagaatcctgtgatcagt

SEQ ID NO: 7720590 - DNA, 22 bp, Homo sapiens
tgcagaatgtggacagtgggtt

SEQ ID NO: 7720591 - DNA, 22 bp, Homo sapiens
tgcagaatgtggacagtgggtt

SEQ ID NO: 7720592 - DNA, 22 bp, Homo sapiens
tgcagaatctcaaccttaccca

SEQ ID NO: 7720593 - DNA, 22 bp, Homo sapiens
tgcagaatctcaaccttaccca

SEQ ID NO: 7720594 - DNA, 22 bp, Homo sapiens
tgcagaatgtggacagtgggtt

SEQ ID NO: 7720595 - DNA, 22 bp, Homo sapiens
tgcagaatgttatcaaagttag

SEQ ID NO: 7720596 - DNA, 22 bp, Homo sapiens
tgcagaatgttatcaaagttag

SEQ ID NO: 7720597 - DNA, 22 bp, Homo sapiens
tgcagacagagaaatgaggccc

SEQ ID NO: 7720598 - DNA, 22 bp, Homo sapiens
tgcagacagagaaatgaggccc

SEQ ID NO: 7720599 - DNA, 21 bp, Homo sapiens
tgcagacagggacagaatgga

SEQ ID NO: 7720600 - DNA, 21 bp, Homo sapiens
tgcagacagggacagaatgga

SEQ ID NO: 7720601 - DNA, 22 bp, Homo sapiens
tgcagacagagaaatgaggccc

SEQ ID NO: 7720602 - DNA, 22 bp, Homo sapiens
tgcagacaagccaggctatggc

SEQ ID NO: 7720603 - DNA, 22 bp, Homo sapiens
tgcagacaagccaggctatggc

SEQ ID NO: 7720604 - DNA, 22 bp, Homo sapiens
tgcagacaagccaggctatggc

SEQ ID NO: 7720605 - DNA, 22 bp, Homo sapiens
tgcagacaagtgcatctaaccc

SEQ ID NO: 7720606 - DNA, 22 bp, Homo sapiens
tgcagacaagtgcatctaaccc

SEQ ID NO: 7720607 - DNA, 22 bp, Homo sapiens
tgcagacaagtcgtgggatctt

SEQ ID NO: 7720608 - DNA, 22 bp, Homo sapiens
tgcagacaagtcgtgggatctt

SEQ ID NO: 7720609 - DNA, 22 bp, Homo sapiens
tgcagacaagtcgtgggatctt

SEQ ID NO: 7720610 - DNA, 19 bp, Homo sapiens
tgcagagggtaggaaggcc

SEQ ID NO: 7720611 - DNA, 19 bp, Homo sapiens
tgcagagggtaggaaggcc

SEQ ID NO: 7720612 - DNA, 19 bp, Homo sapiens
tgcagagggtaggaaggcc

SEQ ID NO: 7720613 - DNA, 19 bp, Homo sapiens
tgcagagggtaggaaggcc

SEQ ID NO: 7720614 - DNA, 19 bp, Homo sapiens
tgcagagggtaggaaggcc

SEQ ID NO: 7720615 - DNA, 19 bp, Homo sapiens
tgcagagggtaggaaggcc

SEQ ID NO: 7720616 - DNA, 19 bp, Homo sapiens
tgcagagggtaggaaggcc

SEQ ID NO: 7720617 - DNA, 22 bp, Homo sapiens
tgcagagtcacccagataatta

SEQ ID NO: 7720618 - DNA, 22 bp, Homo sapiens
tgcagagtcacccagataatta

SEQ ID NO: 7720619 - DNA, 22 bp, Homo sapiens
tgcagagtcccaggacccagag

SEQ ID NO: 7720620 - DNA, 22 bp, Homo sapiens
tgcagagtcccaggacccagag

SEQ ID NO: 7720621 - DNA, 22 bp, Homo sapiens
tgcagagtagtgaggggacaga

SEQ ID NO: 7720622 - DNA, 22 bp, Homo sapiens
tgcagagtagtgaggggacaga

SEQ ID NO: 7720623 - DNA, 22 bp, Homo sapiens
tgcagagtagctataccatttt

SEQ ID NO: 7720624 - DNA, 22 bp, Homo sapiens
tgcagagtaacgatcacatata

SEQ ID NO: 7720625 - DNA, 22 bp, Homo sapiens
tgcagatgaatgctgagacact

SEQ ID NO: 7720626 - DNA, 21 bp, Homo sapiens
tgcagataattgaaagctgac

SEQ ID NO: 7720627 - DNA, 23 bp, Homo sapiens
tgcagagtgtcacttgaaaacca

SEQ ID NO: 7720628 - DNA, 22 bp, Homo sapiens
tgcagagttgctttgatagtcc

SEQ ID NO: 7720629 - DNA, 22 bp, Homo sapiens
tgcagagtagctataccatttt

SEQ ID NO: 7720630 - DNA, 23 bp, Homo sapiens
tgcagagtgtcacttgaaaacca

SEQ ID NO: 7720631 - DNA, 22 bp, Homo sapiens
tgcagagtggattctgtatacc

SEQ ID NO: 7720632 - DNA, 22 bp, Homo sapiens
tgcagagtgggagaggtgcggg

SEQ ID NO: 7720633 - DNA, 22 bp, Homo sapiens
tgcagagtgaggaagaactgca

SEQ ID NO: 7720634 - DNA, 22 bp, Homo sapiens
tgcagagtgaggaagaactgca

SEQ ID NO: 7720635 - DNA, 22 bp, Homo sapiens
tgcagagtggattctgtatacc

SEQ ID NO: 7720636 - DNA, 22 bp, Homo sapiens
tgcagagtcctctggagggact

SEQ ID NO: 7720637 - DNA, 22 bp, Homo sapiens
tgcagagtcctctggagggact

SEQ ID NO: 7720638 - DNA, 22 bp, Homo sapiens
tgcagagtcctctggagggact

SEQ ID NO: 7720639 - DNA, 22 bp, Homo sapiens
tgcagagggagtgacggttcac

SEQ ID NO: 7720640 - DNA, 22 bp, Homo sapiens
tgcagagggagtgacggttcac

SEQ ID NO: 7720641 - DNA, 22 bp, Homo sapiens
tgcagagggagtgacggttcac

SEQ ID NO: 7720642 - DNA, 22 bp, Homo sapiens
tgcagagggagtgacggttcac

SEQ ID NO: 7720643 - DNA, 22 bp, Homo sapiens
tgcagagggagtgacggttcac

SEQ ID NO: 7720644 - DNA, 19 bp, Homo sapiens
tgcagagggtaggaaggcc

SEQ ID NO: 7720645 - DNA, 19 bp, Homo sapiens
tgcagagggtaggaaggcc

SEQ ID NO: 7720646 - DNA, 19 bp, Homo sapiens
tgcagagggtaggaaggcc

SEQ ID NO: 7720647 - DNA, 19 bp, Homo sapiens
tgcagagggtaggaaggcc

SEQ ID NO: 7720648 - DNA, 23 bp, Homo sapiens
tgcagagggactgaagccagctt

SEQ ID NO: 7720649 - DNA, 23 bp, Homo sapiens
tgcagagggactgaagccagctt

SEQ ID NO: 7720650 - DNA, 23 bp, Homo sapiens
tgcagagggactgaagccagctt

SEQ ID NO: 7720651 - DNA, 23 bp, Homo sapiens
tgcagagggactgaagccagctt

SEQ ID NO: 7720652 - DNA, 23 bp, Homo sapiens
tgcagagggactgaagccagctt

SEQ ID NO: 7720653 - DNA, 22 bp, Homo sapiens
tgcagagggagtgacggttcac

SEQ ID NO: 7720654 - DNA, 23 bp, Homo sapiens
tgcagagggactgaagccagctt

SEQ ID NO: 7720655 - DNA, 23 bp, Homo sapiens
tgcagagggactgaagccagctt

SEQ ID NO: 7720656 - DNA, 22 bp, Homo sapiens
tgcagagggacagccacagctc

SEQ ID NO: 7720657 - DNA, 22 bp, Homo sapiens
tgcagagggacagccacagctc

SEQ ID NO: 7720658 - DNA, 22 bp, Homo sapiens
tgcagagggacagccacagctc

SEQ ID NO: 7720659 - DNA, 22 bp, Homo sapiens
tgcagagggacagccacagctc

SEQ ID NO: 7720660 - DNA, 23 bp, Homo sapiens
tgcagagggactgaagccagctt

SEQ ID NO: 7720661 - DNA, 23 bp, Homo sapiens
tgcagagggactgaagccagctt

SEQ ID NO: 7720662 - DNA, 23 bp, Homo sapiens
tgcagagggactgaagccagctt

SEQ ID NO: 7720663 - DNA, 22 bp, Homo sapiens
tgcagagggacagccacagctc

SEQ ID NO: 7720664 - DNA, 22 bp, Homo sapiens
tgcagagggaaaaggtgctcct

SEQ ID NO: 7720665 - DNA, 22 bp, Homo sapiens
tgcagagggaaaaggtgctcct

SEQ ID NO: 7720666 - DNA, 22 bp, Homo sapiens
tgcagagggaaaaggtgctcct

SEQ ID NO: 7720667 - DNA, 22 bp, Homo sapiens
tgcagagggaaaaggtgctcct

SEQ ID NO: 7720668 - DNA, 22 bp, Homo sapiens
tgcagagggaaaaggtgctcct

SEQ ID NO: 7720669 - DNA, 22 bp, Homo sapiens
tgcagagggaaaaggtgctcct

SEQ ID NO: 7720670 - DNA, 22 bp, Homo sapiens
tgcagagggaaaaggtgctcct

SEQ ID NO: 7720671 - DNA, 22 bp, Homo sapiens
tgcagagggaaaaggtgctcct

SEQ ID NO: 7720672 - DNA, 22 bp, Homo sapiens
tgcagagggacagccacagctc

SEQ ID NO: 7720673 - DNA, 22 bp, Homo sapiens
tgcagagggacagccacagctc

SEQ ID NO: 7720674 - DNA, 22 bp, Homo sapiens
tgcagagggacagccacagctc

SEQ ID NO: 7720675 - DNA, 22 bp, Homo sapiens
tgcagagggacagccacagctc

SEQ ID NO: 7720676 - DNA, 22 bp, Homo sapiens
tgcagagggacagccacagctc

SEQ ID NO: 7720677 - DNA, 22 bp, Homo sapiens
tgcagcagaagtgttcttctct

SEQ ID NO: 7720678 - DNA, 22 bp, Homo sapiens
tgcagcagaatatggctgcagg

SEQ ID NO: 7720679 - DNA, 22 bp, Homo sapiens
tgcagcagaatatggctgcagg

SEQ ID NO: 7720680 - DNA, 22 bp, Homo sapiens
tgcagcagaatatggctgcagg

SEQ ID NO: 7720681 - DNA, 22 bp, Homo sapiens
tgcagcagaagtgttcttctct

SEQ ID NO: 7720682 - DNA, 22 bp, Homo sapiens
tgcagcagaatatggctgcagg

SEQ ID NO: 7720683 - DNA, 22 bp, Homo sapiens
tgcagcagaatatggctgcagg

SEQ ID NO: 7720684 - DNA, 22 bp, Homo sapiens
tgcagcagaatatggctgcagg

SEQ ID NO: 7720685 - DNA, 22 bp, Homo sapiens
tgcagcagaatatggctgcagg

SEQ ID NO: 7720686 - DNA, 22 bp, Homo sapiens
tgcagcagaatatggctgcagg

SEQ ID NO: 7720687 - DNA, 21 bp, Homo sapiens
tgcagcagaagtctctgtgtc

SEQ ID NO: 7720688 - DNA, 21 bp, Homo sapiens
tgcagcagaagtctctgtgtc

SEQ ID NO: 7720689 - DNA, 21 bp, Homo sapiens
tgcagcagaagtctctgtgtc

SEQ ID NO: 7720690 - DNA, 21 bp, Homo sapiens
tgcagcagaagtctctgtgtc

SEQ ID NO: 7720691 - DNA, 20 bp, Homo sapiens
tgcagcagaagcccatgctc

SEQ ID NO: 7720692 - DNA, 20 bp, Homo sapiens
tgcagcagaagcccatgctc

SEQ ID NO: 7720693 - DNA, 21 bp, Homo sapiens
tgcagcagaagtctctgtgtc

SEQ ID NO: 7720694 - DNA, 22 bp, Homo sapiens
tgcagcaccacacctggctaat

SEQ ID NO: 7720695 - DNA, 22 bp, Homo sapiens
tgcagcaccacacctggctaat

SEQ ID NO: 7720696 - DNA, 22 bp, Homo sapiens
tgcagcaccacacctggctaat

SEQ ID NO: 7720697 - DNA, 22 bp, Homo sapiens
tgcagcacatgtctggggctgg

SEQ ID NO: 7720698 - DNA, 22 bp, Homo sapiens
tgcagcaattttttaggcattc

SEQ ID NO: 7720699 - DNA, 22 bp, Homo sapiens
tgcagcaattttttaggcattc

SEQ ID NO: 7720700 - DNA, 22 bp, Homo sapiens
tgcagcacaggtgtgattggtt

SEQ ID NO: 7720701 - DNA, 22 bp, Homo sapiens
tgcagcaccgtcccactggcta

SEQ ID NO: 7720702 - DNA, 22 bp, Homo sapiens
tgcagcaccgtcccactggcta

SEQ ID NO: 7720703 - DNA, 22 bp, Homo sapiens
tgcagcaccgtcccactggcta

SEQ ID NO: 7720704 - DNA, 22 bp, Homo sapiens
tgcagcacctatggacacttgt

SEQ ID NO: 7720705 - DNA, 22 bp, Homo sapiens
tgcagcacctatggacacttgt

SEQ ID NO: 7720706 - DNA, 22 bp, Homo sapiens
tgcagcacctatggacacttgt

SEQ ID NO: 7720707 - DNA, 22 bp, Homo sapiens
tgcagcacctatggacacttgt

SEQ ID NO: 7720708 - DNA, 20 bp, Homo sapiens
tgcagcacgggccctttcca

SEQ ID NO: 7720709 - DNA, 20 bp, Homo sapiens
tgcagcacgggccctttcca

SEQ ID NO: 7720710 - DNA, 20 bp, Homo sapiens
tgcagcacgggccctttcca

SEQ ID NO: 7720711 - DNA, 20 bp, Homo sapiens
tgcagcacgggccctttcca

SEQ ID NO: 7720712 - DNA, 20 bp, Homo sapiens
tgcagcacgggccctttcca

SEQ ID NO: 7720713 - DNA, 22 bp, Homo sapiens
tgcagcactgttcacaatagcc

SEQ ID NO: 7720714 - DNA, 19 bp, Homo sapiens
tgcagcactaaaaactttc

SEQ ID NO: 7720715 - DNA, 19 bp, Homo sapiens
tgcagcactaaaaactttc

SEQ ID NO: 7720716 - DNA, 19 bp, Homo sapiens
tgcagcactaaaaactttc

SEQ ID NO: 7720717 - DNA, 22 bp, Homo sapiens
tgcagcactgttcacaatagcc

SEQ ID NO: 7720718 - DNA, 22 bp, Homo sapiens
tgcagcacttgccaaactaact

SEQ ID NO: 7720719 - DNA, 22 bp, Homo sapiens
tgcagcacttgccaaactaact

SEQ ID NO: 7720720 - DNA, 22 bp, Homo sapiens
tgcagcacttgccaaactaact

SEQ ID NO: 7720721 - DNA, 20 bp, Homo sapiens
tgcagcagaagcccatgctc

SEQ ID NO: 7720722 - DNA, 18 bp, Homo sapiens
tgcagcaagtgctaaata

SEQ ID NO: 7720723 - DNA, 22 bp, Homo sapiens
tgcagcaagtaaccatcttcct

SEQ ID NO: 7720724 - DNA, 22 bp, Homo sapiens
tgcagcaaggggccctgatagg

SEQ ID NO: 7720725 - DNA, 22 bp, Homo sapiens
tgcagcaatttgcagtaattta

SEQ ID NO: 7720726 - DNA, 22 bp, Homo sapiens
tgcagcaatttgcagtaattta

SEQ ID NO: 7720727 - DNA, 22 bp, Homo sapiens
tgcagcaatttgcagtaattta

SEQ ID NO: 7720728 - DNA, 22 bp, Homo sapiens
tgcagcaatttgcagtaattta

SEQ ID NO: 7720729 - DNA, 22 bp, Homo sapiens
tgcagcaatggtccctgccctc

SEQ ID NO: 7720730 - DNA, 22 bp, Homo sapiens
tgcagcaatgtagtttgggaca

SEQ ID NO: 7720731 - DNA, 18 bp, Homo sapiens
tgcagcaagtgctaaata

SEQ ID NO: 7720732 - DNA, 18 bp, Homo sapiens
tgcagcaagtgctaaata

SEQ ID NO: 7720733 - DNA, 22 bp, Homo sapiens
tgcagcaagaaggcactgtctg

SEQ ID NO: 7720734 - DNA, 22 bp, Homo sapiens
tgcagcaagaccggatatgtcg

SEQ ID NO: 7720735 - DNA, 22 bp, Homo sapiens
tgcagcaagaccggatatgtcg

SEQ ID NO: 7720736 - DNA, 22 bp, Homo sapiens
tgcagcaagcaagtatggttct

SEQ ID NO: 7720737 - DNA, 22 bp, Homo sapiens
tgcagcaagcaagtatggttct

SEQ ID NO: 7720738 - DNA, 22 bp, Homo sapiens
tgcagcaagcaagtatggttct

SEQ ID NO: 7720739 - DNA, 23 bp, Homo sapiens
tgcagcaaccttggaagcatttc

SEQ ID NO: 7720740 - DNA, 23 bp, Homo sapiens
tgcagcaaccttggaagcatttc

SEQ ID NO: 7720741 - DNA, 22 bp, Homo sapiens
tgcagcaacaagatagaatggc

SEQ ID NO: 7720742 - DNA, 22 bp, Homo sapiens
tgcagcaaatggggcccgtcct

SEQ ID NO: 7720743 - DNA, 17 bp, Homo sapiens
tgcagcaaatgggggac

SEQ ID NO: 7720744 - DNA, 17 bp, Homo sapiens
tgcagcaaatgggggac

SEQ ID NO: 7720745 - DNA, 22 bp, Homo sapiens
tgcagatgagggatgaaaatga

SEQ ID NO: 7720746 - DNA, 22 bp, Homo sapiens
tgcagatgagggatgaaaatga

SEQ ID NO: 7720747 - DNA, 22 bp, Homo sapiens
tgcagatggggatcagtggctc

SEQ ID NO: 7720748 - DNA, 22 bp, Homo sapiens
tgcagatggggatcagtggctc

SEQ ID NO: 7720749 - DNA, 22 bp, Homo sapiens
tgcagatggggatcagtggctc

SEQ ID NO: 7720750 - DNA, 22 bp, Homo sapiens
tgcagattcaaatgaaatgcaa

SEQ ID NO: 7720751 - DNA, 22 bp, Homo sapiens
tgcagattcaaatgaaatgcaa

SEQ ID NO: 7720752 - DNA, 22 bp, Homo sapiens
tgcagattcaaatgaaatgcaa

SEQ ID NO: 7720753 - DNA, 22 bp, Homo sapiens
tgcagattcaaatgaaatgcaa

SEQ ID NO: 7720754 - DNA, 22 bp, Homo sapiens
tgcagattcaaatgaaatgcaa

SEQ ID NO: 7720755 - DNA, 22 bp, Homo sapiens
tgcagattcaaatgaaatgcaa

SEQ ID NO: 7720756 - DNA, 22 bp, Homo sapiens
tgcagattcaaatgaaatgcaa

SEQ ID NO: 7720757 - DNA, 22 bp, Homo sapiens
tgcagcaaacaggccttcaggg

SEQ ID NO: 7720758 - DNA, 22 bp, Homo sapiens
tgcagcaaaaggtcagagggag

SEQ ID NO: 7720759 - DNA, 22 bp, Homo sapiens
tgcagcaaaaggtcagagggag

SEQ ID NO: 7720760 - DNA, 22 bp, Homo sapiens
tgcagattcaaatgaaatgcaa

SEQ ID NO: 7720761 - DNA, 22 bp, Homo sapiens
tgcagattcaaatgaaatgcaa

SEQ ID NO: 7720762 - DNA, 22 bp, Homo sapiens
tgcagattcaaatgaaatgcaa

SEQ ID NO: 7720763 - DNA, 19 bp, Homo sapiens
tgcaggaggactgagcaga

SEQ ID NO: 7720764 - DNA, 19 bp, Homo sapiens
tgcaggaggactgagcaga

SEQ ID NO: 7720765 - DNA, 19 bp, Homo sapiens
tgcaggaggactgagcaga

SEQ ID NO: 7720766 - DNA, 22 bp, Homo sapiens
tgcaggagcttggctctgtccc

SEQ ID NO: 7720767 - DNA, 22 bp, Homo sapiens
tgcaggagcttggctctgtccc

SEQ ID NO: 7720768 - DNA, 22 bp, Homo sapiens
tgcaggagcttggctctgtccc

SEQ ID NO: 7720769 - DNA, 22 bp, Homo sapiens
tgcaggagcttggctctgtccc

SEQ ID NO: 7720770 - DNA, 22 bp, Homo sapiens
tgcaggagcttggctctgtccc

SEQ ID NO: 7720771 - DNA, 22 bp, Homo sapiens
tgcaggagcttggctctgtccc

SEQ ID NO: 7720772 - DNA, 19 bp, Homo sapiens
tgcaggaggactgagcaga

SEQ ID NO: 7720773 - DNA, 22 bp, Homo sapiens
tgcaggagctgtgcggtgaggg

SEQ ID NO: 7720774 - DNA, 22 bp, Homo sapiens
tgcaggagctgtgcggtgaggg

SEQ ID NO: 7720775 - DNA, 22 bp, Homo sapiens
tgcaggagctgtgcggtgaggg

SEQ ID NO: 7720776 - DNA, 22 bp, Homo sapiens
tgcaggagctgtgcggtgaggg

SEQ ID NO: 7720777 - DNA, 22 bp, Homo sapiens
tgcaggagctgtgcggtgaggg

SEQ ID NO: 7720778 - DNA, 22 bp, Homo sapiens
tgcaggagctgtgcggtgaggg

SEQ ID NO: 7720779 - DNA, 22 bp, Homo sapiens
tgcaggagcttggctctgtccc

SEQ ID NO: 7720780 - DNA, 22 bp, Homo sapiens
tgcaggagcttggctctgtccc

SEQ ID NO: 7720781 - DNA, 22 bp, Homo sapiens
tgcaggagctgctgtcctgctc

SEQ ID NO: 7720782 - DNA, 22 bp, Homo sapiens
tgcaggagctgctgtcctgctc

SEQ ID NO: 7720783 - DNA, 22 bp, Homo sapiens
tgcaggagctgctgtcctgctc

SEQ ID NO: 7720784 - DNA, 22 bp, Homo sapiens
tgcaggagctgctgtcctgctc

SEQ ID NO: 7720785 - DNA, 22 bp, Homo sapiens
tgcaggagctgctgtcctgctc

SEQ ID NO: 7720786 - DNA, 22 bp, Homo sapiens
tgcaggagctgctgtcctgctc

SEQ ID NO: 7720787 - DNA, 22 bp, Homo sapiens
tgcaggagctgctgtcctgctc

SEQ ID NO: 7720788 - DNA, 22 bp, Homo sapiens
tgcaggagcccttgggctctgg

SEQ ID NO: 7720789 - DNA, 22 bp, Homo sapiens
tgcaggagccttggacttgaaa

SEQ ID NO: 7720790 - DNA, 22 bp, Homo sapiens
tgcaggagccttggacttgaaa

SEQ ID NO: 7720791 - DNA, 22 bp, Homo sapiens
tgcaggagcccttgggctctgg

SEQ ID NO: 7720792 - DNA, 22 bp, Homo sapiens
tgcaggagcccttgggctctgg

SEQ ID NO: 7720793 - DNA, 22 bp, Homo sapiens
tgcaggagcccttgggctctgg

SEQ ID NO: 7720794 - DNA, 22 bp, Homo sapiens
tgcaggagcccttgggctctgg

SEQ ID NO: 7720795 - DNA, 22 bp, Homo sapiens
tgcaggagcccttgggctctgg

SEQ ID NO: 7720796 - DNA, 22 bp, Homo sapiens
tgcaggagcccttgggctctgg

SEQ ID NO: 7720797 - DNA, 22 bp, Homo sapiens
tgcaggagtccaatcaggagac

SEQ ID NO: 7720798 - DNA, 22 bp, Homo sapiens
tgcaggagtccaatcaggagac

SEQ ID NO: 7720799 - DNA, 22 bp, Homo sapiens
tgcaggagtccaatcaggagac

SEQ ID NO: 7720800 - DNA, 22 bp, Homo sapiens
tgcaggagtccaatcaggagac

SEQ ID NO: 7720801 - DNA, 22 bp, Homo sapiens
tgcaggagtccaatcaggagac

SEQ ID NO: 7720802 - DNA, 22 bp, Homo sapiens
tgcaggagtccaatcaggagac

SEQ ID NO: 7720803 - DNA, 22 bp, Homo sapiens
tgcaggagtccaatcaggagac

SEQ ID NO: 7720804 - DNA, 22 bp, Homo sapiens
tgcaggagtccaatcaggagac

SEQ ID NO: 7720805 - DNA, 22 bp, Homo sapiens
tgcaggagggagggttacagtt

SEQ ID NO: 7720806 - DNA, 22 bp, Homo sapiens
tgcaggagggagggttacagtt

SEQ ID NO: 7720807 - DNA, 22 bp, Homo sapiens
tgcaggagggagggttacagtt

SEQ ID NO: 7720808 - DNA, 22 bp, Homo sapiens
tgcaggagggagggttacagtt

SEQ ID NO: 7720809 - DNA, 22 bp, Homo sapiens
tgcaggagggagggttacagtt

SEQ ID NO: 7720810 - DNA, 22 bp, Homo sapiens
tgcaggagtccaatcaggagac

SEQ ID NO: 7720811 - DNA, 22 bp, Homo sapiens
tgcaggagtccaatcaggagac

SEQ ID NO: 7720812 - DNA, 21 bp, Homo sapiens
tgcaggagtctgtgagtcagg

SEQ ID NO: 7720813 - DNA, 21 bp, Homo sapiens
tgcaggagtctgtgagtcagg

SEQ ID NO: 7720814 - DNA, 22 bp, Homo sapiens
tgcaggagtccaatcaggagac

SEQ ID NO: 7720815 - DNA, 22 bp, Homo sapiens
tgcaggaggattttgtggagct

SEQ ID NO: 7720816 - DNA, 19 bp, Homo sapiens
tgcaggaggactgagcaga

SEQ ID NO: 7720817 - DNA, 22 bp, Homo sapiens
tgcaggaggattttgtggagct

SEQ ID NO: 7720818 - DNA, 22 bp, Homo sapiens
tgcaggaggattttgtggagct

SEQ ID NO: 7720819 - DNA, 22 bp, Homo sapiens
tgcaggaggattttgtggagct

SEQ ID NO: 7720820 - DNA, 22 bp, Homo sapiens
tgcaggaggattttgtggagct

SEQ ID NO: 7720821 - DNA, 22 bp, Homo sapiens
tgcaggaggattttgtggagct

SEQ ID NO: 7720822 - DNA, 22 bp, Homo sapiens
tgcaggagggagggttacagtt

SEQ ID NO: 7720823 - DNA, 22 bp, Homo sapiens
tgcaggaggctttattcaggat

SEQ ID NO: 7720824 - DNA, 22 bp, Homo sapiens
tgcaggaggccccatggaaccg

SEQ ID NO: 7720825 - DNA, 22 bp, Homo sapiens
tgcaggaggctttattcaggat

SEQ ID NO: 7720826 - DNA, 22 bp, Homo sapiens
tgcaggaggccccatggaaccg

SEQ ID NO: 7720827 - DNA, 22 bp, Homo sapiens
tgcaggaggccccatggaaccg

SEQ ID NO: 7720828 - DNA, 22 bp, Homo sapiens
tgcaggaggccccatggaaccg

SEQ ID NO: 7720829 - DNA, 22 bp, Homo sapiens
tgcaggcagctgaaaggtgcct

SEQ ID NO: 7720830 - DNA, 22 bp, Homo sapiens
tgcaggcctcagacttagccat

SEQ ID NO: 7720831 - DNA, 22 bp, Homo sapiens
tgcaggcctcagacttagccat

SEQ ID NO: 7720832 - DNA, 21 bp, Homo sapiens
tgcaggctacttctgactcta

SEQ ID NO: 7720833 - DNA, 21 bp, Homo sapiens
tgcaggctacttctgactcta

SEQ ID NO: 7720834 - DNA, 21 bp, Homo sapiens
tgcaggctacttctgactcta

SEQ ID NO: 7720835 - DNA, 22 bp, Homo sapiens
tgcaggcctggactgatgtggt

SEQ ID NO: 7720836 - DNA, 21 bp, Homo sapiens
tgcaggctacttctgactcta

SEQ ID NO: 7720837 - DNA, 23 bp, Homo sapiens
tgcaggctaggaagagagccttc

SEQ ID NO: 7720838 - DNA, 23 bp, Homo sapiens
tgcaggctaggaagagagccttc

SEQ ID NO: 7720839 - DNA, 23 bp, Homo sapiens
tgcaggctaggaagagagccttc

SEQ ID NO: 7720840 - DNA, 23 bp, Homo sapiens
tgcaggctaggaagagagccttc

SEQ ID NO: 7720841 - DNA, 21 bp, Homo sapiens
tgcaggctacttctgactcta

SEQ ID NO: 7720842 - DNA, 22 bp, Homo sapiens
tgcaggctatcctttgctgcaa

SEQ ID NO: 7720843 - DNA, 22 bp, Homo sapiens
tgcaggctatcctttgctgcaa

SEQ ID NO: 7720844 - DNA, 22 bp, Homo sapiens
tgcaggctatcctttgctgcaa

SEQ ID NO: 7720845 - DNA, 22 bp, Homo sapiens
tgcaggctatcctttgctgcaa

SEQ ID NO: 7720846 - DNA, 23 bp, Homo sapiens
tgcaggctaggaagagagccttc

SEQ ID NO: 7720847 - DNA, 22 bp, Homo sapiens
tgcaggctatatcttatttgac

SEQ ID NO: 7720848 - DNA, 22 bp, Homo sapiens
tgcaggctccaggtgcacatat

SEQ ID NO: 7720849 - DNA, 22 bp, Homo sapiens
tgcaggctccaggtgcacatat

SEQ ID NO: 7720850 - DNA, 22 bp, Homo sapiens
tgcaggctccaggtgcacatat

SEQ ID NO: 7720851 - DNA, 22 bp, Homo sapiens
tgcaggctccacgttgttgtcc

SEQ ID NO: 7720852 - DNA, 22 bp, Homo sapiens
tgcaggctccacgttgttgtcc

SEQ ID NO: 7720853 - DNA, 22 bp, Homo sapiens
tgcaggctccaggtgcacatat

SEQ ID NO: 7720854 - DNA, 22 bp, Homo sapiens
tgcaggctccaggtgcacatat

SEQ ID NO: 7720855 - DNA, 22 bp, Homo sapiens
tgcaggctcatctcaagagtag

SEQ ID NO: 7720856 - DNA, 22 bp, Homo sapiens
tgcaggctcatctcaagagtag

SEQ ID NO: 7720857 - DNA, 22 bp, Homo sapiens
tgcaggctcatctcaagagtag

SEQ ID NO: 7720858 - DNA, 22 bp, Homo sapiens
tgcaggctcatctcaagagtag

SEQ ID NO: 7720859 - DNA, 22 bp, Homo sapiens
tgcaggctcaccctggagctga

SEQ ID NO: 7720860 - DNA, 22 bp, Homo sapiens
tgcaggctcaccctggagctga

SEQ ID NO: 7720861 - DNA, 22 bp, Homo sapiens
tgcaggctcaccctggagctga

SEQ ID NO: 7720862 - DNA, 22 bp, Homo sapiens
tgcaggctcaccctggagctga

SEQ ID NO: 7720863 - DNA, 22 bp, Homo sapiens
tgcaggctcacctgccagggcc

SEQ ID NO: 7720864 - DNA, 22 bp, Homo sapiens
tgcaggctcacctgccagggcc

SEQ ID NO: 7720865 - DNA, 22 bp, Homo sapiens
tgcaggctcacctgccagggcc

SEQ ID NO: 7720866 - DNA, 22 bp, Homo sapiens
tgcaggctcaccctggagctga

SEQ ID NO: 7720867 - DNA, 22 bp, Homo sapiens
tgcaggctcaccctggagctga

SEQ ID NO: 7720868 - DNA, 22 bp, Homo sapiens
tgcaggcaccattctgcctctc

SEQ ID NO: 7720869 - DNA, 22 bp, Homo sapiens
tgcaggcaccattctgcctctc

SEQ ID NO: 7720870 - DNA, 22 bp, Homo sapiens
tgcaggcagctaaaccatgtaa

SEQ ID NO: 7720871 - DNA, 22 bp, Homo sapiens
tgcaggcagctaaaccatgtaa

SEQ ID NO: 7720872 - DNA, 22 bp, Homo sapiens
tgcaggcagctgaaaggtgcct

SEQ ID NO: 7720873 - DNA, 22 bp, Homo sapiens
tgcaggcagctgaaaggtgcct

SEQ ID NO: 7720874 - DNA, 21 bp, Homo sapiens
tgcaggattccaggtcagtat

SEQ ID NO: 7720875 - DNA, 22 bp, Homo sapiens
tgcaggagttcccctctgcctg

SEQ ID NO: 7720876 - DNA, 22 bp, Homo sapiens
tgcaggagttcccctctgcctg

SEQ ID NO: 7720877 - DNA, 22 bp, Homo sapiens
tgcaggagttcccctctgcctg

SEQ ID NO: 7720878 - DNA, 22 bp, Homo sapiens
tgcaggagttcccctctgcctg

SEQ ID NO: 7720879 - DNA, 22 bp, Homo sapiens
tgcaggagttcccctctgcctg

SEQ ID NO: 7720880 - DNA, 22 bp, Homo sapiens
tgcaggagttaagtgctctcct

SEQ ID NO: 7720881 - DNA, 22 bp, Homo sapiens
tgcaggagttaagtgctctcct

SEQ ID NO: 7720882 - DNA, 22 bp, Homo sapiens
tgcaggagttaagtgctctcct

SEQ ID NO: 7720883 - DNA, 22 bp, Homo sapiens
tgcaggagttcccctctgcctg

SEQ ID NO: 7720884 - DNA, 21 bp, Homo sapiens
tgcaggagtctgtgagtcagg

SEQ ID NO: 7720885 - DNA, 18 bp, Homo sapiens
tgcaggagtgaccccggc

SEQ ID NO: 7720886 - DNA, 18 bp, Homo sapiens
tgcaggagtgaccccggc

SEQ ID NO: 7720887 - DNA, 18 bp, Homo sapiens
tgcaggagtgaccccggc

SEQ ID NO: 7720888 - DNA, 21 bp, Homo sapiens
tgcaggagtgtaatgtgaccc

SEQ ID NO: 7720889 - DNA, 21 bp, Homo sapiens
tgcaggagtgtaatgtgaccc

SEQ ID NO: 7720890 - DNA, 21 bp, Homo sapiens
tgcaggagtgtaatgtgaccc

SEQ ID NO: 7720891 - DNA, 21 bp, Homo sapiens
tgcaggagtgtaatgtgaccc

SEQ ID NO: 7720892 - DNA, 21 bp, Homo sapiens
tgcaggagtgtaatgtgaccc

SEQ ID NO: 7720893 - DNA, 22 bp, Homo sapiens
tgcaggagttaagtgctctcct

SEQ ID NO: 7720894 - DNA, 22 bp, Homo sapiens
tgcaggagttaagtgctctcct

SEQ ID NO: 7720895 - DNA, 21 bp, Homo sapiens
tgcaggagtgtaatgtgaccc

SEQ ID NO: 7720896 - DNA, 21 bp, Homo sapiens
tgcaggagtgtaatgtgaccc

SEQ ID NO: 7720897 - DNA, 21 bp, Homo sapiens
tgcaggagtgtaatgtgaccc

SEQ ID NO: 7720898 - DNA, 22 bp, Homo sapiens
tgcaggagcaccagctcaccct

SEQ ID NO: 7720899 - DNA, 22 bp, Homo sapiens
tgcaggagcaccagctcaccct

SEQ ID NO: 7720900 - DNA, 22 bp, Homo sapiens
tgcaggagcaccagctcaccct

SEQ ID NO: 7720901 - DNA, 22 bp, Homo sapiens
tgcaggagcaccagctcaccct

SEQ ID NO: 7720902 - DNA, 22 bp, Homo sapiens
tgcaggagcagagatggctgga

SEQ ID NO: 7720903 - DNA, 22 bp, Homo sapiens
tgcaggagcagagatggctgga

SEQ ID NO: 7720904 - DNA, 22 bp, Homo sapiens
tgcaggagcagagatggctgga

SEQ ID NO: 7720905 - DNA, 22 bp, Homo sapiens
tgcaggagcagagatggctgga

SEQ ID NO: 7720906 - DNA, 22 bp, Homo sapiens
tgcaggagcagagatggctgga

SEQ ID NO: 7720907 - DNA, 22 bp, Homo sapiens
tgcaggagcagagatggctgga

SEQ ID NO: 7720908 - DNA, 22 bp, Homo sapiens
tgcaggagcagagatggctgga

SEQ ID NO: 7720909 - DNA, 22 bp, Homo sapiens
tgcaggagcagagatggctgga

SEQ ID NO: 7720910 - DNA, 22 bp, Homo sapiens
tgcaggagcccaggaatactat

SEQ ID NO: 7720911 - DNA, 22 bp, Homo sapiens
tgcaggagcccaggaatactat

SEQ ID NO: 7720912 - DNA, 22 bp, Homo sapiens
tgcaggagcccttgggctctgg

SEQ ID NO: 7720913 - DNA, 22 bp, Homo sapiens
tgcaggagagctggtctggccc

SEQ ID NO: 7720914 - DNA, 22 bp, Homo sapiens
tgcaggagagctggtctggccc

SEQ ID NO: 7720915 - DNA, 22 bp, Homo sapiens
tgcaggagagctggtctggccc

SEQ ID NO: 7720916 - DNA, 22 bp, Homo sapiens
tgcaggagagctggtctggccc

SEQ ID NO: 7720917 - DNA, 22 bp, Homo sapiens
tgcaggagagctggtctggccc

SEQ ID NO: 7720918 - DNA, 22 bp, Homo sapiens
tgcaggagagctggtctggccc

SEQ ID NO: 7720919 - DNA, 22 bp, Homo sapiens
tgcaggagagctggtctggccc

SEQ ID NO: 7720920 - DNA, 22 bp, Homo sapiens
tgcaggagagctggtctggccc

SEQ ID NO: 7720921 - DNA, 22 bp, Homo sapiens
tgcaggagagctggtctggccc

SEQ ID NO: 7720922 - DNA, 22 bp, Homo sapiens
tgcaggagagtgagtcagtagg

SEQ ID NO: 7720923 - DNA, 22 bp, Homo sapiens
tgcaggagagtgagtcagtagg

SEQ ID NO: 7720924 - DNA, 22 bp, Homo sapiens
tgcaggagagtgagtcagtagg

SEQ ID NO: 7720925 - DNA, 22 bp, Homo sapiens
tgcaggagagtgagtcagtagg

SEQ ID NO: 7720926 - DNA, 22 bp, Homo sapiens
tgcaggagagtgagtcagtagg

SEQ ID NO: 7720927 - DNA, 22 bp, Homo sapiens
tgcaggagataatggtgcttag

SEQ ID NO: 7720928 - DNA, 22 bp, Homo sapiens
tgcaggagataatggtgcttag

SEQ ID NO: 7720929 - DNA, 22 bp, Homo sapiens
tgcaggagataatggtgcttag

SEQ ID NO: 7720930 - DNA, 22 bp, Homo sapiens
tgcaggagacataatagggact

SEQ ID NO: 7720931 - DNA, 22 bp, Homo sapiens
tgcaggagacataatagggact

SEQ ID NO: 7720932 - DNA, 22 bp, Homo sapiens
tgcaggagacataatagggact

SEQ ID NO: 7720933 - DNA, 22 bp, Homo sapiens
tgcaggagaaagtacggagcgt

SEQ ID NO: 7720934 - DNA, 22 bp, Homo sapiens
tgcaggagacataatagggact

SEQ ID NO: 7720935 - DNA, 22 bp, Homo sapiens
tgcaggagacataatagggact

SEQ ID NO: 7720936 - DNA, 21 bp, Homo sapiens
tgcaggaagtatggtgcctat

SEQ ID NO: 7720937 - DNA, 21 bp, Homo sapiens
tgcaggaagtatggtgcctat

SEQ ID NO: 7720938 - DNA, 22 bp, Homo sapiens
tgcaggagaaagtacggagcgt

SEQ ID NO: 7720939 - DNA, 22 bp, Homo sapiens
tgcaggaagacttcccaagcca

SEQ ID NO: 7720940 - DNA, 22 bp, Homo sapiens
tgcaggaagacttcccaagcca

SEQ ID NO: 7720941 - DNA, 22 bp, Homo sapiens
tgcaggaagcaaccaggtccaa

SEQ ID NO: 7720942 - DNA, 22 bp, Homo sapiens
tgcaggaagcaaccaggtccaa

SEQ ID NO: 7720943 - DNA, 21 bp, Homo sapiens
tgcaggaagtatggtgcctat

SEQ ID NO: 7720944 - DNA, 22 bp, Homo sapiens
tgcaggaaattccagggtggcc

SEQ ID NO: 7720945 - DNA, 22 bp, Homo sapiens
tgcaggaaattccagggtggcc

SEQ ID NO: 7720946 - DNA, 22 bp, Homo sapiens
tgcaggaacagaactcactccc

SEQ ID NO: 7720947 - DNA, 22 bp, Homo sapiens
tgcaggaacagaactcactccc

SEQ ID NO: 7720948 - DNA, 22 bp, Homo sapiens
tgcaggaacagaactcactccc

SEQ ID NO: 7720949 - DNA, 22 bp, Homo sapiens
tgcaggaaattccagggtggcc

SEQ ID NO: 7720950 - DNA, 22 bp, Homo sapiens
tgcaggaacagaactcactccc

SEQ ID NO: 7720951 - DNA, 22 bp, Homo sapiens
tgcaggaaattccagggtggcc

SEQ ID NO: 7720952 - DNA, 22 bp, Homo sapiens
tgcaggaaattccagggtggcc

SEQ ID NO: 7720953 - DNA, 21 bp, Homo sapiens
tgcaggaaagtgctgcgaccc

SEQ ID NO: 7720954 - DNA, 21 bp, Homo sapiens
tgcaggaaagtgctgcgaccc

SEQ ID NO: 7720955 - DNA, 21 bp, Homo sapiens
tgcaggaaagtgctgcgaccc

SEQ ID NO: 7720956 - DNA, 21 bp, Homo sapiens
tgcaggaaagtgctgcgaccc

SEQ ID NO: 7720957 - DNA, 22 bp, Homo sapiens
tgcaggaactgggagggatagt

SEQ ID NO: 7720958 - DNA, 22 bp, Homo sapiens
tgcaggaactgggagggatagt

SEQ ID NO: 7720959 - DNA, 22 bp, Homo sapiens
tgcaggaactcgaaaactatag

SEQ ID NO: 7720960 - DNA, 22 bp, Homo sapiens
tgcaggaactgggagggatagt

SEQ ID NO: 7720961 - DNA, 22 bp, Homo sapiens
tgcaggaacttggttttactca

SEQ ID NO: 7720962 - DNA, 22 bp, Homo sapiens
tgcaggaacttggttttactca

SEQ ID NO: 7720963 - DNA, 22 bp, Homo sapiens
tgcaggaacataggttccttgg

SEQ ID NO: 7720964 - DNA, 22 bp, Homo sapiens
tgcaggaacagaactcactccc

SEQ ID NO: 7720965 - DNA, 22 bp, Homo sapiens
tgcaggaacataggttccttgg

SEQ ID NO: 7720966 - DNA, 22 bp, Homo sapiens
tgcaggaactcgaaaactatag

SEQ ID NO: 7720967 - DNA, 22 bp, Homo sapiens
tgcaggaactcgaaaactatag

SEQ ID NO: 7720968 - DNA, 22 bp, Homo sapiens
tgcaggaactcgaaaactatag

SEQ ID NO: 7720969 - DNA, 22 bp, Homo sapiens
tgcagctgttacggaccctgtc

SEQ ID NO: 7720970 - DNA, 22 bp, Homo sapiens
tgcagctgttacggaccctgtc

SEQ ID NO: 7720971 - DNA, 22 bp, Homo sapiens
tgcagctgtgggagaatctctg

SEQ ID NO: 7720972 - DNA, 22 bp, Homo sapiens
tgcagctgtgggagaatctctg

SEQ ID NO: 7720973 - DNA, 22 bp, Homo sapiens
tgcagctgtgggagaatctctg

SEQ ID NO: 7720974 - DNA, 22 bp, Homo sapiens
tgcagctgtgcctgaaaagtac

SEQ ID NO: 7720975 - DNA, 22 bp, Homo sapiens
tgcagctgtgcctgaaaagtac

SEQ ID NO: 7720976 - DNA, 22 bp, Homo sapiens
tgcagctgtgggagaatctctg

SEQ ID NO: 7720977 - DNA, 22 bp, Homo sapiens
tgcagctgtgaaagggaaccaa

SEQ ID NO: 7720978 - DNA, 22 bp, Homo sapiens
tgcagctgtgaaagggaaccaa

SEQ ID NO: 7720979 - DNA, 22 bp, Homo sapiens
tgcagctgtgaaagggaaccaa

SEQ ID NO: 7720980 - DNA, 19 bp, Homo sapiens
tgcagctgtctctatatta

SEQ ID NO: 7720981 - DNA, 22 bp, Homo sapiens
tgcagctgtgcctgaaaagtac

SEQ ID NO: 7720982 - DNA, 22 bp, Homo sapiens
tgcagctgtgcctgaaaagtac

SEQ ID NO: 7720983 - DNA, 22 bp, Homo sapiens
tgcagctgtgcctgaaaagtac

SEQ ID NO: 7720984 - DNA, 22 bp, Homo sapiens
tgcagctgtgcctgaaaagtac

SEQ ID NO: 7720985 - DNA, 22 bp, Homo sapiens
tgcagctgtgaaagggaaccaa

SEQ ID NO: 7720986 - DNA, 22 bp, Homo sapiens
tgcagctgtaacagaggcctca

SEQ ID NO: 7720987 - DNA, 22 bp, Homo sapiens
tgcagctgtaacagaggcctca

SEQ ID NO: 7720988 - DNA, 22 bp, Homo sapiens
tgcagctgtaacagaggcctca

SEQ ID NO: 7720989 - DNA, 19 bp, Homo sapiens
tgcagctgtctctatatta

SEQ ID NO: 7720990 - DNA, 19 bp, Homo sapiens
tgcagctgtatgagcttaa

SEQ ID NO: 7720991 - DNA, 19 bp, Homo sapiens
tgcagctgtatgagcttaa

SEQ ID NO: 7720992 - DNA, 19 bp, Homo sapiens
tgcagctgtatgagcttaa

SEQ ID NO: 7720993 - DNA, 19 bp, Homo sapiens
tgcagctgtatgagcttaa

SEQ ID NO: 7720994 - DNA, 19 bp, Homo sapiens
tgcagctgtatgagcttaa

SEQ ID NO: 7720995 - DNA, 22 bp, Homo sapiens
tgcagctgtaacagaggcctca

SEQ ID NO: 7720996 - DNA, 20 bp, Homo sapiens
tgcagctggtttcacaggga

SEQ ID NO: 7720997 - DNA, 20 bp, Homo sapiens
tgcagctggtttcacaggga

SEQ ID NO: 7720998 - DNA, 20 bp, Homo sapiens
tgcagctggtttcacaggga

SEQ ID NO: 7720999 - DNA, 20 bp, Homo sapiens
tgcagctggtttcacaggga

SEQ ID NO: 7721000 - DNA, 22 bp, Homo sapiens
tgcagctgtaacagaggcctca

SEQ ID NO: 7721001 - DNA, 22 bp, Homo sapiens
tgcagctgtaacagaggcctca

SEQ ID NO: 7721002 - DNA, 20 bp, Homo sapiens
tgcagctggtttcacaggga

SEQ ID NO: 7721003 - DNA, 22 bp, Homo sapiens
tgcagctgtaacagaggcctca

SEQ ID NO: 7721004 - DNA, 22 bp, Homo sapiens
tgcagctgtaacagaggcctca

SEQ ID NO: 7721005 - DNA, 22 bp, Homo sapiens
tgcagctgtaacagaggcctca

SEQ ID NO: 7721006 - DNA, 22 bp, Homo sapiens
tgcagctgtaacagaggcctca

SEQ ID NO: 7721007 - DNA, 20 bp, Homo sapiens
tgcagcttctcatcttcaaa

SEQ ID NO: 7721008 - DNA, 22 bp, Homo sapiens
tgcagcttcactcctgaagcca

SEQ ID NO: 7721009 - DNA, 22 bp, Homo sapiens
tgcagcttctccaaatattaca

SEQ ID NO: 7721010 - DNA, 20 bp, Homo sapiens
tgcagcttctcatcttcaaa

SEQ ID NO: 7721011 - DNA, 22 bp, Homo sapiens
tgcagcttctccaaatattaca

SEQ ID NO: 7721012 - DNA, 22 bp, Homo sapiens
tgcagcttctccaaatattaca

SEQ ID NO: 7721013 - DNA, 22 bp, Homo sapiens
tgcagcttctccatctccttgt

SEQ ID NO: 7721014 - DNA, 22 bp, Homo sapiens
tgcagcttccacatccacactc

SEQ ID NO: 7721015 - DNA, 22 bp, Homo sapiens
tgcagcttcactcctgaagcca

SEQ ID NO: 7721016 - DNA, 22 bp, Homo sapiens
tgcagcttcactcctgaagcca

SEQ ID NO: 7721017 - DNA, 22 bp, Homo sapiens
tgcagcttccacatccacactc

SEQ ID NO: 7721018 - DNA, 22 bp, Homo sapiens
tgcagcttcaaagaacctttcc

SEQ ID NO: 7721019 - DNA, 22 bp, Homo sapiens
tgcagcttcaaagaacctttcc

SEQ ID NO: 7721020 - DNA, 20 bp, Homo sapiens
tgcagcttcacctgtgtcat

SEQ ID NO: 7721021 - DNA, 22 bp, Homo sapiens
tgcagcttcactcaggaagcca

SEQ ID NO: 7721022 - DNA, 22 bp, Homo sapiens
tgcagcttcactcaggaagcca

SEQ ID NO: 7721023 - DNA, 22 bp, Homo sapiens
tgcagcttcactcaggaagcca

SEQ ID NO: 7721024 - DNA, 22 bp, Homo sapiens
tgcagcttaaatcagggtttct

SEQ ID NO: 7721025 - DNA, 22 bp, Homo sapiens
tgcagctgttacggaccctgtc

SEQ ID NO: 7721026 - DNA, 22 bp, Homo sapiens
tgcagcttagtagggtaaagtt

SEQ ID NO: 7721027 - DNA, 22 bp, Homo sapiens
tgcagcttagtagggtaaagtt

SEQ ID NO: 7721028 - DNA, 22 bp, Homo sapiens
tgcagcttaaatcagggtttct

SEQ ID NO: 7721029 - DNA, 22 bp, Homo sapiens
tgcagcttatctctttggcagt

SEQ ID NO: 7721030 - DNA, 22 bp, Homo sapiens
tgcagcttatctctttggcagt

SEQ ID NO: 7721031 - DNA, 22 bp, Homo sapiens
tgcaggaaacagaggctcaaat

SEQ ID NO: 7721032 - DNA, 22 bp, Homo sapiens
tgcaggaaacagaggctcaaat

SEQ ID NO: 7721033 - DNA, 22 bp, Homo sapiens
tgcaggaaacagaggctcaaat

SEQ ID NO: 7721034 - DNA, 22 bp, Homo sapiens
tgcaggaaacagaggctcaaat

SEQ ID NO: 7721035 - DNA, 22 bp, Homo sapiens
tgcaggaaacagaggctcaaat

SEQ ID NO: 7721036 - DNA, 22 bp, Homo sapiens
tgcaggaaaaccaacacgcctt

SEQ ID NO: 7721037 - DNA, 22 bp, Homo sapiens
tgcaggaaaacacctatcaccc

SEQ ID NO: 7721038 - DNA, 22 bp, Homo sapiens
tgcaggaaaacacctatcaccc

SEQ ID NO: 7721039 - DNA, 22 bp, Homo sapiens
tgcaggaaaacacctatcaccc

SEQ ID NO: 7721040 - DNA, 22 bp, Homo sapiens
tgcaggaaaacacctatcaccc

SEQ ID NO: 7721041 - DNA, 22 bp, Homo sapiens
tgcaggaaaacacctatcaccc

SEQ ID NO: 7721042 - DNA, 22 bp, Homo sapiens
tgcaggaaaaccaacacgcctt

SEQ ID NO: 7721043 - DNA, 22 bp, Homo sapiens
tgcagctttgctctggtcccca

SEQ ID NO: 7721044 - DNA, 22 bp, Homo sapiens
tgcaggaaaaataaatagtgtt

SEQ ID NO: 7721045 - DNA, 22 bp, Homo sapiens
tgcagctttgctctggtcccca

SEQ ID NO: 7721046 - DNA, 22 bp, Homo sapiens
tgcagctttaagctttcatcag

SEQ ID NO: 7721047 - DNA, 22 bp, Homo sapiens
tgcagcttcttgtcctgtgatt

SEQ ID NO: 7721048 - DNA, 22 bp, Homo sapiens
tgcagcttcttgtcctgtgatt

SEQ ID NO: 7721049 - DNA, 22 bp, Homo sapiens
tgcagcttgctgtaggctaagt

SEQ ID NO: 7721050 - DNA, 22 bp, Homo sapiens
tgcagcttgctgtaggctaagt

SEQ ID NO: 7721051 - DNA, 22 bp, Homo sapiens
tgcagcttgctgtaggctaagt

SEQ ID NO: 7721052 - DNA, 22 bp, Homo sapiens
tgcagcttctctgcaacaggag

SEQ ID NO: 7721053 - DNA, 22 bp, Homo sapiens
tgcagcttctctgcaacaggag

SEQ ID NO: 7721054 - DNA, 22 bp, Homo sapiens
tgcagcttctctgcaacaggag

SEQ ID NO: 7721055 - DNA, 22 bp, Homo sapiens
tgcagcttcttgtcctgtgatt

SEQ ID NO: 7721056 - DNA, 22 bp, Homo sapiens
tgcagcttcttgtcctgtgatt

SEQ ID NO: 7721057 - DNA, 22 bp, Homo sapiens
tgcagcttcttgtcctgtgatt

SEQ ID NO: 7721058 - DNA, 22 bp, Homo sapiens
tgcagccatctttcttggagga

SEQ ID NO: 7721059 - DNA, 22 bp, Homo sapiens
tgcagccatctttcttggagga

SEQ ID NO: 7721060 - DNA, 22 bp, Homo sapiens
tgcagccatcgcagagtctgta

SEQ ID NO: 7721061 - DNA, 22 bp, Homo sapiens
tgcagccagcaagtgaatacat

SEQ ID NO: 7721062 - DNA, 22 bp, Homo sapiens
tgcagccatctttcttggagga

SEQ ID NO: 7721063 - DNA, 22 bp, Homo sapiens
tgcagccatcgcagagtctgta

SEQ ID NO: 7721064 - DNA, 22 bp, Homo sapiens
tgcagccattttctgccaatgc

SEQ ID NO: 7721065 - DNA, 22 bp, Homo sapiens
tgcagcccagccccagaacctt

SEQ ID NO: 7721066 - DNA, 22 bp, Homo sapiens
tgcagcccagccccagaacctt

SEQ ID NO: 7721067 - DNA, 21 bp, Homo sapiens
tgcagccattcagccctatgc

SEQ ID NO: 7721068 - DNA, 21 bp, Homo sapiens
tgcagccattcagccctatgc

SEQ ID NO: 7721069 - DNA, 22 bp, Homo sapiens
tgcagccatttgaaaagcagtt

SEQ ID NO: 7721070 - DNA, 22 bp, Homo sapiens
tgcagccatttgaaaagcagtt

SEQ ID NO: 7721071 - DNA, 23 bp, Homo sapiens
tgcagcagggtggtctacttctc

SEQ ID NO: 7721072 - DNA, 22 bp, Homo sapiens
tgcagcaggtatggcaagctcc

SEQ ID NO: 7721073 - DNA, 22 bp, Homo sapiens
tgcagcaggtatggcaagctcc

SEQ ID NO: 7721074 - DNA, 23 bp, Homo sapiens
tgcagcagggtggtctacttctc

SEQ ID NO: 7721075 - DNA, 19 bp, Homo sapiens
tgcagccacgtgagagact

SEQ ID NO: 7721076 - DNA, 19 bp, Homo sapiens
tgcagccacgtgagagact

SEQ ID NO: 7721077 - DNA, 22 bp, Homo sapiens
tgcagcaggtatggcaagctcc

SEQ ID NO: 7721078 - DNA, 23 bp, Homo sapiens
tgcagccactcaggagctcagtg

SEQ ID NO: 7721079 - DNA, 23 bp, Homo sapiens
tgcagccactcaggagctcagtg

SEQ ID NO: 7721080 - DNA, 23 bp, Homo sapiens
tgcagccactcaggagctcagtg

SEQ ID NO: 7721081 - DNA, 19 bp, Homo sapiens
tgcagccacgtgagagact

SEQ ID NO: 7721082 - DNA, 23 bp, Homo sapiens
tgcagccactcaggagctcagtg

SEQ ID NO: 7721083 - DNA, 22 bp, Homo sapiens
tgcagccaggaaatatttgctg

SEQ ID NO: 7721084 - DNA, 22 bp, Homo sapiens
tgcagccagcaagtgaatacat

SEQ ID NO: 7721085 - DNA, 22 bp, Homo sapiens
tgcagccagactttgtgcgaaa

SEQ ID NO: 7721086 - DNA, 22 bp, Homo sapiens
tgcagccagactttgtgcgaaa

SEQ ID NO: 7721087 - DNA, 22 bp, Homo sapiens
tgcagcctagacattctggtca

SEQ ID NO: 7721088 - DNA, 22 bp, Homo sapiens
tgcagcccttccttcctctggg

SEQ ID NO: 7721089 - DNA, 22 bp, Homo sapiens
tgcagcccttccttcctctggg

SEQ ID NO: 7721090 - DNA, 22 bp, Homo sapiens
tgcagcccttccttcctctggg

SEQ ID NO: 7721091 - DNA, 22 bp, Homo sapiens
tgcagcccttccttcctctggg

SEQ ID NO: 7721092 - DNA, 22 bp, Homo sapiens
tgcagcctagacattctggtca

SEQ ID NO: 7721093 - DNA, 23 bp, Homo sapiens
tgcagccgattctattgaattca

SEQ ID NO: 7721094 - DNA, 22 bp, Homo sapiens
tgcagcctcacgcatccgcatt

SEQ ID NO: 7721095 - DNA, 22 bp, Homo sapiens
tgcagcctctctgcttcaggaa

SEQ ID NO: 7721096 - DNA, 22 bp, Homo sapiens
tgcagccctgtgcacatcccct

SEQ ID NO: 7721097 - DNA, 22 bp, Homo sapiens
tgcagccctgtgcacatcccct

SEQ ID NO: 7721098 - DNA, 22 bp, Homo sapiens
tgcagccctgtgcacatcccct

SEQ ID NO: 7721099 - DNA, 22 bp, Homo sapiens
tgcagcccctgaaaatggcagc

SEQ ID NO: 7721100 - DNA, 22 bp, Homo sapiens
tgcagcccctgaaaatggcagc

SEQ ID NO: 7721101 - DNA, 22 bp, Homo sapiens
tgcagcccctatcgcggacagg

SEQ ID NO: 7721102 - DNA, 22 bp, Homo sapiens
tgcagcccctatcgcggacagg

SEQ ID NO: 7721103 - DNA, 22 bp, Homo sapiens
tgcagcccctgaaaatggcagc

SEQ ID NO: 7721104 - DNA, 22 bp, Homo sapiens
tgcagcccaggcgtcaggtggt

SEQ ID NO: 7721105 - DNA, 22 bp, Homo sapiens
tgcagcccaggcgtcaggtggt

SEQ ID NO: 7721106 - DNA, 22 bp, Homo sapiens
tgcagcccaggcgtcaggtggt

SEQ ID NO: 7721107 - DNA, 22 bp, Homo sapiens
tgcagccccccagatggccgta

SEQ ID NO: 7721108 - DNA, 22 bp, Homo sapiens
tgcagccccccagatggccgta

SEQ ID NO: 7721109 - DNA, 19 bp, Homo sapiens
tgcagcccctaccacattc

SEQ ID NO: 7721110 - DNA, 19 bp, Homo sapiens
tgcagcccctaccacattc

SEQ ID NO: 7721111 - DNA, 19 bp, Homo sapiens
tgcagcccctaccacattc

SEQ ID NO: 7721112 - DNA, 22 bp, Homo sapiens
tgcagcctctctgcttcaggaa

SEQ ID NO: 7721113 - DNA, 21 bp, Homo sapiens
tgcagcctctgcccagcagtg

SEQ ID NO: 7721114 - DNA, 21 bp, Homo sapiens
tgcagcctctgcccagcagtg

SEQ ID NO: 7721115 - DNA, 21 bp, Homo sapiens
tgcagcctctgcccagcagtg

SEQ ID NO: 7721116 - DNA, 22 bp, Homo sapiens
tgcagcctggtggtcactggag

SEQ ID NO: 7721117 - DNA, 22 bp, Homo sapiens
tgcagcctggtggtcactggag

SEQ ID NO: 7721118 - DNA, 22 bp, Homo sapiens
tgcagcctggtggtcactggag

SEQ ID NO: 7721119 - DNA, 22 bp, Homo sapiens
tgcagcctggcttcgcgcctcc

SEQ ID NO: 7721120 - DNA, 22 bp, Homo sapiens
tgcagcctggtggtcactggag

SEQ ID NO: 7721121 - DNA, 22 bp, Homo sapiens
tgcagcctggtggtcactggag

SEQ ID NO: 7721122 - DNA, 18 bp, Homo sapiens
tgcagcctgtagtcttgt

SEQ ID NO: 7721123 - DNA, 22 bp, Homo sapiens
tgcagcctggtggtcactggag

SEQ ID NO: 7721124 - DNA, 22 bp, Homo sapiens
tgcagcagagtgggcctgggtg

SEQ ID NO: 7721125 - DNA, 21 bp, Homo sapiens
tgcagcagagtaagcagggga

SEQ ID NO: 7721126 - DNA, 22 bp, Homo sapiens
tgcagcagagtgggcctgggtg

SEQ ID NO: 7721127 - DNA, 22 bp, Homo sapiens
tgcagcagagtgggcctgggtg

SEQ ID NO: 7721128 - DNA, 22 bp, Homo sapiens
tgcagcagagtgggcctgggtg

SEQ ID NO: 7721129 - DNA, 22 bp, Homo sapiens
tgcagcagagtgggcctgggtg

SEQ ID NO: 7721130 - DNA, 22 bp, Homo sapiens
tgcagcagagtgggcctgggtg

SEQ ID NO: 7721131 - DNA, 21 bp, Homo sapiens
tgcagcagatttgggggaaga

SEQ ID NO: 7721132 - DNA, 21 bp, Homo sapiens
tgcagcagatttgggggaaga

SEQ ID NO: 7721133 - DNA, 21 bp, Homo sapiens
tgcagcagatttgggggaaga

SEQ ID NO: 7721134 - DNA, 21 bp, Homo sapiens
tgcagcagatttgggggaaga

SEQ ID NO: 7721135 - DNA, 21 bp, Homo sapiens
tgcagcagatttgggggaaga

SEQ ID NO: 7721136 - DNA, 22 bp, Homo sapiens
tgcagcagcagggaggaggctc

SEQ ID NO: 7721137 - DNA, 22 bp, Homo sapiens
tgcagcagcagggaggaggctc

SEQ ID NO: 7721138 - DNA, 22 bp, Homo sapiens
tgcagcagcagggaggaggctc

SEQ ID NO: 7721139 - DNA, 22 bp, Homo sapiens
tgcagcagcagggaggaggctc

SEQ ID NO: 7721140 - DNA, 22 bp, Homo sapiens
tgcagcagactgagtatgagaa

SEQ ID NO: 7721141 - DNA, 22 bp, Homo sapiens
tgcagcagactgagtatgagaa

SEQ ID NO: 7721142 - DNA, 21 bp, Homo sapiens
tgcagcagagtaagcagggga

SEQ ID NO: 7721143 - DNA, 21 bp, Homo sapiens
tgcagcagagtaagcagggga

SEQ ID NO: 7721144 - DNA, 21 bp, Homo sapiens
tgcagcagagtaagcagggga

SEQ ID NO: 7721145 - DNA, 21 bp, Homo sapiens
tgcagcagagtaagcagggga

SEQ ID NO: 7721146 - DNA, 21 bp, Homo sapiens
tgcagcagagtaagcagggga

SEQ ID NO: 7721147 - DNA, 21 bp, Homo sapiens
tgcagcagagtaagcagggga

SEQ ID NO: 7721148 - DNA, 21 bp, Homo sapiens
tgcagcagagtaagcagggga

SEQ ID NO: 7721149 - DNA, 22 bp, Homo sapiens
tgcagcagactgagtatgagaa

SEQ ID NO: 7721150 - DNA, 22 bp, Homo sapiens
tgcagcagactgagtatgagaa

SEQ ID NO: 7721151 - DNA, 22 bp, Homo sapiens
tgcagcagacataatgtggatt

SEQ ID NO: 7721152 - DNA, 22 bp, Homo sapiens
tgcagcagacataatgtggatt

SEQ ID NO: 7721153 - DNA, 22 bp, Homo sapiens
tgcagcagacataatgtggatt

SEQ ID NO: 7721154 - DNA, 22 bp, Homo sapiens
tgcagcagacataatgtggatt

SEQ ID NO: 7721155 - DNA, 22 bp, Homo sapiens
tgcagcagacataatgtggatt

SEQ ID NO: 7721156 - DNA, 22 bp, Homo sapiens
tgcagcagcagggaggaggctc

SEQ ID NO: 7721157 - DNA, 22 bp, Homo sapiens
tgcagcagccaaggttctgtgc

SEQ ID NO: 7721158 - DNA, 22 bp, Homo sapiens
tgcagcagccaaggttctgtgc

SEQ ID NO: 7721159 - DNA, 22 bp, Homo sapiens
tgcagcagcagggaggaggctc

SEQ ID NO: 7721160 - DNA, 22 bp, Homo sapiens
tgcagcagcagggaggaggctc

SEQ ID NO: 7721161 - DNA, 22 bp, Homo sapiens
tgcagcagcagggaggaggctc

SEQ ID NO: 7721162 - DNA, 22 bp, Homo sapiens
tgcagcagcctcatctggtttc

SEQ ID NO: 7721163 - DNA, 22 bp, Homo sapiens
tgcagcagcctcatctggtttc

SEQ ID NO: 7721164 - DNA, 22 bp, Homo sapiens
tgcagcagcctcatctggtttc

SEQ ID NO: 7721165 - DNA, 22 bp, Homo sapiens
tgcagcaggagccaggcctggt

SEQ ID NO: 7721166 - DNA, 22 bp, Homo sapiens
tgcagcagctccaggttaccct

SEQ ID NO: 7721167 - DNA, 22 bp, Homo sapiens
tgcagcagggcccaggcacaga

SEQ ID NO: 7721168 - DNA, 22 bp, Homo sapiens
tgcagcagggcccaggcacaga

SEQ ID NO: 7721169 - DNA, 22 bp, Homo sapiens
tgcagcagggcccaggcacaga

SEQ ID NO: 7721170 - DNA, 22 bp, Homo sapiens
tgcagcagggcccaggcacaga

SEQ ID NO: 7721171 - DNA, 22 bp, Homo sapiens
tgcagcagggcccaggcacaga

SEQ ID NO: 7721172 - DNA, 22 bp, Homo sapiens
tgcagcagggcccaggcacaga

SEQ ID NO: 7721173 - DNA, 22 bp, Homo sapiens
tgcagcaggcacaggacggaag

SEQ ID NO: 7721174 - DNA, 22 bp, Homo sapiens
tgcagcaggcacaggacggaag

SEQ ID NO: 7721175 - DNA, 22 bp, Homo sapiens
tgcagcaggcacaggacggaag

SEQ ID NO: 7721176 - DNA, 22 bp, Homo sapiens
tgcagcagggacctctatgtga

SEQ ID NO: 7721177 - DNA, 22 bp, Homo sapiens
tgcagcagggacctctatgtga

SEQ ID NO: 7721178 - DNA, 22 bp, Homo sapiens
tgcagcaggcacaggacggaag

SEQ ID NO: 7721179 - DNA, 22 bp, Homo sapiens
tgcagcaggagccaggcctggt

SEQ ID NO: 7721180 - DNA, 22 bp, Homo sapiens
tgcagctgctggtggctgaaag

SEQ ID NO: 7721181 - DNA, 22 bp, Homo sapiens
tgcagctgctggtggctgaaag

SEQ ID NO: 7721182 - DNA, 22 bp, Homo sapiens
tgcagctgctggtggctgaaag

SEQ ID NO: 7721183 - DNA, 22 bp, Homo sapiens
tgcagctgctggtggctgaaag

SEQ ID NO: 7721184 - DNA, 22 bp, Homo sapiens
tgcagctgcttgattcatcttg

SEQ ID NO: 7721185 - DNA, 22 bp, Homo sapiens
tgcagctgctggtggctgaaag

SEQ ID NO: 7721186 - DNA, 22 bp, Homo sapiens
tgcagctgcttgattcatcttg

SEQ ID NO: 7721187 - DNA, 22 bp, Homo sapiens
tgcagctgctggcccaggtgct

SEQ ID NO: 7721188 - DNA, 22 bp, Homo sapiens
tgcagctgctggcccaggtgct

SEQ ID NO: 7721189 - DNA, 22 bp, Homo sapiens
tgcagctgctggcccaggtgct

SEQ ID NO: 7721190 - DNA, 22 bp, Homo sapiens
tgcagctgctggtggctgaaag

SEQ ID NO: 7721191 - DNA, 22 bp, Homo sapiens
tgcagctgctcttcatttcccc

SEQ ID NO: 7721192 - DNA, 22 bp, Homo sapiens
tgcagctgctcttcatttcccc

SEQ ID NO: 7721193 - DNA, 22 bp, Homo sapiens
tgcagctgctggcccaggtgct

SEQ ID NO: 7721194 - DNA, 22 bp, Homo sapiens
tgcagctgctggcccaggtgct

SEQ ID NO: 7721195 - DNA, 22 bp, Homo sapiens
tgcagctgctggcccaggtgct

SEQ ID NO: 7721196 - DNA, 22 bp, Homo sapiens
tgcagctgctcttcatttcccc

SEQ ID NO: 7721197 - DNA, 17 bp, Homo sapiens
tgcagctgctcccaggc

SEQ ID NO: 7721198 - DNA, 17 bp, Homo sapiens
tgcagctgatggggaaa

SEQ ID NO: 7721199 - DNA, 17 bp, Homo sapiens
tgcagctgctcccaggc

SEQ ID NO: 7721200 - DNA, 17 bp, Homo sapiens
tgcagctgctcccaggc

SEQ ID NO: 7721201 - DNA, 22 bp, Homo sapiens
tgcagctgctcttcatttcccc

SEQ ID NO: 7721202 - DNA, 17 bp, Homo sapiens
tgcagctgctcccaggc

SEQ ID NO: 7721203 - DNA, 17 bp, Homo sapiens
tgcagctgctcccaggc

SEQ ID NO: 7721204 - DNA, 17 bp, Homo sapiens
tgcagctgatggggaaa

SEQ ID NO: 7721205 - DNA, 17 bp, Homo sapiens
tgcagctgatggggaaa

SEQ ID NO: 7721206 - DNA, 17 bp, Homo sapiens
tgcagctgatggggaaa

SEQ ID NO: 7721207 - DNA, 17 bp, Homo sapiens
tgcagctgatggggaaa

SEQ ID NO: 7721208 - DNA, 17 bp, Homo sapiens
tgcagctgatggggaaa

SEQ ID NO: 7721209 - DNA, 22 bp, Homo sapiens
tgcagctgatgatacccccatg

SEQ ID NO: 7721210 - DNA, 22 bp, Homo sapiens
tgcagctgatgatacccccatg

SEQ ID NO: 7721211 - DNA, 22 bp, Homo sapiens
tgcagctgatgatacccccatg

SEQ ID NO: 7721212 - DNA, 22 bp, Homo sapiens
tgcagctgataattacatgttc

SEQ ID NO: 7721213 - DNA, 22 bp, Homo sapiens
tgcagctgataattacatgttc

SEQ ID NO: 7721214 - DNA, 22 bp, Homo sapiens
tgcagctgagtcacccagccat

SEQ ID NO: 7721215 - DNA, 22 bp, Homo sapiens
tgcagctgagtcacccagccat

SEQ ID NO: 7721216 - DNA, 22 bp, Homo sapiens
tgcagctgagtcacccagccat

SEQ ID NO: 7721217 - DNA, 22 bp, Homo sapiens
tgcagctgataattacatgttc

SEQ ID NO: 7721218 - DNA, 22 bp, Homo sapiens
tgcagctgagtcacccagccat

SEQ ID NO: 7721219 - DNA, 22 bp, Homo sapiens
tgcagctgaggccagctatgcc

SEQ ID NO: 7721220 - DNA, 22 bp, Homo sapiens
tgcagctgaggccagctatgcc

SEQ ID NO: 7721221 - DNA, 22 bp, Homo sapiens
tgcagctgaggccagctatgcc

SEQ ID NO: 7721222 - DNA, 22 bp, Homo sapiens
tgcagctggatttatcttttcc

SEQ ID NO: 7721223 - DNA, 22 bp, Homo sapiens
tgcagctggatttatcttttcc

SEQ ID NO: 7721224 - DNA, 22 bp, Homo sapiens
tgcagctgggacatttttgata

SEQ ID NO: 7721225 - DNA, 22 bp, Homo sapiens
tgcagctgggtctgccctggct

SEQ ID NO: 7721226 - DNA, 22 bp, Homo sapiens
tgcagctgggacatttttgata

SEQ ID NO: 7721227 - DNA, 22 bp, Homo sapiens
tgcagctgggtctgccctggct

SEQ ID NO: 7721228 - DNA, 22 bp, Homo sapiens
tgcagctgggtctgccctggct

SEQ ID NO: 7721229 - DNA, 22 bp, Homo sapiens
tgcagctgggtctgccctggct

SEQ ID NO: 7721230 - DNA, 22 bp, Homo sapiens
tgcagctgggtctgccctggct

SEQ ID NO: 7721231 - DNA, 22 bp, Homo sapiens
tgcagctgggtctgccctggct

SEQ ID NO: 7721232 - DNA, 22 bp, Homo sapiens
tgcagctggaacttagaggaga

SEQ ID NO: 7721233 - DNA, 22 bp, Homo sapiens
tgcagctggaacttagaggaga

SEQ ID NO: 7721234 - DNA, 22 bp, Homo sapiens
tgcagctggaacttagaggaga

SEQ ID NO: 7721235 - DNA, 22 bp, Homo sapiens
tgcagctggaacttagaggaga

SEQ ID NO: 7721236 - DNA, 22 bp, Homo sapiens
tgcagctgcttgattcatcttg

SEQ ID NO: 7721237 - DNA, 22 bp, Homo sapiens
tgcagctgcttgattcatcttg

SEQ ID NO: 7721238 - DNA, 22 bp, Homo sapiens
tgcagctggaacttagaggaga

SEQ ID NO: 7721239 - DNA, 22 bp, Homo sapiens
tgcagctgcttgattcatcttg

SEQ ID NO: 7721240 - DNA, 22 bp, Homo sapiens
tgcagctggtttagaactagat

SEQ ID NO: 7721241 - DNA, 22 bp, Homo sapiens
tgcagctggtatcccatggatt

SEQ ID NO: 7721242 - DNA, 22 bp, Homo sapiens
tgcagctggtttagaactagat

SEQ ID NO: 7721243 - DNA, 20 bp, Homo sapiens
tgcagctggtttcacaggga

SEQ ID NO: 7721244 - DNA, 22 bp, Homo sapiens
tgcagctggtttagaactagat

SEQ ID NO: 7721245 - DNA, 22 bp, Homo sapiens
tgcagctggtttagaactagat

SEQ ID NO: 7721246 - DNA, 22 bp, Homo sapiens
tgcagctggtttagaactagat

SEQ ID NO: 7721247 - DNA, 22 bp, Homo sapiens
tgcagctggtatcccatggatt

SEQ ID NO: 7721248 - DNA, 22 bp, Homo sapiens
tgcagctggtatcccatggatt

SEQ ID NO: 7721249 - DNA, 22 bp, Homo sapiens
tgcagctggtatcccatggatt

SEQ ID NO: 7721250 - DNA, 21 bp, Homo sapiens
tgcagctgggttctggtttgc

SEQ ID NO: 7721251 - DNA, 21 bp, Homo sapiens
tgcagctgggttctggtttgc

SEQ ID NO: 7721252 - DNA, 21 bp, Homo sapiens
tgcagctgggttctggtttgc

SEQ ID NO: 7721253 - DNA, 21 bp, Homo sapiens
tgcagctgggttctggtttgc

SEQ ID NO: 7721254 - DNA, 21 bp, Homo sapiens
tgcagctgggttctggtttgc

SEQ ID NO: 7721255 - DNA, 22 bp, Homo sapiens
tgcagctgggtctgccctggct

SEQ ID NO: 7721256 - DNA, 21 bp, Homo sapiens
tgcagctgacaccctttggga

SEQ ID NO: 7721257 - DNA, 22 bp, Homo sapiens
tgcagctgaacctagagtctgt

SEQ ID NO: 7721258 - DNA, 21 bp, Homo sapiens
tgcagctgacaccctttggga

SEQ ID NO: 7721259 - DNA, 21 bp, Homo sapiens
tgcagctgacaccctttggga

SEQ ID NO: 7721260 - DNA, 21 bp, Homo sapiens
tgcagctgacactggtatgcc

SEQ ID NO: 7721261 - DNA, 22 bp, Homo sapiens
tgcagctgaacctagagtctgt

SEQ ID NO: 7721262 - DNA, 22 bp, Homo sapiens
tgcagctgaacctagagtctgt

SEQ ID NO: 7721263 - DNA, 22 bp, Homo sapiens
tgcagctgaacctagagtctgt

SEQ ID NO: 7721264 - DNA, 22 bp, Homo sapiens
tgcagctgaaaggactgaatga

SEQ ID NO: 7721265 - DNA, 22 bp, Homo sapiens
tgcagctgaaaggactgaatga

SEQ ID NO: 7721266 - DNA, 22 bp, Homo sapiens
tgcagctcttacggagggcggg

SEQ ID NO: 7721267 - DNA, 22 bp, Homo sapiens
tgcagctcttacggagggcggg

SEQ ID NO: 7721268 - DNA, 22 bp, Homo sapiens
tgcagctctgtatgctgattat

SEQ ID NO: 7721269 - DNA, 22 bp, Homo sapiens
tgcagctctgtatgctgattat

SEQ ID NO: 7721270 - DNA, 22 bp, Homo sapiens
tgcagctctgggcaagtgcctt

SEQ ID NO: 7721271 - DNA, 22 bp, Homo sapiens
tgcagctctgggtgtagaggct

SEQ ID NO: 7721272 - DNA, 22 bp, Homo sapiens
tgcagctctgggtgtagaggct

SEQ ID NO: 7721273 - DNA, 22 bp, Homo sapiens
tgcagctctgggtgtagaggct

SEQ ID NO: 7721274 - DNA, 22 bp, Homo sapiens
tgcagctctggggtaaggggtg

SEQ ID NO: 7721275 - DNA, 22 bp, Homo sapiens
tgcagctctgggcaagtgcctt

SEQ ID NO: 7721276 - DNA, 22 bp, Homo sapiens
tgcagctctgggcaagtgcctt

SEQ ID NO: 7721277 - DNA, 22 bp, Homo sapiens
tgcagctctgaacagtcatgaa

SEQ ID NO: 7721278 - DNA, 21 bp, Homo sapiens
tgcagctgacactggtatgcc

SEQ ID NO: 7721279 - DNA, 21 bp, Homo sapiens
tgcagctgacactggtatgcc

SEQ ID NO: 7721280 - DNA, 21 bp, Homo sapiens
tgcagctgacactggtatgcc

SEQ ID NO: 7721281 - DNA, 21 bp, Homo sapiens
tgcagctgacactggtatgcc

SEQ ID NO: 7721282 - DNA, 21 bp, Homo sapiens
tgcagctgacactggtatgcc

SEQ ID NO: 7721283 - DNA, 21 bp, Homo sapiens
tgcagctgacactggtatgcc

SEQ ID NO: 7721284 - DNA, 21 bp, Homo sapiens
tgcagctgacactggtatgcc

SEQ ID NO: 7721285 - DNA, 22 bp, Homo sapiens
tgcagctgaccagcaagtcctg

SEQ ID NO: 7721286 - DNA, 22 bp, Homo sapiens
tgcagctgaccagcaagtcctg

SEQ ID NO: 7721287 - DNA, 22 bp, Homo sapiens
tgcagctgaccagcaagtcctg

SEQ ID NO: 7721288 - DNA, 22 bp, Homo sapiens
tgcagctgaccagcaagtcctg

SEQ ID NO: 7721289 - DNA, 22 bp, Homo sapiens
tgcagctgacccactccagtcc

SEQ ID NO: 7721290 - DNA, 22 bp, Homo sapiens
tgcagctgacccactccagtcc

SEQ ID NO: 7721291 - DNA, 22 bp, Homo sapiens
tgcagctgacccactccagtcc

SEQ ID NO: 7721292 - DNA, 22 bp, Homo sapiens
tgcagctgaccagcaagtcctg

SEQ ID NO: 7721293 - DNA, 22 bp, Homo sapiens
tgcagctgacccactccagtcc

SEQ ID NO: 7721294 - DNA, 22 bp, Homo sapiens
tgcagctgacccactccagtcc

SEQ ID NO: 7721295 - DNA, 22 bp, Homo sapiens
tgcagctgaggccagctatgcc

SEQ ID NO: 7721296 - DNA, 22 bp, Homo sapiens
tgcagctgacccactccagtcc

SEQ ID NO: 7721297 - DNA, 22 bp, Homo sapiens
tgcagctgacccactccagtcc

SEQ ID NO: 7721298 - DNA, 22 bp, Homo sapiens
tgcagctgacccactccagtcc

SEQ ID NO: 7721299 - DNA, 22 bp, Homo sapiens
tgcagcctttagaagttcagat

SEQ ID NO: 7721300 - DNA, 22 bp, Homo sapiens
tgcagcctttagaagttcagat

SEQ ID NO: 7721301 - DNA, 22 bp, Homo sapiens
tgcagccttggcaaccagggac

SEQ ID NO: 7721302 - DNA, 22 bp, Homo sapiens
tgcagcctttagaagttcagat

SEQ ID NO: 7721303 - DNA, 22 bp, Homo sapiens
tgcagctcaagctggtgaggtg

SEQ ID NO: 7721304 - DNA, 22 bp, Homo sapiens
tgcagctcaagctggtgaggtg

SEQ ID NO: 7721305 - DNA, 23 bp, Homo sapiens
tgcagctcaaagatgggtaaatg

SEQ ID NO: 7721306 - DNA, 23 bp, Homo sapiens
tgcagctcaaagatgggtaaatg

SEQ ID NO: 7721307 - DNA, 22 bp, Homo sapiens
tgcagccttggcaaccagggac

SEQ ID NO: 7721308 - DNA, 22 bp, Homo sapiens
tgcagccttgcctcctcccagc

SEQ ID NO: 7721309 - DNA, 22 bp, Homo sapiens
tgcagccttggcaaccagggac

SEQ ID NO: 7721310 - DNA, 22 bp, Homo sapiens
tgcagccttggcaaccagggac

SEQ ID NO: 7721311 - DNA, 18 bp, Homo sapiens
tgcagcctgtagtcttgt

SEQ ID NO: 7721312 - DNA, 22 bp, Homo sapiens
tgcagcctggtggtcactggag

SEQ ID NO: 7721313 - DNA, 22 bp, Homo sapiens
tgcagccttgcctcctcccagc

SEQ ID NO: 7721314 - DNA, 22 bp, Homo sapiens
tgcagccttgcctcctcccagc

SEQ ID NO: 7721315 - DNA, 22 bp, Homo sapiens
tgcagccttgcctcctcccagc

SEQ ID NO: 7721316 - DNA, 22 bp, Homo sapiens
tgcagctcctctggctgcctga

SEQ ID NO: 7721317 - DNA, 22 bp, Homo sapiens
tgcagctcctgtgctgagtgtg

SEQ ID NO: 7721318 - DNA, 22 bp, Homo sapiens
tgcagctcctgtgctgagtgtg

SEQ ID NO: 7721319 - DNA, 22 bp, Homo sapiens
tgcagctcgggcttagggtggg

SEQ ID NO: 7721320 - DNA, 22 bp, Homo sapiens
tgcagctcgggcttagggtggg

SEQ ID NO: 7721321 - DNA, 22 bp, Homo sapiens
tgcagctcctgtgctgagtgtg

SEQ ID NO: 7721322 - DNA, 22 bp, Homo sapiens
tgcagctctgaacagtcatgaa

SEQ ID NO: 7721323 - DNA, 22 bp, Homo sapiens
tgcagctctgaacagtcatgaa

SEQ ID NO: 7721324 - DNA, 22 bp, Homo sapiens
tgcagctctgcatggctggttc

SEQ ID NO: 7721325 - DNA, 22 bp, Homo sapiens
tgcagctctgcatggctggttc

SEQ ID NO: 7721326 - DNA, 22 bp, Homo sapiens
tgcagctcatattagagagaag

SEQ ID NO: 7721327 - DNA, 22 bp, Homo sapiens
tgcagctcaggattctcagggc

SEQ ID NO: 7721328 - DNA, 19 bp, Homo sapiens
tgcagctcagggcaggggc

SEQ ID NO: 7721329 - DNA, 19 bp, Homo sapiens
tgcagctcagggcaggggc

SEQ ID NO: 7721330 - DNA, 22 bp, Homo sapiens
tgcagctcaagctggtgaggtg

SEQ ID NO: 7721331 - DNA, 22 bp, Homo sapiens
tgcagctcaggattctcagggc

SEQ ID NO: 7721332 - DNA, 22 bp, Homo sapiens
tgcagctcaggattctcagggc

SEQ ID NO: 7721333 - DNA, 22 bp, Homo sapiens
tgcagctcaggattctcagggc

SEQ ID NO: 7721334 - DNA, 22 bp, Homo sapiens
tgcagctcattgctggggtctg

SEQ ID NO: 7721335 - DNA, 22 bp, Homo sapiens
tgcagctcatattagagagaag

SEQ ID NO: 7721336 - DNA, 22 bp, Homo sapiens
tgcagctcatattagagagaag

SEQ ID NO: 7721337 - DNA, 22 bp, Homo sapiens
tgcagctcattggtgtcctggt

SEQ ID NO: 7721338 - DNA, 22 bp, Homo sapiens
tgcagctcattggtgtcctggt

SEQ ID NO: 7721339 - DNA, 22 bp, Homo sapiens
tgcagctcattggtgtcctggt

SEQ ID NO: 7721340 - DNA, 22 bp, Homo sapiens
tctgaaatggggctgaagcact

SEQ ID NO: 7721341 - DNA, 22 bp, Homo sapiens
tctgaaatggggctgaagcact

SEQ ID NO: 7721342 - DNA, 22 bp, Homo sapiens
tctgaaatgcaggcaatttgct

SEQ ID NO: 7721343 - DNA, 22 bp, Homo sapiens
tctgaaatggcgatggccgttg

SEQ ID NO: 7721344 - DNA, 22 bp, Homo sapiens
tctgaaatgcaggcaatttgct

SEQ ID NO: 7721345 - DNA, 22 bp, Homo sapiens
tctgaaatggcagcgggaatga

SEQ ID NO: 7721346 - DNA, 22 bp, Homo sapiens
tctgaaatagaagtgtctttct

SEQ ID NO: 7721347 - DNA, 22 bp, Homo sapiens
tctgaaataggaaagcaaatgg

SEQ ID NO: 7721348 - DNA, 22 bp, Homo sapiens
tctgaaataggaaagcaaatgg

SEQ ID NO: 7721349 - DNA, 22 bp, Homo sapiens
tctgaaataggaaagcaaatgg

SEQ ID NO: 7721350 - DNA, 22 bp, Homo sapiens
tctgaaatgcaaatttgactga

SEQ ID NO: 7721351 - DNA, 22 bp, Homo sapiens
tctgaaatgcaaatttgactga

SEQ ID NO: 7721352 - DNA, 22 bp, Homo sapiens
tctgaaatgcaaatttgactga

SEQ ID NO: 7721353 - DNA, 22 bp, Homo sapiens
tctgaaatggggctgaagcact

SEQ ID NO: 7721354 - DNA, 22 bp, Homo sapiens
tctgaaatggggctgaagcact

SEQ ID NO: 7721355 - DNA, 22 bp, Homo sapiens
tctgaaatgttctcttgttttg

SEQ ID NO: 7721356 - DNA, 22 bp, Homo sapiens
tctgaaattcacagttgagtca

SEQ ID NO: 7721357 - DNA, 22 bp, Homo sapiens
tctgaaattcacagttgagtca

SEQ ID NO: 7721358 - DNA, 22 bp, Homo sapiens
tctgaaattgttagtaaaaatg

SEQ ID NO: 7721359 - DNA, 22 bp, Homo sapiens
tctgaaattgttagtaaaaatg

SEQ ID NO: 7721360 - DNA, 22 bp, Homo sapiens
tctgaaattttagttatagaaa

SEQ ID NO: 7721361 - DNA, 22 bp, Homo sapiens
tctgaaattgttagtaaaaatg

SEQ ID NO: 7721362 - DNA, 22 bp, Homo sapiens
tctgaaattttagttatagaaa

SEQ ID NO: 7721363 - DNA, 22 bp, Homo sapiens
tctgaaattttagttatagaaa

SEQ ID NO: 7721364 - DNA, 22 bp, Homo sapiens
tctgaaattgttagtaaaaatg

SEQ ID NO: 7721365 - DNA, 22 bp, Homo sapiens
tctgaaattccttccagacttt

SEQ ID NO: 7721366 - DNA, 22 bp, Homo sapiens
tctgaaattccttccagacttt

SEQ ID NO: 7721367 - DNA, 22 bp, Homo sapiens
tctgaagaaatacagctggggt

SEQ ID NO: 7721368 - DNA, 22 bp, Homo sapiens
tctgaagaactgagtaaacatg

SEQ ID NO: 7721369 - DNA, 22 bp, Homo sapiens
tctgaagaaatacagctggggt

SEQ ID NO: 7721370 - DNA, 22 bp, Homo sapiens
tctgaagaaatacagctggggt

SEQ ID NO: 7721371 - DNA, 22 bp, Homo sapiens
tctgaagaactgagtaaacatg

SEQ ID NO: 7721372 - DNA, 22 bp, Homo sapiens
tctgaagaactgagtaaacatg

SEQ ID NO: 7721373 - DNA, 20 bp, Homo sapiens
tctgaagaaagacagggact

SEQ ID NO: 7721374 - DNA, 20 bp, Homo sapiens
tctgaagaaagacagggact

SEQ ID NO: 7721375 - DNA, 22 bp, Homo sapiens
tctgaactccagccctgctctc

SEQ ID NO: 7721376 - DNA, 20 bp, Homo sapiens
tctgaagaaagacagggact

SEQ ID NO: 7721377 - DNA, 22 bp, Homo sapiens
tctgaactccagccctgctctc

SEQ ID NO: 7721378 - DNA, 20 bp, Homo sapiens
tctgaagaaagacagggact

SEQ ID NO: 7721379 - DNA, 22 bp, Homo sapiens
tctgaagaactgagtaaacatg

SEQ ID NO: 7721380 - DNA, 22 bp, Homo sapiens
tctgaagaactgtctagagaac

SEQ ID NO: 7721381 - DNA, 22 bp, Homo sapiens
tctgaagaactgtctagagaac

SEQ ID NO: 7721382 - DNA, 22 bp, Homo sapiens
tctgaagaactgtctagagaac

SEQ ID NO: 7721383 - DNA, 22 bp, Homo sapiens
tctgaagaactgtctagagaac

SEQ ID NO: 7721384 - DNA, 22 bp, Homo sapiens
tctgaagaataggatgttgtgt

SEQ ID NO: 7721385 - DNA, 19 bp, Homo sapiens
tctgaagaattagagagca

SEQ ID NO: 7721386 - DNA, 22 bp, Homo sapiens
tctgaagaagggtgccaggctg

SEQ ID NO: 7721387 - DNA, 22 bp, Homo sapiens
tctgaagaactgtctagagaac

SEQ ID NO: 7721388 - DNA, 22 bp, Homo sapiens
tctgaagaactgtctagagaac

SEQ ID NO: 7721389 - DNA, 22 bp, Homo sapiens
tctgaagaataggatgttgtgt

SEQ ID NO: 7721390 - DNA, 22 bp, Homo sapiens
tctgaagaataggatgttgtgt

SEQ ID NO: 7721391 - DNA, 22 bp, Homo sapiens
tctgaacatgatgtcatctgga

SEQ ID NO: 7721392 - DNA, 22 bp, Homo sapiens
tctgaacatgatgtcatctgga

SEQ ID NO: 7721393 - DNA, 22 bp, Homo sapiens
tctgaacatcctacaacatttt

SEQ ID NO: 7721394 - DNA, 22 bp, Homo sapiens
tctgaacatggcttcctcttca

SEQ ID NO: 7721395 - DNA, 22 bp, Homo sapiens
tctgaacagcatggaatcattt

SEQ ID NO: 7721396 - DNA, 22 bp, Homo sapiens
tctgaacatccagcaatgcaca

SEQ ID NO: 7721397 - DNA, 22 bp, Homo sapiens
tctgaacagaaaagatgcacaa

SEQ ID NO: 7721398 - DNA, 22 bp, Homo sapiens
tctgaacagaaaagatgcacaa

SEQ ID NO: 7721399 - DNA, 22 bp, Homo sapiens
tctgaacagaaaagatgcacaa

SEQ ID NO: 7721400 - DNA, 22 bp, Homo sapiens
tctgaacagaaaagatgcacaa

SEQ ID NO: 7721401 - DNA, 22 bp, Homo sapiens
tctgaacactgagtgtcatcac

SEQ ID NO: 7721402 - DNA, 22 bp, Homo sapiens
tctgaacagcatggaatcattt

SEQ ID NO: 7721403 - DNA, 22 bp, Homo sapiens
tctgaaattttagttatagaaa

SEQ ID NO: 7721404 - DNA, 22 bp, Homo sapiens
tctgaaattttagttatagaaa

SEQ ID NO: 7721405 - DNA, 22 bp, Homo sapiens
tctgaacaagggcaccttccag

SEQ ID NO: 7721406 - DNA, 22 bp, Homo sapiens
tctgaacaagggcaccttccag

SEQ ID NO: 7721407 - DNA, 22 bp, Homo sapiens
tctgaagatatgagctttatga

SEQ ID NO: 7721408 - DNA, 22 bp, Homo sapiens
tctgaagagtcttgcaagaaag

SEQ ID NO: 7721409 - DNA, 22 bp, Homo sapiens
tctgaagagtcttgcaagaaag

SEQ ID NO: 7721410 - DNA, 22 bp, Homo sapiens
tctgaagagtcttgcaagaaag

SEQ ID NO: 7721411 - DNA, 22 bp, Homo sapiens
tctgaagagtcttgcaagaaag

SEQ ID NO: 7721412 - DNA, 23 bp, Homo sapiens
tctgaagatgctgtttccagtga

SEQ ID NO: 7721413 - DNA, 23 bp, Homo sapiens
tctgaagatgctgtttccagtga

SEQ ID NO: 7721414 - DNA, 22 bp, Homo sapiens
tctgaagatggaggaacttaga

SEQ ID NO: 7721415 - DNA, 22 bp, Homo sapiens
tctgaagatggaggaacttaga

SEQ ID NO: 7721416 - DNA, 22 bp, Homo sapiens
tctgaagatatgagctttatga

SEQ ID NO: 7721417 - DNA, 23 bp, Homo sapiens
tctgaagatgctgtttccagtga

SEQ ID NO: 7721418 - DNA, 22 bp, Homo sapiens
tctgaagatggaggaacttaga

SEQ ID NO: 7721419 - DNA, 22 bp, Homo sapiens
tctgaagattaccagctaaatg

SEQ ID NO: 7721420 - DNA, 22 bp, Homo sapiens
tctgaagattaccagctaaatg

SEQ ID NO: 7721421 - DNA, 22 bp, Homo sapiens
tctgaagattaccagctaaatg

SEQ ID NO: 7721422 - DNA, 22 bp, Homo sapiens
tctgaagattaccagctaaatg

SEQ ID NO: 7721423 - DNA, 22 bp, Homo sapiens
tctgaagattaccagctaaatg

SEQ ID NO: 7721424 - DNA, 22 bp, Homo sapiens
tctgaagattaccagctaaatg

SEQ ID NO: 7721425 - DNA, 22 bp, Homo sapiens
tctgaagattctttccactatt

SEQ ID NO: 7721426 - DNA, 22 bp, Homo sapiens
tctgaagattctttccactatt

SEQ ID NO: 7721427 - DNA, 22 bp, Homo sapiens
tctgaagattctttccactatt

SEQ ID NO: 7721428 - DNA, 22 bp, Homo sapiens
tctgaagattctttccactatt

SEQ ID NO: 7721429 - DNA, 22 bp, Homo sapiens
tctgaagcacagcaggaagggt

SEQ ID NO: 7721430 - DNA, 22 bp, Homo sapiens
tctgaagcacagcaggaagggt

SEQ ID NO: 7721431 - DNA, 22 bp, Homo sapiens
tctgaagcacagcaggaagggt

SEQ ID NO: 7721432 - DNA, 22 bp, Homo sapiens
tctgaagcactgcaatgcttta

SEQ ID NO: 7721433 - DNA, 22 bp, Homo sapiens
tctgaagcacagcaggaagggt

SEQ ID NO: 7721434 - DNA, 22 bp, Homo sapiens
tctgaagaggctcttgataaga

SEQ ID NO: 7721435 - DNA, 22 bp, Homo sapiens
tctgaagaggctcttgataaga

SEQ ID NO: 7721436 - DNA, 22 bp, Homo sapiens
tctgaagagctttggaagtatg

SEQ ID NO: 7721437 - DNA, 22 bp, Homo sapiens
tctgaagaggctcttgataaga

SEQ ID NO: 7721438 - DNA, 22 bp, Homo sapiens
tctgaagagaatgctgctgaac

SEQ ID NO: 7721439 - DNA, 22 bp, Homo sapiens
tctgaagagctttggaagtatg

SEQ ID NO: 7721440 - DNA, 22 bp, Homo sapiens
tctgaagacatatgatatggtg

SEQ ID NO: 7721441 - DNA, 22 bp, Homo sapiens
tctgaagagctttggaagtatg

SEQ ID NO: 7721442 - DNA, 22 bp, Homo sapiens
tctgaagagtcatctttgggtg

SEQ ID NO: 7721443 - DNA, 22 bp, Homo sapiens
tctgaagagtcttgcaagaaag

SEQ ID NO: 7721444 - DNA, 22 bp, Homo sapiens
tctgaagagtcttgcaagaaag

SEQ ID NO: 7721445 - DNA, 22 bp, Homo sapiens
tctgaagagtcttgcaagaaag

SEQ ID NO: 7721446 - DNA, 22 bp, Homo sapiens
tctgaagagtcatctttgggtg

SEQ ID NO: 7721447 - DNA, 22 bp, Homo sapiens
tctgaagagtcttgcaagaaag

SEQ ID NO: 7721448 - DNA, 22 bp, Homo sapiens
tctgaagacatatgatatggtg

SEQ ID NO: 7721449 - DNA, 22 bp, Homo sapiens
tctgaagagaacaccagtagtt

SEQ ID NO: 7721450 - DNA, 22 bp, Homo sapiens
tctgaagagaatgctgctgaac

SEQ ID NO: 7721451 - DNA, 19 bp, Homo sapiens
tctgaagaattagagagca

SEQ ID NO: 7721452 - DNA, 22 bp, Homo sapiens
tctgaagaagggtgccaggctg

SEQ ID NO: 7721453 - DNA, 19 bp, Homo sapiens
tctgaagaattagagagca

SEQ ID NO: 7721454 - DNA, 19 bp, Homo sapiens
tctgaagaattagagagca

SEQ ID NO: 7721455 - DNA, 19 bp, Homo sapiens
tctgaagaattagagagca

SEQ ID NO: 7721456 - DNA, 17 bp, Homo sapiens
tctgaagccagtctgct

SEQ ID NO: 7721457 - DNA, 17 bp, Homo sapiens
tctgaagccagtctgct

SEQ ID NO: 7721458 - DNA, 22 bp, Homo sapiens
tctgaagcctttgtacaggcct

SEQ ID NO: 7721459 - DNA, 17 bp, Homo sapiens
tctgaagccagtctgct

SEQ ID NO: 7721460 - DNA, 22 bp, Homo sapiens
tctgaagccacctctgcttgtc

SEQ ID NO: 7721461 - DNA, 17 bp, Homo sapiens
tctgaagccagtctgct

SEQ ID NO: 7721462 - DNA, 17 bp, Homo sapiens
tctgaagccagtctgct

SEQ ID NO: 7721463 - DNA, 22 bp, Homo sapiens
tctgaaggaaaagggtagatat

SEQ ID NO: 7721464 - DNA, 22 bp, Homo sapiens
tctgaagcctttgtacaggcct

SEQ ID NO: 7721465 - DNA, 22 bp, Homo sapiens
tctgaagctggaggaagctttg

SEQ ID NO: 7721466 - DNA, 18 bp, Homo sapiens
tctgaaggaatgattcca

SEQ ID NO: 7721467 - DNA, 22 bp, Homo sapiens
tctgaaggaaaagggtagatat

SEQ ID NO: 7721468 - DNA, 18 bp, Homo sapiens
tctgaaggaatgattcca

SEQ ID NO: 7721469 - DNA, 18 bp, Homo sapiens
tctgaaggaatgattcca

SEQ ID NO: 7721470 - DNA, 22 bp, Homo sapiens
tctgaaggcctggagggtccca

SEQ ID NO: 7721471 - DNA, 22 bp, Homo sapiens
tctgaaggcctggagggtccca

SEQ ID NO: 7721472 - DNA, 21 bp, Homo sapiens
tctgaaggcattttccaaggt

SEQ ID NO: 7721473 - DNA, 21 bp, Homo sapiens
tctgaaggcattttccaaggt

SEQ ID NO: 7721474 - DNA, 21 bp, Homo sapiens
tctgaaggcattttccaaggt

SEQ ID NO: 7721475 - DNA, 22 bp, Homo sapiens
tctgaaggtctgagaaccagga

SEQ ID NO: 7721476 - DNA, 22 bp, Homo sapiens
tctgaagggctgagtggaggag

SEQ ID NO: 7721477 - DNA, 22 bp, Homo sapiens
tctgaagggctgagtggaggag

SEQ ID NO: 7721478 - DNA, 21 bp, Homo sapiens
tctgaaggcttgactggggct

SEQ ID NO: 7721479 - DNA, 22 bp, Homo sapiens
tctgaaggtgctagagaaagct

SEQ ID NO: 7721480 - DNA, 22 bp, Homo sapiens
tctgaaggtgctagagaaagct

SEQ ID NO: 7721481 - DNA, 22 bp, Homo sapiens
tctgaaggtctgagaaccagga

SEQ ID NO: 7721482 - DNA, 22 bp, Homo sapiens
tctgaaggtctgagctagaggt

SEQ ID NO: 7721483 - DNA, 22 bp, Homo sapiens
tctgaaggtctgagaaccagga

SEQ ID NO: 7721484 - DNA, 22 bp, Homo sapiens
tctgaaggtgctagagaaagct

SEQ ID NO: 7721485 - DNA, 22 bp, Homo sapiens
tctgaaggtgctagagaaagct

SEQ ID NO: 7721486 - DNA, 22 bp, Homo sapiens
tctgaaggttacttctgctcag

SEQ ID NO: 7721487 - DNA, 22 bp, Homo sapiens
tctgaaggttgagaagggctga

SEQ ID NO: 7721488 - DNA, 22 bp, Homo sapiens
tctgaaggttgagaagggctga

SEQ ID NO: 7721489 - DNA, 22 bp, Homo sapiens
tctgaattttaactacacaaag

SEQ ID NO: 7721490 - DNA, 22 bp, Homo sapiens
tctgaattttccacagatttgg

SEQ ID NO: 7721491 - DNA, 22 bp, Homo sapiens
tctctttaaagactcagagatt

SEQ ID NO: 7721492 - DNA, 22 bp, Homo sapiens
tctctttaagtataatcttata

SEQ ID NO: 7721493 - DNA, 22 bp, Homo sapiens
tctctttaagtataatcttata

SEQ ID NO: 7721494 - DNA, 22 bp, Homo sapiens
tctctttaagtataatcttata

SEQ ID NO: 7721495 - DNA, 22 bp, Homo sapiens
tctctttaagtataatcttata

SEQ ID NO: 7721496 - DNA, 22 bp, Homo sapiens
tctctttaagtataatcttata

SEQ ID NO: 7721497 - DNA, 23 bp, Homo sapiens
tctctttcaagagcttaatgtgc

SEQ ID NO: 7721498 - DNA, 23 bp, Homo sapiens
tctctttcaagagcttaatgtgc

SEQ ID NO: 7721499 - DNA, 22 bp, Homo sapiens
tctctttagtgcttagacgtct

SEQ ID NO: 7721500 - DNA, 22 bp, Homo sapiens
tctctttagtgcttagacgtct

SEQ ID NO: 7721501 - DNA, 22 bp, Homo sapiens
tctctttaagtataatcttata

SEQ ID NO: 7721502 - DNA, 22 bp, Homo sapiens
tctctttactttcaccaatttg

SEQ ID NO: 7721503 - DNA, 22 bp, Homo sapiens
tctctttactttcaccaatttg

SEQ ID NO: 7721504 - DNA, 22 bp, Homo sapiens
tctctttaaaaatagtgaaata

SEQ ID NO: 7721505 - DNA, 22 bp, Homo sapiens
tctctttaaaaatagtgaaata

SEQ ID NO: 7721506 - DNA, 22 bp, Homo sapiens
tctcttctttggggtgggctca

SEQ ID NO: 7721507 - DNA, 22 bp, Homo sapiens
tctctttaaaaatagtgaaata

SEQ ID NO: 7721508 - DNA, 22 bp, Homo sapiens
tctctttaaaaatagtgaaata

SEQ ID NO: 7721509 - DNA, 22 bp, Homo sapiens
tctctttaaaaatagtgaaata

SEQ ID NO: 7721510 - DNA, 22 bp, Homo sapiens
tctctttaaagactcagagatt

SEQ ID NO: 7721511 - DNA, 22 bp, Homo sapiens
tctctttaaagactcagagatt

SEQ ID NO: 7721512 - DNA, 22 bp, Homo sapiens
tctctttaaagactcagagatt

SEQ ID NO: 7721513 - DNA, 22 bp, Homo sapiens
tctctttaaaaatagtgaaata

SEQ ID NO: 7721514 - DNA, 22 bp, Homo sapiens
tctctttaaaaatagtgaaata

SEQ ID NO: 7721515 - DNA, 22 bp, Homo sapiens
tctcttcttgtgttttcctgcc

SEQ ID NO: 7721516 - DNA, 22 bp, Homo sapiens
tctcttcttgtgttttcctgcc

SEQ ID NO: 7721517 - DNA, 22 bp, Homo sapiens
tctcttcttgtgttttcctgcc

SEQ ID NO: 7721518 - DNA, 22 bp, Homo sapiens
tctcttcttgtgttttcctgcc

SEQ ID NO: 7721519 - DNA, 22 bp, Homo sapiens
tctcttcttgtgttttcctgcc

SEQ ID NO: 7721520 - DNA, 22 bp, Homo sapiens
tctcttcttgtgttttcctgcc

SEQ ID NO: 7721521 - DNA, 17 bp, Homo sapiens
tctctttccctttctgc

SEQ ID NO: 7721522 - DNA, 19 bp, Homo sapiens
tctctttcatggggctagt

SEQ ID NO: 7721523 - DNA, 17 bp, Homo sapiens
tctctttccctttctgc

SEQ ID NO: 7721524 - DNA, 17 bp, Homo sapiens
tctctttccctttctgc

SEQ ID NO: 7721525 - DNA, 22 bp, Homo sapiens
tctctttctatatgtgagtctt

SEQ ID NO: 7721526 - DNA, 22 bp, Homo sapiens
tctctttctatatgtgagtctt

SEQ ID NO: 7721527 - DNA, 18 bp, Homo sapiens
tctctttcctcagtggag

SEQ ID NO: 7721528 - DNA, 18 bp, Homo sapiens
tctctttcctcagtggag

SEQ ID NO: 7721529 - DNA, 18 bp, Homo sapiens
tctctttcctcagtggag

SEQ ID NO: 7721530 - DNA, 22 bp, Homo sapiens
tctctttctattgcaccatgct

SEQ ID NO: 7721531 - DNA, 22 bp, Homo sapiens
tctctttctattgcaccatgct

SEQ ID NO: 7721532 - DNA, 22 bp, Homo sapiens
tctctttctattgcaccatgct

SEQ ID NO: 7721533 - DNA, 22 bp, Homo sapiens
tctctttctttgtatgtctatt

SEQ ID NO: 7721534 - DNA, 21 bp, Homo sapiens
tctctttctggaagcttccct

SEQ ID NO: 7721535 - DNA, 21 bp, Homo sapiens
tctctttctggaagcttccct

SEQ ID NO: 7721536 - DNA, 21 bp, Homo sapiens
tctctttctggaagcttccct

SEQ ID NO: 7721537 - DNA, 21 bp, Homo sapiens
tctctttctggaagcttccct

SEQ ID NO: 7721538 - DNA, 22 bp, Homo sapiens
tctctttctcagatggtggaga

SEQ ID NO: 7721539 - DNA, 22 bp, Homo sapiens
tctctttctcaaaatgtaagca

SEQ ID NO: 7721540 - DNA, 22 bp, Homo sapiens
tctctttgcctgctgccatcca

SEQ ID NO: 7721541 - DNA, 22 bp, Homo sapiens
tctctttgcctgctgccatcca

SEQ ID NO: 7721542 - DNA, 22 bp, Homo sapiens
tctctttgaccctttagctcca

SEQ ID NO: 7721543 - DNA, 21 bp, Homo sapiens
tctctttgggaacattaatca

SEQ ID NO: 7721544 - DNA, 21 bp, Homo sapiens
tctctttgggaacattaatca

SEQ ID NO: 7721545 - DNA, 22 bp, Homo sapiens
tctctttgaccctttagctcca

SEQ ID NO: 7721546 - DNA, 22 bp, Homo sapiens
tctctttctttgtatgtctatt

SEQ ID NO: 7721547 - DNA, 22 bp, Homo sapiens
tctctttctttgtatgtctatt

SEQ ID NO: 7721548 - DNA, 20 bp, Homo sapiens
tctcttttagcttacagctg

SEQ ID NO: 7721549 - DNA, 20 bp, Homo sapiens
tctcttttagcttacagctg

SEQ ID NO: 7721550 - DNA, 20 bp, Homo sapiens
tctcttttagcttacagctg

SEQ ID NO: 7721551 - DNA, 22 bp, Homo sapiens
tctctttgtggccaggagagga

SEQ ID NO: 7721552 - DNA, 20 bp, Homo sapiens
tctcttttagcttacagctg

SEQ ID NO: 7721553 - DNA, 22 bp, Homo sapiens
tctcttttatgtacaccctgac

SEQ ID NO: 7721554 - DNA, 22 bp, Homo sapiens
tctcttttatgtacaccctgac

SEQ ID NO: 7721555 - DNA, 18 bp, Homo sapiens
tctcttttcccctcattg

SEQ ID NO: 7721556 - DNA, 18 bp, Homo sapiens
tctcttttcccctcattg

SEQ ID NO: 7721557 - DNA, 22 bp, Homo sapiens
tctctttgtctgctcttagttg

SEQ ID NO: 7721558 - DNA, 22 bp, Homo sapiens
tctctttgtggccaggagagga

SEQ ID NO: 7721559 - DNA, 22 bp, Homo sapiens
tctctttgtggccaggagagga

SEQ ID NO: 7721560 - DNA, 22 bp, Homo sapiens
tctctttgtggccaggagagga

SEQ ID NO: 7721561 - DNA, 22 bp, Homo sapiens
tctctttgtggccaggagagga

SEQ ID NO: 7721562 - DNA, 22 bp, Homo sapiens
tctctttgtctgctcttagttg

SEQ ID NO: 7721563 - DNA, 22 bp, Homo sapiens
tctctttgtctgctcttagttg

SEQ ID NO: 7721564 - DNA, 22 bp, Homo sapiens
tctctttgtctgctcttagttg

SEQ ID NO: 7721565 - DNA, 22 bp, Homo sapiens
tctctttgtctgctcttagttg

SEQ ID NO: 7721566 - DNA, 22 bp, Homo sapiens
tctctttgtctgctcttagttg

SEQ ID NO: 7721567 - DNA, 22 bp, Homo sapiens
tctgaaagaaagattttgtttc

SEQ ID NO: 7721568 - DNA, 22 bp, Homo sapiens
tctgaaagaaagattttgtttc

SEQ ID NO: 7721569 - DNA, 22 bp, Homo sapiens
tctgaaaatgttgactttgttt

SEQ ID NO: 7721570 - DNA, 22 bp, Homo sapiens
tctgaaagagagtacatacagt

SEQ ID NO: 7721571 - DNA, 22 bp, Homo sapiens
tctgaaaatgttgactttgttt

SEQ ID NO: 7721572 - DNA, 22 bp, Homo sapiens
tctgaaaatgttgactttgttt

SEQ ID NO: 7721573 - DNA, 22 bp, Homo sapiens
tctgaaaatgttgactttgttt

SEQ ID NO: 7721574 - DNA, 22 bp, Homo sapiens
tctgaaaactccatgagctcgt

SEQ ID NO: 7721575 - DNA, 22 bp, Homo sapiens
tctcttttctttctggataaaa

SEQ ID NO: 7721576 - DNA, 22 bp, Homo sapiens
tctcttttctttctggataaaa

SEQ ID NO: 7721577 - DNA, 22 bp, Homo sapiens
tctcttttctttctggataaaa

SEQ ID NO: 7721578 - DNA, 22 bp, Homo sapiens
tctcttttctttctggataaaa

SEQ ID NO: 7721579 - DNA, 22 bp, Homo sapiens
tctgaaataaatgcactgttag

SEQ ID NO: 7721580 - DNA, 22 bp, Homo sapiens
tctgaaataaatgcactgttag

SEQ ID NO: 7721581 - DNA, 22 bp, Homo sapiens
tctgaaataaatgcactgttag

SEQ ID NO: 7721582 - DNA, 22 bp, Homo sapiens
tctgaaataactgatgccagat

SEQ ID NO: 7721583 - DNA, 22 bp, Homo sapiens
tctgaaataactgatgccagat

SEQ ID NO: 7721584 - DNA, 22 bp, Homo sapiens
tctgaaataagggagaagggaa

SEQ ID NO: 7721585 - DNA, 22 bp, Homo sapiens
tctgaaataagggagaagggaa

SEQ ID NO: 7721586 - DNA, 22 bp, Homo sapiens
tctgaaatactgcaggttctct

SEQ ID NO: 7721587 - DNA, 22 bp, Homo sapiens
tctgaaatactgcaggttctct

SEQ ID NO: 7721588 - DNA, 22 bp, Homo sapiens
tctgaaatagaagtgtctttct

SEQ ID NO: 7721589 - DNA, 22 bp, Homo sapiens
tctgaaatagaagtgtctttct

SEQ ID NO: 7721590 - DNA, 22 bp, Homo sapiens
tctgaaagcataatttgtccca

SEQ ID NO: 7721591 - DNA, 22 bp, Homo sapiens
tctgaaagccctagtttgtaat

SEQ ID NO: 7721592 - DNA, 22 bp, Homo sapiens
tctgaaagccctagtttgtaat

SEQ ID NO: 7721593 - DNA, 22 bp, Homo sapiens
tctgaaagccctagtttgtaat

SEQ ID NO: 7721594 - DNA, 22 bp, Homo sapiens
tctgaaagctagaaaatgctct

SEQ ID NO: 7721595 - DNA, 22 bp, Homo sapiens
tctgaaagctagaaaatgctct

SEQ ID NO: 7721596 - DNA, 22 bp, Homo sapiens
tctgaaagctagaaaatgctct

SEQ ID NO: 7721597 - DNA, 22 bp, Homo sapiens
tctgaaagggctaaataatttg

SEQ ID NO: 7721598 - DNA, 22 bp, Homo sapiens
tctgaaagtatctggatctttt

SEQ ID NO: 7721599 - DNA, 22 bp, Homo sapiens
tctgaaagtctgaaacagtgtc

SEQ ID NO: 7721600 - DNA, 22 bp, Homo sapiens
tctgaaagtctgaaacagtgtc

SEQ ID NO: 7721601 - DNA, 22 bp, Homo sapiens
tctgaaagtatctggatctttt

SEQ ID NO: 7721602 - DNA, 22 bp, Homo sapiens
tctgaaagtctgaaacagtgtc

SEQ ID NO: 7721603 - DNA, 22 bp, Homo sapiens
tctgaaagtctgaaacagtgtc

SEQ ID NO: 7721604 - DNA, 22 bp, Homo sapiens
tctcttaggagaaattcataaa

SEQ ID NO: 7721605 - DNA, 23 bp, Homo sapiens
tctcttacctgagacatttccta

SEQ ID NO: 7721606 - DNA, 22 bp, Homo sapiens
tctcttagtcttatatgtaaaa

SEQ ID NO: 7721607 - DNA, 22 bp, Homo sapiens
tctcttaggagaaattcataaa

SEQ ID NO: 7721608 - DNA, 22 bp, Homo sapiens
tctcttaatccggtgctttctg

SEQ ID NO: 7721609 - DNA, 23 bp, Homo sapiens
tctctgtgtgcctcagtttcttc

SEQ ID NO: 7721610 - DNA, 22 bp, Homo sapiens
tctcttaatccggtgctttctg

SEQ ID NO: 7721611 - DNA, 22 bp, Homo sapiens
tctcttaattcagaggcagtta

SEQ ID NO: 7721612 - DNA, 21 bp, Homo sapiens
tctctgtgtctttaagctgga

SEQ ID NO: 7721613 - DNA, 21 bp, Homo sapiens
tctctgtgtctttaagctgga

SEQ ID NO: 7721614 - DNA, 21 bp, Homo sapiens
tctctgtgtctttaagctgga

SEQ ID NO: 7721615 - DNA, 23 bp, Homo sapiens
tctctgtgtgcctcagtttcttc

SEQ ID NO: 7721616 - DNA, 22 bp, Homo sapiens
tctcttcacattcctggcaaac

SEQ ID NO: 7721617 - DNA, 22 bp, Homo sapiens
tctcttcacattcctggcaaac

SEQ ID NO: 7721618 - DNA, 22 bp, Homo sapiens
tctcttcacatgcttgctccaa

SEQ ID NO: 7721619 - DNA, 22 bp, Homo sapiens
tctcttcacatgcttgctccaa

SEQ ID NO: 7721620 - DNA, 22 bp, Homo sapiens
tctcttcacatgcttgctccaa

SEQ ID NO: 7721621 - DNA, 22 bp, Homo sapiens
tctcttcacatgcttgctccaa

SEQ ID NO: 7721622 - DNA, 22 bp, Homo sapiens
tctcttattttgcctttgacaa

SEQ ID NO: 7721623 - DNA, 22 bp, Homo sapiens
tctcttaggagaaattcataaa

SEQ ID NO: 7721624 - DNA, 22 bp, Homo sapiens
tctcttcacactacccctgtgt

SEQ ID NO: 7721625 - DNA, 22 bp, Homo sapiens
tctcttcacactacccctgtgt

SEQ ID NO: 7721626 - DNA, 22 bp, Homo sapiens
tctcttcacactacccctgtgt

SEQ ID NO: 7721627 - DNA, 22 bp, Homo sapiens
tctcttcatagtgacacccatc

SEQ ID NO: 7721628 - DNA, 22 bp, Homo sapiens
tctcttcatagtgacacccatc

SEQ ID NO: 7721629 - DNA, 20 bp, Homo sapiens
tctcttcaggaggtccatgt

SEQ ID NO: 7721630 - DNA, 22 bp, Homo sapiens
tctcttccagtaagagtcttta

SEQ ID NO: 7721631 - DNA, 22 bp, Homo sapiens
tctcttcatagtgacacccatc

SEQ ID NO: 7721632 - DNA, 22 bp, Homo sapiens
tctcttcatttgctatgggtca

SEQ ID NO: 7721633 - DNA, 22 bp, Homo sapiens
tctcttcagcccattataaggg

SEQ ID NO: 7721634 - DNA, 22 bp, Homo sapiens
tctcttcagcccattataaggg

SEQ ID NO: 7721635 - DNA, 22 bp, Homo sapiens
tctcttcagcccattataaggg

SEQ ID NO: 7721636 - DNA, 22 bp, Homo sapiens
tctcttcagcccattataaggg

SEQ ID NO: 7721637 - DNA, 20 bp, Homo sapiens
tctcttcaggaggtccatgt

SEQ ID NO: 7721638 - DNA, 22 bp, Homo sapiens
tctcttctaacactagaaattc

SEQ ID NO: 7721639 - DNA, 22 bp, Homo sapiens
tctcttctaacactagaaattc

SEQ ID NO: 7721640 - DNA, 22 bp, Homo sapiens
tctcttctaacactagaaattc

SEQ ID NO: 7721641 - DNA, 22 bp, Homo sapiens
tctcttctaacactagaaattc

SEQ ID NO: 7721642 - DNA, 22 bp, Homo sapiens
tctcttccttgacctattgtaa

SEQ ID NO: 7721643 - DNA, 22 bp, Homo sapiens
tctcttctaacactagaaattc

SEQ ID NO: 7721644 - DNA, 22 bp, Homo sapiens
tctcttctaacactagaaattc

SEQ ID NO: 7721645 - DNA, 22 bp, Homo sapiens
tctcttctaacactagaaattc

SEQ ID NO: 7721646 - DNA, 22 bp, Homo sapiens
tctcttcctagtgatgggcttt

SEQ ID NO: 7721647 - DNA, 22 bp, Homo sapiens
tctcttcctagtgatgggcttt

SEQ ID NO: 7721648 - DNA, 22 bp, Homo sapiens
tctcttcctagtgatgggcttt

SEQ ID NO: 7721649 - DNA, 22 bp, Homo sapiens
tctcttcctagtgatgggcttt

SEQ ID NO: 7721650 - DNA, 22 bp, Homo sapiens
tctcttcctcagcctggggcct

SEQ ID NO: 7721651 - DNA, 22 bp, Homo sapiens
tctcttcctcagcctggggcct

SEQ ID NO: 7721652 - DNA, 21 bp, Homo sapiens
tctcttcctccgcgccgccgc

SEQ ID NO: 7721653 - DNA, 22 bp, Homo sapiens
tctcttcctcagcctggggcct

SEQ ID NO: 7721654 - DNA, 21 bp, Homo sapiens
tctcttcctccgcgccgccgc

SEQ ID NO: 7721655 - DNA, 22 bp, Homo sapiens
tctcttccttgacctattgtaa

SEQ ID NO: 7721656 - DNA, 21 bp, Homo sapiens
tctcttcccatcaggacacta

SEQ ID NO: 7721657 - DNA, 22 bp, Homo sapiens
tctcttcccctttcctttaaca

SEQ ID NO: 7721658 - DNA, 22 bp, Homo sapiens
tctcttcccctttcctttaaca

SEQ ID NO: 7721659 - DNA, 22 bp, Homo sapiens
tctcttcccggataaagtaagt

SEQ ID NO: 7721660 - DNA, 22 bp, Homo sapiens
tctcttcccggataaagtaagt

SEQ ID NO: 7721661 - DNA, 22 bp, Homo sapiens
tctcttcccggataaagtaagt

SEQ ID NO: 7721662 - DNA, 22 bp, Homo sapiens
tctcttccagtaagagtcttta

SEQ ID NO: 7721663 - DNA, 22 bp, Homo sapiens
tctcttccagtaagagtcttta

SEQ ID NO: 7721664 - DNA, 22 bp, Homo sapiens
tctcttccagtggctttgattt

SEQ ID NO: 7721665 - DNA, 22 bp, Homo sapiens
tctcttccagtggctttgattt

SEQ ID NO: 7721666 - DNA, 22 bp, Homo sapiens
tctcttccatgtttcagcccca

SEQ ID NO: 7721667 - DNA, 22 bp, Homo sapiens
tctcttccatgtttcagcccca

SEQ ID NO: 7721668 - DNA, 22 bp, Homo sapiens
tctcttccatgtttcagcccca

SEQ ID NO: 7721669 - DNA, 22 bp, Homo sapiens
tctcttccatgtttcagcccca

SEQ ID NO: 7721670 - DNA, 22 bp, Homo sapiens
tctcttccagtaagagtcttta

SEQ ID NO: 7721671 - DNA, 22 bp, Homo sapiens
tctcttctatttgagactattt

SEQ ID NO: 7721672 - DNA, 22 bp, Homo sapiens
tctcttctatttgagactattt

SEQ ID NO: 7721673 - DNA, 22 bp, Homo sapiens
tctcttctatttgagactattt

SEQ ID NO: 7721674 - DNA, 22 bp, Homo sapiens
tctcttctatttgagactattt

SEQ ID NO: 7721675 - DNA, 22 bp, Homo sapiens
tctcttctgaaacctgtcttta

SEQ ID NO: 7721676 - DNA, 22 bp, Homo sapiens
tctcttctctagtgagcaactg

SEQ ID NO: 7721677 - DNA, 22 bp, Homo sapiens
tctcttctctagtgagcaactg

SEQ ID NO: 7721678 - DNA, 19 bp, Homo sapiens
tctcttctccctggtttta

SEQ ID NO: 7721679 - DNA, 19 bp, Homo sapiens
tctcttctccctggtttta

SEQ ID NO: 7721680 - DNA, 19 bp, Homo sapiens
tctcttctccctggtttta

SEQ ID NO: 7721681 - DNA, 22 bp, Homo sapiens
tctcttctatttgagactattt

SEQ ID NO: 7721682 - DNA, 22 bp, Homo sapiens
tctcttctagcttcttgtggtt

SEQ ID NO: 7721683 - DNA, 22 bp, Homo sapiens
tctcttctatttgagactattt

SEQ ID NO: 7721684 - DNA, 22 bp, Homo sapiens
tctcttctatttgagactattt

SEQ ID NO: 7721685 - DNA, 22 bp, Homo sapiens
tctcttctatttgagactattt

SEQ ID NO: 7721686 - DNA, 22 bp, Homo sapiens
tctcttctagcttcttgtggtt

SEQ ID NO: 7721687 - DNA, 22 bp, Homo sapiens
tctcttctagcttcttgtggtt

SEQ ID NO: 7721688 - DNA, 22 bp, Homo sapiens
tctcttctaattttcccgagta

SEQ ID NO: 7721689 - DNA, 22 bp, Homo sapiens
tctcttctaattttcccgagta

SEQ ID NO: 7721690 - DNA, 22 bp, Homo sapiens
tctcttctaattagggtccatg

SEQ ID NO: 7721691 - DNA, 20 bp, Homo sapiens
tctcttctggggagataaaa

SEQ ID NO: 7721692 - DNA, 20 bp, Homo sapiens
tctcttctggggagataaaa

SEQ ID NO: 7721693 - DNA, 20 bp, Homo sapiens
tctcttctggggagataaaa

SEQ ID NO: 7721694 - DNA, 22 bp, Homo sapiens
tctcttctgacctagccttgga

SEQ ID NO: 7721695 - DNA, 22 bp, Homo sapiens
tctcttctgacctagccttgga

SEQ ID NO: 7721696 - DNA, 22 bp, Homo sapiens
tctcttctgacctagccttgga

SEQ ID NO: 7721697 - DNA, 22 bp, Homo sapiens
tctcttctgacctagccttgga

SEQ ID NO: 7721698 - DNA, 22 bp, Homo sapiens
tctcttctgaaacctgtcttta

SEQ ID NO: 7721699 - DNA, 22 bp, Homo sapiens
tctcttctgaaacctgtcttta

SEQ ID NO: 7721700 - DNA, 22 bp, Homo sapiens
tctcttctgaaacctgtcttta

SEQ ID NO: 7721701 - DNA, 22 bp, Homo sapiens
tctcttctgaaacctgtcttta

SEQ ID NO: 7721702 - DNA, 22 bp, Homo sapiens
tctcttctgaaacctgtcttta

SEQ ID NO: 7721703 - DNA, 22 bp, Homo sapiens
tctcttctgaaacctgtcttta

SEQ ID NO: 7721704 - DNA, 22 bp, Homo sapiens
tctcttctgaaacctgtcttta

SEQ ID NO: 7721705 - DNA, 22 bp, Homo sapiens
tctcttctgaaacctgtcttta

SEQ ID NO: 7721706 - DNA, 22 bp, Homo sapiens
tctcttctgaaacctgtcttta

SEQ ID NO: 7721707 - DNA, 22 bp, Homo sapiens
tctcttctgaaacctgtcttta

SEQ ID NO: 7721708 - DNA, 22 bp, Homo sapiens
tctcttctgaaacctgtcttta

SEQ ID NO: 7721709 - DNA, 22 bp, Homo sapiens
tctcttcttgattttcactgga

SEQ ID NO: 7721710 - DNA, 22 bp, Homo sapiens
tctcttctctagtgagcaactg

SEQ ID NO: 7721711 - DNA, 22 bp, Homo sapiens
tctcttcttgattttcactgga

SEQ ID NO: 7721712 - DNA, 22 bp, Homo sapiens
tctcttcttgattttcactgga

SEQ ID NO: 7721713 - DNA, 22 bp, Homo sapiens
tctcttcttgattttcactgga

SEQ ID NO: 7721714 - DNA, 22 bp, Homo sapiens
tctcttcttgattttcactgga

SEQ ID NO: 7721715 - DNA, 22 bp, Homo sapiens
tctcttcttgattttcactgga

SEQ ID NO: 7721716 - DNA, 22 bp, Homo sapiens
tctcttcttgattttcactgga

SEQ ID NO: 7721717 - DNA, 22 bp, Homo sapiens
tctcttcttgtgttttcctgcc

SEQ ID NO: 7721718 - DNA, 22 bp, Homo sapiens
tctcttcttgtgttttcctgcc

SEQ ID NO: 7721719 - DNA, 18 bp, Homo sapiens
tctcttcttggcagtcaa

SEQ ID NO: 7721720 - DNA, 18 bp, Homo sapiens
tctcttcttggcagtcaa

SEQ ID NO: 7721721 - DNA, 18 bp, Homo sapiens
tctcttcttggcagtcaa

SEQ ID NO: 7721722 - DNA, 18 bp, Homo sapiens
tctcttcttggcagtcaa

SEQ ID NO: 7721723 - DNA, 18 bp, Homo sapiens
tctcttcttggcagtcaa

SEQ ID NO: 7721724 - DNA, 22 bp, Homo sapiens
tctctgtgagatttgtattaag

SEQ ID NO: 7721725 - DNA, 22 bp, Homo sapiens
tctctgtgagatttgtattaag

SEQ ID NO: 7721726 - DNA, 22 bp, Homo sapiens
tctctgtgagatgccttcctga

SEQ ID NO: 7721727 - DNA, 22 bp, Homo sapiens
tctctgtgagatttgtattaag

SEQ ID NO: 7721728 - DNA, 22 bp, Homo sapiens
tctctgtgagccaggtcctagt

SEQ ID NO: 7721729 - DNA, 22 bp, Homo sapiens
tctctgtgagatgccttcctga

SEQ ID NO: 7721730 - DNA, 22 bp, Homo sapiens
tctctgtgagccaggtcctagt

SEQ ID NO: 7721731 - DNA, 22 bp, Homo sapiens
tctctgtgagtggaaggcaccc

SEQ ID NO: 7721732 - DNA, 22 bp, Homo sapiens
tctctgtgagtggaaggcaccc

SEQ ID NO: 7721733 - DNA, 22 bp, Homo sapiens
tctctgtgcaggatgctgagtt

SEQ ID NO: 7721734 - DNA, 22 bp, Homo sapiens
tctctgtgcaggatgctgagtt

SEQ ID NO: 7721735 - DNA, 22 bp, Homo sapiens
tctctgtgcaggatgctgagtt

SEQ ID NO: 7721736 - DNA, 22 bp, Homo sapiens
tctctgtgcaggatgctgagtt

SEQ ID NO: 7721737 - DNA, 22 bp, Homo sapiens
tctctgtgaagctcccgttagg

SEQ ID NO: 7721738 - DNA, 22 bp, Homo sapiens
tctctgtgaatggcgtcacctg

SEQ ID NO: 7721739 - DNA, 22 bp, Homo sapiens
tctctgtgaatggcgtcacctg

SEQ ID NO: 7721740 - DNA, 22 bp, Homo sapiens
tctctgtctttgttgtcttcac

SEQ ID NO: 7721741 - DNA, 22 bp, Homo sapiens
tctctgtgacagctgggtatgt

SEQ ID NO: 7721742 - DNA, 22 bp, Homo sapiens
tctctgtgacagctgggtatgt

SEQ ID NO: 7721743 - DNA, 22 bp, Homo sapiens
tctctgtgagatgccttcctga

SEQ ID NO: 7721744 - DNA, 22 bp, Homo sapiens
tctctgtgactgcagctttgca

SEQ ID NO: 7721745 - DNA, 22 bp, Homo sapiens
tctctgtgacatttctgagcct

SEQ ID NO: 7721746 - DNA, 22 bp, Homo sapiens
tctctgtgacatttctgagcct

SEQ ID NO: 7721747 - DNA, 22 bp, Homo sapiens
tctctgtctcccgtgtgtccgg

SEQ ID NO: 7721748 - DNA, 22 bp, Homo sapiens
tctctgtctgagcctggcagac

SEQ ID NO: 7721749 - DNA, 22 bp, Homo sapiens
tctctgtctgagcctggcagac

SEQ ID NO: 7721750 - DNA, 22 bp, Homo sapiens
tctctgtctgagcctggcagac

SEQ ID NO: 7721751 - DNA, 22 bp, Homo sapiens
tctctgtctttgttgtcttcac

SEQ ID NO: 7721752 - DNA, 22 bp, Homo sapiens
tctctgtctttgttgtcttcac

SEQ ID NO: 7721753 - DNA, 22 bp, Homo sapiens
tctctgtctgcacccaatcaat

SEQ ID NO: 7721754 - DNA, 22 bp, Homo sapiens
tctctgtctcccgtgtgtccgg

SEQ ID NO: 7721755 - DNA, 22 bp, Homo sapiens
tctctgtctcccgtgtgtccgg

SEQ ID NO: 7721756 - DNA, 22 bp, Homo sapiens
tctctgtctgagcctggcagac

SEQ ID NO: 7721757 - DNA, 22 bp, Homo sapiens
tctctgtctgagcctggcagac

SEQ ID NO: 7721758 - DNA, 22 bp, Homo sapiens
tctctgtccctaggagccttgc

SEQ ID NO: 7721759 - DNA, 22 bp, Homo sapiens
tctctgtctcccgtgtgtccgg

SEQ ID NO: 7721760 - DNA, 22 bp, Homo sapiens
tctctgtcccctcagctggggt

SEQ ID NO: 7721761 - DNA, 22 bp, Homo sapiens
tctctgtcacacaatctacaca

SEQ ID NO: 7721762 - DNA, 22 bp, Homo sapiens
tctctgtcccctcagctggggt

SEQ ID NO: 7721763 - DNA, 22 bp, Homo sapiens
tctctgtcacacaatctacaca

SEQ ID NO: 7721764 - DNA, 23 bp, Homo sapiens
tctctggttaggggagattggtg

SEQ ID NO: 7721765 - DNA, 22 bp, Homo sapiens
tctctggtggctccatcagtag

SEQ ID NO: 7721766 - DNA, 22 bp, Homo sapiens
tctctggtcccacctggccatt

SEQ ID NO: 7721767 - DNA, 22 bp, Homo sapiens
tctctggtcccacctggccatt

SEQ ID NO: 7721768 - DNA, 22 bp, Homo sapiens
tctctgggtttttgtcctgtac

SEQ ID NO: 7721769 - DNA, 22 bp, Homo sapiens
tctctgggtttttgtcctgtac

SEQ ID NO: 7721770 - DNA, 22 bp, Homo sapiens
tctctgggtttttgtcctgtac

SEQ ID NO: 7721771 - DNA, 22 bp, Homo sapiens
tctctgggtttttgtcctgtac

SEQ ID NO: 7721772 - DNA, 22 bp, Homo sapiens
tctctgggtttttgtcctgtac

SEQ ID NO: 7721773 - DNA, 22 bp, Homo sapiens
tctctgggtttttgtcctgtac

SEQ ID NO: 7721774 - DNA, 22 bp, Homo sapiens
tctctgtggagcagtgtgttca

SEQ ID NO: 7721775 - DNA, 22 bp, Homo sapiens
tctctgtgcttgactttcccat

SEQ ID NO: 7721776 - DNA, 22 bp, Homo sapiens
tctctgtgcaggatgctgagtt

SEQ ID NO: 7721777 - DNA, 22 bp, Homo sapiens
tctctgtgcccagtagttctct

SEQ ID NO: 7721778 - DNA, 22 bp, Homo sapiens
tctctgtgcccagtagttctct

SEQ ID NO: 7721779 - DNA, 22 bp, Homo sapiens
tctctgtggcaacaattcacta

SEQ ID NO: 7721780 - DNA, 22 bp, Homo sapiens
tctctgtggcaacaattcacta

SEQ ID NO: 7721781 - DNA, 22 bp, Homo sapiens
tctctgtggcaactacttagct

SEQ ID NO: 7721782 - DNA, 22 bp, Homo sapiens
tctctgtggagcagtgtgttca

SEQ ID NO: 7721783 - DNA, 22 bp, Homo sapiens
tctctgtggagcagtgtgttca

SEQ ID NO: 7721784 - DNA, 22 bp, Homo sapiens
tctctgtggagcagtgtgttca

SEQ ID NO: 7721785 - DNA, 22 bp, Homo sapiens
tctctgtggagcagtgtgttca

SEQ ID NO: 7721786 - DNA, 21 bp, Homo sapiens
tctctgtggcctaccctctac

SEQ ID NO: 7721787 - DNA, 22 bp, Homo sapiens
tctctgtgggctttggacttga

SEQ ID NO: 7721788 - DNA, 21 bp, Homo sapiens
tctctgtggcctaccctctac

SEQ ID NO: 7721789 - DNA, 22 bp, Homo sapiens
tctctgtggcatccactcaact

SEQ ID NO: 7721790 - DNA, 22 bp, Homo sapiens
tctctgtggcatccactcaact

SEQ ID NO: 7721791 - DNA, 22 bp, Homo sapiens
tctctgtggcaactacttagct

SEQ ID NO: 7721792 - DNA, 22 bp, Homo sapiens
tctctgtggcaactacttagct

SEQ ID NO: 7721793 - DNA, 22 bp, Homo sapiens
tctctgtggcaagcatgctgct

SEQ ID NO: 7721794 - DNA, 22 bp, Homo sapiens
tctctgtggcaagcatgctgct

SEQ ID NO: 7721795 - DNA, 22 bp, Homo sapiens
tctctgtggcaagcatgctgct

SEQ ID NO: 7721796 - DNA, 22 bp, Homo sapiens
tctctgtggcaagcatgctgct

SEQ ID NO: 7721797 - DNA, 22 bp, Homo sapiens
tctctgtgtctcatgttcctat

SEQ ID NO: 7721798 - DNA, 22 bp, Homo sapiens
tctctgtgtcttagtgaaggga

SEQ ID NO: 7721799 - DNA, 22 bp, Homo sapiens
tctctgtgtctcatgttcctat

SEQ ID NO: 7721800 - DNA, 22 bp, Homo sapiens
tctctgtgtctcatgttcctat

SEQ ID NO: 7721801 - DNA, 22 bp, Homo sapiens
tctctgtggtttgagagccggg

SEQ ID NO: 7721802 - DNA, 21 bp, Homo sapiens
tctctgtgtacagtctcaccc

SEQ ID NO: 7721803 - DNA, 21 bp, Homo sapiens
tctctgtgtacagtctcaccc

SEQ ID NO: 7721804 - DNA, 21 bp, Homo sapiens
tctctgtgtacagtctcaccc

SEQ ID NO: 7721805 - DNA, 21 bp, Homo sapiens
tctctgtgtacagtctcaccc

SEQ ID NO: 7721806 - DNA, 21 bp, Homo sapiens
tctctgtggtccaatcccagc

SEQ ID NO: 7721807 - DNA, 22 bp, Homo sapiens
tctctgtggtgggaggctgagt

SEQ ID NO: 7721808 - DNA, 22 bp, Homo sapiens
tctctgtggtgggaggctgagt

SEQ ID NO: 7721809 - DNA, 22 bp, Homo sapiens
tctctgtggtatgtcatagcaa

SEQ ID NO: 7721810 - DNA, 22 bp, Homo sapiens
tctctgtggtatgtcatagcaa

SEQ ID NO: 7721811 - DNA, 22 bp, Homo sapiens
tctctgtggtatgtcatagcaa

SEQ ID NO: 7721812 - DNA, 22 bp, Homo sapiens
tctctgtggtatgtcatagcaa

SEQ ID NO: 7721813 - DNA, 22 bp, Homo sapiens
tctctgtggtactgagagtcta

SEQ ID NO: 7721814 - DNA, 22 bp, Homo sapiens
tctctgtggtactgagagtcta

SEQ ID NO: 7721815 - DNA, 22 bp, Homo sapiens
tctctgtgggtttcaccagcgc

SEQ ID NO: 7721816 - DNA, 22 bp, Homo sapiens
tctctgtgggtttcaccagcgc

SEQ ID NO: 7721817 - DNA, 22 bp, Homo sapiens
tctctgtgggtttcaccagcgc

SEQ ID NO: 7721818 - DNA, 22 bp, Homo sapiens
tctctgtgggtttcaccagcgc

SEQ ID NO: 7721819 - DNA, 22 bp, Homo sapiens
tctctggccccatggctgagct

SEQ ID NO: 7721820 - DNA, 22 bp, Homo sapiens
tctctggccccatggctgagct

SEQ ID NO: 7721821 - DNA, 22 bp, Homo sapiens
tctctggccccatggctgagct

SEQ ID NO: 7721822 - DNA, 22 bp, Homo sapiens
tctctggccccatggctgagct

SEQ ID NO: 7721823 - DNA, 22 bp, Homo sapiens
tctctggccccatggctgagct

SEQ ID NO: 7721824 - DNA, 22 bp, Homo sapiens
tctctggccccatggctgagct

SEQ ID NO: 7721825 - DNA, 22 bp, Homo sapiens
tctctggccccatggctgagct

SEQ ID NO: 7721826 - DNA, 22 bp, Homo sapiens
tctctggccctgttttctatct

SEQ ID NO: 7721827 - DNA, 19 bp, Homo sapiens
tctctggcatagactcaat

SEQ ID NO: 7721828 - DNA, 19 bp, Homo sapiens
tctctggcatagactcaat

SEQ ID NO: 7721829 - DNA, 19 bp, Homo sapiens
tctctggcatagactcaat

SEQ ID NO: 7721830 - DNA, 20 bp, Homo sapiens
tctctggccagaaacaacag

SEQ ID NO: 7721831 - DNA, 19 bp, Homo sapiens
tctctggcagttcagagca

SEQ ID NO: 7721832 - DNA, 23 bp, Homo sapiens
tctctggcctttgatcaggttga

SEQ ID NO: 7721833 - DNA, 22 bp, Homo sapiens
tctctggccgagagtccctggg

SEQ ID NO: 7721834 - DNA, 22 bp, Homo sapiens
tctctggccgagagtccctggg

SEQ ID NO: 7721835 - DNA, 22 bp, Homo sapiens
tctctggccgagagtccctggg

SEQ ID NO: 7721836 - DNA, 22 bp, Homo sapiens
tctctggccgagagtccctggg

SEQ ID NO: 7721837 - DNA, 23 bp, Homo sapiens
tctctggcctttgatcaggttga

SEQ ID NO: 7721838 - DNA, 21 bp, Homo sapiens
tctctggcggtgtttggctcc

SEQ ID NO: 7721839 - DNA, 22 bp, Homo sapiens
tctctggctcctgccgggtcca

SEQ ID NO: 7721840 - DNA, 22 bp, Homo sapiens
tctctggctgatattcctctgc

SEQ ID NO: 7721841 - DNA, 22 bp, Homo sapiens
tctctggctgatattcctctgc

SEQ ID NO: 7721842 - DNA, 22 bp, Homo sapiens
tctctggctcctgccgggtcca

SEQ ID NO: 7721843 - DNA, 22 bp, Homo sapiens
tctctggctggcaccccaggga

SEQ ID NO: 7721844 - DNA, 22 bp, Homo sapiens
tctctggctgatattcctctgc

SEQ ID NO: 7721845 - DNA, 22 bp, Homo sapiens
tctctggctggcaccccaggga

SEQ ID NO: 7721846 - DNA, 22 bp, Homo sapiens
tctctggcagaggccctatccc

SEQ ID NO: 7721847 - DNA, 22 bp, Homo sapiens
tctctggcagaggccctatccc

SEQ ID NO: 7721848 - DNA, 22 bp, Homo sapiens
tctctggcagaggccctatccc

SEQ ID NO: 7721849 - DNA, 22 bp, Homo sapiens
tctctggcagactggctgggct

SEQ ID NO: 7721850 - DNA, 22 bp, Homo sapiens
tctctggcagacacctccctga

SEQ ID NO: 7721851 - DNA, 22 bp, Homo sapiens
tctctggcagactggctgggct

SEQ ID NO: 7721852 - DNA, 22 bp, Homo sapiens
tctctggcagactggctgggct

SEQ ID NO: 7721853 - DNA, 22 bp, Homo sapiens
tctctggcagactggctgggct

SEQ ID NO: 7721854 - DNA, 22 bp, Homo sapiens
tctctggcagaggccctatccc

SEQ ID NO: 7721855 - DNA, 22 bp, Homo sapiens
tctctggcagcttgtgctgttg

SEQ ID NO: 7721856 - DNA, 22 bp, Homo sapiens
tctctggcagcttgtgctgttg

SEQ ID NO: 7721857 - DNA, 22 bp, Homo sapiens
tctctggcagggatatctggct

SEQ ID NO: 7721858 - DNA, 19 bp, Homo sapiens
tctctggcagttcagagca

SEQ ID NO: 7721859 - DNA, 19 bp, Homo sapiens
tctctggcagttcagagca

SEQ ID NO: 7721860 - DNA, 19 bp, Homo sapiens
tctctggcagttcagagca

SEQ ID NO: 7721861 - DNA, 19 bp, Homo sapiens
tctctggatgacagacact

SEQ ID NO: 7721862 - DNA, 21 bp, Homo sapiens
tctctggagttagcagagaga

SEQ ID NO: 7721863 - DNA, 21 bp, Homo sapiens
tctctggagttagcagagaga

SEQ ID NO: 7721864 - DNA, 21 bp, Homo sapiens
tctctggagttagcagagaga

SEQ ID NO: 7721865 - DNA, 20 bp, Homo sapiens
tctctggcaagaagctgcag

SEQ ID NO: 7721866 - DNA, 19 bp, Homo sapiens
tctctggatgacagacact

SEQ ID NO: 7721867 - DNA, 20 bp, Homo sapiens
tctctggcaagaagctgcag

SEQ ID NO: 7721868 - DNA, 20 bp, Homo sapiens
tctctggcaagaagctgcag

SEQ ID NO: 7721869 - DNA, 19 bp, Homo sapiens
tctctggatgacagacact

SEQ ID NO: 7721870 - DNA, 22 bp, Homo sapiens
tctctggcacataataaggtct

SEQ ID NO: 7721871 - DNA, 20 bp, Homo sapiens
tctctggcaagaagctgcag

SEQ ID NO: 7721872 - DNA, 22 bp, Homo sapiens
tctctggcacataataaggtct

SEQ ID NO: 7721873 - DNA, 22 bp, Homo sapiens
tctctggcactcccttatggct

SEQ ID NO: 7721874 - DNA, 22 bp, Homo sapiens
tctctggcagacacctccctga

SEQ ID NO: 7721875 - DNA, 22 bp, Homo sapiens
tctctggcactcccttatggct

SEQ ID NO: 7721876 - DNA, 22 bp, Homo sapiens
tctctggcagacacctccctga

SEQ ID NO: 7721877 - DNA, 22 bp, Homo sapiens
tctctggcagacacctccctga

SEQ ID NO: 7721878 - DNA, 22 bp, Homo sapiens
tctctgcccatgagcaatctgc

SEQ ID NO: 7721879 - DNA, 19 bp, Homo sapiens
tctctgccgatcagggccc

SEQ ID NO: 7721880 - DNA, 22 bp, Homo sapiens
tctctgagttctcctccagccc

SEQ ID NO: 7721881 - DNA, 22 bp, Homo sapiens
tctctgagttctcctccagccc

SEQ ID NO: 7721882 - DNA, 22 bp, Homo sapiens
tctctgagttctcctccagccc

SEQ ID NO: 7721883 - DNA, 22 bp, Homo sapiens
tctctgagttctcctccagccc

SEQ ID NO: 7721884 - DNA, 22 bp, Homo sapiens
tctctgagttctcctccagccc

SEQ ID NO: 7721885 - DNA, 22 bp, Homo sapiens
tctctgagttctcctccagccc

SEQ ID NO: 7721886 - DNA, 22 bp, Homo sapiens
tctctgctaagattgtgtctag

SEQ ID NO: 7721887 - DNA, 22 bp, Homo sapiens
tctctgctaagattgtgtctag

SEQ ID NO: 7721888 - DNA, 22 bp, Homo sapiens
tctctgctaagattgtgtctag

SEQ ID NO: 7721889 - DNA, 22 bp, Homo sapiens
tctctgctaagattgtgtctag

SEQ ID NO: 7721890 - DNA, 22 bp, Homo sapiens
tctctgctcaggcaccagccct

SEQ ID NO: 7721891 - DNA, 22 bp, Homo sapiens
tctctgctcaggcaccagccct

SEQ ID NO: 7721892 - DNA, 22 bp, Homo sapiens
tctctgctcaggcaccagccct

SEQ ID NO: 7721893 - DNA, 22 bp, Homo sapiens
tctctgctctgtgcctcagttt

SEQ ID NO: 7721894 - DNA, 22 bp, Homo sapiens
tctctgctctgtgcctcagttt

SEQ ID NO: 7721895 - DNA, 22 bp, Homo sapiens
tctctgctctgtgcctcagttt

SEQ ID NO: 7721896 - DNA, 22 bp, Homo sapiens
tctctgctctgtgcctcagttt

SEQ ID NO: 7721897 - DNA, 22 bp, Homo sapiens
tctctgctctgtgcctcagttt

SEQ ID NO: 7721898 - DNA, 22 bp, Homo sapiens
tctctgctctgtgcctcagttt

SEQ ID NO: 7721899 - DNA, 22 bp, Homo sapiens
tctctgctctgtgcctcagttt

SEQ ID NO: 7721900 - DNA, 22 bp, Homo sapiens
tctctgctctgtgcctcagttt

SEQ ID NO: 7721901 - DNA, 19 bp, Homo sapiens
tctctgcttctcttggcat

SEQ ID NO: 7721902 - DNA, 19 bp, Homo sapiens
tctctgcttctcttggcat

SEQ ID NO: 7721903 - DNA, 19 bp, Homo sapiens
tctctgcttctcttggcat

SEQ ID NO: 7721904 - DNA, 19 bp, Homo sapiens
tctctgcttctcttggcat

SEQ ID NO: 7721905 - DNA, 16 bp, Homo sapiens
tctctgcttcataggt

SEQ ID NO: 7721906 - DNA, 20 bp, Homo sapiens
tctctgctgtccacatttgc

SEQ ID NO: 7721907 - DNA, 19 bp, Homo sapiens
tctctgcttctcttggcat

SEQ ID NO: 7721908 - DNA, 20 bp, Homo sapiens
tctctgctgtccacatttgc

SEQ ID NO: 7721909 - DNA, 22 bp, Homo sapiens
tctctgctgagaagggctggca

SEQ ID NO: 7721910 - DNA, 20 bp, Homo sapiens
tctctgctgtccacatttgc

SEQ ID NO: 7721911 - DNA, 22 bp, Homo sapiens
tctctggagtataaccagggat

SEQ ID NO: 7721912 - DNA, 22 bp, Homo sapiens
tctctggagtataaccagggat

SEQ ID NO: 7721913 - DNA, 22 bp, Homo sapiens
tctctggagggctccaggcggg

SEQ ID NO: 7721914 - DNA, 22 bp, Homo sapiens
tctctggagtataaccagggat

SEQ ID NO: 7721915 - DNA, 22 bp, Homo sapiens
tctctggagggctccaggcggg

SEQ ID NO: 7721916 - DNA, 22 bp, Homo sapiens
tctctggagggctccaggcggg

SEQ ID NO: 7721917 - DNA, 22 bp, Homo sapiens
tctctggagggctccaggcggg

SEQ ID NO: 7721918 - DNA, 22 bp, Homo sapiens
tctctggagctgcagatccagg

SEQ ID NO: 7721919 - DNA, 22 bp, Homo sapiens
tctctggagctgcagatccagg

SEQ ID NO: 7721920 - DNA, 22 bp, Homo sapiens
tctctggagggctccaggcggg

SEQ ID NO: 7721921 - DNA, 22 bp, Homo sapiens
tctctggactcgagcttactca

SEQ ID NO: 7721922 - DNA, 22 bp, Homo sapiens
tctctggacttccacctctatt

SEQ ID NO: 7721923 - DNA, 22 bp, Homo sapiens
tctctggacttccacctctatt

SEQ ID NO: 7721924 - DNA, 22 bp, Homo sapiens
tctctggaattttgagagtgac

SEQ ID NO: 7721925 - DNA, 22 bp, Homo sapiens
tctctggaattttgagagtgac

SEQ ID NO: 7721926 - DNA, 22 bp, Homo sapiens
tctctggaattttgagagtgac

SEQ ID NO: 7721927 - DNA, 22 bp, Homo sapiens
tctctggaattttgagagtgac

SEQ ID NO: 7721928 - DNA, 22 bp, Homo sapiens
tctctggaattggctgaggcaa

SEQ ID NO: 7721929 - DNA, 22 bp, Homo sapiens
tctctggaattggctgaggcaa

SEQ ID NO: 7721930 - DNA, 21 bp, Homo sapiens
tctctggaattagaccatgtt

SEQ ID NO: 7721931 - DNA, 21 bp, Homo sapiens
tctctggaattagaccatgtt

SEQ ID NO: 7721932 - DNA, 21 bp, Homo sapiens
tctctggaattagaccatgtt

SEQ ID NO: 7721933 - DNA, 21 bp, Homo sapiens
tctctggaattagaccatgtt

SEQ ID NO: 7721934 - DNA, 22 bp, Homo sapiens
tctctggaagcgcagatctgtt

SEQ ID NO: 7721935 - DNA, 22 bp, Homo sapiens
tctctgcttggtgtatgtgagt

SEQ ID NO: 7721936 - DNA, 22 bp, Homo sapiens
tctctgcttggtgtatgtgagt

SEQ ID NO: 7721937 - DNA, 23 bp, Homo sapiens
tctctggaactggagagtacggt

SEQ ID NO: 7721938 - DNA, 22 bp, Homo sapiens
tctctgcttggtgtatgtgagt

SEQ ID NO: 7721939 - DNA, 19 bp, Homo sapiens
tctctgcttctcttggcat

SEQ ID NO: 7721940 - DNA, 22 bp, Homo sapiens
tctctggctggcaccccaggga

SEQ ID NO: 7721941 - DNA, 22 bp, Homo sapiens
tctctggctggcaccccaggga

SEQ ID NO: 7721942 - DNA, 22 bp, Homo sapiens
tctctggctggcaccccaggga

SEQ ID NO: 7721943 - DNA, 19 bp, Homo sapiens
tctctggcttgtctgcctg

SEQ ID NO: 7721944 - DNA, 22 bp, Homo sapiens
tctctggcttaggttgagtgca

SEQ ID NO: 7721945 - DNA, 22 bp, Homo sapiens
tctctggcttaggttgagtgca

SEQ ID NO: 7721946 - DNA, 19 bp, Homo sapiens
tctctggcttgtctgcctg

SEQ ID NO: 7721947 - DNA, 19 bp, Homo sapiens
tctctggcttgtctgcctg

SEQ ID NO: 7721948 - DNA, 22 bp, Homo sapiens
tctctgggaaatggagaatttt

SEQ ID NO: 7721949 - DNA, 19 bp, Homo sapiens
tctctggcttgtctgcctg

SEQ ID NO: 7721950 - DNA, 22 bp, Homo sapiens
tctctgggatcaggtggcccag

SEQ ID NO: 7721951 - DNA, 21 bp, Homo sapiens
tctctgggccctcctgtgggg

SEQ ID NO: 7721952 - DNA, 21 bp, Homo sapiens
tctctgggccctcctgtgggg

SEQ ID NO: 7721953 - DNA, 22 bp, Homo sapiens
tctctgggcccagaccttcctt

SEQ ID NO: 7721954 - DNA, 22 bp, Homo sapiens
tctctgggcccagaccttcctt

SEQ ID NO: 7721955 - DNA, 22 bp, Homo sapiens
tctctgggatcgttttgggctc

SEQ ID NO: 7721956 - DNA, 22 bp, Homo sapiens
tctctgggatcgttttgggctc

SEQ ID NO: 7721957 - DNA, 22 bp, Homo sapiens
tctctgggcccagaccttcctt

SEQ ID NO: 7721958 - DNA, 21 bp, Homo sapiens
tctctgggccctcctgtgggg

SEQ ID NO: 7721959 - DNA, 22 bp, Homo sapiens
tctctgggcctcagttttctca

SEQ ID NO: 7721960 - DNA, 21 bp, Homo sapiens
tctctgggccctcctgtgggg

SEQ ID NO: 7721961 - DNA, 22 bp, Homo sapiens
tctctgggcctcagttttctca

SEQ ID NO: 7721962 - DNA, 22 bp, Homo sapiens
tctctgggcctgttttctcatc

SEQ ID NO: 7721963 - DNA, 22 bp, Homo sapiens
tctctgggcctgttttctcatc

SEQ ID NO: 7721964 - DNA, 22 bp, Homo sapiens
tctctgggctaaaatcaaggtg

SEQ ID NO: 7721965 - DNA, 22 bp, Homo sapiens
tctctgggctaaaatcaaggtg

SEQ ID NO: 7721966 - DNA, 22 bp, Homo sapiens
tctctgggctcaggagcccggc

SEQ ID NO: 7721967 - DNA, 22 bp, Homo sapiens
tctctgggctcaggagcccggc

SEQ ID NO: 7721968 - DNA, 22 bp, Homo sapiens
tctctgggctcaggagcccggc

SEQ ID NO: 7721969 - DNA, 22 bp, Homo sapiens
tctctgggctaaaatcaaggtg

SEQ ID NO: 7721970 - DNA, 22 bp, Homo sapiens
tctctgggcctccctttccaag

SEQ ID NO: 7721971 - DNA, 22 bp, Homo sapiens
tctctgggcctccctttccaag

SEQ ID NO: 7721972 - DNA, 22 bp, Homo sapiens
tctctgggcctccctttccaag

SEQ ID NO: 7721973 - DNA, 22 bp, Homo sapiens
tctctgggcctgttttctcatc

SEQ ID NO: 7721974 - DNA, 22 bp, Homo sapiens
tctctggggaaaaggctgatac

SEQ ID NO: 7721975 - DNA, 22 bp, Homo sapiens
tctctggggaaaaggctgatac

SEQ ID NO: 7721976 - DNA, 22 bp, Homo sapiens
tctctgggctcaggagcccggc

SEQ ID NO: 7721977 - DNA, 22 bp, Homo sapiens
tctctggggaaaaggctgatac

SEQ ID NO: 7721978 - DNA, 22 bp, Homo sapiens
tctctggggaaaaggctgatac

SEQ ID NO: 7721979 - DNA, 22 bp, Homo sapiens
tctctgggctcaggagcccggc

SEQ ID NO: 7721980 - DNA, 22 bp, Homo sapiens
tctctgggctcaggagcccggc

SEQ ID NO: 7721981 - DNA, 22 bp, Homo sapiens
tctctggggatgcttattcttg

SEQ ID NO: 7721982 - DNA, 19 bp, Homo sapiens
tctctggggacactttcac

SEQ ID NO: 7721983 - DNA, 22 bp, Homo sapiens
tctctggggatgcttattcttg

SEQ ID NO: 7721984 - DNA, 19 bp, Homo sapiens
tctctggggacactttcac

SEQ ID NO: 7721985 - DNA, 19 bp, Homo sapiens
tctctggggacactttcac

SEQ ID NO: 7721986 - DNA, 23 bp, Homo sapiens
tctctgggtgggctgtgtctata

SEQ ID NO: 7721987 - DNA, 23 bp, Homo sapiens
tctctgggtgggctgtgtctata

SEQ ID NO: 7721988 - DNA, 22 bp, Homo sapiens
tctctgggtgatggcagggcac

SEQ ID NO: 7721989 - DNA, 22 bp, Homo sapiens
tctctgggtgatggcagggcac

SEQ ID NO: 7721990 - DNA, 22 bp, Homo sapiens
tctctgggtgatggcagggcac

SEQ ID NO: 7721991 - DNA, 22 bp, Homo sapiens
tctctgggtgatggcagggcac

SEQ ID NO: 7721992 - DNA, 22 bp, Homo sapiens
tctctgggtgatggcagggcac

SEQ ID NO: 7721993 - DNA, 22 bp, Homo sapiens
tctctgggtgatggcagggcac

SEQ ID NO: 7721994 - DNA, 22 bp, Homo sapiens
tctctgggtgatggcagggcac

SEQ ID NO: 7721995 - DNA, 22 bp, Homo sapiens
tctctgggtcctggcaagctca

SEQ ID NO: 7721996 - DNA, 22 bp, Homo sapiens
tctctgggtcctggcaagctca

SEQ ID NO: 7721997 - DNA, 22 bp, Homo sapiens
tctctgggttctcactcagcac

SEQ ID NO: 7721998 - DNA, 20 bp, Homo sapiens
tctctgggttctcactcagc

SEQ ID NO: 7721999 - DNA, 22 bp, Homo sapiens
tctctgggttctcactcagcac

SEQ ID NO: 7722000 - DNA, 22 bp, Homo sapiens
tctctgggttctcactcagcac

SEQ ID NO: 7722001 - DNA, 22 bp, Homo sapiens
tctctgggttgagaactaggac

SEQ ID NO: 7722002 - DNA, 22 bp, Homo sapiens
tctctgggttgagaactaggac

SEQ ID NO: 7722003 - DNA, 22 bp, Homo sapiens
tctctggggatggacctgggag

SEQ ID NO: 7722004 - DNA, 22 bp, Homo sapiens
tctctggggatggacctgggag

SEQ ID NO: 7722005 - DNA, 22 bp, Homo sapiens
tctctggggatgcttattcttg

SEQ ID NO: 7722006 - DNA, 22 bp, Homo sapiens
tctctggggatggacctgggag

SEQ ID NO: 7722007 - DNA, 22 bp, Homo sapiens
tctctggggcctttctacatca

SEQ ID NO: 7722008 - DNA, 22 bp, Homo sapiens
tctctggggcctttctacatca

SEQ ID NO: 7722009 - DNA, 22 bp, Homo sapiens
tctctggggtagggcccaggac

SEQ ID NO: 7722010 - DNA, 22 bp, Homo sapiens
tctctgggggtagaactcaggc

SEQ ID NO: 7722011 - DNA, 22 bp, Homo sapiens
tctctgggtattcactgccttc

SEQ ID NO: 7722012 - DNA, 22 bp, Homo sapiens
tctctgggtattcactgccttc

SEQ ID NO: 7722013 - DNA, 22 bp, Homo sapiens
tctctgggtatggtaacgttgg

SEQ ID NO: 7722014 - DNA, 22 bp, Homo sapiens
tctctgggtaaagttctctcat

SEQ ID NO: 7722015 - DNA, 22 bp, Homo sapiens
tctctgggtattcactgccttc

SEQ ID NO: 7722016 - DNA, 22 bp, Homo sapiens
tctctgggtcctggcaagctca

SEQ ID NO: 7722017 - DNA, 22 bp, Homo sapiens
tctctgggtcctggcaagctca

SEQ ID NO: 7722018 - DNA, 22 bp, Homo sapiens
tctctgggtcctggcaagctca

SEQ ID NO: 7722019 - DNA, 22 bp, Homo sapiens
tctctggggtagggcccaggac

SEQ ID NO: 7722020 - DNA, 22 bp, Homo sapiens
tctctgggtaaagttctctcat

SEQ ID NO: 7722021 - DNA, 22 bp, Homo sapiens
tctctgggtaaagttctctcat

SEQ ID NO: 7722022 - DNA, 22 bp, Homo sapiens
tctctcagaaagcccatgtctg

SEQ ID NO: 7722023 - DNA, 22 bp, Homo sapiens
tctctcagaaagcccatgtctg

SEQ ID NO: 7722024 - DNA, 22 bp, Homo sapiens
tctctcagaactgcagctgcag

SEQ ID NO: 7722025 - DNA, 22 bp, Homo sapiens
tctctcagaaagcccatgtctg

SEQ ID NO: 7722026 - DNA, 22 bp, Homo sapiens
tctctcagaaagcccatgtctg

SEQ ID NO: 7722027 - DNA, 22 bp, Homo sapiens
tctctcagaaagcccatgtctg

SEQ ID NO: 7722028 - DNA, 22 bp, Homo sapiens
tctctcagactccccatggttt

SEQ ID NO: 7722029 - DNA, 22 bp, Homo sapiens
tctctcagaggaagaggcagtg

SEQ ID NO: 7722030 - DNA, 22 bp, Homo sapiens
tctctcagaggaagaggcagtg

SEQ ID NO: 7722031 - DNA, 22 bp, Homo sapiens
tctctcagaggaagaggcagtg

SEQ ID NO: 7722032 - DNA, 22 bp, Homo sapiens
tctctcagaggaagaggcagtg

SEQ ID NO: 7722033 - DNA, 22 bp, Homo sapiens
tctctcagaggaagaggcagtg

SEQ ID NO: 7722034 - DNA, 20 bp, Homo sapiens
tctctcacgggttggtttct

SEQ ID NO: 7722035 - DNA, 22 bp, Homo sapiens
tctctcaccctggaaaagccaa

SEQ ID NO: 7722036 - DNA, 22 bp, Homo sapiens
tctctcactggtgcctctgttg

SEQ ID NO: 7722037 - DNA, 19 bp, Homo sapiens
tctctcaattgcttcaatt

SEQ ID NO: 7722038 - DNA, 22 bp, Homo sapiens
tctctcactggtgcctctgttg

SEQ ID NO: 7722039 - DNA, 22 bp, Homo sapiens
tctctcactggtgcctctgttg

SEQ ID NO: 7722040 - DNA, 22 bp, Homo sapiens
tctctattaattgacaatggct

SEQ ID NO: 7722041 - DNA, 20 bp, Homo sapiens
tctctattcccacgaggaaa

SEQ ID NO: 7722042 - DNA, 22 bp, Homo sapiens
tctctcaaatatctaacacctc

SEQ ID NO: 7722043 - DNA, 22 bp, Homo sapiens
tctctatttgcctaggcttgtg

SEQ ID NO: 7722044 - DNA, 22 bp, Homo sapiens
tctctatttgcctaggcttgtg

SEQ ID NO: 7722045 - DNA, 20 bp, Homo sapiens
tctctattcccacgaggaaa

SEQ ID NO: 7722046 - DNA, 22 bp, Homo sapiens
tctctattaattgacaatggct

SEQ ID NO: 7722047 - DNA, 22 bp, Homo sapiens
tctctatgtgcacaccttggtg

SEQ ID NO: 7722048 - DNA, 20 bp, Homo sapiens
tctctatgaagtcaacagga

SEQ ID NO: 7722049 - DNA, 22 bp, Homo sapiens
tctctcagggggaaggctgaag

SEQ ID NO: 7722050 - DNA, 22 bp, Homo sapiens
tctctcagggggaaggctgaag

SEQ ID NO: 7722051 - DNA, 22 bp, Homo sapiens
tctctcagggggaaggctgaag

SEQ ID NO: 7722052 - DNA, 22 bp, Homo sapiens
tctctcagggggaaggctgaag

SEQ ID NO: 7722053 - DNA, 18 bp, Homo sapiens
tctctcagggaaacagaa

SEQ ID NO: 7722054 - DNA, 18 bp, Homo sapiens
tctctcagggaaacagaa

SEQ ID NO: 7722055 - DNA, 18 bp, Homo sapiens
tctctcagggaaacagaa

SEQ ID NO: 7722056 - DNA, 22 bp, Homo sapiens
tctctcatagagaaaaatatat

SEQ ID NO: 7722057 - DNA, 22 bp, Homo sapiens
tctctcagtcagatgctaaaga

SEQ ID NO: 7722058 - DNA, 22 bp, Homo sapiens
tctctcagatggggcactagta

SEQ ID NO: 7722059 - DNA, 22 bp, Homo sapiens
tctctcagatggggcactagta

SEQ ID NO: 7722060 - DNA, 22 bp, Homo sapiens
tctctcagatggggcactagta

SEQ ID NO: 7722061 - DNA, 22 bp, Homo sapiens
tctctcagaggccagggtcctg

SEQ ID NO: 7722062 - DNA, 22 bp, Homo sapiens
tctctcagaggaagaggcagtg

SEQ ID NO: 7722063 - DNA, 22 bp, Homo sapiens
tctctcagatggggcactagta

SEQ ID NO: 7722064 - DNA, 22 bp, Homo sapiens
tctctcagatggggcactagta

SEQ ID NO: 7722065 - DNA, 22 bp, Homo sapiens
tctctcagctttgagacctgct

SEQ ID NO: 7722066 - DNA, 22 bp, Homo sapiens
tctctcagctttgagacctgct

SEQ ID NO: 7722067 - DNA, 22 bp, Homo sapiens
tctctcagctttgagacctgct

SEQ ID NO: 7722068 - DNA, 22 bp, Homo sapiens
tctctcaggaggcaggttccta

SEQ ID NO: 7722069 - DNA, 22 bp, Homo sapiens
tctctcaggctggagtgcagtg

SEQ ID NO: 7722070 - DNA, 22 bp, Homo sapiens
tctctcaggctggagtgcagtg

SEQ ID NO: 7722071 - DNA, 22 bp, Homo sapiens
tctctcaggctggagtgcagtg

SEQ ID NO: 7722072 - DNA, 22 bp, Homo sapiens
tctctcaggctggagtgcagtg

SEQ ID NO: 7722073 - DNA, 22 bp, Homo sapiens
tctctctatttatttgtcttgt

SEQ ID NO: 7722074 - DNA, 22 bp, Homo sapiens
tctctctatatgtcaacagggg

SEQ ID NO: 7722075 - DNA, 22 bp, Homo sapiens
tctctctcagccattacagaac

SEQ ID NO: 7722076 - DNA, 22 bp, Homo sapiens
tctctcgactcacaagttttgc

SEQ ID NO: 7722077 - DNA, 22 bp, Homo sapiens
tctctctcagccattacagaac

SEQ ID NO: 7722078 - DNA, 22 bp, Homo sapiens
tctctctcagccattacagaac

SEQ ID NO: 7722079 - DNA, 22 bp, Homo sapiens
tctctcctgtgttctgatgttt

SEQ ID NO: 7722080 - DNA, 22 bp, Homo sapiens
tctctcctgtgttctgatgttt

SEQ ID NO: 7722081 - DNA, 22 bp, Homo sapiens
tctctccttatcattgtgttta

SEQ ID NO: 7722082 - DNA, 22 bp, Homo sapiens
tctctcctgtgttctgatgttt

SEQ ID NO: 7722083 - DNA, 22 bp, Homo sapiens
tctctctactggggcactagga

SEQ ID NO: 7722084 - DNA, 22 bp, Homo sapiens
tctctccttatcattgtgttta

SEQ ID NO: 7722085 - DNA, 22 bp, Homo sapiens
tctctctactggggcactagga

SEQ ID NO: 7722086 - DNA, 22 bp, Homo sapiens
tctctccttatcattgtgttta

SEQ ID NO: 7722087 - DNA, 22 bp, Homo sapiens
tctctcctgtgttctgatgttt

SEQ ID NO: 7722088 - DNA, 22 bp, Homo sapiens
tctctccttatcattgtgttta

SEQ ID NO: 7722089 - DNA, 22 bp, Homo sapiens
tctctccttatcattgtgttta

SEQ ID NO: 7722090 - DNA, 18 bp, Homo sapiens
tctctctgaagagttccc

SEQ ID NO: 7722091 - DNA, 18 bp, Homo sapiens
tctctctgaagagttccc

SEQ ID NO: 7722092 - DNA, 18 bp, Homo sapiens
tctctctgaagagttccc

SEQ ID NO: 7722093 - DNA, 22 bp, Homo sapiens
tctctctcctagtttttagtgg

SEQ ID NO: 7722094 - DNA, 18 bp, Homo sapiens
tctctctgaagagttccc

SEQ ID NO: 7722095 - DNA, 22 bp, Homo sapiens
tctctctcctagtttttagtgg

SEQ ID NO: 7722096 - DNA, 22 bp, Homo sapiens
tctctctcctagtttttagtgg

SEQ ID NO: 7722097 - DNA, 22 bp, Homo sapiens
tctctctgagttgagcaggagt

SEQ ID NO: 7722098 - DNA, 22 bp, Homo sapiens
tctctctgagccctgctttttc

SEQ ID NO: 7722099 - DNA, 22 bp, Homo sapiens
tctctctgagccctgctttttc

SEQ ID NO: 7722100 - DNA, 22 bp, Homo sapiens
tctctctgagccctgctttttc

SEQ ID NO: 7722101 - DNA, 22 bp, Homo sapiens
tctctctgagccctgctttttc

SEQ ID NO: 7722102 - DNA, 22 bp, Homo sapiens
tctctctgagttgagcaggagt

SEQ ID NO: 7722103 - DNA, 22 bp, Homo sapiens
tctctctgagttgagcaggagt

SEQ ID NO: 7722104 - DNA, 22 bp, Homo sapiens
tctctctgagttgagcaggagt

SEQ ID NO: 7722105 - DNA, 22 bp, Homo sapiens
tctctctgagttgagcaggagt

SEQ ID NO: 7722106 - DNA, 18 bp, Homo sapiens
tctctctgataacatttt

SEQ ID NO: 7722107 - DNA, 18 bp, Homo sapiens
tctctctgataacatttt

SEQ ID NO: 7722108 - DNA, 22 bp, Homo sapiens
tctctctgcagcccgggacact

SEQ ID NO: 7722109 - DNA, 22 bp, Homo sapiens
tctctcctaatttcaggtgctt

SEQ ID NO: 7722110 - DNA, 22 bp, Homo sapiens
tctctcctaatttcaggtgctt

SEQ ID NO: 7722111 - DNA, 22 bp, Homo sapiens
tctctcctaatttcaggtgctt

SEQ ID NO: 7722112 - DNA, 22 bp, Homo sapiens
tctctcctaatttcaggtgctt

SEQ ID NO: 7722113 - DNA, 22 bp, Homo sapiens
tctctcctaatttcaggtgctt

SEQ ID NO: 7722114 - DNA, 22 bp, Homo sapiens
tctctccctttccttatcagtt

SEQ ID NO: 7722115 - DNA, 22 bp, Homo sapiens
tctctcccctggccgctacgcg

SEQ ID NO: 7722116 - DNA, 22 bp, Homo sapiens
tctctccctttccttatcagtt

SEQ ID NO: 7722117 - DNA, 22 bp, Homo sapiens
tctctccctttccttatcagtt

SEQ ID NO: 7722118 - DNA, 22 bp, Homo sapiens
tctctcccaaatctgcagatag

SEQ ID NO: 7722119 - DNA, 18 bp, Homo sapiens
tctctccatctatttgtt

SEQ ID NO: 7722120 - DNA, 22 bp, Homo sapiens
tctctcccaaatctgcagatag

SEQ ID NO: 7722121 - DNA, 22 bp, Homo sapiens
tctctcccaaatctgcagatag

SEQ ID NO: 7722122 - DNA, 22 bp, Homo sapiens
tctctcccctggccgctacgcg

SEQ ID NO: 7722123 - DNA, 22 bp, Homo sapiens
tctctcccaaatctgcagatag

SEQ ID NO: 7722124 - DNA, 21 bp, Homo sapiens
tctctcctcaagctcgacccc

SEQ ID NO: 7722125 - DNA, 21 bp, Homo sapiens
tctctcctcaagctcgacccc

SEQ ID NO: 7722126 - DNA, 21 bp, Homo sapiens
tctctcctcaagctcgacccc

SEQ ID NO: 7722127 - DNA, 21 bp, Homo sapiens
tctctcctcaagctcgacccc

SEQ ID NO: 7722128 - DNA, 22 bp, Homo sapiens
tctctcctccacaccgggtgct

SEQ ID NO: 7722129 - DNA, 22 bp, Homo sapiens
tctctcctctagtcagggtggt

SEQ ID NO: 7722130 - DNA, 22 bp, Homo sapiens
tctctcctgcactgaattatgt

SEQ ID NO: 7722131 - DNA, 22 bp, Homo sapiens
tctctcctgcactgaattatgt

SEQ ID NO: 7722132 - DNA, 22 bp, Homo sapiens
tctctcctgtgttctgatgttt

SEQ ID NO: 7722133 - DNA, 22 bp, Homo sapiens
tctctcctgtgttctgatgttt

SEQ ID NO: 7722134 - DNA, 22 bp, Homo sapiens
tctctcctgtgttctgatgttt

SEQ ID NO: 7722135 - DNA, 22 bp, Homo sapiens
tctctgaattctgatgcaagtg

SEQ ID NO: 7722136 - DNA, 22 bp, Homo sapiens
tctctgaattgtttaagttatt

SEQ ID NO: 7722137 - DNA, 22 bp, Homo sapiens
tctctgaattgtttaagttatt

SEQ ID NO: 7722138 - DNA, 22 bp, Homo sapiens
tctctgacagtgaaagagttca

SEQ ID NO: 7722139 - DNA, 22 bp, Homo sapiens
tctctgacatgcctaagacttt

SEQ ID NO: 7722140 - DNA, 22 bp, Homo sapiens
tctctgaattgtttaagttatt

SEQ ID NO: 7722141 - DNA, 18 bp, Homo sapiens
tctctgaatattttatgt

SEQ ID NO: 7722142 - DNA, 18 bp, Homo sapiens
tctctgaatattttatgt

SEQ ID NO: 7722143 - DNA, 22 bp, Homo sapiens
tctctgaattctgatgcaagtg

SEQ ID NO: 7722144 - DNA, 22 bp, Homo sapiens
tctctgaaggggagctgtttaa

SEQ ID NO: 7722145 - DNA, 22 bp, Homo sapiens
tctctgaaggctgtgttgatgg

SEQ ID NO: 7722146 - DNA, 22 bp, Homo sapiens
tctctgaagctcaattgagata

SEQ ID NO: 7722147 - DNA, 22 bp, Homo sapiens
tctctgaataatgctattcttt

SEQ ID NO: 7722148 - DNA, 22 bp, Homo sapiens
tctctgaagctgttgtagtctc

SEQ ID NO: 7722149 - DNA, 22 bp, Homo sapiens
tctctgaaggctgtgttgatgg

SEQ ID NO: 7722150 - DNA, 22 bp, Homo sapiens
tctctgagaatatcccataaga

SEQ ID NO: 7722151 - DNA, 22 bp, Homo sapiens
tctctgagaagttcctttgtga

SEQ ID NO: 7722152 - DNA, 22 bp, Homo sapiens
tctctgagaagttcctttgtga

SEQ ID NO: 7722153 - DNA, 22 bp, Homo sapiens
tctctgagaagttcctttgtga

SEQ ID NO: 7722154 - DNA, 18 bp, Homo sapiens
tctctgagaatattaatg

SEQ ID NO: 7722155 - DNA, 22 bp, Homo sapiens
tctctgagaatatcccataaga

SEQ ID NO: 7722156 - DNA, 22 bp, Homo sapiens
tctctgagaatatcccataaga

SEQ ID NO: 7722157 - DNA, 22 bp, Homo sapiens
tctctgagaagctgaggctggg

SEQ ID NO: 7722158 - DNA, 22 bp, Homo sapiens
tctctgacttgatgcaatggcc

SEQ ID NO: 7722159 - DNA, 20 bp, Homo sapiens
tctctgacttctccccgcct

SEQ ID NO: 7722160 - DNA, 22 bp, Homo sapiens
tctctgacttgatgcaatggcc

SEQ ID NO: 7722161 - DNA, 22 bp, Homo sapiens
tctctgagaaacatgttcaaag

SEQ ID NO: 7722162 - DNA, 22 bp, Homo sapiens
tctctgagaagttcctttgtga

SEQ ID NO: 7722163 - DNA, 22 bp, Homo sapiens
tctctgagaagctgaggctggg

SEQ ID NO: 7722164 - DNA, 22 bp, Homo sapiens
tctctgagaagctgaggctggg

SEQ ID NO: 7722165 - DNA, 22 bp, Homo sapiens
tctctgacatgcctaagacttt

SEQ ID NO: 7722166 - DNA, 22 bp, Homo sapiens
tctctgaccaagagaattggta

SEQ ID NO: 7722167 - DNA, 22 bp, Homo sapiens
tctctgaccaagagaattggta

SEQ ID NO: 7722168 - DNA, 21 bp, Homo sapiens
tctctgacccaggaagagggc

SEQ ID NO: 7722169 - DNA, 22 bp, Homo sapiens
tctctgacatgcctaagacttt

SEQ ID NO: 7722170 - DNA, 22 bp, Homo sapiens
tctctgaccactgagggattta

SEQ ID NO: 7722171 - DNA, 22 bp, Homo sapiens
tctctgactcatatttgtgcct

SEQ ID NO: 7722172 - DNA, 22 bp, Homo sapiens
tctctgactcatatttgtgcct

SEQ ID NO: 7722173 - DNA, 22 bp, Homo sapiens
tctctgactaggtctgattttc

SEQ ID NO: 7722174 - DNA, 22 bp, Homo sapiens
tctctgactaggtctgattttc

SEQ ID NO: 7722175 - DNA, 22 bp, Homo sapiens
tctctgactggcctttcacctg

SEQ ID NO: 7722176 - DNA, 22 bp, Homo sapiens
tctctgactggcctttcacctg

SEQ ID NO: 7722177 - DNA, 20 bp, Homo sapiens
tctctgacttctccccgcct

SEQ ID NO: 7722178 - DNA, 22 bp, Homo sapiens
tctctgactggcctttcacctg

SEQ ID NO: 7722179 - DNA, 22 bp, Homo sapiens
tctctgaagatatttattatta

SEQ ID NO: 7722180 - DNA, 22 bp, Homo sapiens
tctctgaagagtcagacataac

SEQ ID NO: 7722181 - DNA, 22 bp, Homo sapiens
tctctgaagagtcagacataac

SEQ ID NO: 7722182 - DNA, 22 bp, Homo sapiens
tctctgaagctcaattgagata

SEQ ID NO: 7722183 - DNA, 22 bp, Homo sapiens
tctctgaagatatttattatta

SEQ ID NO: 7722184 - DNA, 22 bp, Homo sapiens
tctctgaagaatcgatgattct

SEQ ID NO: 7722185 - DNA, 22 bp, Homo sapiens
tctctgaagagctcagactagt

SEQ ID NO: 7722186 - DNA, 22 bp, Homo sapiens
tctctgaagagtcagacataac

SEQ ID NO: 7722187 - DNA, 22 bp, Homo sapiens
tctctgaagagtcagacataac

SEQ ID NO: 7722188 - DNA, 22 bp, Homo sapiens
tctctgaagagtcagacataac

SEQ ID NO: 7722189 - DNA, 22 bp, Homo sapiens
tctctgaaagcagctgctcatc

SEQ ID NO: 7722190 - DNA, 22 bp, Homo sapiens
tctctgaacttcctggaaaggc

SEQ ID NO: 7722191 - DNA, 22 bp, Homo sapiens
tctctgaacttcctggaaaggc

SEQ ID NO: 7722192 - DNA, 22 bp, Homo sapiens
tctctctttttaatcatgtaat

SEQ ID NO: 7722193 - DNA, 22 bp, Homo sapiens
tctctcttttttgaacccgctc

SEQ ID NO: 7722194 - DNA, 22 bp, Homo sapiens
tctctctttttaatcatgtaat

SEQ ID NO: 7722195 - DNA, 20 bp, Homo sapiens
tctctctggttggaggagct

SEQ ID NO: 7722196 - DNA, 23 bp, Homo sapiens
tctctctggcaaatttcacatat

SEQ ID NO: 7722197 - DNA, 22 bp, Homo sapiens
tctctctggagctggggcatga

SEQ ID NO: 7722198 - DNA, 22 bp, Homo sapiens
tctctctggagctggggcatga

SEQ ID NO: 7722199 - DNA, 23 bp, Homo sapiens
tctctctggcaaatttcacatat

SEQ ID NO: 7722200 - DNA, 23 bp, Homo sapiens
tctctctggcaaatttcacatat

SEQ ID NO: 7722201 - DNA, 22 bp, Homo sapiens
tctctctttttaatcatgtaat

SEQ ID NO: 7722202 - DNA, 22 bp, Homo sapiens
tctctctttttaatcatgtaat

SEQ ID NO: 7722203 - DNA, 22 bp, Homo sapiens
tctctctttttaatcatgtaat

SEQ ID NO: 7722204 - DNA, 22 bp, Homo sapiens
tctctctttttaatcatgtaat

SEQ ID NO: 7722205 - DNA, 22 bp, Homo sapiens
tctctctttttaatcatgtaat

SEQ ID NO: 7722206 - DNA, 22 bp, Homo sapiens
tctctctttttaatcatgtaat

SEQ ID NO: 7722207 - DNA, 22 bp, Homo sapiens
tctctctgcgaattaggtttgc

SEQ ID NO: 7722208 - DNA, 22 bp, Homo sapiens
tctctctgcgaattaggtttgc

SEQ ID NO: 7722209 - DNA, 22 bp, Homo sapiens
tctctctgccaactcacagcca

SEQ ID NO: 7722210 - DNA, 22 bp, Homo sapiens
tctctctgccaactcacagcca

SEQ ID NO: 7722211 - DNA, 22 bp, Homo sapiens
tctctctggagctggggcatga

SEQ ID NO: 7722212 - DNA, 22 bp, Homo sapiens
tctctctgccaactcacagcca

SEQ ID NO: 7722213 - DNA, 22 bp, Homo sapiens
tctctctgcagcccgggacact

SEQ ID NO: 7722214 - DNA, 18 bp, Homo sapiens
tctctctgataacatttt

SEQ ID NO: 7722215 - DNA, 22 bp, Homo sapiens
tctctctgccaactcacagcca

SEQ ID NO: 7722216 - DNA, 22 bp, Homo sapiens
tctctctgccaactcacagcca

SEQ ID NO: 7722217 - DNA, 22 bp, Homo sapiens
tctctctgccaactcacagcca

SEQ ID NO: 7722218 - DNA, 22 bp, Homo sapiens
tctctctgccaactcacagcca

SEQ ID NO: 7722219 - DNA, 23 bp, Homo sapiens
tctctgagccatagcagtcccaa

SEQ ID NO: 7722220 - DNA, 23 bp, Homo sapiens
tctctgagccatagcagtcccaa

SEQ ID NO: 7722221 - DNA, 23 bp, Homo sapiens
tctctgagccatagcagtcccaa

SEQ ID NO: 7722222 - DNA, 23 bp, Homo sapiens
tctctgagccatagcagtcccaa

SEQ ID NO: 7722223 - DNA, 22 bp, Homo sapiens
tctctgagcccaatgtagcaat

SEQ ID NO: 7722224 - DNA, 22 bp, Homo sapiens
tctctgagcccaatgtagcaat

SEQ ID NO: 7722225 - DNA, 21 bp, Homo sapiens
tctctgagcccaccaggatct

SEQ ID NO: 7722226 - DNA, 21 bp, Homo sapiens
tctctgagcccaccaggatct

SEQ ID NO: 7722227 - DNA, 21 bp, Homo sapiens
tctctgagcccaccaggatct

SEQ ID NO: 7722228 - DNA, 22 bp, Homo sapiens
tctctgagcccagtgtccccct

SEQ ID NO: 7722229 - DNA, 21 bp, Homo sapiens
tctctgagcccaccaggatct

SEQ ID NO: 7722230 - DNA, 22 bp, Homo sapiens
tctctgagcccctgcctctttc

SEQ ID NO: 7722231 - DNA, 22 bp, Homo sapiens
tctctgagcccctgcctctttc

SEQ ID NO: 7722232 - DNA, 22 bp, Homo sapiens
tctctgagcccctgcctctttc

SEQ ID NO: 7722233 - DNA, 22 bp, Homo sapiens
tctctgagcccagtgtccccct

SEQ ID NO: 7722234 - DNA, 22 bp, Homo sapiens
tctctgagcccagtgtccccct

SEQ ID NO: 7722235 - DNA, 22 bp, Homo sapiens
tctctgagcccctgcctctttc

SEQ ID NO: 7722236 - DNA, 22 bp, Homo sapiens
tctctgagctcaggagctgcag

SEQ ID NO: 7722237 - DNA, 22 bp, Homo sapiens
tctctgagctcaggagctgcag

SEQ ID NO: 7722238 - DNA, 22 bp, Homo sapiens
tctctgagctcaggagctgcag

SEQ ID NO: 7722239 - DNA, 22 bp, Homo sapiens
tctctgagcgcattcctccggc

SEQ ID NO: 7722240 - DNA, 22 bp, Homo sapiens
tctctgagcgcattcctccggc

SEQ ID NO: 7722241 - DNA, 22 bp, Homo sapiens
tctctgagcgcattcctccggc

SEQ ID NO: 7722242 - DNA, 22 bp, Homo sapiens
tctctgagacagtagcctctgc

SEQ ID NO: 7722243 - DNA, 22 bp, Homo sapiens
tctctgagacagtagcctctgc

SEQ ID NO: 7722244 - DNA, 22 bp, Homo sapiens
tctctgagacagtagcctctgc

SEQ ID NO: 7722245 - DNA, 22 bp, Homo sapiens
tctctgagacagtagcctctgc

SEQ ID NO: 7722246 - DNA, 22 bp, Homo sapiens
tctctgagacagtagcctctgc

SEQ ID NO: 7722247 - DNA, 21 bp, Homo sapiens
tctctgagacactctggagcc

SEQ ID NO: 7722248 - DNA, 21 bp, Homo sapiens
tctctgagacactctggagcc

SEQ ID NO: 7722249 - DNA, 22 bp, Homo sapiens
tctctgagatcagccactgact

SEQ ID NO: 7722250 - DNA, 22 bp, Homo sapiens
tctctgagatcagccactgact

SEQ ID NO: 7722251 - DNA, 22 bp, Homo sapiens
tctctgagatcagccactgact

SEQ ID NO: 7722252 - DNA, 21 bp, Homo sapiens
tctctgagaggtctgcttaga

SEQ ID NO: 7722253 - DNA, 22 bp, Homo sapiens
tctctgagcaccagtgtattcg

SEQ ID NO: 7722254 - DNA, 22 bp, Homo sapiens
tctctgagatcagccactgact

SEQ ID NO: 7722255 - DNA, 22 bp, Homo sapiens
tctctgagcatgccatattgct

SEQ ID NO: 7722256 - DNA, 22 bp, Homo sapiens
tctctgagcatgccatattgct

SEQ ID NO: 7722257 - DNA, 22 bp, Homo sapiens
tctctgagcacctaagatatat

SEQ ID NO: 7722258 - DNA, 22 bp, Homo sapiens
tctctgagcacctaagatatat

SEQ ID NO: 7722259 - DNA, 22 bp, Homo sapiens
tctctgagcatgccatattgct

SEQ ID NO: 7722260 - DNA, 22 bp, Homo sapiens
tctctgaggttgtttccagcac

SEQ ID NO: 7722261 - DNA, 22 bp, Homo sapiens
tctctgaggttgtttccagcac

SEQ ID NO: 7722262 - DNA, 22 bp, Homo sapiens
tctctgaggttgtttccagcac

SEQ ID NO: 7722263 - DNA, 22 bp, Homo sapiens
tctctgaggttgtttccagcac

SEQ ID NO: 7722264 - DNA, 22 bp, Homo sapiens
tctctgagggagatggcctgcc

SEQ ID NO: 7722265 - DNA, 22 bp, Homo sapiens
tctctgagggagatggcctgcc

SEQ ID NO: 7722266 - DNA, 22 bp, Homo sapiens
tctctgagggagatggcctgcc

SEQ ID NO: 7722267 - DNA, 22 bp, Homo sapiens
tctctgagggagatggcctgcc

SEQ ID NO: 7722268 - DNA, 22 bp, Homo sapiens
tctctgagttcctgtggatttt

SEQ ID NO: 7722269 - DNA, 22 bp, Homo sapiens
tctctgagttctcctccagccc

SEQ ID NO: 7722270 - DNA, 22 bp, Homo sapiens
tctctgagtcaccgtggagacg

SEQ ID NO: 7722271 - DNA, 22 bp, Homo sapiens
tctctgagtcaccgtggagacg

SEQ ID NO: 7722272 - DNA, 22 bp, Homo sapiens
tctctgagtcaccgtggagacg

SEQ ID NO: 7722273 - DNA, 22 bp, Homo sapiens
tctctgaggttgtttccagcac

SEQ ID NO: 7722274 - DNA, 22 bp, Homo sapiens
tctctgagtatcctgaactgcc

SEQ ID NO: 7722275 - DNA, 22 bp, Homo sapiens
tctctgagctgcttcttgcata

SEQ ID NO: 7722276 - DNA, 22 bp, Homo sapiens
tctctgagctgcttcttgcata

SEQ ID NO: 7722277 - DNA, 22 bp, Homo sapiens
tctctgagctgcttcttgcata

SEQ ID NO: 7722278 - DNA, 22 bp, Homo sapiens
tctctgagctgcttcttgcata

SEQ ID NO: 7722279 - DNA, 22 bp, Homo sapiens
tctctgagcttaaggtgtttca

SEQ ID NO: 7722280 - DNA, 22 bp, Homo sapiens
tctctgagctggatttgttctt

SEQ ID NO: 7722281 - DNA, 22 bp, Homo sapiens
tctctgagctgcttcttgcata

SEQ ID NO: 7722282 - DNA, 22 bp, Homo sapiens
tctctgagctcaggagctgcag

SEQ ID NO: 7722283 - DNA, 22 bp, Homo sapiens
tctctgagctcaggagctgcag

SEQ ID NO: 7722284 - DNA, 22 bp, Homo sapiens
tctctgagggagatggcctgcc

SEQ ID NO: 7722285 - DNA, 22 bp, Homo sapiens
tctctgaggaagaggctgtaat

SEQ ID NO: 7722286 - DNA, 20 bp, Homo sapiens
tctctgagcttctcttgggg

SEQ ID NO: 7722287 - DNA, 20 bp, Homo sapiens
tctctgagcttctcttgggg

SEQ ID NO: 7722288 - DNA, 22 bp, Homo sapiens
tctctgagcttaaggtgtttca

SEQ ID NO: 7722289 - DNA, 20 bp, Homo sapiens
tctctgagcttctcttgggg

SEQ ID NO: 7722290 - DNA, 20 bp, Homo sapiens
tctctgagcttctcttgggg

SEQ ID NO: 7722291 - DNA, 20 bp, Homo sapiens
tctctgagcttctcttgggg

SEQ ID NO: 7722292 - DNA, 20 bp, Homo sapiens
tctctgagcttctcttgggg

SEQ ID NO: 7722293 - DNA, 22 bp, Homo sapiens
tctcattttgagtcagacacta

SEQ ID NO: 7722294 - DNA, 19 bp, Homo sapiens
tctccaaaaccaatcacta

SEQ ID NO: 7722295 - DNA, 19 bp, Homo sapiens
tctccaaaaccaatcacta

SEQ ID NO: 7722296 - DNA, 19 bp, Homo sapiens
tctccaaaaccaatcacta

SEQ ID NO: 7722297 - DNA, 19 bp, Homo sapiens
tctccaaaaccaatcacta

SEQ ID NO: 7722298 - DNA, 22 bp, Homo sapiens
tctccaaatagttatatttaga

SEQ ID NO: 7722299 - DNA, 22 bp, Homo sapiens
tctccaaactcagactaagtat

SEQ ID NO: 7722300 - DNA, 22 bp, Homo sapiens
tctccaaatagttatatttaga

SEQ ID NO: 7722301 - DNA, 22 bp, Homo sapiens
tctcatttgtgtgcaattcaga

SEQ ID NO: 7722302 - DNA, 22 bp, Homo sapiens
tctcatttgtgtgcaattcaga

SEQ ID NO: 7722303 - DNA, 22 bp, Homo sapiens
tctcatttgtgtgcaattcaga

SEQ ID NO: 7722304 - DNA, 22 bp, Homo sapiens
tctcatttgtgtgcaattcaga

SEQ ID NO: 7722305 - DNA, 22 bp, Homo sapiens
tctcatttgtgtgcaattcaga

SEQ ID NO: 7722306 - DNA, 22 bp, Homo sapiens
tctcattttgagtcagacacta

SEQ ID NO: 7722307 - DNA, 22 bp, Homo sapiens
tctcattttgagtcagacacta

SEQ ID NO: 7722308 - DNA, 22 bp, Homo sapiens
tctcatttgcctcatctataaa

SEQ ID NO: 7722309 - DNA, 22 bp, Homo sapiens
tctcatttggctttgttttaaa

SEQ ID NO: 7722310 - DNA, 22 bp, Homo sapiens
tctcatttggctttgttttaaa

SEQ ID NO: 7722311 - DNA, 22 bp, Homo sapiens
tctcatttggctttgttttaaa

SEQ ID NO: 7722312 - DNA, 22 bp, Homo sapiens
tctcatttggctttgttttaaa

SEQ ID NO: 7722313 - DNA, 22 bp, Homo sapiens
tctcatttgcctcatctataaa

SEQ ID NO: 7722314 - DNA, 22 bp, Homo sapiens
tctcatttgcctcatctataaa

SEQ ID NO: 7722315 - DNA, 22 bp, Homo sapiens
tctcatttgcctcatctataaa

SEQ ID NO: 7722316 - DNA, 22 bp, Homo sapiens
tctcatttgcctcatctataaa

SEQ ID NO: 7722317 - DNA, 22 bp, Homo sapiens
tctcatttgcctcatctataaa

SEQ ID NO: 7722318 - DNA, 22 bp, Homo sapiens
tctcatttgcctcatctataaa

SEQ ID NO: 7722319 - DNA, 23 bp, Homo sapiens
tctcatttcccttgatctatctt

SEQ ID NO: 7722320 - DNA, 23 bp, Homo sapiens
tctcatttcccttgatctatctt

SEQ ID NO: 7722321 - DNA, 22 bp, Homo sapiens
tctcattgttagtgtgggagca

SEQ ID NO: 7722322 - DNA, 22 bp, Homo sapiens
tctcattggtatatacatgtgt

SEQ ID NO: 7722323 - DNA, 22 bp, Homo sapiens
tctcatttacttccacaggctg

SEQ ID NO: 7722324 - DNA, 23 bp, Homo sapiens
tctcatttcccttgatctatctt

SEQ ID NO: 7722325 - DNA, 22 bp, Homo sapiens
tctcattcatccaaggatttat

SEQ ID NO: 7722326 - DNA, 22 bp, Homo sapiens
tctcattcataccctacatgct

SEQ ID NO: 7722327 - DNA, 22 bp, Homo sapiens
tctcattcatccaaggatttat

SEQ ID NO: 7722328 - DNA, 22 bp, Homo sapiens
tctcattgcacaatgcagagtg

SEQ ID NO: 7722329 - DNA, 22 bp, Homo sapiens
tctcatgttttacctgtcctca

SEQ ID NO: 7722330 - DNA, 22 bp, Homo sapiens
tctcattattatttgtatgggt

SEQ ID NO: 7722331 - DNA, 22 bp, Homo sapiens
tctcattattgtattcttagtt

SEQ ID NO: 7722332 - DNA, 22 bp, Homo sapiens
tctcattcataccctacatgct

SEQ ID NO: 7722333 - DNA, 22 bp, Homo sapiens
tctcattatccatcactgcact

SEQ ID NO: 7722334 - DNA, 20 bp, Homo sapiens
tctcattatatccaagaggc

SEQ ID NO: 7722335 - DNA, 22 bp, Homo sapiens
tctcatgtgattcccgtgcatg

SEQ ID NO: 7722336 - DNA, 22 bp, Homo sapiens
tctcatgtgaagaaagaatttc

SEQ ID NO: 7722337 - DNA, 22 bp, Homo sapiens
tctcatgtgattcccgtgcatg

SEQ ID NO: 7722338 - DNA, 22 bp, Homo sapiens
tctcatgttttacctgtcctca

SEQ ID NO: 7722339 - DNA, 22 bp, Homo sapiens
tctcatggcttaacaagcccac

SEQ ID NO: 7722340 - DNA, 22 bp, Homo sapiens
tctcatggcttgtaggaggtga

SEQ ID NO: 7722341 - DNA, 22 bp, Homo sapiens
tctcatggtttgtgattcaaat

SEQ ID NO: 7722342 - DNA, 22 bp, Homo sapiens
tctcatgtattgccctggtgtg

SEQ ID NO: 7722343 - DNA, 17 bp, Homo sapiens
tctccaggacgagctca

SEQ ID NO: 7722344 - DNA, 17 bp, Homo sapiens
tctccaggacgagctca

SEQ ID NO: 7722345 - DNA, 17 bp, Homo sapiens
tctccaggacgagctca

SEQ ID NO: 7722346 - DNA, 22 bp, Homo sapiens
tctccaggactgagctccagcc

SEQ ID NO: 7722347 - DNA, 22 bp, Homo sapiens
tctccaggactgagctccagcc

SEQ ID NO: 7722348 - DNA, 22 bp, Homo sapiens
tctccaggactgagctccagcc

SEQ ID NO: 7722349 - DNA, 22 bp, Homo sapiens
tctccaggactgagctccagcc

SEQ ID NO: 7722350 - DNA, 22 bp, Homo sapiens
tctccaggactgagctccagcc

SEQ ID NO: 7722351 - DNA, 22 bp, Homo sapiens
tctccaggactgagctccagcc

SEQ ID NO: 7722352 - DNA, 22 bp, Homo sapiens
tctccacaagctttctcctttt

SEQ ID NO: 7722353 - DNA, 22 bp, Homo sapiens
tctccaggaagccctccctgac

SEQ ID NO: 7722354 - DNA, 22 bp, Homo sapiens
tctccacaagctgatgctagga

SEQ ID NO: 7722355 - DNA, 22 bp, Homo sapiens
tctccaatctgatgtgactggt

SEQ ID NO: 7722356 - DNA, 22 bp, Homo sapiens
tctccaatctgtagctgtttgt

SEQ ID NO: 7722357 - DNA, 22 bp, Homo sapiens
tctccaatgcttaggaaagttt

SEQ ID NO: 7722358 - DNA, 22 bp, Homo sapiens
tctccaaggccctactctattt

SEQ ID NO: 7722359 - DNA, 22 bp, Homo sapiens
tctccaaggagctcctgtgccg

SEQ ID NO: 7722360 - DNA, 22 bp, Homo sapiens
tctccaaggagctcctgtgccg

SEQ ID NO: 7722361 - DNA, 22 bp, Homo sapiens
tctccaaggagctcctgtgccg

SEQ ID NO: 7722362 - DNA, 22 bp, Homo sapiens
tctccaagcagggctgcaaggc

SEQ ID NO: 7722363 - DNA, 22 bp, Homo sapiens
tctccaagaaaagatctcagct

SEQ ID NO: 7722364 - DNA, 22 bp, Homo sapiens
tctccaagaaaagatctcagct

SEQ ID NO: 7722365 - DNA, 22 bp, Homo sapiens
tctccaagaaaagatctcagct

SEQ ID NO: 7722366 - DNA, 22 bp, Homo sapiens
tctccaaatagttatatttaga

SEQ ID NO: 7722367 - DNA, 19 bp, Homo sapiens
tctccaggcaggtgagcga

SEQ ID NO: 7722368 - DNA, 22 bp, Homo sapiens
tctccaggcccactgatttata

SEQ ID NO: 7722369 - DNA, 23 bp, Homo sapiens
tctccaggccttactccaggcct

SEQ ID NO: 7722370 - DNA, 23 bp, Homo sapiens
tctccaggccttactccaggcct

SEQ ID NO: 7722371 - DNA, 23 bp, Homo sapiens
tctccaggccttactccaggcct

SEQ ID NO: 7722372 - DNA, 23 bp, Homo sapiens
tctccaggccttactccaggcct

SEQ ID NO: 7722373 - DNA, 23 bp, Homo sapiens
tctccaggccttactccaggcct

SEQ ID NO: 7722374 - DNA, 22 bp, Homo sapiens
tctccaggcacttggctgctac

SEQ ID NO: 7722375 - DNA, 22 bp, Homo sapiens
tctccaggcacttggctgctac

SEQ ID NO: 7722376 - DNA, 22 bp, Homo sapiens
tctccaggcacttggctgctac

SEQ ID NO: 7722377 - DNA, 19 bp, Homo sapiens
tctccaggcaggtgagcga

SEQ ID NO: 7722378 - DNA, 19 bp, Homo sapiens
tctccaggcaggtgagcga

SEQ ID NO: 7722379 - DNA, 19 bp, Homo sapiens
tctccaggcaggtgagcga

SEQ ID NO: 7722380 - DNA, 19 bp, Homo sapiens
tctccaggcaggtgagcga

SEQ ID NO: 7722381 - DNA, 22 bp, Homo sapiens
tctccaggagcaagtcacccag

SEQ ID NO: 7722382 - DNA, 22 bp, Homo sapiens
tctccaggagcaagtcacccag

SEQ ID NO: 7722383 - DNA, 22 bp, Homo sapiens
tctccaggagcaagtcacccag

SEQ ID NO: 7722384 - DNA, 22 bp, Homo sapiens
tctccaggcacttggctgctac

SEQ ID NO: 7722385 - DNA, 22 bp, Homo sapiens
tctccaggcacttggctgctac

SEQ ID NO: 7722386 - DNA, 22 bp, Homo sapiens
tctccaggcacttggctgctac

SEQ ID NO: 7722387 - DNA, 22 bp, Homo sapiens
tctccaggcacttggctgctac

SEQ ID NO: 7722388 - DNA, 22 bp, Homo sapiens
tctccaggcactacctgggtaa

SEQ ID NO: 7722389 - DNA, 22 bp, Homo sapiens
tctccaggcactacctgggtaa

SEQ ID NO: 7722390 - DNA, 22 bp, Homo sapiens
tctccaggcactacctgggtaa

SEQ ID NO: 7722391 - DNA, 22 bp, Homo sapiens
tctcagtgatggcccatttgga

SEQ ID NO: 7722392 - DNA, 22 bp, Homo sapiens
tctcagtgatggcccatttgga

SEQ ID NO: 7722393 - DNA, 23 bp, Homo sapiens
tctcagtgcacgcaccatgcctg

SEQ ID NO: 7722394 - DNA, 23 bp, Homo sapiens
tctcagtgcacgcaccatgcctg

SEQ ID NO: 7722395 - DNA, 22 bp, Homo sapiens
tctcagtgagcttttctatgtt

SEQ ID NO: 7722396 - DNA, 22 bp, Homo sapiens
tctcagtgagcttttctatgtt

SEQ ID NO: 7722397 - DNA, 22 bp, Homo sapiens
tctcagtgagcttttctatgtt

SEQ ID NO: 7722398 - DNA, 17 bp, Homo sapiens
tctcagtgactgatagc

SEQ ID NO: 7722399 - DNA, 22 bp, Homo sapiens
tctcagtgactgctgggtcccc

SEQ ID NO: 7722400 - DNA, 22 bp, Homo sapiens
tctcagtgcagagaggctatct

SEQ ID NO: 7722401 - DNA, 22 bp, Homo sapiens
tctcagtgcagagaggctatct

SEQ ID NO: 7722402 - DNA, 22 bp, Homo sapiens
tctcagtgagcttttctatgtt

SEQ ID NO: 7722403 - DNA, 22 bp, Homo sapiens
tctcagtgcagcaaggaattta

SEQ ID NO: 7722404 - DNA, 22 bp, Homo sapiens
tctcagtgatggcccatttgga

SEQ ID NO: 7722405 - DNA, 22 bp, Homo sapiens
tctcagtgcagcaaggaattta

SEQ ID NO: 7722406 - DNA, 22 bp, Homo sapiens
tctcagtgcagcaaggaattta

SEQ ID NO: 7722407 - DNA, 22 bp, Homo sapiens
tctcagtgcagcttgacagaga

SEQ ID NO: 7722408 - DNA, 22 bp, Homo sapiens
tctcagtgcagcttgacagaga

SEQ ID NO: 7722409 - DNA, 22 bp, Homo sapiens
tctcagtgcagcttgacagaga

SEQ ID NO: 7722410 - DNA, 22 bp, Homo sapiens
tctcagtgcagcaaggaattta

SEQ ID NO: 7722411 - DNA, 23 bp, Homo sapiens
tctcagtgaatctcagaattcgc

SEQ ID NO: 7722412 - DNA, 23 bp, Homo sapiens
tctcagtgaatctcagaattcgc

SEQ ID NO: 7722413 - DNA, 23 bp, Homo sapiens
tctcagtgaatctcagaattcgc

SEQ ID NO: 7722414 - DNA, 22 bp, Homo sapiens
tctcagtctttttggttactca

SEQ ID NO: 7722415 - DNA, 22 bp, Homo sapiens
tctcagtgacactcttcataca

SEQ ID NO: 7722416 - DNA, 22 bp, Homo sapiens
tctcagtgacactcttcataca

SEQ ID NO: 7722417 - DNA, 22 bp, Homo sapiens
tctcagtgacactcttcataca

SEQ ID NO: 7722418 - DNA, 17 bp, Homo sapiens
tctcagtgactgatagc

SEQ ID NO: 7722419 - DNA, 22 bp, Homo sapiens
tctcagtatgcttgattggatt

SEQ ID NO: 7722420 - DNA, 22 bp, Homo sapiens
tctcagtcagccttgatgtccc

SEQ ID NO: 7722421 - DNA, 19 bp, Homo sapiens
tctcagtagactgtatgtt

SEQ ID NO: 7722422 - DNA, 22 bp, Homo sapiens
tctcagtaattaatgttatgga

SEQ ID NO: 7722423 - DNA, 22 bp, Homo sapiens
tctcagtaagtggcactctgtc

SEQ ID NO: 7722424 - DNA, 22 bp, Homo sapiens
tctcagtcagtttggactgtgt

SEQ ID NO: 7722425 - DNA, 22 bp, Homo sapiens
tctcagtccaaatgagaggttg

SEQ ID NO: 7722426 - DNA, 22 bp, Homo sapiens
tctcagtcccattgaagaggtg

SEQ ID NO: 7722427 - DNA, 22 bp, Homo sapiens
tctcagtcccattgaagaggtg

SEQ ID NO: 7722428 - DNA, 22 bp, Homo sapiens
tctcagtctttgcaaggatgct

SEQ ID NO: 7722429 - DNA, 22 bp, Homo sapiens
tctcagggtttcctgggggctg

SEQ ID NO: 7722430 - DNA, 22 bp, Homo sapiens
tctcagggttctgtgttataat

SEQ ID NO: 7722431 - DNA, 23 bp, Homo sapiens
tctcagggtggctgggcccatcc

SEQ ID NO: 7722432 - DNA, 20 bp, Homo sapiens
tctcagggttcagcaaagta

SEQ ID NO: 7722433 - DNA, 22 bp, Homo sapiens
tctcagggtgaggaaagaattt

SEQ ID NO: 7722434 - DNA, 20 bp, Homo sapiens
tctcagggtcttagatggaa

SEQ ID NO: 7722435 - DNA, 20 bp, Homo sapiens
tctcagggtcttagatggaa

SEQ ID NO: 7722436 - DNA, 22 bp, Homo sapiens
tctcagggggacttaatttact

SEQ ID NO: 7722437 - DNA, 23 bp, Homo sapiens
tctcagtaaatgttagtttaatc

SEQ ID NO: 7722438 - DNA, 22 bp, Homo sapiens
tctcaggtaagcttctttgatg

SEQ ID NO: 7722439 - DNA, 22 bp, Homo sapiens
tctcaggtggcccccatgagtg

SEQ ID NO: 7722440 - DNA, 22 bp, Homo sapiens
tctcaggtggcccccatgagtg

SEQ ID NO: 7722441 - DNA, 22 bp, Homo sapiens
tctcaggtctcatgccaggcct

SEQ ID NO: 7722442 - DNA, 22 bp, Homo sapiens
tctcaggtaaaagggtatctac

SEQ ID NO: 7722443 - DNA, 22 bp, Homo sapiens
tctcaggtaagcttctttgatg

SEQ ID NO: 7722444 - DNA, 22 bp, Homo sapiens
tctcagggtttgtacaagtgta

SEQ ID NO: 7722445 - DNA, 22 bp, Homo sapiens
tctcagggtttgtacaagtgta

SEQ ID NO: 7722446 - DNA, 22 bp, Homo sapiens
tctcagggtttcctgggggctg

SEQ ID NO: 7722447 - DNA, 22 bp, Homo sapiens
tctcagggctcagagctcaggc

SEQ ID NO: 7722448 - DNA, 22 bp, Homo sapiens
tctcagggctcagagctcaggc

SEQ ID NO: 7722449 - DNA, 22 bp, Homo sapiens
tctcagggcttttcttttgaat

SEQ ID NO: 7722450 - DNA, 22 bp, Homo sapiens
tctcagggcgcagtgaggcagt

SEQ ID NO: 7722451 - DNA, 22 bp, Homo sapiens
tctcagggcgcagtgaggcagt

SEQ ID NO: 7722452 - DNA, 22 bp, Homo sapiens
tctcagggctcagagctcaggc

SEQ ID NO: 7722453 - DNA, 22 bp, Homo sapiens
tctcagggctcagagctcaggc

SEQ ID NO: 7722454 - DNA, 22 bp, Homo sapiens
tctcagggcgcagtgaggcagt

SEQ ID NO: 7722455 - DNA, 22 bp, Homo sapiens
tctcaggggcctggagtcctgg

SEQ ID NO: 7722456 - DNA, 22 bp, Homo sapiens
tctcaggggcctggagtcctgg

SEQ ID NO: 7722457 - DNA, 22 bp, Homo sapiens
tctcaggggcagtgatcctaag

SEQ ID NO: 7722458 - DNA, 22 bp, Homo sapiens
tctcaggggcagtgatcctaag

SEQ ID NO: 7722459 - DNA, 22 bp, Homo sapiens
tctcaggggattcactggcacc

SEQ ID NO: 7722460 - DNA, 17 bp, Homo sapiens
tctcaggggctagccct

SEQ ID NO: 7722461 - DNA, 17 bp, Homo sapiens
tctcaggggctagccct

SEQ ID NO: 7722462 - DNA, 22 bp, Homo sapiens
tctcaggggcctggagtcctgg

SEQ ID NO: 7722463 - DNA, 20 bp, Homo sapiens
tctcagggtcttagatggaa

SEQ ID NO: 7722464 - DNA, 22 bp, Homo sapiens
tctcatggagtcaggagcagaa

SEQ ID NO: 7722465 - DNA, 22 bp, Homo sapiens
tctcatggcttaacaagcccac

SEQ ID NO: 7722466 - DNA, 22 bp, Homo sapiens
tctcatggatccccctgtatag

SEQ ID NO: 7722467 - DNA, 22 bp, Homo sapiens
tctcatgctgtagtgcactaac

SEQ ID NO: 7722468 - DNA, 22 bp, Homo sapiens
tctcatgctgtagtgcactaac

SEQ ID NO: 7722469 - DNA, 22 bp, Homo sapiens
tctcatgcctggaattatcatt

SEQ ID NO: 7722470 - DNA, 22 bp, Homo sapiens
tctcatgaagatagaatagtat

SEQ ID NO: 7722471 - DNA, 22 bp, Homo sapiens
tctcatctttaaatgaaaattt

SEQ ID NO: 7722472 - DNA, 22 bp, Homo sapiens
tctcatctttaaatgaaaattt

SEQ ID NO: 7722473 - DNA, 22 bp, Homo sapiens
tctcatctttaaatgaaaattt

SEQ ID NO: 7722474 - DNA, 22 bp, Homo sapiens
tctcatctttaaatgaaaattt

SEQ ID NO: 7722475 - DNA, 22 bp, Homo sapiens
tctcatcttgttcatctaccct

SEQ ID NO: 7722476 - DNA, 22 bp, Homo sapiens
tctcatcttgttcatctaccct

SEQ ID NO: 7722477 - DNA, 22 bp, Homo sapiens
tctcatcttgttcatctaccct

SEQ ID NO: 7722478 - DNA, 22 bp, Homo sapiens
tctcatcttcattgtctcccat

SEQ ID NO: 7722479 - DNA, 22 bp, Homo sapiens
tctcatcttcattgtctcccat

SEQ ID NO: 7722480 - DNA, 21 bp, Homo sapiens
tctcatctcctgacctgtgcc

SEQ ID NO: 7722481 - DNA, 21 bp, Homo sapiens
tctcatctcctgacctgtgcc

SEQ ID NO: 7722482 - DNA, 21 bp, Homo sapiens
tctcatctcctgacctgtgcc

SEQ ID NO: 7722483 - DNA, 22 bp, Homo sapiens
tctcatctcggatcagaagtga

SEQ ID NO: 7722484 - DNA, 22 bp, Homo sapiens
tctcatctcggatcagaagtga

SEQ ID NO: 7722485 - DNA, 22 bp, Homo sapiens
tctcatctcggatcagaagtga

SEQ ID NO: 7722486 - DNA, 22 bp, Homo sapiens
tctcatctcggatcagaagtga

SEQ ID NO: 7722487 - DNA, 22 bp, Homo sapiens
tctcatctgccatttgcaggag

SEQ ID NO: 7722488 - DNA, 22 bp, Homo sapiens
tctcatctcggatcagaagtga

SEQ ID NO: 7722489 - DNA, 22 bp, Homo sapiens
tctcatctgccatttgcaggag

SEQ ID NO: 7722490 - DNA, 22 bp, Homo sapiens
tctcatcttcatatctgaaaga

SEQ ID NO: 7722491 - DNA, 22 bp, Homo sapiens
tctcatctgcgagctctgccag

SEQ ID NO: 7722492 - DNA, 22 bp, Homo sapiens
tctcatcttcatatctgaaaga

SEQ ID NO: 7722493 - DNA, 22 bp, Homo sapiens
tctcatcttcatatctgaaaga

SEQ ID NO: 7722494 - DNA, 22 bp, Homo sapiens
tctcatcttcattgtctcccat

SEQ ID NO: 7722495 - DNA, 22 bp, Homo sapiens
tctcatcttcattgtctcccat

SEQ ID NO: 7722496 - DNA, 22 bp, Homo sapiens
tctcatcttcatatctgaaaga

SEQ ID NO: 7722497 - DNA, 22 bp, Homo sapiens
tctcatctgcgagctctgccag

SEQ ID NO: 7722498 - DNA, 22 bp, Homo sapiens
tctcatctgcgagctctgccag

SEQ ID NO: 7722499 - DNA, 22 bp, Homo sapiens
tctcatctgcgagctctgccag

SEQ ID NO: 7722500 - DNA, 22 bp, Homo sapiens
tctcagtgctatccatattcca

SEQ ID NO: 7722501 - DNA, 19 bp, Homo sapiens
tctcagtgccgctgaccgc

SEQ ID NO: 7722502 - DNA, 22 bp, Homo sapiens
tctcagtgcagcttgacagaga

SEQ ID NO: 7722503 - DNA, 23 bp, Homo sapiens
tctcagtgccgattgcatacaca

SEQ ID NO: 7722504 - DNA, 22 bp, Homo sapiens
tctcagtggacgtgtctgtctt

SEQ ID NO: 7722505 - DNA, 22 bp, Homo sapiens
tctcagtgctatccatattcca

SEQ ID NO: 7722506 - DNA, 22 bp, Homo sapiens
tctcagtggacgtgtctgtctt

SEQ ID NO: 7722507 - DNA, 22 bp, Homo sapiens
tctcagtggacgtgtctgtctt

SEQ ID NO: 7722508 - DNA, 22 bp, Homo sapiens
tctcagttttttcaaccataat

SEQ ID NO: 7722509 - DNA, 22 bp, Homo sapiens
tctcagtggatctcagaatttt

SEQ ID NO: 7722510 - DNA, 22 bp, Homo sapiens
tctcataatagcatttctcacc

SEQ ID NO: 7722511 - DNA, 22 bp, Homo sapiens
tctcataaactcagttttctca

SEQ ID NO: 7722512 - DNA, 22 bp, Homo sapiens
tctcataattaggtaagtcaga

SEQ ID NO: 7722513 - DNA, 22 bp, Homo sapiens
tctcataatagcatttctcacc

SEQ ID NO: 7722514 - DNA, 22 bp, Homo sapiens
tctcataattgtttcccagcta

SEQ ID NO: 7722515 - DNA, 22 bp, Homo sapiens
tctcatacgtttccaggtgtca

SEQ ID NO: 7722516 - DNA, 22 bp, Homo sapiens
tctcatacatgtttgcagaaag

SEQ ID NO: 7722517 - DNA, 22 bp, Homo sapiens
tctcatcattccttcaaagccc

SEQ ID NO: 7722518 - DNA, 22 bp, Homo sapiens
tctcatctagactctgcccttg

SEQ ID NO: 7722519 - DNA, 22 bp, Homo sapiens
tctcatctagactctgcccttg

SEQ ID NO: 7722520 - DNA, 22 bp, Homo sapiens
tctcatcagcccaaacatgaca

SEQ ID NO: 7722521 - DNA, 22 bp, Homo sapiens
tctcatcagcccaaacatgaca

SEQ ID NO: 7722522 - DNA, 22 bp, Homo sapiens
tctcatcacacagccagtatgt

SEQ ID NO: 7722523 - DNA, 22 bp, Homo sapiens
tctcatcacttaacatctgctt

SEQ ID NO: 7722524 - DNA, 22 bp, Homo sapiens
tctcatctattcacattaactg

SEQ ID NO: 7722525 - DNA, 22 bp, Homo sapiens
tctcatctattcacattaactg

SEQ ID NO: 7722526 - DNA, 22 bp, Homo sapiens
tctcatctagactctgcccttg

SEQ ID NO: 7722527 - DNA, 22 bp, Homo sapiens
tctcatctagactctgcccttg

SEQ ID NO: 7722528 - DNA, 22 bp, Homo sapiens
tctcatctagactctgcccttg

SEQ ID NO: 7722529 - DNA, 22 bp, Homo sapiens
tctcatctccattatagcatca

SEQ ID NO: 7722530 - DNA, 22 bp, Homo sapiens
tctcatctccattatagcatca

SEQ ID NO: 7722531 - DNA, 22 bp, Homo sapiens
tctcatctccattatagcatca

SEQ ID NO: 7722532 - DNA, 22 bp, Homo sapiens
tctcatctcaaattgtaatccc

SEQ ID NO: 7722533 - DNA, 22 bp, Homo sapiens
tctcatctattcacattaactg

SEQ ID NO: 7722534 - DNA, 22 bp, Homo sapiens
tctcatctcaaattgtaatccc

SEQ ID NO: 7722535 - DNA, 22 bp, Homo sapiens
tctcatctcaaattgtaatccc

SEQ ID NO: 7722536 - DNA, 22 bp, Homo sapiens
tctcacaggtgcacgtggctgt

SEQ ID NO: 7722537 - DNA, 22 bp, Homo sapiens
tctcacaggtgcacgtggctgt

SEQ ID NO: 7722538 - DNA, 22 bp, Homo sapiens
tctcacaggtgcacgtggctgt

SEQ ID NO: 7722539 - DNA, 22 bp, Homo sapiens
tctcacagtgagcctgaggtcg

SEQ ID NO: 7722540 - DNA, 22 bp, Homo sapiens
tctcacagtgagcctgaggtcg

SEQ ID NO: 7722541 - DNA, 22 bp, Homo sapiens
tctcacagttgtccactgaaaa

SEQ ID NO: 7722542 - DNA, 22 bp, Homo sapiens
tctcacagttgtccactgaaaa

SEQ ID NO: 7722543 - DNA, 22 bp, Homo sapiens
tctcacagtgcaggtctgtctc

SEQ ID NO: 7722544 - DNA, 22 bp, Homo sapiens
tctcacagtgagcctgaggtcg

SEQ ID NO: 7722545 - DNA, 22 bp, Homo sapiens
tctcacagtgagcctgaggtcg

SEQ ID NO: 7722546 - DNA, 22 bp, Homo sapiens
tctcacagttgtcccttgtgag

SEQ ID NO: 7722547 - DNA, 19 bp, Homo sapiens
tctcacagtttccttgcct

SEQ ID NO: 7722548 - DNA, 22 bp, Homo sapiens
tctcaccccgttttctgtgtga

SEQ ID NO: 7722549 - DNA, 22 bp, Homo sapiens
tctcacccaacgtgcaatgagt

SEQ ID NO: 7722550 - DNA, 22 bp, Homo sapiens
tctcaccatggtgcttgcttat

SEQ ID NO: 7722551 - DNA, 22 bp, Homo sapiens
tctcacccaacgtgcaatgagt

SEQ ID NO: 7722552 - DNA, 22 bp, Homo sapiens
tctcaccatggtgcttgcttat

SEQ ID NO: 7722553 - DNA, 22 bp, Homo sapiens
tctcaccatcttgaatccctta

SEQ ID NO: 7722554 - DNA, 22 bp, Homo sapiens
tctcaccaaagccttgaccata

SEQ ID NO: 7722555 - DNA, 22 bp, Homo sapiens
tctcacatctgccctgtgctgg

SEQ ID NO: 7722556 - DNA, 19 bp, Homo sapiens
tctcacatcagctcctagc

SEQ ID NO: 7722557 - DNA, 22 bp, Homo sapiens
tctcacatctgccctgtgctgg

SEQ ID NO: 7722558 - DNA, 19 bp, Homo sapiens
tctcacatcagctcctagc

SEQ ID NO: 7722559 - DNA, 19 bp, Homo sapiens
tctcacatcagctcctagc

SEQ ID NO: 7722560 - DNA, 22 bp, Homo sapiens
tctcacatcttcttggctttat

SEQ ID NO: 7722561 - DNA, 22 bp, Homo sapiens
tctcacatgcaaacagtccaca

SEQ ID NO: 7722562 - DNA, 22 bp, Homo sapiens
tctcacatgcaaacagtccaca

SEQ ID NO: 7722563 - DNA, 22 bp, Homo sapiens
tctcacatttcattgacagctg

SEQ ID NO: 7722564 - DNA, 22 bp, Homo sapiens
tctcacatttcattgacagctg

SEQ ID NO: 7722565 - DNA, 22 bp, Homo sapiens
tctcacattttaaaaggacata

SEQ ID NO: 7722566 - DNA, 22 bp, Homo sapiens
tctcacattttaaaaggacata

SEQ ID NO: 7722567 - DNA, 22 bp, Homo sapiens
tctcactgatttgagaccaagg

SEQ ID NO: 7722568 - DNA, 22 bp, Homo sapiens
tctcactgcaaatattatgtat

SEQ ID NO: 7722569 - DNA, 22 bp, Homo sapiens
tctcactgatttgagaccaagg

SEQ ID NO: 7722570 - DNA, 22 bp, Homo sapiens
tctcactgatttgagaccaagg

SEQ ID NO: 7722571 - DNA, 22 bp, Homo sapiens
tctcactgatttgagaccaagg

SEQ ID NO: 7722572 - DNA, 22 bp, Homo sapiens
tctcactcatttcctaggtctt

SEQ ID NO: 7722573 - DNA, 22 bp, Homo sapiens
tctcactgggtataaatgagta

SEQ ID NO: 7722574 - DNA, 22 bp, Homo sapiens
tctcactgggtataaatgagta

SEQ ID NO: 7722575 - DNA, 22 bp, Homo sapiens
tctcactgggtataaatgagta

SEQ ID NO: 7722576 - DNA, 22 bp, Homo sapiens
tctcactgggtataaatgagta

SEQ ID NO: 7722577 - DNA, 22 bp, Homo sapiens
tctcactgggtcacagcagagg

SEQ ID NO: 7722578 - DNA, 22 bp, Homo sapiens
tctcactgggtataaatgagta

SEQ ID NO: 7722579 - DNA, 22 bp, Homo sapiens
tctcactgggtcacagcagagg

SEQ ID NO: 7722580 - DNA, 22 bp, Homo sapiens
tctcactgggtcacagcagagg

SEQ ID NO: 7722581 - DNA, 22 bp, Homo sapiens
tctcactgggtcacagcagagg

SEQ ID NO: 7722582 - DNA, 22 bp, Homo sapiens
tctcactgggtcacagcagagg

SEQ ID NO: 7722583 - DNA, 22 bp, Homo sapiens
tctcactgggtcacagcagagg

SEQ ID NO: 7722584 - DNA, 21 bp, Homo sapiens
tctcactgtctgctttgttta

SEQ ID NO: 7722585 - DNA, 22 bp, Homo sapiens
tctcactgggtcacagcagagg

SEQ ID NO: 7722586 - DNA, 22 bp, Homo sapiens
tctcactttccagacttttcaa

SEQ ID NO: 7722587 - DNA, 22 bp, Homo sapiens
tctcagaaaagagcttcagaaa

SEQ ID NO: 7722588 - DNA, 22 bp, Homo sapiens
tctcagaaaagagcttcagaaa

SEQ ID NO: 7722589 - DNA, 22 bp, Homo sapiens
tctcagaaaaaggagaaactgg

SEQ ID NO: 7722590 - DNA, 22 bp, Homo sapiens
tctcagaaaaaggagaaactgg

SEQ ID NO: 7722591 - DNA, 22 bp, Homo sapiens
tctcagaaaaactttgagggta

SEQ ID NO: 7722592 - DNA, 22 bp, Homo sapiens
tctcagaaaaactttgagggta

SEQ ID NO: 7722593 - DNA, 22 bp, Homo sapiens
tctcagaaaaaggagaaactgg

SEQ ID NO: 7722594 - DNA, 22 bp, Homo sapiens
tctcagaaaaaggagaaactgg

SEQ ID NO: 7722595 - DNA, 22 bp, Homo sapiens
tctcagaaaaaggagaaactgg

SEQ ID NO: 7722596 - DNA, 22 bp, Homo sapiens
tctcagagcctaactaacctaa

SEQ ID NO: 7722597 - DNA, 22 bp, Homo sapiens
tctcagagctcacacctcctgg

SEQ ID NO: 7722598 - DNA, 22 bp, Homo sapiens
tctcagagcctaactaacctaa

SEQ ID NO: 7722599 - DNA, 22 bp, Homo sapiens
tctcagagcttcagttattttc

SEQ ID NO: 7722600 - DNA, 22 bp, Homo sapiens
tctcagagcttcagttattttc

SEQ ID NO: 7722601 - DNA, 22 bp, Homo sapiens
tctcagagcttcagaaagcacc

SEQ ID NO: 7722602 - DNA, 22 bp, Homo sapiens
tctcagagcttcagaaagcacc

SEQ ID NO: 7722603 - DNA, 22 bp, Homo sapiens
tctcagagcttcagaaagcacc

SEQ ID NO: 7722604 - DNA, 18 bp, Homo sapiens
tctcagaggccatcctag

SEQ ID NO: 7722605 - DNA, 23 bp, Homo sapiens
tctcagaggattcctgggccttg

SEQ ID NO: 7722606 - DNA, 23 bp, Homo sapiens
tctcagaggattcctgggccttg

SEQ ID NO: 7722607 - DNA, 19 bp, Homo sapiens
tctcagaggaaaaattgct

SEQ ID NO: 7722608 - DNA, 19 bp, Homo sapiens
tctcagaggaaaaattgct

SEQ ID NO: 7722609 - DNA, 23 bp, Homo sapiens
tctcagaggattcctgggccttg

SEQ ID NO: 7722610 - DNA, 23 bp, Homo sapiens
tctcagaggattcctgggccttg

SEQ ID NO: 7722611 - DNA, 23 bp, Homo sapiens
tctcagaggattcctgggccttg

SEQ ID NO: 7722612 - DNA, 23 bp, Homo sapiens
tctcagaggattcctgggccttg

SEQ ID NO: 7722613 - DNA, 22 bp, Homo sapiens
tctcagagatttatggaaaact

SEQ ID NO: 7722614 - DNA, 22 bp, Homo sapiens
tctcagagcatcattttcttag

SEQ ID NO: 7722615 - DNA, 22 bp, Homo sapiens
tctcagagcatcattttcttag

SEQ ID NO: 7722616 - DNA, 22 bp, Homo sapiens
tctcagagattttgtttccctt

SEQ ID NO: 7722617 - DNA, 22 bp, Homo sapiens
tctcagagattcagggagaagt

SEQ ID NO: 7722618 - DNA, 22 bp, Homo sapiens
tctcagagatttatggaaaact

SEQ ID NO: 7722619 - DNA, 22 bp, Homo sapiens
tctcagagatttatggaaaact

SEQ ID NO: 7722620 - DNA, 22 bp, Homo sapiens
tctcagagatgttagggaagag

SEQ ID NO: 7722621 - DNA, 22 bp, Homo sapiens
tctcagagcatcattttcttag

SEQ ID NO: 7722622 - DNA, 19 bp, Homo sapiens
tctcagagccctagaggcc

SEQ ID NO: 7722623 - DNA, 19 bp, Homo sapiens
tctcagagccctagaggcc

SEQ ID NO: 7722624 - DNA, 19 bp, Homo sapiens
tctcagagccctagaggcc

SEQ ID NO: 7722625 - DNA, 19 bp, Homo sapiens
tctcagagccctagaggcc

SEQ ID NO: 7722626 - DNA, 19 bp, Homo sapiens
tctcagagccctagaggcc

SEQ ID NO: 7722627 - DNA, 19 bp, Homo sapiens
tctcagagccctagaggcc

SEQ ID NO: 7722628 - DNA, 19 bp, Homo sapiens
tctcagagccctagaggcc

SEQ ID NO: 7722629 - DNA, 22 bp, Homo sapiens
tctcagagagatgaaacttcca

SEQ ID NO: 7722630 - DNA, 22 bp, Homo sapiens
tctcagagagatgaaacttcca

SEQ ID NO: 7722631 - DNA, 22 bp, Homo sapiens
tctcagagagctgtgttttcct

SEQ ID NO: 7722632 - DNA, 22 bp, Homo sapiens
tctcagagagctgtgttttcct

SEQ ID NO: 7722633 - DNA, 22 bp, Homo sapiens
tctcagagagatgaaacttcca

SEQ ID NO: 7722634 - DNA, 22 bp, Homo sapiens
tctcagagagatgaaacttcca

SEQ ID NO: 7722635 - DNA, 22 bp, Homo sapiens
tctcagaaggcaagggctgggg

SEQ ID NO: 7722636 - DNA, 22 bp, Homo sapiens
tctcagagagctgtgttttcct

SEQ ID NO: 7722637 - DNA, 22 bp, Homo sapiens
tctcagagaggggccgggcctt

SEQ ID NO: 7722638 - DNA, 22 bp, Homo sapiens
tctcagagaggggccgggcctt

SEQ ID NO: 7722639 - DNA, 22 bp, Homo sapiens
tctcagagatgttagggaagag

SEQ ID NO: 7722640 - DNA, 22 bp, Homo sapiens
tctcagagatgttagggaagag

SEQ ID NO: 7722641 - DNA, 22 bp, Homo sapiens
tctcagagatgttagggaagag

SEQ ID NO: 7722642 - DNA, 22 bp, Homo sapiens
tctcagagatgtcaagagtcta

SEQ ID NO: 7722643 - DNA, 22 bp, Homo sapiens
tctcagagatgtcaagagtcta

SEQ ID NO: 7722644 - DNA, 22 bp, Homo sapiens
tctcagagatgtcaagagtcta

SEQ ID NO: 7722645 - DNA, 22 bp, Homo sapiens
tctcagagatgtcaagagtcta

SEQ ID NO: 7722646 - DNA, 22 bp, Homo sapiens
tctcagagatctttctgcatgt

SEQ ID NO: 7722647 - DNA, 22 bp, Homo sapiens
tctcagagatctttctgcatgt

SEQ ID NO: 7722648 - DNA, 22 bp, Homo sapiens
tctcagagaggggccgggcctt

SEQ ID NO: 7722649 - DNA, 22 bp, Homo sapiens
tctcagagatctttctgcatgt

SEQ ID NO: 7722650 - DNA, 22 bp, Homo sapiens
tctcagaacctcagtttgctct

SEQ ID NO: 7722651 - DNA, 22 bp, Homo sapiens
tctcagaactttatatgtatca

SEQ ID NO: 7722652 - DNA, 22 bp, Homo sapiens
tctcagaactttatatgtatca

SEQ ID NO: 7722653 - DNA, 22 bp, Homo sapiens
tctcagaactttatatgtatca

SEQ ID NO: 7722654 - DNA, 22 bp, Homo sapiens
tctcagaactttatatgtatca

SEQ ID NO: 7722655 - DNA, 22 bp, Homo sapiens
tctcagaaggcaagggctgggg

SEQ ID NO: 7722656 - DNA, 22 bp, Homo sapiens
tctcagaaggcaagggctgggg

SEQ ID NO: 7722657 - DNA, 22 bp, Homo sapiens
tctcagaactttatatgtatca

SEQ ID NO: 7722658 - DNA, 22 bp, Homo sapiens
tctcagaacacccttctatggt

SEQ ID NO: 7722659 - DNA, 22 bp, Homo sapiens
tctcagaacacccttctatggt

SEQ ID NO: 7722660 - DNA, 22 bp, Homo sapiens
tctcagaacctcagtttgctct

SEQ ID NO: 7722661 - DNA, 22 bp, Homo sapiens
tctcagaacacccttctatggt

SEQ ID NO: 7722662 - DNA, 22 bp, Homo sapiens
tctcagaacacccttctatggt

SEQ ID NO: 7722663 - DNA, 22 bp, Homo sapiens
tctcagaaatgacaggaggtac

SEQ ID NO: 7722664 - DNA, 22 bp, Homo sapiens
tctcagaaatactatgttgtca

SEQ ID NO: 7722665 - DNA, 23 bp, Homo sapiens
tctcagaaaggagaagtaatttg

SEQ ID NO: 7722666 - DNA, 22 bp, Homo sapiens
tctcagaaatactatgttgtca

SEQ ID NO: 7722667 - DNA, 22 bp, Homo sapiens
tctcagagtggtggtccctctg

SEQ ID NO: 7722668 - DNA, 22 bp, Homo sapiens
tctcagagttcctctggagtcc

SEQ ID NO: 7722669 - DNA, 22 bp, Homo sapiens
tctcagagtggtggtccctctg

SEQ ID NO: 7722670 - DNA, 22 bp, Homo sapiens
tctcagagtggtggtccctctg

SEQ ID NO: 7722671 - DNA, 22 bp, Homo sapiens
tctcagagttcctctggagtcc

SEQ ID NO: 7722672 - DNA, 22 bp, Homo sapiens
tctcagagttcctctggagtcc

SEQ ID NO: 7722673 - DNA, 22 bp, Homo sapiens
tctcagagttcctctggagtcc

SEQ ID NO: 7722674 - DNA, 22 bp, Homo sapiens
tctcagagttcctctggagtcc

SEQ ID NO: 7722675 - DNA, 22 bp, Homo sapiens
tctcagagtaattctttaaggt

SEQ ID NO: 7722676 - DNA, 22 bp, Homo sapiens
tctcagagtaattctttaaggt

SEQ ID NO: 7722677 - DNA, 22 bp, Homo sapiens
tctcagagtgacaatgagaatt

SEQ ID NO: 7722678 - DNA, 22 bp, Homo sapiens
tctcagagtgacaatgagaatt

SEQ ID NO: 7722679 - DNA, 22 bp, Homo sapiens
tctcagaggtgccctggcatct

SEQ ID NO: 7722680 - DNA, 22 bp, Homo sapiens
tctcagagtaattctttaaggt

SEQ ID NO: 7722681 - DNA, 22 bp, Homo sapiens
tctcagagtaattctttaaggt

SEQ ID NO: 7722682 - DNA, 22 bp, Homo sapiens
tctcagaggtgccctggcatct

SEQ ID NO: 7722683 - DNA, 22 bp, Homo sapiens
tctcagaggtcttcagcctctg

SEQ ID NO: 7722684 - DNA, 22 bp, Homo sapiens
tctcagaggtcttcagcctctg

SEQ ID NO: 7722685 - DNA, 22 bp, Homo sapiens
tctcagaggtgccctggcatct

SEQ ID NO: 7722686 - DNA, 22 bp, Homo sapiens
tctcagaggtcttcagcctctg

SEQ ID NO: 7722687 - DNA, 22 bp, Homo sapiens
tctcagaggtgccctggcatct

SEQ ID NO: 7722688 - DNA, 22 bp, Homo sapiens
tctcagagggaaaggccaattt

SEQ ID NO: 7722689 - DNA, 22 bp, Homo sapiens
tctcagagggaggattactgcc

SEQ ID NO: 7722690 - DNA, 22 bp, Homo sapiens
tctcagagggaggattactgcc

SEQ ID NO: 7722691 - DNA, 22 bp, Homo sapiens
tctcagagggaggattactgcc

SEQ ID NO: 7722692 - DNA, 22 bp, Homo sapiens
tctcagaggcccgacgttctcc

SEQ ID NO: 7722693 - DNA, 22 bp, Homo sapiens
tctcagaggcccgacgttctcc

SEQ ID NO: 7722694 - DNA, 22 bp, Homo sapiens
tctcagagggaaacatgagtga

SEQ ID NO: 7722695 - DNA, 22 bp, Homo sapiens
tctcagagggaaacatgagtga

SEQ ID NO: 7722696 - DNA, 22 bp, Homo sapiens
tctcagagggaaacatgagtga

SEQ ID NO: 7722697 - DNA, 22 bp, Homo sapiens
tctcagagggaaacatgagtga

SEQ ID NO: 7722698 - DNA, 22 bp, Homo sapiens
tctcagagggaaacatgagtga

SEQ ID NO: 7722699 - DNA, 22 bp, Homo sapiens
tctcagagggaaacatgagtga

SEQ ID NO: 7722700 - DNA, 22 bp, Homo sapiens
tctcagagggaaacatgagtga

SEQ ID NO: 7722701 - DNA, 22 bp, Homo sapiens
tctcagagggaaacatgagtga

SEQ ID NO: 7722702 - DNA, 22 bp, Homo sapiens
tctcagcagccagatccagagc

SEQ ID NO: 7722703 - DNA, 22 bp, Homo sapiens
tctcagcagccagatccagagc

SEQ ID NO: 7722704 - DNA, 22 bp, Homo sapiens
tctcagcacgttgttttcattg

SEQ ID NO: 7722705 - DNA, 18 bp, Homo sapiens
tctcagcccagctccggc

SEQ ID NO: 7722706 - DNA, 22 bp, Homo sapiens
tctcagcaaggaaagaggcagg

SEQ ID NO: 7722707 - DNA, 22 bp, Homo sapiens
tctcagcaaggaaagaggcagg

SEQ ID NO: 7722708 - DNA, 22 bp, Homo sapiens
tctcagcaaggaaagaggcagg

SEQ ID NO: 7722709 - DNA, 22 bp, Homo sapiens
tctcagcaaggaaagaggcagg

SEQ ID NO: 7722710 - DNA, 22 bp, Homo sapiens
tctcagatggcatcagctagag

SEQ ID NO: 7722711 - DNA, 22 bp, Homo sapiens
tctcagagtttttttccaggac

SEQ ID NO: 7722712 - DNA, 22 bp, Homo sapiens
tctcagatgcccttgcatcacc

SEQ ID NO: 7722713 - DNA, 22 bp, Homo sapiens
tctcagatggcatcagctagag

SEQ ID NO: 7722714 - DNA, 22 bp, Homo sapiens
tctcagagtttgaatctggagt

SEQ ID NO: 7722715 - DNA, 22 bp, Homo sapiens
tctcagagtttgaatctggagt

SEQ ID NO: 7722716 - DNA, 22 bp, Homo sapiens
tctcagagtttgaatctggagt

SEQ ID NO: 7722717 - DNA, 22 bp, Homo sapiens
tctcagagtttttttccaggac

SEQ ID NO: 7722718 - DNA, 22 bp, Homo sapiens
tctcagagtttgaatctggagt

SEQ ID NO: 7722719 - DNA, 22 bp, Homo sapiens
tctcagagtttgaatctggagt

SEQ ID NO: 7722720 - DNA, 22 bp, Homo sapiens
tctcagagtttagagctgagcc

SEQ ID NO: 7722721 - DNA, 22 bp, Homo sapiens
tctcagagtttagagctgagcc

SEQ ID NO: 7722722 - DNA, 22 bp, Homo sapiens
tctcagagtttagagctgagcc

SEQ ID NO: 7722723 - DNA, 22 bp, Homo sapiens
tctcagagtttacggggctgaa

SEQ ID NO: 7722724 - DNA, 22 bp, Homo sapiens
tctcagagtttagagctgagcc

SEQ ID NO: 7722725 - DNA, 22 bp, Homo sapiens
tctcagagtttagagctgagcc

SEQ ID NO: 7722726 - DNA, 22 bp, Homo sapiens
tctcagagtttagagctgagcc

SEQ ID NO: 7722727 - DNA, 22 bp, Homo sapiens
tctcaggcttcctggtgctgtg

SEQ ID NO: 7722728 - DNA, 22 bp, Homo sapiens
tctcaggctgtgtgtggaggac

SEQ ID NO: 7722729 - DNA, 22 bp, Homo sapiens
tctcaggctgtgtgtggaggac

SEQ ID NO: 7722730 - DNA, 22 bp, Homo sapiens
tctcaggctgtgtgtggaggac

SEQ ID NO: 7722731 - DNA, 19 bp, Homo sapiens
tctcaggctgggcggctgc

SEQ ID NO: 7722732 - DNA, 22 bp, Homo sapiens
tctcaggctgacattgggactc

SEQ ID NO: 7722733 - DNA, 22 bp, Homo sapiens
tctcaggctcttggaacctgtt

SEQ ID NO: 7722734 - DNA, 22 bp, Homo sapiens
tctcagggagagctgctggcat

SEQ ID NO: 7722735 - DNA, 22 bp, Homo sapiens
tctcagggagagctgctggcat

SEQ ID NO: 7722736 - DNA, 22 bp, Homo sapiens
tctcagggagggcgagtcagcg

SEQ ID NO: 7722737 - DNA, 22 bp, Homo sapiens
tctcagggagggcgagtcagcg

SEQ ID NO: 7722738 - DNA, 22 bp, Homo sapiens
tctcagggagagctgctggcat

SEQ ID NO: 7722739 - DNA, 22 bp, Homo sapiens
tctcaggcttcctggtgctgtg

SEQ ID NO: 7722740 - DNA, 22 bp, Homo sapiens
tctcagggcaattctcagcgac

SEQ ID NO: 7722741 - DNA, 22 bp, Homo sapiens
tctcagggcaattctcagcgac

SEQ ID NO: 7722742 - DNA, 22 bp, Homo sapiens
tctcagggatgggaggccccag

SEQ ID NO: 7722743 - DNA, 22 bp, Homo sapiens
tctcagggagttgaggctgcct

SEQ ID NO: 7722744 - DNA, 22 bp, Homo sapiens
tctcagggagttgaggctgcct

SEQ ID NO: 7722745 - DNA, 22 bp, Homo sapiens
tctcagggagttgaggctgcct

SEQ ID NO: 7722746 - DNA, 22 bp, Homo sapiens
tctcagggaggttccccgttct

SEQ ID NO: 7722747 - DNA, 22 bp, Homo sapiens
tctcagggagttgaggctgcct

SEQ ID NO: 7722748 - DNA, 22 bp, Homo sapiens
tctcagggagttgaggctgcct

SEQ ID NO: 7722749 - DNA, 22 bp, Homo sapiens
tctcagggagttgaggctgcct

SEQ ID NO: 7722750 - DNA, 22 bp, Homo sapiens
tctcagggcctccctctgtttc

SEQ ID NO: 7722751 - DNA, 22 bp, Homo sapiens
tctcagggcgcagtgaggcagt

SEQ ID NO: 7722752 - DNA, 22 bp, Homo sapiens
tctcagggccccaaaggctagt

SEQ ID NO: 7722753 - DNA, 22 bp, Homo sapiens
tctcagggcagcaaggaagcat

SEQ ID NO: 7722754 - DNA, 22 bp, Homo sapiens
tctcagggcagcaaggaagcat

SEQ ID NO: 7722755 - DNA, 22 bp, Homo sapiens
tctcagggccccaaaggctagt

SEQ ID NO: 7722756 - DNA, 22 bp, Homo sapiens
tctcaggctcttggaacctgtt

SEQ ID NO: 7722757 - DNA, 22 bp, Homo sapiens
tctcaggctcttggaacctgtt

SEQ ID NO: 7722758 - DNA, 22 bp, Homo sapiens
tctcaggctcctgacatatatg

SEQ ID NO: 7722759 - DNA, 22 bp, Homo sapiens
tctcaggctagtaaaagatggg

SEQ ID NO: 7722760 - DNA, 22 bp, Homo sapiens
tctcaggctaccttgcacaagg

SEQ ID NO: 7722761 - DNA, 20 bp, Homo sapiens
tctcaggccccctccttgct

SEQ ID NO: 7722762 - DNA, 22 bp, Homo sapiens
tctcaggcccctgagtttctct

SEQ ID NO: 7722763 - DNA, 22 bp, Homo sapiens
tctcaggcccctgagtttctct

SEQ ID NO: 7722764 - DNA, 22 bp, Homo sapiens
tctcaggcccctgagtttctct

SEQ ID NO: 7722765 - DNA, 22 bp, Homo sapiens
tctcagctgactgctttcctcg

SEQ ID NO: 7722766 - DNA, 21 bp, Homo sapiens
tctcaggcgagaattctttta

SEQ ID NO: 7722767 - DNA, 21 bp, Homo sapiens
tctcaggcgagaattctttta

SEQ ID NO: 7722768 - DNA, 20 bp, Homo sapiens
tctcaggccccctccttgct

SEQ ID NO: 7722769 - DNA, 22 bp, Homo sapiens
tctcagctgactgctttcctcg

SEQ ID NO: 7722770 - DNA, 22 bp, Homo sapiens
tctcagctgcctgccctgctcc

SEQ ID NO: 7722771 - DNA, 22 bp, Homo sapiens
tctcagctgactgctttcctcg

SEQ ID NO: 7722772 - DNA, 22 bp, Homo sapiens
tctcagctcttttttcacagaa

SEQ ID NO: 7722773 - DNA, 22 bp, Homo sapiens
tctcagctcatggcagccttga

SEQ ID NO: 7722774 - DNA, 22 bp, Homo sapiens
tctcagctcttttttcacagaa

SEQ ID NO: 7722775 - DNA, 22 bp, Homo sapiens
tctcagctcttttttcacagaa

SEQ ID NO: 7722776 - DNA, 22 bp, Homo sapiens
tctcagctcttttttcacagaa

SEQ ID NO: 7722777 - DNA, 18 bp, Homo sapiens
tctcagcccagctccggc

SEQ ID NO: 7722778 - DNA, 22 bp, Homo sapiens
tctcagcctcacctctatggag

SEQ ID NO: 7722779 - DNA, 22 bp, Homo sapiens
tctcagcctcacctctatggag

SEQ ID NO: 7722780 - DNA, 22 bp, Homo sapiens
tctcagctcagcttccacagag

SEQ ID NO: 7722781 - DNA, 22 bp, Homo sapiens
tctcagctcagcttccacagag

SEQ ID NO: 7722782 - DNA, 22 bp, Homo sapiens
tctcagctcagcttccacagag

SEQ ID NO: 7722783 - DNA, 22 bp, Homo sapiens
tctcagctcatggcagccttga

SEQ ID NO: 7722784 - DNA, 22 bp, Homo sapiens
tctcagctcatggcagccttga

SEQ ID NO: 7722785 - DNA, 22 bp, Homo sapiens
tctcagctcatggcagccttga

SEQ ID NO: 7722786 - DNA, 22 bp, Homo sapiens
tctcagctcatggcagccttga

SEQ ID NO: 7722787 - DNA, 22 bp, Homo sapiens
tctcagctcagcttccacagag

SEQ ID NO: 7722788 - DNA, 22 bp, Homo sapiens
tctcagctcagcttccacagag

SEQ ID NO: 7722789 - DNA, 22 bp, Homo sapiens
tctcagctcagcttccacagag

SEQ ID NO: 7722790 - DNA, 22 bp, Homo sapiens
tctcctggagcccagatgctgg

SEQ ID NO: 7722791 - DNA, 22 bp, Homo sapiens
tctcctggagcaggaaggtggg

SEQ ID NO: 7722792 - DNA, 22 bp, Homo sapiens
tctcctggagcaggaaggtggg

SEQ ID NO: 7722793 - DNA, 22 bp, Homo sapiens
tctcctggagcaggaaggtggg

SEQ ID NO: 7722794 - DNA, 22 bp, Homo sapiens
tctcctggagcaggaaggtggg

SEQ ID NO: 7722795 - DNA, 22 bp, Homo sapiens
tctcctggagcccagatgctgg

SEQ ID NO: 7722796 - DNA, 22 bp, Homo sapiens
tctcctggagcccagatgctgg

SEQ ID NO: 7722797 - DNA, 22 bp, Homo sapiens
tctcctggagcccagatgctgg

SEQ ID NO: 7722798 - DNA, 22 bp, Homo sapiens
tctcctggatagatactatcca

SEQ ID NO: 7722799 - DNA, 22 bp, Homo sapiens
tctcctggagcccagatgctgg

SEQ ID NO: 7722800 - DNA, 22 bp, Homo sapiens
tctcctggagcccagatgctgg

SEQ ID NO: 7722801 - DNA, 22 bp, Homo sapiens
tctcctggatagatactatcca

SEQ ID NO: 7722802 - DNA, 22 bp, Homo sapiens
tctcctggcatgtgggtcatct

SEQ ID NO: 7722803 - DNA, 22 bp, Homo sapiens
tctcctggatggaccttctctt

SEQ ID NO: 7722804 - DNA, 22 bp, Homo sapiens
tctcctggatggaccttctctt

SEQ ID NO: 7722805 - DNA, 22 bp, Homo sapiens
tctcctggatggaccttctctt

SEQ ID NO: 7722806 - DNA, 22 bp, Homo sapiens
tctcctggatagatactatcca

SEQ ID NO: 7722807 - DNA, 22 bp, Homo sapiens
tctcctggatagatactatcca

SEQ ID NO: 7722808 - DNA, 22 bp, Homo sapiens
tctcctggcatttggttgagta

SEQ ID NO: 7722809 - DNA, 22 bp, Homo sapiens
tctcctggcatgtgggtcatct

SEQ ID NO: 7722810 - DNA, 22 bp, Homo sapiens
tctcctggcatttggttgagta

SEQ ID NO: 7722811 - DNA, 22 bp, Homo sapiens
tctcctggcatgtgggtcatct

SEQ ID NO: 7722812 - DNA, 22 bp, Homo sapiens
tctcctgcagcgagcccgacac

SEQ ID NO: 7722813 - DNA, 22 bp, Homo sapiens
tctcctgcagtcagcagtctca

SEQ ID NO: 7722814 - DNA, 22 bp, Homo sapiens
tctcctgcagcgagcccgacac

SEQ ID NO: 7722815 - DNA, 22 bp, Homo sapiens
tctcctgcagcgagcccgacac

SEQ ID NO: 7722816 - DNA, 22 bp, Homo sapiens
tctcctgccactgcttcccatt

SEQ ID NO: 7722817 - DNA, 22 bp, Homo sapiens
tctcctgcagtcagcagtctca

SEQ ID NO: 7722818 - DNA, 22 bp, Homo sapiens
tctcctgcagtcagcagtctca

SEQ ID NO: 7722819 - DNA, 22 bp, Homo sapiens
tctcctgccactgcttcccatt

SEQ ID NO: 7722820 - DNA, 22 bp, Homo sapiens
tctcctgccactgcttcccatt

SEQ ID NO: 7722821 - DNA, 22 bp, Homo sapiens
tctcctgccactgcttcccatt

SEQ ID NO: 7722822 - DNA, 22 bp, Homo sapiens
tctcctgctcagaacagcctca

SEQ ID NO: 7722823 - DNA, 22 bp, Homo sapiens
tctcctgctcagaacagcctca

SEQ ID NO: 7722824 - DNA, 22 bp, Homo sapiens
tctcctgctcagaacagcctca

SEQ ID NO: 7722825 - DNA, 22 bp, Homo sapiens
tctcctgctcagaacagcctca

SEQ ID NO: 7722826 - DNA, 22 bp, Homo sapiens
tctcctgctcagaacagcctca

SEQ ID NO: 7722827 - DNA, 22 bp, Homo sapiens
tctcctgctcagaacagcctca

SEQ ID NO: 7722828 - DNA, 22 bp, Homo sapiens
tctcctgctcccaactgctgca

SEQ ID NO: 7722829 - DNA, 22 bp, Homo sapiens
tctcctgctcccaactgctgca

SEQ ID NO: 7722830 - DNA, 22 bp, Homo sapiens
tctcctgctcccaactgctgca

SEQ ID NO: 7722831 - DNA, 22 bp, Homo sapiens
tctcctgcttcaactgatggac

SEQ ID NO: 7722832 - DNA, 22 bp, Homo sapiens
tctcctgcttcaactgatggac

SEQ ID NO: 7722833 - DNA, 22 bp, Homo sapiens
tctcctgcttcaactgatggac

SEQ ID NO: 7722834 - DNA, 22 bp, Homo sapiens
tctcctgcttcaactgatggac

SEQ ID NO: 7722835 - DNA, 22 bp, Homo sapiens
tctcctggaagaataccacact

SEQ ID NO: 7722836 - DNA, 22 bp, Homo sapiens
tctcctggaagaataccacact

SEQ ID NO: 7722837 - DNA, 22 bp, Homo sapiens
tctcctggaagtgattcccctg

SEQ ID NO: 7722838 - DNA, 22 bp, Homo sapiens
tctcctggaagtgattcccctg

SEQ ID NO: 7722839 - DNA, 22 bp, Homo sapiens
tctcctctactgggtctgcaga

SEQ ID NO: 7722840 - DNA, 22 bp, Homo sapiens
tctcctctactgggtctgcaga

SEQ ID NO: 7722841 - DNA, 22 bp, Homo sapiens
tctcctctactgggtctgcaga

SEQ ID NO: 7722842 - DNA, 22 bp, Homo sapiens
tctcctctactgggtctgcaga

SEQ ID NO: 7722843 - DNA, 22 bp, Homo sapiens
tctcctccttttttcaacatag

SEQ ID NO: 7722844 - DNA, 22 bp, Homo sapiens
tctcctctactgggtctgcaga

SEQ ID NO: 7722845 - DNA, 23 bp, Homo sapiens
tctcctcctagatacagtcatgg

SEQ ID NO: 7722846 - DNA, 23 bp, Homo sapiens
tctcctcctagatacagtcatgg

SEQ ID NO: 7722847 - DNA, 23 bp, Homo sapiens
tctcctcctagatacagtcatgg

SEQ ID NO: 7722848 - DNA, 22 bp, Homo sapiens
tctcctccttttttcaacatag

SEQ ID NO: 7722849 - DNA, 22 bp, Homo sapiens
tctcctcccaggctcttccagg

SEQ ID NO: 7722850 - DNA, 21 bp, Homo sapiens
tctcctcccggggagaggccg

SEQ ID NO: 7722851 - DNA, 21 bp, Homo sapiens
tctcctcccggggagaggccg

SEQ ID NO: 7722852 - DNA, 23 bp, Homo sapiens
tctcctcctagatacagtcatgg

SEQ ID NO: 7722853 - DNA, 23 bp, Homo sapiens
tctcctcctagatacagtcatgg

SEQ ID NO: 7722854 - DNA, 21 bp, Homo sapiens
tctcctcccggggagaggccg

SEQ ID NO: 7722855 - DNA, 23 bp, Homo sapiens
tctcctcctagatacagtcatgg

SEQ ID NO: 7722856 - DNA, 23 bp, Homo sapiens
tctcctcctagatacagtcatgg

SEQ ID NO: 7722857 - DNA, 22 bp, Homo sapiens
tctcctccagaggctgtgggga

SEQ ID NO: 7722858 - DNA, 22 bp, Homo sapiens
tctcctcccaggctcttccagg

SEQ ID NO: 7722859 - DNA, 22 bp, Homo sapiens
tctcctcccaggctcttccagg

SEQ ID NO: 7722860 - DNA, 22 bp, Homo sapiens
tctcctcccaggctcttccagg

SEQ ID NO: 7722861 - DNA, 22 bp, Homo sapiens
tctcctccagaggctgtgggga

SEQ ID NO: 7722862 - DNA, 22 bp, Homo sapiens
tctcctcccaggctcttccagg

SEQ ID NO: 7722863 - DNA, 22 bp, Homo sapiens
tctcctcccaggctcttccagg

SEQ ID NO: 7722864 - DNA, 22 bp, Homo sapiens
tctcctcccaggctcttccagg

SEQ ID NO: 7722865 - DNA, 22 bp, Homo sapiens
tctcctcccaggctcttccagg

SEQ ID NO: 7722866 - DNA, 22 bp, Homo sapiens
tctcctcaccaccagcagcaga

SEQ ID NO: 7722867 - DNA, 22 bp, Homo sapiens
tctcctaggctggagtgcagtg

SEQ ID NO: 7722868 - DNA, 22 bp, Homo sapiens
tctcctactcactcaaggcttg

SEQ ID NO: 7722869 - DNA, 22 bp, Homo sapiens
tctcctactcactcaaggcttg

SEQ ID NO: 7722870 - DNA, 22 bp, Homo sapiens
tctcctactcactcaaggcttg

SEQ ID NO: 7722871 - DNA, 22 bp, Homo sapiens
tctcctcaccaccagcagcaga

SEQ ID NO: 7722872 - DNA, 22 bp, Homo sapiens
tctcctccagaggctgtgggga

SEQ ID NO: 7722873 - DNA, 22 bp, Homo sapiens
tctcctccagaggctgtgggga

SEQ ID NO: 7722874 - DNA, 22 bp, Homo sapiens
tctcctccagaggctgtgggga

SEQ ID NO: 7722875 - DNA, 22 bp, Homo sapiens
tctcctcaccaccagcagcaga

SEQ ID NO: 7722876 - DNA, 22 bp, Homo sapiens
tctcctcaccaccagcagcaga

SEQ ID NO: 7722877 - DNA, 22 bp, Homo sapiens
tctcctctcttacctggtacaa

SEQ ID NO: 7722878 - DNA, 22 bp, Homo sapiens
tctcctctcctttcatgttgtt

SEQ ID NO: 7722879 - DNA, 22 bp, Homo sapiens
tctcctctcttacctggtacaa

SEQ ID NO: 7722880 - DNA, 22 bp, Homo sapiens
tctcctctcttacctggtacaa

SEQ ID NO: 7722881 - DNA, 22 bp, Homo sapiens
tctcctctcctttcatgttgtt

SEQ ID NO: 7722882 - DNA, 22 bp, Homo sapiens
tctcctctcctttcatgttgtt

SEQ ID NO: 7722883 - DNA, 22 bp, Homo sapiens
tctcctctgcgcggcagtgccc

SEQ ID NO: 7722884 - DNA, 22 bp, Homo sapiens
tctcctctgcgcggcagtgccc

SEQ ID NO: 7722885 - DNA, 22 bp, Homo sapiens
tctcctctgcgcggcagtgccc

SEQ ID NO: 7722886 - DNA, 22 bp, Homo sapiens
tctcctctcttacctggtacaa

SEQ ID NO: 7722887 - DNA, 22 bp, Homo sapiens
tctcctctcttacctggtacaa

SEQ ID NO: 7722888 - DNA, 22 bp, Homo sapiens
tctcctctatttctgtatgtat

SEQ ID NO: 7722889 - DNA, 22 bp, Homo sapiens
tctcctctatttctgtatgtat

SEQ ID NO: 7722890 - DNA, 22 bp, Homo sapiens
tctcctctatttctgtatgtat

SEQ ID NO: 7722891 - DNA, 22 bp, Homo sapiens
tctcctctactgggtctgcaga

SEQ ID NO: 7722892 - DNA, 22 bp, Homo sapiens
tctcctctatttctgtatgtat

SEQ ID NO: 7722893 - DNA, 22 bp, Homo sapiens
tctcctctcctttcatgttgtt

SEQ ID NO: 7722894 - DNA, 22 bp, Homo sapiens
tctcctctcctttcatgttgtt

SEQ ID NO: 7722895 - DNA, 22 bp, Homo sapiens
tctcctctcctttcatgttgtt

SEQ ID NO: 7722896 - DNA, 22 bp, Homo sapiens
tctcctctgcgcggcagtgccc

SEQ ID NO: 7722897 - DNA, 22 bp, Homo sapiens
tctcctctgtgccacagcttgg

SEQ ID NO: 7722898 - DNA, 22 bp, Homo sapiens
tctcctctgtgccacagcttgg

SEQ ID NO: 7722899 - DNA, 22 bp, Homo sapiens
tctcctctgtgccacagcttgg

SEQ ID NO: 7722900 - DNA, 22 bp, Homo sapiens
tctcctgaagaccatgtgcact

SEQ ID NO: 7722901 - DNA, 22 bp, Homo sapiens
tctcctgatgatggtactggca

SEQ ID NO: 7722902 - DNA, 22 bp, Homo sapiens
tctcctgatgatggtactggca

SEQ ID NO: 7722903 - DNA, 22 bp, Homo sapiens
tctcctgatgatggtactggca

SEQ ID NO: 7722904 - DNA, 22 bp, Homo sapiens
tctcctgatatctgcagaccta

SEQ ID NO: 7722905 - DNA, 22 bp, Homo sapiens
tctcctgatatctgcagaccta

SEQ ID NO: 7722906 - DNA, 22 bp, Homo sapiens
tctcctgatatctgcagaccta

SEQ ID NO: 7722907 - DNA, 22 bp, Homo sapiens
tctcctgacatgtctggaggaa

SEQ ID NO: 7722908 - DNA, 22 bp, Homo sapiens
tctcctgacatgtctggaggaa

SEQ ID NO: 7722909 - DNA, 22 bp, Homo sapiens
tctcctgacatgtctggaggaa

SEQ ID NO: 7722910 - DNA, 20 bp, Homo sapiens
tctcctggtctggtccgtgc

SEQ ID NO: 7722911 - DNA, 20 bp, Homo sapiens
tctcctggtctggtccgtgc

SEQ ID NO: 7722912 - DNA, 22 bp, Homo sapiens
tctcctggtcacctcagaagtc

SEQ ID NO: 7722913 - DNA, 22 bp, Homo sapiens
tctcctggtcacctcagaagtc

SEQ ID NO: 7722914 - DNA, 22 bp, Homo sapiens
tctcctggtcacctcagaagtc

SEQ ID NO: 7722915 - DNA, 22 bp, Homo sapiens
tctcctggtcacctcagaagtc

SEQ ID NO: 7722916 - DNA, 20 bp, Homo sapiens
tctcctggtctggtccgtgc

SEQ ID NO: 7722917 - DNA, 22 bp, Homo sapiens
tctcctggtttgttaaataatt

SEQ ID NO: 7722918 - DNA, 20 bp, Homo sapiens
tctcctggtgacagtaccca

SEQ ID NO: 7722919 - DNA, 20 bp, Homo sapiens
tctcctggtgacagtaccca

SEQ ID NO: 7722920 - DNA, 20 bp, Homo sapiens
tctcctggtgacagtaccca

SEQ ID NO: 7722921 - DNA, 22 bp, Homo sapiens
tctcctggtttgttaaataatt

SEQ ID NO: 7722922 - DNA, 22 bp, Homo sapiens
tctcctgtcttctcagcacccc

SEQ ID NO: 7722923 - DNA, 22 bp, Homo sapiens
tctcctgtgcaccctccctgtg

SEQ ID NO: 7722924 - DNA, 22 bp, Homo sapiens
tctcctgtatgggactggcgag

SEQ ID NO: 7722925 - DNA, 22 bp, Homo sapiens
tctcctgtatgggactggcgag

SEQ ID NO: 7722926 - DNA, 23 bp, Homo sapiens
tctcctgtcctaattaccacccc

SEQ ID NO: 7722927 - DNA, 22 bp, Homo sapiens
tctccttccaacaaaaggtcac

SEQ ID NO: 7722928 - DNA, 22 bp, Homo sapiens
tctccttcgaggcccagctccc

SEQ ID NO: 7722929 - DNA, 18 bp, Homo sapiens
tctccttccaaatcttca

SEQ ID NO: 7722930 - DNA, 18 bp, Homo sapiens
tctccttccaaatcttca

SEQ ID NO: 7722931 - DNA, 18 bp, Homo sapiens
tctccttccaaatcttca

SEQ ID NO: 7722932 - DNA, 18 bp, Homo sapiens
tctccttccaaatcttca

SEQ ID NO: 7722933 - DNA, 18 bp, Homo sapiens
tctccttccaaatcttca

SEQ ID NO: 7722934 - DNA, 18 bp, Homo sapiens
tctccttccaaatcttca

SEQ ID NO: 7722935 - DNA, 22 bp, Homo sapiens
tctcctgtgcaccctccctgtg

SEQ ID NO: 7722936 - DNA, 22 bp, Homo sapiens
tctcctgtgcaccctccctgtg

SEQ ID NO: 7722937 - DNA, 22 bp, Homo sapiens
tctcctgggcttggttgaagtt

SEQ ID NO: 7722938 - DNA, 22 bp, Homo sapiens
tctcctgggtaaaagggttgat

SEQ ID NO: 7722939 - DNA, 22 bp, Homo sapiens
tctcctggccctgtcgccatct

SEQ ID NO: 7722940 - DNA, 22 bp, Homo sapiens
tctcctgggtaaaagggttgat

SEQ ID NO: 7722941 - DNA, 22 bp, Homo sapiens
tctcctgggtaaaagggttgat

SEQ ID NO: 7722942 - DNA, 18 bp, Homo sapiens
tctcctgggtaggggcct

SEQ ID NO: 7722943 - DNA, 18 bp, Homo sapiens
tctcctgggtaggggcct

SEQ ID NO: 7722944 - DNA, 18 bp, Homo sapiens
tctcctgggtaggggcct

SEQ ID NO: 7722945 - DNA, 21 bp, Homo sapiens
tctcctgggtccaacccatgc

SEQ ID NO: 7722946 - DNA, 21 bp, Homo sapiens
tctcctgggtccaacccatgc

SEQ ID NO: 7722947 - DNA, 22 bp, Homo sapiens
tctcctgggtgctttatcagaa

SEQ ID NO: 7722948 - DNA, 22 bp, Homo sapiens
tctcctgggtgctttatcagaa

SEQ ID NO: 7722949 - DNA, 22 bp, Homo sapiens
tctcctggtacccttcctagca

SEQ ID NO: 7722950 - DNA, 22 bp, Homo sapiens
tctcctggtacccttcctagca

SEQ ID NO: 7722951 - DNA, 22 bp, Homo sapiens
tctcctggtacccttcctagca

SEQ ID NO: 7722952 - DNA, 22 bp, Homo sapiens
tctcctggtatgtatgcacctg

SEQ ID NO: 7722953 - DNA, 22 bp, Homo sapiens
tctcctggtatgtatgcacctg

SEQ ID NO: 7722954 - DNA, 22 bp, Homo sapiens
tctcctggtatgtatgcacctg

SEQ ID NO: 7722955 - DNA, 22 bp, Homo sapiens
tctcctggtacccttcctagca

SEQ ID NO: 7722956 - DNA, 22 bp, Homo sapiens
tctcctggtacccttcctagca

SEQ ID NO: 7722957 - DNA, 22 bp, Homo sapiens
tctcgggtttaggtgatagtat

SEQ ID NO: 7722958 - DNA, 22 bp, Homo sapiens
tctcgggtcatgatttccatca

SEQ ID NO: 7722959 - DNA, 22 bp, Homo sapiens
tctcgctctgtcgcccaggctg

SEQ ID NO: 7722960 - DNA, 22 bp, Homo sapiens
tctcgctctgtcgcccaggctg

SEQ ID NO: 7722961 - DNA, 22 bp, Homo sapiens
tctcgctctgtcgcccaggctg

SEQ ID NO: 7722962 - DNA, 22 bp, Homo sapiens
tctcgctctgtcgcccaggctg

SEQ ID NO: 7722963 - DNA, 22 bp, Homo sapiens
tctcgctctgtcgcccaggctg

SEQ ID NO: 7722964 - DNA, 22 bp, Homo sapiens
tctcgctctgtcgcccaggctg

SEQ ID NO: 7722965 - DNA, 22 bp, Homo sapiens
tctcgctctgtcgcccaggctg

SEQ ID NO: 7722966 - DNA, 22 bp, Homo sapiens
tctcgctctgtcgcccaggctg

SEQ ID NO: 7722967 - DNA, 22 bp, Homo sapiens
tctcgctctgtcgcccaggctg

SEQ ID NO: 7722968 - DNA, 22 bp, Homo sapiens
tctcgctctgtcgcccaggctg

SEQ ID NO: 7722969 - DNA, 22 bp, Homo sapiens
tctcgctctgtcgcccaggctg

SEQ ID NO: 7722970 - DNA, 22 bp, Homo sapiens
tctcgctctgtcgcccaggctg

SEQ ID NO: 7722971 - DNA, 22 bp, Homo sapiens
tctctaaacttatatgaactat

SEQ ID NO: 7722972 - DNA, 22 bp, Homo sapiens
tctctagtctcctttaacctga

SEQ ID NO: 7722973 - DNA, 22 bp, Homo sapiens
tctctagtctcctttaacctga

SEQ ID NO: 7722974 - DNA, 22 bp, Homo sapiens
tctctagtctcctttaacctga

SEQ ID NO: 7722975 - DNA, 22 bp, Homo sapiens
tctctagtctcctttaacctga

SEQ ID NO: 7722976 - DNA, 22 bp, Homo sapiens
tctctaaacttatatgaactat

SEQ ID NO: 7722977 - DNA, 22 bp, Homo sapiens
tctctaaacttatatgaactat

SEQ ID NO: 7722978 - DNA, 22 bp, Homo sapiens
tctctaaacttatatgaactat

SEQ ID NO: 7722979 - DNA, 22 bp, Homo sapiens
tctctaaacttatatgaactat

SEQ ID NO: 7722980 - DNA, 21 bp, Homo sapiens
tctctaaaaagattctatttg

SEQ ID NO: 7722981 - DNA, 21 bp, Homo sapiens
tctcgttgtatggtcttgggg

SEQ ID NO: 7722982 - DNA, 22 bp, Homo sapiens
tctcgtgcaggccttgctcgga

SEQ ID NO: 7722983 - DNA, 21 bp, Homo sapiens
tctcgttgtatggtcttgggg

SEQ ID NO: 7722984 - DNA, 22 bp, Homo sapiens
tctcgatctcctgaccttgtga

SEQ ID NO: 7722985 - DNA, 22 bp, Homo sapiens
tctcctttgaaagttaggactg

SEQ ID NO: 7722986 - DNA, 22 bp, Homo sapiens
tctcgacagcctggcacagtgg

SEQ ID NO: 7722987 - DNA, 22 bp, Homo sapiens
tctcctttcttttaaaatgtca

SEQ ID NO: 7722988 - DNA, 22 bp, Homo sapiens
tctcctttctggagcctgctca

SEQ ID NO: 7722989 - DNA, 22 bp, Homo sapiens
tctcctttgaaagttaggactg

SEQ ID NO: 7722990 - DNA, 22 bp, Homo sapiens
tctcctttgaaagttaggactg

SEQ ID NO: 7722991 - DNA, 22 bp, Homo sapiens
tctcctttcttttaaaatgtca

SEQ ID NO: 7722992 - DNA, 22 bp, Homo sapiens
tctcctttcttttaaaatgtca

SEQ ID NO: 7722993 - DNA, 22 bp, Homo sapiens
tctcctttcttttaaaatgtca

SEQ ID NO: 7722994 - DNA, 22 bp, Homo sapiens
tctcgatctcctgaccttgtga

SEQ ID NO: 7722995 - DNA, 22 bp, Homo sapiens
tctcgatctcctgaccttgtga

SEQ ID NO: 7722996 - DNA, 22 bp, Homo sapiens
tctcgatctcctgaccttgtga

SEQ ID NO: 7722997 - DNA, 22 bp, Homo sapiens
tctcgatctcctgaccttgtga

SEQ ID NO: 7722998 - DNA, 22 bp, Homo sapiens
tctcgatctcctgaccttgtga

SEQ ID NO: 7722999 - DNA, 22 bp, Homo sapiens
tctcgatctcctgaccttgtga

SEQ ID NO: 7723000 - DNA, 20 bp, Homo sapiens
tctcgcactcggagcagccg

SEQ ID NO: 7723001 - DNA, 20 bp, Homo sapiens
tctcgcactcggagcagccg

SEQ ID NO: 7723002 - DNA, 22 bp, Homo sapiens
tctcgctctgtcgcccaggctg

SEQ ID NO: 7723003 - DNA, 22 bp, Homo sapiens
tctcgctctgtcgcccaggctg

SEQ ID NO: 7723004 - DNA, 22 bp, Homo sapiens
tctcgctctgtcgcccaggctg

SEQ ID NO: 7723005 - DNA, 22 bp, Homo sapiens
tctcgctctgtcgcccaggctg

SEQ ID NO: 7723006 - DNA, 22 bp, Homo sapiens
tctccttcgaggcccagctccc

SEQ ID NO: 7723007 - DNA, 22 bp, Homo sapiens
tctccttcgaggcccagctccc

SEQ ID NO: 7723008 - DNA, 22 bp, Homo sapiens
tctccttcgaggcccagctccc

SEQ ID NO: 7723009 - DNA, 22 bp, Homo sapiens
tctccttcgaggcccagctccc

SEQ ID NO: 7723010 - DNA, 22 bp, Homo sapiens
tctccttcgaggcccagctccc

SEQ ID NO: 7723011 - DNA, 22 bp, Homo sapiens
tctccttcgaggcccagctccc

SEQ ID NO: 7723012 - DNA, 22 bp, Homo sapiens
tctccttgacaggcaggcagac

SEQ ID NO: 7723013 - DNA, 22 bp, Homo sapiens
tctccttcgaggcccagctccc

SEQ ID NO: 7723014 - DNA, 22 bp, Homo sapiens
tctccttgacaggcaggcagac

SEQ ID NO: 7723015 - DNA, 22 bp, Homo sapiens
tctccttgctacccagtatgtc

SEQ ID NO: 7723016 - DNA, 22 bp, Homo sapiens
tctccttgctacccagtatgtc

SEQ ID NO: 7723017 - DNA, 22 bp, Homo sapiens
tctcctttaagatttcctcagg

SEQ ID NO: 7723018 - DNA, 22 bp, Homo sapiens
tctcctttctggagcctgctca

SEQ ID NO: 7723019 - DNA, 22 bp, Homo sapiens
tctcctttctggagcctgctca

SEQ ID NO: 7723020 - DNA, 22 bp, Homo sapiens
tctcccagaggatcccagtgga

SEQ ID NO: 7723021 - DNA, 22 bp, Homo sapiens
tctcccagaggatcccagtgga

SEQ ID NO: 7723022 - DNA, 22 bp, Homo sapiens
tctcccagaggatcccagtgga

SEQ ID NO: 7723023 - DNA, 22 bp, Homo sapiens
tctcccagaagtcctcagtaca

SEQ ID NO: 7723024 - DNA, 22 bp, Homo sapiens
tctcccagaggatcccagtgga

SEQ ID NO: 7723025 - DNA, 22 bp, Homo sapiens
tctcccagaggatcccagtgga

SEQ ID NO: 7723026 - DNA, 22 bp, Homo sapiens
tctcccagaggatcccagtgga

SEQ ID NO: 7723027 - DNA, 22 bp, Homo sapiens
tctcccagaggatcccagtgga

SEQ ID NO: 7723028 - DNA, 22 bp, Homo sapiens
tctcccagaagtcctcagtaca

SEQ ID NO: 7723029 - DNA, 22 bp, Homo sapiens
tctcccagaagtcctcagtaca

SEQ ID NO: 7723030 - DNA, 22 bp, Homo sapiens
tctcccagaagtcctcagtaca

SEQ ID NO: 7723031 - DNA, 22 bp, Homo sapiens
tctcccactggccttgtatgat

SEQ ID NO: 7723032 - DNA, 22 bp, Homo sapiens
tctcccactggccttgtatgat

SEQ ID NO: 7723033 - DNA, 22 bp, Homo sapiens
tctcccactgcaagcccaggct

SEQ ID NO: 7723034 - DNA, 22 bp, Homo sapiens
tctccaggttcagtcgatggaa

SEQ ID NO: 7723035 - DNA, 22 bp, Homo sapiens
tctccaggttcagtcgatggaa

SEQ ID NO: 7723036 - DNA, 22 bp, Homo sapiens
tctccaggttcagtcgatggaa

SEQ ID NO: 7723037 - DNA, 22 bp, Homo sapiens
tctccaggtggggtcacctttt

SEQ ID NO: 7723038 - DNA, 22 bp, Homo sapiens
tctccaggtggggtcacctttt

SEQ ID NO: 7723039 - DNA, 22 bp, Homo sapiens
tctccaggtggggtcacctttt

SEQ ID NO: 7723040 - DNA, 22 bp, Homo sapiens
tctccaggtggcttgggcttct

SEQ ID NO: 7723041 - DNA, 21 bp, Homo sapiens
tctccagtatccttctctgag

SEQ ID NO: 7723042 - DNA, 21 bp, Homo sapiens
tctccagtatccttctctgag

SEQ ID NO: 7723043 - DNA, 22 bp, Homo sapiens
tctcccactgcaagcccaggct

SEQ ID NO: 7723044 - DNA, 22 bp, Homo sapiens
tctcccactgcaagcccaggct

SEQ ID NO: 7723045 - DNA, 22 bp, Homo sapiens
tctcccactgcaagcccaggct

SEQ ID NO: 7723046 - DNA, 22 bp, Homo sapiens
tctccaggtagatatgtcagga

SEQ ID NO: 7723047 - DNA, 22 bp, Homo sapiens
tctccaggtagatatgtcagga

SEQ ID NO: 7723048 - DNA, 22 bp, Homo sapiens
tctccaggtagatatgtcagga

SEQ ID NO: 7723049 - DNA, 22 bp, Homo sapiens
tctccaggtaaatggcatcctg

SEQ ID NO: 7723050 - DNA, 22 bp, Homo sapiens
tctccaggtgaaacttgcaggg

SEQ ID NO: 7723051 - DNA, 22 bp, Homo sapiens
tctccaggtgaaacttgcaggg

SEQ ID NO: 7723052 - DNA, 22 bp, Homo sapiens
tctccaggtgaaacttgcaggg

SEQ ID NO: 7723053 - DNA, 22 bp, Homo sapiens
tctccaggtgaaacttgcaggg

SEQ ID NO: 7723054 - DNA, 22 bp, Homo sapiens
tctccaggtgaaacttgcaggg

SEQ ID NO: 7723055 - DNA, 22 bp, Homo sapiens
tctccaggtgaaacttgcaggg

SEQ ID NO: 7723056 - DNA, 22 bp, Homo sapiens
tctccaggtgactctgatgtat

SEQ ID NO: 7723057 - DNA, 22 bp, Homo sapiens
tctccaggtgactctgatgtat

SEQ ID NO: 7723058 - DNA, 19 bp, Homo sapiens
tctccaggtgccccaaaca

SEQ ID NO: 7723059 - DNA, 22 bp, Homo sapiens
tctccaggtgagggtggttaga

SEQ ID NO: 7723060 - DNA, 19 bp, Homo sapiens
tctccaggtgccccaaaca

SEQ ID NO: 7723061 - DNA, 22 bp, Homo sapiens
tctccaggtgctaagtgtgcct

SEQ ID NO: 7723062 - DNA, 22 bp, Homo sapiens
tctccaggtggcttgggcttct

SEQ ID NO: 7723063 - DNA, 22 bp, Homo sapiens
tctccaggtggcttgggcttct

SEQ ID NO: 7723064 - DNA, 22 bp, Homo sapiens
tctccaggtggcttgggcttct

SEQ ID NO: 7723065 - DNA, 22 bp, Homo sapiens
tctccaggtgctaagtgtgcct

SEQ ID NO: 7723066 - DNA, 22 bp, Homo sapiens
tctccaggtggcttgggcttct

SEQ ID NO: 7723067 - DNA, 22 bp, Homo sapiens
tctccaggtggcttgggcttct

SEQ ID NO: 7723068 - DNA, 22 bp, Homo sapiens
tctccaggtgctaagtgtgcct

SEQ ID NO: 7723069 - DNA, 22 bp, Homo sapiens
tctccaggtgctaagtgtgcct

SEQ ID NO: 7723070 - DNA, 22 bp, Homo sapiens
tctccagggactgaggctggag

SEQ ID NO: 7723071 - DNA, 22 bp, Homo sapiens
tctccagggactgaggctggag

SEQ ID NO: 7723072 - DNA, 22 bp, Homo sapiens
tctccagggactgaggctggag

SEQ ID NO: 7723073 - DNA, 22 bp, Homo sapiens
tctccagggaggtagcccagtg

SEQ ID NO: 7723074 - DNA, 22 bp, Homo sapiens
tctccagggactgaggctggag

SEQ ID NO: 7723075 - DNA, 22 bp, Homo sapiens
tctccagggacatgtttctgga

SEQ ID NO: 7723076 - DNA, 22 bp, Homo sapiens
tctccaggctttttgtgaattg

SEQ ID NO: 7723077 - DNA, 22 bp, Homo sapiens
tctccaggctttttgtgaattg

SEQ ID NO: 7723078 - DNA, 22 bp, Homo sapiens
tctccaggctttttgtgaattg

SEQ ID NO: 7723079 - DNA, 22 bp, Homo sapiens
tctccagggactgaggctggag

SEQ ID NO: 7723080 - DNA, 22 bp, Homo sapiens
tctccagggacatgtttctgga

SEQ ID NO: 7723081 - DNA, 22 bp, Homo sapiens
tctccagggacatgtttctgga

SEQ ID NO: 7723082 - DNA, 22 bp, Homo sapiens
tctccagggacatgtttctgga

SEQ ID NO: 7723083 - DNA, 22 bp, Homo sapiens
tctccaggcttaatctcagctt

SEQ ID NO: 7723084 - DNA, 22 bp, Homo sapiens
tctccaggcttaatctcagctt

SEQ ID NO: 7723085 - DNA, 22 bp, Homo sapiens
tctccaggcttaatctcagctt

SEQ ID NO: 7723086 - DNA, 22 bp, Homo sapiens
tctccaggcttaatctcagctt

SEQ ID NO: 7723087 - DNA, 23 bp, Homo sapiens
tctccaggccttactccaggcct

SEQ ID NO: 7723088 - DNA, 22 bp, Homo sapiens
tctccaggcctttcccatctta

SEQ ID NO: 7723089 - DNA, 22 bp, Homo sapiens
tctccaggcctttcccatctta

SEQ ID NO: 7723090 - DNA, 22 bp, Homo sapiens
tctccaggggctgctgtgccac

SEQ ID NO: 7723091 - DNA, 22 bp, Homo sapiens
tctccaggggctgctgtgccac

SEQ ID NO: 7723092 - DNA, 22 bp, Homo sapiens
tctccaggggctgctgtgccac

SEQ ID NO: 7723093 - DNA, 22 bp, Homo sapiens
tctccaggggctgctgtgccac

SEQ ID NO: 7723094 - DNA, 22 bp, Homo sapiens
tctccagggtgagctaggccag

SEQ ID NO: 7723095 - DNA, 22 bp, Homo sapiens
tctccagggtgagctaggccag

SEQ ID NO: 7723096 - DNA, 22 bp, Homo sapiens
tctccagggtgagctaggccag

SEQ ID NO: 7723097 - DNA, 22 bp, Homo sapiens
tctccagggtgagctaggccag

SEQ ID NO: 7723098 - DNA, 22 bp, Homo sapiens
tctccaggtaaatggcatcctg

SEQ ID NO: 7723099 - DNA, 22 bp, Homo sapiens
tctccaggtaaatggcatcctg

SEQ ID NO: 7723100 - DNA, 22 bp, Homo sapiens
tctccagggtgagctaggccag

SEQ ID NO: 7723101 - DNA, 22 bp, Homo sapiens
tctccaggggcagggtctggag

SEQ ID NO: 7723102 - DNA, 22 bp, Homo sapiens
tctccagggcccccgagcgttg

SEQ ID NO: 7723103 - DNA, 22 bp, Homo sapiens
tctccagggcccccgagcgttg

SEQ ID NO: 7723104 - DNA, 22 bp, Homo sapiens
tctccaggggctgctgtgccac

SEQ ID NO: 7723105 - DNA, 22 bp, Homo sapiens
tctccaggggcagggtctggag

SEQ ID NO: 7723106 - DNA, 22 bp, Homo sapiens
tctccaggggcagggtctggag

SEQ ID NO: 7723107 - DNA, 22 bp, Homo sapiens
tctccaggggcagggtctggag

SEQ ID NO: 7723108 - DNA, 22 bp, Homo sapiens
tctccagggcagagaatagcaa

SEQ ID NO: 7723109 - DNA, 22 bp, Homo sapiens
tctccagggcagagaatagcaa

SEQ ID NO: 7723110 - DNA, 22 bp, Homo sapiens
tctccagggaggtagcccagtg

SEQ ID NO: 7723111 - DNA, 22 bp, Homo sapiens
tctccagggaggtagcccagtg

SEQ ID NO: 7723112 - DNA, 22 bp, Homo sapiens
tctcccctgttggccaggtttt

SEQ ID NO: 7723113 - DNA, 22 bp, Homo sapiens
tctcccctgttggccaggtttt

SEQ ID NO: 7723114 - DNA, 22 bp, Homo sapiens
tctcccctgttggccaggtttt

SEQ ID NO: 7723115 - DNA, 22 bp, Homo sapiens
tctcccctggtctcgcgcgctg

SEQ ID NO: 7723116 - DNA, 22 bp, Homo sapiens
tctcccctccctggaccagtgc

SEQ ID NO: 7723117 - DNA, 22 bp, Homo sapiens
tctcccctccctggaccagtgc

SEQ ID NO: 7723118 - DNA, 22 bp, Homo sapiens
tctcccctactctaaatctgca

SEQ ID NO: 7723119 - DNA, 22 bp, Homo sapiens
tctcccctagtgcattaaagtg

SEQ ID NO: 7723120 - DNA, 22 bp, Homo sapiens
tctcccccagtctctacagcag

SEQ ID NO: 7723121 - DNA, 22 bp, Homo sapiens
tctcccccagtctctacagcag

SEQ ID NO: 7723122 - DNA, 22 bp, Homo sapiens
tctccccaggggtatgggtatt

SEQ ID NO: 7723123 - DNA, 22 bp, Homo sapiens
tctccccagtatggattctctg

SEQ ID NO: 7723124 - DNA, 22 bp, Homo sapiens
tctccccagtatggattctctg

SEQ ID NO: 7723125 - DNA, 22 bp, Homo sapiens
tctccccaggggtatgggtatt

SEQ ID NO: 7723126 - DNA, 22 bp, Homo sapiens
tctccccaggggtatgggtatt

SEQ ID NO: 7723127 - DNA, 22 bp, Homo sapiens
tctccccaggggtatgggtatt

SEQ ID NO: 7723128 - DNA, 21 bp, Homo sapiens
tctccccattcttattcccat

SEQ ID NO: 7723129 - DNA, 21 bp, Homo sapiens
tctccccattcttattcccat

SEQ ID NO: 7723130 - DNA, 22 bp, Homo sapiens
tctccccagtatggattctctg

SEQ ID NO: 7723131 - DNA, 21 bp, Homo sapiens
tctccccattcttattcccat

SEQ ID NO: 7723132 - DNA, 22 bp, Homo sapiens
tctccctcattcctgcttccat

SEQ ID NO: 7723133 - DNA, 22 bp, Homo sapiens
tctccctcattcctgcttccat

SEQ ID NO: 7723134 - DNA, 22 bp, Homo sapiens
tctccctcattcctgcttccat

SEQ ID NO: 7723135 - DNA, 22 bp, Homo sapiens
tctccctcattcctgcttccat

SEQ ID NO: 7723136 - DNA, 23 bp, Homo sapiens
tctccctcatgcctaggcctggg

SEQ ID NO: 7723137 - DNA, 22 bp, Homo sapiens
tctcctaattaaatgctcttat

SEQ ID NO: 7723138 - DNA, 22 bp, Homo sapiens
tctccctcattcctgcttccat

SEQ ID NO: 7723139 - DNA, 22 bp, Homo sapiens
tctccctcattcctgcttccat

SEQ ID NO: 7723140 - DNA, 22 bp, Homo sapiens
tctccctactgactccaggacc

SEQ ID NO: 7723141 - DNA, 23 bp, Homo sapiens
tctccctcatgcctaggcctggg

SEQ ID NO: 7723142 - DNA, 23 bp, Homo sapiens
tctccctcatgcctaggcctggg

SEQ ID NO: 7723143 - DNA, 18 bp, Homo sapiens
tctcccggtcaccttcac

SEQ ID NO: 7723144 - DNA, 23 bp, Homo sapiens
tctccctcatgcctaggcctggg

SEQ ID NO: 7723145 - DNA, 23 bp, Homo sapiens
tctccctcatgcctaggcctggg

SEQ ID NO: 7723146 - DNA, 22 bp, Homo sapiens
tctccctagggccgctggctaa

SEQ ID NO: 7723147 - DNA, 23 bp, Homo sapiens
tctccctcatgcctaggcctggg

SEQ ID NO: 7723148 - DNA, 22 bp, Homo sapiens
tctccccaaaggactcactctc

SEQ ID NO: 7723149 - DNA, 22 bp, Homo sapiens
tctccccaaaggactcactctc

SEQ ID NO: 7723150 - DNA, 22 bp, Homo sapiens
tctccccaaaggactcactctc

SEQ ID NO: 7723151 - DNA, 22 bp, Homo sapiens
tctccccaaccatggcactcac

SEQ ID NO: 7723152 - DNA, 22 bp, Homo sapiens
tctccccaaccatggcactcac

SEQ ID NO: 7723153 - DNA, 22 bp, Homo sapiens
tctccccaaccatggcactcac

SEQ ID NO: 7723154 - DNA, 22 bp, Homo sapiens
tctccccaaccatggcactcac

SEQ ID NO: 7723155 - DNA, 22 bp, Homo sapiens
tctccccagaccctggacataa

SEQ ID NO: 7723156 - DNA, 22 bp, Homo sapiens
tctccccagaccctggacataa

SEQ ID NO: 7723157 - DNA, 22 bp, Homo sapiens
tctccccaggggtatgggtatt

SEQ ID NO: 7723158 - DNA, 22 bp, Homo sapiens
tctccccagctgagctgccctt

SEQ ID NO: 7723159 - DNA, 22 bp, Homo sapiens
tctccccagctgagctgccctt

SEQ ID NO: 7723160 - DNA, 22 bp, Homo sapiens
tctccccagctgagctgccctt

SEQ ID NO: 7723161 - DNA, 22 bp, Homo sapiens
tctccccagctgagctgccctt

SEQ ID NO: 7723162 - DNA, 22 bp, Homo sapiens
tctccccagctgagctgccctt

SEQ ID NO: 7723163 - DNA, 22 bp, Homo sapiens
tctccccagctgagctgccctt

SEQ ID NO: 7723164 - DNA, 22 bp, Homo sapiens
tctccccagaccctggacataa

SEQ ID NO: 7723165 - DNA, 22 bp, Homo sapiens
tctccccagaccctggacataa

SEQ ID NO: 7723166 - DNA, 22 bp, Homo sapiens
tctcccatgaggctgcggtcaa

SEQ ID NO: 7723167 - DNA, 19 bp, Homo sapiens
tctcccatgcctgtgtcta

SEQ ID NO: 7723168 - DNA, 22 bp, Homo sapiens
tctcccattcagcttgcagtca

SEQ ID NO: 7723169 - DNA, 22 bp, Homo sapiens
tctccccaaaggactcactctc

SEQ ID NO: 7723170 - DNA, 22 bp, Homo sapiens
tctccccaaaggactcactctc

SEQ ID NO: 7723171 - DNA, 22 bp, Homo sapiens
tctcccagtgtctggcagtcag

SEQ ID NO: 7723172 - DNA, 22 bp, Homo sapiens
tctcccagtgtctggcagtcag

SEQ ID NO: 7723173 - DNA, 22 bp, Homo sapiens
tctcccagtgtctggcagtcag

SEQ ID NO: 7723174 - DNA, 22 bp, Homo sapiens
tctcccagtgtctggcagtcag

SEQ ID NO: 7723175 - DNA, 22 bp, Homo sapiens
tctcccagtgtctggcagtcag

SEQ ID NO: 7723176 - DNA, 20 bp, Homo sapiens
tctcccaggctcagggaaga

SEQ ID NO: 7723177 - DNA, 20 bp, Homo sapiens
tctcccaggctcagggaaga

SEQ ID NO: 7723178 - DNA, 22 bp, Homo sapiens
tctcccaggctgccctgtggac

SEQ ID NO: 7723179 - DNA, 22 bp, Homo sapiens
tctcccaggctgccctgtggac

SEQ ID NO: 7723180 - DNA, 20 bp, Homo sapiens
tctcccaggctcagggaaga

SEQ ID NO: 7723181 - DNA, 20 bp, Homo sapiens
tctcccaggctcagggaaga

SEQ ID NO: 7723182 - DNA, 20 bp, Homo sapiens
tctcccaggctcagggaaga

SEQ ID NO: 7723183 - DNA, 22 bp, Homo sapiens
tctcccaggctggagtgcagtg

SEQ ID NO: 7723184 - DNA, 22 bp, Homo sapiens
tctcccaggctgccctgtggac

SEQ ID NO: 7723185 - DNA, 22 bp, Homo sapiens
tctcccaggctgccctgtggac

SEQ ID NO: 7723186 - DNA, 22 bp, Homo sapiens
tctcccaggctgccctgtggac

SEQ ID NO: 7723187 - DNA, 22 bp, Homo sapiens
tctcccaggctgccctgtggac

SEQ ID NO: 7723188 - DNA, 22 bp, Homo sapiens
tctcccaggctgccctgtggac

SEQ ID NO: 7723189 - DNA, 22 bp, Homo sapiens
tctcccaggctgccctgtggac

SEQ ID NO: 7723190 - DNA, 20 bp, Homo sapiens
tctcccaggctcagggaaga

SEQ ID NO: 7723191 - DNA, 20 bp, Homo sapiens
tctcccaggctcagggaaga

SEQ ID NO: 7723192 - DNA, 20 bp, Homo sapiens
tctcccaggctcagggaaga

SEQ ID NO: 7723193 - DNA, 20 bp, Homo sapiens
tctcccaggctcagggaaga

SEQ ID NO: 7723194 - DNA, 22 bp, Homo sapiens
tctcccaggcaggagtgcagtg

SEQ ID NO: 7723195 - DNA, 22 bp, Homo sapiens
tctcccaggcaggagtgcagtg

SEQ ID NO: 7723196 - DNA, 22 bp, Homo sapiens
tctcccaggcaggagtgcagtg

SEQ ID NO: 7723197 - DNA, 22 bp, Homo sapiens
tctcccaggcaggagtgcagtg

SEQ ID NO: 7723198 - DNA, 22 bp, Homo sapiens
tctcccaggcaggagtgcagtg

SEQ ID NO: 7723199 - DNA, 22 bp, Homo sapiens
tctcccaggcaggagtgcagtg

SEQ ID NO: 7723200 - DNA, 22 bp, Homo sapiens
tctcccaggcaggagtgcagtg

SEQ ID NO: 7723201 - DNA, 19 bp, Homo sapiens
tctcccagctgagaagggc

SEQ ID NO: 7723202 - DNA, 19 bp, Homo sapiens
tctcccagctgagaagggc

SEQ ID NO: 7723203 - DNA, 19 bp, Homo sapiens
tctcccagctgagaagggc

SEQ ID NO: 7723204 - DNA, 19 bp, Homo sapiens
tctcccagctgagaagggc

SEQ ID NO: 7723205 - DNA, 22 bp, Homo sapiens
tctcccagaggatcccagtgga

SEQ ID NO: 7723206 - DNA, 22 bp, Homo sapiens
tctcccagaggatcccagtgga

SEQ ID NO: 7723207 - DNA, 22 bp, Homo sapiens
tctcccaggtcatacacagaga

SEQ ID NO: 7723208 - DNA, 22 bp, Homo sapiens
tctcccaggtcatacacagaga

SEQ ID NO: 7723209 - DNA, 22 bp, Homo sapiens
tctcccaggctggagtgcagtg

SEQ ID NO: 7723210 - DNA, 22 bp, Homo sapiens
tctcccaggctggagtgcagtg

SEQ ID NO: 7723211 - DNA, 22 bp, Homo sapiens
tctcccaggctggagtgcagtg

SEQ ID NO: 7723212 - DNA, 22 bp, Homo sapiens
tctcccaggctggagtgcagtg

SEQ ID NO: 7723213 - DNA, 22 bp, Homo sapiens
tctcccaggctggagtgcagtg

SEQ ID NO: 7723214 - DNA, 22 bp, Homo sapiens
tctcccaggctggagtgcagtg

SEQ ID NO: 7723215 - DNA, 22 bp, Homo sapiens
tctcccaggtgggtgcctggag

SEQ ID NO: 7723216 - DNA, 22 bp, Homo sapiens
tctcccaggtgggtgcctggag

SEQ ID NO: 7723217 - DNA, 22 bp, Homo sapiens
tctcccaggtgggtgcctggag

SEQ ID NO: 7723218 - DNA, 22 bp, Homo sapiens
tctcccaggtgggtgcctggag

SEQ ID NO: 7723219 - DNA, 22 bp, Homo sapiens
tctcccaggtgggtgcctggag

SEQ ID NO: 7723220 - DNA, 22 bp, Homo sapiens
tctcccaggtcatacacagaga

SEQ ID NO: 7723221 - DNA, 22 bp, Homo sapiens
tctcccaggtcatacacagaga

SEQ ID NO: 7723222 - DNA, 22 bp, Homo sapiens
tctcccaggtcatacacagaga

SEQ ID NO: 7723223 - DNA, 22 bp, Homo sapiens
tctcccaggtgggtgcctggag

SEQ ID NO: 7723224 - DNA, 22 bp, Homo sapiens
tctcccaggtgggtgcctggag

SEQ ID NO: 7723225 - DNA, 22 bp, Homo sapiens
tctcccaggtgggtgcctggag

SEQ ID NO: 7723226 - DNA, 22 bp, Homo sapiens
tctcccaggtgggtgcctggag

SEQ ID NO: 7723227 - DNA, 22 bp, Homo sapiens
tctcccaggtgggtgcctggag

SEQ ID NO: 7723228 - DNA, 22 bp, Homo sapiens
tctcccaggtgggtgcctggag

SEQ ID NO: 7723229 - DNA, 22 bp, Homo sapiens
tctcccaggtgggtgcctggag

SEQ ID NO: 7723230 - DNA, 22 bp, Homo sapiens
tctcccagtggtgcagaaagca

SEQ ID NO: 7723231 - DNA, 22 bp, Homo sapiens
tctcccagtggtgcagaaagca

SEQ ID NO: 7723232 - DNA, 22 bp, Homo sapiens
tctcccagtggtgcagaaagca

SEQ ID NO: 7723233 - DNA, 22 bp, Homo sapiens
tctcccagtcctctgtgcttac

SEQ ID NO: 7723234 - DNA, 22 bp, Homo sapiens
tctcccagtcctctgtgcttac

SEQ ID NO: 7723235 - DNA, 22 bp, Homo sapiens
tctcccagtggtgcagaaagca

SEQ ID NO: 7723236 - DNA, 22 bp, Homo sapiens
tctcccagtggtgcagaaagca

SEQ ID NO: 7723237 - DNA, 22 bp, Homo sapiens
tctcccagtggtgcagaaagca

SEQ ID NO: 7723238 - DNA, 22 bp, Homo sapiens
tctcccagtggtgcagaaagca

SEQ ID NO: 7723239 - DNA, 22 bp, Homo sapiens
tctcccagtggtgcagaaagca

SEQ ID NO: 7723240 - DNA, 22 bp, Homo sapiens
tctataaaactcaagagcaatt

SEQ ID NO: 7723241 - DNA, 22 bp, Homo sapiens
tctataaaactcaagagcaatt

SEQ ID NO: 7723242 - DNA, 22 bp, Homo sapiens
tctataaaactcaagagcaatt

SEQ ID NO: 7723243 - DNA, 22 bp, Homo sapiens
tctataaaactcaagagcaatt

SEQ ID NO: 7723244 - DNA, 22 bp, Homo sapiens
tctataaaactcaagagcaatt

SEQ ID NO: 7723245 - DNA, 22 bp, Homo sapiens
tctataaaactcaagagcaatt

SEQ ID NO: 7723246 - DNA, 22 bp, Homo sapiens
tctataaaactcaagagcaatt

SEQ ID NO: 7723247 - DNA, 22 bp, Homo sapiens
tctataaagggccagatagtag

SEQ ID NO: 7723248 - DNA, 22 bp, Homo sapiens
tctataaagggccagatagtag

SEQ ID NO: 7723249 - DNA, 22 bp, Homo sapiens
tctataaagggccagatagtag

SEQ ID NO: 7723250 - DNA, 22 bp, Homo sapiens
tctataaaactcaagagcaatt

SEQ ID NO: 7723251 - DNA, 22 bp, Homo sapiens
tctataaaactcaagagcaatt

SEQ ID NO: 7723252 - DNA, 22 bp, Homo sapiens
tctataaagggccagatagtag

SEQ ID NO: 7723253 - DNA, 22 bp, Homo sapiens
tctataaagggccagatagtag

SEQ ID NO: 7723254 - DNA, 22 bp, Homo sapiens
tctataaagggccagatagtag

SEQ ID NO: 7723255 - DNA, 22 bp, Homo sapiens
tctagttttctcaaatgacttg

SEQ ID NO: 7723256 - DNA, 22 bp, Homo sapiens
tctagttttctcaaatgacttg

SEQ ID NO: 7723257 - DNA, 22 bp, Homo sapiens
tctagttgtgagaaagcaatgt

SEQ ID NO: 7723258 - DNA, 22 bp, Homo sapiens
tctagttgtgagaaagcaatgt

SEQ ID NO: 7723259 - DNA, 19 bp, Homo sapiens
tctagttttgagagacttc

SEQ ID NO: 7723260 - DNA, 19 bp, Homo sapiens
tctagttttgagagacttc

SEQ ID NO: 7723261 - DNA, 22 bp, Homo sapiens
tctagttttggtatgagatgca

SEQ ID NO: 7723262 - DNA, 22 bp, Homo sapiens
tctagttttggtatgagatgca

SEQ ID NO: 7723263 - DNA, 22 bp, Homo sapiens
tctagttctagatccctgagga

SEQ ID NO: 7723264 - DNA, 22 bp, Homo sapiens
tctagttctagatccctgagga

SEQ ID NO: 7723265 - DNA, 22 bp, Homo sapiens
tctagttctagatccctgagga

SEQ ID NO: 7723266 - DNA, 22 bp, Homo sapiens
tctagttctagatccctgagga

SEQ ID NO: 7723267 - DNA, 17 bp, Homo sapiens
tctagtgttcttgctca

SEQ ID NO: 7723268 - DNA, 22 bp, Homo sapiens
tctagtgttttggaacatggaa

SEQ ID NO: 7723269 - DNA, 22 bp, Homo sapiens
tctagtgttttggaacatggaa

SEQ ID NO: 7723270 - DNA, 22 bp, Homo sapiens
tctagtctcagccttcacctaa

SEQ ID NO: 7723271 - DNA, 19 bp, Homo sapiens
tctagtgtgaccaccagat

SEQ ID NO: 7723272 - DNA, 19 bp, Homo sapiens
tctagtgtgaccaccagat

SEQ ID NO: 7723273 - DNA, 22 bp, Homo sapiens
tctagtgttaaggcaaagtaaa

SEQ ID NO: 7723274 - DNA, 22 bp, Homo sapiens
tctagggtgttacatacctgct

SEQ ID NO: 7723275 - DNA, 22 bp, Homo sapiens
tctagggtgtgcggcagggcta

SEQ ID NO: 7723276 - DNA, 20 bp, Homo sapiens
tctagggtggctgtagcagc

SEQ ID NO: 7723277 - DNA, 22 bp, Homo sapiens
tctagggtgtataaggaagcct

SEQ ID NO: 7723278 - DNA, 20 bp, Homo sapiens
tctagggtggctgtagcagc

SEQ ID NO: 7723279 - DNA, 20 bp, Homo sapiens
tctagggtggctgtagcagc

SEQ ID NO: 7723280 - DNA, 20 bp, Homo sapiens
tctagggtggctgtagcagc

SEQ ID NO: 7723281 - DNA, 22 bp, Homo sapiens
tctagggtgatgattcaggatg

SEQ ID NO: 7723282 - DNA, 22 bp, Homo sapiens
tctagggtgatgattcaggatg

SEQ ID NO: 7723283 - DNA, 22 bp, Homo sapiens
tctagggtggagctgggaatcc

SEQ ID NO: 7723284 - DNA, 22 bp, Homo sapiens
tctaggtggatgaggaacatag

SEQ ID NO: 7723285 - DNA, 22 bp, Homo sapiens
tctaggttagaacccagaaaag

SEQ ID NO: 7723286 - DNA, 22 bp, Homo sapiens
tctaggttagaacccagaaaag

SEQ ID NO: 7723287 - DNA, 22 bp, Homo sapiens
tctagtactagttaggaagagt

SEQ ID NO: 7723288 - DNA, 22 bp, Homo sapiens
tctagtctcagccttcacctaa

SEQ ID NO: 7723289 - DNA, 22 bp, Homo sapiens
tctagtcatattttttcagtat

SEQ ID NO: 7723290 - DNA, 20 bp, Homo sapiens
tctaggctagattttgtcat

SEQ ID NO: 7723291 - DNA, 20 bp, Homo sapiens
tctaggctagattttgtcat

SEQ ID NO: 7723292 - DNA, 22 bp, Homo sapiens
tctaggccctttttccctccaa

SEQ ID NO: 7723293 - DNA, 22 bp, Homo sapiens
tctaggcctggcttgggcccag

SEQ ID NO: 7723294 - DNA, 22 bp, Homo sapiens
tctagggaacctatcctatgat

SEQ ID NO: 7723295 - DNA, 22 bp, Homo sapiens
tctagggaacatgggtcaagct

SEQ ID NO: 7723296 - DNA, 22 bp, Homo sapiens
tctagggaattgtggttttctt

SEQ ID NO: 7723297 - DNA, 22 bp, Homo sapiens
tctaggccgtaggatacagagc

SEQ ID NO: 7723298 - DNA, 22 bp, Homo sapiens
tctaggagttgataaaagggct

SEQ ID NO: 7723299 - DNA, 22 bp, Homo sapiens
tctaggcattgttattacaact

SEQ ID NO: 7723300 - DNA, 22 bp, Homo sapiens
tctaggcccaggcctgcggctg

SEQ ID NO: 7723301 - DNA, 22 bp, Homo sapiens
tctaggggtgcagaagggatcc

SEQ ID NO: 7723302 - DNA, 22 bp, Homo sapiens
tctagggggacagctggctgtg

SEQ ID NO: 7723303 - DNA, 22 bp, Homo sapiens
tctagggtccacagggtcagcc

SEQ ID NO: 7723304 - DNA, 22 bp, Homo sapiens
tctaggggcaatgtgcaaggac

SEQ ID NO: 7723305 - DNA, 22 bp, Homo sapiens
tctaggggcaatgtgcaaggac

SEQ ID NO: 7723306 - DNA, 22 bp, Homo sapiens
tctagggggacagctggctgtg

SEQ ID NO: 7723307 - DNA, 20 bp, Homo sapiens
tctagggatggcatatgtct

SEQ ID NO: 7723308 - DNA, 20 bp, Homo sapiens
tctagggatggcatatgtct

SEQ ID NO: 7723309 - DNA, 22 bp, Homo sapiens
tctagggagaagctctgtctgt

SEQ ID NO: 7723310 - DNA, 22 bp, Homo sapiens
tctagggagagttgttatgggt

SEQ ID NO: 7723311 - DNA, 22 bp, Homo sapiens
tctagggagctctagcagtggt

SEQ ID NO: 7723312 - DNA, 22 bp, Homo sapiens
tctagggagctctagcagtggt

SEQ ID NO: 7723313 - DNA, 22 bp, Homo sapiens
tctagggagctctagcagtggt

SEQ ID NO: 7723314 - DNA, 22 bp, Homo sapiens
tctatgtctccaccttcgcaga

SEQ ID NO: 7723315 - DNA, 22 bp, Homo sapiens
tctatgtctcgacccaagacaa

SEQ ID NO: 7723316 - DNA, 22 bp, Homo sapiens
tctatgtcctttctcccattcc

SEQ ID NO: 7723317 - DNA, 22 bp, Homo sapiens
tctatgtcagcatctttctacc

SEQ ID NO: 7723318 - DNA, 22 bp, Homo sapiens
tctatgtatggaccttttctgt

SEQ ID NO: 7723319 - DNA, 22 bp, Homo sapiens
tctatgtatggaccttttctgt

SEQ ID NO: 7723320 - DNA, 22 bp, Homo sapiens
tctatgtaggagagagcttgac

SEQ ID NO: 7723321 - DNA, 22 bp, Homo sapiens
tctatgtatatctttccattca

SEQ ID NO: 7723322 - DNA, 22 bp, Homo sapiens
tctatgtagtgccagctagtat

SEQ ID NO: 7723323 - DNA, 22 bp, Homo sapiens
tctatgtagtgccagctagtat

SEQ ID NO: 7723324 - DNA, 22 bp, Homo sapiens
tctatgtatatctttccattca

SEQ ID NO: 7723325 - DNA, 19 bp, Homo sapiens
tctatgggctttttgtagt

SEQ ID NO: 7723326 - DNA, 22 bp, Homo sapiens
tctatggggcctcacaggcact

SEQ ID NO: 7723327 - DNA, 22 bp, Homo sapiens
tctatgtaaagccatattgata

SEQ ID NO: 7723328 - DNA, 22 bp, Homo sapiens
tctatgtaaagccatattgata

SEQ ID NO: 7723329 - DNA, 22 bp, Homo sapiens
tctatgtaaagccatattgata

SEQ ID NO: 7723330 - DNA, 22 bp, Homo sapiens
tctatgtaaatgtgagttggtg

SEQ ID NO: 7723331 - DNA, 21 bp, Homo sapiens
tctatgtacgcatctatgcct

SEQ ID NO: 7723332 - DNA, 21 bp, Homo sapiens
tctatgtacgcatctatgcct

SEQ ID NO: 7723333 - DNA, 22 bp, Homo sapiens
tctattagattattctcaagga

SEQ ID NO: 7723334 - DNA, 22 bp, Homo sapiens
tctattagaatgttctttttca

SEQ ID NO: 7723335 - DNA, 22 bp, Homo sapiens
tctattacttaccactaattca

SEQ ID NO: 7723336 - DNA, 22 bp, Homo sapiens
tctattacttaccactaattca

SEQ ID NO: 7723337 - DNA, 22 bp, Homo sapiens
tctattatggtacttatcatga

SEQ ID NO: 7723338 - DNA, 22 bp, Homo sapiens
tctattatggtacttatcatga

SEQ ID NO: 7723339 - DNA, 19 bp, Homo sapiens
tctatgtggcagtgatggc

SEQ ID NO: 7723340 - DNA, 22 bp, Homo sapiens
tctatgtgccctttgtgtgatg

SEQ ID NO: 7723341 - DNA, 22 bp, Homo sapiens
tctatgttggtccatattatgg

SEQ ID NO: 7723342 - DNA, 22 bp, Homo sapiens
tctatgttgtgtgtcacacaga

SEQ ID NO: 7723343 - DNA, 22 bp, Homo sapiens
tctattaatgattcaatagtgt

SEQ ID NO: 7723344 - DNA, 22 bp, Homo sapiens
tctattaatgattcaatagtgt

SEQ ID NO: 7723345 - DNA, 22 bp, Homo sapiens
tctattactcttttaaggaaaa

SEQ ID NO: 7723346 - DNA, 22 bp, Homo sapiens
tctattacttaccactaattca

SEQ ID NO: 7723347 - DNA, 22 bp, Homo sapiens
tctatattccagatacagatta

SEQ ID NO: 7723348 - DNA, 22 bp, Homo sapiens
tctataaatgcagatatgtgtg

SEQ ID NO: 7723349 - DNA, 22 bp, Homo sapiens
tctataaagggccagatagtag

SEQ ID NO: 7723350 - DNA, 22 bp, Homo sapiens
tctataaatgcagatatgtgtg

SEQ ID NO: 7723351 - DNA, 22 bp, Homo sapiens
tctataaagggccagatagtag

SEQ ID NO: 7723352 - DNA, 22 bp, Homo sapiens
tctataaagggccagatagtag

SEQ ID NO: 7723353 - DNA, 22 bp, Homo sapiens
tctataaagggccagatagtag

SEQ ID NO: 7723354 - DNA, 22 bp, Homo sapiens
tctataaagggccagatagtag

SEQ ID NO: 7723355 - DNA, 22 bp, Homo sapiens
tctatctgaggaggtgacattt

SEQ ID NO: 7723356 - DNA, 22 bp, Homo sapiens
tctatctggccccttttatata

SEQ ID NO: 7723357 - DNA, 22 bp, Homo sapiens
tctatcctgcttagaagtatgt

SEQ ID NO: 7723358 - DNA, 22 bp, Homo sapiens
tctatattttgaaaggtattta

SEQ ID NO: 7723359 - DNA, 22 bp, Homo sapiens
tctatattttgaaaggtattta

SEQ ID NO: 7723360 - DNA, 21 bp, Homo sapiens
tctatcacctaaattaaacag

SEQ ID NO: 7723361 - DNA, 22 bp, Homo sapiens
tctatcagagtagaaggcaacg

SEQ ID NO: 7723362 - DNA, 22 bp, Homo sapiens
tctatgaaaagtctattcattc

SEQ ID NO: 7723363 - DNA, 22 bp, Homo sapiens
tctatgaaaaactgttaagctc

SEQ ID NO: 7723364 - DNA, 22 bp, Homo sapiens
tctatgaaaaactgttaagctc

SEQ ID NO: 7723365 - DNA, 21 bp, Homo sapiens
tctatgaacatggagaagggc

SEQ ID NO: 7723366 - DNA, 22 bp, Homo sapiens
tctatgaacaaagtggtttata

SEQ ID NO: 7723367 - DNA, 22 bp, Homo sapiens
tctatgaaacgttgcaggaggg

SEQ ID NO: 7723368 - DNA, 22 bp, Homo sapiens
tctatgaacaaagtggtttata

SEQ ID NO: 7723369 - DNA, 22 bp, Homo sapiens
tctatgaacaaagtggtttata

SEQ ID NO: 7723370 - DNA, 21 bp, Homo sapiens
tctatgaacatggagaagggc

SEQ ID NO: 7723371 - DNA, 22 bp, Homo sapiens
tctatgaacctctgcaatgaca

SEQ ID NO: 7723372 - DNA, 22 bp, Homo sapiens
tctatgaacctctgcaatgaca

SEQ ID NO: 7723373 - DNA, 22 bp, Homo sapiens
tctatgaagtgcaattaactgt

SEQ ID NO: 7723374 - DNA, 22 bp, Homo sapiens
tctatgaacctctgcaatgaca

SEQ ID NO: 7723375 - DNA, 22 bp, Homo sapiens
tctatgaagtgcgaagaggcac

SEQ ID NO: 7723376 - DNA, 22 bp, Homo sapiens
tctatgaatgacacagataata

SEQ ID NO: 7723377 - DNA, 22 bp, Homo sapiens
tctatgaatgacacagataata

SEQ ID NO: 7723378 - DNA, 22 bp, Homo sapiens
tctatgaatgacacagataata

SEQ ID NO: 7723379 - DNA, 22 bp, Homo sapiens
tctatgaattccatttcacgat

SEQ ID NO: 7723380 - DNA, 22 bp, Homo sapiens
tctatgaattccatttcacgat

SEQ ID NO: 7723381 - DNA, 21 bp, Homo sapiens
tctatgcaagaccctagtcct

SEQ ID NO: 7723382 - DNA, 22 bp, Homo sapiens
tctatgaatgacacagataata

SEQ ID NO: 7723383 - DNA, 22 bp, Homo sapiens
tctatgaatcaattttaacatc

SEQ ID NO: 7723384 - DNA, 22 bp, Homo sapiens
tctatgaatcaattttaacatc

SEQ ID NO: 7723385 - DNA, 22 bp, Homo sapiens
tctatgaatcaattttaacatc

SEQ ID NO: 7723386 - DNA, 22 bp, Homo sapiens
tctatgaagtgcgaagaggcac

SEQ ID NO: 7723387 - DNA, 22 bp, Homo sapiens
tctatgaagtgcgaagaggcac

SEQ ID NO: 7723388 - DNA, 22 bp, Homo sapiens
tctatgaagttcagagatctat

SEQ ID NO: 7723389 - DNA, 22 bp, Homo sapiens
tctatgaagttcagagatctat

SEQ ID NO: 7723390 - DNA, 22 bp, Homo sapiens
tctatgaagttcagagatctat

SEQ ID NO: 7723391 - DNA, 22 bp, Homo sapiens
tctatgaatcaattttaacatc

SEQ ID NO: 7723392 - DNA, 22 bp, Homo sapiens
tctattgggactctgcggtgag

SEQ ID NO: 7723393 - DNA, 22 bp, Homo sapiens
tctattctgataaatgcatgga

SEQ ID NO: 7723394 - DNA, 22 bp, Homo sapiens
tctattcattcaatttagctct

SEQ ID NO: 7723395 - DNA, 22 bp, Homo sapiens
tctattgcagatggatgccctc

SEQ ID NO: 7723396 - DNA, 21 bp, Homo sapiens
tctattcattacagttatttg

SEQ ID NO: 7723397 - DNA, 21 bp, Homo sapiens
tctattcattacagttatttg

SEQ ID NO: 7723398 - DNA, 22 bp, Homo sapiens
tctattcaggcagagtgcagca

SEQ ID NO: 7723399 - DNA, 22 bp, Homo sapiens
tctattcaggcagagtgcagca

SEQ ID NO: 7723400 - DNA, 22 bp, Homo sapiens
tctattcattcaatttagctct

SEQ ID NO: 7723401 - DNA, 22 bp, Homo sapiens
tctattcattcaatttagctct

SEQ ID NO: 7723402 - DNA, 22 bp, Homo sapiens
tctattggtaggggctgaggca

SEQ ID NO: 7723403 - DNA, 22 bp, Homo sapiens
tctatttacagaaagcagaatt

SEQ ID NO: 7723404 - DNA, 22 bp, Homo sapiens
tctatttacagaaagcagaatt

SEQ ID NO: 7723405 - DNA, 22 bp, Homo sapiens
tctattgtgctaccagaattac

SEQ ID NO: 7723406 - DNA, 22 bp, Homo sapiens
tctatttaccaaatgtagttcc

SEQ ID NO: 7723407 - DNA, 22 bp, Homo sapiens
tctatttaccaaatgtagttcc

SEQ ID NO: 7723408 - DNA, 22 bp, Homo sapiens
tctatttaccaaatgtagttcc

SEQ ID NO: 7723409 - DNA, 22 bp, Homo sapiens
tctatttaccaaatgtagttcc

SEQ ID NO: 7723410 - DNA, 22 bp, Homo sapiens
tctatttaccaaatgtagttcc

SEQ ID NO: 7723411 - DNA, 22 bp, Homo sapiens
tctattttatactcaaatcttc

SEQ ID NO: 7723412 - DNA, 22 bp, Homo sapiens
tctattttcttgccaaaactgc

SEQ ID NO: 7723413 - DNA, 22 bp, Homo sapiens
tctattttatactcaaatcttc

SEQ ID NO: 7723414 - DNA, 22 bp, Homo sapiens
tctattttatactcaaatcttc

SEQ ID NO: 7723415 - DNA, 22 bp, Homo sapiens
tctatttctgggtttgtgtggt

SEQ ID NO: 7723416 - DNA, 22 bp, Homo sapiens
tctatttgctggttgcttctgt

SEQ ID NO: 7723417 - DNA, 22 bp, Homo sapiens
tctatttaggagaccctggttc

SEQ ID NO: 7723418 - DNA, 22 bp, Homo sapiens
tctattttatactcaaatcttc

SEQ ID NO: 7723419 - DNA, 22 bp, Homo sapiens
tctattttatactcaaatcttc

SEQ ID NO: 7723420 - DNA, 22 bp, Homo sapiens
tctattttatactcaaatcttc

SEQ ID NO: 7723421 - DNA, 22 bp, Homo sapiens
tctattttatactcaaatcttc

SEQ ID NO: 7723422 - DNA, 22 bp, Homo sapiens
tctattttcttgccaaaactgc

SEQ ID NO: 7723423 - DNA, 22 bp, Homo sapiens
tctattttgtttccagctctac

SEQ ID NO: 7723424 - DNA, 22 bp, Homo sapiens
tctattttgtttccagctctac

SEQ ID NO: 7723425 - DNA, 22 bp, Homo sapiens
tctattttgtttccagctctac

SEQ ID NO: 7723426 - DNA, 22 bp, Homo sapiens
tctattttgtttccagctctac

SEQ ID NO: 7723427 - DNA, 22 bp, Homo sapiens
tctattttgtttccagctctac

SEQ ID NO: 7723428 - DNA, 22 bp, Homo sapiens
tctatttttatagttgaagtgc

SEQ ID NO: 7723429 - DNA, 22 bp, Homo sapiens
tctatttttatagttgaagtgc

SEQ ID NO: 7723430 - DNA, 22 bp, Homo sapiens
tctatttttatagttgaagtgc

SEQ ID NO: 7723431 - DNA, 22 bp, Homo sapiens
tctatttttatagttgaagtgc

SEQ ID NO: 7723432 - DNA, 22 bp, Homo sapiens
tctatttttatagttgaagtgc

SEQ ID NO: 7723433 - DNA, 18 bp, Homo sapiens
tctcaaaaataatggctt

SEQ ID NO: 7723434 - DNA, 22 bp, Homo sapiens
tctatttttatagttgaagtgc

SEQ ID NO: 7723435 - DNA, 22 bp, Homo sapiens
tctatttttatagttgaagtgc

SEQ ID NO: 7723436 - DNA, 22 bp, Homo sapiens
tctatttttatagttgaagtgc

SEQ ID NO: 7723437 - DNA, 23 bp, Homo sapiens
tctcaaacagtgagttcaccaga

SEQ ID NO: 7723438 - DNA, 23 bp, Homo sapiens
tctcaaacagtgagttcaccaga

SEQ ID NO: 7723439 - DNA, 22 bp, Homo sapiens
tctcaaactaacaatgattata

SEQ ID NO: 7723440 - DNA, 22 bp, Homo sapiens
tctcaaactaacaatgattata

SEQ ID NO: 7723441 - DNA, 22 bp, Homo sapiens
tctcaaactgtgtattataatt

SEQ ID NO: 7723442 - DNA, 22 bp, Homo sapiens
tctcaaagtagctcccacagat

SEQ ID NO: 7723443 - DNA, 22 bp, Homo sapiens
tctcaaataggccttggtcctg

SEQ ID NO: 7723444 - DNA, 22 bp, Homo sapiens
tctcaaataggccttggtcctg

SEQ ID NO: 7723445 - DNA, 23 bp, Homo sapiens
tctcaaatatgatctgggtcatc

SEQ ID NO: 7723446 - DNA, 23 bp, Homo sapiens
tctcaaatatgatctgggtcatc

SEQ ID NO: 7723447 - DNA, 22 bp, Homo sapiens
tctcaaatatttggagagagga

SEQ ID NO: 7723448 - DNA, 22 bp, Homo sapiens
tctcaaatatttggagagagga

SEQ ID NO: 7723449 - DNA, 22 bp, Homo sapiens
tctcaaatatttggagagagga

SEQ ID NO: 7723450 - DNA, 22 bp, Homo sapiens
tctcaaatggcaaatgtgggtc

SEQ ID NO: 7723451 - DNA, 22 bp, Homo sapiens
tctcaaggactttgggcactaa

SEQ ID NO: 7723452 - DNA, 22 bp, Homo sapiens
tctcaaatggcaaatgtgggtc

SEQ ID NO: 7723453 - DNA, 22 bp, Homo sapiens
tctcaagttttctcataatctc

SEQ ID NO: 7723454 - DNA, 22 bp, Homo sapiens
tctcaaggaaaagtgatggcat

SEQ ID NO: 7723455 - DNA, 22 bp, Homo sapiens
tctcaaggactttgggcactaa

SEQ ID NO: 7723456 - DNA, 22 bp, Homo sapiens
tctcaaggtaaaatttgtcaca

SEQ ID NO: 7723457 - DNA, 22 bp, Homo sapiens
tctcaagttatgtaacagctgt

SEQ ID NO: 7723458 - DNA, 22 bp, Homo sapiens
tctcaaatggacaatattgtgg

SEQ ID NO: 7723459 - DNA, 22 bp, Homo sapiens
tctcaaatggacaatattgtgg

SEQ ID NO: 7723460 - DNA, 22 bp, Homo sapiens
tctcaaatggacaatattgtgg

SEQ ID NO: 7723461 - DNA, 22 bp, Homo sapiens
tctcaaatggacaatattgtgg

SEQ ID NO: 7723462 - DNA, 23 bp, Homo sapiens
tctcaaatctttgcgttgtatct

SEQ ID NO: 7723463 - DNA, 22 bp, Homo sapiens
tctcaaatggacaatattgtgg

SEQ ID NO: 7723464 - DNA, 22 bp, Homo sapiens
tctcaaatggacaatattgtgg

SEQ ID NO: 7723465 - DNA, 22 bp, Homo sapiens
tctcaaatcaaactttgagctt

SEQ ID NO: 7723466 - DNA, 23 bp, Homo sapiens
tctcaaatctttgcgttgtatct

SEQ ID NO: 7723467 - DNA, 23 bp, Homo sapiens
tctcaaatctttgcgttgtatct

SEQ ID NO: 7723468 - DNA, 22 bp, Homo sapiens
tctcaattgtgggtgaggagca

SEQ ID NO: 7723469 - DNA, 22 bp, Homo sapiens
tctcaatttgattacattcata

SEQ ID NO: 7723470 - DNA, 22 bp, Homo sapiens
tctcacaactagaagggaaaga

SEQ ID NO: 7723471 - DNA, 19 bp, Homo sapiens
tctcacaagactgctgctc

SEQ ID NO: 7723472 - DNA, 19 bp, Homo sapiens
tctcacaagactgctgctc

SEQ ID NO: 7723473 - DNA, 19 bp, Homo sapiens
tctcacaagcaacattgtt

SEQ ID NO: 7723474 - DNA, 19 bp, Homo sapiens
tctcacaagcaacattgtt

SEQ ID NO: 7723475 - DNA, 19 bp, Homo sapiens
tctcacaagcaacattgtt

SEQ ID NO: 7723476 - DNA, 22 bp, Homo sapiens
tctcacaagctcaaggattagt

SEQ ID NO: 7723477 - DNA, 21 bp, Homo sapiens
tctcacaatatgatgccagat

SEQ ID NO: 7723478 - DNA, 22 bp, Homo sapiens
tctcacacaacatgttactttg

SEQ ID NO: 7723479 - DNA, 19 bp, Homo sapiens
tctcaattcagactgagag

SEQ ID NO: 7723480 - DNA, 22 bp, Homo sapiens
tctcaattcatgaagttggaat

SEQ ID NO: 7723481 - DNA, 19 bp, Homo sapiens
tctcaattctccccactgc

SEQ ID NO: 7723482 - DNA, 19 bp, Homo sapiens
tctcaattctccccactgc

SEQ ID NO: 7723483 - DNA, 19 bp, Homo sapiens
tctcaattctccccactgc

SEQ ID NO: 7723484 - DNA, 22 bp, Homo sapiens
tctcaatattatatgtcataaa

SEQ ID NO: 7723485 - DNA, 22 bp, Homo sapiens
tctcaatcaaacatgtctgact

SEQ ID NO: 7723486 - DNA, 19 bp, Homo sapiens
tctcaatgttcagaaagct

SEQ ID NO: 7723487 - DNA, 18 bp, Homo sapiens
tctcaatcgctgcagtct

SEQ ID NO: 7723488 - DNA, 18 bp, Homo sapiens
tctcaatcgctgcagtct

SEQ ID NO: 7723489 - DNA, 22 bp, Homo sapiens
tctcacagaggcttgggctcat

SEQ ID NO: 7723490 - DNA, 22 bp, Homo sapiens
tctcacacttctgtgttgcaca

SEQ ID NO: 7723491 - DNA, 22 bp, Homo sapiens
tctcacacttctgtgttgcaca

SEQ ID NO: 7723492 - DNA, 22 bp, Homo sapiens
tctcacactatttcaggtgact

SEQ ID NO: 7723493 - DNA, 22 bp, Homo sapiens
tctcacagcaggggccaggtct

SEQ ID NO: 7723494 - DNA, 22 bp, Homo sapiens
tctcacagcaggggccaggtct

SEQ ID NO: 7723495 - DNA, 22 bp, Homo sapiens
tctcacactaatgctctatcag

SEQ ID NO: 7723496 - DNA, 22 bp, Homo sapiens
tctcacactaatgctctatcag

SEQ ID NO: 7723497 - DNA, 22 bp, Homo sapiens
tctcacactaatgctctatcag

SEQ ID NO: 7723498 - DNA, 22 bp, Homo sapiens
tctcacaccgtccctaaaccat

SEQ ID NO: 7723499 - DNA, 22 bp, Homo sapiens
tctcacactaatgctctatcag

SEQ ID NO: 7723500 - DNA, 21 bp, Homo sapiens
tctcacaatatgatgccagat

SEQ ID NO: 7723501 - DNA, 22 bp, Homo sapiens
tctcacaccgtccctaaaccat

SEQ ID NO: 7723502 - DNA, 22 bp, Homo sapiens
tctcacaccgtccctaaaccat

SEQ ID NO: 7723503 - DNA, 22 bp, Homo sapiens
tctcacaccgtccctaaaccat

SEQ ID NO: 7723504 - DNA, 22 bp, Homo sapiens
tctcacactatttattctgctt

SEQ ID NO: 7723505 - DNA, 22 bp, Homo sapiens
tctcacactatttattctgctt

SEQ ID NO: 7723506 - DNA, 22 bp, Homo sapiens
tctcacactatttattctgctt

SEQ ID NO: 7723507 - DNA, 22 bp, Homo sapiens
tctcacactatttcaggtgact

SEQ ID NO: 7723508 - DNA, 22 bp, Homo sapiens
tctcacacttctgtgttgcaca

SEQ ID NO: 7723509 - DNA, 22 bp, Homo sapiens
tctcacactatttcaggtgact

SEQ ID NO: 7723510 - DNA, 22 bp, Homo sapiens
tctcacagcattatccagggca

SEQ ID NO: 7723511 - DNA, 22 bp, Homo sapiens
tctcacagcattatccagggca

SEQ ID NO: 7723512 - DNA, 22 bp, Homo sapiens
tctcacagccatttctccctct

SEQ ID NO: 7723513 - DNA, 22 bp, Homo sapiens
tctcacagcaggggccaggtct

SEQ ID NO: 7723514 - DNA, 22 bp, Homo sapiens
tctcacagcatcattgctcatg

SEQ ID NO: 7723515 - DNA, 22 bp, Homo sapiens
tctcacagcatcattgctcatg

SEQ ID NO: 7723516 - DNA, 22 bp, Homo sapiens
tctcacagggctaggccctgcc

SEQ ID NO: 7723517 - DNA, 22 bp, Homo sapiens
tctcacagctctgctgcatgct

SEQ ID NO: 7723518 - DNA, 22 bp, Homo sapiens
tctcacagggctaggccctgcc

SEQ ID NO: 7723519 - DNA, 23 bp, Homo sapiens
tctcacagcgatctaggaagagg

SEQ ID NO: 7723520 - DNA, 23 bp, Homo sapiens
tctcacagcgatctaggaagagg

SEQ ID NO: 7723521 - DNA, 19 bp, Homo sapiens
tctcacagctctactatgt

SEQ ID NO: 7723522 - DNA, 19 bp, Homo sapiens
tctcacagctctactatgt

SEQ ID NO: 7723523 - DNA, 22 bp, Homo sapiens
tctagcaagctcgtgctcaagg

SEQ ID NO: 7723524 - DNA, 22 bp, Homo sapiens
tctagatttttgtgcacctttg

SEQ ID NO: 7723525 - DNA, 19 bp, Homo sapiens
tctagcaacccactgcatg

SEQ ID NO: 7723526 - DNA, 22 bp, Homo sapiens
tctagatgaatgtgaggatatc

SEQ ID NO: 7723527 - DNA, 22 bp, Homo sapiens
tctagcagggaaagcagagaat

SEQ ID NO: 7723528 - DNA, 22 bp, Homo sapiens
tctagcagggaaagcagagaat

SEQ ID NO: 7723529 - DNA, 22 bp, Homo sapiens
tctagcagggaaagcagagaat

SEQ ID NO: 7723530 - DNA, 22 bp, Homo sapiens
tctagcatctaattatggaatc

SEQ ID NO: 7723531 - DNA, 22 bp, Homo sapiens
tctagcatgggaaaatcacagc

SEQ ID NO: 7723532 - DNA, 22 bp, Homo sapiens
tctagaggccagggacactgct

SEQ ID NO: 7723533 - DNA, 22 bp, Homo sapiens
tctagagctggagtagaatgtg

SEQ ID NO: 7723534 - DNA, 22 bp, Homo sapiens
tctagatcagtgcctgaaggaa

SEQ ID NO: 7723535 - DNA, 22 bp, Homo sapiens
tctagatcagtgcctgaaggaa

SEQ ID NO: 7723536 - DNA, 22 bp, Homo sapiens
tctagagattggacttcctaga

SEQ ID NO: 7723537 - DNA, 22 bp, Homo sapiens
tctagacctggcactgccctgt

SEQ ID NO: 7723538 - DNA, 22 bp, Homo sapiens
tctagacatcttggctgcaatt

SEQ ID NO: 7723539 - DNA, 22 bp, Homo sapiens
tctagagaaaaaactcaagtga

SEQ ID NO: 7723540 - DNA, 22 bp, Homo sapiens
tctagagacaaaggaaggaggg

SEQ ID NO: 7723541 - DNA, 22 bp, Homo sapiens
tctagagacaaaggaaggaggg

SEQ ID NO: 7723542 - DNA, 22 bp, Homo sapiens
tctagagactataatgtgtcct

SEQ ID NO: 7723543 - DNA, 22 bp, Homo sapiens
tctagagatacattggtcattt

SEQ ID NO: 7723544 - DNA, 22 bp, Homo sapiens
tctagagactataatgtgtcct

SEQ ID NO: 7723545 - DNA, 17 bp, Homo sapiens
tctaggagagcagagct

SEQ ID NO: 7723546 - DNA, 22 bp, Homo sapiens
tctaggagaaccatcagggagg

SEQ ID NO: 7723547 - DNA, 22 bp, Homo sapiens
tctaggaacctgacatctctca

SEQ ID NO: 7723548 - DNA, 22 bp, Homo sapiens
tctaggaacctgacatctctca

SEQ ID NO: 7723549 - DNA, 22 bp, Homo sapiens
tctaggaagtaaggagggacta

SEQ ID NO: 7723550 - DNA, 22 bp, Homo sapiens
tctaggaagtaaggagggacta

SEQ ID NO: 7723551 - DNA, 22 bp, Homo sapiens
tctaggaatttcatctagttct

SEQ ID NO: 7723552 - DNA, 22 bp, Homo sapiens
tctaggaatgttcttagggatt

SEQ ID NO: 7723553 - DNA, 20 bp, Homo sapiens
tctaggcaggcaggctcgtg

SEQ ID NO: 7723554 - DNA, 22 bp, Homo sapiens
tctaggagttgataaaagggct

SEQ ID NO: 7723555 - DNA, 22 bp, Homo sapiens
tctaggagcttaaaggaggcca

SEQ ID NO: 7723556 - DNA, 22 bp, Homo sapiens
tctaggagcttaaaggaggcca

SEQ ID NO: 7723557 - DNA, 22 bp, Homo sapiens
tctaggagctgagagtgtgtac

SEQ ID NO: 7723558 - DNA, 22 bp, Homo sapiens
tctaggagctgagagtgtgtac

SEQ ID NO: 7723559 - DNA, 22 bp, Homo sapiens
tctaggagcatgaagggaaggc

SEQ ID NO: 7723560 - DNA, 22 bp, Homo sapiens
tctaggagcatgaagggaaggc

SEQ ID NO: 7723561 - DNA, 22 bp, Homo sapiens
tctagctctgcttatcatggct

SEQ ID NO: 7723562 - DNA, 22 bp, Homo sapiens
tctagctctgcttatcatggct

SEQ ID NO: 7723563 - DNA, 22 bp, Homo sapiens
tctagctcctgagtgccagagg

SEQ ID NO: 7723564 - DNA, 22 bp, Homo sapiens
tctagctctgcttatcatggct

SEQ ID NO: 7723565 - DNA, 22 bp, Homo sapiens
tctagctgccccgaggcagggt

SEQ ID NO: 7723566 - DNA, 22 bp, Homo sapiens
tctagctgagggtaggagacct

SEQ ID NO: 7723567 - DNA, 22 bp, Homo sapiens
tctagctgacaacccacagcct

SEQ ID NO: 7723568 - DNA, 22 bp, Homo sapiens
tctagctgacaacccacagcct

SEQ ID NO: 7723569 - DNA, 22 bp, Homo sapiens
tctagctgagggtaggagacct

SEQ ID NO: 7723570 - DNA, 22 bp, Homo sapiens
tctaggaaattgttactatatt

SEQ ID NO: 7723571 - DNA, 22 bp, Homo sapiens
tctaggaaataatgactcatcc

SEQ ID NO: 7723572 - DNA, 22 bp, Homo sapiens
tctaggaaataatgactcatcc

SEQ ID NO: 7723573 - DNA, 22 bp, Homo sapiens
tctaggaaagcctttcacaact

SEQ ID NO: 7723574 - DNA, 22 bp, Homo sapiens
tctaggaaagcctttcacaact

SEQ ID NO: 7723575 - DNA, 22 bp, Homo sapiens
tctaggaaagcctttcacaact

SEQ ID NO: 7723576 - DNA, 22 bp, Homo sapiens
tctagctttgagatcagtagcc

SEQ ID NO: 7723577 - DNA, 22 bp, Homo sapiens
tctaggaaagcctttcacaact

SEQ ID NO: 7723578 - DNA, 22 bp, Homo sapiens
tctaggaaagcctttcacaact

SEQ ID NO: 7723579 - DNA, 22 bp, Homo sapiens
tctactgccacttaagacattt

SEQ ID NO: 7723580 - DNA, 22 bp, Homo sapiens
tctactgtggtccttgtaacca

SEQ ID NO: 7723581 - DNA, 22 bp, Homo sapiens
tctactctactgtctgtgccta

SEQ ID NO: 7723582 - DNA, 22 bp, Homo sapiens
tctactatgtttcttaaataga

SEQ ID NO: 7723583 - DNA, 17 bp, Homo sapiens
tctactcctgaaggaag

SEQ ID NO: 7723584 - DNA, 22 bp, Homo sapiens
tctactgcactggtgtctcatc

SEQ ID NO: 7723585 - DNA, 17 bp, Homo sapiens
tctactcctgaaggaag

SEQ ID NO: 7723586 - DNA, 22 bp, Homo sapiens
tctaccctgcggtcttggggca

SEQ ID NO: 7723587 - DNA, 22 bp, Homo sapiens
tctacctatttcttctattggt

SEQ ID NO: 7723588 - DNA, 22 bp, Homo sapiens
tctacctatttcttctattggt

SEQ ID NO: 7723589 - DNA, 22 bp, Homo sapiens
tctacctggagtccgttgttaa

SEQ ID NO: 7723590 - DNA, 22 bp, Homo sapiens
tctacctggagtccgttgttaa

SEQ ID NO: 7723591 - DNA, 22 bp, Homo sapiens
tctacctggagtccgttgttaa

SEQ ID NO: 7723592 - DNA, 22 bp, Homo sapiens
tctacctggagtccgttgttaa

SEQ ID NO: 7723593 - DNA, 22 bp, Homo sapiens
tctacgaatggtccccggtgtg

SEQ ID NO: 7723594 - DNA, 22 bp, Homo sapiens
tctactaggtgtactactgcag

SEQ ID NO: 7723595 - DNA, 22 bp, Homo sapiens
tctactaggtgtactactgcag

SEQ ID NO: 7723596 - DNA, 22 bp, Homo sapiens
tctacgaagccaccatggagac

SEQ ID NO: 7723597 - DNA, 22 bp, Homo sapiens
tctactatgtatgctttatgcg

SEQ ID NO: 7723598 - DNA, 22 bp, Homo sapiens
tctactatgtttcttaaataga

SEQ ID NO: 7723599 - DNA, 22 bp, Homo sapiens
tctaccactttgacctctctgt

SEQ ID NO: 7723600 - DNA, 22 bp, Homo sapiens
tctaccacttatcttggttaaa

SEQ ID NO: 7723601 - DNA, 22 bp, Homo sapiens
tctaccaccccgggcctggaga

SEQ ID NO: 7723602 - DNA, 22 bp, Homo sapiens
tctaccatgtgctgtgcattgg

SEQ ID NO: 7723603 - DNA, 22 bp, Homo sapiens
tctaccagggtcacagaggccc

SEQ ID NO: 7723604 - DNA, 22 bp, Homo sapiens
tctaccacttattagctctgtg

SEQ ID NO: 7723605 - DNA, 22 bp, Homo sapiens
tctaccactcatgctacttact

SEQ ID NO: 7723606 - DNA, 22 bp, Homo sapiens
tctaccactaagtgtgctttga

SEQ ID NO: 7723607 - DNA, 22 bp, Homo sapiens
tctaccactaagtgtgctttga

SEQ ID NO: 7723608 - DNA, 18 bp, Homo sapiens
tctaccctctcagagtct

SEQ ID NO: 7723609 - DNA, 22 bp, Homo sapiens
tctaccctgcggtcttggggca

SEQ ID NO: 7723610 - DNA, 22 bp, Homo sapiens
tctaccctgcggtcttggggca

SEQ ID NO: 7723611 - DNA, 23 bp, Homo sapiens
tctacccacactgctctagaagg

SEQ ID NO: 7723612 - DNA, 23 bp, Homo sapiens
tctacccacactgctctagaagg

SEQ ID NO: 7723613 - DNA, 22 bp, Homo sapiens
tctaccattgcttttcctccag

SEQ ID NO: 7723614 - DNA, 23 bp, Homo sapiens
tctacccacactgctctagaagg

SEQ ID NO: 7723615 - DNA, 22 bp, Homo sapiens
tctagaaaaacaaagtatctga

SEQ ID NO: 7723616 - DNA, 22 bp, Homo sapiens
tctagaaaaacaaagtatctga

SEQ ID NO: 7723617 - DNA, 22 bp, Homo sapiens
tctagaaaaacaaagtatctga

SEQ ID NO: 7723618 - DNA, 22 bp, Homo sapiens
tctacttttccctatacagttt

SEQ ID NO: 7723619 - DNA, 22 bp, Homo sapiens
tctagaaaaaaactgctgtgga

SEQ ID NO: 7723620 - DNA, 22 bp, Homo sapiens
tctagaaaaaaactgctgtgga

SEQ ID NO: 7723621 - DNA, 22 bp, Homo sapiens
tctagaaaaacaaagtatctga

SEQ ID NO: 7723622 - DNA, 22 bp, Homo sapiens
tctagaaaaacaaagtatctga

SEQ ID NO: 7723623 - DNA, 22 bp, Homo sapiens
tctagaaaaccaatattacatg

SEQ ID NO: 7723624 - DNA, 22 bp, Homo sapiens
tctagaaaaccaatattacatg

SEQ ID NO: 7723625 - DNA, 22 bp, Homo sapiens
tctactttataagtatataagt

SEQ ID NO: 7723626 - DNA, 22 bp, Homo sapiens
tctactttataagtatataagt

SEQ ID NO: 7723627 - DNA, 22 bp, Homo sapiens
tctacttgtcagtcttcaaatc

SEQ ID NO: 7723628 - DNA, 22 bp, Homo sapiens
tctactttataagtatataagt

SEQ ID NO: 7723629 - DNA, 22 bp, Homo sapiens
tctacttttccctatacagttt

SEQ ID NO: 7723630 - DNA, 22 bp, Homo sapiens
tctacttttccctatacagttt

SEQ ID NO: 7723631 - DNA, 22 bp, Homo sapiens
tctactttcactcatacttatt

SEQ ID NO: 7723632 - DNA, 22 bp, Homo sapiens
tctacttttccctatacagttt

SEQ ID NO: 7723633 - DNA, 22 bp, Homo sapiens
tctagaaaaccaatattacatg

SEQ ID NO: 7723634 - DNA, 23 bp, Homo sapiens
tctagaaaatgaaagaatgcagt

SEQ ID NO: 7723635 - DNA, 22 bp, Homo sapiens
tctagaaacaggtttctagaaa

SEQ ID NO: 7723636 - DNA, 22 bp, Homo sapiens
tctagaaacaggtttctagaaa

SEQ ID NO: 7723637 - DNA, 23 bp, Homo sapiens
tctagaaaatgaaagaatgcagt

SEQ ID NO: 7723638 - DNA, 22 bp, Homo sapiens
tctagaaaaccaatattacatg

SEQ ID NO: 7723639 - DNA, 22 bp, Homo sapiens
tctagaaaaccaatattacatg

SEQ ID NO: 7723640 - DNA, 22 bp, Homo sapiens
tctagaaaaccaatattacatg

SEQ ID NO: 7723641 - DNA, 22 bp, Homo sapiens
tctagaaaaccaatattacatg

SEQ ID NO: 7723642 - DNA, 19 bp, Homo sapiens
tctagacaccaaagttgtc

SEQ ID NO: 7723643 - DNA, 19 bp, Homo sapiens
tctagacaccaaagttgtc

SEQ ID NO: 7723644 - DNA, 22 bp, Homo sapiens
tctagacatcttggctgcaatt

SEQ ID NO: 7723645 - DNA, 22 bp, Homo sapiens
tctagacaatgcactgtaagga

SEQ ID NO: 7723646 - DNA, 19 bp, Homo sapiens
tctagacaccaaagttgtc

SEQ ID NO: 7723647 - DNA, 22 bp, Homo sapiens
tctacaaagccattcaggatct

SEQ ID NO: 7723648 - DNA, 22 bp, Homo sapiens
tctacaaagccattcaggatct

SEQ ID NO: 7723649 - DNA, 22 bp, Homo sapiens
tctacaaagaagaattaatgtc

SEQ ID NO: 7723650 - DNA, 23 bp, Homo sapiens
tctacaaagctgtgtcaggaccc

SEQ ID NO: 7723651 - DNA, 22 bp, Homo sapiens
tctacaaagccattcaggatct

SEQ ID NO: 7723652 - DNA, 23 bp, Homo sapiens
tctacaaagctgtgtcaggaccc

SEQ ID NO: 7723653 - DNA, 22 bp, Homo sapiens
tctacaaagaagaattaatgtc

SEQ ID NO: 7723654 - DNA, 22 bp, Homo sapiens
tctacaaagaagaattaatgtc

SEQ ID NO: 7723655 - DNA, 22 bp, Homo sapiens
tctacaaagaagaattaatgtc

SEQ ID NO: 7723656 - DNA, 22 bp, Homo sapiens
tctacaaagaagaattaatgtc

SEQ ID NO: 7723657 - DNA, 22 bp, Homo sapiens
tctaattttggcattttaacct

SEQ ID NO: 7723658 - DNA, 22 bp, Homo sapiens
tctacaaagaagaattaatgtc

SEQ ID NO: 7723659 - DNA, 22 bp, Homo sapiens
tctacaaagaagaattaatgtc

SEQ ID NO: 7723660 - DNA, 22 bp, Homo sapiens
tctaattttggcattttaacct

SEQ ID NO: 7723661 - DNA, 22 bp, Homo sapiens
tctaattttaggcatttgttca

SEQ ID NO: 7723662 - DNA, 22 bp, Homo sapiens
tctaacttgtatgtatagtttt

SEQ ID NO: 7723663 - DNA, 22 bp, Homo sapiens
tctaacttgtatgtatagtttt

SEQ ID NO: 7723664 - DNA, 22 bp, Homo sapiens
tctaacttgtatgtatagtttt

SEQ ID NO: 7723665 - DNA, 22 bp, Homo sapiens
tctaacttgtgagtatagatga

SEQ ID NO: 7723666 - DNA, 22 bp, Homo sapiens
tctaagaaagattaagaaattt

SEQ ID NO: 7723667 - DNA, 22 bp, Homo sapiens
tctaagaaagattaagaaattt

SEQ ID NO: 7723668 - DNA, 22 bp, Homo sapiens
tctaagaaagattaagaaattt

SEQ ID NO: 7723669 - DNA, 22 bp, Homo sapiens
tctaacttgtgagtatagatga

SEQ ID NO: 7723670 - DNA, 22 bp, Homo sapiens
tctaagaaagattaagaaattt

SEQ ID NO: 7723671 - DNA, 22 bp, Homo sapiens
tctaagaaagattaagaaattt

SEQ ID NO: 7723672 - DNA, 22 bp, Homo sapiens
tctaattttaggcatttgttca

SEQ ID NO: 7723673 - DNA, 22 bp, Homo sapiens
tctaattttaggcatttgttca

SEQ ID NO: 7723674 - DNA, 22 bp, Homo sapiens
tctaattttaggcatttgttca

SEQ ID NO: 7723675 - DNA, 22 bp, Homo sapiens
tctaattgcaattctcagagat

SEQ ID NO: 7723676 - DNA, 22 bp, Homo sapiens
tctaattccattaaattgatgt

SEQ ID NO: 7723677 - DNA, 22 bp, Homo sapiens
tctaattccattaaattgatgt

SEQ ID NO: 7723678 - DNA, 20 bp, Homo sapiens
tctaattaaaattgtctagt

SEQ ID NO: 7723679 - DNA, 22 bp, Homo sapiens
tctaagaaatcagatgatgagg

SEQ ID NO: 7723680 - DNA, 22 bp, Homo sapiens
tctaatgggtaaatatttttat

SEQ ID NO: 7723681 - DNA, 22 bp, Homo sapiens
tctaagaaatcagatgatgagg

SEQ ID NO: 7723682 - DNA, 22 bp, Homo sapiens
tctaacttagggaatactttag

SEQ ID NO: 7723683 - DNA, 22 bp, Homo sapiens
tctaacttgaactcatgactgt

SEQ ID NO: 7723684 - DNA, 22 bp, Homo sapiens
tctaacttgaactcatgactgt

SEQ ID NO: 7723685 - DNA, 22 bp, Homo sapiens
tctaactatacaaagaaaacat

SEQ ID NO: 7723686 - DNA, 22 bp, Homo sapiens
tctaactaactacagtaagagg

SEQ ID NO: 7723687 - DNA, 22 bp, Homo sapiens
tctaactatacaaagaaaacat

SEQ ID NO: 7723688 - DNA, 22 bp, Homo sapiens
tctaacttagggaatactttag

SEQ ID NO: 7723689 - DNA, 22 bp, Homo sapiens
tctaacattgtttttcacagat

SEQ ID NO: 7723690 - DNA, 19 bp, Homo sapiens
tctaacagctttcattcta

SEQ ID NO: 7723691 - DNA, 19 bp, Homo sapiens
tctaacagctttcattcta

SEQ ID NO: 7723692 - DNA, 19 bp, Homo sapiens
tctaacagctttcattcta

SEQ ID NO: 7723693 - DNA, 22 bp, Homo sapiens
tctaacattgaatggctgatta

SEQ ID NO: 7723694 - DNA, 22 bp, Homo sapiens
tctaacattgtttttcacagat

SEQ ID NO: 7723695 - DNA, 22 bp, Homo sapiens
tctaacatttatggccactgga

SEQ ID NO: 7723696 - DNA, 19 bp, Homo sapiens
tctaacctccccttcagtt

SEQ ID NO: 7723697 - DNA, 19 bp, Homo sapiens
tctaacctccccttcagtt

SEQ ID NO: 7723698 - DNA, 22 bp, Homo sapiens
tctaaccttgtggtctgctggt

SEQ ID NO: 7723699 - DNA, 22 bp, Homo sapiens
tctaactaactacagtaagagg

SEQ ID NO: 7723700 - DNA, 22 bp, Homo sapiens
tctaaatgtggtagtcataaga

SEQ ID NO: 7723701 - DNA, 22 bp, Homo sapiens
tctaaatgtggtagtcataaga

SEQ ID NO: 7723702 - DNA, 22 bp, Homo sapiens
tctaaatgtggtagtcataaga

SEQ ID NO: 7723703 - DNA, 22 bp, Homo sapiens
tctaaatgtcagtacagaatga

SEQ ID NO: 7723704 - DNA, 22 bp, Homo sapiens
tctaaatgtatcacatctggat

SEQ ID NO: 7723705 - DNA, 22 bp, Homo sapiens
tctaaatgtcagtacagaatga

SEQ ID NO: 7723706 - DNA, 22 bp, Homo sapiens
tctaaatgtcagtacagaatga

SEQ ID NO: 7723707 - DNA, 21 bp, Homo sapiens
tctaaatgtccagcaatagaa

SEQ ID NO: 7723708 - DNA, 22 bp, Homo sapiens
tctaaatcccaacatgatatca

SEQ ID NO: 7723709 - DNA, 22 bp, Homo sapiens
tctaaatggaaagaaaatacct

SEQ ID NO: 7723710 - DNA, 22 bp, Homo sapiens
tctaaatggaaagaaaatacct

SEQ ID NO: 7723711 - DNA, 22 bp, Homo sapiens
tctaaatcccaacatgatatca

SEQ ID NO: 7723712 - DNA, 19 bp, Homo sapiens
tctaacagaagtgtcgtcc

SEQ ID NO: 7723713 - DNA, 22 bp, Homo sapiens
tctaacagaaattctgacaaaa

SEQ ID NO: 7723714 - DNA, 19 bp, Homo sapiens
tctaacagaagtgtcgtcc

SEQ ID NO: 7723715 - DNA, 19 bp, Homo sapiens
tctaacagaagtgtcgtcc

SEQ ID NO: 7723716 - DNA, 22 bp, Homo sapiens
tctaaattctttcctgggttga

SEQ ID NO: 7723717 - DNA, 22 bp, Homo sapiens
tctaacacctgtcagatgtgat

SEQ ID NO: 7723718 - DNA, 22 bp, Homo sapiens
tctaacagaaattctgacaaaa

SEQ ID NO: 7723719 - DNA, 22 bp, Homo sapiens
tctaacagaaattctgacaaaa

SEQ ID NO: 7723720 - DNA, 22 bp, Homo sapiens
tctaaattactttgggcagtat

SEQ ID NO: 7723721 - DNA, 22 bp, Homo sapiens
tctaaattactttgggcagtat

SEQ ID NO: 7723722 - DNA, 22 bp, Homo sapiens
tctaaattcagtttattttgat

SEQ ID NO: 7723723 - DNA, 22 bp, Homo sapiens
tctaaattcagtttattttgat

SEQ ID NO: 7723724 - DNA, 22 bp, Homo sapiens
tctacaggtggggcctggcaat

SEQ ID NO: 7723725 - DNA, 22 bp, Homo sapiens
tctacagggtaaggggcttgcc

SEQ ID NO: 7723726 - DNA, 22 bp, Homo sapiens
tctacagctgctgcttctcatg

SEQ ID NO: 7723727 - DNA, 22 bp, Homo sapiens
tctacagggtcagagtttcatg

SEQ ID NO: 7723728 - DNA, 22 bp, Homo sapiens
tctacagccattttgagcagtg

SEQ ID NO: 7723729 - DNA, 22 bp, Homo sapiens
tctacagctgaacagtgtctca

SEQ ID NO: 7723730 - DNA, 22 bp, Homo sapiens
tctacagctgaacagtgtctca

SEQ ID NO: 7723731 - DNA, 22 bp, Homo sapiens
tctacagggtaaggggcttgcc

SEQ ID NO: 7723732 - DNA, 22 bp, Homo sapiens
tctacaggtggggcctggcaat

SEQ ID NO: 7723733 - DNA, 22 bp, Homo sapiens
tctacaggtggggcctggcaat

SEQ ID NO: 7723734 - DNA, 22 bp, Homo sapiens
tctacaggtggggcctggcaat

SEQ ID NO: 7723735 - DNA, 22 bp, Homo sapiens
tctacagtcaagttatattgct

SEQ ID NO: 7723736 - DNA, 22 bp, Homo sapiens
tctacaggtggggcctggcaat

SEQ ID NO: 7723737 - DNA, 22 bp, Homo sapiens
tctacaggtggggcctggcaat

SEQ ID NO: 7723738 - DNA, 22 bp, Homo sapiens
tctacagtgtttggtttgagga

SEQ ID NO: 7723739 - DNA, 22 bp, Homo sapiens
tctacagttttcttgggagttg

SEQ ID NO: 7723740 - DNA, 22 bp, Homo sapiens
tctacataaaaattcagaaggc

SEQ ID NO: 7723741 - DNA, 22 bp, Homo sapiens
tctacagtgtcaatgtgtcttg

SEQ ID NO: 7723742 - DNA, 22 bp, Homo sapiens
tctacattttaacaagatgccc

SEQ ID NO: 7723743 - DNA, 22 bp, Homo sapiens
tctacattttaacaagatgccc

SEQ ID NO: 7723744 - DNA, 22 bp, Homo sapiens
tctacattccttttataatatc

SEQ ID NO: 7723745 - DNA, 22 bp, Homo sapiens
tctacattttcacaaggtctcc

SEQ ID NO: 7723746 - DNA, 22 bp, Homo sapiens
tctacattttctttatgtacat

SEQ ID NO: 7723747 - DNA, 22 bp, Homo sapiens
tctacattttcacaaggtctcc

SEQ ID NO: 7723748 - DNA, 22 bp, Homo sapiens
tctacattttaacaagatgccc

SEQ ID NO: 7723749 - DNA, 22 bp, Homo sapiens
tctacatatgtgatttctaagt

SEQ ID NO: 7723750 - DNA, 21 bp, Homo sapiens
tctacatatcaatatgtaatt

SEQ ID NO: 7723751 - DNA, 21 bp, Homo sapiens
tctacatatcaatatgtaatt

SEQ ID NO: 7723752 - DNA, 22 bp, Homo sapiens
tctacatagaattaggtaattt

SEQ ID NO: 7723753 - DNA, 21 bp, Homo sapiens
tctacatatcaatatgtaatt

SEQ ID NO: 7723754 - DNA, 22 bp, Homo sapiens
tctacatgcagcgaggggactt

SEQ ID NO: 7723755 - DNA, 22 bp, Homo sapiens
tctacatgcagcgaggggactt

SEQ ID NO: 7723756 - DNA, 22 bp, Homo sapiens
tctacatgcagcgaggggactt

SEQ ID NO: 7723757 - DNA, 22 bp, Homo sapiens
tctacatgatgtaccatctaag

SEQ ID NO: 7723758 - DNA, 22 bp, Homo sapiens
tctacaatgagaaatgatcagt

SEQ ID NO: 7723759 - DNA, 22 bp, Homo sapiens
tctacacaagtgagtggcacaa

SEQ ID NO: 7723760 - DNA, 22 bp, Homo sapiens
tctacacaagtgagtggcacaa

SEQ ID NO: 7723761 - DNA, 22 bp, Homo sapiens
tctacacaagtgagtggcacaa

SEQ ID NO: 7723762 - DNA, 22 bp, Homo sapiens
tctacacatttgtaaaggcatt

SEQ ID NO: 7723763 - DNA, 22 bp, Homo sapiens
tctacacatttgtaaaggcatt

SEQ ID NO: 7723764 - DNA, 22 bp, Homo sapiens
tctacacatttgtaaaggcatt

SEQ ID NO: 7723765 - DNA, 22 bp, Homo sapiens
tctacacatttgtaaaggcatt

SEQ ID NO: 7723766 - DNA, 22 bp, Homo sapiens
tctacactccagagtctcatca

SEQ ID NO: 7723767 - DNA, 22 bp, Homo sapiens
tctacactccagagtctcatca

SEQ ID NO: 7723768 - DNA, 22 bp, Homo sapiens
tctacagactcctatgtaacac

SEQ ID NO: 7723769 - DNA, 22 bp, Homo sapiens
tctacagactcctatgtaacac

SEQ ID NO: 7723770 - DNA, 22 bp, Homo sapiens
tctacagacagagcaggtggga

SEQ ID NO: 7723771 - DNA, 22 bp, Homo sapiens
tctacagacagagcaggtggga

SEQ ID NO: 7723772 - DNA, 22 bp, Homo sapiens
tctacagaaactggctactctc

SEQ ID NO: 7723773 - DNA, 22 bp, Homo sapiens
tctacagaaactggctactctc

SEQ ID NO: 7723774 - DNA, 22 bp, Homo sapiens
tctacagagagtcatagactca

SEQ ID NO: 7723775 - DNA, 22 bp, Homo sapiens
tctacagagagtcatagactca

SEQ ID NO: 7723776 - DNA, 22 bp, Homo sapiens
tctacagagagcaaacattcta

SEQ ID NO: 7723777 - DNA, 22 bp, Homo sapiens
tctacagagagtcatagactca

SEQ ID NO: 7723778 - DNA, 22 bp, Homo sapiens
tctacagagagcaaacattcta

SEQ ID NO: 7723779 - DNA, 22 bp, Homo sapiens
tctacagagagcaaacattcta

SEQ ID NO: 7723780 - DNA, 22 bp, Homo sapiens
tctacagagagtcatagactca

SEQ ID NO: 7723781 - DNA, 22 bp, Homo sapiens
tctacagccattttgagcagtg

SEQ ID NO: 7723782 - DNA, 22 bp, Homo sapiens
tctacagagagtcatagactca

SEQ ID NO: 7723783 - DNA, 19 bp, Homo sapiens
tctacaaagtggcatcagg

SEQ ID NO: 7723784 - DNA, 19 bp, Homo sapiens
tctacaaagtggcatcagg

SEQ ID NO: 7723785 - DNA, 19 bp, Homo sapiens
tctacaaagtggcatcagg

SEQ ID NO: 7723786 - DNA, 22 bp, Homo sapiens
tctacaaaggttgaggtgccct

SEQ ID NO: 7723787 - DNA, 22 bp, Homo sapiens
tctacaaaggttgaggtgccct

SEQ ID NO: 7723788 - DNA, 22 bp, Homo sapiens
tctacaaaggttgaggtgccct

SEQ ID NO: 7723789 - DNA, 22 bp, Homo sapiens
tctacaaataaattactatgta

SEQ ID NO: 7723790 - DNA, 22 bp, Homo sapiens
tctacaaataaattactatgta

SEQ ID NO: 7723791 - DNA, 22 bp, Homo sapiens
tctacaaataaattactatgta

SEQ ID NO: 7723792 - DNA, 22 bp, Homo sapiens
tctacaaataaattactatgta

SEQ ID NO: 7723793 - DNA, 19 bp, Homo sapiens
tctacaaagtggcatcagg

SEQ ID NO: 7723794 - DNA, 22 bp, Homo sapiens
tctacaaataaattactatgta

SEQ ID NO: 7723795 - DNA, 22 bp, Homo sapiens
tctacaaataaattactatgta

SEQ ID NO: 7723796 - DNA, 22 bp, Homo sapiens
tctacaaataaattactatgta

SEQ ID NO: 7723797 - DNA, 22 bp, Homo sapiens
tctacaatgagaaatgatcagt

SEQ ID NO: 7723798 - DNA, 22 bp, Homo sapiens
tctacaagttgtgacttgatac

SEQ ID NO: 7723799 - DNA, 22 bp, Homo sapiens
tctacaagttgtgacttgatac

SEQ ID NO: 7723800 - DNA, 22 bp, Homo sapiens
tctacaagtttaattccactta

SEQ ID NO: 7723801 - DNA, 22 bp, Homo sapiens
tctacaacattccacaggcatg

SEQ ID NO: 7723802 - DNA, 22 bp, Homo sapiens
tctacaagtcaagtctatcaag

SEQ ID NO: 7723803 - DNA, 22 bp, Homo sapiens
tctaaagatttggattcatttg

SEQ ID NO: 7723804 - DNA, 22 bp, Homo sapiens
tctaaagatgtttattgacata

SEQ ID NO: 7723805 - DNA, 22 bp, Homo sapiens
tctaaagatgtttattgacata

SEQ ID NO: 7723806 - DNA, 22 bp, Homo sapiens
tctaaagatgtttattgacata

SEQ ID NO: 7723807 - DNA, 22 bp, Homo sapiens
tctaaagagagtgggtacatgt

SEQ ID NO: 7723808 - DNA, 22 bp, Homo sapiens
tctaaagagaaccttttctcat

SEQ ID NO: 7723809 - DNA, 22 bp, Homo sapiens
tctaaagtatgctaatatgtga

SEQ ID NO: 7723810 - DNA, 20 bp, Homo sapiens
tctaaagtacagtttgtgtg

SEQ ID NO: 7723811 - DNA, 20 bp, Homo sapiens
tctaaagtacagtttgtgtg

SEQ ID NO: 7723812 - DNA, 22 bp, Homo sapiens
tctaaagatttggattcatttg

SEQ ID NO: 7723813 - DNA, 22 bp, Homo sapiens
tctaaagatttggattcatttg

SEQ ID NO: 7723814 - DNA, 22 bp, Homo sapiens
tctaaagatttggattcatttg

SEQ ID NO: 7723815 - DNA, 22 bp, Homo sapiens
tctaaagacactttttacaggg

SEQ ID NO: 7723816 - DNA, 22 bp, Homo sapiens
tctaaagaaacattgagacctg

SEQ ID NO: 7723817 - DNA, 22 bp, Homo sapiens
tctaaactgcgagcatgccccc

SEQ ID NO: 7723818 - DNA, 22 bp, Homo sapiens
tctaaacttcactttaagtgct

SEQ ID NO: 7723819 - DNA, 22 bp, Homo sapiens
tctaaacttcactttaagtgct

SEQ ID NO: 7723820 - DNA, 19 bp, Homo sapiens
tctaaactctatactggta

SEQ ID NO: 7723821 - DNA, 22 bp, Homo sapiens
tctaaacattgtgatagacctt

SEQ ID NO: 7723822 - DNA, 22 bp, Homo sapiens
tctaaacattgtgatagacctt

SEQ ID NO: 7723823 - DNA, 22 bp, Homo sapiens
tctaaaaaagtctgttcacttg

SEQ ID NO: 7723824 - DNA, 22 bp, Homo sapiens
tctaaaaaagtctgttcacttg

SEQ ID NO: 7723825 - DNA, 22 bp, Homo sapiens
tctaaaaaagtctgttcacttg

SEQ ID NO: 7723826 - DNA, 22 bp, Homo sapiens
tctaaaaaagtctgttcacttg

SEQ ID NO: 7723827 - DNA, 22 bp, Homo sapiens
tctaaaatgcagatctactggt

SEQ ID NO: 7723828 - DNA, 22 bp, Homo sapiens
tctaaaatgcagatctactggt

SEQ ID NO: 7723829 - DNA, 22 bp, Homo sapiens
tctaaaagagggaggagagcct

SEQ ID NO: 7723830 - DNA, 22 bp, Homo sapiens
tctaaaaaagtctgttcacttg

SEQ ID NO: 7723831 - DNA, 22 bp, Homo sapiens
tctaaaaaagtctgttcacttg

SEQ ID NO: 7723832 - DNA, 23 bp, Homo sapiens
tctaaaattcatcatttacgttc

SEQ ID NO: 7723833 - DNA, 22 bp, Homo sapiens
tctaaaatgcagatctactggt

SEQ ID NO: 7723834 - DNA, 22 bp, Homo sapiens
tctaaaatgcagatctactggt

SEQ ID NO: 7723835 - DNA, 22 bp, Homo sapiens
tctaaaatgcagatctactggt

SEQ ID NO: 7723836 - DNA, 22 bp, Homo sapiens
tctaaaatgcagatctactggt

SEQ ID NO: 7723837 - DNA, 23 bp, Homo sapiens
tctaaaattcatcatttacgttc

SEQ ID NO: 7723838 - DNA, 23 bp, Homo sapiens
tctaaaattcatcatttacgttc

SEQ ID NO: 7723839 - DNA, 23 bp, Homo sapiens
tctaaaattcatcatttacgttc

SEQ ID NO: 7723840 - DNA, 23 bp, Homo sapiens
tctaaaattcatcatttacgttc

SEQ ID NO: 7723841 - DNA, 19 bp, Homo sapiens
tctaaacacagggacaagc

SEQ ID NO: 7723842 - DNA, 22 bp, Homo sapiens
tctaaacacgtctctttgaata

SEQ ID NO: 7723843 - DNA, 22 bp, Homo sapiens
tctaaacagtttcactcttaat

SEQ ID NO: 7723844 - DNA, 22 bp, Homo sapiens
tctaaacagtttcactcttaat

SEQ ID NO: 7723845 - DNA, 22 bp, Homo sapiens
tctaaacagcctcttaccaact

SEQ ID NO: 7723846 - DNA, 22 bp, Homo sapiens
tctaaacattatgatagtagag

SEQ ID NO: 7723847 - DNA, 22 bp, Homo sapiens
tctaaacattatgatagtagag

SEQ ID NO: 7723848 - DNA, 22 bp, Homo sapiens
tctaaacataactttgtgtgat

SEQ ID NO: 7723849 - DNA, 22 bp, Homo sapiens
tctaaacattatgatagtagag

SEQ ID NO: 7723850 - DNA, 22 bp, Homo sapiens
tctaaacattatgatagtagag

SEQ ID NO: 7723851 - DNA, 22 bp, Homo sapiens
tctaaacattatgatagtagag

SEQ ID NO: 7723852 - DNA, 22 bp, Homo sapiens
tctaaacactaagtcttgatgc

SEQ ID NO: 7723853 - DNA, 22 bp, Homo sapiens
tctaaacactaagtcttgatgc

SEQ ID NO: 7723854 - DNA, 22 bp, Homo sapiens
tctaaacactaagtcttgatgc

SEQ ID NO: 7723855 - DNA, 22 bp, Homo sapiens
tctaaacactaagtcttgatgc

SEQ ID NO: 7723856 - DNA, 22 bp, Homo sapiens
tctaaacacgtctctttgaata

SEQ ID NO: 7723857 - DNA, 22 bp, Homo sapiens
tctaaacacgtctctttgaata

SEQ ID NO: 7723858 - DNA, 22 bp, Homo sapiens
tctaaacacgtctctttgaata

SEQ ID NO: 7723859 - DNA, 22 bp, Homo sapiens
tctaaacacgtctctttgaata

SEQ ID NO: 7723860 - DNA, 22 bp, Homo sapiens
tcgtgatctgtccacctcggcc

SEQ ID NO: 7723861 - DNA, 22 bp, Homo sapiens
tcgtgaggctctgcatcgcaca

SEQ ID NO: 7723862 - DNA, 22 bp, Homo sapiens
tcgtgagggccctggaggtgct

SEQ ID NO: 7723863 - DNA, 22 bp, Homo sapiens
tcgtgaggctctgcatcgcaca

SEQ ID NO: 7723864 - DNA, 22 bp, Homo sapiens
tcgtgatctgtccacctcggcc

SEQ ID NO: 7723865 - DNA, 22 bp, Homo sapiens
tcgtgatctgtccacctcggcc

SEQ ID NO: 7723866 - DNA, 22 bp, Homo sapiens
tcgtgatctgtccacctcggcc

SEQ ID NO: 7723867 - DNA, 21 bp, Homo sapiens
tcgtgcagcagctgaggcttg

SEQ ID NO: 7723868 - DNA, 22 bp, Homo sapiens
tcgtggagaggccatgtggagg

SEQ ID NO: 7723869 - DNA, 22 bp, Homo sapiens
tcgtggaggcaccgtgagcttt

SEQ ID NO: 7723870 - DNA, 22 bp, Homo sapiens
tcgtggagaggccatgtggagg

SEQ ID NO: 7723871 - DNA, 22 bp, Homo sapiens
tcgtggaggcaccgtgagcttt

SEQ ID NO: 7723872 - DNA, 22 bp, Homo sapiens
tcgtggatcaccgcgtctgtgt

SEQ ID NO: 7723873 - DNA, 21 bp, Homo sapiens
tcgtgcagcagctgaggcttg

SEQ ID NO: 7723874 - DNA, 21 bp, Homo sapiens
tcgtgcagcagctgaggcttg

SEQ ID NO: 7723875 - DNA, 21 bp, Homo sapiens
tcgtgcagcagctgaggcttg

SEQ ID NO: 7723876 - DNA, 21 bp, Homo sapiens
tcgtgcagcagctgaggcttg

SEQ ID NO: 7723877 - DNA, 22 bp, Homo sapiens
tcgtgcatcatgtattcccatt

SEQ ID NO: 7723878 - DNA, 22 bp, Homo sapiens
tcgtgctcctggtgaggctctg

SEQ ID NO: 7723879 - DNA, 22 bp, Homo sapiens
tcgtgctggatatagggctcta

SEQ ID NO: 7723880 - DNA, 22 bp, Homo sapiens
tcgtgtgtattccctctccttc

SEQ ID NO: 7723881 - DNA, 22 bp, Homo sapiens
tcgtgtgtattccctctccttc

SEQ ID NO: 7723882 - DNA, 19 bp, Homo sapiens
tcgtggggaggtgggcagc

SEQ ID NO: 7723883 - DNA, 19 bp, Homo sapiens
tcgtggggaggtgggcagc

SEQ ID NO: 7723884 - DNA, 19 bp, Homo sapiens
tcgtggggaggtgggcagc

SEQ ID NO: 7723885 - DNA, 22 bp, Homo sapiens
tcgtggatgcgcagggcggcct

SEQ ID NO: 7723886 - DNA, 19 bp, Homo sapiens
tcgtggggaggtgggcagc

SEQ ID NO: 7723887 - DNA, 23 bp, Homo sapiens
tcgttgaatagcaatagcacaac

SEQ ID NO: 7723888 - DNA, 23 bp, Homo sapiens
tcgttgaatagcaatagcacaac

SEQ ID NO: 7723889 - DNA, 20 bp, Homo sapiens
tcgtttatttgaaattgctc

SEQ ID NO: 7723890 - DNA, 23 bp, Homo sapiens
tcgttgaatagcaatagcacaac

SEQ ID NO: 7723891 - DNA, 23 bp, Homo sapiens
tcgttgaatagcaatagcacaac

SEQ ID NO: 7723892 - DNA, 22 bp, Homo sapiens
tcgttttaccaaattgaatgtt

SEQ ID NO: 7723893 - DNA, 22 bp, Homo sapiens
tcgtttgtctgtttaagcaggg

SEQ ID NO: 7723894 - DNA, 22 bp, Homo sapiens
tcgttttaccaaattgaatgtt

SEQ ID NO: 7723895 - DNA, 22 bp, Homo sapiens
tcgttttaccaaattgaatgtt

SEQ ID NO: 7723896 - DNA, 22 bp, Homo sapiens
tcgttttaggtggacattgtgt

SEQ ID NO: 7723897 - DNA, 22 bp, Homo sapiens
tcgttttaggtggacattgtgt

SEQ ID NO: 7723898 - DNA, 22 bp, Homo sapiens
tcgttttaggtggacattgtgt

SEQ ID NO: 7723899 - DNA, 17 bp, Homo sapiens
tcgttttctgaacaaag

SEQ ID NO: 7723900 - DNA, 17 bp, Homo sapiens
tcgttttctgaacaaag

SEQ ID NO: 7723901 - DNA, 22 bp, Homo sapiens
tcgcccagctcatctcccacaa

SEQ ID NO: 7723902 - DNA, 22 bp, Homo sapiens
tcgccagggatgctgtaaggaa

SEQ ID NO: 7723903 - DNA, 22 bp, Homo sapiens
tcgcatttgggcaggagatgct

SEQ ID NO: 7723904 - DNA, 22 bp, Homo sapiens
tcgcccagctcatctcccacaa

SEQ ID NO: 7723905 - DNA, 22 bp, Homo sapiens
tcgccatggaagtccttgcgga

SEQ ID NO: 7723906 - DNA, 22 bp, Homo sapiens
tcgccatggaagtccttgcgga

SEQ ID NO: 7723907 - DNA, 22 bp, Homo sapiens
tcgcccaggctggaagtgcagt

SEQ ID NO: 7723908 - DNA, 22 bp, Homo sapiens
tcgcccaggctggaagtgcagt

SEQ ID NO: 7723909 - DNA, 22 bp, Homo sapiens
tcgcccaggctggaagtgcagt

SEQ ID NO: 7723910 - DNA, 22 bp, Homo sapiens
tcgcccaggctggaagtgcagt

SEQ ID NO: 7723911 - DNA, 22 bp, Homo sapiens
tcgcccaggctggaagtgcagt

SEQ ID NO: 7723912 - DNA, 22 bp, Homo sapiens
tcgcccaggctggaagtgcagt

SEQ ID NO: 7723913 - DNA, 22 bp, Homo sapiens
tcgcccaggctggaagtgcagt

SEQ ID NO: 7723914 - DNA, 19 bp, Homo sapiens
tcgcagacctgagttctaa

SEQ ID NO: 7723915 - DNA, 22 bp, Homo sapiens
tcgcagcactagccctgcattg

SEQ ID NO: 7723916 - DNA, 22 bp, Homo sapiens
tcgcagcactagccctgcattg

SEQ ID NO: 7723917 - DNA, 22 bp, Homo sapiens
tcgcagaggcacgagtgcagaa

SEQ ID NO: 7723918 - DNA, 22 bp, Homo sapiens
tcgcaccattgcactccagcca

SEQ ID NO: 7723919 - DNA, 22 bp, Homo sapiens
tcgagtacagttgagccaaaac

SEQ ID NO: 7723920 - DNA, 22 bp, Homo sapiens
tcgcaccattgcactccagcca

SEQ ID NO: 7723921 - DNA, 22 bp, Homo sapiens
tcgcaccattgcactccagcca

SEQ ID NO: 7723922 - DNA, 22 bp, Homo sapiens
tcgtaaggttgtttacaacaat

SEQ ID NO: 7723923 - DNA, 22 bp, Homo sapiens
tcgcccaggctggaagtgcagt

SEQ ID NO: 7723924 - DNA, 22 bp, Homo sapiens
tcgcccaggctggaagtgcagt

SEQ ID NO: 7723925 - DNA, 22 bp, Homo sapiens
tcgcccaggctggaagtgcagt

SEQ ID NO: 7723926 - DNA, 22 bp, Homo sapiens
tcgcccaggctggaagtgcagt

SEQ ID NO: 7723927 - DNA, 22 bp, Homo sapiens
tcgcccaggctggaagtgcagt

SEQ ID NO: 7723928 - DNA, 22 bp, Homo sapiens
tcgcccaggctggaagtgcagt

SEQ ID NO: 7723929 - DNA, 19 bp, Homo sapiens
tcgtcagttgctccatcgg

SEQ ID NO: 7723930 - DNA, 22 bp, Homo sapiens
tcgtcctgtgcacctgcctgca

SEQ ID NO: 7723931 - DNA, 22 bp, Homo sapiens
tcgtctgtgaaattgggataag

SEQ ID NO: 7723932 - DNA, 22 bp, Homo sapiens
tcgtcatctgaaggctgtcaat

SEQ ID NO: 7723933 - DNA, 22 bp, Homo sapiens
tcgtatttgtctttgaaaaatc

SEQ ID NO: 7723934 - DNA, 22 bp, Homo sapiens
tcgtacagcagactgaagtcct

SEQ ID NO: 7723935 - DNA, 22 bp, Homo sapiens
tcgtgaggctctgcatcgcaca

SEQ ID NO: 7723936 - DNA, 22 bp, Homo sapiens
tcgtctgtgaaattgggataag

SEQ ID NO: 7723937 - DNA, 22 bp, Homo sapiens
tcctttcttcttctgcccatgg

SEQ ID NO: 7723938 - DNA, 22 bp, Homo sapiens
tcctttcttcttctgcccatgg

SEQ ID NO: 7723939 - DNA, 22 bp, Homo sapiens
tcctttcttcttctgcccatgg

SEQ ID NO: 7723940 - DNA, 19 bp, Homo sapiens
tcctttctgttcctgagat

SEQ ID NO: 7723941 - DNA, 22 bp, Homo sapiens
tcctttcttcttctgcccatgg

SEQ ID NO: 7723942 - DNA, 19 bp, Homo sapiens
tcctttctgttcctgagat

SEQ ID NO: 7723943 - DNA, 22 bp, Homo sapiens
tcctttcttgtgtatcaaatgg

SEQ ID NO: 7723944 - DNA, 22 bp, Homo sapiens
tcctttcttgtgtatcaaatgg

SEQ ID NO: 7723945 - DNA, 17 bp, Homo sapiens
tcctttctttacctgtt

SEQ ID NO: 7723946 - DNA, 17 bp, Homo sapiens
tcctttctttacctgtt

SEQ ID NO: 7723947 - DNA, 19 bp, Homo sapiens
tcctttgaatatcagttga

SEQ ID NO: 7723948 - DNA, 19 bp, Homo sapiens
tcctttgaatatcagttga

SEQ ID NO: 7723949 - DNA, 22 bp, Homo sapiens
tcctttcttttctatgggccca

SEQ ID NO: 7723950 - DNA, 22 bp, Homo sapiens
tcctttcttttctatgggccca

SEQ ID NO: 7723951 - DNA, 22 bp, Homo sapiens
tcctttctgtctttactctgga

SEQ ID NO: 7723952 - DNA, 19 bp, Homo sapiens
tcctttctgttcctgagat

SEQ ID NO: 7723953 - DNA, 22 bp, Homo sapiens
tcctttctgtctttactctgga

SEQ ID NO: 7723954 - DNA, 22 bp, Homo sapiens
tcctttctgggcctcagtgact

SEQ ID NO: 7723955 - DNA, 22 bp, Homo sapiens
tcctttctgggcctcagtgact

SEQ ID NO: 7723956 - DNA, 22 bp, Homo sapiens
tcctttctgtctttactctgga

SEQ ID NO: 7723957 - DNA, 22 bp, Homo sapiens
tcctttctgtctttactctgga

SEQ ID NO: 7723958 - DNA, 18 bp, Homo sapiens
tcctttctccctcatctt

SEQ ID NO: 7723959 - DNA, 18 bp, Homo sapiens
tcctttctccctcatctt

SEQ ID NO: 7723960 - DNA, 22 bp, Homo sapiens
tcctttctccttccgacttcat

SEQ ID NO: 7723961 - DNA, 22 bp, Homo sapiens
tcctttctccgggggactgttg

SEQ ID NO: 7723962 - DNA, 22 bp, Homo sapiens
tcctttctccttccgacttcat

SEQ ID NO: 7723963 - DNA, 22 bp, Homo sapiens
tcctttctccgggggactgttg

SEQ ID NO: 7723964 - DNA, 22 bp, Homo sapiens
tcctttccatgcttctagaggc

SEQ ID NO: 7723965 - DNA, 22 bp, Homo sapiens
tcctttccatgcttctagaggc

SEQ ID NO: 7723966 - DNA, 22 bp, Homo sapiens
tcctttccatgcttctagaggc

SEQ ID NO: 7723967 - DNA, 23 bp, Homo sapiens
tccttgggcctgcccagagtggt

SEQ ID NO: 7723968 - DNA, 22 bp, Homo sapiens
tccttgggaaacatcatgtaat

SEQ ID NO: 7723969 - DNA, 22 bp, Homo sapiens
tccttgggaaatcactagcact

SEQ ID NO: 7723970 - DNA, 22 bp, Homo sapiens
tccttgggaaatcactagcact

SEQ ID NO: 7723971 - DNA, 21 bp, Homo sapiens
tccttgggcagtgcccagctt

SEQ ID NO: 7723972 - DNA, 22 bp, Homo sapiens
tccttggcctgggtggggtctc

SEQ ID NO: 7723973 - DNA, 22 bp, Homo sapiens
tccttggctagtactggccagc

SEQ ID NO: 7723974 - DNA, 22 bp, Homo sapiens
tccttggctagtactggccagc

SEQ ID NO: 7723975 - DNA, 22 bp, Homo sapiens
tccttggctagtactggccagc

SEQ ID NO: 7723976 - DNA, 22 bp, Homo sapiens
tccttggctctttgataaatac

SEQ ID NO: 7723977 - DNA, 22 bp, Homo sapiens
tcctttccctttccatcctggc

SEQ ID NO: 7723978 - DNA, 22 bp, Homo sapiens
tcctttccctttccatcctggc

SEQ ID NO: 7723979 - DNA, 22 bp, Homo sapiens
tcctttccatgcttctagaggc

SEQ ID NO: 7723980 - DNA, 22 bp, Homo sapiens
tcctttccctttccatcctggc

SEQ ID NO: 7723981 - DNA, 22 bp, Homo sapiens
tcctttccctttccatcctggc

SEQ ID NO: 7723982 - DNA, 20 bp, Homo sapiens
tcctttcctccttctaaatg

SEQ ID NO: 7723983 - DNA, 20 bp, Homo sapiens
tcctttcctccttctaaatg

SEQ ID NO: 7723984 - DNA, 22 bp, Homo sapiens
tcctttctccagctggcattgt

SEQ ID NO: 7723985 - DNA, 22 bp, Homo sapiens
tcctttctatcttgggtatcta

SEQ ID NO: 7723986 - DNA, 20 bp, Homo sapiens
tcctttcctccttctaaatg

SEQ ID NO: 7723987 - DNA, 20 bp, Homo sapiens
tcctttcctccttctaaatg

SEQ ID NO: 7723988 - DNA, 18 bp, Homo sapiens
tcctttctccctcatctt

SEQ ID NO: 7723989 - DNA, 22 bp, Homo sapiens
tcctttctcccaggttagttgt

SEQ ID NO: 7723990 - DNA, 22 bp, Homo sapiens
tcctttctccagctggcattgt

SEQ ID NO: 7723991 - DNA, 22 bp, Homo sapiens
tcgcaccattgcactccagcca

SEQ ID NO: 7723992 - DNA, 22 bp, Homo sapiens
tcgcaccattgcactccagcca

SEQ ID NO: 7723993 - DNA, 22 bp, Homo sapiens
tcgatttgtattacatctacat

SEQ ID NO: 7723994 - DNA, 22 bp, Homo sapiens
tcgataatatcttacatgtgct

SEQ ID NO: 7723995 - DNA, 19 bp, Homo sapiens
tcgagtcaagacactaggc

SEQ ID NO: 7723996 - DNA, 22 bp, Homo sapiens
tcgaagtacccagggctctccc

SEQ ID NO: 7723997 - DNA, 21 bp, Homo sapiens
tcgacctgctgggctcgggct

SEQ ID NO: 7723998 - DNA, 22 bp, Homo sapiens
tcgagctctggagccaaggatg

SEQ ID NO: 7723999 - DNA, 22 bp, Homo sapiens
tcgaaggcctcttgctcctcga

SEQ ID NO: 7724000 - DNA, 22 bp, Homo sapiens
tcgaatggcaaggaaagaggct

SEQ ID NO: 7724001 - DNA, 22 bp, Homo sapiens
tcgagctgggcaagcttccata

SEQ ID NO: 7724002 - DNA, 22 bp, Homo sapiens
tcgagctgcacgcccccgagct

SEQ ID NO: 7724003 - DNA, 22 bp, Homo sapiens
tcctttttggtccaaggtgacc

SEQ ID NO: 7724004 - DNA, 22 bp, Homo sapiens
tcctttttggtccaaggtgacc

SEQ ID NO: 7724005 - DNA, 22 bp, Homo sapiens
tcctttttggtccaaggtgacc

SEQ ID NO: 7724006 - DNA, 22 bp, Homo sapiens
tccttttttatgaagctttgag

SEQ ID NO: 7724007 - DNA, 22 bp, Homo sapiens
tccttttttatgaagctttgag

SEQ ID NO: 7724008 - DNA, 22 bp, Homo sapiens
tcgaaataatttagaatataga

SEQ ID NO: 7724009 - DNA, 22 bp, Homo sapiens
tccttttttatgaagctttgag

SEQ ID NO: 7724010 - DNA, 22 bp, Homo sapiens
tcgaaaatgaagagtcaattaa

SEQ ID NO: 7724011 - DNA, 22 bp, Homo sapiens
tcgaaataatttagaatataga

SEQ ID NO: 7724012 - DNA, 22 bp, Homo sapiens
tcgaaatactgtttccccttta

SEQ ID NO: 7724013 - DNA, 22 bp, Homo sapiens
tcgaaccacgtagtaaacaaca

SEQ ID NO: 7724014 - DNA, 22 bp, Homo sapiens
tcgaagattctttttgttagta

SEQ ID NO: 7724015 - DNA, 22 bp, Homo sapiens
tcgaactcatagtcgtagctgt

SEQ ID NO: 7724016 - DNA, 22 bp, Homo sapiens
tcctttttatagttagagaaac

SEQ ID NO: 7724017 - DNA, 22 bp, Homo sapiens
tcctttttatagttagagaaac

SEQ ID NO: 7724018 - DNA, 22 bp, Homo sapiens
tcctttttaagtcgttgtggta

SEQ ID NO: 7724019 - DNA, 22 bp, Homo sapiens
tcctttttatagttagagaaac

SEQ ID NO: 7724020 - DNA, 22 bp, Homo sapiens
tcctttttaagtcgttgtggta

SEQ ID NO: 7724021 - DNA, 22 bp, Homo sapiens
tcctttttatagttagagaaac

SEQ ID NO: 7724022 - DNA, 22 bp, Homo sapiens
tcctttttatagttagagaaac

SEQ ID NO: 7724023 - DNA, 22 bp, Homo sapiens
tcctttttctcacacaacgaac

SEQ ID NO: 7724024 - DNA, 22 bp, Homo sapiens
tcctttttctcacacaacgaac

SEQ ID NO: 7724025 - DNA, 22 bp, Homo sapiens
tcctttttctcacacaacgaac

SEQ ID NO: 7724026 - DNA, 22 bp, Homo sapiens
tcctttttggtccaaggtgacc

SEQ ID NO: 7724027 - DNA, 22 bp, Homo sapiens
tcctttgcttctgtcattctcc

SEQ ID NO: 7724028 - DNA, 22 bp, Homo sapiens
tcctttgcttctgtcattctcc

SEQ ID NO: 7724029 - DNA, 22 bp, Homo sapiens
tcctttgcttctgtcattctcc

SEQ ID NO: 7724030 - DNA, 22 bp, Homo sapiens
tcctttgcttctgtcattctcc

SEQ ID NO: 7724031 - DNA, 22 bp, Homo sapiens
tcctttgcttctgtcattctcc

SEQ ID NO: 7724032 - DNA, 22 bp, Homo sapiens
tcctttgcttctgtcattctcc

SEQ ID NO: 7724033 - DNA, 23 bp, Homo sapiens
tcctttgacaagagacagatgtt

SEQ ID NO: 7724034 - DNA, 23 bp, Homo sapiens
tcctttgacaagagacagatgtt

SEQ ID NO: 7724035 - DNA, 22 bp, Homo sapiens
tcctttgacttcttgcagtcca

SEQ ID NO: 7724036 - DNA, 22 bp, Homo sapiens
tcctttgcttctgtcattctcc

SEQ ID NO: 7724037 - DNA, 22 bp, Homo sapiens
tcctttgcttctgtcattctcc

SEQ ID NO: 7724038 - DNA, 22 bp, Homo sapiens
tcctttggagcttgactggtag

SEQ ID NO: 7724039 - DNA, 22 bp, Homo sapiens
tcctttggagcttgactggtag

SEQ ID NO: 7724040 - DNA, 22 bp, Homo sapiens
tcctttggacacattttttata

SEQ ID NO: 7724041 - DNA, 22 bp, Homo sapiens
tcctttggaactgactccgtta

SEQ ID NO: 7724042 - DNA, 22 bp, Homo sapiens
tcctttggaactgactccgtta

SEQ ID NO: 7724043 - DNA, 20 bp, Homo sapiens
tcctttggccttagagctgt

SEQ ID NO: 7724044 - DNA, 20 bp, Homo sapiens
tcctttggccttagagctgt

SEQ ID NO: 7724045 - DNA, 22 bp, Homo sapiens
tcctttggcaagctctgctctt

SEQ ID NO: 7724046 - DNA, 22 bp, Homo sapiens
tcctttggcaagctctgctctt

SEQ ID NO: 7724047 - DNA, 22 bp, Homo sapiens
tcctttggtagttttcttaaag

SEQ ID NO: 7724048 - DNA, 22 bp, Homo sapiens
tcctttggtagttttcttaaag

SEQ ID NO: 7724049 - DNA, 22 bp, Homo sapiens
tcctttggttctctaagatgct

SEQ ID NO: 7724050 - DNA, 22 bp, Homo sapiens
tcctttggttctctaagatgct

SEQ ID NO: 7724051 - DNA, 22 bp, Homo sapiens
tccttttctcttccccagagta

SEQ ID NO: 7724052 - DNA, 22 bp, Homo sapiens
tccttttctctagtaagcttta

SEQ ID NO: 7724053 - DNA, 22 bp, Homo sapiens
tccttttctctagtaagcttta

SEQ ID NO: 7724054 - DNA, 22 bp, Homo sapiens
tccttttctctagtaagcttta

SEQ ID NO: 7724055 - DNA, 22 bp, Homo sapiens
tccttttgctgggatcatcagg

SEQ ID NO: 7724056 - DNA, 22 bp, Homo sapiens
tccttttctcttccccagagta

SEQ ID NO: 7724057 - DNA, 22 bp, Homo sapiens
tccttttctcttccccagagta

SEQ ID NO: 7724058 - DNA, 18 bp, Homo sapiens
tccttttctcccacccac

SEQ ID NO: 7724059 - DNA, 22 bp, Homo sapiens
tccttttccctgaaggtattta

SEQ ID NO: 7724060 - DNA, 18 bp, Homo sapiens
tccttttctcccacccac

SEQ ID NO: 7724061 - DNA, 18 bp, Homo sapiens
tccttttctcccacccac

SEQ ID NO: 7724062 - DNA, 22 bp, Homo sapiens
tccttttctctagtaagcttta

SEQ ID NO: 7724063 - DNA, 22 bp, Homo sapiens
tccttttccctgaaggtattta

SEQ ID NO: 7724064 - DNA, 22 bp, Homo sapiens
tccttttccctgaaggtattta

SEQ ID NO: 7724065 - DNA, 22 bp, Homo sapiens
tccttttccctgaaggtattta

SEQ ID NO: 7724066 - DNA, 23 bp, Homo sapiens
tcctttgtctttgcatagatggt

SEQ ID NO: 7724067 - DNA, 23 bp, Homo sapiens
tcctttgtctttgcatagatggt

SEQ ID NO: 7724068 - DNA, 22 bp, Homo sapiens
tcctttggttgtagacaggaat

SEQ ID NO: 7724069 - DNA, 22 bp, Homo sapiens
tcctttggttgtagacaggaat

SEQ ID NO: 7724070 - DNA, 23 bp, Homo sapiens
tcctttgtctttgcatagatggt

SEQ ID NO: 7724071 - DNA, 22 bp, Homo sapiens
tcctttgtggaaatacttgtgg

SEQ ID NO: 7724072 - DNA, 22 bp, Homo sapiens
tcctttgttgagataaattggg

SEQ ID NO: 7724073 - DNA, 22 bp, Homo sapiens
tcctttgttaaggaggtttgtt

SEQ ID NO: 7724074 - DNA, 22 bp, Homo sapiens
tcctttgttgtacaattatttt

SEQ ID NO: 7724075 - DNA, 22 bp, Homo sapiens
tcctttgttgtacaattatttt

SEQ ID NO: 7724076 - DNA, 21 bp, Homo sapiens
tccttttcaatcgggcccttt

SEQ ID NO: 7724077 - DNA, 21 bp, Homo sapiens
tccttttcaatcgggcccttt

SEQ ID NO: 7724078 - DNA, 22 bp, Homo sapiens
tccttacagttaaaatgggagt

SEQ ID NO: 7724079 - DNA, 22 bp, Homo sapiens
tccttacagaaagcagtagaca

SEQ ID NO: 7724080 - DNA, 22 bp, Homo sapiens
tccttacatgcttccttataca

SEQ ID NO: 7724081 - DNA, 22 bp, Homo sapiens
tccttacatagtgctgaaatat

SEQ ID NO: 7724082 - DNA, 22 bp, Homo sapiens
tccttacatgcttccttataca

SEQ ID NO: 7724083 - DNA, 22 bp, Homo sapiens
tccttacatagtgctgaaatat

SEQ ID NO: 7724084 - DNA, 22 bp, Homo sapiens
tccttacatagtgctgaaatat

SEQ ID NO: 7724085 - DNA, 22 bp, Homo sapiens
tccttagacaaagagtgggctt

SEQ ID NO: 7724086 - DNA, 22 bp, Homo sapiens
tccttagacaaagagtgggctt

SEQ ID NO: 7724087 - DNA, 22 bp, Homo sapiens
tccttagacaaagagtgggctt

SEQ ID NO: 7724088 - DNA, 22 bp, Homo sapiens
tccttacatgcttccttataca

SEQ ID NO: 7724089 - DNA, 22 bp, Homo sapiens
tccttacctcaagcttgtggtc

SEQ ID NO: 7724090 - DNA, 22 bp, Homo sapiens
tccttacctcaagcttgtggtc

SEQ ID NO: 7724091 - DNA, 22 bp, Homo sapiens
tccttagacaaagagtgggctt

SEQ ID NO: 7724092 - DNA, 22 bp, Homo sapiens
tccttagacaaagagtgggctt

SEQ ID NO: 7724093 - DNA, 22 bp, Homo sapiens
tccttagacaaagagtgggctt

SEQ ID NO: 7724094 - DNA, 22 bp, Homo sapiens
tccttagagtggttgtgctatg

SEQ ID NO: 7724095 - DNA, 22 bp, Homo sapiens
tccttaaatgtgatctagattt

SEQ ID NO: 7724096 - DNA, 22 bp, Homo sapiens
tccttaaatgtgatctagattt

SEQ ID NO: 7724097 - DNA, 22 bp, Homo sapiens
tccttaaatgtgatctagattt

SEQ ID NO: 7724098 - DNA, 22 bp, Homo sapiens
tccttaaatgtgatctagattt

SEQ ID NO: 7724099 - DNA, 22 bp, Homo sapiens
tccttaaatgaactctgcatga

SEQ ID NO: 7724100 - DNA, 22 bp, Homo sapiens
tccttaaatgaactctgcatga

SEQ ID NO: 7724101 - DNA, 22 bp, Homo sapiens
tccttaaatccttcagagatta

SEQ ID NO: 7724102 - DNA, 22 bp, Homo sapiens
tccttaaatccttcagagatta

SEQ ID NO: 7724103 - DNA, 22 bp, Homo sapiens
tccttaaatatttactgttaac

SEQ ID NO: 7724104 - DNA, 22 bp, Homo sapiens
tccttacaacttgttatttttc

SEQ ID NO: 7724105 - DNA, 22 bp, Homo sapiens
tccttacaacttgttatttttc

SEQ ID NO: 7724106 - DNA, 22 bp, Homo sapiens
tccttaatgtccagggcgttgg

SEQ ID NO: 7724107 - DNA, 22 bp, Homo sapiens
tccttaattctgtgcaatatgt

SEQ ID NO: 7724108 - DNA, 22 bp, Homo sapiens
tccttaagttctccaaggccag

SEQ ID NO: 7724109 - DNA, 22 bp, Homo sapiens
tccttaataagtacttcattgt

SEQ ID NO: 7724110 - DNA, 22 bp, Homo sapiens
tccttacactggggaaggtgta

SEQ ID NO: 7724111 - DNA, 22 bp, Homo sapiens
tccttaattggcttattggcat

SEQ ID NO: 7724112 - DNA, 22 bp, Homo sapiens
tccttacaacttgttatttttc

SEQ ID NO: 7724113 - DNA, 22 bp, Homo sapiens
tccttacaggttacagaaagca

SEQ ID NO: 7724114 - DNA, 22 bp, Homo sapiens
tccttacagaaagcagtagaca

SEQ ID NO: 7724115 - DNA, 22 bp, Homo sapiens
tccttaggcaatttgggagagt

SEQ ID NO: 7724116 - DNA, 22 bp, Homo sapiens
tccttaggcaatttgggagagt

SEQ ID NO: 7724117 - DNA, 22 bp, Homo sapiens
tccttaggcaatttgggagagt

SEQ ID NO: 7724118 - DNA, 22 bp, Homo sapiens
tccttaggcaatttgggagagt

SEQ ID NO: 7724119 - DNA, 22 bp, Homo sapiens
tccttagggatttttccagtca

SEQ ID NO: 7724120 - DNA, 22 bp, Homo sapiens
tccttaggtatttagcatgaat

SEQ ID NO: 7724121 - DNA, 22 bp, Homo sapiens
tccttaggtatttagcatgaat

SEQ ID NO: 7724122 - DNA, 22 bp, Homo sapiens
tccttaggaaaatgatgagggg

SEQ ID NO: 7724123 - DNA, 22 bp, Homo sapiens
tccttaggcaatttgggagagt

SEQ ID NO: 7724124 - DNA, 22 bp, Homo sapiens
tccttaggcaatttgggagagt

SEQ ID NO: 7724125 - DNA, 22 bp, Homo sapiens
tccttaggcaatttgggagagt

SEQ ID NO: 7724126 - DNA, 22 bp, Homo sapiens
tccttaggcaatttgggagagt

SEQ ID NO: 7724127 - DNA, 22 bp, Homo sapiens
tccttcaactttttacttgccc

SEQ ID NO: 7724128 - DNA, 22 bp, Homo sapiens
tccttcaactttttacttgccc

SEQ ID NO: 7724129 - DNA, 22 bp, Homo sapiens
tccttcaaagctcctagtgagc

SEQ ID NO: 7724130 - DNA, 22 bp, Homo sapiens
tccttcaaaagttgagagagcc

SEQ ID NO: 7724131 - DNA, 22 bp, Homo sapiens
tccttcaaaagttgagagagcc

SEQ ID NO: 7724132 - DNA, 21 bp, Homo sapiens
tccttatatttgaatacttta

SEQ ID NO: 7724133 - DNA, 22 bp, Homo sapiens
tccttcaactttttacttgccc

SEQ ID NO: 7724134 - DNA, 22 bp, Homo sapiens
tccttcaactttttacttgccc

SEQ ID NO: 7724135 - DNA, 22 bp, Homo sapiens
tccttcaactttttacttgccc

SEQ ID NO: 7724136 - DNA, 22 bp, Homo sapiens
tccttcaagatgccacagcttt

SEQ ID NO: 7724137 - DNA, 22 bp, Homo sapiens
tccttcaagatgccacagcttt

SEQ ID NO: 7724138 - DNA, 22 bp, Homo sapiens
tccttcaagatgccacagcttt

SEQ ID NO: 7724139 - DNA, 22 bp, Homo sapiens
tccttcaagatgccacagcttt

SEQ ID NO: 7724140 - DNA, 22 bp, Homo sapiens
tccttcaagatgccacagcttt

SEQ ID NO: 7724141 - DNA, 20 bp, Homo sapiens
tccttcaggcagggcctagt

SEQ ID NO: 7724142 - DNA, 22 bp, Homo sapiens
tccttcaggcctcattctcata

SEQ ID NO: 7724143 - DNA, 17 bp, Homo sapiens
tccttcagggcctcaca

SEQ ID NO: 7724144 - DNA, 23 bp, Homo sapiens
tccttcaggctcttcccctggac

SEQ ID NO: 7724145 - DNA, 22 bp, Homo sapiens
tccttcagggctgaccacaggc

SEQ ID NO: 7724146 - DNA, 22 bp, Homo sapiens
tccttcagggggccgcctgcac

SEQ ID NO: 7724147 - DNA, 22 bp, Homo sapiens
tccttcagggggccgcctgcac

SEQ ID NO: 7724148 - DNA, 22 bp, Homo sapiens
tccttcagggctgaccacaggc

SEQ ID NO: 7724149 - DNA, 22 bp, Homo sapiens
tccttcagctctctatttagat

SEQ ID NO: 7724150 - DNA, 22 bp, Homo sapiens
tccttcagctactcagtttcca

SEQ ID NO: 7724151 - DNA, 22 bp, Homo sapiens
tccttcagccatgggctctcca

SEQ ID NO: 7724152 - DNA, 22 bp, Homo sapiens
tccttcagccatgggctctcca

SEQ ID NO: 7724153 - DNA, 22 bp, Homo sapiens
tccttcagcctcccagctcaaa

SEQ ID NO: 7724154 - DNA, 22 bp, Homo sapiens
tccttcagcttgttagagtgac

SEQ ID NO: 7724155 - DNA, 22 bp, Homo sapiens
tccttcagcttatttcttagga

SEQ ID NO: 7724156 - DNA, 22 bp, Homo sapiens
tccttcagcttgttagagtgac

SEQ ID NO: 7724157 - DNA, 22 bp, Homo sapiens
tccttcagctgctaggaaatga

SEQ ID NO: 7724158 - DNA, 22 bp, Homo sapiens
tccttcagctactcagtttcca

SEQ ID NO: 7724159 - DNA, 22 bp, Homo sapiens
tccttcagctgctaggaaatga

SEQ ID NO: 7724160 - DNA, 22 bp, Homo sapiens
tccttcagcttatttcttagga

SEQ ID NO: 7724161 - DNA, 22 bp, Homo sapiens
tccttcagctctctatttagat

SEQ ID NO: 7724162 - DNA, 22 bp, Homo sapiens
tccttcaagtgcagtacctgag

SEQ ID NO: 7724163 - DNA, 22 bp, Homo sapiens
tccttcaagtgcagtacctgag

SEQ ID NO: 7724164 - DNA, 22 bp, Homo sapiens
tccttcaagtgcagtacctgag

SEQ ID NO: 7724165 - DNA, 23 bp, Homo sapiens
tccttcaagttaggaagtgaaca

SEQ ID NO: 7724166 - DNA, 23 bp, Homo sapiens
tccttcaagttaggaagtgaaca

SEQ ID NO: 7724167 - DNA, 18 bp, Homo sapiens
tccttcacagcaggaagg

SEQ ID NO: 7724168 - DNA, 18 bp, Homo sapiens
tccttcacagcaggaagg

SEQ ID NO: 7724169 - DNA, 18 bp, Homo sapiens
tccttcacagcaggaagg

SEQ ID NO: 7724170 - DNA, 18 bp, Homo sapiens
tccttcacagcaggaagg

SEQ ID NO: 7724171 - DNA, 22 bp, Homo sapiens
tccttcaatcacccagtgggga

SEQ ID NO: 7724172 - DNA, 19 bp, Homo sapiens
tccttcacttcttaccagg

SEQ ID NO: 7724173 - DNA, 22 bp, Homo sapiens
tccttcagaaaacctcagtctt

SEQ ID NO: 7724174 - DNA, 22 bp, Homo sapiens
tccttcagaaaacctcagtctt

SEQ ID NO: 7724175 - DNA, 22 bp, Homo sapiens
tccttcaccttagccctcctag

SEQ ID NO: 7724176 - DNA, 22 bp, Homo sapiens
tccttcacctcaagcttttgaa

SEQ ID NO: 7724177 - DNA, 22 bp, Homo sapiens
tccttcacctcaagcttttgaa

SEQ ID NO: 7724178 - DNA, 22 bp, Homo sapiens
tccttcaccttagccctcctag

SEQ ID NO: 7724179 - DNA, 22 bp, Homo sapiens
tccttcactccctctgcatcca

SEQ ID NO: 7724180 - DNA, 22 bp, Homo sapiens
tccttcaccttagccctcctag

SEQ ID NO: 7724181 - DNA, 22 bp, Homo sapiens
tccttcactccctctgcatcca

SEQ ID NO: 7724182 - DNA, 22 bp, Homo sapiens
tccttcactccctctgcatcca

SEQ ID NO: 7724183 - DNA, 22 bp, Homo sapiens
tccttcaccttagccctcctag

SEQ ID NO: 7724184 - DNA, 22 bp, Homo sapiens
tccttcagaggataaggaagaa

SEQ ID NO: 7724185 - DNA, 22 bp, Homo sapiens
tccttcagaggacggcagccag

SEQ ID NO: 7724186 - DNA, 22 bp, Homo sapiens
tccttcagaggataaggaagaa

SEQ ID NO: 7724187 - DNA, 22 bp, Homo sapiens
tccttcagattcctgcttctgg

SEQ ID NO: 7724188 - DNA, 22 bp, Homo sapiens
tccttcagattcctgcttctgg

SEQ ID NO: 7724189 - DNA, 23 bp, Homo sapiens
tccttcagagcctccctccaagc

SEQ ID NO: 7724190 - DNA, 22 bp, Homo sapiens
tccttcagaggacggcagccag

SEQ ID NO: 7724191 - DNA, 22 bp, Homo sapiens
tccttcagaggacggcagccag

SEQ ID NO: 7724192 - DNA, 20 bp, Homo sapiens
tccttcagacgacaagcaag

SEQ ID NO: 7724193 - DNA, 20 bp, Homo sapiens
tccttcagacgacaagcaag

SEQ ID NO: 7724194 - DNA, 22 bp, Homo sapiens
tccttcagaacctgtgatggaa

SEQ ID NO: 7724195 - DNA, 20 bp, Homo sapiens
tccttcagacgacaagcaag

SEQ ID NO: 7724196 - DNA, 20 bp, Homo sapiens
tccttcagacgacaagcaag

SEQ ID NO: 7724197 - DNA, 20 bp, Homo sapiens
tccttcagactttggagttg

SEQ ID NO: 7724198 - DNA, 22 bp, Homo sapiens
tccttgcatatctgaaaatgtt

SEQ ID NO: 7724199 - DNA, 22 bp, Homo sapiens
tccttgcagggtttgataaaga

SEQ ID NO: 7724200 - DNA, 22 bp, Homo sapiens
tccttgcatatctgaaaatgtt

SEQ ID NO: 7724201 - DNA, 22 bp, Homo sapiens
tccttgccctaaatgtctgtgt

SEQ ID NO: 7724202 - DNA, 21 bp, Homo sapiens
tccttgctattttcctcagct

SEQ ID NO: 7724203 - DNA, 21 bp, Homo sapiens
tccttgctattttcctcagct

SEQ ID NO: 7724204 - DNA, 22 bp, Homo sapiens
tccttgcaaatagctttctgag

SEQ ID NO: 7724205 - DNA, 22 bp, Homo sapiens
tccttgcaaatagctttctgag

SEQ ID NO: 7724206 - DNA, 22 bp, Homo sapiens
tccttgcacattatctgggaaa

SEQ ID NO: 7724207 - DNA, 22 bp, Homo sapiens
tccttgcagacatctctcttca

SEQ ID NO: 7724208 - DNA, 22 bp, Homo sapiens
tccttgcagcaggaacccactt

SEQ ID NO: 7724209 - DNA, 22 bp, Homo sapiens
tccttggaagagcattcccagg

SEQ ID NO: 7724210 - DNA, 22 bp, Homo sapiens
tccttggaacattgatccaaac

SEQ ID NO: 7724211 - DNA, 22 bp, Homo sapiens
tccttggaagagcattcccagg

SEQ ID NO: 7724212 - DNA, 22 bp, Homo sapiens
tccttggagcccaggagtagca

SEQ ID NO: 7724213 - DNA, 21 bp, Homo sapiens
tccttgctattttcctcagct

SEQ ID NO: 7724214 - DNA, 22 bp, Homo sapiens
tccttggaaatttcatcagaca

SEQ ID NO: 7724215 - DNA, 17 bp, Homo sapiens
tccttggcaaccagttc

SEQ ID NO: 7724216 - DNA, 17 bp, Homo sapiens
tccttggcaaccagttc

SEQ ID NO: 7724217 - DNA, 22 bp, Homo sapiens
tccttggcaagacacagcacag

SEQ ID NO: 7724218 - DNA, 22 bp, Homo sapiens
tccttggcaagctgcaatggga

SEQ ID NO: 7724219 - DNA, 22 bp, Homo sapiens
tccttggcaagctgcaatggga

SEQ ID NO: 7724220 - DNA, 22 bp, Homo sapiens
tccttggcaagacacagcacag

SEQ ID NO: 7724221 - DNA, 22 bp, Homo sapiens
tccttggcacactcggatctga

SEQ ID NO: 7724222 - DNA, 22 bp, Homo sapiens
tccttggcacactcggatctga

SEQ ID NO: 7724223 - DNA, 22 bp, Homo sapiens
tccttggcagcagggagcatga

SEQ ID NO: 7724224 - DNA, 22 bp, Homo sapiens
tccttggcatgccgtcttctcc

SEQ ID NO: 7724225 - DNA, 22 bp, Homo sapiens
tccttggagctctccaagggat

SEQ ID NO: 7724226 - DNA, 22 bp, Homo sapiens
tccttggagctctccaagggat

SEQ ID NO: 7724227 - DNA, 22 bp, Homo sapiens
tccttggaggtcaacgggacgg

SEQ ID NO: 7724228 - DNA, 22 bp, Homo sapiens
tccttggagtcatgatggaggt

SEQ ID NO: 7724229 - DNA, 22 bp, Homo sapiens
tccttggagtcatgatggaggt

SEQ ID NO: 7724230 - DNA, 22 bp, Homo sapiens
tccttgaggaggtgacactgga

SEQ ID NO: 7724231 - DNA, 22 bp, Homo sapiens
tccttgaggaggtgacactgga

SEQ ID NO: 7724232 - DNA, 22 bp, Homo sapiens
tccttgagcctcccagactcag

SEQ ID NO: 7724233 - DNA, 22 bp, Homo sapiens
tccttgaggaggtgacactgga

SEQ ID NO: 7724234 - DNA, 22 bp, Homo sapiens
tccttgaggaggtgacactgga

SEQ ID NO: 7724235 - DNA, 22 bp, Homo sapiens
tccttgagccgtggccagggcc

SEQ ID NO: 7724236 - DNA, 22 bp, Homo sapiens
tccttgagaggacagagccata

SEQ ID NO: 7724237 - DNA, 22 bp, Homo sapiens
tccttgagaggacagagccata

SEQ ID NO: 7724238 - DNA, 22 bp, Homo sapiens
tccttgagaggacagagccata

SEQ ID NO: 7724239 - DNA, 22 bp, Homo sapiens
tccttgagagccactgtcttgg

SEQ ID NO: 7724240 - DNA, 22 bp, Homo sapiens
tccttgactgtgaggaactagc

SEQ ID NO: 7724241 - DNA, 19 bp, Homo sapiens
tccttgactgtattcagag

SEQ ID NO: 7724242 - DNA, 19 bp, Homo sapiens
tccttgactgtattcagag

SEQ ID NO: 7724243 - DNA, 22 bp, Homo sapiens
tccttgaagcttgtatctaata

SEQ ID NO: 7724244 - DNA, 22 bp, Homo sapiens
tccttgaagcttgtatctaata

SEQ ID NO: 7724245 - DNA, 22 bp, Homo sapiens
tccttgaatcctagcatcctat

SEQ ID NO: 7724246 - DNA, 22 bp, Homo sapiens
tccttgaatgaagagaggtgac

SEQ ID NO: 7724247 - DNA, 22 bp, Homo sapiens
tccttgaaaatcttggtttaga

SEQ ID NO: 7724248 - DNA, 22 bp, Homo sapiens
tccttctttgacaagtggcaga

SEQ ID NO: 7724249 - DNA, 22 bp, Homo sapiens
tccttgaagaatgattcttgga

SEQ ID NO: 7724250 - DNA, 22 bp, Homo sapiens
tccttgaagcaacgtgcagaca

SEQ ID NO: 7724251 - DNA, 22 bp, Homo sapiens
tccttctttcacctcatagtca

SEQ ID NO: 7724252 - DNA, 22 bp, Homo sapiens
tccttctttcacctcatagtca

SEQ ID NO: 7724253 - DNA, 22 bp, Homo sapiens
tccttcttcatgaagatatatg

SEQ ID NO: 7724254 - DNA, 22 bp, Homo sapiens
tccttcttcatgaagatatatg

SEQ ID NO: 7724255 - DNA, 22 bp, Homo sapiens
tccttcttcatgaagatatatg

SEQ ID NO: 7724256 - DNA, 22 bp, Homo sapiens
tccttctttccccctagtcatt

SEQ ID NO: 7724257 - DNA, 22 bp, Homo sapiens
tccttctttcacctcatagtca

SEQ ID NO: 7724258 - DNA, 22 bp, Homo sapiens
tccttctggaggctctaagggg

SEQ ID NO: 7724259 - DNA, 20 bp, Homo sapiens
tccttctgaggtgaggagga

SEQ ID NO: 7724260 - DNA, 20 bp, Homo sapiens
tccttctgaggtgaggagga

SEQ ID NO: 7724261 - DNA, 20 bp, Homo sapiens
tccttctgaggtgaggagga

SEQ ID NO: 7724262 - DNA, 22 bp, Homo sapiens
tccttctgaaaaatgcacacga

SEQ ID NO: 7724263 - DNA, 22 bp, Homo sapiens
tccttctgaaaaatgcacacga

SEQ ID NO: 7724264 - DNA, 21 bp, Homo sapiens
tccttctctatgattgtctga

SEQ ID NO: 7724265 - DNA, 22 bp, Homo sapiens
tccttctgaaaaatgcacacga

SEQ ID NO: 7724266 - DNA, 22 bp, Homo sapiens
tccttctctggtttttactgta

SEQ ID NO: 7724267 - DNA, 22 bp, Homo sapiens
tccttctgtagtccctgtccct

SEQ ID NO: 7724268 - DNA, 22 bp, Homo sapiens
tccttctgtagtccctgtccct

SEQ ID NO: 7724269 - DNA, 22 bp, Homo sapiens
tccttctggaggctctaagggg

SEQ ID NO: 7724270 - DNA, 22 bp, Homo sapiens
tccttctggaggctgtaaagga

SEQ ID NO: 7724271 - DNA, 22 bp, Homo sapiens
tccttctgtagtccctgtccct

SEQ ID NO: 7724272 - DNA, 22 bp, Homo sapiens
tccttctgtagtccctgtccct

SEQ ID NO: 7724273 - DNA, 22 bp, Homo sapiens
tccttctgtagtccctgtccct

SEQ ID NO: 7724274 - DNA, 22 bp, Homo sapiens
tccttctgtagtccctgtccct

SEQ ID NO: 7724275 - DNA, 22 bp, Homo sapiens
tccttctcctccttgagtgaca

SEQ ID NO: 7724276 - DNA, 19 bp, Homo sapiens
tccttctccggccaccccg

SEQ ID NO: 7724277 - DNA, 22 bp, Homo sapiens
tccttctatttgtttatgtggc

SEQ ID NO: 7724278 - DNA, 19 bp, Homo sapiens
tccttctccggccaccccg

SEQ ID NO: 7724279 - DNA, 19 bp, Homo sapiens
tccttctccggccaccccg

SEQ ID NO: 7724280 - DNA, 21 bp, Homo sapiens
tccttctctatgattgtctga

SEQ ID NO: 7724281 - DNA, 21 bp, Homo sapiens
tccttctctatgattgtctga

SEQ ID NO: 7724282 - DNA, 22 bp, Homo sapiens
tccttctctggtttttactgta

SEQ ID NO: 7724283 - DNA, 22 bp, Homo sapiens
tccttctctacaaatccaggca

SEQ ID NO: 7724284 - DNA, 22 bp, Homo sapiens
tccttctcctccttgagtgaca

SEQ ID NO: 7724285 - DNA, 22 bp, Homo sapiens
tccttctcctccttgagtgaca

SEQ ID NO: 7724286 - DNA, 22 bp, Homo sapiens
tccttctacactgcctctgaga

SEQ ID NO: 7724287 - DNA, 22 bp, Homo sapiens
tccttctacactgcctctgaga

SEQ ID NO: 7724288 - DNA, 23 bp, Homo sapiens
tccttcctttgagaggctccatc

SEQ ID NO: 7724289 - DNA, 23 bp, Homo sapiens
tccttcctttgagaggctccatc

SEQ ID NO: 7724290 - DNA, 23 bp, Homo sapiens
tccttcctttgagaggctccatc

SEQ ID NO: 7724291 - DNA, 23 bp, Homo sapiens
tccttcctttgagaggctccatc

SEQ ID NO: 7724292 - DNA, 23 bp, Homo sapiens
tccttcctttgagaggctccatc

SEQ ID NO: 7724293 - DNA, 23 bp, Homo sapiens
tccttcctttgagaggctccatc

SEQ ID NO: 7724294 - DNA, 23 bp, Homo sapiens
tccttcctttgagaggctccatc

SEQ ID NO: 7724295 - DNA, 21 bp, Homo sapiens
tccttccttgaggtcctttcc

SEQ ID NO: 7724296 - DNA, 21 bp, Homo sapiens
tccttccttgaggtcctttcc

SEQ ID NO: 7724297 - DNA, 21 bp, Homo sapiens
tccttccttgaggtcctttcc

SEQ ID NO: 7724298 - DNA, 21 bp, Homo sapiens
tccttccttgaggtcctttcc

SEQ ID NO: 7724299 - DNA, 22 bp, Homo sapiens
tccttccttcctgaaattttag

SEQ ID NO: 7724300 - DNA, 22 bp, Homo sapiens
tccttccttcctgaaattttag

SEQ ID NO: 7724301 - DNA, 22 bp, Homo sapiens
tccttccttcctgaaattttag

SEQ ID NO: 7724302 - DNA, 21 bp, Homo sapiens
tccttccttgaggtcctttcc

SEQ ID NO: 7724303 - DNA, 22 bp, Homo sapiens
tccttccttcctgaaattttag

SEQ ID NO: 7724304 - DNA, 22 bp, Homo sapiens
tccttccttcctgaaattttag

SEQ ID NO: 7724305 - DNA, 22 bp, Homo sapiens
tccttccttcctgaaattttag

SEQ ID NO: 7724306 - DNA, 22 bp, Homo sapiens
tccttcctggggtctctgctgc

SEQ ID NO: 7724307 - DNA, 22 bp, Homo sapiens
tccttcctggggtctctgctgc

SEQ ID NO: 7724308 - DNA, 22 bp, Homo sapiens
tccttcagggttgaggccgact

SEQ ID NO: 7724309 - DNA, 22 bp, Homo sapiens
tccttcagggggccgcctgcac

SEQ ID NO: 7724310 - DNA, 22 bp, Homo sapiens
tccttcagggggccgcctgcac

SEQ ID NO: 7724311 - DNA, 19 bp, Homo sapiens
tccttcagtcagatctggg

SEQ ID NO: 7724312 - DNA, 19 bp, Homo sapiens
tccttcagtcagatctggg

SEQ ID NO: 7724313 - DNA, 19 bp, Homo sapiens
tccttcagtcagatctggg

SEQ ID NO: 7724314 - DNA, 22 bp, Homo sapiens
tccttcctggggtctctgctgc

SEQ ID NO: 7724315 - DNA, 22 bp, Homo sapiens
tccttcctggggtctctgctgc

SEQ ID NO: 7724316 - DNA, 22 bp, Homo sapiens
tccttcctggggtctctgctgc

SEQ ID NO: 7724317 - DNA, 22 bp, Homo sapiens
tccttcctggggtctctgctgc

SEQ ID NO: 7724318 - DNA, 21 bp, Homo sapiens
tccttcagtctagatgattgt

SEQ ID NO: 7724319 - DNA, 22 bp, Homo sapiens
tccttcctggggtctctgctgc

SEQ ID NO: 7724320 - DNA, 22 bp, Homo sapiens
tccttcctggggtctctgctgc

SEQ ID NO: 7724321 - DNA, 22 bp, Homo sapiens
tccttcctggggtctctgctgc

SEQ ID NO: 7724322 - DNA, 22 bp, Homo sapiens
tcctgggttaattatgattcac

SEQ ID NO: 7724323 - DNA, 22 bp, Homo sapiens
tcctgggttaattatgattcac

SEQ ID NO: 7724324 - DNA, 22 bp, Homo sapiens
tcctgggtgtgatattcataga

SEQ ID NO: 7724325 - DNA, 23 bp, Homo sapiens
tcctgggtttgaattctagtctt

SEQ ID NO: 7724326 - DNA, 22 bp, Homo sapiens
tcctgggttcatgtcctggtgc

SEQ ID NO: 7724327 - DNA, 23 bp, Homo sapiens
tcctgggtttgaattctagtctt

SEQ ID NO: 7724328 - DNA, 22 bp, Homo sapiens
tcctgggttaattatgattcac

SEQ ID NO: 7724329 - DNA, 22 bp, Homo sapiens
tcctgggttcatgtcctggtgc

SEQ ID NO: 7724330 - DNA, 22 bp, Homo sapiens
tcctgggttcatgtcctggtgc

SEQ ID NO: 7724331 - DNA, 22 bp, Homo sapiens
tcctgggttcatgtcctggtgc

SEQ ID NO: 7724332 - DNA, 22 bp, Homo sapiens
tcctggtggctttccctgcctt

SEQ ID NO: 7724333 - DNA, 22 bp, Homo sapiens
tcctggtggctctttgggaagg

SEQ ID NO: 7724334 - DNA, 22 bp, Homo sapiens
tcctggtggctctttgggaagg

SEQ ID NO: 7724335 - DNA, 22 bp, Homo sapiens
tcctggtcagctttgaggttgt

SEQ ID NO: 7724336 - DNA, 22 bp, Homo sapiens
tcctggtcagctttgaggttgt

SEQ ID NO: 7724337 - DNA, 22 bp, Homo sapiens
tcctggtcagctttgaggttgt

SEQ ID NO: 7724338 - DNA, 22 bp, Homo sapiens
tcctggtaggctatgtcatgtc

SEQ ID NO: 7724339 - DNA, 18 bp, Homo sapiens
tcctggtattgcaagcac

SEQ ID NO: 7724340 - DNA, 22 bp, Homo sapiens
tcctgggtgaaagaacaggcag

SEQ ID NO: 7724341 - DNA, 22 bp, Homo sapiens
tcctgggtggctctgcccggct

SEQ ID NO: 7724342 - DNA, 22 bp, Homo sapiens
tcctgggtggctctgcccggct

SEQ ID NO: 7724343 - DNA, 22 bp, Homo sapiens
tcctgggtggtggtaggagcag

SEQ ID NO: 7724344 - DNA, 22 bp, Homo sapiens
tcctgggtggtggtaggagcag

SEQ ID NO: 7724345 - DNA, 22 bp, Homo sapiens
tcctgggtggtggtaggagcag

SEQ ID NO: 7724346 - DNA, 22 bp, Homo sapiens
tcctgggtctgggtgtctgagg

SEQ ID NO: 7724347 - DNA, 22 bp, Homo sapiens
tcctgggtgaaagaacaggcag

SEQ ID NO: 7724348 - DNA, 22 bp, Homo sapiens
tcctgggtctgggtgtctgagg

SEQ ID NO: 7724349 - DNA, 22 bp, Homo sapiens
tcctgggtctgggtgtctgagg

SEQ ID NO: 7724350 - DNA, 22 bp, Homo sapiens
tcctgggtccatggcagccgaa

SEQ ID NO: 7724351 - DNA, 22 bp, Homo sapiens
tcctgggtcccgcacatctgtc

SEQ ID NO: 7724352 - DNA, 22 bp, Homo sapiens
tcctgggtctgggtgtctgagg

SEQ ID NO: 7724353 - DNA, 22 bp, Homo sapiens
tcctgggtctcttccttagttc

SEQ ID NO: 7724354 - DNA, 22 bp, Homo sapiens
tcctgggtctcttccttagttc

SEQ ID NO: 7724355 - DNA, 22 bp, Homo sapiens
tcctgggtcctgggaagccctg

SEQ ID NO: 7724356 - DNA, 22 bp, Homo sapiens
tcctgggtcccgcacatctgtc

SEQ ID NO: 7724357 - DNA, 22 bp, Homo sapiens
tcctgggtctcttccttagttc

SEQ ID NO: 7724358 - DNA, 22 bp, Homo sapiens
tcctgggtctcttccttagttc

SEQ ID NO: 7724359 - DNA, 22 bp, Homo sapiens
tcctggggttttggccgcagct

SEQ ID NO: 7724360 - DNA, 22 bp, Homo sapiens
tcctggggttttggccgcagct

SEQ ID NO: 7724361 - DNA, 22 bp, Homo sapiens
tcctggggttttggccgcagct

SEQ ID NO: 7724362 - DNA, 22 bp, Homo sapiens
tcctggggttttggccgcagct

SEQ ID NO: 7724363 - DNA, 22 bp, Homo sapiens
tcctggggttttggccgcagct

SEQ ID NO: 7724364 - DNA, 22 bp, Homo sapiens
tcctggggttttggccgcagct

SEQ ID NO: 7724365 - DNA, 22 bp, Homo sapiens
tcctggggttttggccgcagct

SEQ ID NO: 7724366 - DNA, 22 bp, Homo sapiens
tcctgggtaaacactgaccttt

SEQ ID NO: 7724367 - DNA, 22 bp, Homo sapiens
tcctgggtaaacactgaccttt

SEQ ID NO: 7724368 - DNA, 22 bp, Homo sapiens
tcctgggtaaacactgaccttt

SEQ ID NO: 7724369 - DNA, 22 bp, Homo sapiens
tcctgggtagagacctgatgaa

SEQ ID NO: 7724370 - DNA, 22 bp, Homo sapiens
tcctgggtagagacctgatgaa

SEQ ID NO: 7724371 - DNA, 22 bp, Homo sapiens
tcctgggtagagacctgatgaa

SEQ ID NO: 7724372 - DNA, 22 bp, Homo sapiens
tcctgggtagagacctgatgaa

SEQ ID NO: 7724373 - DNA, 22 bp, Homo sapiens
tcctgggtagagacctgatgaa

SEQ ID NO: 7724374 - DNA, 22 bp, Homo sapiens
tcctgggtagcctgtccaagat

SEQ ID NO: 7724375 - DNA, 22 bp, Homo sapiens
tcctgggtagcctgtccaagat

SEQ ID NO: 7724376 - DNA, 22 bp, Homo sapiens
tcctgggtagcctgtccaagat

SEQ ID NO: 7724377 - DNA, 22 bp, Homo sapiens
tcctggggtgtgttttgctgct

SEQ ID NO: 7724378 - DNA, 22 bp, Homo sapiens
tcctggggtgtgttttgctgct

SEQ ID NO: 7724379 - DNA, 22 bp, Homo sapiens
tcctggggtgtgttttgctgct

SEQ ID NO: 7724380 - DNA, 22 bp, Homo sapiens
tcctggggtcctgactgcttcc

SEQ ID NO: 7724381 - DNA, 22 bp, Homo sapiens
tcctggggtcctgactgcttcc

SEQ ID NO: 7724382 - DNA, 20 bp, Homo sapiens
tcctggggtaagccatggtc

SEQ ID NO: 7724383 - DNA, 20 bp, Homo sapiens
tcctggggtaagccatggtc

SEQ ID NO: 7724384 - DNA, 22 bp, Homo sapiens
tcctggggtcctgactgcttcc

SEQ ID NO: 7724385 - DNA, 22 bp, Homo sapiens
tcctggggtcctgactgcttcc

SEQ ID NO: 7724386 - DNA, 22 bp, Homo sapiens
tcctggggtcctgactgcttcc

SEQ ID NO: 7724387 - DNA, 22 bp, Homo sapiens
tcctggggtgtgttttgctgct

SEQ ID NO: 7724388 - DNA, 22 bp, Homo sapiens
tcctggggtgtgttttgctgct

SEQ ID NO: 7724389 - DNA, 22 bp, Homo sapiens
tcctggggtttagagggaagtg

SEQ ID NO: 7724390 - DNA, 22 bp, Homo sapiens
tcctggggtttagagggaagtg

SEQ ID NO: 7724391 - DNA, 22 bp, Homo sapiens
tcctggggtttagagggaagtg

SEQ ID NO: 7724392 - DNA, 22 bp, Homo sapiens
tcctggggtttagagggaagtg

SEQ ID NO: 7724393 - DNA, 22 bp, Homo sapiens
tcctggggtttagagggaagtg

SEQ ID NO: 7724394 - DNA, 22 bp, Homo sapiens
tcctggggccagcactggtgga

SEQ ID NO: 7724395 - DNA, 22 bp, Homo sapiens
tcctggggccaggcacctctgg

SEQ ID NO: 7724396 - DNA, 22 bp, Homo sapiens
tcctggggccaggcacctctgg

SEQ ID NO: 7724397 - DNA, 22 bp, Homo sapiens
tcctggggccagcactggtgga

SEQ ID NO: 7724398 - DNA, 22 bp, Homo sapiens
tcctggggccagcactggtgga

SEQ ID NO: 7724399 - DNA, 22 bp, Homo sapiens
tcctggggccagcactggtgga

SEQ ID NO: 7724400 - DNA, 22 bp, Homo sapiens
tcctggggccagcactggtgga

SEQ ID NO: 7724401 - DNA, 22 bp, Homo sapiens
tcctggggccagcactggtgga

SEQ ID NO: 7724402 - DNA, 22 bp, Homo sapiens
tcctggggctcatgggatttgt

SEQ ID NO: 7724403 - DNA, 22 bp, Homo sapiens
tcctggggctcatgggatttgt

SEQ ID NO: 7724404 - DNA, 22 bp, Homo sapiens
tcctggggccaggcacctctgg

SEQ ID NO: 7724405 - DNA, 22 bp, Homo sapiens
tcctggggccaggcacctctgg

SEQ ID NO: 7724406 - DNA, 22 bp, Homo sapiens
tcctggggctctgagcgagaca

SEQ ID NO: 7724407 - DNA, 22 bp, Homo sapiens
tcctggggctctgagcgagaca

SEQ ID NO: 7724408 - DNA, 22 bp, Homo sapiens
tcctggggctcatgggatttgt

SEQ ID NO: 7724409 - DNA, 22 bp, Homo sapiens
tcctggggctcatgggatttgt

SEQ ID NO: 7724410 - DNA, 19 bp, Homo sapiens
tcctggggatgtggtcacc

SEQ ID NO: 7724411 - DNA, 19 bp, Homo sapiens
tcctggggatgtggtcacc

SEQ ID NO: 7724412 - DNA, 22 bp, Homo sapiens
tcctggggccagcactggtgga

SEQ ID NO: 7724413 - DNA, 22 bp, Homo sapiens
tcctggggccagcactggtgga

SEQ ID NO: 7724414 - DNA, 22 bp, Homo sapiens
tcctggggccagcactggtgga

SEQ ID NO: 7724415 - DNA, 19 bp, Homo sapiens
tcctggggatgtggtcacc

SEQ ID NO: 7724416 - DNA, 19 bp, Homo sapiens
tcctggggatgtggtcacc

SEQ ID NO: 7724417 - DNA, 16 bp, Homo sapiens
tcctggggatactgga

SEQ ID NO: 7724418 - DNA, 22 bp, Homo sapiens
tcctggggaggtcgaggctgag

SEQ ID NO: 7724419 - DNA, 22 bp, Homo sapiens
tcctggggaggtcgaggctgag

SEQ ID NO: 7724420 - DNA, 22 bp, Homo sapiens
tcctggggaggtcgaggctgag

SEQ ID NO: 7724421 - DNA, 19 bp, Homo sapiens
tcctggggatgtggtcacc

SEQ ID NO: 7724422 - DNA, 19 bp, Homo sapiens
tcctggggatgtggtcacc

SEQ ID NO: 7724423 - DNA, 19 bp, Homo sapiens
tcctggggatgtggtcacc

SEQ ID NO: 7724424 - DNA, 19 bp, Homo sapiens
tcctggggatgtggtcacc

SEQ ID NO: 7724425 - DNA, 16 bp, Homo sapiens
tcctggggatactgga

SEQ ID NO: 7724426 - DNA, 16 bp, Homo sapiens
tcctggggatactgga

SEQ ID NO: 7724427 - DNA, 22 bp, Homo sapiens
tcctggggctctgagcgagaca

SEQ ID NO: 7724428 - DNA, 22 bp, Homo sapiens
tcctggggctctgagcgagaca

SEQ ID NO: 7724429 - DNA, 22 bp, Homo sapiens
tcctggggctctgagcgagaca

SEQ ID NO: 7724430 - DNA, 22 bp, Homo sapiens
tcctggggctctttgatgtgat

SEQ ID NO: 7724431 - DNA, 22 bp, Homo sapiens
tcctggggctctttgatgtgat

SEQ ID NO: 7724432 - DNA, 22 bp, Homo sapiens
tcctggggctctttgatgtgat

SEQ ID NO: 7724433 - DNA, 22 bp, Homo sapiens
tcctggggctctttgatgtgat

SEQ ID NO: 7724434 - DNA, 22 bp, Homo sapiens
tcctggggctgcaaggcctgtc

SEQ ID NO: 7724435 - DNA, 22 bp, Homo sapiens
tcctggggctgcaaggcctgtc

SEQ ID NO: 7724436 - DNA, 22 bp, Homo sapiens
tcctggggctgcaaggcctgtc

SEQ ID NO: 7724437 - DNA, 22 bp, Homo sapiens
tcctggggctgcaaggcctgtc

SEQ ID NO: 7724438 - DNA, 22 bp, Homo sapiens
tcctggggctgcaaggcctgtc

SEQ ID NO: 7724439 - DNA, 22 bp, Homo sapiens
tcctggggctgcaaggcctgtc

SEQ ID NO: 7724440 - DNA, 22 bp, Homo sapiens
tcctggggctgcaaggcctgtc

SEQ ID NO: 7724441 - DNA, 22 bp, Homo sapiens
tcctggggctgcaaggcctgtc

SEQ ID NO: 7724442 - DNA, 22 bp, Homo sapiens
tcctggggctgcaaggcctgtc

SEQ ID NO: 7724443 - DNA, 21 bp, Homo sapiens
tcctggggggtaggtgagttt

SEQ ID NO: 7724444 - DNA, 20 bp, Homo sapiens
tcctggggtaagccatggtc

SEQ ID NO: 7724445 - DNA, 20 bp, Homo sapiens
tcctggggtaagccatggtc

SEQ ID NO: 7724446 - DNA, 20 bp, Homo sapiens
tcctggggtaagccatggtc

SEQ ID NO: 7724447 - DNA, 20 bp, Homo sapiens
tcctggggtaagccatggtc

SEQ ID NO: 7724448 - DNA, 20 bp, Homo sapiens
tcctggggtaagccatggtc

SEQ ID NO: 7724449 - DNA, 21 bp, Homo sapiens
tcctggggggtaggtgagttt

SEQ ID NO: 7724450 - DNA, 21 bp, Homo sapiens
tcctggggggtaggtgagttt

SEQ ID NO: 7724451 - DNA, 22 bp, Homo sapiens
tcctggggctgcaaggcctgtc

SEQ ID NO: 7724452 - DNA, 22 bp, Homo sapiens
tcctggggctgcaaggcctgtc

SEQ ID NO: 7724453 - DNA, 21 bp, Homo sapiens
tcctggggggtaggtgagttt

SEQ ID NO: 7724454 - DNA, 21 bp, Homo sapiens
tcctggggggtaggtgagttt

SEQ ID NO: 7724455 - DNA, 21 bp, Homo sapiens
tcctggggggtaggtgagttt

SEQ ID NO: 7724456 - DNA, 21 bp, Homo sapiens
tcctggggggtaggtgagttt

SEQ ID NO: 7724457 - DNA, 22 bp, Homo sapiens
tcctggttttcctgggacaggg

SEQ ID NO: 7724458 - DNA, 21 bp, Homo sapiens
tcctgtaagcttgggtggctc

SEQ ID NO: 7724459 - DNA, 21 bp, Homo sapiens
tcctgtaagcttgggtggctc

SEQ ID NO: 7724460 - DNA, 22 bp, Homo sapiens
tcctggttcctaccttcagctg

SEQ ID NO: 7724461 - DNA, 22 bp, Homo sapiens
tcctggttttcctgggacaggg

SEQ ID NO: 7724462 - DNA, 21 bp, Homo sapiens
tcctgtaagcttgggtggctc

SEQ ID NO: 7724463 - DNA, 22 bp, Homo sapiens
tcctggtttatagactgatggc

SEQ ID NO: 7724464 - DNA, 22 bp, Homo sapiens
tcctggtttatagcttagggaa

SEQ ID NO: 7724465 - DNA, 22 bp, Homo sapiens
tcctggtttatagactgatggc

SEQ ID NO: 7724466 - DNA, 22 bp, Homo sapiens
tcctggttcttgaggagccatg

SEQ ID NO: 7724467 - DNA, 18 bp, Homo sapiens
tcctggttctgtggccac

SEQ ID NO: 7724468 - DNA, 18 bp, Homo sapiens
tcctggttctgtggccac

SEQ ID NO: 7724469 - DNA, 22 bp, Homo sapiens
tcctggttgttgttatagtata

SEQ ID NO: 7724470 - DNA, 22 bp, Homo sapiens
tcctggtttacagagtaaacca

SEQ ID NO: 7724471 - DNA, 22 bp, Homo sapiens
tcctggtttatagactgatggc

SEQ ID NO: 7724472 - DNA, 22 bp, Homo sapiens
tcctgtatttgttcatctgtac

SEQ ID NO: 7724473 - DNA, 22 bp, Homo sapiens
tcctgtatcctgatacaataag

SEQ ID NO: 7724474 - DNA, 22 bp, Homo sapiens
tcctgtcagtgaggcagatgaa

SEQ ID NO: 7724475 - DNA, 21 bp, Homo sapiens
tcctgtaagcttgggtggctc

SEQ ID NO: 7724476 - DNA, 22 bp, Homo sapiens
tcctgtagttgctaagtttgtt

SEQ ID NO: 7724477 - DNA, 21 bp, Homo sapiens
tcctgtaagcttgggtggctc

SEQ ID NO: 7724478 - DNA, 21 bp, Homo sapiens
tcctgtaagcttgggtggctc

SEQ ID NO: 7724479 - DNA, 22 bp, Homo sapiens
tcctgtcctgaggctccaggcc

SEQ ID NO: 7724480 - DNA, 22 bp, Homo sapiens
tcctgtcctctgggtgccccat

SEQ ID NO: 7724481 - DNA, 20 bp, Homo sapiens
tcctgtccgcgccttgcgtc

SEQ ID NO: 7724482 - DNA, 20 bp, Homo sapiens
tcctgtccgcgccttgcgtc

SEQ ID NO: 7724483 - DNA, 22 bp, Homo sapiens
tcctgtccacagccctgacctc

SEQ ID NO: 7724484 - DNA, 22 bp, Homo sapiens
tcctgtccacagccctgacctc

SEQ ID NO: 7724485 - DNA, 22 bp, Homo sapiens
tcctgtcagtgaggcagatgaa

SEQ ID NO: 7724486 - DNA, 22 bp, Homo sapiens
tcctgtctaaagacctgcaggc

SEQ ID NO: 7724487 - DNA, 22 bp, Homo sapiens
tcctgtctaaagacctgcaggc

SEQ ID NO: 7724488 - DNA, 22 bp, Homo sapiens
tcctgtctaaagacctgcaggc

SEQ ID NO: 7724489 - DNA, 22 bp, Homo sapiens
tcctgtctaaagacctgcaggc

SEQ ID NO: 7724490 - DNA, 22 bp, Homo sapiens
tcctgtcctgaggctccaggcc

SEQ ID NO: 7724491 - DNA, 22 bp, Homo sapiens
tcctgtcctgaggctccaggcc

SEQ ID NO: 7724492 - DNA, 22 bp, Homo sapiens
tcctgtcctgaggctccaggcc

SEQ ID NO: 7724493 - DNA, 22 bp, Homo sapiens
tcctgtctaaagacctgcaggc

SEQ ID NO: 7724494 - DNA, 22 bp, Homo sapiens
tcctggtggtctgtgcttcttc

SEQ ID NO: 7724495 - DNA, 22 bp, Homo sapiens
tcctggtggtctgtgcttcttc

SEQ ID NO: 7724496 - DNA, 22 bp, Homo sapiens
tcctggtggtctgtgcttcttc

SEQ ID NO: 7724497 - DNA, 22 bp, Homo sapiens
tcctggtgggacagaaaacctc

SEQ ID NO: 7724498 - DNA, 22 bp, Homo sapiens
tcctggtggtgccagctgcagg

SEQ ID NO: 7724499 - DNA, 22 bp, Homo sapiens
tcctggtggtgccagctgcagg

SEQ ID NO: 7724500 - DNA, 22 bp, Homo sapiens
tcctggtggtctgtgcttcttc

SEQ ID NO: 7724501 - DNA, 22 bp, Homo sapiens
tcctggtggtgccggtgcccgg

SEQ ID NO: 7724502 - DNA, 22 bp, Homo sapiens
tcctggtggtgccggtgcccgg

SEQ ID NO: 7724503 - DNA, 22 bp, Homo sapiens
tcctggtggtgccggtgcccgg

SEQ ID NO: 7724504 - DNA, 22 bp, Homo sapiens
tcctggtgtaatggtaagcatg

SEQ ID NO: 7724505 - DNA, 22 bp, Homo sapiens
tcctggtggtttgaaaactgaa

SEQ ID NO: 7724506 - DNA, 22 bp, Homo sapiens
tcctggtgtaatggtaagcatg

SEQ ID NO: 7724507 - DNA, 22 bp, Homo sapiens
tcctggtgtcgcctggtcagtt

SEQ ID NO: 7724508 - DNA, 22 bp, Homo sapiens
tcctggtggtttgaaaactgaa

SEQ ID NO: 7724509 - DNA, 22 bp, Homo sapiens
tcctggtgtcctggtctgctag

SEQ ID NO: 7724510 - DNA, 22 bp, Homo sapiens
tcctggtgtcctggtctgctag

SEQ ID NO: 7724511 - DNA, 22 bp, Homo sapiens
tcctggtgtaatggtaagcatg

SEQ ID NO: 7724512 - DNA, 22 bp, Homo sapiens
tcctggtgtcctggtctgctag

SEQ ID NO: 7724513 - DNA, 22 bp, Homo sapiens
tcctggtgtcctggtctgctag

SEQ ID NO: 7724514 - DNA, 22 bp, Homo sapiens
tcctggtgtcgcctggtcagtt

SEQ ID NO: 7724515 - DNA, 22 bp, Homo sapiens
tcctggtgtcgcctggtcagtt

SEQ ID NO: 7724516 - DNA, 22 bp, Homo sapiens
tcctggtgtcgcctggtcagtt

SEQ ID NO: 7724517 - DNA, 22 bp, Homo sapiens
tcctggtgtcgcctggtcagtt

SEQ ID NO: 7724518 - DNA, 22 bp, Homo sapiens
tcctggtgttactaaattgaaa

SEQ ID NO: 7724519 - DNA, 22 bp, Homo sapiens
tcctggtgtttatgtcacatag

SEQ ID NO: 7724520 - DNA, 22 bp, Homo sapiens
tcctggttctggaatgtttaag

SEQ ID NO: 7724521 - DNA, 22 bp, Homo sapiens
tcctggttcctaccttcagctg

SEQ ID NO: 7724522 - DNA, 22 bp, Homo sapiens
tcctggttcctaccttcagctg

SEQ ID NO: 7724523 - DNA, 22 bp, Homo sapiens
tcctggttagagctctctgggg

SEQ ID NO: 7724524 - DNA, 22 bp, Homo sapiens
tcctggttagagctctctgggg

SEQ ID NO: 7724525 - DNA, 22 bp, Homo sapiens
tcctggttaccaagcagctctc

SEQ ID NO: 7724526 - DNA, 22 bp, Homo sapiens
tcctggttaccaagcagctctc

SEQ ID NO: 7724527 - DNA, 22 bp, Homo sapiens
tcctgtgaccagcttccatgct

SEQ ID NO: 7724528 - DNA, 22 bp, Homo sapiens
tcctgtgacggagcgccagagg

SEQ ID NO: 7724529 - DNA, 22 bp, Homo sapiens
tcctgtgaagaatagcactcaa

SEQ ID NO: 7724530 - DNA, 22 bp, Homo sapiens
tcctgtgaagaatagcactcaa

SEQ ID NO: 7724531 - DNA, 22 bp, Homo sapiens
tcctgtcttaatgatctcgtgc

SEQ ID NO: 7724532 - DNA, 22 bp, Homo sapiens
tcctgtgcctccacctgctccg

SEQ ID NO: 7724533 - DNA, 22 bp, Homo sapiens
tcctgtgccatctctagagact

SEQ ID NO: 7724534 - DNA, 22 bp, Homo sapiens
tcctgtgccatctctagagact

SEQ ID NO: 7724535 - DNA, 22 bp, Homo sapiens
tcctgtgccatctctagagact

SEQ ID NO: 7724536 - DNA, 21 bp, Homo sapiens
tcctgtgaggacctgtcagtg

SEQ ID NO: 7724537 - DNA, 22 bp, Homo sapiens
tcctgtgatggcttgcgatgtg

SEQ ID NO: 7724538 - DNA, 22 bp, Homo sapiens
tcctgtgcaggctggttgtaga

SEQ ID NO: 7724539 - DNA, 22 bp, Homo sapiens
tcctgtctcagtgtatttgcag

SEQ ID NO: 7724540 - DNA, 22 bp, Homo sapiens
tcctgtctcagtgtatttgcag

SEQ ID NO: 7724541 - DNA, 22 bp, Homo sapiens
tcctgtctaaagacctgcaggc

SEQ ID NO: 7724542 - DNA, 22 bp, Homo sapiens
tcctgtctaaagacctgcaggc

SEQ ID NO: 7724543 - DNA, 22 bp, Homo sapiens
tcctgtctgctcacagagctgg

SEQ ID NO: 7724544 - DNA, 22 bp, Homo sapiens
tcctgtctgctcacagagctgg

SEQ ID NO: 7724545 - DNA, 22 bp, Homo sapiens
tcctgtctcagtgtatttgcag

SEQ ID NO: 7724546 - DNA, 22 bp, Homo sapiens
tcctgtctgctcacagagctgg

SEQ ID NO: 7724547 - DNA, 22 bp, Homo sapiens
tcctgtctgctcacagagctgg

SEQ ID NO: 7724548 - DNA, 22 bp, Homo sapiens
tcctgtctgctcacagagctgg

SEQ ID NO: 7724549 - DNA, 22 bp, Homo sapiens
tcctgtcttaatgatctcgtgc

SEQ ID NO: 7724550 - DNA, 22 bp, Homo sapiens
tcctgtctgtctttggtccctt

SEQ ID NO: 7724551 - DNA, 22 bp, Homo sapiens
tcctgtctgtctttggtccctt

SEQ ID NO: 7724552 - DNA, 22 bp, Homo sapiens
tcctgtctgtctttggtccctt

SEQ ID NO: 7724553 - DNA, 22 bp, Homo sapiens
tcctgtctgctcacagagctgg

SEQ ID NO: 7724554 - DNA, 22 bp, Homo sapiens
tcctgtctgtctttggtccctt

SEQ ID NO: 7724555 - DNA, 22 bp, Homo sapiens
tcctgtctgctcacagagctgg

SEQ ID NO: 7724556 - DNA, 22 bp, Homo sapiens
tccttaaatatttactgttaac

SEQ ID NO: 7724557 - DNA, 22 bp, Homo sapiens
tcctgtggtatgggagtgatgt

SEQ ID NO: 7724558 - DNA, 22 bp, Homo sapiens
tcctgtggtcagacattgccaa

SEQ ID NO: 7724559 - DNA, 22 bp, Homo sapiens
tcctgtggtcagacattgccaa

SEQ ID NO: 7724560 - DNA, 22 bp, Homo sapiens
tcctgtggtatgggagtgatgt

SEQ ID NO: 7724561 - DNA, 22 bp, Homo sapiens
tcctgtggtatgggagtgatgt

SEQ ID NO: 7724562 - DNA, 17 bp, Homo sapiens
tcctgtgggtgcagcag

SEQ ID NO: 7724563 - DNA, 17 bp, Homo sapiens
tcctgtgggtgcagcag

SEQ ID NO: 7724564 - DNA, 22 bp, Homo sapiens
tcctgtggcgttatcatgtgat

SEQ ID NO: 7724565 - DNA, 22 bp, Homo sapiens
tcctgtggcgttatcatgtgat

SEQ ID NO: 7724566 - DNA, 22 bp, Homo sapiens
tcctgtggctctgtggaacctt

SEQ ID NO: 7724567 - DNA, 22 bp, Homo sapiens
tcctgtggcttccacgacctaa

SEQ ID NO: 7724568 - DNA, 22 bp, Homo sapiens
tcctgtgggctctcggcctcca

SEQ ID NO: 7724569 - DNA, 22 bp, Homo sapiens
tcctgtggctctgtggaacctt

SEQ ID NO: 7724570 - DNA, 22 bp, Homo sapiens
tcctgtgggctctcggcctcca

SEQ ID NO: 7724571 - DNA, 22 bp, Homo sapiens
tcctgtggggaaaagcctatct

SEQ ID NO: 7724572 - DNA, 22 bp, Homo sapiens
tcctgtggggaaaagcctatct

SEQ ID NO: 7724573 - DNA, 22 bp, Homo sapiens
tcctgtggggaaaagcctatct

SEQ ID NO: 7724574 - DNA, 22 bp, Homo sapiens
tcctgtgctgttaatagtgata

SEQ ID NO: 7724575 - DNA, 22 bp, Homo sapiens
tcctgtgctgttaatagtgata

SEQ ID NO: 7724576 - DNA, 22 bp, Homo sapiens
tcctgtgctttggaggatgttc

SEQ ID NO: 7724577 - DNA, 22 bp, Homo sapiens
tcctgtggaagacagtgttggg

SEQ ID NO: 7724578 - DNA, 20 bp, Homo sapiens
tcctgtggacattgctggcc

SEQ ID NO: 7724579 - DNA, 22 bp, Homo sapiens
tcctgtggaagacagtgttggg

SEQ ID NO: 7724580 - DNA, 20 bp, Homo sapiens
tcctgtggacattgctggcc

SEQ ID NO: 7724581 - DNA, 20 bp, Homo sapiens
tcctgtggacattgctggcc

SEQ ID NO: 7724582 - DNA, 22 bp, Homo sapiens
tcctgtgctttggatgcttaga

SEQ ID NO: 7724583 - DNA, 22 bp, Homo sapiens
tcctgtggagaggactggaggt

SEQ ID NO: 7724584 - DNA, 22 bp, Homo sapiens
tcctgtggagaggactggaggt

SEQ ID NO: 7724585 - DNA, 22 bp, Homo sapiens
tcctgtggcgttatcatgtgat

SEQ ID NO: 7724586 - DNA, 22 bp, Homo sapiens
tcctgtggcgttatcatgtgat

SEQ ID NO: 7724587 - DNA, 22 bp, Homo sapiens
tcctgtggcgttatcatgtgat

SEQ ID NO: 7724588 - DNA, 18 bp, Homo sapiens
tcctgtggcccagagttt

SEQ ID NO: 7724589 - DNA, 22 bp, Homo sapiens
tcctgtggagaggactggaggt

SEQ ID NO: 7724590 - DNA, 22 bp, Homo sapiens
tcctggggaggtcgaggctgag

SEQ ID NO: 7724591 - DNA, 22 bp, Homo sapiens
tcctggggaggtcgaggctgag

SEQ ID NO: 7724592 - DNA, 22 bp, Homo sapiens
tcctggggaggtcgaggctgag

SEQ ID NO: 7724593 - DNA, 22 bp, Homo sapiens
tcctggggaggtcgaggctgag

SEQ ID NO: 7724594 - DNA, 22 bp, Homo sapiens
tcctggggaggtcgaggctgag

SEQ ID NO: 7724595 - DNA, 22 bp, Homo sapiens
tcctggggaggtcgaggctgag

SEQ ID NO: 7724596 - DNA, 22 bp, Homo sapiens
tcctggggaggtcgaggctgag

SEQ ID NO: 7724597 - DNA, 22 bp, Homo sapiens
tcctgggctgtggccccgggca

SEQ ID NO: 7724598 - DNA, 22 bp, Homo sapiens
tcctgggctgtggccccgggca

SEQ ID NO: 7724599 - DNA, 22 bp, Homo sapiens
tcctgggctgtgtgccactctg

SEQ ID NO: 7724600 - DNA, 19 bp, Homo sapiens
tcctgggctgggccaggtc

SEQ ID NO: 7724601 - DNA, 19 bp, Homo sapiens
tcctgggctgggccaggtc

SEQ ID NO: 7724602 - DNA, 19 bp, Homo sapiens
tcctgggctgcgtcttgcc

SEQ ID NO: 7724603 - DNA, 19 bp, Homo sapiens
tcctgggctgcgtcttgcc

SEQ ID NO: 7724604 - DNA, 19 bp, Homo sapiens
tcctgggctgggccaggtc

SEQ ID NO: 7724605 - DNA, 19 bp, Homo sapiens
tcctgggctgggccaggtc

SEQ ID NO: 7724606 - DNA, 19 bp, Homo sapiens
tcctgggctgggccaggtc

SEQ ID NO: 7724607 - DNA, 19 bp, Homo sapiens
tcctgggctgggccaggtc

SEQ ID NO: 7724608 - DNA, 19 bp, Homo sapiens
tcctgggctgggccaggtc

SEQ ID NO: 7724609 - DNA, 19 bp, Homo sapiens
tcctgggcgttgactttgg

SEQ ID NO: 7724610 - DNA, 19 bp, Homo sapiens
tcctgggcgttgactttgg

SEQ ID NO: 7724611 - DNA, 22 bp, Homo sapiens
tcctgggctgcagggaagagca

SEQ ID NO: 7724612 - DNA, 22 bp, Homo sapiens
tcctgggctgcagggaagagca

SEQ ID NO: 7724613 - DNA, 22 bp, Homo sapiens
tcctgggcggttatgtgatctg

SEQ ID NO: 7724614 - DNA, 22 bp, Homo sapiens
tcctgggcgattttctgaatat

SEQ ID NO: 7724615 - DNA, 22 bp, Homo sapiens
tcctgggcagcgggacgctcag

SEQ ID NO: 7724616 - DNA, 22 bp, Homo sapiens
tcctgggcagcgggacgctcag

SEQ ID NO: 7724617 - DNA, 22 bp, Homo sapiens
tcctgggcagcgggacgctcag

SEQ ID NO: 7724618 - DNA, 22 bp, Homo sapiens
tcctgggcagcgggacgctcag

SEQ ID NO: 7724619 - DNA, 22 bp, Homo sapiens
tcctgggcagcgggacgctcag

SEQ ID NO: 7724620 - DNA, 22 bp, Homo sapiens
tcctgggccaagggctgtgagg

SEQ ID NO: 7724621 - DNA, 22 bp, Homo sapiens
tcctgggccaagggctgtgagg

SEQ ID NO: 7724622 - DNA, 22 bp, Homo sapiens
tcctgggcccaggctgccaggg

SEQ ID NO: 7724623 - DNA, 22 bp, Homo sapiens
tcctgggcccaggctgccaggg

SEQ ID NO: 7724624 - DNA, 22 bp, Homo sapiens
tcctgggcccaggctgccaggg

SEQ ID NO: 7724625 - DNA, 22 bp, Homo sapiens
tcctgggcccaggctgccaggg

SEQ ID NO: 7724626 - DNA, 22 bp, Homo sapiens
tcctgggcccaggctgccaggg

SEQ ID NO: 7724627 - DNA, 22 bp, Homo sapiens
tcctgggcccaggctgccaggg

SEQ ID NO: 7724628 - DNA, 22 bp, Homo sapiens
tcctgggcccaggctgccaggg

SEQ ID NO: 7724629 - DNA, 22 bp, Homo sapiens
tcctgggcccaggctgccaggg

SEQ ID NO: 7724630 - DNA, 22 bp, Homo sapiens
tcctgggcccaggctgccaggg

SEQ ID NO: 7724631 - DNA, 22 bp, Homo sapiens
tcctgggcccaggctgccaggg

SEQ ID NO: 7724632 - DNA, 22 bp, Homo sapiens
tcctgggcgagtggtggtacac

SEQ ID NO: 7724633 - DNA, 22 bp, Homo sapiens
tcctgggcgaggtactggggct

SEQ ID NO: 7724634 - DNA, 22 bp, Homo sapiens
tcctgggcgaggtactggggct

SEQ ID NO: 7724635 - DNA, 22 bp, Homo sapiens
tcctgggcgaggtactggggct

SEQ ID NO: 7724636 - DNA, 22 bp, Homo sapiens
tcctgggcccaggctgccaggg

SEQ ID NO: 7724637 - DNA, 22 bp, Homo sapiens
tcctgggccctccggatcaggt

SEQ ID NO: 7724638 - DNA, 22 bp, Homo sapiens
tcctgggccctccggatcaggt

SEQ ID NO: 7724639 - DNA, 22 bp, Homo sapiens
tcctgggccctccggatcaggt

SEQ ID NO: 7724640 - DNA, 22 bp, Homo sapiens
tcctgggcctgtactccatccg

SEQ ID NO: 7724641 - DNA, 22 bp, Homo sapiens
tcctgggcctgtactccatccg

SEQ ID NO: 7724642 - DNA, 22 bp, Homo sapiens
tcctgggcctgtactccatccg

SEQ ID NO: 7724643 - DNA, 22 bp, Homo sapiens
tcctgggatgaggaaacaagga

SEQ ID NO: 7724644 - DNA, 22 bp, Homo sapiens
tcctgggatgaggaaacaagga

SEQ ID NO: 7724645 - DNA, 22 bp, Homo sapiens
tcctgggatcaagtgatcctcc

SEQ ID NO: 7724646 - DNA, 22 bp, Homo sapiens
tcctgggatgacttttgaaatg

SEQ ID NO: 7724647 - DNA, 22 bp, Homo sapiens
tcctgggatcaagtgatcctcc

SEQ ID NO: 7724648 - DNA, 22 bp, Homo sapiens
tcctgggatcaagtgatcctcc

SEQ ID NO: 7724649 - DNA, 22 bp, Homo sapiens
tcctgggatcaagtgatcctcc

SEQ ID NO: 7724650 - DNA, 22 bp, Homo sapiens
tcctgggatcaagtgatcctcc

SEQ ID NO: 7724651 - DNA, 22 bp, Homo sapiens
tcctgggatactaagaaatttt

SEQ ID NO: 7724652 - DNA, 22 bp, Homo sapiens
tcctgggagtggccatgtaatg

SEQ ID NO: 7724653 - DNA, 22 bp, Homo sapiens
tcctgggagtggccatgtaatg

SEQ ID NO: 7724654 - DNA, 22 bp, Homo sapiens
tcctgggagtggccatgtaatg

SEQ ID NO: 7724655 - DNA, 21 bp, Homo sapiens
tcctgggagtctgagatcctg

SEQ ID NO: 7724656 - DNA, 22 bp, Homo sapiens
tcctgggagtaattgagtcatg

SEQ ID NO: 7724657 - DNA, 22 bp, Homo sapiens
tcctgggagtggccatgtaatg

SEQ ID NO: 7724658 - DNA, 21 bp, Homo sapiens
tcctgggagtctgagatcctg

SEQ ID NO: 7724659 - DNA, 21 bp, Homo sapiens
tcctgggagtctgagatcctg

SEQ ID NO: 7724660 - DNA, 21 bp, Homo sapiens
tcctgggagtctgagatcctg

SEQ ID NO: 7724661 - DNA, 22 bp, Homo sapiens
tcctgggagtaattgagtcatg

SEQ ID NO: 7724662 - DNA, 22 bp, Homo sapiens
tcctgggagtaattgagtcatg

SEQ ID NO: 7724663 - DNA, 22 bp, Homo sapiens
tcctgggagtaattgagtcatg

SEQ ID NO: 7724664 - DNA, 22 bp, Homo sapiens
tcctgggagtaaaagctgccct

SEQ ID NO: 7724665 - DNA, 22 bp, Homo sapiens
tcctgggaggtaaaccagcatc

SEQ ID NO: 7724666 - DNA, 22 bp, Homo sapiens
tcctgggcaaagaggggcagtg

SEQ ID NO: 7724667 - DNA, 22 bp, Homo sapiens
tcctgggcaaagaggggcagtg

SEQ ID NO: 7724668 - DNA, 22 bp, Homo sapiens
tcctgggcaaagaggggcagtg

SEQ ID NO: 7724669 - DNA, 22 bp, Homo sapiens
tcctgggcaaaagtatctgtga

SEQ ID NO: 7724670 - DNA, 22 bp, Homo sapiens
tcctgggatttgcccttttctc

SEQ ID NO: 7724671 - DNA, 22 bp, Homo sapiens
tcctgggattctgcatttctaa

SEQ ID NO: 7724672 - DNA, 22 bp, Homo sapiens
tcctgggattaaggtggtgatt

SEQ ID NO: 7724673 - DNA, 22 bp, Homo sapiens
tcctgggattctgcatttctaa

SEQ ID NO: 7724674 - DNA, 22 bp, Homo sapiens
tcctgggattctgcatttctaa

SEQ ID NO: 7724675 - DNA, 22 bp, Homo sapiens
tcctgggattaaggtggtgatt

SEQ ID NO: 7724676 - DNA, 22 bp, Homo sapiens
tcctgggattaaggtggtgatt

SEQ ID NO: 7724677 - DNA, 22 bp, Homo sapiens
tcctgggattaaggtggtgatt

SEQ ID NO: 7724678 - DNA, 22 bp, Homo sapiens
tcctgggatgcataaaatatgt

SEQ ID NO: 7724679 - DNA, 22 bp, Homo sapiens
tcctgggcagaatgggatggct

SEQ ID NO: 7724680 - DNA, 22 bp, Homo sapiens
tcctgggcacaagtgagtctcc

SEQ ID NO: 7724681 - DNA, 22 bp, Homo sapiens
tcctgggcacaagtgagtctcc

SEQ ID NO: 7724682 - DNA, 22 bp, Homo sapiens
tcctgggcacaagtgagtctcc

SEQ ID NO: 7724683 - DNA, 22 bp, Homo sapiens
tcctgggcacaagtgagtctcc

SEQ ID NO: 7724684 - DNA, 22 bp, Homo sapiens
tcctgggcagcctctctggaag

SEQ ID NO: 7724685 - DNA, 22 bp, Homo sapiens
tcctgggcagcctctctggaag

SEQ ID NO: 7724686 - DNA, 22 bp, Homo sapiens
tcctgggcagcctctctggaag

SEQ ID NO: 7724687 - DNA, 22 bp, Homo sapiens
tcctgggcagcctctctggaag

SEQ ID NO: 7724688 - DNA, 22 bp, Homo sapiens
tcctgggcagcctctctggaag

SEQ ID NO: 7724689 - DNA, 22 bp, Homo sapiens
tcctgggcagcctctctggaag

SEQ ID NO: 7724690 - DNA, 22 bp, Homo sapiens
tcctgggaccaggcacctactg

SEQ ID NO: 7724691 - DNA, 22 bp, Homo sapiens
tcctgggacaccccaatatgag

SEQ ID NO: 7724692 - DNA, 22 bp, Homo sapiens
tcctgggaccaggcacctactg

SEQ ID NO: 7724693 - DNA, 22 bp, Homo sapiens
tcctgggacaagccgtggaagt

SEQ ID NO: 7724694 - DNA, 22 bp, Homo sapiens
tcctgggacaagccgtggaagt

SEQ ID NO: 7724695 - DNA, 22 bp, Homo sapiens
tcctgggaagttgcatcaccgt

SEQ ID NO: 7724696 - DNA, 22 bp, Homo sapiens
tcctgggaagttgcatcaccgt

SEQ ID NO: 7724697 - DNA, 22 bp, Homo sapiens
tcctgggaagtggctggctgag

SEQ ID NO: 7724698 - DNA, 22 bp, Homo sapiens
tcctgggaagtggctggctgag

SEQ ID NO: 7724699 - DNA, 22 bp, Homo sapiens
tcctgggaagttgcatcaccgt

SEQ ID NO: 7724700 - DNA, 22 bp, Homo sapiens
tcctgggaagttgcatcaccgt

SEQ ID NO: 7724701 - DNA, 22 bp, Homo sapiens
tcctgggaagttgcatcaccgt

SEQ ID NO: 7724702 - DNA, 22 bp, Homo sapiens
tcctgggaagagacctgagcat

SEQ ID NO: 7724703 - DNA, 22 bp, Homo sapiens
tcctgggaagagacctgagcat

SEQ ID NO: 7724704 - DNA, 21 bp, Homo sapiens
tcctgggaagcactggggtgg

SEQ ID NO: 7724705 - DNA, 21 bp, Homo sapiens
tcctgggaagcactggggtgg

SEQ ID NO: 7724706 - DNA, 22 bp, Homo sapiens
tcctgggaagagacctgagcat

SEQ ID NO: 7724707 - DNA, 21 bp, Homo sapiens
tcctgggaagcactggggtgg

SEQ ID NO: 7724708 - DNA, 21 bp, Homo sapiens
tcctgggaagcactggggtgg

SEQ ID NO: 7724709 - DNA, 22 bp, Homo sapiens
tcctgggaagcgccggcctgcg

SEQ ID NO: 7724710 - DNA, 22 bp, Homo sapiens
tcctgggaagtggctggctgag

SEQ ID NO: 7724711 - DNA, 22 bp, Homo sapiens
tcctgggaagtggctggctgag

SEQ ID NO: 7724712 - DNA, 22 bp, Homo sapiens
tcctgggaggctgtgcctggct

SEQ ID NO: 7724713 - DNA, 22 bp, Homo sapiens
tcctgggaggctgtgcctggct

SEQ ID NO: 7724714 - DNA, 22 bp, Homo sapiens
tcctgggaggctgtgcctggct

SEQ ID NO: 7724715 - DNA, 22 bp, Homo sapiens
tcctgggaggctgtgcctggct

SEQ ID NO: 7724716 - DNA, 22 bp, Homo sapiens
tcctgggaggctgtgcctggct

SEQ ID NO: 7724717 - DNA, 22 bp, Homo sapiens
tcctgggaggcggaggttgcag

SEQ ID NO: 7724718 - DNA, 22 bp, Homo sapiens
tcctgggaggcaggaccccttt

SEQ ID NO: 7724719 - DNA, 22 bp, Homo sapiens
tcctgggaggcaggaccccttt

SEQ ID NO: 7724720 - DNA, 22 bp, Homo sapiens
tcctgggaggaacatttaccta

SEQ ID NO: 7724721 - DNA, 22 bp, Homo sapiens
tcctgggactctgcctcaggct

SEQ ID NO: 7724722 - DNA, 22 bp, Homo sapiens
tcctgggactctgcctcaggct

SEQ ID NO: 7724723 - DNA, 22 bp, Homo sapiens
tcctgggactctgcctcaggct

SEQ ID NO: 7724724 - DNA, 22 bp, Homo sapiens
tcctgggactctgcctcaggct

SEQ ID NO: 7724725 - DNA, 22 bp, Homo sapiens
tcctgggactctgcctcaggct

SEQ ID NO: 7724726 - DNA, 22 bp, Homo sapiens
tcctgggactcaacttagaagg

SEQ ID NO: 7724727 - DNA, 22 bp, Homo sapiens
tcctgggactcaacttagaagg

SEQ ID NO: 7724728 - DNA, 22 bp, Homo sapiens
tcctgggactcaacttagaagg

SEQ ID NO: 7724729 - DNA, 22 bp, Homo sapiens
tcctgggaccctgggtgcagag

SEQ ID NO: 7724730 - DNA, 22 bp, Homo sapiens
tcctgggaccgagggaagagct

SEQ ID NO: 7724731 - DNA, 22 bp, Homo sapiens
tcctgggaccgagggaagagct

SEQ ID NO: 7724732 - DNA, 18 bp, Homo sapiens
tcctgggaaaggcataca

SEQ ID NO: 7724733 - DNA, 18 bp, Homo sapiens
tcctgggaaaggcataca

SEQ ID NO: 7724734 - DNA, 22 bp, Homo sapiens
tcctggcttttcttggctcatc

SEQ ID NO: 7724735 - DNA, 22 bp, Homo sapiens
tcctggcttttcttggctcatc

SEQ ID NO: 7724736 - DNA, 22 bp, Homo sapiens
tcctggcttgtcacatctacgt

SEQ ID NO: 7724737 - DNA, 22 bp, Homo sapiens
tcctggcttgtcacatctacgt

SEQ ID NO: 7724738 - DNA, 22 bp, Homo sapiens
tcctggcttgtcacatctacgt

SEQ ID NO: 7724739 - DNA, 22 bp, Homo sapiens
tcctggcttctgtctccttatt

SEQ ID NO: 7724740 - DNA, 22 bp, Homo sapiens
tcctggcttgtcacatctacgt

SEQ ID NO: 7724741 - DNA, 22 bp, Homo sapiens
tcctggcttgtcacatctacgt

SEQ ID NO: 7724742 - DNA, 21 bp, Homo sapiens
tcctggctttatgctacctct

SEQ ID NO: 7724743 - DNA, 21 bp, Homo sapiens
tcctggctttatgctacctct

SEQ ID NO: 7724744 - DNA, 21 bp, Homo sapiens
tcctggctttatgctacctct

SEQ ID NO: 7724745 - DNA, 21 bp, Homo sapiens
tcctggctttatgctacctct

SEQ ID NO: 7724746 - DNA, 21 bp, Homo sapiens
tcctggctttatgctacctct

SEQ ID NO: 7724747 - DNA, 22 bp, Homo sapiens
tcctgggaagactgtgaggaca

SEQ ID NO: 7724748 - DNA, 22 bp, Homo sapiens
tcctgggaagactgtgaggaca

SEQ ID NO: 7724749 - DNA, 18 bp, Homo sapiens
tcctgggaacttgctagc

SEQ ID NO: 7724750 - DNA, 18 bp, Homo sapiens
tcctgggaacttgctagc

SEQ ID NO: 7724751 - DNA, 22 bp, Homo sapiens
tcctgggaagagacctgagcat

SEQ ID NO: 7724752 - DNA, 22 bp, Homo sapiens
tcctgggaagagacctgagcat

SEQ ID NO: 7724753 - DNA, 18 bp, Homo sapiens
tcctgggaacttgctagc

SEQ ID NO: 7724754 - DNA, 22 bp, Homo sapiens
tcctgggaactcggaaagctct

SEQ ID NO: 7724755 - DNA, 22 bp, Homo sapiens
tcctgggaactcggaaagctct

SEQ ID NO: 7724756 - DNA, 22 bp, Homo sapiens
tcctgggaactcggaaagctct

SEQ ID NO: 7724757 - DNA, 22 bp, Homo sapiens
tcctgggaactcggaaagctct

SEQ ID NO: 7724758 - DNA, 18 bp, Homo sapiens
tcctgggaaaggcataca

SEQ ID NO: 7724759 - DNA, 18 bp, Homo sapiens
tcctgggaaaggcataca

SEQ ID NO: 7724760 - DNA, 22 bp, Homo sapiens
tcctggctgcaccagtgaccct

SEQ ID NO: 7724761 - DNA, 22 bp, Homo sapiens
tcctggctgcaccagtgaccct

SEQ ID NO: 7724762 - DNA, 22 bp, Homo sapiens
tcctggctgccgtcgtcctgcg

SEQ ID NO: 7724763 - DNA, 22 bp, Homo sapiens
tcctggctgcaccagtgaccct

SEQ ID NO: 7724764 - DNA, 22 bp, Homo sapiens
tcctggctgcaccagtgaccct

SEQ ID NO: 7724765 - DNA, 22 bp, Homo sapiens
tcctggctgccgtcgtcctgcg

SEQ ID NO: 7724766 - DNA, 22 bp, Homo sapiens
tcctggctgccgtcgtcctgcg

SEQ ID NO: 7724767 - DNA, 22 bp, Homo sapiens
tcctggctgagttcccaagtcg

SEQ ID NO: 7724768 - DNA, 22 bp, Homo sapiens
tcctggctgagttcccaagtcg

SEQ ID NO: 7724769 - DNA, 22 bp, Homo sapiens
tcctggctgagttcccaagtcg

SEQ ID NO: 7724770 - DNA, 22 bp, Homo sapiens
tcctggctgagttcccaagtcg

SEQ ID NO: 7724771 - DNA, 22 bp, Homo sapiens
tcctggctggaatttctcactc

SEQ ID NO: 7724772 - DNA, 22 bp, Homo sapiens
tcctggctgtcactcgggttga

SEQ ID NO: 7724773 - DNA, 22 bp, Homo sapiens
tcctggctggaatttctcactc

SEQ ID NO: 7724774 - DNA, 22 bp, Homo sapiens
tcctggctgttagagaggcaag

SEQ ID NO: 7724775 - DNA, 22 bp, Homo sapiens
tcctggctgttagagaggcaag

SEQ ID NO: 7724776 - DNA, 22 bp, Homo sapiens
tcctggctgttagagaggcaag

SEQ ID NO: 7724777 - DNA, 22 bp, Homo sapiens
tcctggcttaggtttccagaac

SEQ ID NO: 7724778 - DNA, 22 bp, Homo sapiens
tcctggcttaggtttccagaac

SEQ ID NO: 7724779 - DNA, 22 bp, Homo sapiens
tcctggcttaggtttccagaac

SEQ ID NO: 7724780 - DNA, 22 bp, Homo sapiens
tcctggcttaggtttccagaac

SEQ ID NO: 7724781 - DNA, 22 bp, Homo sapiens
tcctggcttccacacctgtcat

SEQ ID NO: 7724782 - DNA, 22 bp, Homo sapiens
tcctggcttccacacctgtcat

SEQ ID NO: 7724783 - DNA, 22 bp, Homo sapiens
tcctggcttccacacctgtcat

SEQ ID NO: 7724784 - DNA, 22 bp, Homo sapiens
tcctggcttctgtctccttatt

SEQ ID NO: 7724785 - DNA, 22 bp, Homo sapiens
tcctggcttctgtctccttatt

SEQ ID NO: 7724786 - DNA, 22 bp, Homo sapiens
tcctggcttcctgctcttgtca

SEQ ID NO: 7724787 - DNA, 22 bp, Homo sapiens
tcctggcttccactcctctgtt

SEQ ID NO: 7724788 - DNA, 22 bp, Homo sapiens
tcctggcttccactcctctgtt

SEQ ID NO: 7724789 - DNA, 22 bp, Homo sapiens
tcctggcttccactcctctgtt

SEQ ID NO: 7724790 - DNA, 22 bp, Homo sapiens
tcctggcttccactcctctgtt

SEQ ID NO: 7724791 - DNA, 22 bp, Homo sapiens
tcctggctctctacaaaccaga

SEQ ID NO: 7724792 - DNA, 17 bp, Homo sapiens
tcctggctctgccactg

SEQ ID NO: 7724793 - DNA, 17 bp, Homo sapiens
tcctggctctgccactg

SEQ ID NO: 7724794 - DNA, 22 bp, Homo sapiens
tcctggctctctacaaaccaga

SEQ ID NO: 7724795 - DNA, 22 bp, Homo sapiens
tcctggctctgctgcctcctag

SEQ ID NO: 7724796 - DNA, 22 bp, Homo sapiens
tcctggctctgctgcctcctag

SEQ ID NO: 7724797 - DNA, 22 bp, Homo sapiens
tcctggctctgctgcctcctag

SEQ ID NO: 7724798 - DNA, 17 bp, Homo sapiens
tcctggctctgccactg

SEQ ID NO: 7724799 - DNA, 22 bp, Homo sapiens
tcctggctctgctgcctcctag

SEQ ID NO: 7724800 - DNA, 22 bp, Homo sapiens
tcctggctctgctgcctcctag

SEQ ID NO: 7724801 - DNA, 22 bp, Homo sapiens
tcctggctcttctgagttttct

SEQ ID NO: 7724802 - DNA, 22 bp, Homo sapiens
tcctggctcttctgagttttct

SEQ ID NO: 7724803 - DNA, 22 bp, Homo sapiens
tcctggctctaagtcctgagtg

SEQ ID NO: 7724804 - DNA, 22 bp, Homo sapiens
tcctggctctaagtcctgagtg

SEQ ID NO: 7724805 - DNA, 22 bp, Homo sapiens
tcctggctctaagtcctgagtg

SEQ ID NO: 7724806 - DNA, 22 bp, Homo sapiens
tcctggctctaagtcctgagtg

SEQ ID NO: 7724807 - DNA, 22 bp, Homo sapiens
tcctggctctaagtcctgagtg

SEQ ID NO: 7724808 - DNA, 22 bp, Homo sapiens
tcctggctcggcttggggactt

SEQ ID NO: 7724809 - DNA, 22 bp, Homo sapiens
tcctggctctaagtcctgagtg

SEQ ID NO: 7724810 - DNA, 22 bp, Homo sapiens
tcctggctctaagtcctgagtg

SEQ ID NO: 7724811 - DNA, 22 bp, Homo sapiens
tcctggctctaagtcctgagtg

SEQ ID NO: 7724812 - DNA, 22 bp, Homo sapiens
tcctggctctaagtcctgagtg

SEQ ID NO: 7724813 - DNA, 22 bp, Homo sapiens
tcctggctctaagtcctgagtg

SEQ ID NO: 7724814 - DNA, 22 bp, Homo sapiens
tcctggctcggcttggggactt

SEQ ID NO: 7724815 - DNA, 22 bp, Homo sapiens
tcctggctcggcttggggactt

SEQ ID NO: 7724816 - DNA, 22 bp, Homo sapiens
tcctggctcgattgctaccaat

SEQ ID NO: 7724817 - DNA, 22 bp, Homo sapiens
tcctggctcgattgctaccaat

SEQ ID NO: 7724818 - DNA, 22 bp, Homo sapiens
tcctggctcgattgctaccaat

SEQ ID NO: 7724819 - DNA, 22 bp, Homo sapiens
tcctggctcgattgctaccaat

SEQ ID NO: 7724820 - DNA, 22 bp, Homo sapiens
tcctggctcctggagacctgct

SEQ ID NO: 7724821 - DNA, 22 bp, Homo sapiens
tcctggctcctggagacctgct

SEQ ID NO: 7724822 - DNA, 20 bp, Homo sapiens
tcctggcctccctggggctc

SEQ ID NO: 7724823 - DNA, 22 bp, Homo sapiens
tcctggcctcacagtcctgggt

SEQ ID NO: 7724824 - DNA, 22 bp, Homo sapiens
tcctggcctcacagtcctgggt

SEQ ID NO: 7724825 - DNA, 20 bp, Homo sapiens
tcctggcctccctggggctc

SEQ ID NO: 7724826 - DNA, 20 bp, Homo sapiens
tcctggcctccctggggctc

SEQ ID NO: 7724827 - DNA, 20 bp, Homo sapiens
tcctggcctccctggggctc

SEQ ID NO: 7724828 - DNA, 20 bp, Homo sapiens
tcctggcctccctggggctc

SEQ ID NO: 7724829 - DNA, 20 bp, Homo sapiens
tcctggcctccctggggctc

SEQ ID NO: 7724830 - DNA, 20 bp, Homo sapiens
tcctggcctccctggggctc

SEQ ID NO: 7724831 - DNA, 20 bp, Homo sapiens
tcctggcctccctggggctc

SEQ ID NO: 7724832 - DNA, 22 bp, Homo sapiens
tcctggcctccgttctctgcat

SEQ ID NO: 7724833 - DNA, 20 bp, Homo sapiens
tcctggcctccctggggctc

SEQ ID NO: 7724834 - DNA, 20 bp, Homo sapiens
tcctggcctccctggggctc

SEQ ID NO: 7724835 - DNA, 22 bp, Homo sapiens
tcctggcctccgttctctgcat

SEQ ID NO: 7724836 - DNA, 22 bp, Homo sapiens
tcctggcctccgttctctgcat

SEQ ID NO: 7724837 - DNA, 22 bp, Homo sapiens
tcctggcctccgttctctgcat

SEQ ID NO: 7724838 - DNA, 22 bp, Homo sapiens
tcctggcctccgttctctgcat

SEQ ID NO: 7724839 - DNA, 22 bp, Homo sapiens
tcctggcctccgttctctgcat

SEQ ID NO: 7724840 - DNA, 22 bp, Homo sapiens
tcctggcctcgctgtccacctt

SEQ ID NO: 7724841 - DNA, 22 bp, Homo sapiens
tcctggcctcgctgtccacctt

SEQ ID NO: 7724842 - DNA, 22 bp, Homo sapiens
tcctggcctcgctgtccacctt

SEQ ID NO: 7724843 - DNA, 22 bp, Homo sapiens
tcctggcctccgttctctgcat

SEQ ID NO: 7724844 - DNA, 22 bp, Homo sapiens
tcctggcctccgttctctgcat

SEQ ID NO: 7724845 - DNA, 15 bp, Homo sapiens
tcctggcctgctctg

SEQ ID NO: 7724846 - DNA, 22 bp, Homo sapiens
tcctggcctctgagtcaagaac

SEQ ID NO: 7724847 - DNA, 22 bp, Homo sapiens
tcctggcctctgagtcaagaac

SEQ ID NO: 7724848 - DNA, 22 bp, Homo sapiens
tcctggcctctgagtcaagaac

SEQ ID NO: 7724849 - DNA, 22 bp, Homo sapiens
tcctggcctctgagtcaagaac

SEQ ID NO: 7724850 - DNA, 22 bp, Homo sapiens
tcctggcctctgagtcaagaac

SEQ ID NO: 7724851 - DNA, 22 bp, Homo sapiens
tcctggcctcgctgtccacctt

SEQ ID NO: 7724852 - DNA, 22 bp, Homo sapiens
tcctggcctcgctgtccacctt

SEQ ID NO: 7724853 - DNA, 22 bp, Homo sapiens
tcctggcctcgctgtccacctt

SEQ ID NO: 7724854 - DNA, 22 bp, Homo sapiens
tcctggcctcgctgtccacctt

SEQ ID NO: 7724855 - DNA, 22 bp, Homo sapiens
tcctggctcctggagacctgct

SEQ ID NO: 7724856 - DNA, 22 bp, Homo sapiens
tcctggctcctggagacctgct

SEQ ID NO: 7724857 - DNA, 22 bp, Homo sapiens
tcctggctcctggagacctgct

SEQ ID NO: 7724858 - DNA, 22 bp, Homo sapiens
tcctggctcctggagacctgct

SEQ ID NO: 7724859 - DNA, 22 bp, Homo sapiens
tcctggctcctggagacctgct

SEQ ID NO: 7724860 - DNA, 17 bp, Homo sapiens
tcctggcctggtgtgtg

SEQ ID NO: 7724861 - DNA, 15 bp, Homo sapiens
tcctggcctgctctg

SEQ ID NO: 7724862 - DNA, 17 bp, Homo sapiens
tcctggcctggtgtgtg

SEQ ID NO: 7724863 - DNA, 15 bp, Homo sapiens
tcctggcctgctctg

SEQ ID NO: 7724864 - DNA, 17 bp, Homo sapiens
tcctggcctggtgtgtg

SEQ ID NO: 7724865 - DNA, 22 bp, Homo sapiens
tcctggcccggccgggcctgct

SEQ ID NO: 7724866 - DNA, 22 bp, Homo sapiens
tcctggcccgatccctgtgaag

SEQ ID NO: 7724867 - DNA, 22 bp, Homo sapiens
tcctggcccggccgggcctgct

SEQ ID NO: 7724868 - DNA, 22 bp, Homo sapiens
tcctggcccgatccctgtgaag

SEQ ID NO: 7724869 - DNA, 22 bp, Homo sapiens
tcctggcccggccgggcctgct

SEQ ID NO: 7724870 - DNA, 22 bp, Homo sapiens
tcctggcccggccgggcctgct

SEQ ID NO: 7724871 - DNA, 22 bp, Homo sapiens
tcctggccctctgcaaacgcca

SEQ ID NO: 7724872 - DNA, 22 bp, Homo sapiens
tcctggcccggccgggcctgct

SEQ ID NO: 7724873 - DNA, 22 bp, Homo sapiens
tcctggcccggccgggcctgct

SEQ ID NO: 7724874 - DNA, 22 bp, Homo sapiens
tcctggcccggccgggcctgct

SEQ ID NO: 7724875 - DNA, 22 bp, Homo sapiens
tcctggcccggccgggcctgct

SEQ ID NO: 7724876 - DNA, 16 bp, Homo sapiens
tcctggcccctatgga

SEQ ID NO: 7724877 - DNA, 16 bp, Homo sapiens
tcctggcccctatgga

SEQ ID NO: 7724878 - DNA, 22 bp, Homo sapiens
tcctggcccgatccctgtgaag

SEQ ID NO: 7724879 - DNA, 16 bp, Homo sapiens
tcctggcccctatgga

SEQ ID NO: 7724880 - DNA, 22 bp, Homo sapiens
tcctggcccgatccctgtgaag

SEQ ID NO: 7724881 - DNA, 22 bp, Homo sapiens
tcctggcccgatccctgtgaag

SEQ ID NO: 7724882 - DNA, 16 bp, Homo sapiens
tcctggcccctatgga

SEQ ID NO: 7724883 - DNA, 22 bp, Homo sapiens
tcctggcccgatccctgtgaag

SEQ ID NO: 7724884 - DNA, 22 bp, Homo sapiens
tcctggcccgatccctgtgaag

SEQ ID NO: 7724885 - DNA, 22 bp, Homo sapiens
tcctggcccgatccctgtgaag

SEQ ID NO: 7724886 - DNA, 21 bp, Homo sapiens
tcctggcccactctatcccca

SEQ ID NO: 7724887 - DNA, 22 bp, Homo sapiens
tcctggcccactcctagcttct

SEQ ID NO: 7724888 - DNA, 21 bp, Homo sapiens
tcctggcccactctatcccca

SEQ ID NO: 7724889 - DNA, 21 bp, Homo sapiens
tcctggcccactctatcccca

SEQ ID NO: 7724890 - DNA, 22 bp, Homo sapiens
tcctggcccactcctagcttct

SEQ ID NO: 7724891 - DNA, 21 bp, Homo sapiens
tcctggcccactctatcccca

SEQ ID NO: 7724892 - DNA, 21 bp, Homo sapiens
tcctggcccactctatcccca

SEQ ID NO: 7724893 - DNA, 21 bp, Homo sapiens
tcctggcccactctatcccca

SEQ ID NO: 7724894 - DNA, 22 bp, Homo sapiens
tcctggcccactcctagcttct

SEQ ID NO: 7724895 - DNA, 22 bp, Homo sapiens
tcctggcccactatgccagcat

SEQ ID NO: 7724896 - DNA, 22 bp, Homo sapiens
tcctggcccactatgccagcat

SEQ ID NO: 7724897 - DNA, 22 bp, Homo sapiens
tcctggcccactcctagcttct

SEQ ID NO: 7724898 - DNA, 22 bp, Homo sapiens
tcctggcccactcctagcttct

SEQ ID NO: 7724899 - DNA, 22 bp, Homo sapiens
tcctggcccactcctagcttct

SEQ ID NO: 7724900 - DNA, 22 bp, Homo sapiens
tcctggcccactcctagcttct

SEQ ID NO: 7724901 - DNA, 22 bp, Homo sapiens
tcctggcccactatgccagcat

SEQ ID NO: 7724902 - DNA, 22 bp, Homo sapiens
tcctggcccaatctgcccatga

SEQ ID NO: 7724903 - DNA, 22 bp, Homo sapiens
tcctggcccactatgccagcat

SEQ ID NO: 7724904 - DNA, 22 bp, Homo sapiens
tcctggcccactatgccagcat

SEQ ID NO: 7724905 - DNA, 22 bp, Homo sapiens
tcctggcccaatctgcccatga

SEQ ID NO: 7724906 - DNA, 22 bp, Homo sapiens
tcctggcccactatgccagcat

SEQ ID NO: 7724907 - DNA, 22 bp, Homo sapiens
tcctggcccactatgccagcat

SEQ ID NO: 7724908 - DNA, 22 bp, Homo sapiens
tcctggcccactatgccagcat

SEQ ID NO: 7724909 - DNA, 22 bp, Homo sapiens
tcctggcccactatgccagcat

SEQ ID NO: 7724910 - DNA, 22 bp, Homo sapiens
tcctggccgccgcgtggggccg

SEQ ID NO: 7724911 - DNA, 22 bp, Homo sapiens
tcctggccctgtggcctgcagt

SEQ ID NO: 7724912 - DNA, 22 bp, Homo sapiens
tcctggccctgtggcctgcagt

SEQ ID NO: 7724913 - DNA, 22 bp, Homo sapiens
tcctggccctgtggcctgcagt

SEQ ID NO: 7724914 - DNA, 22 bp, Homo sapiens
tcctggccgccgcgtggggccg

SEQ ID NO: 7724915 - DNA, 22 bp, Homo sapiens
tcctggccctgtggcctgcagt

SEQ ID NO: 7724916 - DNA, 22 bp, Homo sapiens
tcctggccgccgcgtggggccg

SEQ ID NO: 7724917 - DNA, 22 bp, Homo sapiens
tcctggccgctggcccctgaga

SEQ ID NO: 7724918 - DNA, 22 bp, Homo sapiens
tcctggccgccgcgtggggccg

SEQ ID NO: 7724919 - DNA, 22 bp, Homo sapiens
tcctggccgctggcccctgaga

SEQ ID NO: 7724920 - DNA, 22 bp, Homo sapiens
tcctggccgctggcccctgaga

SEQ ID NO: 7724921 - DNA, 22 bp, Homo sapiens
tcctggccgccgcgtggggccg

SEQ ID NO: 7724922 - DNA, 22 bp, Homo sapiens
tcctggccgccgcgtggggccg

SEQ ID NO: 7724923 - DNA, 22 bp, Homo sapiens
tcctggccgccgcgtggggccg

SEQ ID NO: 7724924 - DNA, 22 bp, Homo sapiens
tcctggccgccgcgtggggccg

SEQ ID NO: 7724925 - DNA, 22 bp, Homo sapiens
tcctggccctgtggcctgcagt

SEQ ID NO: 7724926 - DNA, 22 bp, Homo sapiens
tcctggccctgtggcctgcagt

SEQ ID NO: 7724927 - DNA, 22 bp, Homo sapiens
tcctggccctgtggcctgcagt

SEQ ID NO: 7724928 - DNA, 22 bp, Homo sapiens
tcctggccctgtggcctgcagt

SEQ ID NO: 7724929 - DNA, 22 bp, Homo sapiens
tcctggccctgtggcctgcagt

SEQ ID NO: 7724930 - DNA, 22 bp, Homo sapiens
tcctggccctgtggcctgcagt

SEQ ID NO: 7724931 - DNA, 22 bp, Homo sapiens
tcctggccctctgcaaacgcca

SEQ ID NO: 7724932 - DNA, 22 bp, Homo sapiens
tcctggccctctgcaaacgcca

SEQ ID NO: 7724933 - DNA, 22 bp, Homo sapiens
tcctggccctctgcaaacgcca

SEQ ID NO: 7724934 - DNA, 22 bp, Homo sapiens
tcctggccctctgcaaacgcca

SEQ ID NO: 7724935 - DNA, 22 bp, Homo sapiens
tcctggccctgtggcctgcagt

SEQ ID NO: 7724936 - DNA, 22 bp, Homo sapiens
tcctggccctgtggcctgcagt

SEQ ID NO: 7724937 - DNA, 22 bp, Homo sapiens
tcctggccctgtggcctgcagt

SEQ ID NO: 7724938 - DNA, 22 bp, Homo sapiens
tcctggcctcacagtcctgggt

SEQ ID NO: 7724939 - DNA, 22 bp, Homo sapiens
tcctggcctagctcaccctgga

SEQ ID NO: 7724940 - DNA, 22 bp, Homo sapiens
tcctggcctcacagtcctgggt

SEQ ID NO: 7724941 - DNA, 22 bp, Homo sapiens
tcctggcctcacagtcctgggt

SEQ ID NO: 7724942 - DNA, 22 bp, Homo sapiens
tcctggcctcacagtcctgggt

SEQ ID NO: 7724943 - DNA, 22 bp, Homo sapiens
tcctggcctcacagtcctgggt

SEQ ID NO: 7724944 - DNA, 22 bp, Homo sapiens
tcctggcctcacagtcctgggt

SEQ ID NO: 7724945 - DNA, 22 bp, Homo sapiens
tcctggcctagctcaccctgga

SEQ ID NO: 7724946 - DNA, 22 bp, Homo sapiens
tcctggcctagctcaccctgga

SEQ ID NO: 7724947 - DNA, 22 bp, Homo sapiens
tcctggcctagctcaccctgga

SEQ ID NO: 7724948 - DNA, 22 bp, Homo sapiens
tcctggcctagctcaccctgga

SEQ ID NO: 7724949 - DNA, 22 bp, Homo sapiens
tcctggcctagctcaccctgga

SEQ ID NO: 7724950 - DNA, 22 bp, Homo sapiens
tcctggcctagctcaccctgga

SEQ ID NO: 7724951 - DNA, 22 bp, Homo sapiens
tcctggcctagctcaccctgga

SEQ ID NO: 7724952 - DNA, 22 bp, Homo sapiens
tcctggcctagagtttgtgttc

SEQ ID NO: 7724953 - DNA, 22 bp, Homo sapiens
tcctggcctagagtttgtgttc

SEQ ID NO: 7724954 - DNA, 22 bp, Homo sapiens
tcctggcctagagtttgtgttc

SEQ ID NO: 7724955 - DNA, 22 bp, Homo sapiens
tcctggccgctggcccctgaga

SEQ ID NO: 7724956 - DNA, 22 bp, Homo sapiens
tcctggccgctggcccctgaga

SEQ ID NO: 7724957 - DNA, 22 bp, Homo sapiens
tcctggccgctggcccctgaga

SEQ ID NO: 7724958 - DNA, 22 bp, Homo sapiens
tcctggccgctggcccctgaga

SEQ ID NO: 7724959 - DNA, 22 bp, Homo sapiens
tcctggccgctggcccctgaga

SEQ ID NO: 7724960 - DNA, 22 bp, Homo sapiens
tcctggccgctggcccctgaga

SEQ ID NO: 7724961 - DNA, 17 bp, Homo sapiens
tcctggatccatggtgg

SEQ ID NO: 7724962 - DNA, 22 bp, Homo sapiens
tcctggatctactctcaattgg

SEQ ID NO: 7724963 - DNA, 17 bp, Homo sapiens
tcctggatccatggtgg

SEQ ID NO: 7724964 - DNA, 17 bp, Homo sapiens
tcctggatccatggtgg

SEQ ID NO: 7724965 - DNA, 22 bp, Homo sapiens
tcctggatcagcgggggcaggc

SEQ ID NO: 7724966 - DNA, 22 bp, Homo sapiens
tcctggagtttgtggtgatatg

SEQ ID NO: 7724967 - DNA, 22 bp, Homo sapiens
tcctggatatcaaacaaacatt

SEQ ID NO: 7724968 - DNA, 22 bp, Homo sapiens
tcctggatggagctgccctcgc

SEQ ID NO: 7724969 - DNA, 22 bp, Homo sapiens
tcctggatggagctgccctcgc

SEQ ID NO: 7724970 - DNA, 22 bp, Homo sapiens
tcctggatggcctgcaggcggt

SEQ ID NO: 7724971 - DNA, 22 bp, Homo sapiens
tcctggattaatagggagctgt

SEQ ID NO: 7724972 - DNA, 22 bp, Homo sapiens
tcctggattaatagggagctgt

SEQ ID NO: 7724973 - DNA, 22 bp, Homo sapiens
tcctggattctgccctgaaggc

SEQ ID NO: 7724974 - DNA, 22 bp, Homo sapiens
tcctggattctgccctgaaggc

SEQ ID NO: 7724975 - DNA, 22 bp, Homo sapiens
tcctggatttaaccctggctct

SEQ ID NO: 7724976 - DNA, 22 bp, Homo sapiens
tcctggatttaaccctggctct

SEQ ID NO: 7724977 - DNA, 22 bp, Homo sapiens
tcctggattaatagggagctgt

SEQ ID NO: 7724978 - DNA, 22 bp, Homo sapiens
tcctggatttaaccctggctct

SEQ ID NO: 7724979 - DNA, 20 bp, Homo sapiens
tcctggcaagccgtacctcc

SEQ ID NO: 7724980 - DNA, 22 bp, Homo sapiens
tcctggcaaagatgttggtgtt

SEQ ID NO: 7724981 - DNA, 22 bp, Homo sapiens
tcctggatttagaagagcctcc

SEQ ID NO: 7724982 - DNA, 19 bp, Homo sapiens
tcctggcacagtggaacca

SEQ ID NO: 7724983 - DNA, 22 bp, Homo sapiens
tcctggcacattgcaggggctc

SEQ ID NO: 7724984 - DNA, 22 bp, Homo sapiens
tcctggcacattgcaggggctc

SEQ ID NO: 7724985 - DNA, 22 bp, Homo sapiens
tcctggcacattgcaggggctc

SEQ ID NO: 7724986 - DNA, 22 bp, Homo sapiens
tcctggcacaaccctttaccag

SEQ ID NO: 7724987 - DNA, 22 bp, Homo sapiens
tcctggcaatggcaggttcagg

SEQ ID NO: 7724988 - DNA, 22 bp, Homo sapiens
tcctggcaatggcaggttcagg

SEQ ID NO: 7724989 - DNA, 22 bp, Homo sapiens
tcctggagtttgtggtgatatg

SEQ ID NO: 7724990 - DNA, 22 bp, Homo sapiens
tcctggagtttgtggtgatatg

SEQ ID NO: 7724991 - DNA, 22 bp, Homo sapiens
tcctggagtttgtggtgatatg

SEQ ID NO: 7724992 - DNA, 22 bp, Homo sapiens
tcctggagtttgtggtgatatg

SEQ ID NO: 7724993 - DNA, 22 bp, Homo sapiens
tcctggagtttgtaaggtgagc

SEQ ID NO: 7724994 - DNA, 22 bp, Homo sapiens
tcctggagtttgtaaggtgagc

SEQ ID NO: 7724995 - DNA, 22 bp, Homo sapiens
tcctggagtttgtaaggtgagc

SEQ ID NO: 7724996 - DNA, 22 bp, Homo sapiens
tcctggagtttgtaaggtgagc

SEQ ID NO: 7724997 - DNA, 22 bp, Homo sapiens
tcctggagttgtgcagtgcaca

SEQ ID NO: 7724998 - DNA, 22 bp, Homo sapiens
tcctggagttgtgcagtgcaca

SEQ ID NO: 7724999 - DNA, 22 bp, Homo sapiens
tcctggagttgtgcagtgcaca

SEQ ID NO: 7725000 - DNA, 22 bp, Homo sapiens
tcctggagttgtgcagtgcaca

SEQ ID NO: 7725001 - DNA, 22 bp, Homo sapiens
tcctggagttgtgcagtgcaca

SEQ ID NO: 7725002 - DNA, 22 bp, Homo sapiens
tcctggagttgtgcagtgcaca

SEQ ID NO: 7725003 - DNA, 22 bp, Homo sapiens
tcctggagttgtgcagtgcaca

SEQ ID NO: 7725004 - DNA, 22 bp, Homo sapiens
tcctggagttgtgcagtgcaca

SEQ ID NO: 7725005 - DNA, 22 bp, Homo sapiens
tcctggagttgtgcagtgcaca

SEQ ID NO: 7725006 - DNA, 20 bp, Homo sapiens
tcctggagtctggtttggct

SEQ ID NO: 7725007 - DNA, 20 bp, Homo sapiens
tcctggagtctggtttggct

SEQ ID NO: 7725008 - DNA, 22 bp, Homo sapiens
tcctggagtatttctgtggtgt

SEQ ID NO: 7725009 - DNA, 22 bp, Homo sapiens
tcctggagttgtctgtactcat

SEQ ID NO: 7725010 - DNA, 22 bp, Homo sapiens
tcctggagttgtctgtactcat

SEQ ID NO: 7725011 - DNA, 22 bp, Homo sapiens
tcctggagttgtctgtactcat

SEQ ID NO: 7725012 - DNA, 22 bp, Homo sapiens
tcctggagttgtctgtactcat

SEQ ID NO: 7725013 - DNA, 22 bp, Homo sapiens
tcctggagtgtcttccccaagg

SEQ ID NO: 7725014 - DNA, 22 bp, Homo sapiens
tcctggagtggagtctgttgtt

SEQ ID NO: 7725015 - DNA, 22 bp, Homo sapiens
tcctggccaagtagatgtggcg

SEQ ID NO: 7725016 - DNA, 22 bp, Homo sapiens
tcctggccaagtagatgtggcg

SEQ ID NO: 7725017 - DNA, 22 bp, Homo sapiens
tcctggccaagtagatgtggcg

SEQ ID NO: 7725018 - DNA, 22 bp, Homo sapiens
tcctggccaagtagatgtggcg

SEQ ID NO: 7725019 - DNA, 22 bp, Homo sapiens
tcctggccaagtagatgtggcg

SEQ ID NO: 7725020 - DNA, 22 bp, Homo sapiens
tcctggcatttacaaacccacc

SEQ ID NO: 7725021 - DNA, 22 bp, Homo sapiens
tcctggcattgtgcagggtgtg

SEQ ID NO: 7725022 - DNA, 22 bp, Homo sapiens
tcctggccaagttactctctgc

SEQ ID NO: 7725023 - DNA, 22 bp, Homo sapiens
tcctggccaagtagatgtggcg

SEQ ID NO: 7725024 - DNA, 22 bp, Homo sapiens
tcctggccaagtagatgtggcg

SEQ ID NO: 7725025 - DNA, 22 bp, Homo sapiens
tcctggccaagttactctctgc

SEQ ID NO: 7725026 - DNA, 22 bp, Homo sapiens
tcctggccaagttactctctgc

SEQ ID NO: 7725027 - DNA, 22 bp, Homo sapiens
tcctggccaagttactctctgc

SEQ ID NO: 7725028 - DNA, 22 bp, Homo sapiens
tcctggccacacattaatagtg

SEQ ID NO: 7725029 - DNA, 22 bp, Homo sapiens
tcctggccacacattaatagtg

SEQ ID NO: 7725030 - DNA, 22 bp, Homo sapiens
tcctggccaagttactctctgc

SEQ ID NO: 7725031 - DNA, 22 bp, Homo sapiens
tcctggccaagttactctctgc

SEQ ID NO: 7725032 - DNA, 22 bp, Homo sapiens
tcctggcattgtgcagggtgtg

SEQ ID NO: 7725033 - DNA, 22 bp, Homo sapiens
tcctggcattgtgcagggtgtg

SEQ ID NO: 7725034 - DNA, 22 bp, Homo sapiens
tcctggcatccgtgggtctgtg

SEQ ID NO: 7725035 - DNA, 22 bp, Homo sapiens
tcctggcatccgtgggtctgtg

SEQ ID NO: 7725036 - DNA, 22 bp, Homo sapiens
tcctggcatccgtgggtctgtg

SEQ ID NO: 7725037 - DNA, 22 bp, Homo sapiens
tcctggcataatggctttgctc

SEQ ID NO: 7725038 - DNA, 22 bp, Homo sapiens
tcctggcataatggctttgctc

SEQ ID NO: 7725039 - DNA, 22 bp, Homo sapiens
tcctggcagttcagccccctaa

SEQ ID NO: 7725040 - DNA, 22 bp, Homo sapiens
tcctggcataatggctttgctc

SEQ ID NO: 7725041 - DNA, 17 bp, Homo sapiens
tcctggcagtcccctgg

SEQ ID NO: 7725042 - DNA, 22 bp, Homo sapiens
tcctggcacattgcaggggctc

SEQ ID NO: 7725043 - DNA, 22 bp, Homo sapiens
tcctggcagtgcttgttttgga

SEQ ID NO: 7725044 - DNA, 17 bp, Homo sapiens
tcctggcagtcccctgg

SEQ ID NO: 7725045 - DNA, 17 bp, Homo sapiens
tcctggcagtcccctgg

SEQ ID NO: 7725046 - DNA, 22 bp, Homo sapiens
tcctggcccaatctgcccatga

SEQ ID NO: 7725047 - DNA, 22 bp, Homo sapiens
tcctggcccaatctgcccatga

SEQ ID NO: 7725048 - DNA, 22 bp, Homo sapiens
tcctggcccaatctgcccatga

SEQ ID NO: 7725049 - DNA, 22 bp, Homo sapiens
tcctggcccaatctgcccatga

SEQ ID NO: 7725050 - DNA, 22 bp, Homo sapiens
tcctggcccaatctgcccatga

SEQ ID NO: 7725051 - DNA, 22 bp, Homo sapiens
tcctggcccaatctgcccatga

SEQ ID NO: 7725052 - DNA, 22 bp, Homo sapiens
tcctggccatgcaagatgagga

SEQ ID NO: 7725053 - DNA, 22 bp, Homo sapiens
tcctggccataggctatttcag

SEQ ID NO: 7725054 - DNA, 22 bp, Homo sapiens
tcctggccatgcaagatgagga

SEQ ID NO: 7725055 - DNA, 22 bp, Homo sapiens
tcctggccatgcaagatgagga

SEQ ID NO: 7725056 - DNA, 22 bp, Homo sapiens
tcctggccatgcaagatgagga

SEQ ID NO: 7725057 - DNA, 22 bp, Homo sapiens
tcctggccatgcaagatgagga

SEQ ID NO: 7725058 - DNA, 22 bp, Homo sapiens
tcctggccataggctatttcag

SEQ ID NO: 7725059 - DNA, 21 bp, Homo sapiens
tcctggccagggcactaggca

SEQ ID NO: 7725060 - DNA, 22 bp, Homo sapiens
tcctggccataggctatttcag

SEQ ID NO: 7725061 - DNA, 22 bp, Homo sapiens
tcctggccataggctatttcag

SEQ ID NO: 7725062 - DNA, 22 bp, Homo sapiens
tcctggccataggctatttcag

SEQ ID NO: 7725063 - DNA, 21 bp, Homo sapiens
tcctggccagggcactaggca

SEQ ID NO: 7725064 - DNA, 21 bp, Homo sapiens
tcctggccagggcactaggca

SEQ ID NO: 7725065 - DNA, 21 bp, Homo sapiens
tcctggccagggcactaggca

SEQ ID NO: 7725066 - DNA, 21 bp, Homo sapiens
tcctggccagggcactaggca

SEQ ID NO: 7725067 - DNA, 21 bp, Homo sapiens
tcctggccagggcactaggca

SEQ ID NO: 7725068 - DNA, 21 bp, Homo sapiens
tcctggccagggcactaggca

SEQ ID NO: 7725069 - DNA, 21 bp, Homo sapiens
tcctggccagggcactaggca

SEQ ID NO: 7725070 - DNA, 22 bp, Homo sapiens
tcctggccacccgacagaagtc

SEQ ID NO: 7725071 - DNA, 22 bp, Homo sapiens
tcctggccacccgacagaagtc

SEQ ID NO: 7725072 - DNA, 22 bp, Homo sapiens
tcctggccacccgacagaagtc

SEQ ID NO: 7725073 - DNA, 18 bp, Homo sapiens
tcctggccacactacctt

SEQ ID NO: 7725074 - DNA, 22 bp, Homo sapiens
tcctggccacccgacagaagtc

SEQ ID NO: 7725075 - DNA, 22 bp, Homo sapiens
tcctggccacccgacagaagtc

SEQ ID NO: 7725076 - DNA, 22 bp, Homo sapiens
tcctggccacccgacagaagtc

SEQ ID NO: 7725077 - DNA, 18 bp, Homo sapiens
tcctggccacactacctt

SEQ ID NO: 7725078 - DNA, 18 bp, Homo sapiens
tcctggccacactacctt

SEQ ID NO: 7725079 - DNA, 18 bp, Homo sapiens
tcctggccacactacctt

SEQ ID NO: 7725080 - DNA, 22 bp, Homo sapiens
tcctggccacacattaatagtg

SEQ ID NO: 7725081 - DNA, 18 bp, Homo sapiens
tcctggccacactacctt

SEQ ID NO: 7725082 - DNA, 18 bp, Homo sapiens
tcctggccacactacctt

SEQ ID NO: 7725083 - DNA, 22 bp, Homo sapiens
tcctggccaggatgacctaaca

SEQ ID NO: 7725084 - DNA, 22 bp, Homo sapiens
tcctggccaggatgacctaaca

SEQ ID NO: 7725085 - DNA, 22 bp, Homo sapiens
tcctggccaggatgacctaaca

SEQ ID NO: 7725086 - DNA, 22 bp, Homo sapiens
tcctggccaggatgacctaaca

SEQ ID NO: 7725087 - DNA, 22 bp, Homo sapiens
tcctggccaggatgacctaaca

SEQ ID NO: 7725088 - DNA, 22 bp, Homo sapiens
tcctggccagaggacaaagctg

SEQ ID NO: 7725089 - DNA, 22 bp, Homo sapiens
tcctggccagaggacaaagctg

SEQ ID NO: 7725090 - DNA, 22 bp, Homo sapiens
tcctggccagaggacaaagctg

SEQ ID NO: 7725091 - DNA, 22 bp, Homo sapiens
tcctggccacccgacagaagtc

SEQ ID NO: 7725092 - DNA, 22 bp, Homo sapiens
tcctggccagaggacaaagctg

SEQ ID NO: 7725093 - DNA, 22 bp, Homo sapiens
tcctggccagaggacaaagctg

SEQ ID NO: 7725094 - DNA, 22 bp, Homo sapiens
tcctggccagaggacaaagctg

SEQ ID NO: 7725095 - DNA, 22 bp, Homo sapiens
tcctggaagatctctgtgagat

SEQ ID NO: 7725096 - DNA, 22 bp, Homo sapiens
tcctggaagccagagttgagga

SEQ ID NO: 7725097 - DNA, 22 bp, Homo sapiens
tcctggaagatctctgtgagat

SEQ ID NO: 7725098 - DNA, 22 bp, Homo sapiens
tcctggaacatggataaagaat

SEQ ID NO: 7725099 - DNA, 22 bp, Homo sapiens
tcctggaacatggataaagaat

SEQ ID NO: 7725100 - DNA, 19 bp, Homo sapiens
tcctgctttctactctgct

SEQ ID NO: 7725101 - DNA, 22 bp, Homo sapiens
tcctgcttgaaactctgccttc

SEQ ID NO: 7725102 - DNA, 19 bp, Homo sapiens
tcctgctttctactctgct

SEQ ID NO: 7725103 - DNA, 19 bp, Homo sapiens
tcctgctttctactctgct

SEQ ID NO: 7725104 - DNA, 22 bp, Homo sapiens
tcctgctttgtgcctcacactt

SEQ ID NO: 7725105 - DNA, 22 bp, Homo sapiens
tcctggactcaggaccacagga

SEQ ID NO: 7725106 - DNA, 22 bp, Homo sapiens
tcctggactcaggaccacagga

SEQ ID NO: 7725107 - DNA, 22 bp, Homo sapiens
tcctggacagatccccatcatc

SEQ ID NO: 7725108 - DNA, 22 bp, Homo sapiens
tcctggactggctcagcaccct

SEQ ID NO: 7725109 - DNA, 22 bp, Homo sapiens
tcctggactggctcagcaccct

SEQ ID NO: 7725110 - DNA, 22 bp, Homo sapiens
tcctggactggctcagcaccct

SEQ ID NO: 7725111 - DNA, 22 bp, Homo sapiens
tcctggacaagcccttcaccct

SEQ ID NO: 7725112 - DNA, 22 bp, Homo sapiens
tcctggacaagcccttcaccct

SEQ ID NO: 7725113 - DNA, 22 bp, Homo sapiens
tcctggaagtgcttggtgaggg

SEQ ID NO: 7725114 - DNA, 22 bp, Homo sapiens
tcctggacaagcccttcaccct

SEQ ID NO: 7725115 - DNA, 22 bp, Homo sapiens
tcctggacagatccccatcatc

SEQ ID NO: 7725116 - DNA, 22 bp, Homo sapiens
tcctggacagatccccatcatc

SEQ ID NO: 7725117 - DNA, 22 bp, Homo sapiens
tcctggagaagaggggcttgga

SEQ ID NO: 7725118 - DNA, 22 bp, Homo sapiens
tcctggagaagaggggcttgga

SEQ ID NO: 7725119 - DNA, 22 bp, Homo sapiens
tcctggagaagaggggcttgga

SEQ ID NO: 7725120 - DNA, 22 bp, Homo sapiens
tcctggagaactgattcgcggg

SEQ ID NO: 7725121 - DNA, 22 bp, Homo sapiens
tcctggagaagaggggcttgga

SEQ ID NO: 7725122 - DNA, 22 bp, Homo sapiens
tcctggagaaactcagagatct

SEQ ID NO: 7725123 - DNA, 22 bp, Homo sapiens
tcctggagaaactcagagatct

SEQ ID NO: 7725124 - DNA, 22 bp, Homo sapiens
tcctggagaaactcagagatct

SEQ ID NO: 7725125 - DNA, 23 bp, Homo sapiens
tcctggagaaaagaaacatttct

SEQ ID NO: 7725126 - DNA, 22 bp, Homo sapiens
tcctggagaaactcagagatct

SEQ ID NO: 7725127 - DNA, 22 bp, Homo sapiens
tcctggagaaactcagagatct

SEQ ID NO: 7725128 - DNA, 22 bp, Homo sapiens
tcctggagaaactcagagatct

SEQ ID NO: 7725129 - DNA, 22 bp, Homo sapiens
tcctggagagaggcctggaaga

SEQ ID NO: 7725130 - DNA, 22 bp, Homo sapiens
tcctggagagaggcctggaaga

SEQ ID NO: 7725131 - DNA, 22 bp, Homo sapiens
tcctggagagaggcctggaaga

SEQ ID NO: 7725132 - DNA, 22 bp, Homo sapiens
tcctggagaatggacaatgcac

SEQ ID NO: 7725133 - DNA, 22 bp, Homo sapiens
tcctggagagtgggcgagcaca

SEQ ID NO: 7725134 - DNA, 22 bp, Homo sapiens
tcctggagagtgggcgagcaca

SEQ ID NO: 7725135 - DNA, 22 bp, Homo sapiens
tcctggagagaggcctggaaga

SEQ ID NO: 7725136 - DNA, 22 bp, Homo sapiens
tcctggagagaggcctggaaga

SEQ ID NO: 7725137 - DNA, 22 bp, Homo sapiens
tcctggagaatggacaatgcac

SEQ ID NO: 7725138 - DNA, 22 bp, Homo sapiens
tcctggagaatcctgccacctg

SEQ ID NO: 7725139 - DNA, 22 bp, Homo sapiens
tcctggagaagaggggcttgga

SEQ ID NO: 7725140 - DNA, 22 bp, Homo sapiens
tcctggagataattgcagtgaa

SEQ ID NO: 7725141 - DNA, 22 bp, Homo sapiens
tcctggagataattgcagtgaa

SEQ ID NO: 7725142 - DNA, 22 bp, Homo sapiens
tcctggagataattgcagtgaa

SEQ ID NO: 7725143 - DNA, 22 bp, Homo sapiens
tcctggagataattgcagtgaa

SEQ ID NO: 7725144 - DNA, 22 bp, Homo sapiens
tcctggagataattgcagtgaa

SEQ ID NO: 7725145 - DNA, 22 bp, Homo sapiens
tcctggagagtgggcgagcaca

SEQ ID NO: 7725146 - DNA, 22 bp, Homo sapiens
tcctggagagtgggcgagcaca

SEQ ID NO: 7725147 - DNA, 22 bp, Homo sapiens
tcctggagagtgggcgagcaca

SEQ ID NO: 7725148 - DNA, 22 bp, Homo sapiens
tcctggagagtgggcgagcaca

SEQ ID NO: 7725149 - DNA, 22 bp, Homo sapiens
tcctggagccaatgtgctgctg

SEQ ID NO: 7725150 - DNA, 22 bp, Homo sapiens
tcctggagccaatgtgctgctg

SEQ ID NO: 7725151 - DNA, 22 bp, Homo sapiens
tcctggagccaatgtgctgctg

SEQ ID NO: 7725152 - DNA, 22 bp, Homo sapiens
tcctggagataattgcagtgaa

SEQ ID NO: 7725153 - DNA, 22 bp, Homo sapiens
tcctggagataattgcagtgaa

SEQ ID NO: 7725154 - DNA, 22 bp, Homo sapiens
tcctggagataattgcagtgaa

SEQ ID NO: 7725155 - DNA, 22 bp, Homo sapiens
tcctggagataattgcagtgaa

SEQ ID NO: 7725156 - DNA, 22 bp, Homo sapiens
tcctggagataattgcagtgaa

SEQ ID NO: 7725157 - DNA, 22 bp, Homo sapiens
tcctggagataattgcagtgaa

SEQ ID NO: 7725158 - DNA, 22 bp, Homo sapiens
tcctggagtatttctgtggtgt

SEQ ID NO: 7725159 - DNA, 22 bp, Homo sapiens
tcctggagtatttctgtggtgt

SEQ ID NO: 7725160 - DNA, 22 bp, Homo sapiens
tcctggagtatttctgtggtgt

SEQ ID NO: 7725161 - DNA, 20 bp, Homo sapiens
tcctggagtattccatgctt

SEQ ID NO: 7725162 - DNA, 20 bp, Homo sapiens
tcctggagtattccatgctt

SEQ ID NO: 7725163 - DNA, 20 bp, Homo sapiens
tcctggagtattccatgctt

SEQ ID NO: 7725164 - DNA, 20 bp, Homo sapiens
tcctggagtattccatgctt

SEQ ID NO: 7725165 - DNA, 22 bp, Homo sapiens
tcctggagtaggccttagccat

SEQ ID NO: 7725166 - DNA, 22 bp, Homo sapiens
tcctggagtaggccttagccat

SEQ ID NO: 7725167 - DNA, 22 bp, Homo sapiens
tcctggagtaggccttagccat

SEQ ID NO: 7725168 - DNA, 22 bp, Homo sapiens
tcctggaggggacagcatgggc

SEQ ID NO: 7725169 - DNA, 22 bp, Homo sapiens
tcctggaggggacagcatgggc

SEQ ID NO: 7725170 - DNA, 22 bp, Homo sapiens
tcctggaggggacagcatgggc

SEQ ID NO: 7725171 - DNA, 22 bp, Homo sapiens
tcctggagggctcacaggcggc

SEQ ID NO: 7725172 - DNA, 22 bp, Homo sapiens
tcctggagggctcacaggcggc

SEQ ID NO: 7725173 - DNA, 22 bp, Homo sapiens
tcctggagggctcacaggcggc

SEQ ID NO: 7725174 - DNA, 22 bp, Homo sapiens
tcctggagggctcacaggcggc

SEQ ID NO: 7725175 - DNA, 22 bp, Homo sapiens
tcctggagggctcacaggcggc

SEQ ID NO: 7725176 - DNA, 22 bp, Homo sapiens
tcctggagggctcacaggcggc

SEQ ID NO: 7725177 - DNA, 22 bp, Homo sapiens
tcctggagggaggcggtgctac

SEQ ID NO: 7725178 - DNA, 22 bp, Homo sapiens
tcctggagggaggcggtgctac

SEQ ID NO: 7725179 - DNA, 22 bp, Homo sapiens
tcctggaggggacagcatgggc

SEQ ID NO: 7725180 - DNA, 22 bp, Homo sapiens
tcctggaggggacagcatgggc

SEQ ID NO: 7725181 - DNA, 22 bp, Homo sapiens
tcctggagggctcacaggcggc

SEQ ID NO: 7725182 - DNA, 22 bp, Homo sapiens
tcctggaggggacagcatgggc

SEQ ID NO: 7725183 - DNA, 22 bp, Homo sapiens
tcctggagggctcacaggcggc

SEQ ID NO: 7725184 - DNA, 22 bp, Homo sapiens
tcctggaggggacagcatgggc

SEQ ID NO: 7725185 - DNA, 22 bp, Homo sapiens
tcctggaggggacagcatgggc

SEQ ID NO: 7725186 - DNA, 22 bp, Homo sapiens
tcctggagggaggcggtgctac

SEQ ID NO: 7725187 - DNA, 22 bp, Homo sapiens
tcctggagggaggcggtgctac

SEQ ID NO: 7725188 - DNA, 22 bp, Homo sapiens
tcctggagggaggcggtgctac

SEQ ID NO: 7725189 - DNA, 20 bp, Homo sapiens
tcctggaggcttcatccata

SEQ ID NO: 7725190 - DNA, 20 bp, Homo sapiens
tcctggaggcttcatccata

SEQ ID NO: 7725191 - DNA, 20 bp, Homo sapiens
tcctggaggcttcatccata

SEQ ID NO: 7725192 - DNA, 22 bp, Homo sapiens
tcctggaggcactcgctggggc

SEQ ID NO: 7725193 - DNA, 22 bp, Homo sapiens
tcctggaggcactcgctggggc

SEQ ID NO: 7725194 - DNA, 22 bp, Homo sapiens
tcctggaggcactcgctggggc

SEQ ID NO: 7725195 - DNA, 22 bp, Homo sapiens
tcctggaggcaaatgagcacat

SEQ ID NO: 7725196 - DNA, 22 bp, Homo sapiens
tcctggaggcaaatgagcacat

SEQ ID NO: 7725197 - DNA, 22 bp, Homo sapiens
tcctggaggcactcgctggggc

SEQ ID NO: 7725198 - DNA, 22 bp, Homo sapiens
tcctggaggcactcgctggggc

SEQ ID NO: 7725199 - DNA, 22 bp, Homo sapiens
tcctggaggcaaatgagcacat

SEQ ID NO: 7725200 - DNA, 22 bp, Homo sapiens
tcctggaggcaaatgagcacat

SEQ ID NO: 7725201 - DNA, 22 bp, Homo sapiens
tcctggaggcaaatgaagactc

SEQ ID NO: 7725202 - DNA, 22 bp, Homo sapiens
tcctggaggcaaatgaagactc

SEQ ID NO: 7725203 - DNA, 22 bp, Homo sapiens
tcctggaggcaaatgaagactc

SEQ ID NO: 7725204 - DNA, 22 bp, Homo sapiens
tcctggaggcaaatgaagactc

SEQ ID NO: 7725205 - DNA, 22 bp, Homo sapiens
tcctggaggcaaatgaagactc

SEQ ID NO: 7725206 - DNA, 22 bp, Homo sapiens
tcctggaggcaaatgaagactc

SEQ ID NO: 7725207 - DNA, 22 bp, Homo sapiens
tcctggagccaatgtgctgctg

SEQ ID NO: 7725208 - DNA, 22 bp, Homo sapiens
tcctggaggagatccaatctga

SEQ ID NO: 7725209 - DNA, 22 bp, Homo sapiens
tcctggagccaatgtgctgctg

SEQ ID NO: 7725210 - DNA, 22 bp, Homo sapiens
tcctggagccaatgtgctgctg

SEQ ID NO: 7725211 - DNA, 22 bp, Homo sapiens
tcctggagccaatgtgctgctg

SEQ ID NO: 7725212 - DNA, 22 bp, Homo sapiens
tcctgctgttttctggcccaca

SEQ ID NO: 7725213 - DNA, 22 bp, Homo sapiens
tcctgcttaacatatggtcaag

SEQ ID NO: 7725214 - DNA, 22 bp, Homo sapiens
tcctgctgttttctggcccaca

SEQ ID NO: 7725215 - DNA, 22 bp, Homo sapiens
tcctgctgttttctggcccaca

SEQ ID NO: 7725216 - DNA, 22 bp, Homo sapiens
tcctgctgttttctggcccaca

SEQ ID NO: 7725217 - DNA, 22 bp, Homo sapiens
tcctgctgtttacctacaatgg

SEQ ID NO: 7725218 - DNA, 22 bp, Homo sapiens
tcctgctgtttacctacaatgg

SEQ ID NO: 7725219 - DNA, 22 bp, Homo sapiens
tcctgctgtttacctacaatgg

SEQ ID NO: 7725220 - DNA, 19 bp, Homo sapiens
tcctgctgtgtgaagggga

SEQ ID NO: 7725221 - DNA, 22 bp, Homo sapiens
tcctgcttgaaactctgccttc

SEQ ID NO: 7725222 - DNA, 22 bp, Homo sapiens
tcctgcttgaaactctgccttc

SEQ ID NO: 7725223 - DNA, 22 bp, Homo sapiens
tcctgcttgaaactctgccttc

SEQ ID NO: 7725224 - DNA, 22 bp, Homo sapiens
tcctgcttgaaactctgccttc

SEQ ID NO: 7725225 - DNA, 22 bp, Homo sapiens
tcctgcttcttcgagcttctgg

SEQ ID NO: 7725226 - DNA, 20 bp, Homo sapiens
tcctgcttccaccagagcac

SEQ ID NO: 7725227 - DNA, 19 bp, Homo sapiens
tcctgctgtgtgaagggga

SEQ ID NO: 7725228 - DNA, 19 bp, Homo sapiens
tcctgctgtgtgaagggga

SEQ ID NO: 7725229 - DNA, 22 bp, Homo sapiens
tcctgctgtgtctagctggttc

SEQ ID NO: 7725230 - DNA, 19 bp, Homo sapiens
tcctgctgtgtgaagggga

SEQ ID NO: 7725231 - DNA, 22 bp, Homo sapiens
tcctgctgtgtctagctggttc

SEQ ID NO: 7725232 - DNA, 22 bp, Homo sapiens
tcctgctgtgtctagctggttc

SEQ ID NO: 7725233 - DNA, 22 bp, Homo sapiens
tcctgctgtgtctagctggttc

SEQ ID NO: 7725234 - DNA, 22 bp, Homo sapiens
tcctgctgtgcttattatcctg

SEQ ID NO: 7725235 - DNA, 22 bp, Homo sapiens
tcctgctgggtctaactctggt

SEQ ID NO: 7725236 - DNA, 22 bp, Homo sapiens
tcctgctggtgatggttaaggt

SEQ ID NO: 7725237 - DNA, 22 bp, Homo sapiens
tcctgctgggcctgctttagga

SEQ ID NO: 7725238 - DNA, 22 bp, Homo sapiens
tcctgctgggcctgctttagga

SEQ ID NO: 7725239 - DNA, 22 bp, Homo sapiens
tcctgctggcaaggaagggact

SEQ ID NO: 7725240 - DNA, 22 bp, Homo sapiens
tcctgctggcaaggaagggact

SEQ ID NO: 7725241 - DNA, 22 bp, Homo sapiens
tcctgctggattgtgtctggtg

SEQ ID NO: 7725242 - DNA, 22 bp, Homo sapiens
tcctgctggcaaggaagggact

SEQ ID NO: 7725243 - DNA, 22 bp, Homo sapiens
tcctgctggcaaggaagggact

SEQ ID NO: 7725244 - DNA, 21 bp, Homo sapiens
tcctgctgggtcaaccgtttt

SEQ ID NO: 7725245 - DNA, 22 bp, Homo sapiens
tcctgctgggtctaactctggt

SEQ ID NO: 7725246 - DNA, 22 bp, Homo sapiens
taagaattatctcatggataat

SEQ ID NO: 7725247 - DNA, 22 bp, Homo sapiens
taagaatgacaaccataccatt

SEQ ID NO: 7725248 - DNA, 22 bp, Homo sapiens
taagaatgacaaccataccatt

SEQ ID NO: 7725249 - DNA, 22 bp, Homo sapiens
taagaatgactaccaaactgga

SEQ ID NO: 7725250 - DNA, 22 bp, Homo sapiens
taagaatgactaccaaactgga

SEQ ID NO: 7725251 - DNA, 22 bp, Homo sapiens
taagaattccatcgcagagtat

SEQ ID NO: 7725252 - DNA, 22 bp, Homo sapiens
tcctgctggattgtgtctggtg

SEQ ID NO: 7725253 - DNA, 22 bp, Homo sapiens
tcctgctggattgtgtctggtg

SEQ ID NO: 7725254 - DNA, 22 bp, Homo sapiens
taagacaaatactatttcaaga

SEQ ID NO: 7725255 - DNA, 22 bp, Homo sapiens
tcctgctggattgtgtctggtg

SEQ ID NO: 7725256 - DNA, 18 bp, Homo sapiens
taagaattgagagtttac

SEQ ID NO: 7725257 - DNA, 22 bp, Homo sapiens
taagaattgtgttgaatagagt

SEQ ID NO: 7725258 - DNA, 22 bp, Homo sapiens
taagaatagtgtttgcctttgg

SEQ ID NO: 7725259 - DNA, 22 bp, Homo sapiens
taagaatagtgtttgcctttgg

SEQ ID NO: 7725260 - DNA, 22 bp, Homo sapiens
taagaatattgggaatggatgg

SEQ ID NO: 7725261 - DNA, 22 bp, Homo sapiens
taagaatagtgtttgcctttgg

SEQ ID NO: 7725262 - DNA, 22 bp, Homo sapiens
taagaatagtgtttgcctttgg

SEQ ID NO: 7725263 - DNA, 22 bp, Homo sapiens
taagaatagtgtttgcctttgg

SEQ ID NO: 7725264 - DNA, 22 bp, Homo sapiens
taagaatagtccctagatgtgt

SEQ ID NO: 7725265 - DNA, 22 bp, Homo sapiens
taagaatattgggaatggatgg

SEQ ID NO: 7725266 - DNA, 22 bp, Homo sapiens
taagaatcagtagatatagatt

SEQ ID NO: 7725267 - DNA, 22 bp, Homo sapiens
taagaatattgggaatggatgg

SEQ ID NO: 7725268 - DNA, 22 bp, Homo sapiens
taagaatattgggaatggatgg

SEQ ID NO: 7725269 - DNA, 22 bp, Homo sapiens
taagaatattgggaatggatgg

SEQ ID NO: 7725270 - DNA, 22 bp, Homo sapiens
taagaatcggtcgcaacagagg

SEQ ID NO: 7725271 - DNA, 22 bp, Homo sapiens
taagaatcggtcgcaacagagg

SEQ ID NO: 7725272 - DNA, 22 bp, Homo sapiens
taagaatcggtcgcaacagagg

SEQ ID NO: 7725273 - DNA, 22 bp, Homo sapiens
taagaatctgcattttaacaag

SEQ ID NO: 7725274 - DNA, 22 bp, Homo sapiens
taagaatcagtagatatagatt

SEQ ID NO: 7725275 - DNA, 22 bp, Homo sapiens
taagaatcgatgtttatttaga

SEQ ID NO: 7725276 - DNA, 22 bp, Homo sapiens
taagaatcgatgtttatttaga

SEQ ID NO: 7725277 - DNA, 22 bp, Homo sapiens
taagaacagtgtctgtctcaca

SEQ ID NO: 7725278 - DNA, 22 bp, Homo sapiens
taagaacagtgtctgtctcaca

SEQ ID NO: 7725279 - DNA, 22 bp, Homo sapiens
taagaacagtgtctgtctcaca

SEQ ID NO: 7725280 - DNA, 22 bp, Homo sapiens
taagaacagtgacagccaacat

SEQ ID NO: 7725281 - DNA, 22 bp, Homo sapiens
taagaacagtgtctgtctcaca

SEQ ID NO: 7725282 - DNA, 22 bp, Homo sapiens
taagaacagtgtctgtctcaca

SEQ ID NO: 7725283 - DNA, 22 bp, Homo sapiens
taagaacagtgtctgtctcaca

SEQ ID NO: 7725284 - DNA, 22 bp, Homo sapiens
taagaacagtgtctgtctcaca

SEQ ID NO: 7725285 - DNA, 22 bp, Homo sapiens
taagaacatctgtccccagatt

SEQ ID NO: 7725286 - DNA, 22 bp, Homo sapiens
taagaacataaattcatacggg

SEQ ID NO: 7725287 - DNA, 22 bp, Homo sapiens
taagaacataaattcatacggg

SEQ ID NO: 7725288 - DNA, 22 bp, Homo sapiens
taagaacataaattcatacggg

SEQ ID NO: 7725289 - DNA, 22 bp, Homo sapiens
taagaacagtgtctgtctcaca

SEQ ID NO: 7725290 - DNA, 22 bp, Homo sapiens
taagaacagtgtttcatctcta

SEQ ID NO: 7725291 - DNA, 22 bp, Homo sapiens
taagaacagtgtttcatctcta

SEQ ID NO: 7725292 - DNA, 22 bp, Homo sapiens
taagaacagtgtctgtctcaca

SEQ ID NO: 7725293 - DNA, 22 bp, Homo sapiens
taagaacagtgacagccaacat

SEQ ID NO: 7725294 - DNA, 22 bp, Homo sapiens
taagaacagtgacagccaacat

SEQ ID NO: 7725295 - DNA, 22 bp, Homo sapiens
taagaacagtagaacagtaggt

SEQ ID NO: 7725296 - DNA, 22 bp, Homo sapiens
taagaacagtagaacagtaggt

SEQ ID NO: 7725297 - DNA, 22 bp, Homo sapiens
taagaacagtagaacagtaggt

SEQ ID NO: 7725298 - DNA, 22 bp, Homo sapiens
taagaacagtagaacagtaggt

SEQ ID NO: 7725299 - DNA, 22 bp, Homo sapiens
taagaacagtagaacagtaggt

SEQ ID NO: 7725300 - DNA, 22 bp, Homo sapiens
taagaacagtagaacagtaggt

SEQ ID NO: 7725301 - DNA, 22 bp, Homo sapiens
taagaacagataaagtttcccc

SEQ ID NO: 7725302 - DNA, 22 bp, Homo sapiens
taagaacagataaagtttcccc

SEQ ID NO: 7725303 - DNA, 23 bp, Homo sapiens
taagaacagacaagcatttacat

SEQ ID NO: 7725304 - DNA, 23 bp, Homo sapiens
taagaacagacaagcatttacat

SEQ ID NO: 7725305 - DNA, 23 bp, Homo sapiens
taagaacagacaagcatttacat

SEQ ID NO: 7725306 - DNA, 22 bp, Homo sapiens
taagaacaagctgggggttcca

SEQ ID NO: 7725307 - DNA, 23 bp, Homo sapiens
taagaacagacaagcatttacat

SEQ ID NO: 7725308 - DNA, 22 bp, Homo sapiens
taagaacagataaagtttcccc

SEQ ID NO: 7725309 - DNA, 23 bp, Homo sapiens
taagaacagacaagcatttacat

SEQ ID NO: 7725310 - DNA, 22 bp, Homo sapiens
taagaatacctctcagctcttt

SEQ ID NO: 7725311 - DNA, 22 bp, Homo sapiens
taagaatagtccctagatgtgt

SEQ ID NO: 7725312 - DNA, 22 bp, Homo sapiens
taagaatagtccctagatgtgt

SEQ ID NO: 7725313 - DNA, 22 bp, Homo sapiens
taagaatacctctcagctcttt

SEQ ID NO: 7725314 - DNA, 22 bp, Homo sapiens
taagaatacctctcagctcttt

SEQ ID NO: 7725315 - DNA, 22 bp, Homo sapiens
taagaagtgtttgcccagccat

SEQ ID NO: 7725316 - DNA, 22 bp, Homo sapiens
taagaagtgtttgcccagccat

SEQ ID NO: 7725317 - DNA, 22 bp, Homo sapiens
taagaatagtccctagatgtgt

SEQ ID NO: 7725318 - DNA, 22 bp, Homo sapiens
taagaatagtccctagatgtgt

SEQ ID NO: 7725319 - DNA, 22 bp, Homo sapiens
taagaatagtccctagatgtgt

SEQ ID NO: 7725320 - DNA, 22 bp, Homo sapiens
taagaatagtccctagatgtgt

SEQ ID NO: 7725321 - DNA, 22 bp, Homo sapiens
taagaagtacaaaaattttctg

SEQ ID NO: 7725322 - DNA, 18 bp, Homo sapiens
taagaaggtggctccagc

SEQ ID NO: 7725323 - DNA, 22 bp, Homo sapiens
taagaagtacctcttttcctga

SEQ ID NO: 7725324 - DNA, 22 bp, Homo sapiens
taagaagggtacaataaggcat

SEQ ID NO: 7725325 - DNA, 22 bp, Homo sapiens
taagaaggtaatacatttttgc

SEQ ID NO: 7725326 - DNA, 22 bp, Homo sapiens
taagaaggtagtttccaagtca

SEQ ID NO: 7725327 - DNA, 22 bp, Homo sapiens
taagaaggtagtttccaagtca

SEQ ID NO: 7725328 - DNA, 18 bp, Homo sapiens
taagaaggtggctccagc

SEQ ID NO: 7725329 - DNA, 22 bp, Homo sapiens
taagaagtgctgaattgaatat

SEQ ID NO: 7725330 - DNA, 22 bp, Homo sapiens
taagaagtacctcttttcctga

SEQ ID NO: 7725331 - DNA, 22 bp, Homo sapiens
taagaagtgagtgcaccttctt

SEQ ID NO: 7725332 - DNA, 22 bp, Homo sapiens
taagaagtgttgcctaatgcaa

SEQ ID NO: 7725333 - DNA, 21 bp, Homo sapiens
taagaacattatcttcttcct

SEQ ID NO: 7725334 - DNA, 21 bp, Homo sapiens
taagaacattatcttcttcct

SEQ ID NO: 7725335 - DNA, 22 bp, Homo sapiens
taagaacattttcggaaagata

SEQ ID NO: 7725336 - DNA, 22 bp, Homo sapiens
taagaacattttcggaaagata

SEQ ID NO: 7725337 - DNA, 22 bp, Homo sapiens
taagaacattttcggaaagata

SEQ ID NO: 7725338 - DNA, 22 bp, Homo sapiens
taagaacattttcggaaagata

SEQ ID NO: 7725339 - DNA, 22 bp, Homo sapiens
taagaacattttcggaaagata

SEQ ID NO: 7725340 - DNA, 22 bp, Homo sapiens
taagaacattttcggaaagata

SEQ ID NO: 7725341 - DNA, 22 bp, Homo sapiens
taagaacattttcggaaagata

SEQ ID NO: 7725342 - DNA, 22 bp, Homo sapiens
taagaactcgtgatcatttgaa

SEQ ID NO: 7725343 - DNA, 22 bp, Homo sapiens
taagaactcgtgatcatttgaa

SEQ ID NO: 7725344 - DNA, 22 bp, Homo sapiens
taagaacttcggacatgttatc

SEQ ID NO: 7725345 - DNA, 22 bp, Homo sapiens
taagaacttcggacatgttatc

SEQ ID NO: 7725346 - DNA, 22 bp, Homo sapiens
taagaacttcggacatgttatc

SEQ ID NO: 7725347 - DNA, 22 bp, Homo sapiens
taagaacttggcagcaagaaat

SEQ ID NO: 7725348 - DNA, 22 bp, Homo sapiens
taagaacttggcagcaagaaat

SEQ ID NO: 7725349 - DNA, 22 bp, Homo sapiens
taagaacttggcagcaagaaat

SEQ ID NO: 7725350 - DNA, 22 bp, Homo sapiens
taagaactttgtagcctgttct

SEQ ID NO: 7725351 - DNA, 22 bp, Homo sapiens
taagaactttgtagcctgttct

SEQ ID NO: 7725352 - DNA, 22 bp, Homo sapiens
taagaactttgtagcctgttct

SEQ ID NO: 7725353 - DNA, 22 bp, Homo sapiens
tcttcttcccatccctcaaatg

SEQ ID NO: 7725354 - DNA, 22 bp, Homo sapiens
tcttcttatgtgccattatctc

SEQ ID NO: 7725355 - DNA, 22 bp, Homo sapiens
tcttcttcctcatttatacata

SEQ ID NO: 7725356 - DNA, 22 bp, Homo sapiens
tcttcttcctcatttatacata

SEQ ID NO: 7725357 - DNA, 22 bp, Homo sapiens
tcttcttcctcatttatacata

SEQ ID NO: 7725358 - DNA, 22 bp, Homo sapiens
tcttctttatgtcatatgccag

SEQ ID NO: 7725359 - DNA, 22 bp, Homo sapiens
tcttctttatgtcatatgccag

SEQ ID NO: 7725360 - DNA, 22 bp, Homo sapiens
tcttctttgaatcatagtgacc

SEQ ID NO: 7725361 - DNA, 22 bp, Homo sapiens
tcttctttgaatcatagtgacc

SEQ ID NO: 7725362 - DNA, 22 bp, Homo sapiens
tcttctttgaatcatagtgacc

SEQ ID NO: 7725363 - DNA, 22 bp, Homo sapiens
tcttctttgaatcatagtgacc

SEQ ID NO: 7725364 - DNA, 22 bp, Homo sapiens
tcttcttcctccacagggccca

SEQ ID NO: 7725365 - DNA, 22 bp, Homo sapiens
tcttcttcctcatttatacata

SEQ ID NO: 7725366 - DNA, 20 bp, Homo sapiens
tcttctgttgccttgttctg

SEQ ID NO: 7725367 - DNA, 20 bp, Homo sapiens
tcttctgttgccttgttctg

SEQ ID NO: 7725368 - DNA, 20 bp, Homo sapiens
tcttctgttgccttgttctg

SEQ ID NO: 7725369 - DNA, 20 bp, Homo sapiens
tcttctgttgccttgttctg

SEQ ID NO: 7725370 - DNA, 20 bp, Homo sapiens
tcttctgttgccttgttctg

SEQ ID NO: 7725371 - DNA, 22 bp, Homo sapiens
tcttctgttaccacagcgatga

SEQ ID NO: 7725372 - DNA, 22 bp, Homo sapiens
tcttctgttaccacagcgatga

SEQ ID NO: 7725373 - DNA, 22 bp, Homo sapiens
tcttctgttaccacagcgatga

SEQ ID NO: 7725374 - DNA, 22 bp, Homo sapiens
tcttctgttttagattgcatac

SEQ ID NO: 7725375 - DNA, 22 bp, Homo sapiens
tcttcttatgtgccattatctc

SEQ ID NO: 7725376 - DNA, 22 bp, Homo sapiens
tcttcttatgtgccattatctc

SEQ ID NO: 7725377 - DNA, 22 bp, Homo sapiens
tcttcttatgtgccattatctc

SEQ ID NO: 7725378 - DNA, 22 bp, Homo sapiens
tcttctgttttagattgcatac

SEQ ID NO: 7725379 - DNA, 22 bp, Homo sapiens
tcttctgttttagattgcatac

SEQ ID NO: 7725380 - DNA, 22 bp, Homo sapiens
tcttctgttttagattgcatac

SEQ ID NO: 7725381 - DNA, 22 bp, Homo sapiens
tcttcttttatttcaagggtgt

SEQ ID NO: 7725382 - DNA, 22 bp, Homo sapiens
tcttctttggatgaaagaatat

SEQ ID NO: 7725383 - DNA, 22 bp, Homo sapiens
tcttcttttatttcaagggtgt

SEQ ID NO: 7725384 - DNA, 22 bp, Homo sapiens
tcttctttttgtcccacagaat

SEQ ID NO: 7725385 - DNA, 22 bp, Homo sapiens
tcttctttttgtcccacagaat

SEQ ID NO: 7725386 - DNA, 22 bp, Homo sapiens
tcttctttggatgaaagaatat

SEQ ID NO: 7725387 - DNA, 22 bp, Homo sapiens
tcttctttggatgaaagaatat

SEQ ID NO: 7725388 - DNA, 22 bp, Homo sapiens
tcttctttggatgaaagaatat

SEQ ID NO: 7725389 - DNA, 22 bp, Homo sapiens
tcttctttggatgaaagaatat

SEQ ID NO: 7725390 - DNA, 22 bp, Homo sapiens
tcttctttggatgaaagaatat

SEQ ID NO: 7725391 - DNA, 22 bp, Homo sapiens
tcttctttggatgaaagaatat

SEQ ID NO: 7725392 - DNA, 22 bp, Homo sapiens
tcttctttggatgaaagaatat

SEQ ID NO: 7725393 - DNA, 22 bp, Homo sapiens
tcttctttggatgaaagaatat

SEQ ID NO: 7725394 - DNA, 21 bp, Homo sapiens
tcttgaaaagttagattctct

SEQ ID NO: 7725395 - DNA, 22 bp, Homo sapiens
tcttgaaaattgaggttgaagg

SEQ ID NO: 7725396 - DNA, 21 bp, Homo sapiens
tcttgaaaattgtagcagttt

SEQ ID NO: 7725397 - DNA, 21 bp, Homo sapiens
tcttgaaaattgtagcagttt

SEQ ID NO: 7725398 - DNA, 21 bp, Homo sapiens
tcttgaaaagttagattctct

SEQ ID NO: 7725399 - DNA, 21 bp, Homo sapiens
tcttgaaaagttagattctct

SEQ ID NO: 7725400 - DNA, 21 bp, Homo sapiens
tcttgaaaagttagattctct

SEQ ID NO: 7725401 - DNA, 23 bp, Homo sapiens
tcttgaaaagcctacagcagttc

SEQ ID NO: 7725402 - DNA, 23 bp, Homo sapiens
tcttgaaaagcctacagcagttc

SEQ ID NO: 7725403 - DNA, 22 bp, Homo sapiens
tcttgaaagcattttcttcatc

SEQ ID NO: 7725404 - DNA, 22 bp, Homo sapiens
tcttgaaagcattttcttcatc

SEQ ID NO: 7725405 - DNA, 22 bp, Homo sapiens
tcttgaaagcatgagatggaca

SEQ ID NO: 7725406 - DNA, 22 bp, Homo sapiens
tcttgaaagcatgagatggaca

SEQ ID NO: 7725407 - DNA, 22 bp, Homo sapiens
tcttgaaagcattttcttcatc

SEQ ID NO: 7725408 - DNA, 22 bp, Homo sapiens
tcttgaaagcattttcttcatc

SEQ ID NO: 7725409 - DNA, 22 bp, Homo sapiens
tcttgaaacatatgagtaagtg

SEQ ID NO: 7725410 - DNA, 21 bp, Homo sapiens
tcttgaaaattgtagcagttt

SEQ ID NO: 7725411 - DNA, 22 bp, Homo sapiens
tcttgaaacatatgagtaagtg

SEQ ID NO: 7725412 - DNA, 22 bp, Homo sapiens
tcttgaaagcatgagatggaca

SEQ ID NO: 7725413 - DNA, 22 bp, Homo sapiens
tcttgaaacatatgagtaagtg

SEQ ID NO: 7725414 - DNA, 22 bp, Homo sapiens
tcttctccataatcaacactct

SEQ ID NO: 7725415 - DNA, 22 bp, Homo sapiens
tcttctccagttcatcctacca

SEQ ID NO: 7725416 - DNA, 22 bp, Homo sapiens
tcttctccagttcatcctacca

SEQ ID NO: 7725417 - DNA, 22 bp, Homo sapiens
tcttctccagttcatcctacca

SEQ ID NO: 7725418 - DNA, 22 bp, Homo sapiens
tcttctccagtgcttctgcaca

SEQ ID NO: 7725419 - DNA, 22 bp, Homo sapiens
tcttctcatagctagttcttcc

SEQ ID NO: 7725420 - DNA, 22 bp, Homo sapiens
tcttctcatagctagttcttcc

SEQ ID NO: 7725421 - DNA, 22 bp, Homo sapiens
tcttctccagtgcttctgcaca

SEQ ID NO: 7725422 - DNA, 22 bp, Homo sapiens
tcttctccagtgcttctgcaca

SEQ ID NO: 7725423 - DNA, 22 bp, Homo sapiens
tcttctccagtgcttctgcaca

SEQ ID NO: 7725424 - DNA, 22 bp, Homo sapiens
tcttctcagtttctctaggatg

SEQ ID NO: 7725425 - DNA, 22 bp, Homo sapiens
tcttctccagtgcttctgcaca

SEQ ID NO: 7725426 - DNA, 22 bp, Homo sapiens
tcttctcccatcggccgcaggg

SEQ ID NO: 7725427 - DNA, 22 bp, Homo sapiens
tcttctcccatcggccgcaggg

SEQ ID NO: 7725428 - DNA, 22 bp, Homo sapiens
tcttctcccatcggccgcaggg

SEQ ID NO: 7725429 - DNA, 22 bp, Homo sapiens
tcttctcccagggtcgcccaag

SEQ ID NO: 7725430 - DNA, 22 bp, Homo sapiens
tcttctcccagggtcgcccaag

SEQ ID NO: 7725431 - DNA, 22 bp, Homo sapiens
tcttctccataatcaacactct

SEQ ID NO: 7725432 - DNA, 22 bp, Homo sapiens
tcttctccagttcatcctacca

SEQ ID NO: 7725433 - DNA, 22 bp, Homo sapiens
tcttctccataatcaacactct

SEQ ID NO: 7725434 - DNA, 22 bp, Homo sapiens
tcttctccataatcaacactct

SEQ ID NO: 7725435 - DNA, 22 bp, Homo sapiens
tcttctccataatcaacactct

SEQ ID NO: 7725436 - DNA, 22 bp, Homo sapiens
tcttctccataatcaacactct

SEQ ID NO: 7725437 - DNA, 22 bp, Homo sapiens
tcttctcccatctccaggcagg

SEQ ID NO: 7725438 - DNA, 22 bp, Homo sapiens
tcttctcccatctccaggcagg

SEQ ID NO: 7725439 - DNA, 22 bp, Homo sapiens
tcttctcccatctccaggcagg

SEQ ID NO: 7725440 - DNA, 22 bp, Homo sapiens
tcttctcccatctccaggcagg

SEQ ID NO: 7725441 - DNA, 22 bp, Homo sapiens
tcttctcccatcggccgcaggg

SEQ ID NO: 7725442 - DNA, 22 bp, Homo sapiens
tcttctcccatctccaggcagg

SEQ ID NO: 7725443 - DNA, 22 bp, Homo sapiens
tcttctcccatcggccgcaggg

SEQ ID NO: 7725444 - DNA, 22 bp, Homo sapiens
tcttctctacaccagcagcccc

SEQ ID NO: 7725445 - DNA, 22 bp, Homo sapiens
tcttctctcatgtaggagggaa

SEQ ID NO: 7725446 - DNA, 22 bp, Homo sapiens
tcttctgtattgttaactcagg

SEQ ID NO: 7725447 - DNA, 20 bp, Homo sapiens
tcttctggatttcctttagg

SEQ ID NO: 7725448 - DNA, 20 bp, Homo sapiens
tcttctggatttcctttagg

SEQ ID NO: 7725449 - DNA, 22 bp, Homo sapiens
tcttctggatgagagcggaggc

SEQ ID NO: 7725450 - DNA, 22 bp, Homo sapiens
tcttctggatgagagcggaggc

SEQ ID NO: 7725451 - DNA, 22 bp, Homo sapiens
tcttctctcatgtaggagggaa

SEQ ID NO: 7725452 - DNA, 22 bp, Homo sapiens
tcttctcctttgccatgtgttt

SEQ ID NO: 7725453 - DNA, 22 bp, Homo sapiens
tcttctcctttgccatgtgttt

SEQ ID NO: 7725454 - DNA, 22 bp, Homo sapiens
tcttctcctttgccatgtgttt

SEQ ID NO: 7725455 - DNA, 22 bp, Homo sapiens
tcttctcccatctccaggcagg

SEQ ID NO: 7725456 - DNA, 22 bp, Homo sapiens
tcttctgtggctctcaccaccc

SEQ ID NO: 7725457 - DNA, 22 bp, Homo sapiens
tcttctgtgatctatgtgtttt

SEQ ID NO: 7725458 - DNA, 22 bp, Homo sapiens
tcttctgtgatctatgtgtttt

SEQ ID NO: 7725459 - DNA, 22 bp, Homo sapiens
tcttctgttaccacagcgatga

SEQ ID NO: 7725460 - DNA, 22 bp, Homo sapiens
tcttctgttaccacagcgatga

SEQ ID NO: 7725461 - DNA, 22 bp, Homo sapiens
tcttctgtggctctcaccaccc

SEQ ID NO: 7725462 - DNA, 22 bp, Homo sapiens
tcttctgtggctctcaccaccc

SEQ ID NO: 7725463 - DNA, 22 bp, Homo sapiens
tcttctgtcctaagtcaaagca

SEQ ID NO: 7725464 - DNA, 22 bp, Homo sapiens
tcttctgtattgttaactcagg

SEQ ID NO: 7725465 - DNA, 22 bp, Homo sapiens
tcttctgtattgttaactcagg

SEQ ID NO: 7725466 - DNA, 22 bp, Homo sapiens
tcttctgtattgttaactcagg

SEQ ID NO: 7725467 - DNA, 22 bp, Homo sapiens
tcttctgtgagaattcaagcaa

SEQ ID NO: 7725468 - DNA, 22 bp, Homo sapiens
tcttctgtcctaagtcaaagca

SEQ ID NO: 7725469 - DNA, 22 bp, Homo sapiens
tcttctgtgagaattcaagcaa

SEQ ID NO: 7725470 - DNA, 22 bp, Homo sapiens
tcttccttctttgatgacaagg

SEQ ID NO: 7725471 - DNA, 22 bp, Homo sapiens
tcttccttgccttgcttcatca

SEQ ID NO: 7725472 - DNA, 22 bp, Homo sapiens
tcttccttgccttgcttcatca

SEQ ID NO: 7725473 - DNA, 22 bp, Homo sapiens
tcttccttgccttgcttcatca

SEQ ID NO: 7725474 - DNA, 22 bp, Homo sapiens
tcttccttgccttgcttcatca

SEQ ID NO: 7725475 - DNA, 22 bp, Homo sapiens
tcttccttgccttgcttcatca

SEQ ID NO: 7725476 - DNA, 22 bp, Homo sapiens
tcttccttgctccttgtcactt

SEQ ID NO: 7725477 - DNA, 22 bp, Homo sapiens
tcttccttgctccttgtcactt

SEQ ID NO: 7725478 - DNA, 22 bp, Homo sapiens
tcttcctttcattcatgtgtta

SEQ ID NO: 7725479 - DNA, 22 bp, Homo sapiens
tcttcctttcattcatgtgtta

SEQ ID NO: 7725480 - DNA, 22 bp, Homo sapiens
tcttccttgtaagggctttaga

SEQ ID NO: 7725481 - DNA, 22 bp, Homo sapiens
tcttccttgtaagggctttaga

SEQ ID NO: 7725482 - DNA, 22 bp, Homo sapiens
tcttccttgctccttgtcactt

SEQ ID NO: 7725483 - DNA, 22 bp, Homo sapiens
tcttccttgctccttgtcactt

SEQ ID NO: 7725484 - DNA, 22 bp, Homo sapiens
tcttctagtaggccaagaagct

SEQ ID NO: 7725485 - DNA, 22 bp, Homo sapiens
tcttctagtaggccaagaagct

SEQ ID NO: 7725486 - DNA, 22 bp, Homo sapiens
tcttctaatggttcagatatat

SEQ ID NO: 7725487 - DNA, 22 bp, Homo sapiens
tcttctaatggttcagatatat

SEQ ID NO: 7725488 - DNA, 22 bp, Homo sapiens
tcttctactataataattttct

SEQ ID NO: 7725489 - DNA, 22 bp, Homo sapiens
tcttcgtagcatcgtgctggct

SEQ ID NO: 7725490 - DNA, 22 bp, Homo sapiens
tcttctaatggttcagatatat

SEQ ID NO: 7725491 - DNA, 22 bp, Homo sapiens
tcttctaatggttcagatatat

SEQ ID NO: 7725492 - DNA, 22 bp, Homo sapiens
tcttctcaaaaaatgtaggtgg

SEQ ID NO: 7725493 - DNA, 22 bp, Homo sapiens
tcttctagtaggccaagaagct

SEQ ID NO: 7725494 - DNA, 22 bp, Homo sapiens
tcttctatcctcagcccctgcc

SEQ ID NO: 7725495 - DNA, 16 bp, Homo sapiens
tcttccttttgatttt

SEQ ID NO: 7725496 - DNA, 16 bp, Homo sapiens
tcttccttttgatttt

SEQ ID NO: 7725497 - DNA, 22 bp, Homo sapiens
tcttccttttgtaccttctgaa

SEQ ID NO: 7725498 - DNA, 22 bp, Homo sapiens
tcttccttttgtaccttctgaa

SEQ ID NO: 7725499 - DNA, 22 bp, Homo sapiens
tcttccttttgtaccttctgaa

SEQ ID NO: 7725500 - DNA, 22 bp, Homo sapiens
tcttccttctttgatgacaagg

SEQ ID NO: 7725501 - DNA, 22 bp, Homo sapiens
tcttccttcgcccttgctgttt

SEQ ID NO: 7725502 - DNA, 22 bp, Homo sapiens
tcttccttctttgatgacaagg

SEQ ID NO: 7725503 - DNA, 22 bp, Homo sapiens
tcttccttctttgatgacaagg

SEQ ID NO: 7725504 - DNA, 22 bp, Homo sapiens
tcttccttctttgatgacaagg

SEQ ID NO: 7725505 - DNA, 22 bp, Homo sapiens
tcttccttctttgatgacaagg

SEQ ID NO: 7725506 - DNA, 22 bp, Homo sapiens
tcttccttctttgatgacaagg

SEQ ID NO: 7725507 - DNA, 22 bp, Homo sapiens
tcttccttaaatgtttggtaga

SEQ ID NO: 7725508 - DNA, 22 bp, Homo sapiens
tcttccttaaatgtttggtaga

SEQ ID NO: 7725509 - DNA, 22 bp, Homo sapiens
tcttcctgtcaatgagaattaa

SEQ ID NO: 7725510 - DNA, 22 bp, Homo sapiens
tcttcctgtcaatgagaattaa

SEQ ID NO: 7725511 - DNA, 22 bp, Homo sapiens
tcttcctgtcaatgagaattaa

SEQ ID NO: 7725512 - DNA, 22 bp, Homo sapiens
tcttcctggtttctgggccatc

SEQ ID NO: 7725513 - DNA, 22 bp, Homo sapiens
tcttcctggtttctgggccatc

SEQ ID NO: 7725514 - DNA, 22 bp, Homo sapiens
tcttcctgtcaatgagaattaa

SEQ ID NO: 7725515 - DNA, 22 bp, Homo sapiens
tcttcctggtttctgggccatc

SEQ ID NO: 7725516 - DNA, 22 bp, Homo sapiens
tcttcctggatgggggttgatg

SEQ ID NO: 7725517 - DNA, 22 bp, Homo sapiens
tcttcctgctttggtgaggctt

SEQ ID NO: 7725518 - DNA, 22 bp, Homo sapiens
tcttcctggcattgatgctgca

SEQ ID NO: 7725519 - DNA, 22 bp, Homo sapiens
tcttcctggcattgatgctgca

SEQ ID NO: 7725520 - DNA, 22 bp, Homo sapiens
tcttcctgctttggtgaggctt

SEQ ID NO: 7725521 - DNA, 22 bp, Homo sapiens
tcttcctgcttggtgtgtctgg

SEQ ID NO: 7725522 - DNA, 21 bp, Homo sapiens
tcttcctgctccacactcccc

SEQ ID NO: 7725523 - DNA, 21 bp, Homo sapiens
tcttcctgctccacactcccc

SEQ ID NO: 7725524 - DNA, 21 bp, Homo sapiens
tcttcctgctccacactcccc

SEQ ID NO: 7725525 - DNA, 22 bp, Homo sapiens
tcttccaggacctggggctcca

SEQ ID NO: 7725526 - DNA, 22 bp, Homo sapiens
tcttccaggagggcatttcttt

SEQ ID NO: 7725527 - DNA, 22 bp, Homo sapiens
tcttccaggagggcatttcttt

SEQ ID NO: 7725528 - DNA, 22 bp, Homo sapiens
tcttccaggagggcatttcttt

SEQ ID NO: 7725529 - DNA, 22 bp, Homo sapiens
tcttccaggacctggggctcca

SEQ ID NO: 7725530 - DNA, 22 bp, Homo sapiens
tcttccaggacctggggctcca

SEQ ID NO: 7725531 - DNA, 22 bp, Homo sapiens
tcttccaggacctggggctcca

SEQ ID NO: 7725532 - DNA, 22 bp, Homo sapiens
tcttccagcttctggtggctgc

SEQ ID NO: 7725533 - DNA, 22 bp, Homo sapiens
tcttccagcttctggtggctgc

SEQ ID NO: 7725534 - DNA, 22 bp, Homo sapiens
tcttccagcttctggtggctgc

SEQ ID NO: 7725535 - DNA, 20 bp, Homo sapiens
tcttccagcttctggtagaa

SEQ ID NO: 7725536 - DNA, 18 bp, Homo sapiens
tcttccagcttctggagg

SEQ ID NO: 7725537 - DNA, 22 bp, Homo sapiens
tcttccagcttctagaggatgc

SEQ ID NO: 7725538 - DNA, 22 bp, Homo sapiens
tcttccagcttctagaggatgc

SEQ ID NO: 7725539 - DNA, 22 bp, Homo sapiens
tcttccagcttctagaggatgc

SEQ ID NO: 7725540 - DNA, 22 bp, Homo sapiens
tcttccagctgtaggacctagg

SEQ ID NO: 7725541 - DNA, 22 bp, Homo sapiens
tcttccagctgtaggacctagg

SEQ ID NO: 7725542 - DNA, 22 bp, Homo sapiens
tcttccagctgtaggacctagg

SEQ ID NO: 7725543 - DNA, 22 bp, Homo sapiens
tcttccagctgtaggacctagg

SEQ ID NO: 7725544 - DNA, 20 bp, Homo sapiens
tcttccagcttctggtagaa

SEQ ID NO: 7725545 - DNA, 18 bp, Homo sapiens
tcttccagcttctggagg

SEQ ID NO: 7725546 - DNA, 20 bp, Homo sapiens
tcttccagcttctggtagaa

SEQ ID NO: 7725547 - DNA, 20 bp, Homo sapiens
tcttccagcttctggtagaa

SEQ ID NO: 7725548 - DNA, 20 bp, Homo sapiens
tcttccagcttctggtagaa

SEQ ID NO: 7725549 - DNA, 20 bp, Homo sapiens
tcttccagcttctggtagaa

SEQ ID NO: 7725550 - DNA, 18 bp, Homo sapiens
tcttccagcttctggagg

SEQ ID NO: 7725551 - DNA, 18 bp, Homo sapiens
tcttccagcttctggagg

SEQ ID NO: 7725552 - DNA, 18 bp, Homo sapiens
tcttccagcttctggagg

SEQ ID NO: 7725553 - DNA, 18 bp, Homo sapiens
tcttccagcttctggagg

SEQ ID NO: 7725554 - DNA, 22 bp, Homo sapiens
tcttccaggagggtgggcaaac

SEQ ID NO: 7725555 - DNA, 22 bp, Homo sapiens
tcttccaggagggcatttcttt

SEQ ID NO: 7725556 - DNA, 22 bp, Homo sapiens
tcttccaggagggtgggcaaac

SEQ ID NO: 7725557 - DNA, 22 bp, Homo sapiens
tcttccaggagggtgggcaaac

SEQ ID NO: 7725558 - DNA, 22 bp, Homo sapiens
tcttccaggagggtgggcaaac

SEQ ID NO: 7725559 - DNA, 22 bp, Homo sapiens
tcttccaggccctgccacagct

SEQ ID NO: 7725560 - DNA, 22 bp, Homo sapiens
tcttccaggccctgccacagct

SEQ ID NO: 7725561 - DNA, 22 bp, Homo sapiens
tcttccaggccctgccacagct

SEQ ID NO: 7725562 - DNA, 22 bp, Homo sapiens
tcttccaggccctgccacagct

SEQ ID NO: 7725563 - DNA, 22 bp, Homo sapiens
tcttccaggctagagttgttgc

SEQ ID NO: 7725564 - DNA, 22 bp, Homo sapiens
tcttccaggctagagttgttgc

SEQ ID NO: 7725565 - DNA, 22 bp, Homo sapiens
tcttccagggagcctcaaacct

SEQ ID NO: 7725566 - DNA, 22 bp, Homo sapiens
tcttccagggagcctcaaacct

SEQ ID NO: 7725567 - DNA, 20 bp, Homo sapiens
tcttccaggtacagtctgca

SEQ ID NO: 7725568 - DNA, 20 bp, Homo sapiens
tcttccaggtacagtctgca

SEQ ID NO: 7725569 - DNA, 20 bp, Homo sapiens
tcttccaggtacagtctgca

SEQ ID NO: 7725570 - DNA, 20 bp, Homo sapiens
tcttccaggtacagtctgca

SEQ ID NO: 7725571 - DNA, 21 bp, Homo sapiens
tcttcctccacagcgtgccac

SEQ ID NO: 7725572 - DNA, 20 bp, Homo sapiens
tcttccaggtacagtctgca

SEQ ID NO: 7725573 - DNA, 22 bp, Homo sapiens
tcttcctccctacagagctcag

SEQ ID NO: 7725574 - DNA, 21 bp, Homo sapiens
tcttcctccacagcgtgccac

SEQ ID NO: 7725575 - DNA, 22 bp, Homo sapiens
tcttcctccctacagagctcag

SEQ ID NO: 7725576 - DNA, 22 bp, Homo sapiens
tcttcctccctacagagctcag

SEQ ID NO: 7725577 - DNA, 22 bp, Homo sapiens
tcttcctctagatctgaggccc

SEQ ID NO: 7725578 - DNA, 22 bp, Homo sapiens
tcttcctccctacagagctcag

SEQ ID NO: 7725579 - DNA, 22 bp, Homo sapiens
tcttcctccctacagagctcag

SEQ ID NO: 7725580 - DNA, 22 bp, Homo sapiens
tcttcctccctacagagctcag

SEQ ID NO: 7725581 - DNA, 22 bp, Homo sapiens
tcttcctccctacagagctcag

SEQ ID NO: 7725582 - DNA, 22 bp, Homo sapiens
tcttcctccctacagagctcag

SEQ ID NO: 7725583 - DNA, 22 bp, Homo sapiens
tcttcctctagatctgaggccc

SEQ ID NO: 7725584 - DNA, 22 bp, Homo sapiens
tcttcctctagatctgaggccc

SEQ ID NO: 7725585 - DNA, 22 bp, Homo sapiens
tcttcctctagatctgaggccc

SEQ ID NO: 7725586 - DNA, 22 bp, Homo sapiens
tcttcctctctaattgatcaga

SEQ ID NO: 7725587 - DNA, 22 bp, Homo sapiens
tcttcctctagatctgaggccc

SEQ ID NO: 7725588 - DNA, 22 bp, Homo sapiens
tcttcctctagatctgaggccc

SEQ ID NO: 7725589 - DNA, 22 bp, Homo sapiens
tcttcctctctaattgatcaga

SEQ ID NO: 7725590 - DNA, 22 bp, Homo sapiens
tcttcctctctaattgatcaga

SEQ ID NO: 7725591 - DNA, 22 bp, Homo sapiens
tcttcctctctaattgatcaga

SEQ ID NO: 7725592 - DNA, 22 bp, Homo sapiens
tcttcctcttctgctgagaagt

SEQ ID NO: 7725593 - DNA, 22 bp, Homo sapiens
tcttcctctctaattgatcaga

SEQ ID NO: 7725594 - DNA, 22 bp, Homo sapiens
tcttcctcttctgctgagaagt

SEQ ID NO: 7725595 - DNA, 23 bp, Homo sapiens
tcttcctgaactatcaggcacat

SEQ ID NO: 7725596 - DNA, 22 bp, Homo sapiens
tcttcctcttctgctgagaagt

SEQ ID NO: 7725597 - DNA, 22 bp, Homo sapiens
tcttcctcttctgctgagaagt

SEQ ID NO: 7725598 - DNA, 22 bp, Homo sapiens
tcttcctgaaaccctgttccag

SEQ ID NO: 7725599 - DNA, 22 bp, Homo sapiens
tcttcctgaaaccctgttccag

SEQ ID NO: 7725600 - DNA, 21 bp, Homo sapiens
tcttcctgctccacactcccc

SEQ ID NO: 7725601 - DNA, 21 bp, Homo sapiens
tcttcctgctccacactcccc

SEQ ID NO: 7725602 - DNA, 21 bp, Homo sapiens
tcttcctgacatatgcaaggc

SEQ ID NO: 7725603 - DNA, 21 bp, Homo sapiens
tcttcctgacatatgcaaggc

SEQ ID NO: 7725604 - DNA, 23 bp, Homo sapiens
tcttcctgaactatcaggcacat

SEQ ID NO: 7725605 - DNA, 21 bp, Homo sapiens
tcttcctgacatatgcaaggc

SEQ ID NO: 7725606 - DNA, 23 bp, Homo sapiens
tcttcctgaactatcaggcacat

SEQ ID NO: 7725607 - DNA, 21 bp, Homo sapiens
tcttcctgacatatgcaaggc

SEQ ID NO: 7725608 - DNA, 23 bp, Homo sapiens
tcttcctgaactatcaggcacat

SEQ ID NO: 7725609 - DNA, 18 bp, Homo sapiens
tcttccaacactgacacc

SEQ ID NO: 7725610 - DNA, 21 bp, Homo sapiens
tcttccaagggctgctgagac

SEQ ID NO: 7725611 - DNA, 21 bp, Homo sapiens
tcttccaagggctgctgagac

SEQ ID NO: 7725612 - DNA, 21 bp, Homo sapiens
tcttccaagggctgctgagac

SEQ ID NO: 7725613 - DNA, 22 bp, Homo sapiens
tcttccaaggttgcacactatc

SEQ ID NO: 7725614 - DNA, 22 bp, Homo sapiens
tcttccaaggttgcacactatc

SEQ ID NO: 7725615 - DNA, 22 bp, Homo sapiens
tcttccaaggtgcagatcttct

SEQ ID NO: 7725616 - DNA, 22 bp, Homo sapiens
tcttccaaggtgcagatcttct

SEQ ID NO: 7725617 - DNA, 22 bp, Homo sapiens
tcttccaaggtgcagatcttct

SEQ ID NO: 7725618 - DNA, 22 bp, Homo sapiens
tcttccaaggttgcacactatc

SEQ ID NO: 7725619 - DNA, 22 bp, Homo sapiens
tcttccaatacctagattttgg

SEQ ID NO: 7725620 - DNA, 22 bp, Homo sapiens
tcttccaatacctagattttgg

SEQ ID NO: 7725621 - DNA, 22 bp, Homo sapiens
tcttccaatggtttctagattt

SEQ ID NO: 7725622 - DNA, 22 bp, Homo sapiens
tcttccaatggtttctagattt

SEQ ID NO: 7725623 - DNA, 22 bp, Homo sapiens
tcttccaattagaatatttggg

SEQ ID NO: 7725624 - DNA, 22 bp, Homo sapiens
tcttccaattagaatatttggg

SEQ ID NO: 7725625 - DNA, 22 bp, Homo sapiens
tcttccacttgcaagtttatgg

SEQ ID NO: 7725626 - DNA, 22 bp, Homo sapiens
tcttcattttgaagaggcagaa

SEQ ID NO: 7725627 - DNA, 22 bp, Homo sapiens
tcttccaaaattagtctcagtt

SEQ ID NO: 7725628 - DNA, 22 bp, Homo sapiens
tcttccaaatgaatatggtttt

SEQ ID NO: 7725629 - DNA, 22 bp, Homo sapiens
tcttccaaaattagtctcagtt

SEQ ID NO: 7725630 - DNA, 18 bp, Homo sapiens
tcttccaacactgacacc

SEQ ID NO: 7725631 - DNA, 22 bp, Homo sapiens
tcttccaaatgcagctaaagct

SEQ ID NO: 7725632 - DNA, 22 bp, Homo sapiens
tcttccaaatgcagctaaagct

SEQ ID NO: 7725633 - DNA, 22 bp, Homo sapiens
tcttccaaatgaatatggtttt

SEQ ID NO: 7725634 - DNA, 22 bp, Homo sapiens
tcttccaaatgaatatggtttt

SEQ ID NO: 7725635 - DNA, 22 bp, Homo sapiens
tcttcattttacaggcagacct

SEQ ID NO: 7725636 - DNA, 22 bp, Homo sapiens
tcttcattctcgcctttgtcgt

SEQ ID NO: 7725637 - DNA, 22 bp, Homo sapiens
tcttcattctcgcctttgtcgt

SEQ ID NO: 7725638 - DNA, 22 bp, Homo sapiens
tcttcattccgtagatatttat

SEQ ID NO: 7725639 - DNA, 22 bp, Homo sapiens
tcttcatgttgcttattctggg

SEQ ID NO: 7725640 - DNA, 22 bp, Homo sapiens
tcttcatgttgcttattctggg

SEQ ID NO: 7725641 - DNA, 22 bp, Homo sapiens
tcttcattccgtagatatttat

SEQ ID NO: 7725642 - DNA, 22 bp, Homo sapiens
tcttcattccgtagatatttat

SEQ ID NO: 7725643 - DNA, 22 bp, Homo sapiens
tcttcattccgtagatatttat

SEQ ID NO: 7725644 - DNA, 22 bp, Homo sapiens
tcttccagctcatattctatca

SEQ ID NO: 7725645 - DNA, 22 bp, Homo sapiens
tcttccagctcatattctatca

SEQ ID NO: 7725646 - DNA, 22 bp, Homo sapiens
tcttccagctccccacggtgtc

SEQ ID NO: 7725647 - DNA, 22 bp, Homo sapiens
tcttccagctccccacggtgtc

SEQ ID NO: 7725648 - DNA, 22 bp, Homo sapiens
tcttccagctccccacggtgtc

SEQ ID NO: 7725649 - DNA, 22 bp, Homo sapiens
tcttccagctccccacggtgtc

SEQ ID NO: 7725650 - DNA, 22 bp, Homo sapiens
tcttccagccaatagcgtcctt

SEQ ID NO: 7725651 - DNA, 22 bp, Homo sapiens
tcttccagccaatagcgtcctt

SEQ ID NO: 7725652 - DNA, 22 bp, Homo sapiens
tcttccagcccttctaatggta

SEQ ID NO: 7725653 - DNA, 22 bp, Homo sapiens
tcttccagcccttctaatggta

SEQ ID NO: 7725654 - DNA, 22 bp, Homo sapiens
tcttccagcccttctaatggta

SEQ ID NO: 7725655 - DNA, 22 bp, Homo sapiens
tcttccagcccttctaatggta

SEQ ID NO: 7725656 - DNA, 22 bp, Homo sapiens
tcttccagccaatagcgtcctt

SEQ ID NO: 7725657 - DNA, 22 bp, Homo sapiens
tcttccagccaatagcgtcctt

SEQ ID NO: 7725658 - DNA, 22 bp, Homo sapiens
tcttccagccaatagcgtcctt

SEQ ID NO: 7725659 - DNA, 22 bp, Homo sapiens
tcttccagccaatagcgtcctt

SEQ ID NO: 7725660 - DNA, 22 bp, Homo sapiens
tcttccagccaatagcgtcctt

SEQ ID NO: 7725661 - DNA, 19 bp, Homo sapiens
tcttccagcatctgggggc

SEQ ID NO: 7725662 - DNA, 19 bp, Homo sapiens
tcttccagcatctgggggc

SEQ ID NO: 7725663 - DNA, 19 bp, Homo sapiens
tcttccagcatctgggggc

SEQ ID NO: 7725664 - DNA, 19 bp, Homo sapiens
tcttccagcatctgggggc

SEQ ID NO: 7725665 - DNA, 22 bp, Homo sapiens
tcttccagcaatgtgaaatcac

SEQ ID NO: 7725666 - DNA, 22 bp, Homo sapiens
tcttccagcaatgtgaaatcac

SEQ ID NO: 7725667 - DNA, 22 bp, Homo sapiens
tcttccagatggttctttagct

SEQ ID NO: 7725668 - DNA, 22 bp, Homo sapiens
tcttccagatggttctttagct

SEQ ID NO: 7725669 - DNA, 22 bp, Homo sapiens
tcttccagcaatgtgaaatcac

SEQ ID NO: 7725670 - DNA, 22 bp, Homo sapiens
tcttccagcaatgtgaaatcac

SEQ ID NO: 7725671 - DNA, 22 bp, Homo sapiens
tcttccagcaatgtgaaatcac

SEQ ID NO: 7725672 - DNA, 22 bp, Homo sapiens
tcttccagcaatgtgaaatcac

SEQ ID NO: 7725673 - DNA, 20 bp, Homo sapiens
tcttccagagacattttccc

SEQ ID NO: 7725674 - DNA, 20 bp, Homo sapiens
tcttccagagacattttccc

SEQ ID NO: 7725675 - DNA, 22 bp, Homo sapiens
tcttccagagcctccatcccta

SEQ ID NO: 7725676 - DNA, 22 bp, Homo sapiens
tcttccagagcctccatcccta

SEQ ID NO: 7725677 - DNA, 22 bp, Homo sapiens
tcttccagagcctccatcccta

SEQ ID NO: 7725678 - DNA, 22 bp, Homo sapiens
tcttccagatacttcctgactt

SEQ ID NO: 7725679 - DNA, 22 bp, Homo sapiens
tcttccagatacttcctgactt

SEQ ID NO: 7725680 - DNA, 22 bp, Homo sapiens
tcttccagatacttcctgactt

SEQ ID NO: 7725681 - DNA, 22 bp, Homo sapiens
tcttccagatacttcctgactt

SEQ ID NO: 7725682 - DNA, 22 bp, Homo sapiens
tcttccagatgcagatgcttct

SEQ ID NO: 7725683 - DNA, 22 bp, Homo sapiens
tcttccagatacttcctgactt

SEQ ID NO: 7725684 - DNA, 22 bp, Homo sapiens
tcttccagatgcagatgcttct

SEQ ID NO: 7725685 - DNA, 22 bp, Homo sapiens
tcttccagatgcagatgcttct

SEQ ID NO: 7725686 - DNA, 22 bp, Homo sapiens
tcttccagatgcagatgcttct

SEQ ID NO: 7725687 - DNA, 22 bp, Homo sapiens
tcttccagatgcagatgcttct

SEQ ID NO: 7725688 - DNA, 22 bp, Homo sapiens
tcttccagatgcagatgcttct

SEQ ID NO: 7725689 - DNA, 22 bp, Homo sapiens
tcttccagaatgcattctcttt

SEQ ID NO: 7725690 - DNA, 22 bp, Homo sapiens
tcttccagaatgcattctcttt

SEQ ID NO: 7725691 - DNA, 22 bp, Homo sapiens
tcttccagaatgcattctcttt

SEQ ID NO: 7725692 - DNA, 22 bp, Homo sapiens
tcttccagaagtgttttcagaa

SEQ ID NO: 7725693 - DNA, 22 bp, Homo sapiens
tcttccagaatctcagagggct

SEQ ID NO: 7725694 - DNA, 22 bp, Homo sapiens
tcttccagaagtgttttcagaa

SEQ ID NO: 7725695 - DNA, 22 bp, Homo sapiens
tcttccagaatctcagagggct

SEQ ID NO: 7725696 - DNA, 22 bp, Homo sapiens
tcttccagaatctcagagggct

SEQ ID NO: 7725697 - DNA, 22 bp, Homo sapiens
tcttcatacaatttcagacatc

SEQ ID NO: 7725698 - DNA, 22 bp, Homo sapiens
tcttcatacaatttcagacatc

SEQ ID NO: 7725699 - DNA, 22 bp, Homo sapiens
tcttcatacaatttcagacatc

SEQ ID NO: 7725700 - DNA, 22 bp, Homo sapiens
tcttcatactcatcacataggt

SEQ ID NO: 7725701 - DNA, 22 bp, Homo sapiens
tcttcatacaatttcagacatc

SEQ ID NO: 7725702 - DNA, 22 bp, Homo sapiens
tcttcatactcatcacataggt

SEQ ID NO: 7725703 - DNA, 22 bp, Homo sapiens
tcttcatactcatcacataggt

SEQ ID NO: 7725704 - DNA, 22 bp, Homo sapiens
tcttcatctcagattaacagga

SEQ ID NO: 7725705 - DNA, 22 bp, Homo sapiens
tcttcatatataaagtggaata

SEQ ID NO: 7725706 - DNA, 22 bp, Homo sapiens
tcttcatgaatgaatctttgac

SEQ ID NO: 7725707 - DNA, 22 bp, Homo sapiens
tcttcatgacctctgtgtttta

SEQ ID NO: 7725708 - DNA, 22 bp, Homo sapiens
tcttcatgataccctaagccac

SEQ ID NO: 7725709 - DNA, 22 bp, Homo sapiens
tcttcatgcacctcacagctag

SEQ ID NO: 7725710 - DNA, 18 bp, Homo sapiens
tcttcatctcctgagctg

SEQ ID NO: 7725711 - DNA, 22 bp, Homo sapiens
tcttcatgaaattgattgctta

SEQ ID NO: 7725712 - DNA, 18 bp, Homo sapiens
tcttcatctcctgagctg

SEQ ID NO: 7725713 - DNA, 22 bp, Homo sapiens
tcttcatgtatactcatggtac

SEQ ID NO: 7725714 - DNA, 22 bp, Homo sapiens
tcttcatgtatttgacaaccat

SEQ ID NO: 7725715 - DNA, 22 bp, Homo sapiens
tcttcatgtcatggtatattga

SEQ ID NO: 7725716 - DNA, 22 bp, Homo sapiens
tcttcatgtctctgcttgagtc

SEQ ID NO: 7725717 - DNA, 22 bp, Homo sapiens
tcttcatgttagttgggttttc

SEQ ID NO: 7725718 - DNA, 22 bp, Homo sapiens
tcttcatgttgctgtagggaga

SEQ ID NO: 7725719 - DNA, 22 bp, Homo sapiens
tcttcatgttgcttattctggg

SEQ ID NO: 7725720 - DNA, 22 bp, Homo sapiens
tcttcatgtcttgcctgatata

SEQ ID NO: 7725721 - DNA, 22 bp, Homo sapiens
tcttcatgcacctcacagctag

SEQ ID NO: 7725722 - DNA, 22 bp, Homo sapiens
tcttcatgccaaatgagttttg

SEQ ID NO: 7725723 - DNA, 22 bp, Homo sapiens
tcttcatgccaaatgagttttg

SEQ ID NO: 7725724 - DNA, 23 bp, Homo sapiens
tcttcatggccatctggttcttc

SEQ ID NO: 7725725 - DNA, 22 bp, Homo sapiens
tcttcatggtctggttctccag

SEQ ID NO: 7725726 - DNA, 23 bp, Homo sapiens
tcttcatgcccaggccttggtgc

SEQ ID NO: 7725727 - DNA, 22 bp, Homo sapiens
tcttcaggaagggaaatcatcc

SEQ ID NO: 7725728 - DNA, 22 bp, Homo sapiens
tcttcaggaagggaaatcatcc

SEQ ID NO: 7725729 - DNA, 22 bp, Homo sapiens
tcttcaggaagggaaatcatcc

SEQ ID NO: 7725730 - DNA, 22 bp, Homo sapiens
tcttcaggagctgaaagcctgc

SEQ ID NO: 7725731 - DNA, 22 bp, Homo sapiens
tcttcaggagctgaaagcctgc

SEQ ID NO: 7725732 - DNA, 22 bp, Homo sapiens
tcttcaggaagggaaatcatcc

SEQ ID NO: 7725733 - DNA, 22 bp, Homo sapiens
tcttcagggtctgccccagggg

SEQ ID NO: 7725734 - DNA, 22 bp, Homo sapiens
tcttcagggtatgggaaaggga

SEQ ID NO: 7725735 - DNA, 22 bp, Homo sapiens
tcttcagggtatgggaaaggga

SEQ ID NO: 7725736 - DNA, 22 bp, Homo sapiens
tcttcaggctctggctgccttt

SEQ ID NO: 7725737 - DNA, 22 bp, Homo sapiens
tcttcaggctctggctgccttt

SEQ ID NO: 7725738 - DNA, 21 bp, Homo sapiens
tcttcagtacacttgcacgcc

SEQ ID NO: 7725739 - DNA, 22 bp, Homo sapiens
tcttcaggttaacttgtctttt

SEQ ID NO: 7725740 - DNA, 22 bp, Homo sapiens
tcttcaggttaacttgtctttt

SEQ ID NO: 7725741 - DNA, 22 bp, Homo sapiens
tcttcaggtagtgagtggggtg

SEQ ID NO: 7725742 - DNA, 22 bp, Homo sapiens
tcttcagggtctgccccagggg

SEQ ID NO: 7725743 - DNA, 22 bp, Homo sapiens
tcttcagcagggcctctctgag

SEQ ID NO: 7725744 - DNA, 22 bp, Homo sapiens
tcttcagcagagaattatgatg

SEQ ID NO: 7725745 - DNA, 20 bp, Homo sapiens
tcttcagcactccttaggta

SEQ ID NO: 7725746 - DNA, 22 bp, Homo sapiens
tcttcaggaagggaaatcatcc

SEQ ID NO: 7725747 - DNA, 22 bp, Homo sapiens
tcttcagctctgaggctctggc

SEQ ID NO: 7725748 - DNA, 21 bp, Homo sapiens
tcttcagcagtggtgaggtgg

SEQ ID NO: 7725749 - DNA, 21 bp, Homo sapiens
tcttcagcagtggtgaggtgg

SEQ ID NO: 7725750 - DNA, 23 bp, Homo sapiens
tcttcagtgagaccagcaaggcc

SEQ ID NO: 7725751 - DNA, 22 bp, Homo sapiens
tcttcagtgcacctgatgtctt

SEQ ID NO: 7725752 - DNA, 22 bp, Homo sapiens
tcttcagtgcatgccctcaggc

SEQ ID NO: 7725753 - DNA, 22 bp, Homo sapiens
tcttcagtgcatgccctcaggc

SEQ ID NO: 7725754 - DNA, 22 bp, Homo sapiens
tcttcagtgcatgttacctata

SEQ ID NO: 7725755 - DNA, 22 bp, Homo sapiens
tcttcagtgcatgttacctata

SEQ ID NO: 7725756 - DNA, 22 bp, Homo sapiens
tcttcagttgtaaaagtgttgg

SEQ ID NO: 7725757 - DNA, 22 bp, Homo sapiens
tcttcagttgtcatactgcctt

SEQ ID NO: 7725758 - DNA, 22 bp, Homo sapiens
tcttcagttgtcatactgcctt

SEQ ID NO: 7725759 - DNA, 22 bp, Homo sapiens
tcttcagtatttggataacatt

SEQ ID NO: 7725760 - DNA, 22 bp, Homo sapiens
tcttcagtaggtcctcagaatc

SEQ ID NO: 7725761 - DNA, 22 bp, Homo sapiens
tcttcagtaggtcctcagaatc

SEQ ID NO: 7725762 - DNA, 22 bp, Homo sapiens
tcttcagtatttggataacatt

SEQ ID NO: 7725763 - DNA, 22 bp, Homo sapiens
tcttcagtgcacctgatgtctt

SEQ ID NO: 7725764 - DNA, 22 bp, Homo sapiens
tcttcagtcaatccagatgttt

SEQ ID NO: 7725765 - DNA, 22 bp, Homo sapiens
tcttcagtcaatccagatgttt

SEQ ID NO: 7725766 - DNA, 22 bp, Homo sapiens
tcttcagtgaatggcaagatct

SEQ ID NO: 7725767 - DNA, 22 bp, Homo sapiens
tcttcagtgaatggcaagatct

SEQ ID NO: 7725768 - DNA, 22 bp, Homo sapiens
tcttcaaagaattttagtaatt

SEQ ID NO: 7725769 - DNA, 22 bp, Homo sapiens
tcttcaaagaattttagtaatt

SEQ ID NO: 7725770 - DNA, 22 bp, Homo sapiens
tcttcaaagaattttagtaatt

SEQ ID NO: 7725771 - DNA, 22 bp, Homo sapiens
tcttcaaatacagtcatattga

SEQ ID NO: 7725772 - DNA, 22 bp, Homo sapiens
tcttcaaatacagtcatattga

SEQ ID NO: 7725773 - DNA, 22 bp, Homo sapiens
tcttcaaatacagtcatattga

SEQ ID NO: 7725774 - DNA, 22 bp, Homo sapiens
tcttcaaatacagtcatattga

SEQ ID NO: 7725775 - DNA, 22 bp, Homo sapiens
tcttcaaagcatatgcaggcat

SEQ ID NO: 7725776 - DNA, 22 bp, Homo sapiens
tcttcaaactgaaaatttagaa

SEQ ID NO: 7725777 - DNA, 22 bp, Homo sapiens
tcttcaaagaagccttggatta

SEQ ID NO: 7725778 - DNA, 22 bp, Homo sapiens
tcttcaaagaagccttggatta

SEQ ID NO: 7725779 - DNA, 22 bp, Homo sapiens
tcttcaaagaattttagtaatt

SEQ ID NO: 7725780 - DNA, 22 bp, Homo sapiens
tcttcaaagaagccttggatta

SEQ ID NO: 7725781 - DNA, 22 bp, Homo sapiens
tcttcaaaaactgcaccttgct

SEQ ID NO: 7725782 - DNA, 22 bp, Homo sapiens
tcttcaaaaatacaggttttca

SEQ ID NO: 7725783 - DNA, 22 bp, Homo sapiens
tcttcaaaaaatatccatcagt

SEQ ID NO: 7725784 - DNA, 22 bp, Homo sapiens
tcttcaaaaaatatccatcagt

SEQ ID NO: 7725785 - DNA, 22 bp, Homo sapiens
tcttcaaaaaatatccatcagt

SEQ ID NO: 7725786 - DNA, 22 bp, Homo sapiens
tcttcaaaaaatatccatcagt

SEQ ID NO: 7725787 - DNA, 22 bp, Homo sapiens
tcttcaaactgaaaatttagaa

SEQ ID NO: 7725788 - DNA, 22 bp, Homo sapiens
tcttcaaaattgattggagaag

SEQ ID NO: 7725789 - DNA, 22 bp, Homo sapiens
tcttcaaaattgattggagaag

SEQ ID NO: 7725790 - DNA, 22 bp, Homo sapiens
tcttcaaaaatacaggttttca

SEQ ID NO: 7725791 - DNA, 22 bp, Homo sapiens
tcttcaaaatattccatccatt

SEQ ID NO: 7725792 - DNA, 22 bp, Homo sapiens
tcttattgtgatgatgaagaac

SEQ ID NO: 7725793 - DNA, 22 bp, Homo sapiens
tcttattgtgatgatgaagaac

SEQ ID NO: 7725794 - DNA, 22 bp, Homo sapiens
tcttattgtttaaaagtacaca

SEQ ID NO: 7725795 - DNA, 22 bp, Homo sapiens
tcttatttgcaactggctcaga

SEQ ID NO: 7725796 - DNA, 22 bp, Homo sapiens
tcttatttgcaactggctcaga

SEQ ID NO: 7725797 - DNA, 22 bp, Homo sapiens
tcttatttgcaactggctcaga

SEQ ID NO: 7725798 - DNA, 22 bp, Homo sapiens
tcttatttagagaggactagag

SEQ ID NO: 7725799 - DNA, 22 bp, Homo sapiens
tcttatttagagaggactagag

SEQ ID NO: 7725800 - DNA, 22 bp, Homo sapiens
tcttatttgcaactggctcaga

SEQ ID NO: 7725801 - DNA, 22 bp, Homo sapiens
tcttatttgcaactggctcaga

SEQ ID NO: 7725802 - DNA, 22 bp, Homo sapiens
tcttatttagagaggactagag

SEQ ID NO: 7725803 - DNA, 22 bp, Homo sapiens
tcttattttttaatgacagaga

SEQ ID NO: 7725804 - DNA, 22 bp, Homo sapiens
tcttattttttaatgacagaga

SEQ ID NO: 7725805 - DNA, 22 bp, Homo sapiens
tcttattttttaatgacagaga

SEQ ID NO: 7725806 - DNA, 22 bp, Homo sapiens
tcttattttttaatgacagaga

SEQ ID NO: 7725807 - DNA, 22 bp, Homo sapiens
tcttattttttaatgacagaga

SEQ ID NO: 7725808 - DNA, 22 bp, Homo sapiens
tcttattttgttagatgctgta

SEQ ID NO: 7725809 - DNA, 22 bp, Homo sapiens
tcttattttgttagatgctgta

SEQ ID NO: 7725810 - DNA, 22 bp, Homo sapiens
tcttattttagagccccgagcc

SEQ ID NO: 7725811 - DNA, 22 bp, Homo sapiens
tcttatttgcaactggctcaga

SEQ ID NO: 7725812 - DNA, 22 bp, Homo sapiens
tcttatttgcaactggctcaga

SEQ ID NO: 7725813 - DNA, 19 bp, Homo sapiens
tcttattgagcagctgagg

SEQ ID NO: 7725814 - DNA, 19 bp, Homo sapiens
tcttattgagcagctgagg

SEQ ID NO: 7725815 - DNA, 22 bp, Homo sapiens
tcttattggtaatgatggcatt

SEQ ID NO: 7725816 - DNA, 22 bp, Homo sapiens
tcttattgtctagattgagatg

SEQ ID NO: 7725817 - DNA, 22 bp, Homo sapiens
tcttattgtctagattgagatg

SEQ ID NO: 7725818 - DNA, 22 bp, Homo sapiens
tcttatgggaaagatgtaatta

SEQ ID NO: 7725819 - DNA, 22 bp, Homo sapiens
tcttatgtcaagaatgaatatt

SEQ ID NO: 7725820 - DNA, 22 bp, Homo sapiens
tcttatgtgctgtgagattttt

SEQ ID NO: 7725821 - DNA, 22 bp, Homo sapiens
tcttattattgttgtaaaagca

SEQ ID NO: 7725822 - DNA, 22 bp, Homo sapiens
tcttattattgttgtaaaagca

SEQ ID NO: 7725823 - DNA, 22 bp, Homo sapiens
tcttattattgttgtaaaagca

SEQ ID NO: 7725824 - DNA, 22 bp, Homo sapiens
tcttcacagatgcatatacttc

SEQ ID NO: 7725825 - DNA, 22 bp, Homo sapiens
tcttcacagatgcatatacttc

SEQ ID NO: 7725826 - DNA, 22 bp, Homo sapiens
tcttcacagctttgtccagaag

SEQ ID NO: 7725827 - DNA, 22 bp, Homo sapiens
tcttcacagctttgtccagaag

SEQ ID NO: 7725828 - DNA, 22 bp, Homo sapiens
tcttcacaggagcctgcctgcc

SEQ ID NO: 7725829 - DNA, 22 bp, Homo sapiens
tcttcacatattccttgagcta

SEQ ID NO: 7725830 - DNA, 22 bp, Homo sapiens
tcttcacaggagcctgcctgcc

SEQ ID NO: 7725831 - DNA, 23 bp, Homo sapiens
tcttcacagggcttcccatgtgc

SEQ ID NO: 7725832 - DNA, 23 bp, Homo sapiens
tcttcacagggcttcccatgtgc

SEQ ID NO: 7725833 - DNA, 22 bp, Homo sapiens
tcttcacagtcctggtcagtgg

SEQ ID NO: 7725834 - DNA, 22 bp, Homo sapiens
tcttcacagtcctggtcagtgg

SEQ ID NO: 7725835 - DNA, 22 bp, Homo sapiens
tcttcagattgcactgagcaag

SEQ ID NO: 7725836 - DNA, 22 bp, Homo sapiens
tcttcagcaactccccaatctg

SEQ ID NO: 7725837 - DNA, 22 bp, Homo sapiens
tcttcagattgcactgagcaag

SEQ ID NO: 7725838 - DNA, 22 bp, Homo sapiens
tcttcagatggccagttgtccc

SEQ ID NO: 7725839 - DNA, 22 bp, Homo sapiens
tcttcagatggccagttgtccc

SEQ ID NO: 7725840 - DNA, 22 bp, Homo sapiens
tcttcacatggaacatgaagct

SEQ ID NO: 7725841 - DNA, 22 bp, Homo sapiens
tcttcacatgaccttcatgtct

SEQ ID NO: 7725842 - DNA, 22 bp, Homo sapiens
tcttcacatgaccttcatgtct

SEQ ID NO: 7725843 - DNA, 22 bp, Homo sapiens
tcttcacatgaccttcatgtct

SEQ ID NO: 7725844 - DNA, 22 bp, Homo sapiens
tcttcacatcatgttttttaat

SEQ ID NO: 7725845 - DNA, 22 bp, Homo sapiens
tcttcacatggaacatgaagct

SEQ ID NO: 7725846 - DNA, 22 bp, Homo sapiens
tcttcacatggaacatgaagct

SEQ ID NO: 7725847 - DNA, 22 bp, Homo sapiens
tcttcaaatgctagtaatatca

SEQ ID NO: 7725848 - DNA, 22 bp, Homo sapiens
tcttcaagaatatattgctgtc

SEQ ID NO: 7725849 - DNA, 22 bp, Homo sapiens
tcttcaatatgtgtttaatatt

SEQ ID NO: 7725850 - DNA, 22 bp, Homo sapiens
tcttcaaatgctagtaatatca

SEQ ID NO: 7725851 - DNA, 22 bp, Homo sapiens
tcttcaaatgctagtaatatca

SEQ ID NO: 7725852 - DNA, 22 bp, Homo sapiens
tcttcaaatgctagtaatatca

SEQ ID NO: 7725853 - DNA, 22 bp, Homo sapiens
tcttcaaatcctacagtgtctg

SEQ ID NO: 7725854 - DNA, 22 bp, Homo sapiens
tcttcaaatcctacagtgtctg

SEQ ID NO: 7725855 - DNA, 22 bp, Homo sapiens
tcttcaaatacagtcatattga

SEQ ID NO: 7725856 - DNA, 22 bp, Homo sapiens
tcttcaatatgtgtttaatatt

SEQ ID NO: 7725857 - DNA, 22 bp, Homo sapiens
tcttcaatgcattctcttgttt

SEQ ID NO: 7725858 - DNA, 22 bp, Homo sapiens
tcttcaagttccaaagtgcagg

SEQ ID NO: 7725859 - DNA, 22 bp, Homo sapiens
tcttcaattagatttaccaatt

SEQ ID NO: 7725860 - DNA, 22 bp, Homo sapiens
tcttcaattagatttaccaatt

SEQ ID NO: 7725861 - DNA, 22 bp, Homo sapiens
tcttcaattagatttaccaatt

SEQ ID NO: 7725862 - DNA, 22 bp, Homo sapiens
tcttcaatttagaatggattta

SEQ ID NO: 7725863 - DNA, 22 bp, Homo sapiens
tcttcaatttagaatggattta

SEQ ID NO: 7725864 - DNA, 22 bp, Homo sapiens
tcttcaatttagaatggattta

SEQ ID NO: 7725865 - DNA, 22 bp, Homo sapiens
tcttcacaccgggcagcaggaa

SEQ ID NO: 7725866 - DNA, 22 bp, Homo sapiens
tcttcacagatgcatatacttc

SEQ ID NO: 7725867 - DNA, 22 bp, Homo sapiens
tcttcacaccgggcagcaggaa

SEQ ID NO: 7725868 - DNA, 22 bp, Homo sapiens
tcttcacacacagtcctctttc

SEQ ID NO: 7725869 - DNA, 22 bp, Homo sapiens
tcttcacaaagctgttgttaaa

SEQ ID NO: 7725870 - DNA, 22 bp, Homo sapiens
tcttgggcatgtgtttgatttc

SEQ ID NO: 7725871 - DNA, 22 bp, Homo sapiens
tcttgggcatgtgtttgatttc

SEQ ID NO: 7725872 - DNA, 22 bp, Homo sapiens
tcttgggcatgtgtttgatttc

SEQ ID NO: 7725873 - DNA, 22 bp, Homo sapiens
tcttgggcatgtgtttgatttc

SEQ ID NO: 7725874 - DNA, 22 bp, Homo sapiens
tcttgggcatgtgtttgatttc

SEQ ID NO: 7725875 - DNA, 22 bp, Homo sapiens
tcttgggcatgtgtttgatttc

SEQ ID NO: 7725876 - DNA, 22 bp, Homo sapiens
tcttgggcatgtgtttgatttc

SEQ ID NO: 7725877 - DNA, 22 bp, Homo sapiens
tcttgggcatgtgtttgatttc

SEQ ID NO: 7725878 - DNA, 22 bp, Homo sapiens
tcttgggcagcttgctcgcccc

SEQ ID NO: 7725879 - DNA, 22 bp, Homo sapiens
tcttgggcacgatgggaggctt

SEQ ID NO: 7725880 - DNA, 20 bp, Homo sapiens
tcttgggcatggatgtctgg

SEQ ID NO: 7725881 - DNA, 22 bp, Homo sapiens
tcttgggcatgcacagactgca

SEQ ID NO: 7725882 - DNA, 22 bp, Homo sapiens
tcttgggcacgatgggaggctt

SEQ ID NO: 7725883 - DNA, 22 bp, Homo sapiens
tcttgggcaatttctctagagg

SEQ ID NO: 7725884 - DNA, 22 bp, Homo sapiens
tcttgggcaatttctctagagg

SEQ ID NO: 7725885 - DNA, 22 bp, Homo sapiens
tcttgggcaatttctctagagg

SEQ ID NO: 7725886 - DNA, 22 bp, Homo sapiens
tcttgggatcacctcctggctt

SEQ ID NO: 7725887 - DNA, 22 bp, Homo sapiens
tcttgggattgccctgcagttc

SEQ ID NO: 7725888 - DNA, 22 bp, Homo sapiens
tcttgggatagtgtctcatggc

SEQ ID NO: 7725889 - DNA, 22 bp, Homo sapiens
tcttgggagtcccaggacatag

SEQ ID NO: 7725890 - DNA, 22 bp, Homo sapiens
tcttgggagtcccaggacatag

SEQ ID NO: 7725891 - DNA, 22 bp, Homo sapiens
tcttgggagtcccaggacatag

SEQ ID NO: 7725892 - DNA, 22 bp, Homo sapiens
tcttgggaccatttacacatac

SEQ ID NO: 7725893 - DNA, 19 bp, Homo sapiens
tcttggctttgtctactgt

SEQ ID NO: 7725894 - DNA, 19 bp, Homo sapiens
tcttggctttgtctactgt

SEQ ID NO: 7725895 - DNA, 19 bp, Homo sapiens
tcttggctttgtctactgt

SEQ ID NO: 7725896 - DNA, 19 bp, Homo sapiens
tcttggctttgtctactgt

SEQ ID NO: 7725897 - DNA, 22 bp, Homo sapiens
tcttgggaaataaacagattga

SEQ ID NO: 7725898 - DNA, 22 bp, Homo sapiens
tcttggcttttcccctatggtc

SEQ ID NO: 7725899 - DNA, 22 bp, Homo sapiens
tcttgggaaatgtttgcgagct

SEQ ID NO: 7725900 - DNA, 22 bp, Homo sapiens
tcttggctgtgcatgcatcttc

SEQ ID NO: 7725901 - DNA, 22 bp, Homo sapiens
tcttggctgtctttgaagttag

SEQ ID NO: 7725902 - DNA, 20 bp, Homo sapiens
tcttggctgtgtgaggacac

SEQ ID NO: 7725903 - DNA, 22 bp, Homo sapiens
tcttggctgtgcatgcatcttc

SEQ ID NO: 7725904 - DNA, 20 bp, Homo sapiens
tcttggctgtgtgaggacac

SEQ ID NO: 7725905 - DNA, 22 bp, Homo sapiens
tcttggcttctgtatttcctgt

SEQ ID NO: 7725906 - DNA, 22 bp, Homo sapiens
tcttggctttctcctagggatg

SEQ ID NO: 7725907 - DNA, 22 bp, Homo sapiens
tcttggctttctcctagggatg

SEQ ID NO: 7725908 - DNA, 22 bp, Homo sapiens
tcttggcttctgtatttcctgt

SEQ ID NO: 7725909 - DNA, 22 bp, Homo sapiens
tcttggctgtctttgaagttag

SEQ ID NO: 7725910 - DNA, 22 bp, Homo sapiens
tcttggctgtaccattgactag

SEQ ID NO: 7725911 - DNA, 22 bp, Homo sapiens
tcttggctgtaccattgactag

SEQ ID NO: 7725912 - DNA, 22 bp, Homo sapiens
tcttggctgtaccattgactag

SEQ ID NO: 7725913 - DNA, 23 bp, Homo sapiens
tcttggctggacaagtcactcac

SEQ ID NO: 7725914 - DNA, 23 bp, Homo sapiens
tcttggctggacaagtcactcac

SEQ ID NO: 7725915 - DNA, 22 bp, Homo sapiens
tcttggctgctgccaatttact

SEQ ID NO: 7725916 - DNA, 22 bp, Homo sapiens
tcttggctggtcatttaaaatc

SEQ ID NO: 7725917 - DNA, 22 bp, Homo sapiens
tcttggctggtttcacattacc

SEQ ID NO: 7725918 - DNA, 22 bp, Homo sapiens
tcttggctggtcatttaaaatc

SEQ ID NO: 7725919 - DNA, 22 bp, Homo sapiens
tcttggctggtttcacattacc

SEQ ID NO: 7725920 - DNA, 22 bp, Homo sapiens
tcttggctattcttgaattctg

SEQ ID NO: 7725921 - DNA, 22 bp, Homo sapiens
tcttggctatccaagttatcca

SEQ ID NO: 7725922 - DNA, 22 bp, Homo sapiens
tcttggctcccttgtaggccct

SEQ ID NO: 7725923 - DNA, 22 bp, Homo sapiens
tcttggctcccttgtaggccct

SEQ ID NO: 7725924 - DNA, 22 bp, Homo sapiens
tcttggctcctcacagcatcag

SEQ ID NO: 7725925 - DNA, 22 bp, Homo sapiens
tcttggctctgccactaattag

SEQ ID NO: 7725926 - DNA, 22 bp, Homo sapiens
tcttggctctgccactaattag

SEQ ID NO: 7725927 - DNA, 22 bp, Homo sapiens
tcttggctcctgttgtcatcag

SEQ ID NO: 7725928 - DNA, 22 bp, Homo sapiens
tcttggctcctgttgtcatcag

SEQ ID NO: 7725929 - DNA, 22 bp, Homo sapiens
tcttggctcctcacagcatcag

SEQ ID NO: 7725930 - DNA, 22 bp, Homo sapiens
tcttggctcctgttgtcatcag

SEQ ID NO: 7725931 - DNA, 22 bp, Homo sapiens
tcttggctcctgttgtcatcag

SEQ ID NO: 7725932 - DNA, 22 bp, Homo sapiens
tcttggctgctgccaatttact

SEQ ID NO: 7725933 - DNA, 22 bp, Homo sapiens
tcttggctgctgccaatttact

SEQ ID NO: 7725934 - DNA, 22 bp, Homo sapiens
tcttggctgctgccaatttact

SEQ ID NO: 7725935 - DNA, 22 bp, Homo sapiens
tcttggctgcgtcctggctgtg

SEQ ID NO: 7725936 - DNA, 22 bp, Homo sapiens
tcttggctgcgtcctggctgtg

SEQ ID NO: 7725937 - DNA, 22 bp, Homo sapiens
tcttggctgcgtcctggctgtg

SEQ ID NO: 7725938 - DNA, 21 bp, Homo sapiens
tcttggctctgccacttatta

SEQ ID NO: 7725939 - DNA, 22 bp, Homo sapiens
tcttggctgcagagccggcaag

SEQ ID NO: 7725940 - DNA, 21 bp, Homo sapiens
tcttggctctgccacttatta

SEQ ID NO: 7725941 - DNA, 21 bp, Homo sapiens
tcttggctctgccacttatta

SEQ ID NO: 7725942 - DNA, 21 bp, Homo sapiens
tcttggggaggagggctgcac

SEQ ID NO: 7725943 - DNA, 21 bp, Homo sapiens
tcttggggaggagggctgcac

SEQ ID NO: 7725944 - DNA, 21 bp, Homo sapiens
tcttggggaggagggctgcac

SEQ ID NO: 7725945 - DNA, 22 bp, Homo sapiens
tctttaatatctgccccagagc

SEQ ID NO: 7725946 - DNA, 21 bp, Homo sapiens
tcttggggaggagggctgcac

SEQ ID NO: 7725947 - DNA, 22 bp, Homo sapiens
tcttgggctgagagatggggta

SEQ ID NO: 7725948 - DNA, 22 bp, Homo sapiens
tcttgggctgagagatggggta

SEQ ID NO: 7725949 - DNA, 22 bp, Homo sapiens
tcttgggctagaatagcaggag

SEQ ID NO: 7725950 - DNA, 22 bp, Homo sapiens
tcttgggctagaatagcaggag

SEQ ID NO: 7725951 - DNA, 22 bp, Homo sapiens
tcttgggcctttagacatgact

SEQ ID NO: 7725952 - DNA, 22 bp, Homo sapiens
tcttgggcctttagacatgact

SEQ ID NO: 7725953 - DNA, 22 bp, Homo sapiens
tcttgggctagaatagcaggag

SEQ ID NO: 7725954 - DNA, 22 bp, Homo sapiens
tcttgggccaatattctgggta

SEQ ID NO: 7725955 - DNA, 22 bp, Homo sapiens
tcttgggcctcaccccagacat

SEQ ID NO: 7725956 - DNA, 22 bp, Homo sapiens
tcttgggcctcaccccagacat

SEQ ID NO: 7725957 - DNA, 22 bp, Homo sapiens
tcttgggcctcaccccagacat

SEQ ID NO: 7725958 - DNA, 22 bp, Homo sapiens
tctttaatgtactttctttcac

SEQ ID NO: 7725959 - DNA, 22 bp, Homo sapiens
tctttaatgtactttctttcac

SEQ ID NO: 7725960 - DNA, 22 bp, Homo sapiens
tctttaatgtactttctttcac

SEQ ID NO: 7725961 - DNA, 22 bp, Homo sapiens
tctttaatgtactttctttcac

SEQ ID NO: 7725962 - DNA, 22 bp, Homo sapiens
tctttaatcataaccaagatgg

SEQ ID NO: 7725963 - DNA, 22 bp, Homo sapiens
tctttaatcataaccaagatgg

SEQ ID NO: 7725964 - DNA, 22 bp, Homo sapiens
tctttacaagtcacattttctg

SEQ ID NO: 7725965 - DNA, 22 bp, Homo sapiens
tctttacaagtcacattttctg

SEQ ID NO: 7725966 - DNA, 22 bp, Homo sapiens
tctttacaagtcacattttctg

SEQ ID NO: 7725967 - DNA, 22 bp, Homo sapiens
tctttacaatctaagcatagtt

SEQ ID NO: 7725968 - DNA, 22 bp, Homo sapiens
tctttacacaagacaagaataa

SEQ ID NO: 7725969 - DNA, 22 bp, Homo sapiens
tctttacaatctaagcatagtt

SEQ ID NO: 7725970 - DNA, 22 bp, Homo sapiens
tctttaattgtggaagagcagc

SEQ ID NO: 7725971 - DNA, 22 bp, Homo sapiens
tctttaattgtggaagagcagc

SEQ ID NO: 7725972 - DNA, 22 bp, Homo sapiens
tctttaattgtggaagagcagc

SEQ ID NO: 7725973 - DNA, 22 bp, Homo sapiens
tctttaattcagcatgatgcgg

SEQ ID NO: 7725974 - DNA, 22 bp, Homo sapiens
tctttaatgtgattgtaattat

SEQ ID NO: 7725975 - DNA, 22 bp, Homo sapiens
tctttaatgtgattgtaattat

SEQ ID NO: 7725976 - DNA, 22 bp, Homo sapiens
tctttaatgtgattgtaattat

SEQ ID NO: 7725977 - DNA, 23 bp, Homo sapiens
tctttacagcagcaggatttgga

SEQ ID NO: 7725978 - DNA, 22 bp, Homo sapiens
tctttacacaagacaagaataa

SEQ ID NO: 7725979 - DNA, 22 bp, Homo sapiens
tctttacacaagacaagaataa

SEQ ID NO: 7725980 - DNA, 22 bp, Homo sapiens
tctttacacaagacaagaataa

SEQ ID NO: 7725981 - DNA, 22 bp, Homo sapiens
tctttacacaagacaagaataa

SEQ ID NO: 7725982 - DNA, 22 bp, Homo sapiens
tctttacacaagacaagaataa

SEQ ID NO: 7725983 - DNA, 22 bp, Homo sapiens
tctttacatcacaattgtatgg

SEQ ID NO: 7725984 - DNA, 22 bp, Homo sapiens
tctttacatcacaattgtatgg

SEQ ID NO: 7725985 - DNA, 22 bp, Homo sapiens
tctttacatcacaattgtatgg

SEQ ID NO: 7725986 - DNA, 23 bp, Homo sapiens
tctttacatactgatgagttctc

SEQ ID NO: 7725987 - DNA, 23 bp, Homo sapiens
tctttacatactgatgagttctc

SEQ ID NO: 7725988 - DNA, 22 bp, Homo sapiens
tctttacagtcctctgtcaatc

SEQ ID NO: 7725989 - DNA, 22 bp, Homo sapiens
tctttactggaatggaactttc

SEQ ID NO: 7725990 - DNA, 22 bp, Homo sapiens
tctttacttgtgtattgtatat

SEQ ID NO: 7725991 - DNA, 22 bp, Homo sapiens
tctttagaaacttttcttcatg

SEQ ID NO: 7725992 - DNA, 22 bp, Homo sapiens
tctttagaaacttttcttcatg

SEQ ID NO: 7725993 - DNA, 22 bp, Homo sapiens
tctttactggaatggaactttc

SEQ ID NO: 7725994 - DNA, 22 bp, Homo sapiens
tctttacatcacaattgtatgg

SEQ ID NO: 7725995 - DNA, 22 bp, Homo sapiens
tctttacatcacaattgtatgg

SEQ ID NO: 7725996 - DNA, 22 bp, Homo sapiens
tctttacatagtgtggactact

SEQ ID NO: 7725997 - DNA, 22 bp, Homo sapiens
tctttacatcacaattgtatgg

SEQ ID NO: 7725998 - DNA, 23 bp, Homo sapiens
tctttagaagaacatcagaaatg

SEQ ID NO: 7725999 - DNA, 22 bp, Homo sapiens
tctttagacatccagtttctct

SEQ ID NO: 7726000 - DNA, 22 bp, Homo sapiens
tcttgaattgtactcccataag

SEQ ID NO: 7726001 - DNA, 22 bp, Homo sapiens
tcttgaattgtactcccataag

SEQ ID NO: 7726002 - DNA, 22 bp, Homo sapiens
tcttgaattgtactcccataag

SEQ ID NO: 7726003 - DNA, 22 bp, Homo sapiens
tcttgaataagtttcatgagct

SEQ ID NO: 7726004 - DNA, 22 bp, Homo sapiens
tcttgaattgtactcccataag

SEQ ID NO: 7726005 - DNA, 22 bp, Homo sapiens
tcttgaattgtactcccataag

SEQ ID NO: 7726006 - DNA, 22 bp, Homo sapiens
tcttgaagtccttacatttgat

SEQ ID NO: 7726007 - DNA, 22 bp, Homo sapiens
tcttgaattgtactcccataag

SEQ ID NO: 7726008 - DNA, 22 bp, Homo sapiens
tcttgagaagcggctgtctcag

SEQ ID NO: 7726009 - DNA, 22 bp, Homo sapiens
tcttgagaagcggctgtctcag

SEQ ID NO: 7726010 - DNA, 20 bp, Homo sapiens
tcttgagaacaatttctggc

SEQ ID NO: 7726011 - DNA, 20 bp, Homo sapiens
tcttgagaacaatttctggc

SEQ ID NO: 7726012 - DNA, 22 bp, Homo sapiens
tcttgagaaataattaaacatg

SEQ ID NO: 7726013 - DNA, 22 bp, Homo sapiens
tcttgacattgttgttagcagg

SEQ ID NO: 7726014 - DNA, 22 bp, Homo sapiens
tcttgacattgttgttagcagg

SEQ ID NO: 7726015 - DNA, 22 bp, Homo sapiens
tcttgacattcaatcatgtata

SEQ ID NO: 7726016 - DNA, 22 bp, Homo sapiens
tcttgaataagtttcatgagct

SEQ ID NO: 7726017 - DNA, 22 bp, Homo sapiens
tcttgaagtcttatggtttaaa

SEQ ID NO: 7726018 - DNA, 22 bp, Homo sapiens
tcttgaataagtttcatgagct

SEQ ID NO: 7726019 - DNA, 22 bp, Homo sapiens
tcttgaagtgggagacatcgtg

SEQ ID NO: 7726020 - DNA, 22 bp, Homo sapiens
tcttgaagtccttacatttgat

SEQ ID NO: 7726021 - DNA, 22 bp, Homo sapiens
tcttgaagtcacacagaaagtg

SEQ ID NO: 7726022 - DNA, 22 bp, Homo sapiens
tcttgaagtcacacagaaagtg

SEQ ID NO: 7726023 - DNA, 22 bp, Homo sapiens
tcttgaagtccttacatttgat

SEQ ID NO: 7726024 - DNA, 22 bp, Homo sapiens
tcttgaagtctgtcatttaaat

SEQ ID NO: 7726025 - DNA, 22 bp, Homo sapiens
tcttgaagtcttatggtttaaa

SEQ ID NO: 7726026 - DNA, 22 bp, Homo sapiens
tcttgaagaggaagtggagtag

SEQ ID NO: 7726027 - DNA, 22 bp, Homo sapiens
tcttgaagaggaagtggagtag

SEQ ID NO: 7726028 - DNA, 22 bp, Homo sapiens
tcttgaagaggaagtggagtag

SEQ ID NO: 7726029 - DNA, 22 bp, Homo sapiens
tcttgaagcagctctgctcaaa

SEQ ID NO: 7726030 - DNA, 22 bp, Homo sapiens
tcttgaaggggggcagtgttga

SEQ ID NO: 7726031 - DNA, 22 bp, Homo sapiens
tcttgaaggggggcagtgttga

SEQ ID NO: 7726032 - DNA, 22 bp, Homo sapiens
tcttgaaggggggcagtgttga

SEQ ID NO: 7726033 - DNA, 22 bp, Homo sapiens
tcttgaaggtctatcgccttga

SEQ ID NO: 7726034 - DNA, 23 bp, Homo sapiens
tcttgaaggttgtgcccctgcag

SEQ ID NO: 7726035 - DNA, 22 bp, Homo sapiens
tcttgaaaggagattggaggca

SEQ ID NO: 7726036 - DNA, 22 bp, Homo sapiens
tcttgaaagtatcttattttgt

SEQ ID NO: 7726037 - DNA, 22 bp, Homo sapiens
tcttgaagaaagtcaagttatt

SEQ ID NO: 7726038 - DNA, 22 bp, Homo sapiens
tcttgaaagtatcttattttgt

SEQ ID NO: 7726039 - DNA, 22 bp, Homo sapiens
tcttgaaagtatcttattttgt

SEQ ID NO: 7726040 - DNA, 22 bp, Homo sapiens
tcttgaaaggagattggaggca

SEQ ID NO: 7726041 - DNA, 22 bp, Homo sapiens
tcttgaaagcattttcttcatc

SEQ ID NO: 7726042 - DNA, 22 bp, Homo sapiens
tcttgaaagtatcttattttgt

SEQ ID NO: 7726043 - DNA, 22 bp, Homo sapiens
tcttgaaaggagattggaggca

SEQ ID NO: 7726044 - DNA, 22 bp, Homo sapiens
tcttgaaagtatcttattttgt

SEQ ID NO: 7726045 - DNA, 22 bp, Homo sapiens
tcttgctaaagaccaacacatt

SEQ ID NO: 7726046 - DNA, 22 bp, Homo sapiens
tcttgctgaaaacaaatctctt

SEQ ID NO: 7726047 - DNA, 22 bp, Homo sapiens
tcttgctccacatgctgagatg

SEQ ID NO: 7726048 - DNA, 22 bp, Homo sapiens
tcttgctgagactggcaagttt

SEQ ID NO: 7726049 - DNA, 22 bp, Homo sapiens
tcttgctgctgtccacacagta

SEQ ID NO: 7726050 - DNA, 22 bp, Homo sapiens
tcttgctgagactggcaagttt

SEQ ID NO: 7726051 - DNA, 22 bp, Homo sapiens
tcttgctgtgccccagcagggc

SEQ ID NO: 7726052 - DNA, 22 bp, Homo sapiens
tcttgctgtgccccagcagggc

SEQ ID NO: 7726053 - DNA, 22 bp, Homo sapiens
tcttgctgtacggctacttgca

SEQ ID NO: 7726054 - DNA, 22 bp, Homo sapiens
tcttgctgaaaacaaatctctt

SEQ ID NO: 7726055 - DNA, 19 bp, Homo sapiens
tcttgcttcttcatccctc

SEQ ID NO: 7726056 - DNA, 19 bp, Homo sapiens
tcttgcttcttcatccctc

SEQ ID NO: 7726057 - DNA, 22 bp, Homo sapiens
tcttggaaccctatgtgatttc

SEQ ID NO: 7726058 - DNA, 20 bp, Homo sapiens
tcttggaaaaagttcagaat

SEQ ID NO: 7726059 - DNA, 20 bp, Homo sapiens
tcttggaaaaagttcagaat

SEQ ID NO: 7726060 - DNA, 22 bp, Homo sapiens
tcttgcttgatacatggaggaa

SEQ ID NO: 7726061 - DNA, 22 bp, Homo sapiens
tcttgctgtgtattgcatctcc

SEQ ID NO: 7726062 - DNA, 22 bp, Homo sapiens
tcttgctgtgccccagcagggc

SEQ ID NO: 7726063 - DNA, 22 bp, Homo sapiens
tcttgctgtgccccagcagggc

SEQ ID NO: 7726064 - DNA, 22 bp, Homo sapiens
tcttgctgttacagaattaaca

SEQ ID NO: 7726065 - DNA, 22 bp, Homo sapiens
tcttgagagatatactactgaa

SEQ ID NO: 7726066 - DNA, 22 bp, Homo sapiens
tcttgagagatatactactgaa

SEQ ID NO: 7726067 - DNA, 22 bp, Homo sapiens
tcttgagatcaagacacaggga

SEQ ID NO: 7726068 - DNA, 22 bp, Homo sapiens
tcttgaggtcatcatctgaaac

SEQ ID NO: 7726069 - DNA, 22 bp, Homo sapiens
tcttgaggtcatcatctgaaac

SEQ ID NO: 7726070 - DNA, 22 bp, Homo sapiens
tcttgaggtcatcatctgaaac

SEQ ID NO: 7726071 - DNA, 22 bp, Homo sapiens
tcttgaggttattaagctgtta

SEQ ID NO: 7726072 - DNA, 22 bp, Homo sapiens
tcttgattggttgtatagctac

SEQ ID NO: 7726073 - DNA, 22 bp, Homo sapiens
tcttgattgttttctgacctta

SEQ ID NO: 7726074 - DNA, 22 bp, Homo sapiens
tcttgatgctttttctaaatgt

SEQ ID NO: 7726075 - DNA, 22 bp, Homo sapiens
tcttgatagagtgctttcagag

SEQ ID NO: 7726076 - DNA, 19 bp, Homo sapiens
tcttgatgaggtttctcca

SEQ ID NO: 7726077 - DNA, 22 bp, Homo sapiens
tcttgattacttattttgtgcc

SEQ ID NO: 7726078 - DNA, 22 bp, Homo sapiens
tcttgattacttattttgtgcc

SEQ ID NO: 7726079 - DNA, 22 bp, Homo sapiens
tcttgattaataccttagccct

SEQ ID NO: 7726080 - DNA, 22 bp, Homo sapiens
tcttggccaggtgtggtgcctc

SEQ ID NO: 7726081 - DNA, 22 bp, Homo sapiens
tcttggccaggtgtggtgcctc

SEQ ID NO: 7726082 - DNA, 22 bp, Homo sapiens
tcttggccaggtgtggtgcctc

SEQ ID NO: 7726083 - DNA, 22 bp, Homo sapiens
tcttggccagatgcacttcctc

SEQ ID NO: 7726084 - DNA, 22 bp, Homo sapiens
tcttggctacttaggaggattc

SEQ ID NO: 7726085 - DNA, 21 bp, Homo sapiens
tcttggcctaagttcactgaa

SEQ ID NO: 7726086 - DNA, 22 bp, Homo sapiens
tcttggccccacctgtgccagc

SEQ ID NO: 7726087 - DNA, 22 bp, Homo sapiens
tcttggccccacctgtgccagc

SEQ ID NO: 7726088 - DNA, 22 bp, Homo sapiens
tcttggccccaaccctctattt

SEQ ID NO: 7726089 - DNA, 22 bp, Homo sapiens
tcttggctatccaagttatcca

SEQ ID NO: 7726090 - DNA, 22 bp, Homo sapiens
tcttggctatccaagttatcca

SEQ ID NO: 7726091 - DNA, 22 bp, Homo sapiens
tcttggctatccaagttatcca

SEQ ID NO: 7726092 - DNA, 22 bp, Homo sapiens
tcttggctagtaccttcctgcc

SEQ ID NO: 7726093 - DNA, 22 bp, Homo sapiens
tcttggctagtaccttcctgcc

SEQ ID NO: 7726094 - DNA, 22 bp, Homo sapiens
tcttggctactttcctgtctgc

SEQ ID NO: 7726095 - DNA, 22 bp, Homo sapiens
tcttggctactttcctgtctgc

SEQ ID NO: 7726096 - DNA, 22 bp, Homo sapiens
tcttggctacttaggaggattc

SEQ ID NO: 7726097 - DNA, 22 bp, Homo sapiens
tcttggctactttcctgtctgc

SEQ ID NO: 7726098 - DNA, 22 bp, Homo sapiens
tcttggctagtaccttcctgcc

SEQ ID NO: 7726099 - DNA, 22 bp, Homo sapiens
tcttggctactttcctgtctgc

SEQ ID NO: 7726100 - DNA, 22 bp, Homo sapiens
tcttggcaggcagtggggtaag

SEQ ID NO: 7726101 - DNA, 18 bp, Homo sapiens
tcttggcagcatctggca

SEQ ID NO: 7726102 - DNA, 18 bp, Homo sapiens
tcttggcagcatctggca

SEQ ID NO: 7726103 - DNA, 22 bp, Homo sapiens
tcttggcagtggaataccagga

SEQ ID NO: 7726104 - DNA, 22 bp, Homo sapiens
tcttggcagtggaataccagga

SEQ ID NO: 7726105 - DNA, 22 bp, Homo sapiens
tcttggcagttcttgtgctttt

SEQ ID NO: 7726106 - DNA, 22 bp, Homo sapiens
tcttggcagtggaataccagga

SEQ ID NO: 7726107 - DNA, 22 bp, Homo sapiens
tcttggccactaccacctggag

SEQ ID NO: 7726108 - DNA, 22 bp, Homo sapiens
tcttggccactaccacctggag

SEQ ID NO: 7726109 - DNA, 22 bp, Homo sapiens
tcttggcatgcatgggcaatca

SEQ ID NO: 7726110 - DNA, 22 bp, Homo sapiens
tcttggcatgcatgggcaatca

SEQ ID NO: 7726111 - DNA, 22 bp, Homo sapiens
tcttggcagttcttgtgctttt

SEQ ID NO: 7726112 - DNA, 22 bp, Homo sapiens
tcttggcagttcttgtgctttt

SEQ ID NO: 7726113 - DNA, 22 bp, Homo sapiens
tcttggcaaatttttgaggctc

SEQ ID NO: 7726114 - DNA, 22 bp, Homo sapiens
tcttggcaaatttttgaggctc

SEQ ID NO: 7726115 - DNA, 20 bp, Homo sapiens
tcttggcaaatgggagtgtc

SEQ ID NO: 7726116 - DNA, 20 bp, Homo sapiens
tcttggcaaatgggagtgtc

SEQ ID NO: 7726117 - DNA, 22 bp, Homo sapiens
tcttggattttaatggatcaaa

SEQ ID NO: 7726118 - DNA, 22 bp, Homo sapiens
tcttggattttaatggatcaaa

SEQ ID NO: 7726119 - DNA, 22 bp, Homo sapiens
tcttggcaatttgatctcagtt

SEQ ID NO: 7726120 - DNA, 22 bp, Homo sapiens
tcttggcaatttgatctcagtt

SEQ ID NO: 7726121 - DNA, 22 bp, Homo sapiens
tcttggcaagaagcttcagcta

SEQ ID NO: 7726122 - DNA, 22 bp, Homo sapiens
tcttggcaagtggcagattctt

SEQ ID NO: 7726123 - DNA, 22 bp, Homo sapiens
tcttggcaagtggcagattctt

SEQ ID NO: 7726124 - DNA, 18 bp, Homo sapiens
tcttggcagcatctggca

SEQ ID NO: 7726125 - DNA, 18 bp, Homo sapiens
tcttggcagcatctggca

SEQ ID NO: 7726126 - DNA, 18 bp, Homo sapiens
tcttggcagcatctggca

SEQ ID NO: 7726127 - DNA, 22 bp, Homo sapiens
tcttggactcaaaattgcctta

SEQ ID NO: 7726128 - DNA, 22 bp, Homo sapiens
tcttggaatctccatagagtga

SEQ ID NO: 7726129 - DNA, 22 bp, Homo sapiens
tcttggactagtcctaaatcca

SEQ ID NO: 7726130 - DNA, 22 bp, Homo sapiens
tcttggagaagggattgtgctc

SEQ ID NO: 7726131 - DNA, 22 bp, Homo sapiens
tcttggagaatggcagagaagc

SEQ ID NO: 7726132 - DNA, 22 bp, Homo sapiens
tcttggactcaaaattgcctta

SEQ ID NO: 7726133 - DNA, 22 bp, Homo sapiens
tcttggaatctccatagagtga

SEQ ID NO: 7726134 - DNA, 22 bp, Homo sapiens
tcttggaatctccatagagtga

SEQ ID NO: 7726135 - DNA, 22 bp, Homo sapiens
tcttggaagtagaacacagtct

SEQ ID NO: 7726136 - DNA, 22 bp, Homo sapiens
tcttgcttctgctcaaggggag

SEQ ID NO: 7726137 - DNA, 22 bp, Homo sapiens
tcttggaataccccgaaggtca

SEQ ID NO: 7726138 - DNA, 22 bp, Homo sapiens
tcttggaagcctcaagatactc

SEQ ID NO: 7726139 - DNA, 22 bp, Homo sapiens
tcttggaagcctcaagatactc

SEQ ID NO: 7726140 - DNA, 22 bp, Homo sapiens
tcttggaacttattattgtaga

SEQ ID NO: 7726141 - DNA, 22 bp, Homo sapiens
tcttggaaccctatgtgatttc

SEQ ID NO: 7726142 - DNA, 22 bp, Homo sapiens
tcttggaagggttgtgggatga

SEQ ID NO: 7726143 - DNA, 22 bp, Homo sapiens
tcttggaagggttgtgggatga

SEQ ID NO: 7726144 - DNA, 22 bp, Homo sapiens
tcttggaagtagaacacagtct

SEQ ID NO: 7726145 - DNA, 22 bp, Homo sapiens
tcttggaagtagaacacagtct

SEQ ID NO: 7726146 - DNA, 22 bp, Homo sapiens
tcttggaagtagaacacagtct

SEQ ID NO: 7726147 - DNA, 22 bp, Homo sapiens
tcttggaagtagaacacagtct

SEQ ID NO: 7726148 - DNA, 22 bp, Homo sapiens
tcttggaagtagaacacagtct

SEQ ID NO: 7726149 - DNA, 22 bp, Homo sapiens
tcttggagaatggcagagaagc

SEQ ID NO: 7726150 - DNA, 22 bp, Homo sapiens
tcttggagactcttgtatattt

SEQ ID NO: 7726151 - DNA, 22 bp, Homo sapiens
tcttggagatgaccaggcatgc

SEQ ID NO: 7726152 - DNA, 22 bp, Homo sapiens
tcttggagatgaccaggcatgc

SEQ ID NO: 7726153 - DNA, 20 bp, Homo sapiens
tcttggagagggtggactta

SEQ ID NO: 7726154 - DNA, 22 bp, Homo sapiens
tcttggagagccacccagtggc

SEQ ID NO: 7726155 - DNA, 22 bp, Homo sapiens
tcttggattttaatggatcaaa

SEQ ID NO: 7726156 - DNA, 22 bp, Homo sapiens
tcttggattttaatggatcaaa

SEQ ID NO: 7726157 - DNA, 22 bp, Homo sapiens
tcttggattttaatggatcaaa

SEQ ID NO: 7726158 - DNA, 22 bp, Homo sapiens
tcttggattttaatggatcaaa

SEQ ID NO: 7726159 - DNA, 22 bp, Homo sapiens
tcttggattttaatggatcaaa

SEQ ID NO: 7726160 - DNA, 22 bp, Homo sapiens
tcttggattttaatggatcaaa

SEQ ID NO: 7726161 - DNA, 22 bp, Homo sapiens
tcttggattttaatggatcaaa

SEQ ID NO: 7726162 - DNA, 16 bp, Homo sapiens
tcttggagttgttcct

SEQ ID NO: 7726163 - DNA, 22 bp, Homo sapiens
tcttggagtattgggcctcagg

SEQ ID NO: 7726164 - DNA, 18 bp, Homo sapiens
tcttggagtaatgatcaa

SEQ ID NO: 7726165 - DNA, 18 bp, Homo sapiens
tcttggagtaatgatcaa

SEQ ID NO: 7726166 - DNA, 22 bp, Homo sapiens
tcttggaggagagtaagtacct

SEQ ID NO: 7726167 - DNA, 20 bp, Homo sapiens
tcttggagctctttgtcctc

SEQ ID NO: 7726168 - DNA, 22 bp, Homo sapiens
tctttcttattagccattgttc

SEQ ID NO: 7726169 - DNA, 22 bp, Homo sapiens
tctttcttattagccattgttc

SEQ ID NO: 7726170 - DNA, 22 bp, Homo sapiens
tctttgaactctgtgtattaac

SEQ ID NO: 7726171 - DNA, 22 bp, Homo sapiens
tctttgaactctgtgtattaac

SEQ ID NO: 7726172 - DNA, 22 bp, Homo sapiens
tctttgaactctgtgtattaac

SEQ ID NO: 7726173 - DNA, 22 bp, Homo sapiens
tctttgaacttggctgatctct

SEQ ID NO: 7726174 - DNA, 22 bp, Homo sapiens
tctttgaacttggctgatctct

SEQ ID NO: 7726175 - DNA, 22 bp, Homo sapiens
tctttcttacaaagaaaacggt

SEQ ID NO: 7726176 - DNA, 22 bp, Homo sapiens
tctttcttacaaagaaaacggt

SEQ ID NO: 7726177 - DNA, 22 bp, Homo sapiens
tctttcttacaaagaaaacggt

SEQ ID NO: 7726178 - DNA, 22 bp, Homo sapiens
tctttcttaaataggtggattg

SEQ ID NO: 7726179 - DNA, 22 bp, Homo sapiens
tctttcttaaataggtggattg

SEQ ID NO: 7726180 - DNA, 22 bp, Homo sapiens
tctttctggttatgtatagaga

SEQ ID NO: 7726181 - DNA, 22 bp, Homo sapiens
tctttctgtaagctccatggaa

SEQ ID NO: 7726182 - DNA, 22 bp, Homo sapiens
tctttctgtaagctccatggaa

SEQ ID NO: 7726183 - DNA, 22 bp, Homo sapiens
tctttctgtaagctccatggaa

SEQ ID NO: 7726184 - DNA, 22 bp, Homo sapiens
tctttctctctaatcaagcaca

SEQ ID NO: 7726185 - DNA, 22 bp, Homo sapiens
tctttctctctaatcaagcaca

SEQ ID NO: 7726186 - DNA, 22 bp, Homo sapiens
tctttctagtggcctctattct

SEQ ID NO: 7726187 - DNA, 22 bp, Homo sapiens
tctttctctctaatcaagcaca

SEQ ID NO: 7726188 - DNA, 21 bp, Homo sapiens
tctttctgaaatctcagtctg

SEQ ID NO: 7726189 - DNA, 21 bp, Homo sapiens
tctttctgaaatctcagtctg

SEQ ID NO: 7726190 - DNA, 21 bp, Homo sapiens
tctttctgaaatctcagtctg

SEQ ID NO: 7726191 - DNA, 21 bp, Homo sapiens
tctttctgaaatctcagtctg

SEQ ID NO: 7726192 - DNA, 22 bp, Homo sapiens
tctttctgaatatttgacctca

SEQ ID NO: 7726193 - DNA, 22 bp, Homo sapiens
tctttctgcagcacaggggcag

SEQ ID NO: 7726194 - DNA, 22 bp, Homo sapiens
tctttctggtctcgccttattc

SEQ ID NO: 7726195 - DNA, 22 bp, Homo sapiens
tctttctggttatgtatagaga

SEQ ID NO: 7726196 - DNA, 22 bp, Homo sapiens
tctttctggttatgtatagaga

SEQ ID NO: 7726197 - DNA, 22 bp, Homo sapiens
tctttctggttatgtatagaga

SEQ ID NO: 7726198 - DNA, 22 bp, Homo sapiens
tctttctggttatgtatagaga

SEQ ID NO: 7726199 - DNA, 22 bp, Homo sapiens
tctttctgatgggaagggtcaa

SEQ ID NO: 7726200 - DNA, 22 bp, Homo sapiens
tctttctgatgggaagggtcaa

SEQ ID NO: 7726201 - DNA, 22 bp, Homo sapiens
tctttctgcacttagtggggct

SEQ ID NO: 7726202 - DNA, 22 bp, Homo sapiens
tctttctgcagcacaggggcag

SEQ ID NO: 7726203 - DNA, 22 bp, Homo sapiens
tctttgaatcctttacatctga

SEQ ID NO: 7726204 - DNA, 22 bp, Homo sapiens
tctttgaatcctttacatctga

SEQ ID NO: 7726205 - DNA, 22 bp, Homo sapiens
tctttgaatcctttacatctga

SEQ ID NO: 7726206 - DNA, 22 bp, Homo sapiens
tctttgaattcaaactgttcaa

SEQ ID NO: 7726207 - DNA, 22 bp, Homo sapiens
tctttgaattcaaactgttcaa

SEQ ID NO: 7726208 - DNA, 22 bp, Homo sapiens
tctttgaatttctgactgtctt

SEQ ID NO: 7726209 - DNA, 22 bp, Homo sapiens
tctttgaatttctgactgtctt

SEQ ID NO: 7726210 - DNA, 22 bp, Homo sapiens
tctttgaagttgaagtagttgg

SEQ ID NO: 7726211 - DNA, 22 bp, Homo sapiens
tctttgaatacaggaagcatga

SEQ ID NO: 7726212 - DNA, 22 bp, Homo sapiens
tctttgaatacaggaagcatga

SEQ ID NO: 7726213 - DNA, 22 bp, Homo sapiens
tctttgaagtatcttaaatggt

SEQ ID NO: 7726214 - DNA, 22 bp, Homo sapiens
tctttgaagtatcttaaatggt

SEQ ID NO: 7726215 - DNA, 22 bp, Homo sapiens
tctttgaagtatcttaaatggt

SEQ ID NO: 7726216 - DNA, 22 bp, Homo sapiens
tctttgatgggagatctgagag

SEQ ID NO: 7726217 - DNA, 22 bp, Homo sapiens
tctttgatgtggttaattatga

SEQ ID NO: 7726218 - DNA, 22 bp, Homo sapiens
tctttgatgtctcttcctgtaa

SEQ ID NO: 7726219 - DNA, 22 bp, Homo sapiens
tctttgatttgacaatatcttg

SEQ ID NO: 7726220 - DNA, 22 bp, Homo sapiens
tctttgatttgacaatatcttg

SEQ ID NO: 7726221 - DNA, 22 bp, Homo sapiens
tctttgatttagaaggaaatga

SEQ ID NO: 7726222 - DNA, 22 bp, Homo sapiens
tctttgatttagaaggaaatga

SEQ ID NO: 7726223 - DNA, 22 bp, Homo sapiens
tctttgatttagaaggaaatga

SEQ ID NO: 7726224 - DNA, 21 bp, Homo sapiens
tctttgattaagcttgactag

SEQ ID NO: 7726225 - DNA, 22 bp, Homo sapiens
tctttgatttaaaacagtcaaa

SEQ ID NO: 7726226 - DNA, 22 bp, Homo sapiens
tctttgatttaaaacagtcaaa

SEQ ID NO: 7726227 - DNA, 22 bp, Homo sapiens
tctttgatttaaaacagtcaaa

SEQ ID NO: 7726228 - DNA, 22 bp, Homo sapiens
tctttgatcagcctttcactga

SEQ ID NO: 7726229 - DNA, 21 bp, Homo sapiens
tctttgagaataggtttttca

SEQ ID NO: 7726230 - DNA, 22 bp, Homo sapiens
tctttgatcagcctttcactga

SEQ ID NO: 7726231 - DNA, 22 bp, Homo sapiens
tctttgatggagagatagatat

SEQ ID NO: 7726232 - DNA, 22 bp, Homo sapiens
tctttgatggagagatagatat

SEQ ID NO: 7726233 - DNA, 22 bp, Homo sapiens
tctttcctaggtgatatgcaat

SEQ ID NO: 7726234 - DNA, 22 bp, Homo sapiens
tctttcctaggtgatatgcaat

SEQ ID NO: 7726235 - DNA, 22 bp, Homo sapiens
tctttcctaggtgatatgcaat

SEQ ID NO: 7726236 - DNA, 22 bp, Homo sapiens
tctttcctaggtgatatgcaat

SEQ ID NO: 7726237 - DNA, 23 bp, Homo sapiens
tctttcctcagcacacaccaaga

SEQ ID NO: 7726238 - DNA, 22 bp, Homo sapiens
tctttcctaggtgatatgcaat

SEQ ID NO: 7726239 - DNA, 22 bp, Homo sapiens
tctttcctaggtgatatgcaat

SEQ ID NO: 7726240 - DNA, 22 bp, Homo sapiens
tctttcctagaggctgatgagt

SEQ ID NO: 7726241 - DNA, 22 bp, Homo sapiens
tctttcctagaggctgatgagt

SEQ ID NO: 7726242 - DNA, 22 bp, Homo sapiens
tctttcctagaggctgatgagt

SEQ ID NO: 7726243 - DNA, 22 bp, Homo sapiens
tctttcctactttattgtgaac

SEQ ID NO: 7726244 - DNA, 22 bp, Homo sapiens
tctttcctactttattgtgaac

SEQ ID NO: 7726245 - DNA, 22 bp, Homo sapiens
tctttcctagaggctgatgagt

SEQ ID NO: 7726246 - DNA, 22 bp, Homo sapiens
tctttccctgtgttagcctgta

SEQ ID NO: 7726247 - DNA, 17 bp, Homo sapiens
tctttccctgggagatg

SEQ ID NO: 7726248 - DNA, 17 bp, Homo sapiens
tctttccctgggagatg

SEQ ID NO: 7726249 - DNA, 22 bp, Homo sapiens
tctttcccgccagagcatgagt

SEQ ID NO: 7726250 - DNA, 17 bp, Homo sapiens
tctttccctgggagatg

SEQ ID NO: 7726251 - DNA, 22 bp, Homo sapiens
tctttccctgtgttagcctgta

SEQ ID NO: 7726252 - DNA, 22 bp, Homo sapiens
tctttccctgtgttagcctgta

SEQ ID NO: 7726253 - DNA, 22 bp, Homo sapiens
tctttccctgtgttagcctgta

SEQ ID NO: 7726254 - DNA, 22 bp, Homo sapiens
tctttcccttagaacattaaca

SEQ ID NO: 7726255 - DNA, 22 bp, Homo sapiens
tctttcctactttattgtgaac

SEQ ID NO: 7726256 - DNA, 22 bp, Homo sapiens
tctttcctactttattgtgaac

SEQ ID NO: 7726257 - DNA, 23 bp, Homo sapiens
tctttcctaatgaaacagtgaaa

SEQ ID NO: 7726258 - DNA, 23 bp, Homo sapiens
tctttcctaatgaaacagtgaaa

SEQ ID NO: 7726259 - DNA, 23 bp, Homo sapiens
tctttcctaatgaaacagtgaaa

SEQ ID NO: 7726260 - DNA, 23 bp, Homo sapiens
tctttcctaatgaaacagtgaaa

SEQ ID NO: 7726261 - DNA, 22 bp, Homo sapiens
tctttcccttagaacattaaca

SEQ ID NO: 7726262 - DNA, 23 bp, Homo sapiens
tctttcctaatgaaacagtgaaa

SEQ ID NO: 7726263 - DNA, 22 bp, Homo sapiens
tctttcggccatagcgatgatt

SEQ ID NO: 7726264 - DNA, 22 bp, Homo sapiens
tctttctacatcatttgcttct

SEQ ID NO: 7726265 - DNA, 22 bp, Homo sapiens
tctttccttagaataattcttt

SEQ ID NO: 7726266 - DNA, 22 bp, Homo sapiens
tctttcctgtaactgctgttca

SEQ ID NO: 7726267 - DNA, 22 bp, Homo sapiens
tctttcctgtaactgctgttca

SEQ ID NO: 7726268 - DNA, 22 bp, Homo sapiens
tctttcctgtaactgctgttca

SEQ ID NO: 7726269 - DNA, 22 bp, Homo sapiens
tctttcctgtaactgctgttca

SEQ ID NO: 7726270 - DNA, 21 bp, Homo sapiens
tctttcctgcccagttgccct

SEQ ID NO: 7726271 - DNA, 17 bp, Homo sapiens
tctttcctgccatgctc

SEQ ID NO: 7726272 - DNA, 17 bp, Homo sapiens
tctttcctgccatgctc

SEQ ID NO: 7726273 - DNA, 21 bp, Homo sapiens
tctttcctgcccagttgccct

SEQ ID NO: 7726274 - DNA, 21 bp, Homo sapiens
tctttcctgcccagttgccct

SEQ ID NO: 7726275 - DNA, 17 bp, Homo sapiens
tctttcctgccatgctc

SEQ ID NO: 7726276 - DNA, 22 bp, Homo sapiens
tctttcctctgagctcctgtag

SEQ ID NO: 7726277 - DNA, 22 bp, Homo sapiens
tctttcctctgagctcctgtag

SEQ ID NO: 7726278 - DNA, 22 bp, Homo sapiens
tctttcctctgagctcctgtag

SEQ ID NO: 7726279 - DNA, 22 bp, Homo sapiens
tctttcctaggtgatatgcaat

SEQ ID NO: 7726280 - DNA, 23 bp, Homo sapiens
tctttcctcagcacacaccaaga

SEQ ID NO: 7726281 - DNA, 23 bp, Homo sapiens
tctttcctcagcacacaccaaga

SEQ ID NO: 7726282 - DNA, 22 bp, Homo sapiens
tctttcctctgagctcctgtag

SEQ ID NO: 7726283 - DNA, 22 bp, Homo sapiens
tctttcctctgagctcctgtag

SEQ ID NO: 7726284 - DNA, 22 bp, Homo sapiens
tctttccacattctctgtttag

SEQ ID NO: 7726285 - DNA, 22 bp, Homo sapiens
tctttccagaggaatttttaga

SEQ ID NO: 7726286 - DNA, 22 bp, Homo sapiens
tctttccacattctctgtttag

SEQ ID NO: 7726287 - DNA, 22 bp, Homo sapiens
tctttccacattctctgtttag

SEQ ID NO: 7726288 - DNA, 22 bp, Homo sapiens
tctttccacattctctgtttag

SEQ ID NO: 7726289 - DNA, 22 bp, Homo sapiens
tctttccacagcatgtccatgc

SEQ ID NO: 7726290 - DNA, 22 bp, Homo sapiens
tctttccacattctctgtttag

SEQ ID NO: 7726291 - DNA, 22 bp, Homo sapiens
tctttccacactgtatgcccat

SEQ ID NO: 7726292 - DNA, 22 bp, Homo sapiens
tctttccacagcatgtccatgc

SEQ ID NO: 7726293 - DNA, 21 bp, Homo sapiens
tctttccaatattcatgtctc

SEQ ID NO: 7726294 - DNA, 22 bp, Homo sapiens
tctttccaagtaatacttccca

SEQ ID NO: 7726295 - DNA, 21 bp, Homo sapiens
tctttccaatattcatgtctc

SEQ ID NO: 7726296 - DNA, 21 bp, Homo sapiens
tctttccaatattcatgtctc

SEQ ID NO: 7726297 - DNA, 22 bp, Homo sapiens
tctttccaaggactctgtagca

SEQ ID NO: 7726298 - DNA, 22 bp, Homo sapiens
tctttccaaggactctgtagca

SEQ ID NO: 7726299 - DNA, 22 bp, Homo sapiens
tctttccaagtaatacttccca

SEQ ID NO: 7726300 - DNA, 22 bp, Homo sapiens
tctttccaaggactctgtagca

SEQ ID NO: 7726301 - DNA, 22 bp, Homo sapiens
tctttcccgccagagcatgagt

SEQ ID NO: 7726302 - DNA, 22 bp, Homo sapiens
tctttcccctacatttggttaa

SEQ ID NO: 7726303 - DNA, 22 bp, Homo sapiens
tctttcccgccagagcatgagt

SEQ ID NO: 7726304 - DNA, 22 bp, Homo sapiens
tctttcccgccagagcatgagt

SEQ ID NO: 7726305 - DNA, 22 bp, Homo sapiens
tctttcccagtagctctcccag

SEQ ID NO: 7726306 - DNA, 22 bp, Homo sapiens
tctttcccagtagctctcccag

SEQ ID NO: 7726307 - DNA, 22 bp, Homo sapiens
tctttcccagtagctctcccag

SEQ ID NO: 7726308 - DNA, 22 bp, Homo sapiens
tctttccagaggaatttttaga

SEQ ID NO: 7726309 - DNA, 22 bp, Homo sapiens
tctttccagaggaatttttaga

SEQ ID NO: 7726310 - DNA, 22 bp, Homo sapiens
tctttccagaggaatttttaga

SEQ ID NO: 7726311 - DNA, 22 bp, Homo sapiens
tctttccagaggaatttttaga

SEQ ID NO: 7726312 - DNA, 22 bp, Homo sapiens
tctttccatggccacacagtct

SEQ ID NO: 7726313 - DNA, 22 bp, Homo sapiens
tctttccatggccacacagtct

SEQ ID NO: 7726314 - DNA, 22 bp, Homo sapiens
tctttccatggccacacagtct

SEQ ID NO: 7726315 - DNA, 22 bp, Homo sapiens
tctttccatggccacacagtct

SEQ ID NO: 7726316 - DNA, 22 bp, Homo sapiens
tctttccatggccacacagtct

SEQ ID NO: 7726317 - DNA, 22 bp, Homo sapiens
tctttcagctcttcaggaccca

SEQ ID NO: 7726318 - DNA, 22 bp, Homo sapiens
tctttcagccacttacctgtct

SEQ ID NO: 7726319 - DNA, 22 bp, Homo sapiens
tctttcagccacttacctgtct

SEQ ID NO: 7726320 - DNA, 22 bp, Homo sapiens
tctttcagccacttacctgtct

SEQ ID NO: 7726321 - DNA, 22 bp, Homo sapiens
tctttcaatgagcattctttcc

SEQ ID NO: 7726322 - DNA, 22 bp, Homo sapiens
tctttcaatgtgaaaccatgta

SEQ ID NO: 7726323 - DNA, 22 bp, Homo sapiens
tctttcaatgtgaaaccatgta

SEQ ID NO: 7726324 - DNA, 22 bp, Homo sapiens
tctttcaatgtgaaaccatgta

SEQ ID NO: 7726325 - DNA, 22 bp, Homo sapiens
tctttccaaggactctgtagca

SEQ ID NO: 7726326 - DNA, 19 bp, Homo sapiens
tctttcatttctagctctg

SEQ ID NO: 7726327 - DNA, 19 bp, Homo sapiens
tctttcatttctagctctg

SEQ ID NO: 7726328 - DNA, 19 bp, Homo sapiens
tctttcatttctagctctg

SEQ ID NO: 7726329 - DNA, 22 bp, Homo sapiens
tctttattgctactggtttgtc

SEQ ID NO: 7726330 - DNA, 22 bp, Homo sapiens
tctttattgctactggtttgtc

SEQ ID NO: 7726331 - DNA, 22 bp, Homo sapiens
tctttattgctactggtttgtc

SEQ ID NO: 7726332 - DNA, 22 bp, Homo sapiens
tctttattgctactggtttgtc

SEQ ID NO: 7726333 - DNA, 22 bp, Homo sapiens
tctttattgctactggtttgtc

SEQ ID NO: 7726334 - DNA, 22 bp, Homo sapiens
tctttattgctactggtttgtc

SEQ ID NO: 7726335 - DNA, 22 bp, Homo sapiens
tctttcaatgagcattctttcc

SEQ ID NO: 7726336 - DNA, 22 bp, Homo sapiens
tctttatttaagtctgttgtaa

SEQ ID NO: 7726337 - DNA, 22 bp, Homo sapiens
tctttatttaagtctgttgtaa

SEQ ID NO: 7726338 - DNA, 22 bp, Homo sapiens
tctttatttaagtctgttgtaa

SEQ ID NO: 7726339 - DNA, 22 bp, Homo sapiens
tctttatttaagtctgttgtaa

SEQ ID NO: 7726340 - DNA, 22 bp, Homo sapiens
tctttatgcctacctgggaaga

SEQ ID NO: 7726341 - DNA, 22 bp, Homo sapiens
tctttatgtaagactgggcttg

SEQ ID NO: 7726342 - DNA, 22 bp, Homo sapiens
tctttatgcacataaagaaact

SEQ ID NO: 7726343 - DNA, 22 bp, Homo sapiens
tctttatgagaaaaagattgta

SEQ ID NO: 7726344 - DNA, 22 bp, Homo sapiens
tctttatgagaaaaagattgta

SEQ ID NO: 7726345 - DNA, 22 bp, Homo sapiens
tctttatgagaaaaagattgta

SEQ ID NO: 7726346 - DNA, 22 bp, Homo sapiens
tctttatgcacataaagaaact

SEQ ID NO: 7726347 - DNA, 22 bp, Homo sapiens
tctttatgcacataaagaaact

SEQ ID NO: 7726348 - DNA, 22 bp, Homo sapiens
tctttattgctactggtttgtc

SEQ ID NO: 7726349 - DNA, 22 bp, Homo sapiens
tctttatgtttgaaagtacaat

SEQ ID NO: 7726350 - DNA, 22 bp, Homo sapiens
tctttataaaagtcattatgtc

SEQ ID NO: 7726351 - DNA, 22 bp, Homo sapiens
tctttataaaagtcattatgtc

SEQ ID NO: 7726352 - DNA, 22 bp, Homo sapiens
tctttataaaagtcattatgtc

SEQ ID NO: 7726353 - DNA, 22 bp, Homo sapiens
tctttataaaagtcattatgtc

SEQ ID NO: 7726354 - DNA, 22 bp, Homo sapiens
tctttataaaagtcattatgtc

SEQ ID NO: 7726355 - DNA, 22 bp, Homo sapiens
tctttatacaaactgggaaaca

SEQ ID NO: 7726356 - DNA, 22 bp, Homo sapiens
tctttatacaaactgggaaaca

SEQ ID NO: 7726357 - DNA, 22 bp, Homo sapiens
tctttatctggctcagagacac

SEQ ID NO: 7726358 - DNA, 21 bp, Homo sapiens
tctttatgacttgcccatttg

SEQ ID NO: 7726359 - DNA, 22 bp, Homo sapiens
tctttatctggctcagagacac

SEQ ID NO: 7726360 - DNA, 22 bp, Homo sapiens
tctttatctggctcagagacac

SEQ ID NO: 7726361 - DNA, 22 bp, Homo sapiens
tctttatcaagtctgttctttg

SEQ ID NO: 7726362 - DNA, 22 bp, Homo sapiens
tctttatacaaactgggaaaca

SEQ ID NO: 7726363 - DNA, 22 bp, Homo sapiens
tctttatcaagtctgttctttg

SEQ ID NO: 7726364 - DNA, 22 bp, Homo sapiens
tctttatcaagtctgttctttg

SEQ ID NO: 7726365 - DNA, 22 bp, Homo sapiens
tctttatcaggtgaagagggac

SEQ ID NO: 7726366 - DNA, 22 bp, Homo sapiens
tctttatctggctcagagacac

SEQ ID NO: 7726367 - DNA, 22 bp, Homo sapiens
tctttagctagaaatactctaa

SEQ ID NO: 7726368 - DNA, 22 bp, Homo sapiens
tctttagctagaaatactctaa

SEQ ID NO: 7726369 - DNA, 22 bp, Homo sapiens
tctttagccagtatcataatga

SEQ ID NO: 7726370 - DNA, 22 bp, Homo sapiens
tctttagccagtatcataatga

SEQ ID NO: 7726371 - DNA, 20 bp, Homo sapiens
tctttagatttatcttatgt

SEQ ID NO: 7726372 - DNA, 19 bp, Homo sapiens
tctttagccagagctctgg

SEQ ID NO: 7726373 - DNA, 22 bp, Homo sapiens
tctttagtgaccatctcattct

SEQ ID NO: 7726374 - DNA, 22 bp, Homo sapiens
tctttagtgacagttgtgcaag

SEQ ID NO: 7726375 - DNA, 22 bp, Homo sapiens
tctttagtgacagttgtgcaag

SEQ ID NO: 7726376 - DNA, 20 bp, Homo sapiens
tctttagttcctggcccttt

SEQ ID NO: 7726377 - DNA, 22 bp, Homo sapiens
tctttagtattgagttatggta

SEQ ID NO: 7726378 - DNA, 22 bp, Homo sapiens
tctttagtaatgtagcagttta

SEQ ID NO: 7726379 - DNA, 19 bp, Homo sapiens
tctttagtcacatttttat

SEQ ID NO: 7726380 - DNA, 22 bp, Homo sapiens
tctttagatgtttagaggaaga

SEQ ID NO: 7726381 - DNA, 22 bp, Homo sapiens
tctttagatgtttagaggaaga

SEQ ID NO: 7726382 - DNA, 20 bp, Homo sapiens
tctttagatttatcttatgt

SEQ ID NO: 7726383 - DNA, 22 bp, Homo sapiens
tctttagatgtttagaggaaga

SEQ ID NO: 7726384 - DNA, 22 bp, Homo sapiens
tctttagagctcagaaatacag

SEQ ID NO: 7726385 - DNA, 22 bp, Homo sapiens
tctttagagttaacaataatga

SEQ ID NO: 7726386 - DNA, 22 bp, Homo sapiens
tctttagagctcagaaatacag

SEQ ID NO: 7726387 - DNA, 22 bp, Homo sapiens
tctttagagctcagaaatacag

SEQ ID NO: 7726388 - DNA, 22 bp, Homo sapiens
tctttagagcacgggaaaaaca

SEQ ID NO: 7726389 - DNA, 22 bp, Homo sapiens
tctttagagcacgggaaaaaca

SEQ ID NO: 7726390 - DNA, 22 bp, Homo sapiens
tctttagagcacgggaaaaaca

SEQ ID NO: 7726391 - DNA, 22 bp, Homo sapiens
tctgggggaggaggcatggccc

SEQ ID NO: 7726392 - DNA, 22 bp, Homo sapiens
tctgggggaggaggcatggccc

SEQ ID NO: 7726393 - DNA, 22 bp, Homo sapiens
tctgggggaggaggcatggccc

SEQ ID NO: 7726394 - DNA, 22 bp, Homo sapiens
tctgggggaggaggcatggccc

SEQ ID NO: 7726395 - DNA, 22 bp, Homo sapiens
tctgggggaggaggcatggccc

SEQ ID NO: 7726396 - DNA, 22 bp, Homo sapiens
tctgggggaggaggcatggccc

SEQ ID NO: 7726397 - DNA, 22 bp, Homo sapiens
tctgggggaggaggcatggccc

SEQ ID NO: 7726398 - DNA, 22 bp, Homo sapiens
tctgggggcgaccagggactgc

SEQ ID NO: 7726399 - DNA, 22 bp, Homo sapiens
tctgggggcgaccagggactgc

SEQ ID NO: 7726400 - DNA, 22 bp, Homo sapiens
tctgggggcgaccagggactgc

SEQ ID NO: 7726401 - DNA, 22 bp, Homo sapiens
tctgggggcgaccagggactgc

SEQ ID NO: 7726402 - DNA, 22 bp, Homo sapiens
tctgggggcgaccagggactgc

SEQ ID NO: 7726403 - DNA, 22 bp, Homo sapiens
tctgggggcgaccagggactgc

SEQ ID NO: 7726404 - DNA, 22 bp, Homo sapiens
tctgggggcgaccagggactgc

SEQ ID NO: 7726405 - DNA, 22 bp, Homo sapiens
tctgggggcgaccagggactgc

SEQ ID NO: 7726406 - DNA, 22 bp, Homo sapiens
tctgggggcgaccagggactgc

SEQ ID NO: 7726407 - DNA, 22 bp, Homo sapiens
tctgggggttaagtgaggacaa

SEQ ID NO: 7726408 - DNA, 22 bp, Homo sapiens
tctgggggttaagtgaggacaa

SEQ ID NO: 7726409 - DNA, 21 bp, Homo sapiens
tctgggggtgagcctagaaat

SEQ ID NO: 7726410 - DNA, 21 bp, Homo sapiens
tctgggggtgagcctagaaat

SEQ ID NO: 7726411 - DNA, 21 bp, Homo sapiens
tctgggggtgagcctagaaat

SEQ ID NO: 7726412 - DNA, 21 bp, Homo sapiens
tctgggggtgagcctagaaat

SEQ ID NO: 7726413 - DNA, 21 bp, Homo sapiens
tctgggggtgagcctagaaat

SEQ ID NO: 7726414 - DNA, 20 bp, Homo sapiens
tctggggatgaggtctagga

SEQ ID NO: 7726415 - DNA, 20 bp, Homo sapiens
tctggggatgaggtctagga

SEQ ID NO: 7726416 - DNA, 22 bp, Homo sapiens
tctggggatgagtgatgtcgta

SEQ ID NO: 7726417 - DNA, 22 bp, Homo sapiens
tctgggctttgtaatgggaggt

SEQ ID NO: 7726418 - DNA, 22 bp, Homo sapiens
tctgggcttttccatgcctgtg

SEQ ID NO: 7726419 - DNA, 22 bp, Homo sapiens
tctgggcttttccatgcctgtg

SEQ ID NO: 7726420 - DNA, 22 bp, Homo sapiens
tctggggcagttactggggcct

SEQ ID NO: 7726421 - DNA, 22 bp, Homo sapiens
tctgggggaggaggcatggccc

SEQ ID NO: 7726422 - DNA, 22 bp, Homo sapiens
tctggggatgagtgatgtcgta

SEQ ID NO: 7726423 - DNA, 22 bp, Homo sapiens
tctggggatggtctactttctg

SEQ ID NO: 7726424 - DNA, 20 bp, Homo sapiens
tctggggatgaggtctagga

SEQ ID NO: 7726425 - DNA, 22 bp, Homo sapiens
tctggggatgagtgatgtcgta

SEQ ID NO: 7726426 - DNA, 22 bp, Homo sapiens
tctggggatggtctactttctg

SEQ ID NO: 7726427 - DNA, 22 bp, Homo sapiens
tctggggcagttactggggcct

SEQ ID NO: 7726428 - DNA, 22 bp, Homo sapiens
tctgggctttaagaactctgtt

SEQ ID NO: 7726429 - DNA, 22 bp, Homo sapiens
tctgggctttaagaactctgtt

SEQ ID NO: 7726430 - DNA, 22 bp, Homo sapiens
tctgggctttaagaactctgtt

SEQ ID NO: 7726431 - DNA, 22 bp, Homo sapiens
tctgggcttggttagggctgtt

SEQ ID NO: 7726432 - DNA, 22 bp, Homo sapiens
tctgggcttggattggctctgc

SEQ ID NO: 7726433 - DNA, 22 bp, Homo sapiens
tctgggcttgggtagaaatcac

SEQ ID NO: 7726434 - DNA, 22 bp, Homo sapiens
tctgggcttgggtagaaatcac

SEQ ID NO: 7726435 - DNA, 22 bp, Homo sapiens
tctgggcttggttagggctgtt

SEQ ID NO: 7726436 - DNA, 22 bp, Homo sapiens
tctgggcttggttagggctgtt

SEQ ID NO: 7726437 - DNA, 22 bp, Homo sapiens
tctgggcttggttagggctgtt

SEQ ID NO: 7726438 - DNA, 22 bp, Homo sapiens
tctgggctttacactgtgctta

SEQ ID NO: 7726439 - DNA, 22 bp, Homo sapiens
tctgggctttacactgtgctta

SEQ ID NO: 7726440 - DNA, 22 bp, Homo sapiens
tctgggctttacactgtgctta

SEQ ID NO: 7726441 - DNA, 22 bp, Homo sapiens
tctgggctttacactgtgctta

SEQ ID NO: 7726442 - DNA, 21 bp, Homo sapiens
tctgggctttcttataaggca

SEQ ID NO: 7726443 - DNA, 22 bp, Homo sapiens
tctgggctttagtttgttatct

SEQ ID NO: 7726444 - DNA, 22 bp, Homo sapiens
tctgggctttgtaatgggaggt

SEQ ID NO: 7726445 - DNA, 22 bp, Homo sapiens
tctgggctttgtaatgggaggt

SEQ ID NO: 7726446 - DNA, 22 bp, Homo sapiens
tctgggctttgtaatgggaggt

SEQ ID NO: 7726447 - DNA, 22 bp, Homo sapiens
tctgggctttgtaatgggaggt

SEQ ID NO: 7726448 - DNA, 22 bp, Homo sapiens
tctgggctttgtaatgggaggt

SEQ ID NO: 7726449 - DNA, 20 bp, Homo sapiens
tctgggcttcccccagctcc

SEQ ID NO: 7726450 - DNA, 20 bp, Homo sapiens
tctgggcttcccccagctcc

SEQ ID NO: 7726451 - DNA, 20 bp, Homo sapiens
tctgggcttcccccagctcc

SEQ ID NO: 7726452 - DNA, 20 bp, Homo sapiens
tctgggcttcccccagctcc

SEQ ID NO: 7726453 - DNA, 20 bp, Homo sapiens
tctgggcttcccccagctcc

SEQ ID NO: 7726454 - DNA, 20 bp, Homo sapiens
tctgggcttcccccagctcc

SEQ ID NO: 7726455 - DNA, 17 bp, Homo sapiens
tctgggcttcagtggtc

SEQ ID NO: 7726456 - DNA, 17 bp, Homo sapiens
tctgggcttcagtggtc

SEQ ID NO: 7726457 - DNA, 17 bp, Homo sapiens
tctgggcttcagtggtc

SEQ ID NO: 7726458 - DNA, 17 bp, Homo sapiens
tctgggcttcagtggtc

SEQ ID NO: 7726459 - DNA, 22 bp, Homo sapiens
tctgggctgtgccaaagctctt

SEQ ID NO: 7726460 - DNA, 22 bp, Homo sapiens
tctgggctgtgccaaagctctt

SEQ ID NO: 7726461 - DNA, 22 bp, Homo sapiens
tctgggctgtggttccactccg

SEQ ID NO: 7726462 - DNA, 17 bp, Homo sapiens
tctgggcttcagtggtc

SEQ ID NO: 7726463 - DNA, 18 bp, Homo sapiens
tctgggcttcccgaggct

SEQ ID NO: 7726464 - DNA, 18 bp, Homo sapiens
tctgggcttcccgaggct

SEQ ID NO: 7726465 - DNA, 18 bp, Homo sapiens
tctgggcttcccgaggct

SEQ ID NO: 7726466 - DNA, 22 bp, Homo sapiens
tctgggcttgcctggttgtgca

SEQ ID NO: 7726467 - DNA, 22 bp, Homo sapiens
tctgggcttgcctggttgtgca

SEQ ID NO: 7726468 - DNA, 22 bp, Homo sapiens
tctgggcttggattggctctgc

SEQ ID NO: 7726469 - DNA, 22 bp, Homo sapiens
tctgggcttggattggctctgc

SEQ ID NO: 7726470 - DNA, 22 bp, Homo sapiens
tctgggcttgcctggttgtgca

SEQ ID NO: 7726471 - DNA, 22 bp, Homo sapiens
tctgggcttggattggctctgc

SEQ ID NO: 7726472 - DNA, 22 bp, Homo sapiens
tctgggcttggattggctctgc

SEQ ID NO: 7726473 - DNA, 22 bp, Homo sapiens
tctgggctgcttcagccttcgc

SEQ ID NO: 7726474 - DNA, 22 bp, Homo sapiens
tctgggctgcttcagccttcgc

SEQ ID NO: 7726475 - DNA, 22 bp, Homo sapiens
tctgggctgcttcagccttcgc

SEQ ID NO: 7726476 - DNA, 22 bp, Homo sapiens
tctgggctggctttatgctgac

SEQ ID NO: 7726477 - DNA, 22 bp, Homo sapiens
tctgggctggctttatgctgac

SEQ ID NO: 7726478 - DNA, 22 bp, Homo sapiens
tctgggctgggagcgtgtggac

SEQ ID NO: 7726479 - DNA, 22 bp, Homo sapiens
tctgggctgggagcgtgtggac

SEQ ID NO: 7726480 - DNA, 22 bp, Homo sapiens
tctgggctgggcttaggaaccc

SEQ ID NO: 7726481 - DNA, 22 bp, Homo sapiens
tctgggctgggagcgtgtggac

SEQ ID NO: 7726482 - DNA, 22 bp, Homo sapiens
tctgggctgggagcgtgtggac

SEQ ID NO: 7726483 - DNA, 22 bp, Homo sapiens
tctgggctgtgccaaagctctt

SEQ ID NO: 7726484 - DNA, 15 bp, Homo sapiens
tctgggctgtgagca

SEQ ID NO: 7726485 - DNA, 22 bp, Homo sapiens
tctgggctgtctacaggttggc

SEQ ID NO: 7726486 - DNA, 22 bp, Homo sapiens
tctgggctgtctacaggttggc

SEQ ID NO: 7726487 - DNA, 22 bp, Homo sapiens
tctgggctgtctacaggttggc

SEQ ID NO: 7726488 - DNA, 22 bp, Homo sapiens
tctgggctgtctacaggttggc

SEQ ID NO: 7726489 - DNA, 22 bp, Homo sapiens
tctgggctgtctacaggttggc

SEQ ID NO: 7726490 - DNA, 22 bp, Homo sapiens
tctgggctggtgctcatgaatt

SEQ ID NO: 7726491 - DNA, 22 bp, Homo sapiens
tctgggctggtgctcatgaatt

SEQ ID NO: 7726492 - DNA, 22 bp, Homo sapiens
tctgggctggttgtgcttgctt

SEQ ID NO: 7726493 - DNA, 22 bp, Homo sapiens
tctgggctggttgtgcttgctt

SEQ ID NO: 7726494 - DNA, 22 bp, Homo sapiens
tctgggggttaagtgaggacaa

SEQ ID NO: 7726495 - DNA, 22 bp, Homo sapiens
tctgggggttaagtgaggacaa

SEQ ID NO: 7726496 - DNA, 21 bp, Homo sapiens
tctgggggtgagcctagaaat

SEQ ID NO: 7726497 - DNA, 22 bp, Homo sapiens
tctgggggttaagtgaggacaa

SEQ ID NO: 7726498 - DNA, 22 bp, Homo sapiens
tctgggggttaagtgaggacaa

SEQ ID NO: 7726499 - DNA, 22 bp, Homo sapiens
tctgggggttaagtgaggacaa

SEQ ID NO: 7726500 - DNA, 22 bp, Homo sapiens
tctgggggttaagtgaggacaa

SEQ ID NO: 7726501 - DNA, 22 bp, Homo sapiens
tctgggggttaagtgaggacaa

SEQ ID NO: 7726502 - DNA, 22 bp, Homo sapiens
tctggggtcacctggggtgctt

SEQ ID NO: 7726503 - DNA, 22 bp, Homo sapiens
tctggggtcacctggggtgctt

SEQ ID NO: 7726504 - DNA, 22 bp, Homo sapiens
tctggggtcacctggggtgctt

SEQ ID NO: 7726505 - DNA, 22 bp, Homo sapiens
tctggggtcacctggggtgctt

SEQ ID NO: 7726506 - DNA, 22 bp, Homo sapiens
tctggggtgcagcctggacata

SEQ ID NO: 7726507 - DNA, 22 bp, Homo sapiens
tctggggtgcagcctaggcatc

SEQ ID NO: 7726508 - DNA, 22 bp, Homo sapiens
tctggggtgcagcctaggcatc

SEQ ID NO: 7726509 - DNA, 22 bp, Homo sapiens
tctggggtgcagcctaggcatc

SEQ ID NO: 7726510 - DNA, 22 bp, Homo sapiens
tctggggtgaggcctggttatc

SEQ ID NO: 7726511 - DNA, 22 bp, Homo sapiens
tctggggtgaggcctggttatc

SEQ ID NO: 7726512 - DNA, 20 bp, Homo sapiens
tctggggtgaagcccaggaa

SEQ ID NO: 7726513 - DNA, 20 bp, Homo sapiens
tctggggtgaagcccaggaa

SEQ ID NO: 7726514 - DNA, 20 bp, Homo sapiens
tctggggtgaagcccaggaa

SEQ ID NO: 7726515 - DNA, 22 bp, Homo sapiens
tctgggggttaagtgaggacaa

SEQ ID NO: 7726516 - DNA, 22 bp, Homo sapiens
tctggggtcacctggggtgctt

SEQ ID NO: 7726517 - DNA, 18 bp, Homo sapiens
tctggggtgtgctgtgta

SEQ ID NO: 7726518 - DNA, 22 bp, Homo sapiens
tctggggtgtgacctgagcatg

SEQ ID NO: 7726519 - DNA, 18 bp, Homo sapiens
tctggggtgtgctgtgta

SEQ ID NO: 7726520 - DNA, 19 bp, Homo sapiens
tctggggtgtggcctggca

SEQ ID NO: 7726521 - DNA, 19 bp, Homo sapiens
tctggggtgtggcctggca

SEQ ID NO: 7726522 - DNA, 19 bp, Homo sapiens
tctggggtgtggcctggca

SEQ ID NO: 7726523 - DNA, 19 bp, Homo sapiens
tctggggtgtggcctggca

SEQ ID NO: 7726524 - DNA, 22 bp, Homo sapiens
tctggggttaagcccaggaatg

SEQ ID NO: 7726525 - DNA, 22 bp, Homo sapiens
tctggggttaagcccaggaatg

SEQ ID NO: 7726526 - DNA, 22 bp, Homo sapiens
tctggggtgcagcctggacata

SEQ ID NO: 7726527 - DNA, 22 bp, Homo sapiens
tctggggtgcagcctggacata

SEQ ID NO: 7726528 - DNA, 22 bp, Homo sapiens
tctggggtggagccctggagtc

SEQ ID NO: 7726529 - DNA, 22 bp, Homo sapiens
tctggggtggagccctggagtc

SEQ ID NO: 7726530 - DNA, 22 bp, Homo sapiens
tctggggtgcagcctggacata

SEQ ID NO: 7726531 - DNA, 22 bp, Homo sapiens
tctggggtggagccctggagtc

SEQ ID NO: 7726532 - DNA, 22 bp, Homo sapiens
tctggggtgtgacctgagcatg

SEQ ID NO: 7726533 - DNA, 22 bp, Homo sapiens
tctggggtgtgacctgagcatg

SEQ ID NO: 7726534 - DNA, 22 bp, Homo sapiens
tctggggtgtgacctgagcatg

SEQ ID NO: 7726535 - DNA, 22 bp, Homo sapiens
tctgggtaatcagggctgggag

SEQ ID NO: 7726536 - DNA, 22 bp, Homo sapiens
tctgggtatgacctatttttcc

SEQ ID NO: 7726537 - DNA, 22 bp, Homo sapiens
tctgggtcactgtgggagggca

SEQ ID NO: 7726538 - DNA, 22 bp, Homo sapiens
tctgggtcatgactcagcgtga

SEQ ID NO: 7726539 - DNA, 22 bp, Homo sapiens
tctgggtcatgactcagcgtga

SEQ ID NO: 7726540 - DNA, 22 bp, Homo sapiens
tctggggttgagtctgggtcag

SEQ ID NO: 7726541 - DNA, 22 bp, Homo sapiens
tctggggttgagtctgggtcag

SEQ ID NO: 7726542 - DNA, 22 bp, Homo sapiens
tctggggttgagtctgggtcag

SEQ ID NO: 7726543 - DNA, 22 bp, Homo sapiens
tctggggttttcacgctgtctc

SEQ ID NO: 7726544 - DNA, 22 bp, Homo sapiens
tctgggtctattcctactgtga

SEQ ID NO: 7726545 - DNA, 22 bp, Homo sapiens
tctgggtctattcctactgtga

SEQ ID NO: 7726546 - DNA, 22 bp, Homo sapiens
tctgggtccgggactgtggatg

SEQ ID NO: 7726547 - DNA, 22 bp, Homo sapiens
tctgggtctatcccatgccttt

SEQ ID NO: 7726548 - DNA, 22 bp, Homo sapiens
tctgggtctatcccatgccttt

SEQ ID NO: 7726549 - DNA, 22 bp, Homo sapiens
tctgggtctcagagtgaccatg

SEQ ID NO: 7726550 - DNA, 22 bp, Homo sapiens
tctgggtctggctgctggtgca

SEQ ID NO: 7726551 - DNA, 22 bp, Homo sapiens
tctgggtgaccctgggcaaggc

SEQ ID NO: 7726552 - DNA, 22 bp, Homo sapiens
tctgggtgtcactcctgcctgc

SEQ ID NO: 7726553 - DNA, 22 bp, Homo sapiens
tctgggtgtcactcctgcctgc

SEQ ID NO: 7726554 - DNA, 22 bp, Homo sapiens
tctgggtgtagggcctggcaac

SEQ ID NO: 7726555 - DNA, 22 bp, Homo sapiens
tctgggtgtagggcctggcaac

SEQ ID NO: 7726556 - DNA, 22 bp, Homo sapiens
tctgggtgtagggcctggcaac

SEQ ID NO: 7726557 - DNA, 22 bp, Homo sapiens
tctgggtgtggtatcttagcca

SEQ ID NO: 7726558 - DNA, 22 bp, Homo sapiens
tctgggttgaattggataaaca

SEQ ID NO: 7726559 - DNA, 22 bp, Homo sapiens
tctgggttgggagaaaagaggg

SEQ ID NO: 7726560 - DNA, 20 bp, Homo sapiens
tctgggttgaaatcaagatc

SEQ ID NO: 7726561 - DNA, 22 bp, Homo sapiens
tctgggttcttcgattcttccc

SEQ ID NO: 7726562 - DNA, 23 bp, Homo sapiens
tctgggttctaatcatgtgtgat

SEQ ID NO: 7726563 - DNA, 22 bp, Homo sapiens
tctgtaaaacttctttgtaaat

SEQ ID NO: 7726564 - DNA, 22 bp, Homo sapiens
tctgtaaaacttctttgtaaat

SEQ ID NO: 7726565 - DNA, 22 bp, Homo sapiens
tctgtaaaacaatattgtattc

SEQ ID NO: 7726566 - DNA, 22 bp, Homo sapiens
tctgtaaaacaatattgtattc

SEQ ID NO: 7726567 - DNA, 22 bp, Homo sapiens
tctgtaaaacaatattgtattc

SEQ ID NO: 7726568 - DNA, 18 bp, Homo sapiens
tctggtttctaggggagt

SEQ ID NO: 7726569 - DNA, 22 bp, Homo sapiens
tctggtttcccagttcctccgt

SEQ ID NO: 7726570 - DNA, 22 bp, Homo sapiens
tctgtaaaattagtataattgt

SEQ ID NO: 7726571 - DNA, 22 bp, Homo sapiens
tctgtaaaacttctttgtaaat

SEQ ID NO: 7726572 - DNA, 22 bp, Homo sapiens
tctgtaaaacttctttgtaaat

SEQ ID NO: 7726573 - DNA, 22 bp, Homo sapiens
tctgtaaaacttctttgtaaat

SEQ ID NO: 7726574 - DNA, 22 bp, Homo sapiens
tctgtaaaattagtataattgt

SEQ ID NO: 7726575 - DNA, 22 bp, Homo sapiens
tctgtaaaattagtataattgt

SEQ ID NO: 7726576 - DNA, 22 bp, Homo sapiens
tctgtaaacaccatgttagagt

SEQ ID NO: 7726577 - DNA, 22 bp, Homo sapiens
tctgtaaacaccatgttagagt

SEQ ID NO: 7726578 - DNA, 22 bp, Homo sapiens
tctgtaaacaccatgttagagt

SEQ ID NO: 7726579 - DNA, 22 bp, Homo sapiens
tctgtaaacaccatgttagagt

SEQ ID NO: 7726580 - DNA, 22 bp, Homo sapiens
tctgggtgagctgcctcgggtc

SEQ ID NO: 7726581 - DNA, 22 bp, Homo sapiens
tctgggtgaccctgggcaaggc

SEQ ID NO: 7726582 - DNA, 22 bp, Homo sapiens
tctgggtgatgaaatgcactgt

SEQ ID NO: 7726583 - DNA, 22 bp, Homo sapiens
tctgggtgagctgcctcgggtc

SEQ ID NO: 7726584 - DNA, 22 bp, Homo sapiens
tctgggtgccactgtctgtaca

SEQ ID NO: 7726585 - DNA, 22 bp, Homo sapiens
tctgggtgccctttgctctgtt

SEQ ID NO: 7726586 - DNA, 22 bp, Homo sapiens
tctgggtggctgccaatctgcc

SEQ ID NO: 7726587 - DNA, 22 bp, Homo sapiens
tctgggtggcagtgatggcgtg

SEQ ID NO: 7726588 - DNA, 22 bp, Homo sapiens
tctgggtggctgccaatctgcc

SEQ ID NO: 7726589 - DNA, 21 bp, Homo sapiens
tctgggtgctagtgtttgctt

SEQ ID NO: 7726590 - DNA, 22 bp, Homo sapiens
tctgggtgctacaaacagtatt

SEQ ID NO: 7726591 - DNA, 22 bp, Homo sapiens
tctgggtggcagtgatggcgtg

SEQ ID NO: 7726592 - DNA, 22 bp, Homo sapiens
tctgggtggcagtgatggcgtg

SEQ ID NO: 7726593 - DNA, 22 bp, Homo sapiens
tctgggtggcttcagaggccac

SEQ ID NO: 7726594 - DNA, 22 bp, Homo sapiens
tctgggtggcttcagaggccac

SEQ ID NO: 7726595 - DNA, 22 bp, Homo sapiens
tctgggtggcttcagaggccac

SEQ ID NO: 7726596 - DNA, 22 bp, Homo sapiens
tctgggtggcttcagaggccac

SEQ ID NO: 7726597 - DNA, 22 bp, Homo sapiens
tctgggtggtgtcttccaagac

SEQ ID NO: 7726598 - DNA, 22 bp, Homo sapiens
tctgggtggtgtcttccaagac

SEQ ID NO: 7726599 - DNA, 22 bp, Homo sapiens
tctgggtggtgtcttccaagac

SEQ ID NO: 7726600 - DNA, 22 bp, Homo sapiens
tctgggtgggcccgagaaatct

SEQ ID NO: 7726601 - DNA, 21 bp, Homo sapiens
tctgggtgtaaatcttatttg

SEQ ID NO: 7726602 - DNA, 21 bp, Homo sapiens
tctgggtgtaaatcttatttg

SEQ ID NO: 7726603 - DNA, 22 bp, Homo sapiens
tctgtctctttgttctgtgagt

SEQ ID NO: 7726604 - DNA, 22 bp, Homo sapiens
tctgtctctttgttctgtgagt

SEQ ID NO: 7726605 - DNA, 22 bp, Homo sapiens
tctgtctgacagggtatgaact

SEQ ID NO: 7726606 - DNA, 23 bp, Homo sapiens
tctgtctgaataatttactcttt

SEQ ID NO: 7726607 - DNA, 22 bp, Homo sapiens
tctgtctgactaccatgaggca

SEQ ID NO: 7726608 - DNA, 22 bp, Homo sapiens
tctgtctgacagggtatgaact

SEQ ID NO: 7726609 - DNA, 22 bp, Homo sapiens
tctgtctgactaccatgaggca

SEQ ID NO: 7726610 - DNA, 20 bp, Homo sapiens
tctgtctctgagctagactt

SEQ ID NO: 7726611 - DNA, 18 bp, Homo sapiens
tctgtctctgtccttgct

SEQ ID NO: 7726612 - DNA, 18 bp, Homo sapiens
tctgtctctgtccttgct

SEQ ID NO: 7726613 - DNA, 20 bp, Homo sapiens
tctgtctctgagctagactt

SEQ ID NO: 7726614 - DNA, 20 bp, Homo sapiens
tctgtctctgagctagactt

SEQ ID NO: 7726615 - DNA, 18 bp, Homo sapiens
tctgtctctgtccttgct

SEQ ID NO: 7726616 - DNA, 21 bp, Homo sapiens
tctgtctctccactgccctgc

SEQ ID NO: 7726617 - DNA, 21 bp, Homo sapiens
tctgtctctccactgccctgc

SEQ ID NO: 7726618 - DNA, 22 bp, Homo sapiens
tctgtctctcaagggccgtcct

SEQ ID NO: 7726619 - DNA, 22 bp, Homo sapiens
tctgtctctcaagggccgtcct

SEQ ID NO: 7726620 - DNA, 22 bp, Homo sapiens
tctgtctctcaagggccgtcct

SEQ ID NO: 7726621 - DNA, 21 bp, Homo sapiens
tctgtctctccactgccctgc

SEQ ID NO: 7726622 - DNA, 21 bp, Homo sapiens
tctgtctctccactgccctgc

SEQ ID NO: 7726623 - DNA, 21 bp, Homo sapiens
tctgtctctccactgccctgc

SEQ ID NO: 7726624 - DNA, 21 bp, Homo sapiens
tctgtctctccactgccctgc

SEQ ID NO: 7726625 - DNA, 22 bp, Homo sapiens
tctgtctcctgccagtgcctct

SEQ ID NO: 7726626 - DNA, 22 bp, Homo sapiens
tctgtctcctgccagtgcctct

SEQ ID NO: 7726627 - DNA, 22 bp, Homo sapiens
tctgtctcctgccagtgcctct

SEQ ID NO: 7726628 - DNA, 22 bp, Homo sapiens
tctgtctcctgccagtgcctct

SEQ ID NO: 7726629 - DNA, 22 bp, Homo sapiens
tctgtctcctgccagtgcctct

SEQ ID NO: 7726630 - DNA, 18 bp, Homo sapiens
tctgtccttccattcttc

SEQ ID NO: 7726631 - DNA, 18 bp, Homo sapiens
tctgtccttccattcttc

SEQ ID NO: 7726632 - DNA, 18 bp, Homo sapiens
tctgtccttccattcttc

SEQ ID NO: 7726633 - DNA, 22 bp, Homo sapiens
tctgtcctgtttcctcctgaca

SEQ ID NO: 7726634 - DNA, 22 bp, Homo sapiens
tctgtcctgtttcctcctgaca

SEQ ID NO: 7726635 - DNA, 20 bp, Homo sapiens
tctgtcctttctgctaaggc

SEQ ID NO: 7726636 - DNA, 20 bp, Homo sapiens
tctgtcctttctgctaaggc

SEQ ID NO: 7726637 - DNA, 20 bp, Homo sapiens
tctgtcctttctgctaaggc

SEQ ID NO: 7726638 - DNA, 22 bp, Homo sapiens
tctgtcctgtttcctcctgaca

SEQ ID NO: 7726639 - DNA, 22 bp, Homo sapiens
tctgtcctgtttcctcctgaca

SEQ ID NO: 7726640 - DNA, 22 bp, Homo sapiens
tctgtcctctttgaagctgctc

SEQ ID NO: 7726641 - DNA, 22 bp, Homo sapiens
tctgtcctgtttcctcctgaca

SEQ ID NO: 7726642 - DNA, 22 bp, Homo sapiens
tctgtcctgtttcctcctgaca

SEQ ID NO: 7726643 - DNA, 22 bp, Homo sapiens
tctgtcctgtttcctcctgaca

SEQ ID NO: 7726644 - DNA, 22 bp, Homo sapiens
tctgtctcctctgaggtgccag

SEQ ID NO: 7726645 - DNA, 22 bp, Homo sapiens
tctgtctcctcagatgactcca

SEQ ID NO: 7726646 - DNA, 22 bp, Homo sapiens
tctgtctcctcagatgactcca

SEQ ID NO: 7726647 - DNA, 22 bp, Homo sapiens
tctgtctcctctgaggtgccag

SEQ ID NO: 7726648 - DNA, 22 bp, Homo sapiens
tctgtctcctctgaggtgccag

SEQ ID NO: 7726649 - DNA, 22 bp, Homo sapiens
tctgtctcctctgaggtgccag

SEQ ID NO: 7726650 - DNA, 22 bp, Homo sapiens
tctgtctacagggagaatgata

SEQ ID NO: 7726651 - DNA, 22 bp, Homo sapiens
tctgtctcaagttcttgcactc

SEQ ID NO: 7726652 - DNA, 22 bp, Homo sapiens
tctgtctcaagttcttgcactc

SEQ ID NO: 7726653 - DNA, 22 bp, Homo sapiens
tctgtctcaagttcttgcactc

SEQ ID NO: 7726654 - DNA, 22 bp, Homo sapiens
tctgtctcaagttcttgcactc

SEQ ID NO: 7726655 - DNA, 22 bp, Homo sapiens
tctgtctcaagttcttgcactc

SEQ ID NO: 7726656 - DNA, 22 bp, Homo sapiens
tctgtcattgcaataaaatttc

SEQ ID NO: 7726657 - DNA, 22 bp, Homo sapiens
tctgtcatttcaatatggttaa

SEQ ID NO: 7726658 - DNA, 21 bp, Homo sapiens
tctgtcattctatttcatata

SEQ ID NO: 7726659 - DNA, 22 bp, Homo sapiens
tctgtcattttgtatctacatg

SEQ ID NO: 7726660 - DNA, 19 bp, Homo sapiens
tctgtcatttcttctgtac

SEQ ID NO: 7726661 - DNA, 21 bp, Homo sapiens
tctgtcatttgttagatgcaa

SEQ ID NO: 7726662 - DNA, 22 bp, Homo sapiens
tctgtcattgcaataaaatttc

SEQ ID NO: 7726663 - DNA, 22 bp, Homo sapiens
tctgtcatttcattcatatgaa

SEQ ID NO: 7726664 - DNA, 22 bp, Homo sapiens
tctgtcatttcattcatatgaa

SEQ ID NO: 7726665 - DNA, 22 bp, Homo sapiens
tctgtcatttcattcatatgaa

SEQ ID NO: 7726666 - DNA, 22 bp, Homo sapiens
tctgtcatgtttccattacatg

SEQ ID NO: 7726667 - DNA, 22 bp, Homo sapiens
tctgtcatgccacaggacttgg

SEQ ID NO: 7726668 - DNA, 22 bp, Homo sapiens
tctgtcatctgtaacaggaggg

SEQ ID NO: 7726669 - DNA, 22 bp, Homo sapiens
tctgtcatctgttcagtgctca

SEQ ID NO: 7726670 - DNA, 22 bp, Homo sapiens
tctgtcatctctaaaatagaaa

SEQ ID NO: 7726671 - DNA, 22 bp, Homo sapiens
tctgtcatctctaaaatagaaa

SEQ ID NO: 7726672 - DNA, 22 bp, Homo sapiens
tctgtcacccaggctggagtgc

SEQ ID NO: 7726673 - DNA, 22 bp, Homo sapiens
tctgtccacaagcacaggctct

SEQ ID NO: 7726674 - DNA, 22 bp, Homo sapiens
tctgtccacaagcacaggctct

SEQ ID NO: 7726675 - DNA, 20 bp, Homo sapiens
tctgtccaccagcctcgcct

SEQ ID NO: 7726676 - DNA, 20 bp, Homo sapiens
tctgtccaccagcctcgcct

SEQ ID NO: 7726677 - DNA, 18 bp, Homo sapiens
tctgtccaccctgtgctg

SEQ ID NO: 7726678 - DNA, 18 bp, Homo sapiens
tctgtccaccctgtgctg

SEQ ID NO: 7726679 - DNA, 23 bp, Homo sapiens
tctgtccaccgcatgcagcggcc

SEQ ID NO: 7726680 - DNA, 23 bp, Homo sapiens
tctgtccaccgcatgcagcggcc

SEQ ID NO: 7726681 - DNA, 22 bp, Homo sapiens
tctgtccaacactctctagaca

SEQ ID NO: 7726682 - DNA, 22 bp, Homo sapiens
tctgtccaacaagccccttctc

SEQ ID NO: 7726683 - DNA, 22 bp, Homo sapiens
tctgtccacaagcacaggctct

SEQ ID NO: 7726684 - DNA, 22 bp, Homo sapiens
tctgtccaagacaccatagtgg

SEQ ID NO: 7726685 - DNA, 22 bp, Homo sapiens
tctgtccaagacaccatagtgg

SEQ ID NO: 7726686 - DNA, 22 bp, Homo sapiens
tctgtccaacactctctagaca

SEQ ID NO: 7726687 - DNA, 22 bp, Homo sapiens
tctgtccagaacgtacatcttg

SEQ ID NO: 7726688 - DNA, 18 bp, Homo sapiens
tctgtccaccctgtgctg

SEQ ID NO: 7726689 - DNA, 23 bp, Homo sapiens
tctgtccacgcgaggcccttgct

SEQ ID NO: 7726690 - DNA, 22 bp, Homo sapiens
tctgtccagaacgtacatcttg

SEQ ID NO: 7726691 - DNA, 23 bp, Homo sapiens
tctgtccacgcgaggcccttgct

SEQ ID NO: 7726692 - DNA, 22 bp, Homo sapiens
tctgtccagaacgtacatcttg

SEQ ID NO: 7726693 - DNA, 22 bp, Homo sapiens
tctgtccagaataccctggcct

SEQ ID NO: 7726694 - DNA, 22 bp, Homo sapiens
tctgtccagaggtcctggagac

SEQ ID NO: 7726695 - DNA, 22 bp, Homo sapiens
tctgtccagacgcctccgtgag

SEQ ID NO: 7726696 - DNA, 22 bp, Homo sapiens
tctgtccagctctcaggagaca

SEQ ID NO: 7726697 - DNA, 22 bp, Homo sapiens
tctgtccagaggtcctggagac

SEQ ID NO: 7726698 - DNA, 22 bp, Homo sapiens
tctgtccagaggtcctggagac

SEQ ID NO: 7726699 - DNA, 22 bp, Homo sapiens
tctgtccagctctcaggagaca

SEQ ID NO: 7726700 - DNA, 22 bp, Homo sapiens
tctgtccagctctcaggagaca

SEQ ID NO: 7726701 - DNA, 22 bp, Homo sapiens
tctgtccagctctggggctcac

SEQ ID NO: 7726702 - DNA, 22 bp, Homo sapiens
tctgtcctccacactgtaagtt

SEQ ID NO: 7726703 - DNA, 22 bp, Homo sapiens
tctgtccctgagagctcaggag

SEQ ID NO: 7726704 - DNA, 22 bp, Homo sapiens
tctgtcctccggagctcccagt

SEQ ID NO: 7726705 - DNA, 22 bp, Homo sapiens
tctgtcctccggagctcccagt

SEQ ID NO: 7726706 - DNA, 22 bp, Homo sapiens
tctgtcctccggagctcccagt

SEQ ID NO: 7726707 - DNA, 22 bp, Homo sapiens
tctgtcctccggagctcccagt

SEQ ID NO: 7726708 - DNA, 22 bp, Homo sapiens
tctgtcctccggagctcccagt

SEQ ID NO: 7726709 - DNA, 22 bp, Homo sapiens
tctgtcctccggagctcccagt

SEQ ID NO: 7726710 - DNA, 22 bp, Homo sapiens
tctgtccattttccattttggc

SEQ ID NO: 7726711 - DNA, 22 bp, Homo sapiens
tctgtccctgagagctcaggag

SEQ ID NO: 7726712 - DNA, 22 bp, Homo sapiens
tctgtccctgagagctcaggag

SEQ ID NO: 7726713 - DNA, 22 bp, Homo sapiens
tctgtccatttataagccccca

SEQ ID NO: 7726714 - DNA, 22 bp, Homo sapiens
tctgtccatttggagttggaag

SEQ ID NO: 7726715 - DNA, 22 bp, Homo sapiens
tctgtccattttccattttggc

SEQ ID NO: 7726716 - DNA, 22 bp, Homo sapiens
tctgtccatttggagttggaag

SEQ ID NO: 7726717 - DNA, 22 bp, Homo sapiens
tctgtccatttggagttggaag

SEQ ID NO: 7726718 - DNA, 22 bp, Homo sapiens
tctgtccatttacagatatgca

SEQ ID NO: 7726719 - DNA, 22 bp, Homo sapiens
tctgtccatttacagatatgca

SEQ ID NO: 7726720 - DNA, 22 bp, Homo sapiens
tctgtccatttataagccccca

SEQ ID NO: 7726721 - DNA, 17 bp, Homo sapiens
tctgtccagggagtgtg

SEQ ID NO: 7726722 - DNA, 22 bp, Homo sapiens
tctgtccaggcttactatatat

SEQ ID NO: 7726723 - DNA, 22 bp, Homo sapiens
tctgtccaggcttactatatat

SEQ ID NO: 7726724 - DNA, 17 bp, Homo sapiens
tctgtccagggagtgtg

SEQ ID NO: 7726725 - DNA, 22 bp, Homo sapiens
tctgtccagctctggggctcac

SEQ ID NO: 7726726 - DNA, 22 bp, Homo sapiens
tctgtccagctctggggctcac

SEQ ID NO: 7726727 - DNA, 22 bp, Homo sapiens
tctgtccaggcttactatatat

SEQ ID NO: 7726728 - DNA, 22 bp, Homo sapiens
tctgtccaggtcagcctacatt

SEQ ID NO: 7726729 - DNA, 22 bp, Homo sapiens
tctgtccaggtcagcctacatt

SEQ ID NO: 7726730 - DNA, 22 bp, Homo sapiens
tctgtccaggtcagcctacatt

SEQ ID NO: 7726731 - DNA, 17 bp, Homo sapiens
tctgtccagggagtgtg

SEQ ID NO: 7726732 - DNA, 22 bp, Homo sapiens
tctgtccagtggctctcaggga

SEQ ID NO: 7726733 - DNA, 22 bp, Homo sapiens
tctgtccagtggctctcaggga

SEQ ID NO: 7726734 - DNA, 22 bp, Homo sapiens
tctgtccagtggctctcaggga

SEQ ID NO: 7726735 - DNA, 22 bp, Homo sapiens
tctgtccagtgccagtgaagac

SEQ ID NO: 7726736 - DNA, 22 bp, Homo sapiens
tctgtccagtgccagtgaagac

SEQ ID NO: 7726737 - DNA, 22 bp, Homo sapiens
tctgtccattcagaatggccct

SEQ ID NO: 7726738 - DNA, 22 bp, Homo sapiens
tctgtccatgtgaggttctctg

SEQ ID NO: 7726739 - DNA, 22 bp, Homo sapiens
tctgtccattcagaatggccct

SEQ ID NO: 7726740 - DNA, 22 bp, Homo sapiens
tctgtccattcagaatggccct

SEQ ID NO: 7726741 - DNA, 22 bp, Homo sapiens
tctgtccattcagccatccatc

SEQ ID NO: 7726742 - DNA, 22 bp, Homo sapiens
tctgtccattcagccatccatc

SEQ ID NO: 7726743 - DNA, 22 bp, Homo sapiens
tctgtccattcagccatccatc

SEQ ID NO: 7726744 - DNA, 22 bp, Homo sapiens
tctgtccatgcttttctctcac

SEQ ID NO: 7726745 - DNA, 22 bp, Homo sapiens
tctgtccatgcttttctctcac

SEQ ID NO: 7726746 - DNA, 22 bp, Homo sapiens
tctgtccatgcctggaggagag

SEQ ID NO: 7726747 - DNA, 22 bp, Homo sapiens
tctgtccatctcttgggagtga

SEQ ID NO: 7726748 - DNA, 22 bp, Homo sapiens
tctgtccatgcctggaggagag

SEQ ID NO: 7726749 - DNA, 22 bp, Homo sapiens
tctgtccatctcttgggagtga

SEQ ID NO: 7726750 - DNA, 22 bp, Homo sapiens
tctgtcacccagagtgcagtgg

SEQ ID NO: 7726751 - DNA, 22 bp, Homo sapiens
tctgtcaccattcagcttgaat

SEQ ID NO: 7726752 - DNA, 22 bp, Homo sapiens
tctgtcaccattcagcttgaat

SEQ ID NO: 7726753 - DNA, 22 bp, Homo sapiens
tctgtcacaatttgcttactct

SEQ ID NO: 7726754 - DNA, 22 bp, Homo sapiens
tctgtcacatacacttttcagg

SEQ ID NO: 7726755 - DNA, 22 bp, Homo sapiens
tctgtcacccaggctggagtgc

SEQ ID NO: 7726756 - DNA, 22 bp, Homo sapiens
tctgtcacccaggctggagtgc

SEQ ID NO: 7726757 - DNA, 22 bp, Homo sapiens
tctgtcacccagagtgcagtgg

SEQ ID NO: 7726758 - DNA, 22 bp, Homo sapiens
tctgtcaaatgggcataaggat

SEQ ID NO: 7726759 - DNA, 22 bp, Homo sapiens
tctgtattttaagatgctgttt

SEQ ID NO: 7726760 - DNA, 22 bp, Homo sapiens
tctgtattttaagatgctgttt

SEQ ID NO: 7726761 - DNA, 22 bp, Homo sapiens
tctgtattttaagatgctgttt

SEQ ID NO: 7726762 - DNA, 22 bp, Homo sapiens
tctgtcacaagtaatccttttc

SEQ ID NO: 7726763 - DNA, 22 bp, Homo sapiens
tctgtcaatatatgtgctgcag

SEQ ID NO: 7726764 - DNA, 22 bp, Homo sapiens
tctgtcaattattcacataggc

SEQ ID NO: 7726765 - DNA, 22 bp, Homo sapiens
tctgtagtctgtgccatagctg

SEQ ID NO: 7726766 - DNA, 22 bp, Homo sapiens
tctgtagtctctgatatatctg

SEQ ID NO: 7726767 - DNA, 22 bp, Homo sapiens
tctgtagtctctgatatatctg

SEQ ID NO: 7726768 - DNA, 22 bp, Homo sapiens
tctgtagtctgtgccatagctg

SEQ ID NO: 7726769 - DNA, 20 bp, Homo sapiens
tctgtagtctatgaggctta

SEQ ID NO: 7726770 - DNA, 22 bp, Homo sapiens
tctgtagtctctgatatatctg

SEQ ID NO: 7726771 - DNA, 22 bp, Homo sapiens
tctgtataaggacaaacattta

SEQ ID NO: 7726772 - DNA, 22 bp, Homo sapiens
tctgtataaagtaccggtggca

SEQ ID NO: 7726773 - DNA, 22 bp, Homo sapiens
tctgtagtctgtgccatagctg

SEQ ID NO: 7726774 - DNA, 22 bp, Homo sapiens
tctgtatcacccgttcccagaa

SEQ ID NO: 7726775 - DNA, 22 bp, Homo sapiens
tctgtatcacccgttcccagaa

SEQ ID NO: 7726776 - DNA, 22 bp, Homo sapiens
tctgtatatattaatgaaattc

SEQ ID NO: 7726777 - DNA, 22 bp, Homo sapiens
tctgtattgagaaagccggaca

SEQ ID NO: 7726778 - DNA, 22 bp, Homo sapiens
tctgtattgagaaagccggaca

SEQ ID NO: 7726779 - DNA, 22 bp, Homo sapiens
tctgtattgattctgttaggca

SEQ ID NO: 7726780 - DNA, 22 bp, Homo sapiens
tctgtatctaattttacagtag

SEQ ID NO: 7726781 - DNA, 22 bp, Homo sapiens
tctgtagtaggttgtagttctt

SEQ ID NO: 7726782 - DNA, 22 bp, Homo sapiens
tctgtagtaggttgtagttctt

SEQ ID NO: 7726783 - DNA, 22 bp, Homo sapiens
tctgtaggttaaaagtagacaa

SEQ ID NO: 7726784 - DNA, 22 bp, Homo sapiens
tctgtagtaggttgtagttctt

SEQ ID NO: 7726785 - DNA, 22 bp, Homo sapiens
tctgtagtaggttgtagttctt

SEQ ID NO: 7726786 - DNA, 22 bp, Homo sapiens
tctgtagtaggttgtagttctt

SEQ ID NO: 7726787 - DNA, 22 bp, Homo sapiens
tctgtagtaggttgtagttctt

SEQ ID NO: 7726788 - DNA, 22 bp, Homo sapiens
tctgtagggtagtagtggagat

SEQ ID NO: 7726789 - DNA, 22 bp, Homo sapiens
tctgtaggttaaaagtagacaa

SEQ ID NO: 7726790 - DNA, 20 bp, Homo sapiens
tctgtaggcaagttagcagg

SEQ ID NO: 7726791 - DNA, 22 bp, Homo sapiens
tctgtaggacagagaaatgggg

SEQ ID NO: 7726792 - DNA, 20 bp, Homo sapiens
tctgtaggcaagttagcagg

SEQ ID NO: 7726793 - DNA, 22 bp, Homo sapiens
tctgtaggacagagaaatgggg

SEQ ID NO: 7726794 - DNA, 22 bp, Homo sapiens
tctgtagcattcaccagccctg

SEQ ID NO: 7726795 - DNA, 22 bp, Homo sapiens
tctgtacatttggggaccccag

SEQ ID NO: 7726796 - DNA, 22 bp, Homo sapiens
tctgtacatgagttgagaatca

SEQ ID NO: 7726797 - DNA, 22 bp, Homo sapiens
tctgtacatgagttgagaatca

SEQ ID NO: 7726798 - DNA, 22 bp, Homo sapiens
tctgtacatttgtgttgtgaat

SEQ ID NO: 7726799 - DNA, 22 bp, Homo sapiens
tctgtacatttgtgttgtgaat

SEQ ID NO: 7726800 - DNA, 22 bp, Homo sapiens
tctgtacatgagttgagaatca

SEQ ID NO: 7726801 - DNA, 22 bp, Homo sapiens
tctgtaccttattctgtgacct

SEQ ID NO: 7726802 - DNA, 22 bp, Homo sapiens
tctgtaccttattctgtgacct

SEQ ID NO: 7726803 - DNA, 22 bp, Homo sapiens
tctgtacatttgtgttgtgaat

SEQ ID NO: 7726804 - DNA, 22 bp, Homo sapiens
tctgtacatttgtgttgtgaat

SEQ ID NO: 7726805 - DNA, 22 bp, Homo sapiens
tctgtacatttggggaccccag

SEQ ID NO: 7726806 - DNA, 22 bp, Homo sapiens
tctgtacttgttagtcttcatg

SEQ ID NO: 7726807 - DNA, 22 bp, Homo sapiens
tctgtacttcctttaaacttta

SEQ ID NO: 7726808 - DNA, 22 bp, Homo sapiens
tctgtacttgttagtcttcatg

SEQ ID NO: 7726809 - DNA, 22 bp, Homo sapiens
tctgtacttgttagtcttcatg

SEQ ID NO: 7726810 - DNA, 23 bp, Homo sapiens
tctgtacttagactggggcagaa

SEQ ID NO: 7726811 - DNA, 22 bp, Homo sapiens
tctgtagagacgaatgtgttat

SEQ ID NO: 7726812 - DNA, 22 bp, Homo sapiens
tctgtagagacgaatgtgttat

SEQ ID NO: 7726813 - DNA, 22 bp, Homo sapiens
tctgtaaagactccaaaagcca

SEQ ID NO: 7726814 - DNA, 20 bp, Homo sapiens
tctgtaaagactccagaagc

SEQ ID NO: 7726815 - DNA, 22 bp, Homo sapiens
tctgtaaacacccgtaagcttt

SEQ ID NO: 7726816 - DNA, 22 bp, Homo sapiens
tctgtaaagactccaaaagcca

SEQ ID NO: 7726817 - DNA, 22 bp, Homo sapiens
tctgtaaagatgtttatacctt

SEQ ID NO: 7726818 - DNA, 20 bp, Homo sapiens
tctgtaaagactccagaagc

SEQ ID NO: 7726819 - DNA, 22 bp, Homo sapiens
tctgtaaagccctggtacctgg

SEQ ID NO: 7726820 - DNA, 22 bp, Homo sapiens
tctgtaaagccctggtacctgg

SEQ ID NO: 7726821 - DNA, 22 bp, Homo sapiens
tctgtaaagtctgtgtaaagtc

SEQ ID NO: 7726822 - DNA, 22 bp, Homo sapiens
tctgtaaagtctgtgtaaagtc

SEQ ID NO: 7726823 - DNA, 22 bp, Homo sapiens
tctgtaaagtctgtgtaaagtc

SEQ ID NO: 7726824 - DNA, 22 bp, Homo sapiens
tctgtaaagtctgtgtaaagtc

SEQ ID NO: 7726825 - DNA, 22 bp, Homo sapiens
tctgtacaaaggctatttggag

SEQ ID NO: 7726826 - DNA, 22 bp, Homo sapiens
tctgtacaaaggctatttggag

SEQ ID NO: 7726827 - DNA, 22 bp, Homo sapiens
tctgtacaacaaagggatgaga

SEQ ID NO: 7726828 - DNA, 22 bp, Homo sapiens
tctgtacaacaaagggatgaga

SEQ ID NO: 7726829 - DNA, 22 bp, Homo sapiens
tctgtacaacaaagggatgaga

SEQ ID NO: 7726830 - DNA, 22 bp, Homo sapiens
tctgtaatcttccccagctcag

SEQ ID NO: 7726831 - DNA, 22 bp, Homo sapiens
tctgtaaatcctgctcagcaac

SEQ ID NO: 7726832 - DNA, 22 bp, Homo sapiens
tctgtaaatcctgctcagcaac

SEQ ID NO: 7726833 - DNA, 22 bp, Homo sapiens
tctgtaaatctactaagagctc

SEQ ID NO: 7726834 - DNA, 22 bp, Homo sapiens
tctgtaaatctactaagagctc

SEQ ID NO: 7726835 - DNA, 22 bp, Homo sapiens
tctgtaagggaaggtgatttgc

SEQ ID NO: 7726836 - DNA, 22 bp, Homo sapiens
tctgtaatcaagatatttgaga

SEQ ID NO: 7726837 - DNA, 22 bp, Homo sapiens
tctgtaatcagagtagcagata

SEQ ID NO: 7726838 - DNA, 22 bp, Homo sapiens
tctgtaagtgttggttattcta

SEQ ID NO: 7726839 - DNA, 22 bp, Homo sapiens
tctgtaagtgttggttattcta

SEQ ID NO: 7726840 - DNA, 22 bp, Homo sapiens
tctgtacatgagttgagaatca

SEQ ID NO: 7726841 - DNA, 22 bp, Homo sapiens
tctgtacatgagttgagaatca

SEQ ID NO: 7726842 - DNA, 21 bp, Homo sapiens
tctgtacatcattgagtcccc

SEQ ID NO: 7726843 - DNA, 21 bp, Homo sapiens
tctgtacatcattgagtcccc

SEQ ID NO: 7726844 - DNA, 22 bp, Homo sapiens
tctgtacatgagttgagaatca

SEQ ID NO: 7726845 - DNA, 21 bp, Homo sapiens
tctgtacatcattgagtcccc

SEQ ID NO: 7726846 - DNA, 22 bp, Homo sapiens
tctgtacatgagttgagaatca

SEQ ID NO: 7726847 - DNA, 22 bp, Homo sapiens
tctgtacatgagttgagaatca

SEQ ID NO: 7726848 - DNA, 21 bp, Homo sapiens
tctgtacatcattgagtcccc

SEQ ID NO: 7726849 - DNA, 21 bp, Homo sapiens
tctgtacatcattgagtcccc

SEQ ID NO: 7726850 - DNA, 22 bp, Homo sapiens
tctgtacagtaccagatagtaa

SEQ ID NO: 7726851 - DNA, 22 bp, Homo sapiens
tctgtacacttcagcatgcatc

SEQ ID NO: 7726852 - DNA, 22 bp, Homo sapiens
tctgtacacttcagcatgcatc

SEQ ID NO: 7726853 - DNA, 22 bp, Homo sapiens
tctgtacacttcagcatgcatc

SEQ ID NO: 7726854 - DNA, 22 bp, Homo sapiens
tctgtacagtaccagatagtaa

SEQ ID NO: 7726855 - DNA, 22 bp, Homo sapiens
tctgtacagtaccagatagtaa

SEQ ID NO: 7726856 - DNA, 22 bp, Homo sapiens
tctgtacagtaccagatagtaa

SEQ ID NO: 7726857 - DNA, 22 bp, Homo sapiens
tctgtacagtaccagatagtaa

SEQ ID NO: 7726858 - DNA, 22 bp, Homo sapiens
tctgtacagtaccagatagtaa

SEQ ID NO: 7726859 - DNA, 22 bp, Homo sapiens
tctgtacagtaccagatagtaa

SEQ ID NO: 7726860 - DNA, 22 bp, Homo sapiens
tctgtacagtaccagatagtaa

SEQ ID NO: 7726861 - DNA, 22 bp, Homo sapiens
tctgtacagtaccagatagtaa

SEQ ID NO: 7726862 - DNA, 23 bp, Homo sapiens
tctgtacaattgagaagagaaca

SEQ ID NO: 7726863 - DNA, 23 bp, Homo sapiens
tctgtacaattgagaagagaaca

SEQ ID NO: 7726864 - DNA, 23 bp, Homo sapiens
tctgtacaattgagaagagaaca

SEQ ID NO: 7726865 - DNA, 23 bp, Homo sapiens
tctgtacacatcagcatctccca

SEQ ID NO: 7726866 - DNA, 23 bp, Homo sapiens
tctgtacaattgagaagagaaca

SEQ ID NO: 7726867 - DNA, 23 bp, Homo sapiens
tctgtacacatcagcatctccca

SEQ ID NO: 7726868 - DNA, 22 bp, Homo sapiens
tctgtacaccaggggccattct

SEQ ID NO: 7726869 - DNA, 22 bp, Homo sapiens
tctgtacaccaggggccattct

SEQ ID NO: 7726870 - DNA, 23 bp, Homo sapiens
tctgtacacatcagcatctccca

SEQ ID NO: 7726871 - DNA, 20 bp, Homo sapiens
tctgtacactcatcttctgc

SEQ ID NO: 7726872 - DNA, 20 bp, Homo sapiens
tctgtacactcatcttctgc

SEQ ID NO: 7726873 - DNA, 22 bp, Homo sapiens
tctgtacaccaggggccattct

SEQ ID NO: 7726874 - DNA, 23 bp, Homo sapiens
tctgtacacatcagcatctccca

SEQ ID NO: 7726875 - DNA, 22 bp, Homo sapiens
tctgtacaccaggggccattct

SEQ ID NO: 7726876 - DNA, 22 bp, Homo sapiens
tctgtacacttcagcatgcatc

SEQ ID NO: 7726877 - DNA, 22 bp, Homo sapiens
tctgtgctagcacgcagcaagg

SEQ ID NO: 7726878 - DNA, 22 bp, Homo sapiens
tctgtgctagcacgcagcaagg

SEQ ID NO: 7726879 - DNA, 22 bp, Homo sapiens
tctgtgctagaggagttggcca

SEQ ID NO: 7726880 - DNA, 22 bp, Homo sapiens
tctgtgctagaggagttggcca

SEQ ID NO: 7726881 - DNA, 22 bp, Homo sapiens
tctgtgctaggcagcctggccc

SEQ ID NO: 7726882 - DNA, 22 bp, Homo sapiens
tctgtgctagcacgcagcaagg

SEQ ID NO: 7726883 - DNA, 22 bp, Homo sapiens
tctgtgctagaggagttggcca

SEQ ID NO: 7726884 - DNA, 22 bp, Homo sapiens
tctgtgctagaggagttggcca

SEQ ID NO: 7726885 - DNA, 22 bp, Homo sapiens
tctgtgctagaggagttggcca

SEQ ID NO: 7726886 - DNA, 22 bp, Homo sapiens
tctgtgctagaggagttggcca

SEQ ID NO: 7726887 - DNA, 20 bp, Homo sapiens
tctgtgctacactccagatt

SEQ ID NO: 7726888 - DNA, 23 bp, Homo sapiens
tctgtgctacaaatcgcgtctgt

SEQ ID NO: 7726889 - DNA, 20 bp, Homo sapiens
tctgtgctacactccagatt

SEQ ID NO: 7726890 - DNA, 20 bp, Homo sapiens
tctgtgctacactccagatt

SEQ ID NO: 7726891 - DNA, 22 bp, Homo sapiens
tctgtgctcattcagtcattca

SEQ ID NO: 7726892 - DNA, 22 bp, Homo sapiens
tctgtgctcatgcatgtgaatt

SEQ ID NO: 7726893 - DNA, 22 bp, Homo sapiens
tctgtgctcatgcatgtgaatt

SEQ ID NO: 7726894 - DNA, 22 bp, Homo sapiens
tctgtgctcattcagtcattca

SEQ ID NO: 7726895 - DNA, 22 bp, Homo sapiens
tctgtgctcatgcatgtgaatt

SEQ ID NO: 7726896 - DNA, 23 bp, Homo sapiens
tctgtgctcgggggagctctctg

SEQ ID NO: 7726897 - DNA, 22 bp, Homo sapiens
tctgtgctaggcagcctggccc

SEQ ID NO: 7726898 - DNA, 22 bp, Homo sapiens
tctgtgctcaagttctgcctct

SEQ ID NO: 7726899 - DNA, 22 bp, Homo sapiens
tctgtgctcaagttctgcctct

SEQ ID NO: 7726900 - DNA, 22 bp, Homo sapiens
tctgtgctcaagttctgcctct

SEQ ID NO: 7726901 - DNA, 20 bp, Homo sapiens
tctgtgctcatcccacagta

SEQ ID NO: 7726902 - DNA, 20 bp, Homo sapiens
tctgtgctcatcccacagta

SEQ ID NO: 7726903 - DNA, 21 bp, Homo sapiens
tctgtgctgccgtcaacatcc

SEQ ID NO: 7726904 - DNA, 21 bp, Homo sapiens
tctgtgctgccgtcaacatcc

SEQ ID NO: 7726905 - DNA, 22 bp, Homo sapiens
tctgtgctggactgatttcata

SEQ ID NO: 7726906 - DNA, 22 bp, Homo sapiens
tctgtgctggactgatttcata

SEQ ID NO: 7726907 - DNA, 22 bp, Homo sapiens
tctgtgctgcccaacttctcaa

SEQ ID NO: 7726908 - DNA, 19 bp, Homo sapiens
tctgtgctgggaggcagca

SEQ ID NO: 7726909 - DNA, 19 bp, Homo sapiens
tctgtgctgggaggcagca

SEQ ID NO: 7726910 - DNA, 22 bp, Homo sapiens
tctgtgctggactgatttcata

SEQ ID NO: 7726911 - DNA, 22 bp, Homo sapiens
tctgtgctggactgatttcata

SEQ ID NO: 7726912 - DNA, 22 bp, Homo sapiens
tctgtgctgccatcctgtggcc

SEQ ID NO: 7726913 - DNA, 22 bp, Homo sapiens
tctgtgctgccatcctgtggcc

SEQ ID NO: 7726914 - DNA, 22 bp, Homo sapiens
tctgtgctgagctctgagatgt

SEQ ID NO: 7726915 - DNA, 22 bp, Homo sapiens
tctgtgctgccatcctgtggcc

SEQ ID NO: 7726916 - DNA, 22 bp, Homo sapiens
tctgtgctgcccaacttctcaa

SEQ ID NO: 7726917 - DNA, 21 bp, Homo sapiens
tctgtgctgccgtcaacatcc

SEQ ID NO: 7726918 - DNA, 21 bp, Homo sapiens
tctgtgctgccgtcaacatcc

SEQ ID NO: 7726919 - DNA, 22 bp, Homo sapiens
tctgtgctgcaggagtctgcat

SEQ ID NO: 7726920 - DNA, 22 bp, Homo sapiens
tctgtgctgcaggagtctgcat

SEQ ID NO: 7726921 - DNA, 22 bp, Homo sapiens
tctgtgctgcaggagtctgcat

SEQ ID NO: 7726922 - DNA, 22 bp, Homo sapiens
tctgtgctgagctctgagatgt

SEQ ID NO: 7726923 - DNA, 22 bp, Homo sapiens
tctgtgctcttctcagtatcac

SEQ ID NO: 7726924 - DNA, 22 bp, Homo sapiens
tctgtgctcttctcagtatcac

SEQ ID NO: 7726925 - DNA, 22 bp, Homo sapiens
tctgtgctcattcagtcattca

SEQ ID NO: 7726926 - DNA, 22 bp, Homo sapiens
tctgtgctgagctctgagatgt

SEQ ID NO: 7726927 - DNA, 22 bp, Homo sapiens
tctgtgctgagctctgagatgt

SEQ ID NO: 7726928 - DNA, 22 bp, Homo sapiens
tctgtggaaatttcctgaggca

SEQ ID NO: 7726929 - DNA, 22 bp, Homo sapiens
tctgtgctttccctgccttctt

SEQ ID NO: 7726930 - DNA, 22 bp, Homo sapiens
tctgtggaagattccaggcgtt

SEQ ID NO: 7726931 - DNA, 22 bp, Homo sapiens
tctgtgcttaactactcacccc

SEQ ID NO: 7726932 - DNA, 22 bp, Homo sapiens
tctgtgctgtctcagagaaagc

SEQ ID NO: 7726933 - DNA, 22 bp, Homo sapiens
tctgtgctgtctcagataagca

SEQ ID NO: 7726934 - DNA, 22 bp, Homo sapiens
tctgtgcttaactactcacccc

SEQ ID NO: 7726935 - DNA, 22 bp, Homo sapiens
tctgtgcttaactactcacccc

SEQ ID NO: 7726936 - DNA, 22 bp, Homo sapiens
tctgtgcttaactactcacccc

SEQ ID NO: 7726937 - DNA, 22 bp, Homo sapiens
tctgtgctttccctgccttctt

SEQ ID NO: 7726938 - DNA, 18 bp, Homo sapiens
tctgtggagagggcagtt

SEQ ID NO: 7726939 - DNA, 19 bp, Homo sapiens
tctgtggagctcagagtag

SEQ ID NO: 7726940 - DNA, 22 bp, Homo sapiens
tctgtggagttagactggtatc

SEQ ID NO: 7726941 - DNA, 22 bp, Homo sapiens
tctgtggactcaagggatcaca

SEQ ID NO: 7726942 - DNA, 22 bp, Homo sapiens
tctgtggactcaagggatcaca

SEQ ID NO: 7726943 - DNA, 18 bp, Homo sapiens
tctgtggagagggcagtt

SEQ ID NO: 7726944 - DNA, 18 bp, Homo sapiens
tctgtggagagggcagtt

SEQ ID NO: 7726945 - DNA, 22 bp, Homo sapiens
tctgtggctggagaacttgtct

SEQ ID NO: 7726946 - DNA, 23 bp, Homo sapiens
tctgtggctccttcaggctgctg

SEQ ID NO: 7726947 - DNA, 22 bp, Homo sapiens
tctgtggattttagtgttcatg

SEQ ID NO: 7726948 - DNA, 23 bp, Homo sapiens
tctgtggctccttcaggctgctg

SEQ ID NO: 7726949 - DNA, 22 bp, Homo sapiens
tctgtggctgtctttccagagg

SEQ ID NO: 7726950 - DNA, 22 bp, Homo sapiens
tctgtggctgtctttccagagg

SEQ ID NO: 7726951 - DNA, 19 bp, Homo sapiens
tctgtggctgtggggagga

SEQ ID NO: 7726952 - DNA, 19 bp, Homo sapiens
tctgtggctgtggggagga

SEQ ID NO: 7726953 - DNA, 22 bp, Homo sapiens
tctgtggctgtgctgggccaga

SEQ ID NO: 7726954 - DNA, 19 bp, Homo sapiens
tctgtggctgtggggagga

SEQ ID NO: 7726955 - DNA, 22 bp, Homo sapiens
tctgtgtctgcagaagttcagc

SEQ ID NO: 7726956 - DNA, 22 bp, Homo sapiens
tctgtgtctgcagaagttcagc

SEQ ID NO: 7726957 - DNA, 22 bp, Homo sapiens
tctgtgtctggttgggccagta

SEQ ID NO: 7726958 - DNA, 22 bp, Homo sapiens
tctgtgtctgttacttcactgc

SEQ ID NO: 7726959 - DNA, 22 bp, Homo sapiens
tctgtgtctgttacttcactgc

SEQ ID NO: 7726960 - DNA, 22 bp, Homo sapiens
tctgtgtctgcagaagttcagc

SEQ ID NO: 7726961 - DNA, 22 bp, Homo sapiens
tctgtgtctgcagaagttcagc

SEQ ID NO: 7726962 - DNA, 23 bp, Homo sapiens
tctgtgtctccacccaaatctca

SEQ ID NO: 7726963 - DNA, 23 bp, Homo sapiens
tctgtgtctccacccaaatctca

SEQ ID NO: 7726964 - DNA, 22 bp, Homo sapiens
tctgtgtcgttctgtgctctgg

SEQ ID NO: 7726965 - DNA, 22 bp, Homo sapiens
tctgtgtatttgtgacctgtat

SEQ ID NO: 7726966 - DNA, 22 bp, Homo sapiens
tctgtgtatttgtgacctgtat

SEQ ID NO: 7726967 - DNA, 22 bp, Homo sapiens
tctgtgtcagaagatatcatgg

SEQ ID NO: 7726968 - DNA, 22 bp, Homo sapiens
tctgtgtcagcagcactcagcc

SEQ ID NO: 7726969 - DNA, 22 bp, Homo sapiens
tctgtgtcagcagcactcagcc

SEQ ID NO: 7726970 - DNA, 22 bp, Homo sapiens
tctgtgtcagcagcactcagcc

SEQ ID NO: 7726971 - DNA, 22 bp, Homo sapiens
tctgtgtcccttctaatttcag

SEQ ID NO: 7726972 - DNA, 23 bp, Homo sapiens
tctgtgtcctcctggaccacaga

SEQ ID NO: 7726973 - DNA, 23 bp, Homo sapiens
tctgtgtcctcctggaccacaga

SEQ ID NO: 7726974 - DNA, 22 bp, Homo sapiens
tctgtgtcctgctagctgtctt

SEQ ID NO: 7726975 - DNA, 22 bp, Homo sapiens
tctgtgtcctgctagctgtctt

SEQ ID NO: 7726976 - DNA, 22 bp, Homo sapiens
tctgtgtcctgctagctgtctt

SEQ ID NO: 7726977 - DNA, 22 bp, Homo sapiens
tctgtgtcctgctagctgtctt

SEQ ID NO: 7726978 - DNA, 22 bp, Homo sapiens
tctgtgtcctgctagctgtctt

SEQ ID NO: 7726979 - DNA, 22 bp, Homo sapiens
tctgtgggtttcagggggctgt

SEQ ID NO: 7726980 - DNA, 22 bp, Homo sapiens
tctgtgtacgcaggcgtgcgcg

SEQ ID NO: 7726981 - DNA, 22 bp, Homo sapiens
tctgtggtctggctttagtcta

SEQ ID NO: 7726982 - DNA, 21 bp, Homo sapiens
tctgtggtatggccatcttcc

SEQ ID NO: 7726983 - DNA, 21 bp, Homo sapiens
tctgtggtatggccatcttcc

SEQ ID NO: 7726984 - DNA, 23 bp, Homo sapiens
tctgtggtctcatctgaaggctc

SEQ ID NO: 7726985 - DNA, 22 bp, Homo sapiens
tctgtgggtagagtgagtactt

SEQ ID NO: 7726986 - DNA, 22 bp, Homo sapiens
tctgtgggtagagtgagtactt

SEQ ID NO: 7726987 - DNA, 22 bp, Homo sapiens
tctgtgggtttcagggggctgt

SEQ ID NO: 7726988 - DNA, 22 bp, Homo sapiens
tctgtgggtgcctccagcagtg

SEQ ID NO: 7726989 - DNA, 22 bp, Homo sapiens
tctgtggctttcgtgtaagatg

SEQ ID NO: 7726990 - DNA, 22 bp, Homo sapiens
tctgtggcttgggcctgcctgt

SEQ ID NO: 7726991 - DNA, 22 bp, Homo sapiens
tctgtggctttcgtgtaagatg

SEQ ID NO: 7726992 - DNA, 22 bp, Homo sapiens
tctgtggcttgggcctgcctgt

SEQ ID NO: 7726993 - DNA, 22 bp, Homo sapiens
tctgtggcttcctatttcttgg

SEQ ID NO: 7726994 - DNA, 22 bp, Homo sapiens
tctgtggggagcaggagccggg

SEQ ID NO: 7726995 - DNA, 22 bp, Homo sapiens
tctgtgagtactttaacgagag

SEQ ID NO: 7726996 - DNA, 22 bp, Homo sapiens
tctgtgagaaccagtgccaggg

SEQ ID NO: 7726997 - DNA, 22 bp, Homo sapiens
tctgtgaatgatgtttctttct

SEQ ID NO: 7726998 - DNA, 22 bp, Homo sapiens
tctgtgacattgaacatctaca

SEQ ID NO: 7726999 - DNA, 22 bp, Homo sapiens
tctgtgactgatggaggctttt

SEQ ID NO: 7727000 - DNA, 22 bp, Homo sapiens
tctgtgacttacaagaagggac

SEQ ID NO: 7727001 - DNA, 22 bp, Homo sapiens
tctgtgaatgatgtttctttct

SEQ ID NO: 7727002 - DNA, 22 bp, Homo sapiens
tctgtgaagctctgaacagcag

SEQ ID NO: 7727003 - DNA, 22 bp, Homo sapiens
tctgtgaagctctgaacagcag

SEQ ID NO: 7727004 - DNA, 22 bp, Homo sapiens
tctgtgaaaggaaagaactgac

SEQ ID NO: 7727005 - DNA, 22 bp, Homo sapiens
tctgtgaaatcacccaggttta

SEQ ID NO: 7727006 - DNA, 22 bp, Homo sapiens
tctgtgaaaggaaagaactgac

SEQ ID NO: 7727007 - DNA, 22 bp, Homo sapiens
tctgtgaaatcacccaggttta

SEQ ID NO: 7727008 - DNA, 22 bp, Homo sapiens
tctgtgaacatcacattgacag

SEQ ID NO: 7727009 - DNA, 22 bp, Homo sapiens
tctgtgaacatcacattgacag

SEQ ID NO: 7727010 - DNA, 22 bp, Homo sapiens
tctgtgcaagtatttgacattt

SEQ ID NO: 7727011 - DNA, 22 bp, Homo sapiens
tctgtgcaatagtttgttttac

SEQ ID NO: 7727012 - DNA, 22 bp, Homo sapiens
tctgtgcaatagtttgttttac

SEQ ID NO: 7727013 - DNA, 22 bp, Homo sapiens
tctgtgattgatttaatgctct

SEQ ID NO: 7727014 - DNA, 22 bp, Homo sapiens
tctgtgcaagaccaactttcaa

SEQ ID NO: 7727015 - DNA, 22 bp, Homo sapiens
tctgtgatagtttttcagctat

SEQ ID NO: 7727016 - DNA, 22 bp, Homo sapiens
tctgtgatagtttttcagctat

SEQ ID NO: 7727017 - DNA, 22 bp, Homo sapiens
tctgtgatagtttttcagctat

SEQ ID NO: 7727018 - DNA, 22 bp, Homo sapiens
tctgtgatcttgcatttatatg

SEQ ID NO: 7727019 - DNA, 22 bp, Homo sapiens
tctgtgataggtggcatagtga

SEQ ID NO: 7727020 - DNA, 22 bp, Homo sapiens
tctgtgataggtggcatagtga

SEQ ID NO: 7727021 - DNA, 17 bp, Homo sapiens
tctgtgatagtgtagat

SEQ ID NO: 7727022 - DNA, 20 bp, Homo sapiens
tctgtgcacctgctacaagg

SEQ ID NO: 7727023 - DNA, 22 bp, Homo sapiens
tctgtgcaccagaatgatattt

SEQ ID NO: 7727024 - DNA, 22 bp, Homo sapiens
tctgtgcaccagaatgatattt

SEQ ID NO: 7727025 - DNA, 22 bp, Homo sapiens
tctgtgcaccagaatgatattt

SEQ ID NO: 7727026 - DNA, 22 bp, Homo sapiens
tctgtgcaccagaatgatattt

SEQ ID NO: 7727027 - DNA, 22 bp, Homo sapiens
tctgtgcacaataggcattttt

SEQ ID NO: 7727028 - DNA, 22 bp, Homo sapiens
tctgtgcaccttctaatgagta

SEQ ID NO: 7727029 - DNA, 22 bp, Homo sapiens
tctgtgcaccttctaatgagta

SEQ ID NO: 7727030 - DNA, 20 bp, Homo sapiens
tctgtgcacctgctacaagg

SEQ ID NO: 7727031 - DNA, 20 bp, Homo sapiens
tctgtgcacctgctacaagg

SEQ ID NO: 7727032 - DNA, 20 bp, Homo sapiens
tctgtgcacctgctacaagg

SEQ ID NO: 7727033 - DNA, 22 bp, Homo sapiens
tctgtgaaaatgcgaggatctg

SEQ ID NO: 7727034 - DNA, 22 bp, Homo sapiens
tctgtgaaacagctctggcatg

SEQ ID NO: 7727035 - DNA, 22 bp, Homo sapiens
tctgtgaaaatgcgaggatctg

SEQ ID NO: 7727036 - DNA, 22 bp, Homo sapiens
tctgtctttgtcaggaccagag

SEQ ID NO: 7727037 - DNA, 22 bp, Homo sapiens
tctgtctttgagatctcagcct

SEQ ID NO: 7727038 - DNA, 22 bp, Homo sapiens
tctgtctttgagatctcagcct

SEQ ID NO: 7727039 - DNA, 22 bp, Homo sapiens
tctgtctttgagatctcagcct

SEQ ID NO: 7727040 - DNA, 22 bp, Homo sapiens
tctgtctttgagatctcagcct

SEQ ID NO: 7727041 - DNA, 22 bp, Homo sapiens
tctgtctttgagatctcagcct

SEQ ID NO: 7727042 - DNA, 22 bp, Homo sapiens
tctgtctttgagatctcagcct

SEQ ID NO: 7727043 - DNA, 22 bp, Homo sapiens
tctgtctttagaggcctgtgct

SEQ ID NO: 7727044 - DNA, 22 bp, Homo sapiens
tctgtctgcttcacttgcattt

SEQ ID NO: 7727045 - DNA, 22 bp, Homo sapiens
tctgtctgcttcacttgcattt

SEQ ID NO: 7727046 - DNA, 22 bp, Homo sapiens
tctgtctgctcatttacctcag

SEQ ID NO: 7727047 - DNA, 22 bp, Homo sapiens
tctgtctgcgcttgccctggtg

SEQ ID NO: 7727048 - DNA, 22 bp, Homo sapiens
tctgtctgcacctaagcacagt

SEQ ID NO: 7727049 - DNA, 22 bp, Homo sapiens
tctgtctgagtggtgttagagt

SEQ ID NO: 7727050 - DNA, 22 bp, Homo sapiens
tctgtctgcacctaagcacagt

SEQ ID NO: 7727051 - DNA, 22 bp, Homo sapiens
tctgtctgcacctaagcacagt

SEQ ID NO: 7727052 - DNA, 22 bp, Homo sapiens
tctgtctgagtggtgttagagt

SEQ ID NO: 7727053 - DNA, 22 bp, Homo sapiens
tctgtctgagggagtgacattt

SEQ ID NO: 7727054 - DNA, 22 bp, Homo sapiens
tctgtctgaggagtttttgacc

SEQ ID NO: 7727055 - DNA, 22 bp, Homo sapiens
tctgtctgaggagtttttgacc

SEQ ID NO: 7727056 - DNA, 22 bp, Homo sapiens
tctgtctgagggagtgacattt

SEQ ID NO: 7727057 - DNA, 22 bp, Homo sapiens
tctgtctgagggagtgacattt

SEQ ID NO: 7727058 - DNA, 22 bp, Homo sapiens
tctgtctgccttgtgagggcac

SEQ ID NO: 7727059 - DNA, 22 bp, Homo sapiens
tctgtctgccttgtgagggcac

SEQ ID NO: 7727060 - DNA, 22 bp, Homo sapiens
tctgtctgcgcttgccctggtg

SEQ ID NO: 7727061 - DNA, 22 bp, Homo sapiens
tctgtctgccttgtgagggcac

SEQ ID NO: 7727062 - DNA, 22 bp, Homo sapiens
tctgtctgccccagcaagtcac

SEQ ID NO: 7727063 - DNA, 22 bp, Homo sapiens
tctgtctgccccagcaagtcac

SEQ ID NO: 7727064 - DNA, 22 bp, Homo sapiens
tctgtctgccccagcaagtcac

SEQ ID NO: 7727065 - DNA, 22 bp, Homo sapiens
tctgtgcaggaagtcattatga

SEQ ID NO: 7727066 - DNA, 22 bp, Homo sapiens
tctgtgcaggaagtcattatga

SEQ ID NO: 7727067 - DNA, 22 bp, Homo sapiens
tctgtgcaggatttgaggaacc

SEQ ID NO: 7727068 - DNA, 22 bp, Homo sapiens
tctgtgcaggatttgaggaacc

SEQ ID NO: 7727069 - DNA, 22 bp, Homo sapiens
tctgtgcagatgtagaccagtt

SEQ ID NO: 7727070 - DNA, 15 bp, Homo sapiens
tctgtgcagcaaggg

SEQ ID NO: 7727071 - DNA, 22 bp, Homo sapiens
tctgtgcagatgtagaccagtt

SEQ ID NO: 7727072 - DNA, 22 bp, Homo sapiens
tctgtgcagacatggggaagcc

SEQ ID NO: 7727073 - DNA, 22 bp, Homo sapiens
tctgtgcagacatggggaagcc

SEQ ID NO: 7727074 - DNA, 22 bp, Homo sapiens
tctgtgcagatgtagaccagtt

SEQ ID NO: 7727075 - DNA, 22 bp, Homo sapiens
tctgtgcactgtgtcattaggt

SEQ ID NO: 7727076 - DNA, 22 bp, Homo sapiens
tctgtgcactaacattcctggt

SEQ ID NO: 7727077 - DNA, 22 bp, Homo sapiens
tctgtgcactgtgtcattaggt

SEQ ID NO: 7727078 - DNA, 22 bp, Homo sapiens
tctgtgcactaacattcctggt

SEQ ID NO: 7727079 - DNA, 22 bp, Homo sapiens
tctgtgcactaacattcctggt

SEQ ID NO: 7727080 - DNA, 22 bp, Homo sapiens
tctgtgcagaatcaaggagctt

SEQ ID NO: 7727081 - DNA, 22 bp, Homo sapiens
tctgtgcagaactcacagaagg

SEQ ID NO: 7727082 - DNA, 22 bp, Homo sapiens
tctgtgcagaactcacagaagg

SEQ ID NO: 7727083 - DNA, 22 bp, Homo sapiens
tctgtgcagaactcacagaagg

SEQ ID NO: 7727084 - DNA, 22 bp, Homo sapiens
tctgtgcagacatggggaagcc

SEQ ID NO: 7727085 - DNA, 22 bp, Homo sapiens
tctgtgcagaatcaaggagctt

SEQ ID NO: 7727086 - DNA, 22 bp, Homo sapiens
tctgtgcagaatcaaggagctt

SEQ ID NO: 7727087 - DNA, 22 bp, Homo sapiens
tctgtgcagaatcaaggagctt

SEQ ID NO: 7727088 - DNA, 22 bp, Homo sapiens
tctgtgcatccttaacgcctgc

SEQ ID NO: 7727089 - DNA, 20 bp, Homo sapiens
tctgtgcattgcctgctggt

SEQ ID NO: 7727090 - DNA, 20 bp, Homo sapiens
tctgtgcagtttaggaaggc

SEQ ID NO: 7727091 - DNA, 20 bp, Homo sapiens
tctgtgcagtttaggaaggc

SEQ ID NO: 7727092 - DNA, 20 bp, Homo sapiens
tctgtgcagtggaggggcag

SEQ ID NO: 7727093 - DNA, 22 bp, Homo sapiens
tctgtgcatttcaggacctgaa

SEQ ID NO: 7727094 - DNA, 22 bp, Homo sapiens
tctgtgcatttcaggacctgaa

SEQ ID NO: 7727095 - DNA, 22 bp, Homo sapiens
tctgtgcattgtaacaactaaa

SEQ ID NO: 7727096 - DNA, 22 bp, Homo sapiens
tctgtgcattgtaacaactaaa

SEQ ID NO: 7727097 - DNA, 20 bp, Homo sapiens
tctgtgcattgcctgctggt

SEQ ID NO: 7727098 - DNA, 22 bp, Homo sapiens
tctgtgcagttcttgtcttgac

SEQ ID NO: 7727099 - DNA, 20 bp, Homo sapiens
tctgtgcagtggaggggcag

SEQ ID NO: 7727100 - DNA, 22 bp, Homo sapiens
tctgtgcagttcttgtcttgac

SEQ ID NO: 7727101 - DNA, 20 bp, Homo sapiens
tctgtgcagtggaggggcag

SEQ ID NO: 7727102 - DNA, 22 bp, Homo sapiens
tctgtgcagtcagggctcagtc

SEQ ID NO: 7727103 - DNA, 22 bp, Homo sapiens
tctgtgcaggatttgaggaacc

SEQ ID NO: 7727104 - DNA, 22 bp, Homo sapiens
tctgtgcaggatttgaggaacc

SEQ ID NO: 7727105 - DNA, 22 bp, Homo sapiens
tctgtgcagggaccccaagagt

SEQ ID NO: 7727106 - DNA, 22 bp, Homo sapiens
tctgtgcagggaccccaagagt

SEQ ID NO: 7727107 - DNA, 22 bp, Homo sapiens
tctgtgcagtcagggctcagtc

SEQ ID NO: 7727108 - DNA, 22 bp, Homo sapiens
tctgtgcagtcagggctcagtc

SEQ ID NO: 7727109 - DNA, 22 bp, Homo sapiens
tctgtgccatcagtctccagag

SEQ ID NO: 7727110 - DNA, 23 bp, Homo sapiens
tctgtgccagtttccatgtctgt

SEQ ID NO: 7727111 - DNA, 22 bp, Homo sapiens
tctgtgccatcagtctccagag

SEQ ID NO: 7727112 - DNA, 22 bp, Homo sapiens
tctgtgccatcagtctccagag

SEQ ID NO: 7727113 - DNA, 22 bp, Homo sapiens
tctgtgccctcggtgctgggcc

SEQ ID NO: 7727114 - DNA, 22 bp, Homo sapiens
tctgtgccctcggtgctgggcc

SEQ ID NO: 7727115 - DNA, 22 bp, Homo sapiens
tctgtgccatgcccgtctacca

SEQ ID NO: 7727116 - DNA, 22 bp, Homo sapiens
tctgtgccagcagcctcctgga

SEQ ID NO: 7727117 - DNA, 22 bp, Homo sapiens
tctgtgccacctctccagtgtc

SEQ ID NO: 7727118 - DNA, 22 bp, Homo sapiens
tctgtgccacctctccagtgtc

SEQ ID NO: 7727119 - DNA, 22 bp, Homo sapiens
tctgtgccaagcttatatctgt

SEQ ID NO: 7727120 - DNA, 22 bp, Homo sapiens
tctgtgccacctctccagtgtc

SEQ ID NO: 7727121 - DNA, 22 bp, Homo sapiens
tctgtgccagcagcctcctgga

SEQ ID NO: 7727122 - DNA, 23 bp, Homo sapiens
tctgtgccagtttccatgtctgt

SEQ ID NO: 7727123 - DNA, 23 bp, Homo sapiens
tctgtgccagtttccatgtctgt

SEQ ID NO: 7727124 - DNA, 22 bp, Homo sapiens
tctgtgccagcagcctcctgga

SEQ ID NO: 7727125 - DNA, 22 bp, Homo sapiens
tctgtgcctcatctggttcagg

SEQ ID NO: 7727126 - DNA, 21 bp, Homo sapiens
tctgtgcctcaaccctcatct

SEQ ID NO: 7727127 - DNA, 21 bp, Homo sapiens
tctgtgcctcaaccctcatct

SEQ ID NO: 7727128 - DNA, 21 bp, Homo sapiens
tctgtgcctcaaccctcatct

SEQ ID NO: 7727129 - DNA, 22 bp, Homo sapiens
tctgtgcctcatctggttcagg

SEQ ID NO: 7727130 - DNA, 22 bp, Homo sapiens
tctgtgcctccgtaacacacca

SEQ ID NO: 7727131 - DNA, 22 bp, Homo sapiens
tctgtgcctgcttccccaccca

SEQ ID NO: 7727132 - DNA, 22 bp, Homo sapiens
tctgtgcctgcttccccaccca

SEQ ID NO: 7727133 - DNA, 22 bp, Homo sapiens
tctgtgccttctcccagactta

SEQ ID NO: 7727134 - DNA, 22 bp, Homo sapiens
tctgtgcggtctgtgttatgaa

SEQ ID NO: 7727135 - DNA, 22 bp, Homo sapiens
tctgtgcctttaagaagctcat

SEQ ID NO: 7727136 - DNA, 22 bp, Homo sapiens
tctgtgcctttaagaagctcat

SEQ ID NO: 7727137 - DNA, 22 bp, Homo sapiens
tctgtgcctttaagaagctcat

SEQ ID NO: 7727138 - DNA, 22 bp, Homo sapiens
tctgtgctaatgcttcacaata

SEQ ID NO: 7727139 - DNA, 22 bp, Homo sapiens
tctgtgctaatgcttcacaata

SEQ ID NO: 7727140 - DNA, 22 bp, Homo sapiens
tctgtgctaatttatccttcct

SEQ ID NO: 7727141 - DNA, 23 bp, Homo sapiens
tctgtgctacaaatcgcgtctgt

SEQ ID NO: 7727142 - DNA, 22 bp, Homo sapiens
tctgttttgtaccagatacagc

SEQ ID NO: 7727143 - DNA, 22 bp, Homo sapiens
tctgttttgtaccagatacagc

SEQ ID NO: 7727144 - DNA, 22 bp, Homo sapiens
tctgttttggtcacctttatat

SEQ ID NO: 7727145 - DNA, 22 bp, Homo sapiens
tctgttttgtaccagatacagc

SEQ ID NO: 7727146 - DNA, 22 bp, Homo sapiens
tctgttttgtaccagatacagc

SEQ ID NO: 7727147 - DNA, 22 bp, Homo sapiens
tctgttttgtaccagatacagc

SEQ ID NO: 7727148 - DNA, 22 bp, Homo sapiens
tctgttttgtaccagatacagc

SEQ ID NO: 7727149 - DNA, 22 bp, Homo sapiens
tctgttttgtaccagatacagc

SEQ ID NO: 7727150 - DNA, 22 bp, Homo sapiens
tctgtttttgaggctatcttct

SEQ ID NO: 7727151 - DNA, 22 bp, Homo sapiens
tctgtttttgaggctatcttct

SEQ ID NO: 7727152 - DNA, 22 bp, Homo sapiens
tcttaaaagtatgccaattgga

SEQ ID NO: 7727153 - DNA, 22 bp, Homo sapiens
tcttaaaagtatgccaattgga

SEQ ID NO: 7727154 - DNA, 22 bp, Homo sapiens
tcttaaaagtatgccaattgga

SEQ ID NO: 7727155 - DNA, 22 bp, Homo sapiens
tctgtttttgaggctatcttct

SEQ ID NO: 7727156 - DNA, 22 bp, Homo sapiens
tctgttttgtgtctctctggtg

SEQ ID NO: 7727157 - DNA, 22 bp, Homo sapiens
tctgtttttgaggctatcttct

SEQ ID NO: 7727158 - DNA, 22 bp, Homo sapiens
tctgttttgtgtctctctggtg

SEQ ID NO: 7727159 - DNA, 22 bp, Homo sapiens
tctgttttgtgtctctctggtg

SEQ ID NO: 7727160 - DNA, 22 bp, Homo sapiens
tctgttttgtgtctctctggtg

SEQ ID NO: 7727161 - DNA, 22 bp, Homo sapiens
tctgttttgtgtctctctggtg

SEQ ID NO: 7727162 - DNA, 22 bp, Homo sapiens
tcttaaagagcgcaatttgagg

SEQ ID NO: 7727163 - DNA, 22 bp, Homo sapiens
tcttaaagccaagcataaacca

SEQ ID NO: 7727164 - DNA, 22 bp, Homo sapiens
tcttaaagcagcttgtaaaatg

SEQ ID NO: 7727165 - DNA, 22 bp, Homo sapiens
tcttaaagcagcttgtaaaatg

SEQ ID NO: 7727166 - DNA, 22 bp, Homo sapiens
tcttaaagccaagcataaacca

SEQ ID NO: 7727167 - DNA, 22 bp, Homo sapiens
tcttaaagccaagcataaacca

SEQ ID NO: 7727168 - DNA, 22 bp, Homo sapiens
tcttaaagcctcatcactccgt

SEQ ID NO: 7727169 - DNA, 22 bp, Homo sapiens
tcttaaagcttacttcaattgt

SEQ ID NO: 7727170 - DNA, 22 bp, Homo sapiens
tcttaaagcttacttcaattgt

SEQ ID NO: 7727171 - DNA, 22 bp, Homo sapiens
tcttaaaggcatgttagggtcc

SEQ ID NO: 7727172 - DNA, 22 bp, Homo sapiens
tcttaaaggcacatagtgtcta

SEQ ID NO: 7727173 - DNA, 22 bp, Homo sapiens
tcttaaaggcacatagtgtcta

SEQ ID NO: 7727174 - DNA, 22 bp, Homo sapiens
tcttaaagagcgcaatttgagg

SEQ ID NO: 7727175 - DNA, 22 bp, Homo sapiens
tcttaaaagtatgccaattgga

SEQ ID NO: 7727176 - DNA, 22 bp, Homo sapiens
tcttaaaagtatgccaattgga

SEQ ID NO: 7727177 - DNA, 22 bp, Homo sapiens
tcttaaaagtatgccaattgga

SEQ ID NO: 7727178 - DNA, 22 bp, Homo sapiens
tcttaaaagtatgccaattgga

SEQ ID NO: 7727179 - DNA, 22 bp, Homo sapiens
tcttaaaagtatgccaattgga

SEQ ID NO: 7727180 - DNA, 22 bp, Homo sapiens
tcttaaaagtatgccaattgga

SEQ ID NO: 7727181 - DNA, 22 bp, Homo sapiens
tctgtttattcaatttctatat

SEQ ID NO: 7727182 - DNA, 22 bp, Homo sapiens
tctgtttattcaatttctatat

SEQ ID NO: 7727183 - DNA, 22 bp, Homo sapiens
tctgtttcaagtagggcttata

SEQ ID NO: 7727184 - DNA, 22 bp, Homo sapiens
tctgtttctataaagacaagag

SEQ ID NO: 7727185 - DNA, 22 bp, Homo sapiens
tctgtttcctcttgtgtaaagt

SEQ ID NO: 7727186 - DNA, 22 bp, Homo sapiens
tctgtttcctcttgtgtaaagt

SEQ ID NO: 7727187 - DNA, 22 bp, Homo sapiens
tctgtttcctcttgtgtaaagt

SEQ ID NO: 7727188 - DNA, 22 bp, Homo sapiens
tctgtttcctcttgtgtaaagt

SEQ ID NO: 7727189 - DNA, 22 bp, Homo sapiens
tctgtttcaagtagggcttata

SEQ ID NO: 7727190 - DNA, 22 bp, Homo sapiens
tctgtttcacgtcctgaatctc

SEQ ID NO: 7727191 - DNA, 22 bp, Homo sapiens
tctgtttcacgtcctgaatctc

SEQ ID NO: 7727192 - DNA, 22 bp, Homo sapiens
tctgtttcctcttgtgtaaagt

SEQ ID NO: 7727193 - DNA, 22 bp, Homo sapiens
tctgtttcttcttctgttatat

SEQ ID NO: 7727194 - DNA, 22 bp, Homo sapiens
tctgtttcttcttctgttatat

SEQ ID NO: 7727195 - DNA, 22 bp, Homo sapiens
tctgtttcttcttctgttatat

SEQ ID NO: 7727196 - DNA, 22 bp, Homo sapiens
tctgtttcttcttctgttatat

SEQ ID NO: 7727197 - DNA, 22 bp, Homo sapiens
tctgtttcttcctagccatgct

SEQ ID NO: 7727198 - DNA, 22 bp, Homo sapiens
tctgtttcttcctagccatgct

SEQ ID NO: 7727199 - DNA, 17 bp, Homo sapiens
tctgtttctcctttctt

SEQ ID NO: 7727200 - DNA, 22 bp, Homo sapiens
tctgtttctccaacattgtgag

SEQ ID NO: 7727201 - DNA, 22 bp, Homo sapiens
tctgtttctccaacattgtgag

SEQ ID NO: 7727202 - DNA, 22 bp, Homo sapiens
tctgtttctccaacattgtgag

SEQ ID NO: 7727203 - DNA, 22 bp, Homo sapiens
tctgtttctataaagacaagag

SEQ ID NO: 7727204 - DNA, 22 bp, Homo sapiens
tctgtttctccaacattgtgag

SEQ ID NO: 7727205 - DNA, 22 bp, Homo sapiens
tctgttttagataagaaaggct

SEQ ID NO: 7727206 - DNA, 22 bp, Homo sapiens
tctgttttagataagaaaggct

SEQ ID NO: 7727207 - DNA, 22 bp, Homo sapiens
tctgttttagataagaaaggct

SEQ ID NO: 7727208 - DNA, 22 bp, Homo sapiens
tctgtttcttggctagcctctt

SEQ ID NO: 7727209 - DNA, 22 bp, Homo sapiens
tctgttttcatttgtcttgaga

SEQ ID NO: 7727210 - DNA, 22 bp, Homo sapiens
tctgttttctctgtattttgac

SEQ ID NO: 7727211 - DNA, 22 bp, Homo sapiens
tctgttttctctgtattttgac

SEQ ID NO: 7727212 - DNA, 22 bp, Homo sapiens
tctgttttctctgtattttgac

SEQ ID NO: 7727213 - DNA, 22 bp, Homo sapiens
tctgttttctctgtattttgac

SEQ ID NO: 7727214 - DNA, 23 bp, Homo sapiens
tctgttttgcaacatgtgacaag

SEQ ID NO: 7727215 - DNA, 23 bp, Homo sapiens
tctgttttgcaacatgtgacaag

SEQ ID NO: 7727216 - DNA, 23 bp, Homo sapiens
tctgttttgcaacatgtgacaag

SEQ ID NO: 7727217 - DNA, 23 bp, Homo sapiens
tctgttttgcaacatgtgacaag

SEQ ID NO: 7727218 - DNA, 23 bp, Homo sapiens
tctgttttgcaacatgtgacaag

SEQ ID NO: 7727219 - DNA, 23 bp, Homo sapiens
tctgttttgcaacatgtgacaag

SEQ ID NO: 7727220 - DNA, 23 bp, Homo sapiens
tctgttttgcaacatgtgacaag

SEQ ID NO: 7727221 - DNA, 23 bp, Homo sapiens
tctgttttgcaacatgtgacaag

SEQ ID NO: 7727222 - DNA, 22 bp, Homo sapiens
tctgttttgcataatgttcttt

SEQ ID NO: 7727223 - DNA, 22 bp, Homo sapiens
tctgttttgcataatgttcttt

SEQ ID NO: 7727224 - DNA, 22 bp, Homo sapiens
tctgttttgcataatgttcttt

SEQ ID NO: 7727225 - DNA, 22 bp, Homo sapiens
tctgttttggtcacctttatat

SEQ ID NO: 7727226 - DNA, 22 bp, Homo sapiens
tctgttttggtcacctttatat

SEQ ID NO: 7727227 - DNA, 20 bp, Homo sapiens
tcttaaatccccagggccat

SEQ ID NO: 7727228 - DNA, 20 bp, Homo sapiens
tcttaaatccccagggccat

SEQ ID NO: 7727229 - DNA, 22 bp, Homo sapiens
tcttaaagttcttggtaactgc

SEQ ID NO: 7727230 - DNA, 22 bp, Homo sapiens
tcttaaatgactgataagagga

SEQ ID NO: 7727231 - DNA, 22 bp, Homo sapiens
tcttaaatgactgataagagga

SEQ ID NO: 7727232 - DNA, 22 bp, Homo sapiens
tcttaaatgactgataagagga

SEQ ID NO: 7727233 - DNA, 22 bp, Homo sapiens
tcttaaatgactgataagagga

SEQ ID NO: 7727234 - DNA, 22 bp, Homo sapiens
tcttaaatgactgataagagga

SEQ ID NO: 7727235 - DNA, 22 bp, Homo sapiens
tcttaaatgactgataagagga

SEQ ID NO: 7727236 - DNA, 22 bp, Homo sapiens
tcttaacagtgctacagagcag

SEQ ID NO: 7727237 - DNA, 22 bp, Homo sapiens
tcttaacagtgctacagagcag

SEQ ID NO: 7727238 - DNA, 22 bp, Homo sapiens
tcttaactatcatttgaacacc

SEQ ID NO: 7727239 - DNA, 22 bp, Homo sapiens
tcttaactatcatttgaacacc

SEQ ID NO: 7727240 - DNA, 22 bp, Homo sapiens
tcttaatgaaagtgaaatatca

SEQ ID NO: 7727241 - DNA, 22 bp, Homo sapiens
tcttaatgaaagtgaaatatca

SEQ ID NO: 7727242 - DNA, 22 bp, Homo sapiens
tcttaatgaaagtgaaatatca

SEQ ID NO: 7727243 - DNA, 22 bp, Homo sapiens
tcttaagtgcccagaaaccaaa

SEQ ID NO: 7727244 - DNA, 22 bp, Homo sapiens
tcttaagcagagaagaagttga

SEQ ID NO: 7727245 - DNA, 22 bp, Homo sapiens
tcttaagtacctcctttatcac

SEQ ID NO: 7727246 - DNA, 22 bp, Homo sapiens
tcttaagtacctcctttatcac

SEQ ID NO: 7727247 - DNA, 22 bp, Homo sapiens
tcttagaattgaagtcagaggg

SEQ ID NO: 7727248 - DNA, 22 bp, Homo sapiens
tcttagaattgaagtcagaggg

SEQ ID NO: 7727249 - DNA, 22 bp, Homo sapiens
tcttagatgaataaaaagttat

SEQ ID NO: 7727250 - DNA, 22 bp, Homo sapiens
tcttagatgaataaaaagttat

SEQ ID NO: 7727251 - DNA, 22 bp, Homo sapiens
tcttagatgaataaaaagttat

SEQ ID NO: 7727252 - DNA, 22 bp, Homo sapiens
tcttagatggcagctagagctc

SEQ ID NO: 7727253 - DNA, 22 bp, Homo sapiens
tcttaagaaagtgacaaatagg

SEQ ID NO: 7727254 - DNA, 22 bp, Homo sapiens
tcttaagaaagtgacaaatagg

SEQ ID NO: 7727255 - DNA, 22 bp, Homo sapiens
tcttaactgacagtttaatggg

SEQ ID NO: 7727256 - DNA, 22 bp, Homo sapiens
tcttaactgacagtttaatggg

SEQ ID NO: 7727257 - DNA, 22 bp, Homo sapiens
tcttaagcagagaagaagttga

SEQ ID NO: 7727258 - DNA, 22 bp, Homo sapiens
tcttagcatgcatgtataaata

SEQ ID NO: 7727259 - DNA, 22 bp, Homo sapiens
tcttagcagtgctgagaagaat

SEQ ID NO: 7727260 - DNA, 22 bp, Homo sapiens
tcttagcacagctatataagtt

SEQ ID NO: 7727261 - DNA, 22 bp, Homo sapiens
tcttagcacagctatataagtt

SEQ ID NO: 7727262 - DNA, 22 bp, Homo sapiens
tcttagcaaattttctttgcct

SEQ ID NO: 7727263 - DNA, 22 bp, Homo sapiens
tcttagcaaatactacttagaa

SEQ ID NO: 7727264 - DNA, 22 bp, Homo sapiens
tcttagcaaatactacttagaa

SEQ ID NO: 7727265 - DNA, 22 bp, Homo sapiens
tcttaggagtagaattctcaca

SEQ ID NO: 7727266 - DNA, 22 bp, Homo sapiens
tcttagtcacagaggtgagaaa

SEQ ID NO: 7727267 - DNA, 22 bp, Homo sapiens
tcttagtcacagaggtgagaaa

SEQ ID NO: 7727268 - DNA, 22 bp, Homo sapiens
tcttagttagctcccttcttct

SEQ ID NO: 7727269 - DNA, 22 bp, Homo sapiens
tcttagttagctcccttcttct

SEQ ID NO: 7727270 - DNA, 22 bp, Homo sapiens
tcttaggtgactctccaggcca

SEQ ID NO: 7727271 - DNA, 22 bp, Homo sapiens
tcttataaaaggactcccattt

SEQ ID NO: 7727272 - DNA, 22 bp, Homo sapiens
tcttataagcaaactgctgaga

SEQ ID NO: 7727273 - DNA, 22 bp, Homo sapiens
tcttataagcaaactgctgaga

SEQ ID NO: 7727274 - DNA, 22 bp, Homo sapiens
tcttatagacagtggcagcagg

SEQ ID NO: 7727275 - DNA, 22 bp, Homo sapiens
tcttatagacagtggcagcagg

SEQ ID NO: 7727276 - DNA, 22 bp, Homo sapiens
tcttatagctcaaaggaagagt

SEQ ID NO: 7727277 - DNA, 22 bp, Homo sapiens
tcttatagctcaaaggaagagt

SEQ ID NO: 7727278 - DNA, 22 bp, Homo sapiens
tcttatatgcacatacattggg

SEQ ID NO: 7727279 - DNA, 22 bp, Homo sapiens
tcttatatgcacatacattggg

SEQ ID NO: 7727280 - DNA, 22 bp, Homo sapiens
tcttatatgcacatacattggg

SEQ ID NO: 7727281 - DNA, 22 bp, Homo sapiens
tcttatatgcacatacattggg

SEQ ID NO: 7727282 - DNA, 22 bp, Homo sapiens
tcttatcttatacctaacagcc

SEQ ID NO: 7727283 - DNA, 22 bp, Homo sapiens
tcttatcttatacctaacagcc

SEQ ID NO: 7727284 - DNA, 22 bp, Homo sapiens
tcttatgaaaagcacttagaac

SEQ ID NO: 7727285 - DNA, 22 bp, Homo sapiens
tcttatgataatatcactacca

SEQ ID NO: 7727286 - DNA, 22 bp, Homo sapiens
tcttataatctctattttaatg

SEQ ID NO: 7727287 - DNA, 22 bp, Homo sapiens
tcttataatctctattttaatg

SEQ ID NO: 7727288 - DNA, 22 bp, Homo sapiens
tcttataatctctattttaatg

SEQ ID NO: 7727289 - DNA, 22 bp, Homo sapiens
tcttataatctctattttaatg

SEQ ID NO: 7727290 - DNA, 22 bp, Homo sapiens
tcttatacccctaaactgcagc

SEQ ID NO: 7727291 - DNA, 22 bp, Homo sapiens
tcttatacagaagatgtttaat

SEQ ID NO: 7727292 - DNA, 22 bp, Homo sapiens
tcttatacagaagatgtttaat

SEQ ID NO: 7727293 - DNA, 22 bp, Homo sapiens
tcttataatgttgaagggttgg

SEQ ID NO: 7727294 - DNA, 20 bp, Homo sapiens
tcttatacagaaaacatttt

SEQ ID NO: 7727295 - DNA, 22 bp, Homo sapiens
tctgttctttccaacaagacag

SEQ ID NO: 7727296 - DNA, 22 bp, Homo sapiens
tctgttctttccaacaagacag

SEQ ID NO: 7727297 - DNA, 22 bp, Homo sapiens
tctgttctttagcctgcttgag

SEQ ID NO: 7727298 - DNA, 23 bp, Homo sapiens
tctgttcttttagctgatcattt

SEQ ID NO: 7727299 - DNA, 23 bp, Homo sapiens
tctgttcttttagctgatcattt

SEQ ID NO: 7727300 - DNA, 22 bp, Homo sapiens
tctgttgaccaagtcttcttcc

SEQ ID NO: 7727301 - DNA, 22 bp, Homo sapiens
tctgttgactcctagcagccat

SEQ ID NO: 7727302 - DNA, 22 bp, Homo sapiens
tctgttgcaatgtgcatggtga

SEQ ID NO: 7727303 - DNA, 22 bp, Homo sapiens
tctgttgcaatgtgcatggtga

SEQ ID NO: 7727304 - DNA, 22 bp, Homo sapiens
tctgttgcaatgtgcatggtga

SEQ ID NO: 7727305 - DNA, 22 bp, Homo sapiens
tctgttgcaatgtgcatggtga

SEQ ID NO: 7727306 - DNA, 22 bp, Homo sapiens
tctgttgcaatgtgcatggtga

SEQ ID NO: 7727307 - DNA, 18 bp, Homo sapiens
tctgttgagcagagaggc

SEQ ID NO: 7727308 - DNA, 22 bp, Homo sapiens
tctgttgactcctagcagccat

SEQ ID NO: 7727309 - DNA, 22 bp, Homo sapiens
tctgttgactcctagcagccat

SEQ ID NO: 7727310 - DNA, 23 bp, Homo sapiens
tctgttcttttagctgatcattt

SEQ ID NO: 7727311 - DNA, 22 bp, Homo sapiens
tctgttgaccaagtcttcttcc

SEQ ID NO: 7727312 - DNA, 22 bp, Homo sapiens
tctgttgactcctagcagccat

SEQ ID NO: 7727313 - DNA, 22 bp, Homo sapiens
tctgttgactcctagcagccat

SEQ ID NO: 7727314 - DNA, 22 bp, Homo sapiens
tctgttgactcctagcagccat

SEQ ID NO: 7727315 - DNA, 22 bp, Homo sapiens
tctgttcttgtccccacttcag

SEQ ID NO: 7727316 - DNA, 22 bp, Homo sapiens
tctgttcttgtccccacttcag

SEQ ID NO: 7727317 - DNA, 22 bp, Homo sapiens
tctgttcttgtccccacttcag

SEQ ID NO: 7727318 - DNA, 22 bp, Homo sapiens
tctgttcttgtccccacttcag

SEQ ID NO: 7727319 - DNA, 22 bp, Homo sapiens
tctgttctttagcctgcttgag

SEQ ID NO: 7727320 - DNA, 22 bp, Homo sapiens
tctgttcttggtgcagctggga

SEQ ID NO: 7727321 - DNA, 22 bp, Homo sapiens
tctgttattctgtctattgcca

SEQ ID NO: 7727322 - DNA, 22 bp, Homo sapiens
tctgttattctgtctattgcca

SEQ ID NO: 7727323 - DNA, 22 bp, Homo sapiens
tctgttatggaagtttcctttt

SEQ ID NO: 7727324 - DNA, 22 bp, Homo sapiens
tctgttatgcataagcatcagt

SEQ ID NO: 7727325 - DNA, 20 bp, Homo sapiens
tctgttattattacattgcc

SEQ ID NO: 7727326 - DNA, 20 bp, Homo sapiens
tctgttattattacattgcc

SEQ ID NO: 7727327 - DNA, 20 bp, Homo sapiens
tctgttattattacattgcc

SEQ ID NO: 7727328 - DNA, 22 bp, Homo sapiens
tctgttattctgctcagtatag

SEQ ID NO: 7727329 - DNA, 22 bp, Homo sapiens
tctgttattctgctcagtatag

SEQ ID NO: 7727330 - DNA, 22 bp, Homo sapiens
tctgtttaatgggaatgatact

SEQ ID NO: 7727331 - DNA, 22 bp, Homo sapiens
tctgtttaatgggaatgatact

SEQ ID NO: 7727332 - DNA, 22 bp, Homo sapiens
tctgtttaatgggaatgatact

SEQ ID NO: 7727333 - DNA, 22 bp, Homo sapiens
tctgttggagcctaggatgaca

SEQ ID NO: 7727334 - DNA, 22 bp, Homo sapiens
tctgttggacattcatctgcag

SEQ ID NO: 7727335 - DNA, 22 bp, Homo sapiens
tctgttggagcctaggatgaca

SEQ ID NO: 7727336 - DNA, 21 bp, Homo sapiens
tctgttggaggcctctcttcc

SEQ ID NO: 7727337 - DNA, 22 bp, Homo sapiens
tctgttggcttgagatttaatt

SEQ ID NO: 7727338 - DNA, 22 bp, Homo sapiens
tctgttggttctgtttctctga

SEQ ID NO: 7727339 - DNA, 22 bp, Homo sapiens
tctgttgcaatgtgcatggtga

SEQ ID NO: 7727340 - DNA, 22 bp, Homo sapiens
tctgttgcatatgctgctgggt

SEQ ID NO: 7727341 - DNA, 22 bp, Homo sapiens
tctgtttatatttcaaaccttc

SEQ ID NO: 7727342 - DNA, 22 bp, Homo sapiens
tctgtttatatgtttttcagac

SEQ ID NO: 7727343 - DNA, 22 bp, Homo sapiens
tctgtttaggcaaaatagctac

SEQ ID NO: 7727344 - DNA, 22 bp, Homo sapiens
tctgtttatgcatatttaaaac

SEQ ID NO: 7727345 - DNA, 22 bp, Homo sapiens
tctgtttatgtgtctaaataaa

SEQ ID NO: 7727346 - DNA, 22 bp, Homo sapiens
tctgtttatgtgtctaaataaa

SEQ ID NO: 7727347 - DNA, 22 bp, Homo sapiens
tctgtttatgtgtctaaataaa

SEQ ID NO: 7727348 - DNA, 22 bp, Homo sapiens
tctgtttatgtgtctaaataaa

SEQ ID NO: 7727349 - DNA, 22 bp, Homo sapiens
tctgtttagactcagttgaaac

SEQ ID NO: 7727350 - DNA, 22 bp, Homo sapiens
tctgtttagactcagttgaaac

SEQ ID NO: 7727351 - DNA, 22 bp, Homo sapiens
tctgtttagactcagttgaaac

SEQ ID NO: 7727352 - DNA, 22 bp, Homo sapiens
tctgtttaatgggaatgatact

SEQ ID NO: 7727353 - DNA, 22 bp, Homo sapiens
tctgtttagatgctttatctgt

SEQ ID NO: 7727354 - DNA, 22 bp, Homo sapiens
tctgtttagatgctttatctgt

SEQ ID NO: 7727355 - DNA, 22 bp, Homo sapiens
tctgtttaggcaaaatagctac

SEQ ID NO: 7727356 - DNA, 22 bp, Homo sapiens
tctgtttaggcaaaatagctac

SEQ ID NO: 7727357 - DNA, 22 bp, Homo sapiens
tctgttagctgtcaaagtgttt

SEQ ID NO: 7727358 - DNA, 22 bp, Homo sapiens
tctgttataaatcacactgcat

SEQ ID NO: 7727359 - DNA, 22 bp, Homo sapiens
tctgttagagaggtagttcttg

SEQ ID NO: 7727360 - DNA, 22 bp, Homo sapiens
tctgttaacctggtcttggctt

SEQ ID NO: 7727361 - DNA, 22 bp, Homo sapiens
tctgttaaaagtggaataatag

SEQ ID NO: 7727362 - DNA, 22 bp, Homo sapiens
tctgttaacctggtcttggctt

SEQ ID NO: 7727363 - DNA, 22 bp, Homo sapiens
tctgttatatagataatgtgtg

SEQ ID NO: 7727364 - DNA, 22 bp, Homo sapiens
tctgttatatgttttttctaaa

SEQ ID NO: 7727365 - DNA, 22 bp, Homo sapiens
tctgttatatgttttttctaaa

SEQ ID NO: 7727366 - DNA, 22 bp, Homo sapiens
tctgttatctcaagtcacaaga

SEQ ID NO: 7727367 - DNA, 22 bp, Homo sapiens
tctgttatctcaagtcacaaga

SEQ ID NO: 7727368 - DNA, 22 bp, Homo sapiens
tctgttataaatcacactgcat

SEQ ID NO: 7727369 - DNA, 22 bp, Homo sapiens
tctgttatacaacaagtaacag

SEQ ID NO: 7727370 - DNA, 22 bp, Homo sapiens
tctgttatatagataatgtgtg

SEQ ID NO: 7727371 - DNA, 22 bp, Homo sapiens
tctgttatacagtctgtggcac

SEQ ID NO: 7727372 - DNA, 22 bp, Homo sapiens
tctgtgttttaaacagtagaaa

SEQ ID NO: 7727373 - DNA, 22 bp, Homo sapiens
tctgtgttttaaacagtagaaa

SEQ ID NO: 7727374 - DNA, 22 bp, Homo sapiens
tctgtgttttgtgcctactgct

SEQ ID NO: 7727375 - DNA, 22 bp, Homo sapiens
tctgtgtttaaaagatatgtcc

SEQ ID NO: 7727376 - DNA, 22 bp, Homo sapiens
tctgtgtttaaaagatatgtcc

SEQ ID NO: 7727377 - DNA, 18 bp, Homo sapiens
tctgtgttctgtcattgc

SEQ ID NO: 7727378 - DNA, 22 bp, Homo sapiens
tctgtgtgttgtcaggaggatt

SEQ ID NO: 7727379 - DNA, 22 bp, Homo sapiens
tctgtgtgttgtcaggaggatt

SEQ ID NO: 7727380 - DNA, 22 bp, Homo sapiens
tctgtgtgttgtcaggaggatt

SEQ ID NO: 7727381 - DNA, 22 bp, Homo sapiens
tctgtgtgttgtcaggaggatt

SEQ ID NO: 7727382 - DNA, 22 bp, Homo sapiens
tctgtgtgttgtcaggaggatt

SEQ ID NO: 7727383 - DNA, 22 bp, Homo sapiens
tctgtgttgataattttggaga

SEQ ID NO: 7727384 - DNA, 22 bp, Homo sapiens
tctgtgtttaaaagatatgtcc

SEQ ID NO: 7727385 - DNA, 22 bp, Homo sapiens
tctgtgttgataattttggaga

SEQ ID NO: 7727386 - DNA, 22 bp, Homo sapiens
tctgtgttgataattttggaga

SEQ ID NO: 7727387 - DNA, 18 bp, Homo sapiens
tctgtgttctgtcattgc

SEQ ID NO: 7727388 - DNA, 22 bp, Homo sapiens
tctgtgtggtagtttcagtgaa

SEQ ID NO: 7727389 - DNA, 22 bp, Homo sapiens
tctgtgtggtagtttcagtgaa

SEQ ID NO: 7727390 - DNA, 22 bp, Homo sapiens
tctgtgtggtagtttcagtgaa

SEQ ID NO: 7727391 - DNA, 22 bp, Homo sapiens
tctgtgtgggatagtttgagga

SEQ ID NO: 7727392 - DNA, 22 bp, Homo sapiens
tctgtgtgtgcctgttaatatt

SEQ ID NO: 7727393 - DNA, 22 bp, Homo sapiens
tctgtgtggtagtttcagtgaa

SEQ ID NO: 7727394 - DNA, 22 bp, Homo sapiens
tctgtgtgtgcctgttaatatt

SEQ ID NO: 7727395 - DNA, 22 bp, Homo sapiens
tctgtgtgttgtcaggaggatt

SEQ ID NO: 7727396 - DNA, 22 bp, Homo sapiens
tctgtgtgggatagtttgagga

SEQ ID NO: 7727397 - DNA, 22 bp, Homo sapiens
tctgtgtgggatagtttgagga

SEQ ID NO: 7727398 - DNA, 22 bp, Homo sapiens
tctgtgtgggatagtttgagga

SEQ ID NO: 7727399 - DNA, 22 bp, Homo sapiens
tctgtgtgggatagtttgagga

SEQ ID NO: 7727400 - DNA, 22 bp, Homo sapiens
tctgtgtgggatagtttgagga

SEQ ID NO: 7727401 - DNA, 22 bp, Homo sapiens
tctgtgtgggatagtttgagga

SEQ ID NO: 7727402 - DNA, 22 bp, Homo sapiens
tctgtgtgccctaaagcctgct

SEQ ID NO: 7727403 - DNA, 22 bp, Homo sapiens
tctgtgtgggatagtttgagga

SEQ ID NO: 7727404 - DNA, 22 bp, Homo sapiens
tctgtgtgccctaaagcctgct

SEQ ID NO: 7727405 - DNA, 22 bp, Homo sapiens
tctgtgtgcccacctgacacct

SEQ ID NO: 7727406 - DNA, 22 bp, Homo sapiens
tctgtgtgcccacctgacacct

SEQ ID NO: 7727407 - DNA, 22 bp, Homo sapiens
tctgtgtgcccacctgacacct

SEQ ID NO: 7727408 - DNA, 20 bp, Homo sapiens
tctgtgtgccatcacctaac

SEQ ID NO: 7727409 - DNA, 20 bp, Homo sapiens
tctgtgtgccatcacctaac

SEQ ID NO: 7727410 - DNA, 22 bp, Homo sapiens
tctgtgtgatttcagggaagtc

SEQ ID NO: 7727411 - DNA, 22 bp, Homo sapiens
tctgtgtgaccataagccagct

SEQ ID NO: 7727412 - DNA, 22 bp, Homo sapiens
tctgtgtgaccataagccagct

SEQ ID NO: 7727413 - DNA, 22 bp, Homo sapiens
tctgtgtgaccataagccagct

SEQ ID NO: 7727414 - DNA, 22 bp, Homo sapiens
tctgtgtgaccataagccagct

SEQ ID NO: 7727415 - DNA, 22 bp, Homo sapiens
tctgtgtgatttcagggaagtc

SEQ ID NO: 7727416 - DNA, 22 bp, Homo sapiens
tctgtgtgatttcagggaagtc

SEQ ID NO: 7727417 - DNA, 22 bp, Homo sapiens
tctgtgtgatttcagggaagtc

SEQ ID NO: 7727418 - DNA, 22 bp, Homo sapiens
tctggagagtcacagtgccaga

SEQ ID NO: 7727419 - DNA, 22 bp, Homo sapiens
tctggagaggggcctagaattt

SEQ ID NO: 7727420 - DNA, 22 bp, Homo sapiens
tctggagagtcacagtgccaga

SEQ ID NO: 7727421 - DNA, 22 bp, Homo sapiens
tctggagagtcacagtgccaga

SEQ ID NO: 7727422 - DNA, 22 bp, Homo sapiens
tctggagagtcctgctcacgtc

SEQ ID NO: 7727423 - DNA, 22 bp, Homo sapiens
tctggagagtcctgctcacgtc

SEQ ID NO: 7727424 - DNA, 22 bp, Homo sapiens
tctggagagtcctgctcacgtc

SEQ ID NO: 7727425 - DNA, 22 bp, Homo sapiens
tctggagataagacagacagat

SEQ ID NO: 7727426 - DNA, 22 bp, Homo sapiens
tctggagataagacagacagat

SEQ ID NO: 7727427 - DNA, 22 bp, Homo sapiens
tctggagataagacagacagat

SEQ ID NO: 7727428 - DNA, 22 bp, Homo sapiens
tctggagataagacagacagat

SEQ ID NO: 7727429 - DNA, 22 bp, Homo sapiens
tctggagataagacagacagat

SEQ ID NO: 7727430 - DNA, 22 bp, Homo sapiens
tctggagataagcagcaatgaa

SEQ ID NO: 7727431 - DNA, 22 bp, Homo sapiens
tctggagataagcagcaatgaa

SEQ ID NO: 7727432 - DNA, 22 bp, Homo sapiens
tctggagaggggcctagaattt

SEQ ID NO: 7727433 - DNA, 22 bp, Homo sapiens
tctggagaggggcctagaattt

SEQ ID NO: 7727434 - DNA, 22 bp, Homo sapiens
tctggagaggggcctagaattt

SEQ ID NO: 7727435 - DNA, 22 bp, Homo sapiens
tctggagaggggcctagaattt

SEQ ID NO: 7727436 - DNA, 22 bp, Homo sapiens
tctggagaggaggatgtggaca

SEQ ID NO: 7727437 - DNA, 22 bp, Homo sapiens
tctggagaggaggatgtggaca

SEQ ID NO: 7727438 - DNA, 22 bp, Homo sapiens
tctggagaggaggatgtggaca

SEQ ID NO: 7727439 - DNA, 22 bp, Homo sapiens
tctggagaggggcctagaattt

SEQ ID NO: 7727440 - DNA, 22 bp, Homo sapiens
tctggagaggaggatgtggaca

SEQ ID NO: 7727441 - DNA, 22 bp, Homo sapiens
tctggagaggaggatgtggaca

SEQ ID NO: 7727442 - DNA, 22 bp, Homo sapiens
tctggagacctgcatttatatt

SEQ ID NO: 7727443 - DNA, 22 bp, Homo sapiens
tctggagagatcttccacaaca

SEQ ID NO: 7727444 - DNA, 22 bp, Homo sapiens
tctggagacctagccctgttgt

SEQ ID NO: 7727445 - DNA, 22 bp, Homo sapiens
tctggagacctgcatttatatt

SEQ ID NO: 7727446 - DNA, 22 bp, Homo sapiens
tctggagagcagatgcctctgg

SEQ ID NO: 7727447 - DNA, 22 bp, Homo sapiens
tctggagaggaggatgtggaca

SEQ ID NO: 7727448 - DNA, 22 bp, Homo sapiens
tctggagaatctgtcagtgtgg

SEQ ID NO: 7727449 - DNA, 22 bp, Homo sapiens
tctggagaatctgtcagtgtgg

SEQ ID NO: 7727450 - DNA, 22 bp, Homo sapiens
tctggagaatctgtcagtgtgg

SEQ ID NO: 7727451 - DNA, 22 bp, Homo sapiens
tctggagaatctgtcagtgtgg

SEQ ID NO: 7727452 - DNA, 22 bp, Homo sapiens
tctggagaatctgtcagtgtgg

SEQ ID NO: 7727453 - DNA, 22 bp, Homo sapiens
tctggagaatctgtcagtgtgg

SEQ ID NO: 7727454 - DNA, 22 bp, Homo sapiens
tctggagaaggaagagtctttg

SEQ ID NO: 7727455 - DNA, 22 bp, Homo sapiens
tctggagaaggaagagtctttg

SEQ ID NO: 7727456 - DNA, 22 bp, Homo sapiens
tctggagaaggaagagtctttg

SEQ ID NO: 7727457 - DNA, 22 bp, Homo sapiens
tctggagaagcccagggagctg

SEQ ID NO: 7727458 - DNA, 22 bp, Homo sapiens
tctggagaaggaagagtctttg

SEQ ID NO: 7727459 - DNA, 22 bp, Homo sapiens
tctggagaaggaagagtctttg

SEQ ID NO: 7727460 - DNA, 22 bp, Homo sapiens
tctggagaaggaagagtctttg

SEQ ID NO: 7727461 - DNA, 22 bp, Homo sapiens
tctggagaagcccagggagctg

SEQ ID NO: 7727462 - DNA, 22 bp, Homo sapiens
tctggagaagcccagggagctg

SEQ ID NO: 7727463 - DNA, 22 bp, Homo sapiens
tctggagaagcagtgagagtca

SEQ ID NO: 7727464 - DNA, 22 bp, Homo sapiens
tctggagaagcagtgagagtca

SEQ ID NO: 7727465 - DNA, 22 bp, Homo sapiens
tctggagaagcccagggagctg

SEQ ID NO: 7727466 - DNA, 22 bp, Homo sapiens
tctggagaagcccagggagctg

SEQ ID NO: 7727467 - DNA, 22 bp, Homo sapiens
tctggagaagcccagggagctg

SEQ ID NO: 7727468 - DNA, 22 bp, Homo sapiens
tctggagaagcccagggagctg

SEQ ID NO: 7727469 - DNA, 22 bp, Homo sapiens
tctggagaagcccagggagctg

SEQ ID NO: 7727470 - DNA, 22 bp, Homo sapiens
tctggagaagaaacttgctctg

SEQ ID NO: 7727471 - DNA, 22 bp, Homo sapiens
tctggagaagaaacttgctctg

SEQ ID NO: 7727472 - DNA, 22 bp, Homo sapiens
tctggagaagcagtgagagtca

SEQ ID NO: 7727473 - DNA, 22 bp, Homo sapiens
tctggagaagcagtgagagtca

SEQ ID NO: 7727474 - DNA, 22 bp, Homo sapiens
tctggagaagcagtgagagtca

SEQ ID NO: 7727475 - DNA, 22 bp, Homo sapiens
tctggagaagaaacttgctctg

SEQ ID NO: 7727476 - DNA, 22 bp, Homo sapiens
tctggagaacttgcaagaggat

SEQ ID NO: 7727477 - DNA, 22 bp, Homo sapiens
tctggagaacttgcaagaggat

SEQ ID NO: 7727478 - DNA, 22 bp, Homo sapiens
tctggagaacttgcaagaggat

SEQ ID NO: 7727479 - DNA, 22 bp, Homo sapiens
tctggagaaagttgagtttgtg

SEQ ID NO: 7727480 - DNA, 22 bp, Homo sapiens
tctggactttcggtgcaagagt

SEQ ID NO: 7727481 - DNA, 22 bp, Homo sapiens
tctggactttcggtgcaagagt

SEQ ID NO: 7727482 - DNA, 22 bp, Homo sapiens
tctggagaaagttgagtttgtg

SEQ ID NO: 7727483 - DNA, 22 bp, Homo sapiens
tctggagaaagttgagtttgtg

SEQ ID NO: 7727484 - DNA, 22 bp, Homo sapiens
tctggagaaagttgagtttgtg

SEQ ID NO: 7727485 - DNA, 20 bp, Homo sapiens
tctggactgtcagacaggga

SEQ ID NO: 7727486 - DNA, 22 bp, Homo sapiens
tctggacttgaatcagagtaga

SEQ ID NO: 7727487 - DNA, 22 bp, Homo sapiens
tctggactctagggggactgtg

SEQ ID NO: 7727488 - DNA, 20 bp, Homo sapiens
tctggactgtcagacaggga

SEQ ID NO: 7727489 - DNA, 22 bp, Homo sapiens
tctggactctagggggactgtg

SEQ ID NO: 7727490 - DNA, 22 bp, Homo sapiens
tctggaataggtcctgagtatt

SEQ ID NO: 7727491 - DNA, 22 bp, Homo sapiens
tctggaataggtcctgagtatt

SEQ ID NO: 7727492 - DNA, 22 bp, Homo sapiens
tctggaataggtcctgagtatt

SEQ ID NO: 7727493 - DNA, 22 bp, Homo sapiens
tctggaatcagacctaatccca

SEQ ID NO: 7727494 - DNA, 22 bp, Homo sapiens
tctggaatcagtggcttaccct

SEQ ID NO: 7727495 - DNA, 23 bp, Homo sapiens
tctggaatcctcccccttggttc

SEQ ID NO: 7727496 - DNA, 22 bp, Homo sapiens
tctggaatgaatgaggttctgt

SEQ ID NO: 7727497 - DNA, 22 bp, Homo sapiens
tctggaatgatttccttcccct

SEQ ID NO: 7727498 - DNA, 22 bp, Homo sapiens
tctggaatgaatgaggttctgt

SEQ ID NO: 7727499 - DNA, 22 bp, Homo sapiens
tctggaataaccctgcttccaa

SEQ ID NO: 7727500 - DNA, 22 bp, Homo sapiens
tctggaataaccctgcttccaa

SEQ ID NO: 7727501 - DNA, 22 bp, Homo sapiens
tctggaataggacaaaaccaaa

SEQ ID NO: 7727502 - DNA, 22 bp, Homo sapiens
tctggaagttagaggaggaaag

SEQ ID NO: 7727503 - DNA, 22 bp, Homo sapiens
tctggaagttagaggaggaaag

SEQ ID NO: 7727504 - DNA, 22 bp, Homo sapiens
tctggaagttagaggaggaaag

SEQ ID NO: 7727505 - DNA, 22 bp, Homo sapiens
tctggaagtgatgttcatagtg

SEQ ID NO: 7727506 - DNA, 22 bp, Homo sapiens
tctggaaggaacccttagagga

SEQ ID NO: 7727507 - DNA, 22 bp, Homo sapiens
tctggaagctggagtccaggaa

SEQ ID NO: 7727508 - DNA, 22 bp, Homo sapiens
tctggaagctggagtccaggaa

SEQ ID NO: 7727509 - DNA, 22 bp, Homo sapiens
tctggaagacagtgagcccgct

SEQ ID NO: 7727510 - DNA, 22 bp, Homo sapiens
tctggaagacattaatttggtt

SEQ ID NO: 7727511 - DNA, 22 bp, Homo sapiens
tctggaagacattaatttggtt

SEQ ID NO: 7727512 - DNA, 22 bp, Homo sapiens
tctggaagctggagtccaggaa

SEQ ID NO: 7727513 - DNA, 22 bp, Homo sapiens
tctggaagtcaccttagttcct

SEQ ID NO: 7727514 - DNA, 22 bp, Homo sapiens
tctggaaggttggctcccagtt

SEQ ID NO: 7727515 - DNA, 22 bp, Homo sapiens
tctggaaggaagagctgagtcc

SEQ ID NO: 7727516 - DNA, 22 bp, Homo sapiens
tctggaaggaagagctgagtcc

SEQ ID NO: 7727517 - DNA, 22 bp, Homo sapiens
tctggaaggaacccttagagga

SEQ ID NO: 7727518 - DNA, 22 bp, Homo sapiens
tctggaaggcttcaaggtctaa

SEQ ID NO: 7727519 - DNA, 22 bp, Homo sapiens
tctggaaggaagagctgagtcc

SEQ ID NO: 7727520 - DNA, 22 bp, Homo sapiens
tctggacatcctggagaatgac

SEQ ID NO: 7727521 - DNA, 22 bp, Homo sapiens
tctggacatcctggagaatgac

SEQ ID NO: 7727522 - DNA, 22 bp, Homo sapiens
tctggacatcctggagaatgac

SEQ ID NO: 7727523 - DNA, 22 bp, Homo sapiens
tctggacatgcttgaataatat

SEQ ID NO: 7727524 - DNA, 22 bp, Homo sapiens
tctggacatttggtaggataga

SEQ ID NO: 7727525 - DNA, 22 bp, Homo sapiens
tctggacatttggtaggataga

SEQ ID NO: 7727526 - DNA, 22 bp, Homo sapiens
tctggacatttggtaggataga

SEQ ID NO: 7727527 - DNA, 22 bp, Homo sapiens
tctggaccctgggctgtgattt

SEQ ID NO: 7727528 - DNA, 21 bp, Homo sapiens
tctggaccaccttgtaaagct

SEQ ID NO: 7727529 - DNA, 22 bp, Homo sapiens
tctggaccaagtcctgtggtga

SEQ ID NO: 7727530 - DNA, 21 bp, Homo sapiens
tctggaccaccttgtaaagct

SEQ ID NO: 7727531 - DNA, 22 bp, Homo sapiens
tctggactaacagcagcctcag

SEQ ID NO: 7727532 - DNA, 22 bp, Homo sapiens
tctggactaacagcagcctcag

SEQ ID NO: 7727533 - DNA, 22 bp, Homo sapiens
tctggaccctgggctgtgattt

SEQ ID NO: 7727534 - DNA, 22 bp, Homo sapiens
tctggacgtgttggtgaggacc

SEQ ID NO: 7727535 - DNA, 22 bp, Homo sapiens
tctggactccatgctgcctgga

SEQ ID NO: 7727536 - DNA, 20 bp, Homo sapiens
tctggactctaaggtatatt

SEQ ID NO: 7727537 - DNA, 22 bp, Homo sapiens
tctggactcgggtgggtgacac

SEQ ID NO: 7727538 - DNA, 20 bp, Homo sapiens
tctggactctaaggtatatt

SEQ ID NO: 7727539 - DNA, 22 bp, Homo sapiens
tctggactccatgctgcctgga

SEQ ID NO: 7727540 - DNA, 22 bp, Homo sapiens
tctggactaggggaaggcctgt

SEQ ID NO: 7727541 - DNA, 22 bp, Homo sapiens
tctggactaacagcagcctcag

SEQ ID NO: 7727542 - DNA, 22 bp, Homo sapiens
tctggactaatattctggctgc

SEQ ID NO: 7727543 - DNA, 22 bp, Homo sapiens
tctggactaacagcagcctcag

SEQ ID NO: 7727544 - DNA, 22 bp, Homo sapiens
tctggactaatattctggctgc

SEQ ID NO: 7727545 - DNA, 22 bp, Homo sapiens
tctggaattaaactcaggagac

SEQ ID NO: 7727546 - DNA, 22 bp, Homo sapiens
tctggaattaaactcaggagac

SEQ ID NO: 7727547 - DNA, 22 bp, Homo sapiens
tctggaattctcaagtcctgga

SEQ ID NO: 7727548 - DNA, 22 bp, Homo sapiens
tctggaattgctgtgtgagttc

SEQ ID NO: 7727549 - DNA, 22 bp, Homo sapiens
tctggaattctcaagtcctgga

SEQ ID NO: 7727550 - DNA, 22 bp, Homo sapiens
tctggaattttattgatcaaaa

SEQ ID NO: 7727551 - DNA, 22 bp, Homo sapiens
tctggacagagcttcaggagct

SEQ ID NO: 7727552 - DNA, 22 bp, Homo sapiens
tctggacaatcctgagacagac

SEQ ID NO: 7727553 - DNA, 22 bp, Homo sapiens
tctggacagagcttcaggagct

SEQ ID NO: 7727554 - DNA, 22 bp, Homo sapiens
tctggacaatcctgagacagac

SEQ ID NO: 7727555 - DNA, 22 bp, Homo sapiens
tctggacaatcctgagacagac

SEQ ID NO: 7727556 - DNA, 22 bp, Homo sapiens
tctggacaatcctgagacagac

SEQ ID NO: 7727557 - DNA, 22 bp, Homo sapiens
tctggacaatcctgagacagac

SEQ ID NO: 7727558 - DNA, 23 bp, Homo sapiens
tctggacataacggagaagcaaa

SEQ ID NO: 7727559 - DNA, 23 bp, Homo sapiens
tctggacataacggagaagcaaa

SEQ ID NO: 7727560 - DNA, 23 bp, Homo sapiens
tctggacataacggagaagcaaa

SEQ ID NO: 7727561 - DNA, 22 bp, Homo sapiens
tctggacagtagagcaatgatt

SEQ ID NO: 7727562 - DNA, 22 bp, Homo sapiens
tctggacagtagagcaatgatt

SEQ ID NO: 7727563 - DNA, 22 bp, Homo sapiens
tctggacaggtcaaagcccatg

SEQ ID NO: 7727564 - DNA, 22 bp, Homo sapiens
tctggacaggtcaaagcccatg

SEQ ID NO: 7727565 - DNA, 22 bp, Homo sapiens
tctggacaggggcgctttgggg

SEQ ID NO: 7727566 - DNA, 22 bp, Homo sapiens
tctggacaggtcaaagcccatg

SEQ ID NO: 7727567 - DNA, 22 bp, Homo sapiens
tctgctgctgcagctacactat

SEQ ID NO: 7727568 - DNA, 22 bp, Homo sapiens
tctgctgctgcagctacactat

SEQ ID NO: 7727569 - DNA, 22 bp, Homo sapiens
tctgctgctgaccaacactgtg

SEQ ID NO: 7727570 - DNA, 22 bp, Homo sapiens
tctgctgctgagcacactccta

SEQ ID NO: 7727571 - DNA, 18 bp, Homo sapiens
tctgctgctgcgtcctgc

SEQ ID NO: 7727572 - DNA, 18 bp, Homo sapiens
tctgctgctgcgtcctgc

SEQ ID NO: 7727573 - DNA, 18 bp, Homo sapiens
tctgctgctgcgtcctgc

SEQ ID NO: 7727574 - DNA, 22 bp, Homo sapiens
tctgctgctgcagctacactat

SEQ ID NO: 7727575 - DNA, 22 bp, Homo sapiens
tctgctggaaaaccagggaatt

SEQ ID NO: 7727576 - DNA, 22 bp, Homo sapiens
tctgctggaaaaccagggaatt

SEQ ID NO: 7727577 - DNA, 22 bp, Homo sapiens
tctgctggaaaaccagggaatt

SEQ ID NO: 7727578 - DNA, 22 bp, Homo sapiens
tctgctggccttagcaggtcta

SEQ ID NO: 7727579 - DNA, 22 bp, Homo sapiens
tctgctggccttagcaggtcta

SEQ ID NO: 7727580 - DNA, 22 bp, Homo sapiens
tctgctggccttagcaggtcta

SEQ ID NO: 7727581 - DNA, 19 bp, Homo sapiens
tctgctggcagaattccct

SEQ ID NO: 7727582 - DNA, 22 bp, Homo sapiens
tctgctggttccgaattaggcc

SEQ ID NO: 7727583 - DNA, 22 bp, Homo sapiens
tctgctggttccgaattaggcc

SEQ ID NO: 7727584 - DNA, 22 bp, Homo sapiens
tctgctggtgatgacctcataa

SEQ ID NO: 7727585 - DNA, 22 bp, Homo sapiens
tctgctgtaaccttcagaggta

SEQ ID NO: 7727586 - DNA, 22 bp, Homo sapiens
tctgctgtaaccttcagaggta

SEQ ID NO: 7727587 - DNA, 22 bp, Homo sapiens
tctgctgtacttttggtctgtt

SEQ ID NO: 7727588 - DNA, 22 bp, Homo sapiens
tctgctgtaaagaatttctgcc

SEQ ID NO: 7727589 - DNA, 22 bp, Homo sapiens
tctgctggccttagcaggtcta

SEQ ID NO: 7727590 - DNA, 22 bp, Homo sapiens
tctgctggtcaaggctgggtcc

SEQ ID NO: 7727591 - DNA, 22 bp, Homo sapiens
tctgctggtcaaggctgggtcc

SEQ ID NO: 7727592 - DNA, 22 bp, Homo sapiens
tctgctggtcaaggctgggtcc

SEQ ID NO: 7727593 - DNA, 22 bp, Homo sapiens
tctgctggtcaaggctgggtcc

SEQ ID NO: 7727594 - DNA, 22 bp, Homo sapiens
tctgctggtgatgacctcataa

SEQ ID NO: 7727595 - DNA, 22 bp, Homo sapiens
tctgctggtgatgacctcataa

SEQ ID NO: 7727596 - DNA, 23 bp, Homo sapiens
tctgctggtgacacggtcacatt

SEQ ID NO: 7727597 - DNA, 23 bp, Homo sapiens
tctgctggtgacacggtcacatt

SEQ ID NO: 7727598 - DNA, 22 bp, Homo sapiens
tctgctggtcaaggctgggtcc

SEQ ID NO: 7727599 - DNA, 22 bp, Homo sapiens
tctgctgtgaaaggtgaatatt

SEQ ID NO: 7727600 - DNA, 22 bp, Homo sapiens
tctgctgtgattctactagtgt

SEQ ID NO: 7727601 - DNA, 22 bp, Homo sapiens
tctgctgtgggtctatatttta

SEQ ID NO: 7727602 - DNA, 22 bp, Homo sapiens
tctgctgtgggcagagacccct

SEQ ID NO: 7727603 - DNA, 22 bp, Homo sapiens
tctgctgtcccgagggccactt

SEQ ID NO: 7727604 - DNA, 22 bp, Homo sapiens
tctgctgtctatgcaagtcctt

SEQ ID NO: 7727605 - DNA, 22 bp, Homo sapiens
tctgctgtcctttatatagatt

SEQ ID NO: 7727606 - DNA, 22 bp, Homo sapiens
tctgctgtcttttctgggtgag

SEQ ID NO: 7727607 - DNA, 22 bp, Homo sapiens
tctgctgtctgattcccacttc

SEQ ID NO: 7727608 - DNA, 22 bp, Homo sapiens
tctgctgtctgattcccacttc

SEQ ID NO: 7727609 - DNA, 22 bp, Homo sapiens
tctgctgtgttgaatgattggt

SEQ ID NO: 7727610 - DNA, 22 bp, Homo sapiens
tctgctgttcattcttttagct

SEQ ID NO: 7727611 - DNA, 22 bp, Homo sapiens
tctgctgtgtccctggtctcct

SEQ ID NO: 7727612 - DNA, 22 bp, Homo sapiens
tctgctgtgtccctggtctcct

SEQ ID NO: 7727613 - DNA, 22 bp, Homo sapiens
tctgctgtgtcccctgtgcggg

SEQ ID NO: 7727614 - DNA, 22 bp, Homo sapiens
tctgctgtgtcccctgtgcggg

SEQ ID NO: 7727615 - DNA, 22 bp, Homo sapiens
tctgctgttctcatgctgattt

SEQ ID NO: 7727616 - DNA, 22 bp, Homo sapiens
tctgctgttgccatgagtaata

SEQ ID NO: 7727617 - DNA, 22 bp, Homo sapiens
tctgctgttgccatgagtaata

SEQ ID NO: 7727618 - DNA, 22 bp, Homo sapiens
tctgctgttgagcacaagtgaa

SEQ ID NO: 7727619 - DNA, 21 bp, Homo sapiens
tctggaagaaaaaagtattat

SEQ ID NO: 7727620 - DNA, 22 bp, Homo sapiens
tctggaagaacggggcatgctg

SEQ ID NO: 7727621 - DNA, 22 bp, Homo sapiens
tctggaagaacggggcatgctg

SEQ ID NO: 7727622 - DNA, 22 bp, Homo sapiens
tctgctgctgaccaacactgtg

SEQ ID NO: 7727623 - DNA, 22 bp, Homo sapiens
tctgctgctacagactctctag

SEQ ID NO: 7727624 - DNA, 22 bp, Homo sapiens
tctgctgctacagactctctag

SEQ ID NO: 7727625 - DNA, 22 bp, Homo sapiens
tctgctgcctgcagggcagaga

SEQ ID NO: 7727626 - DNA, 22 bp, Homo sapiens
tctgctgcctgcagggcagaga

SEQ ID NO: 7727627 - DNA, 22 bp, Homo sapiens
tctgctgcctcggtgtgggtac

SEQ ID NO: 7727628 - DNA, 22 bp, Homo sapiens
tctgctgccaccttgtggtgag

SEQ ID NO: 7727629 - DNA, 22 bp, Homo sapiens
tctgctgccatgcagagcagta

SEQ ID NO: 7727630 - DNA, 22 bp, Homo sapiens
tctgctgccatgcagagcagta

SEQ ID NO: 7727631 - DNA, 22 bp, Homo sapiens
tctgctgcagcaggattctctg

SEQ ID NO: 7727632 - DNA, 22 bp, Homo sapiens
tctgctgcagcaggattctctg

SEQ ID NO: 7727633 - DNA, 22 bp, Homo sapiens
tctgctgcacaaattcatctct

SEQ ID NO: 7727634 - DNA, 22 bp, Homo sapiens
tctgctgcagagctgcgggtgc

SEQ ID NO: 7727635 - DNA, 22 bp, Homo sapiens
tctgctgcacaaattcatctct

SEQ ID NO: 7727636 - DNA, 22 bp, Homo sapiens
tctgctgcacaaattcatctct

SEQ ID NO: 7727637 - DNA, 22 bp, Homo sapiens
tctgctgagtcagacctctggg

SEQ ID NO: 7727638 - DNA, 22 bp, Homo sapiens
tctgctgaggtggttttagaga

SEQ ID NO: 7727639 - DNA, 22 bp, Homo sapiens
tctgctgaggccttcccactcc

SEQ ID NO: 7727640 - DNA, 22 bp, Homo sapiens
tctgctgaatggagccaacctc

SEQ ID NO: 7727641 - DNA, 22 bp, Homo sapiens
tctgctctgtggcttcagctaa

SEQ ID NO: 7727642 - DNA, 22 bp, Homo sapiens
tctgctgaacttgctgcccaga

SEQ ID NO: 7727643 - DNA, 22 bp, Homo sapiens
tctgctctgtggcttcagctaa

SEQ ID NO: 7727644 - DNA, 22 bp, Homo sapiens
tctgctctgtggcttcagctaa

SEQ ID NO: 7727645 - DNA, 22 bp, Homo sapiens
tctgctctgtggcttcagctaa

SEQ ID NO: 7727646 - DNA, 22 bp, Homo sapiens
tctgctctgtactgcactggcc

SEQ ID NO: 7727647 - DNA, 22 bp, Homo sapiens
tctgctctgagagggccatcag

SEQ ID NO: 7727648 - DNA, 22 bp, Homo sapiens
tctgctctgagagggccatcag

SEQ ID NO: 7727649 - DNA, 22 bp, Homo sapiens
tctgctctgagagggccatcag

SEQ ID NO: 7727650 - DNA, 17 bp, Homo sapiens
tctgctctgccaatcca

SEQ ID NO: 7727651 - DNA, 17 bp, Homo sapiens
tctgctctgccaatcca

SEQ ID NO: 7727652 - DNA, 17 bp, Homo sapiens
tctgctctgccaatcca

SEQ ID NO: 7727653 - DNA, 22 bp, Homo sapiens
tctgctctgtactgcactggcc

SEQ ID NO: 7727654 - DNA, 22 bp, Homo sapiens
tctgctctgtactgcactggcc

SEQ ID NO: 7727655 - DNA, 22 bp, Homo sapiens
tctgctctgagagggccatcag

SEQ ID NO: 7727656 - DNA, 22 bp, Homo sapiens
tctgctctgagagggccatcag

SEQ ID NO: 7727657 - DNA, 23 bp, Homo sapiens
tctgctctgaagttcggctgagc

SEQ ID NO: 7727658 - DNA, 23 bp, Homo sapiens
tctgctctgaagttcggctgagc

SEQ ID NO: 7727659 - DNA, 22 bp, Homo sapiens
tctgctctccatacttccgcac

SEQ ID NO: 7727660 - DNA, 22 bp, Homo sapiens
tctgctctccatacttccgcac

SEQ ID NO: 7727661 - DNA, 22 bp, Homo sapiens
tctgctctccatacttccgcac

SEQ ID NO: 7727662 - DNA, 22 bp, Homo sapiens
tctgctctccatacttccgcac

SEQ ID NO: 7727663 - DNA, 22 bp, Homo sapiens
tctgctctagttgcttcctgcc

SEQ ID NO: 7727664 - DNA, 22 bp, Homo sapiens
tctgctctagttgcttcctgcc

SEQ ID NO: 7727665 - DNA, 22 bp, Homo sapiens
tctggcaccctgacttagtgtt

SEQ ID NO: 7727666 - DNA, 22 bp, Homo sapiens
tctggcaccctgacttagtgtt

SEQ ID NO: 7727667 - DNA, 22 bp, Homo sapiens
tctggcacttaaatgagaattt

SEQ ID NO: 7727668 - DNA, 22 bp, Homo sapiens
tctggcactgggctgtgtgagc

SEQ ID NO: 7727669 - DNA, 22 bp, Homo sapiens
tctggcaccctgacttagtgtt

SEQ ID NO: 7727670 - DNA, 22 bp, Homo sapiens
tctggcactgggctgtgtgagc

SEQ ID NO: 7727671 - DNA, 22 bp, Homo sapiens
tctggcagaaggcagaaattca

SEQ ID NO: 7727672 - DNA, 22 bp, Homo sapiens
tctggcacttaaatgagaattt

SEQ ID NO: 7727673 - DNA, 22 bp, Homo sapiens
tctggcacttgccagtttctat

SEQ ID NO: 7727674 - DNA, 22 bp, Homo sapiens
tctggcacttgccagtttctat

SEQ ID NO: 7727675 - DNA, 22 bp, Homo sapiens
tctggcagaagtgctgtcagta

SEQ ID NO: 7727676 - DNA, 20 bp, Homo sapiens
tctggcacactgagaagctc

SEQ ID NO: 7727677 - DNA, 22 bp, Homo sapiens
tctggcacatagcagggtctct

SEQ ID NO: 7727678 - DNA, 22 bp, Homo sapiens
tctggcacatagcagggtctct

SEQ ID NO: 7727679 - DNA, 22 bp, Homo sapiens
tctggcacatagcagggtctct

SEQ ID NO: 7727680 - DNA, 22 bp, Homo sapiens
tctggcacatagcagggtctct

SEQ ID NO: 7727681 - DNA, 22 bp, Homo sapiens
tctggcacactaggtctcaggt

SEQ ID NO: 7727682 - DNA, 22 bp, Homo sapiens
tctggcaccactgagtctgcag

SEQ ID NO: 7727683 - DNA, 22 bp, Homo sapiens
tctggcaatctgattctgcatc

SEQ ID NO: 7727684 - DNA, 22 bp, Homo sapiens
tctggcaaaggcaaccacagtt

SEQ ID NO: 7727685 - DNA, 22 bp, Homo sapiens
tctggcaaaggcaaccacagtt

SEQ ID NO: 7727686 - DNA, 22 bp, Homo sapiens
tctggcaaaggcaaccacagtt

SEQ ID NO: 7727687 - DNA, 22 bp, Homo sapiens
tctggcacactaggtctcaggt

SEQ ID NO: 7727688 - DNA, 20 bp, Homo sapiens
tctggcacactgagaagctc

SEQ ID NO: 7727689 - DNA, 20 bp, Homo sapiens
tctggcacactgagaagctc

SEQ ID NO: 7727690 - DNA, 22 bp, Homo sapiens
tctggcagaggaaggaggcctg

SEQ ID NO: 7727691 - DNA, 22 bp, Homo sapiens
tctggcagaggaaggaggcctg

SEQ ID NO: 7727692 - DNA, 22 bp, Homo sapiens
tctggcagagatatccatccca

SEQ ID NO: 7727693 - DNA, 22 bp, Homo sapiens
tctggcagaagtgctgtcagta

SEQ ID NO: 7727694 - DNA, 22 bp, Homo sapiens
tctggcagagtgataggataag

SEQ ID NO: 7727695 - DNA, 22 bp, Homo sapiens
tctggcagagtcagtgcacaca

SEQ ID NO: 7727696 - DNA, 22 bp, Homo sapiens
tctggcagagtcagtgcacaca

SEQ ID NO: 7727697 - DNA, 22 bp, Homo sapiens
tctggcagagtcagtgcacaca

SEQ ID NO: 7727698 - DNA, 22 bp, Homo sapiens
tctggcagaggaaggaggcctg

SEQ ID NO: 7727699 - DNA, 22 bp, Homo sapiens
tctggcagtaataggggagaga

SEQ ID NO: 7727700 - DNA, 22 bp, Homo sapiens
tctggcagtaataggggagaga

SEQ ID NO: 7727701 - DNA, 22 bp, Homo sapiens
tctggcaggttcccatgttatg

SEQ ID NO: 7727702 - DNA, 20 bp, Homo sapiens
tctggcaggtgaacgagctg

SEQ ID NO: 7727703 - DNA, 20 bp, Homo sapiens
tctggcaggtgaacgagctg

SEQ ID NO: 7727704 - DNA, 22 bp, Homo sapiens
tctggcagtgaagtcatgaggt

SEQ ID NO: 7727705 - DNA, 22 bp, Homo sapiens
tctggcagtgaagtcatgaggt

SEQ ID NO: 7727706 - DNA, 22 bp, Homo sapiens
tctggcagtgaagtcatgaggt

SEQ ID NO: 7727707 - DNA, 22 bp, Homo sapiens
tctggcagtgaagtcatgaggt

SEQ ID NO: 7727708 - DNA, 22 bp, Homo sapiens
tctggcagtgagcaacttgaca

SEQ ID NO: 7727709 - DNA, 22 bp, Homo sapiens
tctggcagtgagcaacttgaca

SEQ ID NO: 7727710 - DNA, 22 bp, Homo sapiens
tctggcagcaagtctgtttctc

SEQ ID NO: 7727711 - DNA, 22 bp, Homo sapiens
tctggcagggtgtgtatttaca

SEQ ID NO: 7727712 - DNA, 22 bp, Homo sapiens
tctggcagcaagataacaatgg

SEQ ID NO: 7727713 - DNA, 22 bp, Homo sapiens
tctggcagcaagataacaatgg

SEQ ID NO: 7727714 - DNA, 22 bp, Homo sapiens
tctggcagatcttcccacgttt

SEQ ID NO: 7727715 - DNA, 22 bp, Homo sapiens
tctggcagagtgataggataag

SEQ ID NO: 7727716 - DNA, 22 bp, Homo sapiens
tctggcaggtcaatcattcttt

SEQ ID NO: 7727717 - DNA, 19 bp, Homo sapiens
tctggcaggtaattaggga

SEQ ID NO: 7727718 - DNA, 19 bp, Homo sapiens
tctggcaggtaattaggga

SEQ ID NO: 7727719 - DNA, 20 bp, Homo sapiens
tctggcaggtgaacgagctg

SEQ ID NO: 7727720 - DNA, 20 bp, Homo sapiens
tctggcaggtgaacgagctg

SEQ ID NO: 7727721 - DNA, 22 bp, Homo sapiens
tctggcccagcccctgatccca

SEQ ID NO: 7727722 - DNA, 22 bp, Homo sapiens
tctggcccagcccctgatccca

SEQ ID NO: 7727723 - DNA, 22 bp, Homo sapiens
tctggcccagcccctgatccca

SEQ ID NO: 7727724 - DNA, 22 bp, Homo sapiens
tctggcccagcccctgatccca

SEQ ID NO: 7727725 - DNA, 22 bp, Homo sapiens
tctggcccagcccctgaggtca

SEQ ID NO: 7727726 - DNA, 22 bp, Homo sapiens
tctggcccagcccctgatccca

SEQ ID NO: 7727727 - DNA, 22 bp, Homo sapiens
tctggcccatcttctgccacca

SEQ ID NO: 7727728 - DNA, 22 bp, Homo sapiens
tctggcccatgatcctgctaac

SEQ ID NO: 7727729 - DNA, 22 bp, Homo sapiens
tctggcccatgatcctgctaac

SEQ ID NO: 7727730 - DNA, 22 bp, Homo sapiens
tctggcccatcttctgccacca

SEQ ID NO: 7727731 - DNA, 22 bp, Homo sapiens
tctggcccatcttctgccacca

SEQ ID NO: 7727732 - DNA, 22 bp, Homo sapiens
tctggcccatcttctgccacca

SEQ ID NO: 7727733 - DNA, 22 bp, Homo sapiens
tctggcccatcttctgccacca

SEQ ID NO: 7727734 - DNA, 22 bp, Homo sapiens
tctggcccagcccctgatccca

SEQ ID NO: 7727735 - DNA, 22 bp, Homo sapiens
tctggcccaagttttcggtgag

SEQ ID NO: 7727736 - DNA, 22 bp, Homo sapiens
tctggcccaagttttcggtgag

SEQ ID NO: 7727737 - DNA, 22 bp, Homo sapiens
tctggcccaagttttcggtgag

SEQ ID NO: 7727738 - DNA, 22 bp, Homo sapiens
tctggccatggcaagccgagtg

SEQ ID NO: 7727739 - DNA, 22 bp, Homo sapiens
tctggccatggcaagccgagtg

SEQ ID NO: 7727740 - DNA, 22 bp, Homo sapiens
tctggccatggcaagccgagtg

SEQ ID NO: 7727741 - DNA, 22 bp, Homo sapiens
tctggcccagcccctgaggtca

SEQ ID NO: 7727742 - DNA, 22 bp, Homo sapiens
tctggcccagcccctgaggtca

SEQ ID NO: 7727743 - DNA, 22 bp, Homo sapiens
tctggccaggggtccctgaagg

SEQ ID NO: 7727744 - DNA, 22 bp, Homo sapiens
tctggccaggggtccctgaagg

SEQ ID NO: 7727745 - DNA, 22 bp, Homo sapiens
tctggccaggatggcaagacca

SEQ ID NO: 7727746 - DNA, 22 bp, Homo sapiens
tctggccaggatggcaagacca

SEQ ID NO: 7727747 - DNA, 22 bp, Homo sapiens
tctggccaggatggcaagacca

SEQ ID NO: 7727748 - DNA, 22 bp, Homo sapiens
tctggccaggatggcaagacca

SEQ ID NO: 7727749 - DNA, 22 bp, Homo sapiens
tctggccagtgaaatgcagaat

SEQ ID NO: 7727750 - DNA, 22 bp, Homo sapiens
tctggccagtagatgtgggttg

SEQ ID NO: 7727751 - DNA, 22 bp, Homo sapiens
tctggccagtgaaatgcagaat

SEQ ID NO: 7727752 - DNA, 22 bp, Homo sapiens
tctggccagaaagacttgatgt

SEQ ID NO: 7727753 - DNA, 22 bp, Homo sapiens
tctggccacttgcttcacactg

SEQ ID NO: 7727754 - DNA, 22 bp, Homo sapiens
tctggccacttgcttcacactg

SEQ ID NO: 7727755 - DNA, 22 bp, Homo sapiens
tctggccagcatgagacctggt

SEQ ID NO: 7727756 - DNA, 22 bp, Homo sapiens
tctggccagaaagacttgatgt

SEQ ID NO: 7727757 - DNA, 22 bp, Homo sapiens
tctggccacccgaggcccctgc

SEQ ID NO: 7727758 - DNA, 22 bp, Homo sapiens
tctggccacccgaggcccctgc

SEQ ID NO: 7727759 - DNA, 22 bp, Homo sapiens
tctggccactaataggtctcac

SEQ ID NO: 7727760 - DNA, 22 bp, Homo sapiens
tctggccactaataggtctcac

SEQ ID NO: 7727761 - DNA, 22 bp, Homo sapiens
tctggccactaataggtctcac

SEQ ID NO: 7727762 - DNA, 22 bp, Homo sapiens
tctggccactaataggtctcac

SEQ ID NO: 7727763 - DNA, 22 bp, Homo sapiens
tctggcagttccttgttgatat

SEQ ID NO: 7727764 - DNA, 22 bp, Homo sapiens
tctggcagttgccgcttcagtc

SEQ ID NO: 7727765 - DNA, 22 bp, Homo sapiens
tctggcagttccttgttgatat

SEQ ID NO: 7727766 - DNA, 22 bp, Homo sapiens
tctggcagtttgagaaaggcta

SEQ ID NO: 7727767 - DNA, 22 bp, Homo sapiens
tctggcagttgccgcttcagtc

SEQ ID NO: 7727768 - DNA, 22 bp, Homo sapiens
tctggcagttgccgcttcagtc

SEQ ID NO: 7727769 - DNA, 21 bp, Homo sapiens
tctggcagtggtctttcaaat

SEQ ID NO: 7727770 - DNA, 22 bp, Homo sapiens
tctggcagtggatgagggcagc

SEQ ID NO: 7727771 - DNA, 22 bp, Homo sapiens
tctggcagtggatgagggcagc

SEQ ID NO: 7727772 - DNA, 22 bp, Homo sapiens
tctggcagtgatttctgtgatc

SEQ ID NO: 7727773 - DNA, 22 bp, Homo sapiens
tctggcagtgatttctgtgatc

SEQ ID NO: 7727774 - DNA, 22 bp, Homo sapiens
tctggcagtggatgagggcagc

SEQ ID NO: 7727775 - DNA, 22 bp, Homo sapiens
tctggccacccgaggcccctgc

SEQ ID NO: 7727776 - DNA, 22 bp, Homo sapiens
tctggccacccgaggcccctgc

SEQ ID NO: 7727777 - DNA, 22 bp, Homo sapiens
tctggccacccgaggcccctgc

SEQ ID NO: 7727778 - DNA, 22 bp, Homo sapiens
tctggccaatgttgtgatcaca

SEQ ID NO: 7727779 - DNA, 22 bp, Homo sapiens
tctggccaatgttgtgatcaca

SEQ ID NO: 7727780 - DNA, 22 bp, Homo sapiens
tctggccaatgttgtgatcaca

SEQ ID NO: 7727781 - DNA, 22 bp, Homo sapiens
tctggccaaccctcaagttgta

SEQ ID NO: 7727782 - DNA, 22 bp, Homo sapiens
tctggccaaccctcaagttgta

SEQ ID NO: 7727783 - DNA, 22 bp, Homo sapiens
tctggcatctgttttcatattt

SEQ ID NO: 7727784 - DNA, 22 bp, Homo sapiens
tctggcatctgttttcatattt

SEQ ID NO: 7727785 - DNA, 22 bp, Homo sapiens
tctggcatcactcgcaagagca

SEQ ID NO: 7727786 - DNA, 22 bp, Homo sapiens
tctggcatggatttgagtgtct

SEQ ID NO: 7727787 - DNA, 22 bp, Homo sapiens
tctggcatggatttgagtgtct

SEQ ID NO: 7727788 - DNA, 22 bp, Homo sapiens
tctggccaacaaaaactaagtc

SEQ ID NO: 7727789 - DNA, 22 bp, Homo sapiens
tctggcatagtgagagctttta

SEQ ID NO: 7727790 - DNA, 22 bp, Homo sapiens
tctggatgctctgagcccaagg

SEQ ID NO: 7727791 - DNA, 23 bp, Homo sapiens
tctggatgccaccacatactaac

SEQ ID NO: 7727792 - DNA, 22 bp, Homo sapiens
tctggatgacagaatggtcata

SEQ ID NO: 7727793 - DNA, 22 bp, Homo sapiens
tctggatgagattaatggtgtg

SEQ ID NO: 7727794 - DNA, 22 bp, Homo sapiens
tctggatgatatgtgaacttga

SEQ ID NO: 7727795 - DNA, 22 bp, Homo sapiens
tctggatgaagacccagaggct

SEQ ID NO: 7727796 - DNA, 22 bp, Homo sapiens
tctggatgacagaatggtcata

SEQ ID NO: 7727797 - DNA, 22 bp, Homo sapiens
tctggatgaagacccagaggct

SEQ ID NO: 7727798 - DNA, 22 bp, Homo sapiens
tctggatcgggttcctcaggtc

SEQ ID NO: 7727799 - DNA, 22 bp, Homo sapiens
tctggcaaaggcaaccacagtt

SEQ ID NO: 7727800 - DNA, 22 bp, Homo sapiens
tctggatttgtggaaaatctgc

SEQ ID NO: 7727801 - DNA, 22 bp, Homo sapiens
tctggattctgaggtgggtgca

SEQ ID NO: 7727802 - DNA, 22 bp, Homo sapiens
tctggatgttgcggagtacaga

SEQ ID NO: 7727803 - DNA, 22 bp, Homo sapiens
tctggatggtcagctcttcctg

SEQ ID NO: 7727804 - DNA, 17 bp, Homo sapiens
tctggatgtcatggaag

SEQ ID NO: 7727805 - DNA, 17 bp, Homo sapiens
tctggatgtcatggaag

SEQ ID NO: 7727806 - DNA, 22 bp, Homo sapiens
tctggagttttttctgtctgtg

SEQ ID NO: 7727807 - DNA, 22 bp, Homo sapiens
tctggatcctatgcactggact

SEQ ID NO: 7727808 - DNA, 22 bp, Homo sapiens
tctggatcgccggcgcctgggc

SEQ ID NO: 7727809 - DNA, 22 bp, Homo sapiens
tctggagttttttctgtctgtg

SEQ ID NO: 7727810 - DNA, 22 bp, Homo sapiens
tctggagttttttctgtctgtg

SEQ ID NO: 7727811 - DNA, 22 bp, Homo sapiens
tctggagttttttctgtctgtg

SEQ ID NO: 7727812 - DNA, 22 bp, Homo sapiens
tctggagtttgaggacaagctt

SEQ ID NO: 7727813 - DNA, 22 bp, Homo sapiens
tctggagtttgaggacaagctt

SEQ ID NO: 7727814 - DNA, 22 bp, Homo sapiens
tctggagtttgaggacaagctt

SEQ ID NO: 7727815 - DNA, 22 bp, Homo sapiens
tctggagttgaagttcttcccc

SEQ ID NO: 7727816 - DNA, 22 bp, Homo sapiens
tctggagttgagagtgtgcgag

SEQ ID NO: 7727817 - DNA, 22 bp, Homo sapiens
tctggagttgtgcagtggacct

SEQ ID NO: 7727818 - DNA, 22 bp, Homo sapiens
tctggagttgcatgttttggct

SEQ ID NO: 7727819 - DNA, 22 bp, Homo sapiens
tctggagtttgagcacttcaat

SEQ ID NO: 7727820 - DNA, 22 bp, Homo sapiens
tctggagtttgagcacttcaat

SEQ ID NO: 7727821 - DNA, 22 bp, Homo sapiens
tctggagtttgagcacttcaat

SEQ ID NO: 7727822 - DNA, 22 bp, Homo sapiens
tctggagtgtccagttctactc

SEQ ID NO: 7727823 - DNA, 22 bp, Homo sapiens
tctggagtgtccagttctactc

SEQ ID NO: 7727824 - DNA, 22 bp, Homo sapiens
tctggagtgtccagttctactc

SEQ ID NO: 7727825 - DNA, 22 bp, Homo sapiens
tctggagtgtgtgtattcagct

SEQ ID NO: 7727826 - DNA, 22 bp, Homo sapiens
tctggagtggcagtcatctgaa

SEQ ID NO: 7727827 - DNA, 22 bp, Homo sapiens
tctggagtgggactttgcatct

SEQ ID NO: 7727828 - DNA, 22 bp, Homo sapiens
tctggagtgggactttgcatct

SEQ ID NO: 7727829 - DNA, 22 bp, Homo sapiens
tctggagtgggactttgcatct

SEQ ID NO: 7727830 - DNA, 22 bp, Homo sapiens
tctggagtggaggtgccttggg

SEQ ID NO: 7727831 - DNA, 22 bp, Homo sapiens
tctggagtggcagtcatctgaa

SEQ ID NO: 7727832 - DNA, 22 bp, Homo sapiens
tctggagtgtttctaattactg

SEQ ID NO: 7727833 - DNA, 22 bp, Homo sapiens
tctggagtgtgtgtattcagct

SEQ ID NO: 7727834 - DNA, 22 bp, Homo sapiens
tctggagtgtttctaattactg

SEQ ID NO: 7727835 - DNA, 22 bp, Homo sapiens
tctggagtgtttctaattactg

SEQ ID NO: 7727836 - DNA, 22 bp, Homo sapiens
tctggagtgtttctaattactg

SEQ ID NO: 7727837 - DNA, 22 bp, Homo sapiens
tctggagttcctgcaggctgtg

SEQ ID NO: 7727838 - DNA, 22 bp, Homo sapiens
tctggagttcctgcaggctgtg

SEQ ID NO: 7727839 - DNA, 22 bp, Homo sapiens
tctggagttcctgcaggctgtg

SEQ ID NO: 7727840 - DNA, 22 bp, Homo sapiens
tctggagttactgctggctttg

SEQ ID NO: 7727841 - DNA, 22 bp, Homo sapiens
tctggagttactgctggctttg

SEQ ID NO: 7727842 - DNA, 22 bp, Homo sapiens
tctggagttagttataatggtt

SEQ ID NO: 7727843 - DNA, 22 bp, Homo sapiens
tctggagggggatgcctcatcc

SEQ ID NO: 7727844 - DNA, 22 bp, Homo sapiens
tctggagggggatgcctcatcc

SEQ ID NO: 7727845 - DNA, 22 bp, Homo sapiens
tctggagggggatgcctcatcc

SEQ ID NO: 7727846 - DNA, 22 bp, Homo sapiens
tctggaggggtttagagggaca

SEQ ID NO: 7727847 - DNA, 22 bp, Homo sapiens
tctggaggggtttagagggaca

SEQ ID NO: 7727848 - DNA, 22 bp, Homo sapiens
tctggaggggtttagagggaca

SEQ ID NO: 7727849 - DNA, 22 bp, Homo sapiens
tctggagggcccacatccacaa

SEQ ID NO: 7727850 - DNA, 23 bp, Homo sapiens
tctggaggggacactgcagatgc

SEQ ID NO: 7727851 - DNA, 23 bp, Homo sapiens
tctggaggggacactgcagatgc

SEQ ID NO: 7727852 - DNA, 23 bp, Homo sapiens
tctggaggggacactgcagatgc

SEQ ID NO: 7727853 - DNA, 22 bp, Homo sapiens
tctggagggcccacatccacaa

SEQ ID NO: 7727854 - DNA, 22 bp, Homo sapiens
tctggaggctctgagggtgagt

SEQ ID NO: 7727855 - DNA, 22 bp, Homo sapiens
tctggaggctctgagggtgagt

SEQ ID NO: 7727856 - DNA, 22 bp, Homo sapiens
tctggaggctctgagggtgagt

SEQ ID NO: 7727857 - DNA, 22 bp, Homo sapiens
tctggaggctctgagggtgagt

SEQ ID NO: 7727858 - DNA, 22 bp, Homo sapiens
tctggaggctctgagggtgagt

SEQ ID NO: 7727859 - DNA, 21 bp, Homo sapiens
tctggagccctaagctgagaa

SEQ ID NO: 7727860 - DNA, 22 bp, Homo sapiens
tctggagccacaaacctcagct

SEQ ID NO: 7727861 - DNA, 22 bp, Homo sapiens
tctggagcaacagagcaggaca

SEQ ID NO: 7727862 - DNA, 22 bp, Homo sapiens
tctggagcaacagagcaggaca

SEQ ID NO: 7727863 - DNA, 22 bp, Homo sapiens
tctggagcaacagagcaggaca

SEQ ID NO: 7727864 - DNA, 22 bp, Homo sapiens
tctggagcaacagagcaggaca

SEQ ID NO: 7727865 - DNA, 22 bp, Homo sapiens
tctggagcaacagagcaggaca

SEQ ID NO: 7727866 - DNA, 22 bp, Homo sapiens
tctggagatcatgtggggtgga

SEQ ID NO: 7727867 - DNA, 22 bp, Homo sapiens
tctggagataagcagcaatgaa

SEQ ID NO: 7727868 - DNA, 22 bp, Homo sapiens
tctggagatcatgtggggtgga

SEQ ID NO: 7727869 - DNA, 22 bp, Homo sapiens
tctggagatcatgtggggtgga

SEQ ID NO: 7727870 - DNA, 22 bp, Homo sapiens
tctggagatcatgtggggtgga

SEQ ID NO: 7727871 - DNA, 22 bp, Homo sapiens
tctggagtggagctgatcattt

SEQ ID NO: 7727872 - DNA, 22 bp, Homo sapiens
tctggagtggaggtgccttggg

SEQ ID NO: 7727873 - DNA, 22 bp, Homo sapiens
tctggagtggaggtgccttggg

SEQ ID NO: 7727874 - DNA, 22 bp, Homo sapiens
tctggagtggacccagagcact

SEQ ID NO: 7727875 - DNA, 22 bp, Homo sapiens
tctggagtggagctgatcattt

SEQ ID NO: 7727876 - DNA, 22 bp, Homo sapiens
tctggagtgaatgaagtagtgt

SEQ ID NO: 7727877 - DNA, 22 bp, Homo sapiens
tctggagtgccctgctctgccc

SEQ ID NO: 7727878 - DNA, 22 bp, Homo sapiens
tctggagtgccctgctctgccc

SEQ ID NO: 7727879 - DNA, 22 bp, Homo sapiens
tctggagtgccctgctctgccc

SEQ ID NO: 7727880 - DNA, 22 bp, Homo sapiens
tctggagtggacccagagcact

SEQ ID NO: 7727881 - DNA, 22 bp, Homo sapiens
tctggagtggacccagagcact

SEQ ID NO: 7727882 - DNA, 22 bp, Homo sapiens
tctggagtctaaagaaccaaaa

SEQ ID NO: 7727883 - DNA, 22 bp, Homo sapiens
tctggagtctgagatctgagga

SEQ ID NO: 7727884 - DNA, 22 bp, Homo sapiens
tctggagtctgagatctgagga

SEQ ID NO: 7727885 - DNA, 22 bp, Homo sapiens
tctggagtctggtggttatggt

SEQ ID NO: 7727886 - DNA, 22 bp, Homo sapiens
tctggagtccagatccatttgg

SEQ ID NO: 7727887 - DNA, 22 bp, Homo sapiens
tctggagtccagatccatttgg

SEQ ID NO: 7727888 - DNA, 22 bp, Homo sapiens
tctggagtccagatccatttgg

SEQ ID NO: 7727889 - DNA, 22 bp, Homo sapiens
tctggagtcctggaatcagcta

SEQ ID NO: 7727890 - DNA, 22 bp, Homo sapiens
tctggagtcctggaatcagcta

SEQ ID NO: 7727891 - DNA, 22 bp, Homo sapiens
tctggagtcctggaatcagcta

SEQ ID NO: 7727892 - DNA, 22 bp, Homo sapiens
tctggagtctaaagaaccaaaa

SEQ ID NO: 7727893 - DNA, 22 bp, Homo sapiens
tctggagtctaaagaaccaaaa

SEQ ID NO: 7727894 - DNA, 22 bp, Homo sapiens
tctggaggggtttagagggaca

SEQ ID NO: 7727895 - DNA, 22 bp, Homo sapiens
tctggagtaactctgtttctgg

SEQ ID NO: 7727896 - DNA, 22 bp, Homo sapiens
tctggagtaactctgtttctgg

SEQ ID NO: 7727897 - DNA, 22 bp, Homo sapiens
tctggagtaattacagtgactg

SEQ ID NO: 7727898 - DNA, 22 bp, Homo sapiens
tctggagtaggacctgaaaata

SEQ ID NO: 7727899 - DNA, 22 bp, Homo sapiens
tctggagtagggtctgggaatt

SEQ ID NO: 7727900 - DNA, 20 bp, Homo sapiens
tctggagtagagcacaggca

SEQ ID NO: 7727901 - DNA, 20 bp, Homo sapiens
tctggagtagagcacaggca

SEQ ID NO: 7727902 - DNA, 22 bp, Homo sapiens
tctggagtaggacctgaaaata

SEQ ID NO: 7727903 - DNA, 21 bp, Homo sapiens
tctggagtcatctttaccata

SEQ ID NO: 7727904 - DNA, 22 bp, Homo sapiens
tctggagtatgtgtgaacggtg

SEQ ID NO: 7727905 - DNA, 22 bp, Homo sapiens
tctggagtatgtgtgaacggtg

SEQ ID NO: 7727906 - DNA, 22 bp, Homo sapiens
tctggagtatgtgtgaacggtg

SEQ ID NO: 7727907 - DNA, 21 bp, Homo sapiens
tctggagtcatctttaccata

SEQ ID NO: 7727908 - DNA, 21 bp, Homo sapiens
tctggagtcatctttaccata

SEQ ID NO: 7727909 - DNA, 22 bp, Homo sapiens
tctggagtatgtccctggtgaa

SEQ ID NO: 7727910 - DNA, 22 bp, Homo sapiens
tctggagtatgtccctggtgaa

SEQ ID NO: 7727911 - DNA, 22 bp, Homo sapiens
tctggagtatgtccctggtgaa

SEQ ID NO: 7727912 - DNA, 21 bp, Homo sapiens
tctggccctcacagtcacacc

SEQ ID NO: 7727913 - DNA, 21 bp, Homo sapiens
tctggccctcacagtcacacc

SEQ ID NO: 7727914 - DNA, 21 bp, Homo sapiens
tctggccctcacagtcacacc

SEQ ID NO: 7727915 - DNA, 21 bp, Homo sapiens
tctggccctcacagtcacacc

SEQ ID NO: 7727916 - DNA, 21 bp, Homo sapiens
tctggccctcacagtcacacc

SEQ ID NO: 7727917 - DNA, 22 bp, Homo sapiens
tctggccctatggcatgtacct

SEQ ID NO: 7727918 - DNA, 22 bp, Homo sapiens
tctggccctgctgctgtgagca

SEQ ID NO: 7727919 - DNA, 22 bp, Homo sapiens
tctggccctgctgctgtgagca

SEQ ID NO: 7727920 - DNA, 22 bp, Homo sapiens
tctggccctgctgctgtgagca

SEQ ID NO: 7727921 - DNA, 21 bp, Homo sapiens
tctggccctcacagtcacacc

SEQ ID NO: 7727922 - DNA, 22 bp, Homo sapiens
tctggctccacacctcactgca

SEQ ID NO: 7727923 - DNA, 22 bp, Homo sapiens
tctggctccacacctcactgca

SEQ ID NO: 7727924 - DNA, 22 bp, Homo sapiens
tctggctccacacctcactgca

SEQ ID NO: 7727925 - DNA, 22 bp, Homo sapiens
tctggctccacacctcactgca

SEQ ID NO: 7727926 - DNA, 22 bp, Homo sapiens
tctggctccactttcttcattt

SEQ ID NO: 7727927 - DNA, 22 bp, Homo sapiens
tctggctccactttcttcattt

SEQ ID NO: 7727928 - DNA, 22 bp, Homo sapiens
tctggctccaggaccgggcaca

SEQ ID NO: 7727929 - DNA, 22 bp, Homo sapiens
tctggctccaggaccgggcaca

SEQ ID NO: 7727930 - DNA, 22 bp, Homo sapiens
tctggctccaggaccgggcaca

SEQ ID NO: 7727931 - DNA, 22 bp, Homo sapiens
tctggctccactctgtgcatgc

SEQ ID NO: 7727932 - DNA, 22 bp, Homo sapiens
tctggctccactctgtgcatgc

SEQ ID NO: 7727933 - DNA, 22 bp, Homo sapiens
tctggctccctggagctccaca

SEQ ID NO: 7727934 - DNA, 19 bp, Homo sapiens
tctggctccgcctcttagt

SEQ ID NO: 7727935 - DNA, 19 bp, Homo sapiens
tctggctccgcctcttagt

SEQ ID NO: 7727936 - DNA, 22 bp, Homo sapiens
tctggctccgtgtccgctccca

SEQ ID NO: 7727937 - DNA, 22 bp, Homo sapiens
tctggctccgtgtccgctccca

SEQ ID NO: 7727938 - DNA, 22 bp, Homo sapiens
tctggctcctgagtccatgctc

SEQ ID NO: 7727939 - DNA, 22 bp, Homo sapiens
tctggctcctgagtccatgctc

SEQ ID NO: 7727940 - DNA, 22 bp, Homo sapiens
tctggctcctgagtccatgctc

SEQ ID NO: 7727941 - DNA, 22 bp, Homo sapiens
tctggctcctgagtccatgctc

SEQ ID NO: 7727942 - DNA, 22 bp, Homo sapiens
tctggctcctgagtccatgctc

SEQ ID NO: 7727943 - DNA, 22 bp, Homo sapiens
tctggctcctgagtccatgctc

SEQ ID NO: 7727944 - DNA, 23 bp, Homo sapiens
tctggctccatccttggggatcc

SEQ ID NO: 7727945 - DNA, 22 bp, Homo sapiens
tctggctcccagcctgctctca

SEQ ID NO: 7727946 - DNA, 22 bp, Homo sapiens
tctggctcccagcctgctctca

SEQ ID NO: 7727947 - DNA, 22 bp, Homo sapiens
tctggctcccagcctgctctca

SEQ ID NO: 7727948 - DNA, 22 bp, Homo sapiens
tctggctcccagcctgctctca

SEQ ID NO: 7727949 - DNA, 22 bp, Homo sapiens
tctggctccctggagctccaca

SEQ ID NO: 7727950 - DNA, 22 bp, Homo sapiens
tctggctccctggagctccaca

SEQ ID NO: 7727951 - DNA, 22 bp, Homo sapiens
tctggctccctggagctccaca

SEQ ID NO: 7727952 - DNA, 20 bp, Homo sapiens
tctggccccttcctgtcctg

SEQ ID NO: 7727953 - DNA, 20 bp, Homo sapiens
tctggccccttcctgtcctg

SEQ ID NO: 7727954 - DNA, 20 bp, Homo sapiens
tctggccccttcctgtcctg

SEQ ID NO: 7727955 - DNA, 21 bp, Homo sapiens
tctggccctaggttgggcctc

SEQ ID NO: 7727956 - DNA, 21 bp, Homo sapiens
tctggccctaggttgggcctc

SEQ ID NO: 7727957 - DNA, 22 bp, Homo sapiens
tctggccctatggcatgtacct

SEQ ID NO: 7727958 - DNA, 22 bp, Homo sapiens
tctggccctatggcatgtacct

SEQ ID NO: 7727959 - DNA, 22 bp, Homo sapiens
tctggccctatggcatgtacct

SEQ ID NO: 7727960 - DNA, 22 bp, Homo sapiens
tctggccctatggcatgtacct

SEQ ID NO: 7727961 - DNA, 22 bp, Homo sapiens
tctggccctatggcatgtacct

SEQ ID NO: 7727962 - DNA, 22 bp, Homo sapiens
tctggccctatggcatgtacct

SEQ ID NO: 7727963 - DNA, 20 bp, Homo sapiens
tctggccccttcctgtcctg

SEQ ID NO: 7727964 - DNA, 20 bp, Homo sapiens
tctggccccttcctgtcctg

SEQ ID NO: 7727965 - DNA, 20 bp, Homo sapiens
tctggccccttcctgtcctg

SEQ ID NO: 7727966 - DNA, 22 bp, Homo sapiens
tctggcccctggtctctggtgt

SEQ ID NO: 7727967 - DNA, 22 bp, Homo sapiens
tctggcccctggtctctggtgt

SEQ ID NO: 7727968 - DNA, 22 bp, Homo sapiens
tctggcccctggtctctggtgt

SEQ ID NO: 7727969 - DNA, 22 bp, Homo sapiens
tctggcccctggcagtcctgga

SEQ ID NO: 7727970 - DNA, 22 bp, Homo sapiens
tctggcccctggcagtcctgga

SEQ ID NO: 7727971 - DNA, 22 bp, Homo sapiens
tctggcccctggcagtcctgga

SEQ ID NO: 7727972 - DNA, 22 bp, Homo sapiens
tctggcccctggcagtcctgga

SEQ ID NO: 7727973 - DNA, 22 bp, Homo sapiens
tctggccccgcatgcactttat

SEQ ID NO: 7727974 - DNA, 22 bp, Homo sapiens
tctggccccgcatgcactttat

SEQ ID NO: 7727975 - DNA, 22 bp, Homo sapiens
tctggccccgcatgcactttat

SEQ ID NO: 7727976 - DNA, 23 bp, Homo sapiens
tctggccccattctttcccatgt

SEQ ID NO: 7727977 - DNA, 23 bp, Homo sapiens
tctggccccattctttcccatgt

SEQ ID NO: 7727978 - DNA, 22 bp, Homo sapiens
tctggccccatacagagggtct

SEQ ID NO: 7727979 - DNA, 22 bp, Homo sapiens
tctggccccatacagagggtct

SEQ ID NO: 7727980 - DNA, 22 bp, Homo sapiens
tctggccccatacagagggtct

SEQ ID NO: 7727981 - DNA, 22 bp, Homo sapiens
tctggcccatgatcctgctaac

SEQ ID NO: 7727982 - DNA, 22 bp, Homo sapiens
tctggcccctggcagtcctgga

SEQ ID NO: 7727983 - DNA, 22 bp, Homo sapiens
tctggcccctggcagtcctgga

SEQ ID NO: 7727984 - DNA, 22 bp, Homo sapiens
tctggcccctatggcggtggag

SEQ ID NO: 7727985 - DNA, 22 bp, Homo sapiens
tctggcccctatggcggtggag

SEQ ID NO: 7727986 - DNA, 22 bp, Homo sapiens
tctggcccctatggcggtggag

SEQ ID NO: 7727987 - DNA, 22 bp, Homo sapiens
tctggcccctatggcggtggag

SEQ ID NO: 7727988 - DNA, 22 bp, Homo sapiens
tctggccccggtcttcacagct

SEQ ID NO: 7727989 - DNA, 22 bp, Homo sapiens
tctggccccggtcttcacagct

SEQ ID NO: 7727990 - DNA, 22 bp, Homo sapiens
tctggccccggtcttcacagct

SEQ ID NO: 7727991 - DNA, 22 bp, Homo sapiens
tctggccccggtcttcacagct

SEQ ID NO: 7727992 - DNA, 22 bp, Homo sapiens
tctggccccggtcttcacagct

SEQ ID NO: 7727993 - DNA, 22 bp, Homo sapiens
tctggctctcaacaaatattta

SEQ ID NO: 7727994 - DNA, 23 bp, Homo sapiens
tctggctctatgtgacagctctc

SEQ ID NO: 7727995 - DNA, 23 bp, Homo sapiens
tctggctctatgtgacagctctc

SEQ ID NO: 7727996 - DNA, 22 bp, Homo sapiens
tctggctctcaacaaatattta

SEQ ID NO: 7727997 - DNA, 22 bp, Homo sapiens
tctggctctcatactcgccagt

SEQ ID NO: 7727998 - DNA, 22 bp, Homo sapiens
tctggctctcatactcgccagt

SEQ ID NO: 7727999 - DNA, 22 bp, Homo sapiens
tctggctctcatactcgccagt

SEQ ID NO: 7728000 - DNA, 22 bp, Homo sapiens
tctggctctccagtgctcttag

SEQ ID NO: 7728001 - DNA, 22 bp, Homo sapiens
tctggctctccagtgctcttag

SEQ ID NO: 7728002 - DNA, 22 bp, Homo sapiens
tctggctctccagtgctcttag

SEQ ID NO: 7728003 - DNA, 22 bp, Homo sapiens
tctggctctccagtgctcttag

SEQ ID NO: 7728004 - DNA, 22 bp, Homo sapiens
tctggctctcatactcgccagt

SEQ ID NO: 7728005 - DNA, 22 bp, Homo sapiens
tctggctctcatactcgccagt

SEQ ID NO: 7728006 - DNA, 22 bp, Homo sapiens
tctggctctataactcctagct

SEQ ID NO: 7728007 - DNA, 22 bp, Homo sapiens
tctggctctataactcctagct

SEQ ID NO: 7728008 - DNA, 22 bp, Homo sapiens
tctggctctataactcctagct

SEQ ID NO: 7728009 - DNA, 22 bp, Homo sapiens
tctggctctataactcctagct

SEQ ID NO: 7728010 - DNA, 22 bp, Homo sapiens
tctggctctaactaggcatcag

SEQ ID NO: 7728011 - DNA, 23 bp, Homo sapiens
tctggctctatgtgacagctctc

SEQ ID NO: 7728012 - DNA, 23 bp, Homo sapiens
tctggctctatgtgacagctctc

SEQ ID NO: 7728013 - DNA, 23 bp, Homo sapiens
tctggctctatgtgacagctctc

SEQ ID NO: 7728014 - DNA, 19 bp, Homo sapiens
tctggctcctgccaggctg

SEQ ID NO: 7728015 - DNA, 19 bp, Homo sapiens
tctggctcctgccaggctg

SEQ ID NO: 7728016 - DNA, 19 bp, Homo sapiens
tctggctcctgccaggctg

SEQ ID NO: 7728017 - DNA, 22 bp, Homo sapiens
tctggctcctggctccactgcc

SEQ ID NO: 7728018 - DNA, 22 bp, Homo sapiens
tctggctcctggctccactgcc

SEQ ID NO: 7728019 - DNA, 22 bp, Homo sapiens
tctggctcctggctccactgcc

SEQ ID NO: 7728020 - DNA, 22 bp, Homo sapiens
tctggctcggatttgtctagca

SEQ ID NO: 7728021 - DNA, 22 bp, Homo sapiens
tctggctcggatttgtctagca

SEQ ID NO: 7728022 - DNA, 22 bp, Homo sapiens
tctggctcggatttgtctagca

SEQ ID NO: 7728023 - DNA, 22 bp, Homo sapiens
tctggctcggatttgtctagca

SEQ ID NO: 7728024 - DNA, 22 bp, Homo sapiens
tctggctctaactaggcatcag

SEQ ID NO: 7728025 - DNA, 22 bp, Homo sapiens
tctggctctaactaggcatcag

SEQ ID NO: 7728026 - DNA, 22 bp, Homo sapiens
tctggctctaactaggcatcag

SEQ ID NO: 7728027 - DNA, 22 bp, Homo sapiens
tctggctctaactaggcatcag

SEQ ID NO: 7728028 - DNA, 22 bp, Homo sapiens
tctggctcggatttgtctagca

SEQ ID NO: 7728029 - DNA, 22 bp, Homo sapiens
tctggctgaaattagaaggttc

SEQ ID NO: 7728030 - DNA, 22 bp, Homo sapiens
tctggctgaaattagaaggttc

SEQ ID NO: 7728031 - DNA, 22 bp, Homo sapiens
tctggctgaagcttttgcagct

SEQ ID NO: 7728032 - DNA, 22 bp, Homo sapiens
tctggctgaagcttttgcagct

SEQ ID NO: 7728033 - DNA, 22 bp, Homo sapiens
tctggctgaagcttttgcagct

SEQ ID NO: 7728034 - DNA, 22 bp, Homo sapiens
tctggctgaaattagaaggttc

SEQ ID NO: 7728035 - DNA, 22 bp, Homo sapiens
tctggctgaagcttttgcagct

SEQ ID NO: 7728036 - DNA, 22 bp, Homo sapiens
tctggctgaattagccttgggt

SEQ ID NO: 7728037 - DNA, 22 bp, Homo sapiens
tctggctgaattagccttgggt

SEQ ID NO: 7728038 - DNA, 22 bp, Homo sapiens
tctggctgaattagccttgggt

SEQ ID NO: 7728039 - DNA, 22 bp, Homo sapiens
tctggctgaattagccttgggt

SEQ ID NO: 7728040 - DNA, 22 bp, Homo sapiens
tctggctctttgggtgattgta

SEQ ID NO: 7728041 - DNA, 20 bp, Homo sapiens
tctggctctttgctcctccc

SEQ ID NO: 7728042 - DNA, 22 bp, Homo sapiens
tctggctgaaaggggctgtgcc

SEQ ID NO: 7728043 - DNA, 22 bp, Homo sapiens
tctggctgaaaggggctgtgcc

SEQ ID NO: 7728044 - DNA, 22 bp, Homo sapiens
tctggctgaaaggggctgtgcc

SEQ ID NO: 7728045 - DNA, 22 bp, Homo sapiens
tctggctgaaaggggctgtgcc

SEQ ID NO: 7728046 - DNA, 22 bp, Homo sapiens
tctggctgaaaggggctgtgcc

SEQ ID NO: 7728047 - DNA, 22 bp, Homo sapiens
tctggctgaaaggggctgtgcc

SEQ ID NO: 7728048 - DNA, 22 bp, Homo sapiens
tctggctgaaaggggctgtgcc

SEQ ID NO: 7728049 - DNA, 22 bp, Homo sapiens
tctggctctggagtccacctgc

SEQ ID NO: 7728050 - DNA, 22 bp, Homo sapiens
tctggctctggagtccacctgc

SEQ ID NO: 7728051 - DNA, 22 bp, Homo sapiens
tctggctctggagtccacctgc

SEQ ID NO: 7728052 - DNA, 22 bp, Homo sapiens
tctggctctgtgtccccaccca

SEQ ID NO: 7728053 - DNA, 20 bp, Homo sapiens
tctggctctttgctcctccc

SEQ ID NO: 7728054 - DNA, 20 bp, Homo sapiens
tctggctctttgctcctccc

SEQ ID NO: 7728055 - DNA, 20 bp, Homo sapiens
tctggctctttgctcctccc

SEQ ID NO: 7728056 - DNA, 20 bp, Homo sapiens
tctggctctttgctcctccc

SEQ ID NO: 7728057 - DNA, 22 bp, Homo sapiens
tctggctctgtgtcctcaccca

SEQ ID NO: 7728058 - DNA, 22 bp, Homo sapiens
tctggctctgtgtcctcaccca

SEQ ID NO: 7728059 - DNA, 22 bp, Homo sapiens
tctggctctgacactactgtta

SEQ ID NO: 7728060 - DNA, 22 bp, Homo sapiens
tctggctctgacactactgtta

SEQ ID NO: 7728061 - DNA, 22 bp, Homo sapiens
tctggctctgacactactgtta

SEQ ID NO: 7728062 - DNA, 22 bp, Homo sapiens
tctggctctctcatcacccaat

SEQ ID NO: 7728063 - DNA, 22 bp, Homo sapiens
tctggctctctcatcacccaat

SEQ ID NO: 7728064 - DNA, 22 bp, Homo sapiens
tctggctctctcatcacccaat

SEQ ID NO: 7728065 - DNA, 22 bp, Homo sapiens
tctggctgtcattggaggcccc

SEQ ID NO: 7728066 - DNA, 22 bp, Homo sapiens
tctggctgtcattggaggcccc

SEQ ID NO: 7728067 - DNA, 22 bp, Homo sapiens
tctggctgtcattggaggcccc

SEQ ID NO: 7728068 - DNA, 22 bp, Homo sapiens
tctggctgtgtaaggtagcacc

SEQ ID NO: 7728069 - DNA, 22 bp, Homo sapiens
tctggctgtcattggaggcccc

SEQ ID NO: 7728070 - DNA, 22 bp, Homo sapiens
tctggctgtgtaaggtagcacc

SEQ ID NO: 7728071 - DNA, 22 bp, Homo sapiens
tctggctgtgtaaggtagcacc

SEQ ID NO: 7728072 - DNA, 22 bp, Homo sapiens
tctggctgtgtaaggtagcacc

SEQ ID NO: 7728073 - DNA, 22 bp, Homo sapiens
tctggctgtgtaatatgtgtag

SEQ ID NO: 7728074 - DNA, 22 bp, Homo sapiens
tctggctgtgtaatatgtgtag

SEQ ID NO: 7728075 - DNA, 22 bp, Homo sapiens
tctggctgggtgagagcttctc

SEQ ID NO: 7728076 - DNA, 22 bp, Homo sapiens
tctggctgggtgagagcttctc

SEQ ID NO: 7728077 - DNA, 22 bp, Homo sapiens
tctggctgggtgagagcttctc

SEQ ID NO: 7728078 - DNA, 22 bp, Homo sapiens
tctggctgggtgagagcttctc

SEQ ID NO: 7728079 - DNA, 23 bp, Homo sapiens
tctggctgtaatatgaaagttag

SEQ ID NO: 7728080 - DNA, 22 bp, Homo sapiens
tctggctgggctgacattgaac

SEQ ID NO: 7728081 - DNA, 22 bp, Homo sapiens
tctggctgggctgacattgaac

SEQ ID NO: 7728082 - DNA, 22 bp, Homo sapiens
tctggctgggctgacattgaac

SEQ ID NO: 7728083 - DNA, 22 bp, Homo sapiens
tctggctggctcggccgggagt

SEQ ID NO: 7728084 - DNA, 22 bp, Homo sapiens
tctggctgggaagggggcccga

SEQ ID NO: 7728085 - DNA, 22 bp, Homo sapiens
tctggctgggaagggggcccga

SEQ ID NO: 7728086 - DNA, 22 bp, Homo sapiens
tctggctgggctgacattgaac

SEQ ID NO: 7728087 - DNA, 22 bp, Homo sapiens
tctggctgtgtaatatgtgtag

SEQ ID NO: 7728088 - DNA, 22 bp, Homo sapiens
tctggctgtgtatgagagtttt

SEQ ID NO: 7728089 - DNA, 22 bp, Homo sapiens
tctggctgttaggcctgacctt

SEQ ID NO: 7728090 - DNA, 22 bp, Homo sapiens
tctggctgttaggcctgacctt

SEQ ID NO: 7728091 - DNA, 22 bp, Homo sapiens
tctggctgtgtatgagagtttt

SEQ ID NO: 7728092 - DNA, 21 bp, Homo sapiens
tctggctttcattccccttct

SEQ ID NO: 7728093 - DNA, 21 bp, Homo sapiens
tctggctttcattccccttct

SEQ ID NO: 7728094 - DNA, 22 bp, Homo sapiens
tctggctttcatttgtttaaag

SEQ ID NO: 7728095 - DNA, 22 bp, Homo sapiens
tctggctttcatttgtttaaag

SEQ ID NO: 7728096 - DNA, 22 bp, Homo sapiens
tctggctgttaggcctgacctt

SEQ ID NO: 7728097 - DNA, 22 bp, Homo sapiens
tctggctgttaggcctgacctt

SEQ ID NO: 7728098 - DNA, 23 bp, Homo sapiens
tctggctttcacgggtattctta

SEQ ID NO: 7728099 - DNA, 22 bp, Homo sapiens
tctggctttcctggagcaagaa

SEQ ID NO: 7728100 - DNA, 22 bp, Homo sapiens
tctggctttcctggagcaagaa

SEQ ID NO: 7728101 - DNA, 22 bp, Homo sapiens
tctggctttcctggagcaagaa

SEQ ID NO: 7728102 - DNA, 22 bp, Homo sapiens
tctggctttcctggagcaagaa

SEQ ID NO: 7728103 - DNA, 22 bp, Homo sapiens
tctggctttctcagcatggcat

SEQ ID NO: 7728104 - DNA, 22 bp, Homo sapiens
tctggctttctcagcatggcat

SEQ ID NO: 7728105 - DNA, 22 bp, Homo sapiens
tctggctttctcagcatggcat

SEQ ID NO: 7728106 - DNA, 22 bp, Homo sapiens
tctggctttctcagcatggcat

SEQ ID NO: 7728107 - DNA, 22 bp, Homo sapiens
tctggctttctgactctacaac

SEQ ID NO: 7728108 - DNA, 22 bp, Homo sapiens
tctggctttctgactctacaac

SEQ ID NO: 7728109 - DNA, 23 bp, Homo sapiens
tctggctgctcctttcaatgctc

SEQ ID NO: 7728110 - DNA, 22 bp, Homo sapiens
tctggctgcgtggcctttagca

SEQ ID NO: 7728111 - DNA, 22 bp, Homo sapiens
tctggctgcgtggcctttagca

SEQ ID NO: 7728112 - DNA, 22 bp, Homo sapiens
tctggctgccaccatcctcccc

SEQ ID NO: 7728113 - DNA, 22 bp, Homo sapiens
tctggctgccaccatcctcccc

SEQ ID NO: 7728114 - DNA, 19 bp, Homo sapiens
tctggctgccaaggattga

SEQ ID NO: 7728115 - DNA, 22 bp, Homo sapiens
tctggctgccaccatcctcccc

SEQ ID NO: 7728116 - DNA, 22 bp, Homo sapiens
tctggctgccaccatcctcccc

SEQ ID NO: 7728117 - DNA, 22 bp, Homo sapiens
tctggctgcaccattatagtag

SEQ ID NO: 7728118 - DNA, 22 bp, Homo sapiens
tctggctgcaccattatagtag

SEQ ID NO: 7728119 - DNA, 19 bp, Homo sapiens
tctggctgccaaggattga

SEQ ID NO: 7728120 - DNA, 22 bp, Homo sapiens
tctggctgattccctgggactg

SEQ ID NO: 7728121 - DNA, 22 bp, Homo sapiens
tctggctgcaccattatagtag

SEQ ID NO: 7728122 - DNA, 22 bp, Homo sapiens
tctggctgattccctgggactg

SEQ ID NO: 7728123 - DNA, 22 bp, Homo sapiens
tctggctgattccctgggactg

SEQ ID NO: 7728124 - DNA, 22 bp, Homo sapiens
tctggctgattccctgggactg

SEQ ID NO: 7728125 - DNA, 22 bp, Homo sapiens
tctggctgattccctgggactg

SEQ ID NO: 7728126 - DNA, 22 bp, Homo sapiens
tctggctgattccctgggactg

SEQ ID NO: 7728127 - DNA, 22 bp, Homo sapiens
tctggctgacatcctgtatgag

SEQ ID NO: 7728128 - DNA, 22 bp, Homo sapiens
tctggctgacatcctgtatgag

SEQ ID NO: 7728129 - DNA, 22 bp, Homo sapiens
tctggctgacatcctgtatgag

SEQ ID NO: 7728130 - DNA, 22 bp, Homo sapiens
tctggctgacatcctgtatgag

SEQ ID NO: 7728131 - DNA, 22 bp, Homo sapiens
tctggctgaattagccttgggt

SEQ ID NO: 7728132 - DNA, 22 bp, Homo sapiens
tctggctgacatcctgtatgag

SEQ ID NO: 7728133 - DNA, 22 bp, Homo sapiens
tctggctggctcggccgggagt

SEQ ID NO: 7728134 - DNA, 22 bp, Homo sapiens
tctggctggctcggccgggagt

SEQ ID NO: 7728135 - DNA, 22 bp, Homo sapiens
tctggctgggaagggggcccga

SEQ ID NO: 7728136 - DNA, 22 bp, Homo sapiens
tctggctggctcggccgggagt

SEQ ID NO: 7728137 - DNA, 22 bp, Homo sapiens
tctggctggcagtgatggtgtg

SEQ ID NO: 7728138 - DNA, 22 bp, Homo sapiens
tctggctggcagtgatggtgtg

SEQ ID NO: 7728139 - DNA, 22 bp, Homo sapiens
tctggctggcagtgatggtgtg

SEQ ID NO: 7728140 - DNA, 22 bp, Homo sapiens
tctggctggcagtgatggtgtg

SEQ ID NO: 7728141 - DNA, 22 bp, Homo sapiens
tctggctgctgcgtgagtgctt

SEQ ID NO: 7728142 - DNA, 22 bp, Homo sapiens
tctggctgctgcgtgagtgctt

SEQ ID NO: 7728143 - DNA, 22 bp, Homo sapiens
tctggctgctgcgtgagtgctt

SEQ ID NO: 7728144 - DNA, 22 bp, Homo sapiens
tctggctgctgcgtgagtgctt

SEQ ID NO: 7728145 - DNA, 23 bp, Homo sapiens
tctggctgctcctttcaatgctc

SEQ ID NO: 7728146 - DNA, 23 bp, Homo sapiens
tctggctgctcctttcaatgctc

SEQ ID NO: 7728147 - DNA, 23 bp, Homo sapiens
tctggctgctcctttcaatgctc

SEQ ID NO: 7728148 - DNA, 23 bp, Homo sapiens
tctggctgctcctttcaatgctc

SEQ ID NO: 7728149 - DNA, 23 bp, Homo sapiens
tctggctgctcctttcaatgctc

SEQ ID NO: 7728150 - DNA, 23 bp, Homo sapiens
tctggctgctcctttcaatgctc

SEQ ID NO: 7728151 - DNA, 22 bp, Homo sapiens
tctggctgctgcgtgagtgctt

SEQ ID NO: 7728152 - DNA, 22 bp, Homo sapiens
tctggctgctgcgtgagtgctt

SEQ ID NO: 7728153 - DNA, 23 bp, Homo sapiens
tctggctgctcctttcaatgctc

SEQ ID NO: 7728154 - DNA, 22 bp, Homo sapiens
tctgggaactctgtcatttccc

SEQ ID NO: 7728155 - DNA, 22 bp, Homo sapiens
tctgggaactatatctggtggt

SEQ ID NO: 7728156 - DNA, 22 bp, Homo sapiens
tctgggaactatatctggtggt

SEQ ID NO: 7728157 - DNA, 22 bp, Homo sapiens
tctgggaactgagctcccctag

SEQ ID NO: 7728158 - DNA, 22 bp, Homo sapiens
tctgggaactgagctcccctag

SEQ ID NO: 7728159 - DNA, 22 bp, Homo sapiens
tctgggaacgaaggctaatatg

SEQ ID NO: 7728160 - DNA, 22 bp, Homo sapiens
tctgggaactatatctggtggt

SEQ ID NO: 7728161 - DNA, 22 bp, Homo sapiens
tctgggaactctgtcatttccc

SEQ ID NO: 7728162 - DNA, 22 bp, Homo sapiens
tctgggaactatatctggtggt

SEQ ID NO: 7728163 - DNA, 22 bp, Homo sapiens
tctgggaaccattggtggggat

SEQ ID NO: 7728164 - DNA, 22 bp, Homo sapiens
tctgggaacgaaggctaatatg

SEQ ID NO: 7728165 - DNA, 22 bp, Homo sapiens
tctgggaaccaaagggtgctta

SEQ ID NO: 7728166 - DNA, 22 bp, Homo sapiens
tctgggaacattttgagggcaa

SEQ ID NO: 7728167 - DNA, 22 bp, Homo sapiens
tctgggaacatggcttggaatc

SEQ ID NO: 7728168 - DNA, 22 bp, Homo sapiens
tctgggaacatggcttggaatc

SEQ ID NO: 7728169 - DNA, 22 bp, Homo sapiens
tctgggaaccagtgcggctggg

SEQ ID NO: 7728170 - DNA, 22 bp, Homo sapiens
tctgggaaccaaagggtgctta

SEQ ID NO: 7728171 - DNA, 22 bp, Homo sapiens
tctgggaaggagcctgagaatt

SEQ ID NO: 7728172 - DNA, 22 bp, Homo sapiens
tctgggaaggagcctgagaatt

SEQ ID NO: 7728173 - DNA, 22 bp, Homo sapiens
tctgggaagctggtcctgttct

SEQ ID NO: 7728174 - DNA, 22 bp, Homo sapiens
tctgggaagctgcgtgcctgtt

SEQ ID NO: 7728175 - DNA, 22 bp, Homo sapiens
tctgggaagctgcgtgcctgtt

SEQ ID NO: 7728176 - DNA, 22 bp, Homo sapiens
tctgggaaggctctgcagatat

SEQ ID NO: 7728177 - DNA, 22 bp, Homo sapiens
tctgggaaggctctgcagatat

SEQ ID NO: 7728178 - DNA, 22 bp, Homo sapiens
tctgggaaggctctgcagatat

SEQ ID NO: 7728179 - DNA, 22 bp, Homo sapiens
tctgggaaggagcctgagaatt

SEQ ID NO: 7728180 - DNA, 22 bp, Homo sapiens
tctgggaaggctctgcagatat

SEQ ID NO: 7728181 - DNA, 22 bp, Homo sapiens
tctgggaagcctgtatgcagaa

SEQ ID NO: 7728182 - DNA, 22 bp, Homo sapiens
tctgggaagcctgtatgcagaa

SEQ ID NO: 7728183 - DNA, 22 bp, Homo sapiens
tctgggaagcaaatatgtaaga

SEQ ID NO: 7728184 - DNA, 22 bp, Homo sapiens
tctgggaagcctgtatgcagaa

SEQ ID NO: 7728185 - DNA, 22 bp, Homo sapiens
tctgggaagatgtttcaaaggt

SEQ ID NO: 7728186 - DNA, 22 bp, Homo sapiens
tctgggaagacggatggaccct

SEQ ID NO: 7728187 - DNA, 22 bp, Homo sapiens
tctgggaagacggatggaccct

SEQ ID NO: 7728188 - DNA, 22 bp, Homo sapiens
tctgggaagcaaatatgtaaga

SEQ ID NO: 7728189 - DNA, 19 bp, Homo sapiens
tctgggaagccgggctcca

SEQ ID NO: 7728190 - DNA, 23 bp, Homo sapiens
tctggctttgctggaagttttga

SEQ ID NO: 7728191 - DNA, 22 bp, Homo sapiens
tctgggaaagtaaatgtaaagg

SEQ ID NO: 7728192 - DNA, 22 bp, Homo sapiens
tctgggaaacactgcatcccca

SEQ ID NO: 7728193 - DNA, 22 bp, Homo sapiens
tctgggaaacactgcatcccca

SEQ ID NO: 7728194 - DNA, 22 bp, Homo sapiens
tctgggaaagtaaatgtaaagg

SEQ ID NO: 7728195 - DNA, 22 bp, Homo sapiens
tctgggaaatgctgttccttgt

SEQ ID NO: 7728196 - DNA, 22 bp, Homo sapiens
tctgggaaatagaggaccctag

SEQ ID NO: 7728197 - DNA, 22 bp, Homo sapiens
tctgggaaatggctacttgtca

SEQ ID NO: 7728198 - DNA, 23 bp, Homo sapiens
tctggctttgctggaagttttga

SEQ ID NO: 7728199 - DNA, 23 bp, Homo sapiens
tctggctttgctggaagttttga

SEQ ID NO: 7728200 - DNA, 22 bp, Homo sapiens
tctggctttctgactctacaac

SEQ ID NO: 7728201 - DNA, 22 bp, Homo sapiens
tctggctttggatttgaagggt

SEQ ID NO: 7728202 - DNA, 22 bp, Homo sapiens
tctggctttggatttgaagggt

SEQ ID NO: 7728203 - DNA, 18 bp, Homo sapiens
tctggctttgttccttgt

SEQ ID NO: 7728204 - DNA, 22 bp, Homo sapiens
tctggcttttatgggatgagag

SEQ ID NO: 7728205 - DNA, 22 bp, Homo sapiens
tctggcttttattcagttggca

SEQ ID NO: 7728206 - DNA, 18 bp, Homo sapiens
tctggctttgttccttgt

SEQ ID NO: 7728207 - DNA, 22 bp, Homo sapiens
tctggcttttatgggatgagag

SEQ ID NO: 7728208 - DNA, 22 bp, Homo sapiens
tctgggaacagcctggctgtgt

SEQ ID NO: 7728209 - DNA, 22 bp, Homo sapiens
tctgggaacatggcttggaatc

SEQ ID NO: 7728210 - DNA, 22 bp, Homo sapiens
tctgggaacagcttagctccag

SEQ ID NO: 7728211 - DNA, 22 bp, Homo sapiens
tctgggaacacacgtcacttca

SEQ ID NO: 7728212 - DNA, 22 bp, Homo sapiens
tctgggaacactttgtgagctc

SEQ ID NO: 7728213 - DNA, 22 bp, Homo sapiens
tctgggaacagcctggctgtgt

SEQ ID NO: 7728214 - DNA, 22 bp, Homo sapiens
tctgggaacactttgtgagctc

SEQ ID NO: 7728215 - DNA, 22 bp, Homo sapiens
tctgggaacactttgtgagctc

SEQ ID NO: 7728216 - DNA, 22 bp, Homo sapiens
tctgggaacacacgtcacttca

SEQ ID NO: 7728217 - DNA, 22 bp, Homo sapiens
tctgggaacacacgtcacttca

SEQ ID NO: 7728218 - DNA, 22 bp, Homo sapiens
tctgggaacacacgtcacttca

SEQ ID NO: 7728219 - DNA, 21 bp, Homo sapiens
tctgggaaattgggaaagaag

SEQ ID NO: 7728220 - DNA, 21 bp, Homo sapiens
tctgggaaattgggaaagaag

SEQ ID NO: 7728221 - DNA, 21 bp, Homo sapiens
tctgggaaattgggaaagaag

SEQ ID NO: 7728222 - DNA, 22 bp, Homo sapiens
tctgggaaatgggcagcttcgc

SEQ ID NO: 7728223 - DNA, 22 bp, Homo sapiens
tctgggaaatggctacttgtca

SEQ ID NO: 7728224 - DNA, 22 bp, Homo sapiens
tctgggaaatggctacttgtca

SEQ ID NO: 7728225 - DNA, 22 bp, Homo sapiens
tctgggaaatgggcagcttcgc

SEQ ID NO: 7728226 - DNA, 22 bp, Homo sapiens
tctgggaaatggctacttgtca

SEQ ID NO: 7728227 - DNA, 23 bp, Homo sapiens
tctgggaccactcaacaagtcag

SEQ ID NO: 7728228 - DNA, 22 bp, Homo sapiens
tctgggagaagctgatgtgaag

SEQ ID NO: 7728229 - DNA, 22 bp, Homo sapiens
tctgggagacgtgtgttgtcag

SEQ ID NO: 7728230 - DNA, 22 bp, Homo sapiens
tctgggagaagctgatgtgaag

SEQ ID NO: 7728231 - DNA, 22 bp, Homo sapiens
tctgggagaagctgatgtgaag

SEQ ID NO: 7728232 - DNA, 22 bp, Homo sapiens
tctgggagaagctgatgtgaag

SEQ ID NO: 7728233 - DNA, 22 bp, Homo sapiens
tctgggagagcacgtggctgac

SEQ ID NO: 7728234 - DNA, 22 bp, Homo sapiens
tctgggagagcacgtggctgac

SEQ ID NO: 7728235 - DNA, 22 bp, Homo sapiens
tctgggagagcacgtggctgac

SEQ ID NO: 7728236 - DNA, 22 bp, Homo sapiens
tctgggagagcacgtggctgac

SEQ ID NO: 7728237 - DNA, 22 bp, Homo sapiens
tctgggagagcacgtggctgac

SEQ ID NO: 7728238 - DNA, 22 bp, Homo sapiens
tctgggagacgtgtgttgtcag

SEQ ID NO: 7728239 - DNA, 22 bp, Homo sapiens
tctgggagacgtgtgttgtcag

SEQ ID NO: 7728240 - DNA, 22 bp, Homo sapiens
tctgggagagagttgataaagg

SEQ ID NO: 7728241 - DNA, 22 bp, Homo sapiens
tctgggagagagttgataaagg

SEQ ID NO: 7728242 - DNA, 22 bp, Homo sapiens
tctgggagagagttgataaagg

SEQ ID NO: 7728243 - DNA, 22 bp, Homo sapiens
tctgggagagctgctgtcagag

SEQ ID NO: 7728244 - DNA, 22 bp, Homo sapiens
tctgggagagctgctgtcagag

SEQ ID NO: 7728245 - DNA, 22 bp, Homo sapiens
tctgggagagctgctgtcagag

SEQ ID NO: 7728246 - DNA, 22 bp, Homo sapiens
tctgggagagctgctgtcagag

SEQ ID NO: 7728247 - DNA, 22 bp, Homo sapiens
tctgggagagctgctgtcagag

SEQ ID NO: 7728248 - DNA, 22 bp, Homo sapiens
tctgggagagctgctgtcagag

SEQ ID NO: 7728249 - DNA, 22 bp, Homo sapiens
tctgggagagctgctgtcagag

SEQ ID NO: 7728250 - DNA, 22 bp, Homo sapiens
tctgggagagcacgtggctgac

SEQ ID NO: 7728251 - DNA, 22 bp, Homo sapiens
tctgggagagcacgtggctgac

SEQ ID NO: 7728252 - DNA, 22 bp, Homo sapiens
tctgggagagcacgtggctgac

SEQ ID NO: 7728253 - DNA, 22 bp, Homo sapiens
tctgggagagcacgtggctgac

SEQ ID NO: 7728254 - DNA, 22 bp, Homo sapiens
tctgggagagcacgtggctgac

SEQ ID NO: 7728255 - DNA, 22 bp, Homo sapiens
tctgggagagggaaagaagact

SEQ ID NO: 7728256 - DNA, 22 bp, Homo sapiens
tctgggagagggaaagaagact

SEQ ID NO: 7728257 - DNA, 22 bp, Homo sapiens
tctgggagagggaaagaagact

SEQ ID NO: 7728258 - DNA, 22 bp, Homo sapiens
tctgggagagctgctgtcagag

SEQ ID NO: 7728259 - DNA, 22 bp, Homo sapiens
tctgggagagctgctgtcagag

SEQ ID NO: 7728260 - DNA, 22 bp, Homo sapiens
tctgggagagggaaagaagact

SEQ ID NO: 7728261 - DNA, 22 bp, Homo sapiens
tctgggagagctgctgtcagag

SEQ ID NO: 7728262 - DNA, 22 bp, Homo sapiens
tctgggaagtcctctgtcatgc

SEQ ID NO: 7728263 - DNA, 22 bp, Homo sapiens
tctgggaaggctctgcagatat

SEQ ID NO: 7728264 - DNA, 22 bp, Homo sapiens
tctgggaagtcctctgtcatgc

SEQ ID NO: 7728265 - DNA, 22 bp, Homo sapiens
tctgggaagtcctctgtcatgc

SEQ ID NO: 7728266 - DNA, 22 bp, Homo sapiens
tctgggaagtgagatgctgtgt

SEQ ID NO: 7728267 - DNA, 22 bp, Homo sapiens
tctgggaagttggcagccagct

SEQ ID NO: 7728268 - DNA, 22 bp, Homo sapiens
tctgggaagtcctctgtcatgc

SEQ ID NO: 7728269 - DNA, 22 bp, Homo sapiens
tctgggaagtgagatgctgtgt

SEQ ID NO: 7728270 - DNA, 22 bp, Homo sapiens
tctgggaatgaataagacctgt

SEQ ID NO: 7728271 - DNA, 22 bp, Homo sapiens
tctgggaatacacactgattta

SEQ ID NO: 7728272 - DNA, 22 bp, Homo sapiens
tctgggaataaaactagggact

SEQ ID NO: 7728273 - DNA, 22 bp, Homo sapiens
tctgggaatacacactgattta

SEQ ID NO: 7728274 - DNA, 22 bp, Homo sapiens
tctgggaatacacactgattta

SEQ ID NO: 7728275 - DNA, 22 bp, Homo sapiens
tctgggaagtgagatgctgtgt

SEQ ID NO: 7728276 - DNA, 22 bp, Homo sapiens
tctgggaagttggcagccagct

SEQ ID NO: 7728277 - DNA, 22 bp, Homo sapiens
tctgggaataaaactagggact

SEQ ID NO: 7728278 - DNA, 22 bp, Homo sapiens
tctgggaataaaactagggact

SEQ ID NO: 7728279 - DNA, 23 bp, Homo sapiens
tctgggaattggctgtccacagg

SEQ ID NO: 7728280 - DNA, 19 bp, Homo sapiens
tctgggaatgatgccagca

SEQ ID NO: 7728281 - DNA, 19 bp, Homo sapiens
tctgggaatgatgccagca

SEQ ID NO: 7728282 - DNA, 19 bp, Homo sapiens
tctgggaatgatgccagca

SEQ ID NO: 7728283 - DNA, 22 bp, Homo sapiens
tctgggaatgaggcttgggcaa

SEQ ID NO: 7728284 - DNA, 22 bp, Homo sapiens
tctgggaatgaggcttgggcaa

SEQ ID NO: 7728285 - DNA, 22 bp, Homo sapiens
tctgggaatgaggcttgggcaa

SEQ ID NO: 7728286 - DNA, 22 bp, Homo sapiens
tctgggaatgaggcttgggcaa

SEQ ID NO: 7728287 - DNA, 22 bp, Homo sapiens
tctgggaatgaggcccagcgat

SEQ ID NO: 7728288 - DNA, 22 bp, Homo sapiens
tctgggaatttattggcacttt

SEQ ID NO: 7728289 - DNA, 23 bp, Homo sapiens
tctgggaattggctgtccacagg

SEQ ID NO: 7728290 - DNA, 23 bp, Homo sapiens
tctgggaattggctgtccacagg

SEQ ID NO: 7728291 - DNA, 21 bp, Homo sapiens
tctgggacagggcctgaggag

SEQ ID NO: 7728292 - DNA, 22 bp, Homo sapiens
tctgggacattctctccatagt

SEQ ID NO: 7728293 - DNA, 22 bp, Homo sapiens
tctgggacattctctccatagt

SEQ ID NO: 7728294 - DNA, 21 bp, Homo sapiens
tctgggacagggcctgaggag

SEQ ID NO: 7728295 - DNA, 22 bp, Homo sapiens
tctgggaatttattggcacttt

SEQ ID NO: 7728296 - DNA, 22 bp, Homo sapiens
tctgggaatttattggcacttt

SEQ ID NO: 7728297 - DNA, 22 bp, Homo sapiens
tctgggaggtgttttgagaact

SEQ ID NO: 7728298 - DNA, 22 bp, Homo sapiens
tctgggaggtgttttgagaact

SEQ ID NO: 7728299 - DNA, 22 bp, Homo sapiens
tctgggaggtgttttgagaact

SEQ ID NO: 7728300 - DNA, 22 bp, Homo sapiens
tctgggaggtgttttgagaact

SEQ ID NO: 7728301 - DNA, 22 bp, Homo sapiens
tctgggaggtggcagggtgcat

SEQ ID NO: 7728302 - DNA, 22 bp, Homo sapiens
tctgggaggtggcagggtgcat

SEQ ID NO: 7728303 - DNA, 22 bp, Homo sapiens
tctgggaggtggcagggtgcat

SEQ ID NO: 7728304 - DNA, 22 bp, Homo sapiens
tctgggaggtggcagggtgcat

SEQ ID NO: 7728305 - DNA, 22 bp, Homo sapiens
tctgggagtaaggcctaggcat

SEQ ID NO: 7728306 - DNA, 22 bp, Homo sapiens
tctgggaggtgttttgagaact

SEQ ID NO: 7728307 - DNA, 22 bp, Homo sapiens
tctgggagtaaggcctaggcat

SEQ ID NO: 7728308 - DNA, 22 bp, Homo sapiens
tctgggagtaaggcctaggcat

SEQ ID NO: 7728309 - DNA, 22 bp, Homo sapiens
tctgggagtaaggcctaggcat

SEQ ID NO: 7728310 - DNA, 22 bp, Homo sapiens
tctgggagtaaggcctaggcat

SEQ ID NO: 7728311 - DNA, 22 bp, Homo sapiens
tctgggagtgaagcaacagatg

SEQ ID NO: 7728312 - DNA, 22 bp, Homo sapiens
tctgggagtgaagcaacagatg

SEQ ID NO: 7728313 - DNA, 22 bp, Homo sapiens
tctgggagtaaggcctaggcat

SEQ ID NO: 7728314 - DNA, 22 bp, Homo sapiens
tctgggagtaaggcctaggcat

SEQ ID NO: 7728315 - DNA, 22 bp, Homo sapiens
tctgggagtgtgtctggccatc

SEQ ID NO: 7728316 - DNA, 22 bp, Homo sapiens
tctgggagttagaatacatggg

SEQ ID NO: 7728317 - DNA, 22 bp, Homo sapiens
tctgggagttagaatacatggg

SEQ ID NO: 7728318 - DNA, 22 bp, Homo sapiens
tctgggagttagaatacatggg

SEQ ID NO: 7728319 - DNA, 22 bp, Homo sapiens
tctgggagttagaatacatggg

SEQ ID NO: 7728320 - DNA, 22 bp, Homo sapiens
tctgggagttagaatacatggg

SEQ ID NO: 7728321 - DNA, 22 bp, Homo sapiens
tctgggagtttctgtgggagct

SEQ ID NO: 7728322 - DNA, 22 bp, Homo sapiens
tctgggagtttctgtgggagct

SEQ ID NO: 7728323 - DNA, 22 bp, Homo sapiens
tctgggagtttctgtgggagct

SEQ ID NO: 7728324 - DNA, 21 bp, Homo sapiens
tctgggagtgggaaaatggtc

SEQ ID NO: 7728325 - DNA, 22 bp, Homo sapiens
tctgggagtgggtccaaggaat

SEQ ID NO: 7728326 - DNA, 22 bp, Homo sapiens
tctgggagtgggtccaaggaat

SEQ ID NO: 7728327 - DNA, 22 bp, Homo sapiens
tctgggagtgggtccaaggaat

SEQ ID NO: 7728328 - DNA, 22 bp, Homo sapiens
tctgggagtgtgtctggccatc

SEQ ID NO: 7728329 - DNA, 22 bp, Homo sapiens
tctgggagtgtgtctggccatc

SEQ ID NO: 7728330 - DNA, 22 bp, Homo sapiens
tctgggagtgtgtctggccatc

SEQ ID NO: 7728331 - DNA, 22 bp, Homo sapiens
tctgggagtgtgtctggccatc

SEQ ID NO: 7728332 - DNA, 22 bp, Homo sapiens
tctgggaggtcacattggtctt

SEQ ID NO: 7728333 - DNA, 22 bp, Homo sapiens
tctgggaggtcacattggtctt

SEQ ID NO: 7728334 - DNA, 22 bp, Homo sapiens
tctgggaggtcacattggtctt

SEQ ID NO: 7728335 - DNA, 22 bp, Homo sapiens
tctgggaggtggcagggtgcat

SEQ ID NO: 7728336 - DNA, 22 bp, Homo sapiens
tctgggaggtcacattggtctt

SEQ ID NO: 7728337 - DNA, 22 bp, Homo sapiens
tctgggaggtcacattggtctt

SEQ ID NO: 7728338 - DNA, 22 bp, Homo sapiens
tctgggaggtactgggaggtgt

SEQ ID NO: 7728339 - DNA, 22 bp, Homo sapiens
tctgggaggtactgggaggtgt

SEQ ID NO: 7728340 - DNA, 22 bp, Homo sapiens
tctgggaggtactgggaggtgt

SEQ ID NO: 7728341 - DNA, 22 bp, Homo sapiens
tctgggaggtactgggaggtgt

SEQ ID NO: 7728342 - DNA, 22 bp, Homo sapiens
tctgggaggtactgggaggtgt

SEQ ID NO: 7728343 - DNA, 22 bp, Homo sapiens
tctgggaggtactgggaggtgt

SEQ ID NO: 7728344 - DNA, 22 bp, Homo sapiens
tctgggaggtaaccatgctgat

SEQ ID NO: 7728345 - DNA, 22 bp, Homo sapiens
tctgggaggtaaccatgctgat

SEQ ID NO: 7728346 - DNA, 22 bp, Homo sapiens
tctgggaggtaaccatgctgat

SEQ ID NO: 7728347 - DNA, 22 bp, Homo sapiens
tctgggaggtaaccatgctgat

SEQ ID NO: 7728348 - DNA, 22 bp, Homo sapiens
tctgggaggtaaccatgctgat

SEQ ID NO: 7728349 - DNA, 22 bp, Homo sapiens
tctgggaggtaaccatgctgat

SEQ ID NO: 7728350 - DNA, 22 bp, Homo sapiens
tctgggaggtaaccatgctgat

SEQ ID NO: 7728351 - DNA, 22 bp, Homo sapiens
tctgggagggctggttcagtat

SEQ ID NO: 7728352 - DNA, 22 bp, Homo sapiens
tctgggaggggctgccattgct

SEQ ID NO: 7728353 - DNA, 22 bp, Homo sapiens
tctgggaggggctgccattgct

SEQ ID NO: 7728354 - DNA, 22 bp, Homo sapiens
tctgggaggggctgccattgct

SEQ ID NO: 7728355 - DNA, 22 bp, Homo sapiens
tctgggaggggctgccattgct

SEQ ID NO: 7728356 - DNA, 22 bp, Homo sapiens
tctgggaggggctgccattgct

SEQ ID NO: 7728357 - DNA, 22 bp, Homo sapiens
tctgggaggggctgccattgct

SEQ ID NO: 7728358 - DNA, 22 bp, Homo sapiens
tctgggagagtagataaaggaa

SEQ ID NO: 7728359 - DNA, 22 bp, Homo sapiens
tctgggagagtcacaggcattg

SEQ ID NO: 7728360 - DNA, 22 bp, Homo sapiens
tctgggagagtcacaggcattg

SEQ ID NO: 7728361 - DNA, 22 bp, Homo sapiens
tctgggagagtcacaggcattg

SEQ ID NO: 7728362 - DNA, 22 bp, Homo sapiens
tctgggagagtcacaggcattg

SEQ ID NO: 7728363 - DNA, 22 bp, Homo sapiens
tctgggagggagcctcagaatc

SEQ ID NO: 7728364 - DNA, 22 bp, Homo sapiens
tctgggagagtcacaggcattg

SEQ ID NO: 7728365 - DNA, 22 bp, Homo sapiens
tctgggagagtcacaggcattg

SEQ ID NO: 7728366 - DNA, 22 bp, Homo sapiens
tctgggccagatctagggatct

SEQ ID NO: 7728367 - DNA, 22 bp, Homo sapiens
tctgggccagatctagggatct

SEQ ID NO: 7728368 - DNA, 22 bp, Homo sapiens
tctgggccagatctagggatct

SEQ ID NO: 7728369 - DNA, 22 bp, Homo sapiens
tctgggccagtgatttttccag

SEQ ID NO: 7728370 - DNA, 22 bp, Homo sapiens
tctgggccagtgatttttccag

SEQ ID NO: 7728371 - DNA, 22 bp, Homo sapiens
tctgggcccactcaacttcact

SEQ ID NO: 7728372 - DNA, 22 bp, Homo sapiens
tctgggcccactcaacttcact

SEQ ID NO: 7728373 - DNA, 22 bp, Homo sapiens
tctgggccaacccttccatggg

SEQ ID NO: 7728374 - DNA, 22 bp, Homo sapiens
tctgggccaacccttccatggg

SEQ ID NO: 7728375 - DNA, 23 bp, Homo sapiens
tctgggccacttgtctgcacttc

SEQ ID NO: 7728376 - DNA, 23 bp, Homo sapiens
tctgggccacttgtctgcacttc

SEQ ID NO: 7728377 - DNA, 23 bp, Homo sapiens
tctgggccacttgtctgcacttc

SEQ ID NO: 7728378 - DNA, 23 bp, Homo sapiens
tctgggccacttgtctgcacttc

SEQ ID NO: 7728379 - DNA, 23 bp, Homo sapiens
tctgggccacttgtctgcacttc

SEQ ID NO: 7728380 - DNA, 22 bp, Homo sapiens
tctgggccctaaaccagctcta

SEQ ID NO: 7728381 - DNA, 22 bp, Homo sapiens
tctgggccctaaaccagctcta

SEQ ID NO: 7728382 - DNA, 21 bp, Homo sapiens
tctgggcccatgctgcctcac

SEQ ID NO: 7728383 - DNA, 21 bp, Homo sapiens
tctgggcccatgctgcctcac

SEQ ID NO: 7728384 - DNA, 21 bp, Homo sapiens
tctgggcccatgctgcctcac

SEQ ID NO: 7728385 - DNA, 21 bp, Homo sapiens
tctgggcccatgctgcctcac

SEQ ID NO: 7728386 - DNA, 21 bp, Homo sapiens
tctgggcccatgctgcctcac

SEQ ID NO: 7728387 - DNA, 22 bp, Homo sapiens
tctgggccctaaaccagctcta

SEQ ID NO: 7728388 - DNA, 22 bp, Homo sapiens
tctgggctcttagtgtaccctc

SEQ ID NO: 7728389 - DNA, 22 bp, Homo sapiens
tctgggccctaaaccagctcta

SEQ ID NO: 7728390 - DNA, 22 bp, Homo sapiens
tctgggccctaaaccagctcta

SEQ ID NO: 7728391 - DNA, 22 bp, Homo sapiens
tctgggccctaaaccagctcta

SEQ ID NO: 7728392 - DNA, 22 bp, Homo sapiens
tctgggccctaaaccagctcta

SEQ ID NO: 7728393 - DNA, 22 bp, Homo sapiens
tctgggccctaaaccagctcta

SEQ ID NO: 7728394 - DNA, 21 bp, Homo sapiens
tctgggctgctgctgcccatc

SEQ ID NO: 7728395 - DNA, 21 bp, Homo sapiens
tctgggctgctgctgcccatc

SEQ ID NO: 7728396 - DNA, 21 bp, Homo sapiens
tctgggctgctgctgcccatc

SEQ ID NO: 7728397 - DNA, 21 bp, Homo sapiens
tctgggctgctgctgcccatc

SEQ ID NO: 7728398 - DNA, 22 bp, Homo sapiens
tctgggctgctatgaggcagag

SEQ ID NO: 7728399 - DNA, 22 bp, Homo sapiens
tctgggctgctatgaggcagag

SEQ ID NO: 7728400 - DNA, 22 bp, Homo sapiens
tctgggctgctatgaggcagag

SEQ ID NO: 7728401 - DNA, 22 bp, Homo sapiens
tctgggctgctatgaggcagag

SEQ ID NO: 7728402 - DNA, 22 bp, Homo sapiens
tctgggctgctatgaggcagag

SEQ ID NO: 7728403 - DNA, 22 bp, Homo sapiens
tctgggctgctgtgcagtgacc

SEQ ID NO: 7728404 - DNA, 22 bp, Homo sapiens
tctgggctgctgtgcagtgacc

SEQ ID NO: 7728405 - DNA, 22 bp, Homo sapiens
tctgggctgctgtgcagtgacc

SEQ ID NO: 7728406 - DNA, 22 bp, Homo sapiens
tctgggctgctgtgcagtgacc

SEQ ID NO: 7728407 - DNA, 22 bp, Homo sapiens
tctgggctgctgtgcagtgacc

SEQ ID NO: 7728408 - DNA, 23 bp, Homo sapiens
tctgggctgcttaaggatcaagg

SEQ ID NO: 7728409 - DNA, 23 bp, Homo sapiens
tctgggctgcttaaggatcaagg

SEQ ID NO: 7728410 - DNA, 23 bp, Homo sapiens
tctgggctgcttaaggatcaagg

SEQ ID NO: 7728411 - DNA, 23 bp, Homo sapiens
tctgggctgcttaaggatcaagg

SEQ ID NO: 7728412 - DNA, 22 bp, Homo sapiens
tctgggctgaaatgaaggcctt

SEQ ID NO: 7728413 - DNA, 22 bp, Homo sapiens
tctgggctgaaatgaaggcctt

SEQ ID NO: 7728414 - DNA, 22 bp, Homo sapiens
tctgggctgaaatgaaggcctt

SEQ ID NO: 7728415 - DNA, 22 bp, Homo sapiens
tctgggctgaaatgaaggcctt

SEQ ID NO: 7728416 - DNA, 22 bp, Homo sapiens
tctgggctgaaatgaaggcctt

SEQ ID NO: 7728417 - DNA, 23 bp, Homo sapiens
tctgggctgagacttggaaggtc

SEQ ID NO: 7728418 - DNA, 23 bp, Homo sapiens
tctgggctgagacttggaaggtc

SEQ ID NO: 7728419 - DNA, 23 bp, Homo sapiens
tctgggctgagacttggaaggtc

SEQ ID NO: 7728420 - DNA, 23 bp, Homo sapiens
tctgggctgagacttggaaggtc

SEQ ID NO: 7728421 - DNA, 23 bp, Homo sapiens
tctgggctgagacttggaaggtc

SEQ ID NO: 7728422 - DNA, 23 bp, Homo sapiens
tctgggctgagctcgagtgtaga

SEQ ID NO: 7728423 - DNA, 22 bp, Homo sapiens
tctgggctgctatgaggcagag

SEQ ID NO: 7728424 - DNA, 22 bp, Homo sapiens
tctgggctgctatgaggcagag

SEQ ID NO: 7728425 - DNA, 22 bp, Homo sapiens
tctgggctgctatgaggcagag

SEQ ID NO: 7728426 - DNA, 22 bp, Homo sapiens
tctgggctgctatgaggcagag

SEQ ID NO: 7728427 - DNA, 23 bp, Homo sapiens
tctgggctgagctcgagtgtaga

SEQ ID NO: 7728428 - DNA, 23 bp, Homo sapiens
tctgggctgagctcgagtgtaga

SEQ ID NO: 7728429 - DNA, 23 bp, Homo sapiens
tctgggctgagctcgagtgtaga

SEQ ID NO: 7728430 - DNA, 23 bp, Homo sapiens
tctgggctgagctcgagtgtaga

SEQ ID NO: 7728431 - DNA, 22 bp, Homo sapiens
tctgggcacacaccatgcccac

SEQ ID NO: 7728432 - DNA, 22 bp, Homo sapiens
tctgggcaatggatgcactcac

SEQ ID NO: 7728433 - DNA, 23 bp, Homo sapiens
tctgggcaccttgttgacatgat

SEQ ID NO: 7728434 - DNA, 23 bp, Homo sapiens
tctgggcaccttgttgacatgat

SEQ ID NO: 7728435 - DNA, 22 bp, Homo sapiens
tctgggcacacaccatgcccac

SEQ ID NO: 7728436 - DNA, 18 bp, Homo sapiens
tctgggcaatctcagtat

SEQ ID NO: 7728437 - DNA, 22 bp, Homo sapiens
tctgggcaatggatgcactcac

SEQ ID NO: 7728438 - DNA, 22 bp, Homo sapiens
tctgggcaatggatgcactcac

SEQ ID NO: 7728439 - DNA, 22 bp, Homo sapiens
tctgggcaatggatgcactcac

SEQ ID NO: 7728440 - DNA, 22 bp, Homo sapiens
tctgggcaatggatgcactcac

SEQ ID NO: 7728441 - DNA, 22 bp, Homo sapiens
tctgggcactgctgagcctgta

SEQ ID NO: 7728442 - DNA, 22 bp, Homo sapiens
tctgggcactgctgagcctgta

SEQ ID NO: 7728443 - DNA, 23 bp, Homo sapiens
tctgggcaccttgttgacatgat

SEQ ID NO: 7728444 - DNA, 22 bp, Homo sapiens
tctgggcacacaccatgcccac

SEQ ID NO: 7728445 - DNA, 22 bp, Homo sapiens
tctgggataagaccacagattt

SEQ ID NO: 7728446 - DNA, 22 bp, Homo sapiens
tctgggatagggccagaacatg

SEQ ID NO: 7728447 - DNA, 22 bp, Homo sapiens
tctgggatagggccagaacatg

SEQ ID NO: 7728448 - DNA, 22 bp, Homo sapiens
tctgggatgaagccagaaactt

SEQ ID NO: 7728449 - DNA, 22 bp, Homo sapiens
tctgggatgaagccagaaactt

SEQ ID NO: 7728450 - DNA, 22 bp, Homo sapiens
tctgggataagaccacagattt

SEQ ID NO: 7728451 - DNA, 22 bp, Homo sapiens
tctgggagtttctgtgggagct

SEQ ID NO: 7728452 - DNA, 22 bp, Homo sapiens
tctgggagtttctgtgggagct

SEQ ID NO: 7728453 - DNA, 22 bp, Homo sapiens
tctgggatgcaaacagaatctg

SEQ ID NO: 7728454 - DNA, 22 bp, Homo sapiens
tctgggatgcaaacagaatctg

SEQ ID NO: 7728455 - DNA, 22 bp, Homo sapiens
tctgggatgagatcagagacac

SEQ ID NO: 7728456 - DNA, 22 bp, Homo sapiens
tctgggatgagatcagagacac

SEQ ID NO: 7728457 - DNA, 22 bp, Homo sapiens
tctgggattttatagacatgct

SEQ ID NO: 7728458 - DNA, 22 bp, Homo sapiens
tctgggcagaagcagtgcaaag

SEQ ID NO: 7728459 - DNA, 22 bp, Homo sapiens
tctgggcagagggtcttagtca

SEQ ID NO: 7728460 - DNA, 22 bp, Homo sapiens
tctgggcagaagcagtgcaaag

SEQ ID NO: 7728461 - DNA, 22 bp, Homo sapiens
tctgggcagagggtcttagtca

SEQ ID NO: 7728462 - DNA, 22 bp, Homo sapiens
tctgggcagaagcagtgcaaag

SEQ ID NO: 7728463 - DNA, 22 bp, Homo sapiens
tctgggcagcagcagctagtag

SEQ ID NO: 7728464 - DNA, 22 bp, Homo sapiens
tctgggcagcagcagctagtag

SEQ ID NO: 7728465 - DNA, 22 bp, Homo sapiens
tctgggcagccgccccatagga

SEQ ID NO: 7728466 - DNA, 22 bp, Homo sapiens
tctgggcagccgccccatagga

SEQ ID NO: 7728467 - DNA, 22 bp, Homo sapiens
tctgggcagcagcagctagtag

SEQ ID NO: 7728468 - DNA, 22 bp, Homo sapiens
tctgggcagcctcaggccaggg

SEQ ID NO: 7728469 - DNA, 22 bp, Homo sapiens
tctgggcagcctcaggccaggg

SEQ ID NO: 7728470 - DNA, 22 bp, Homo sapiens
tctgggcagcctcaggccaggg

SEQ ID NO: 7728471 - DNA, 20 bp, Homo sapiens
tctgggcagggcacatggaa

SEQ ID NO: 7728472 - DNA, 20 bp, Homo sapiens
tctgggcagggcacatggaa

SEQ ID NO: 7728473 - DNA, 20 bp, Homo sapiens
tctgggcagggcacatggaa

SEQ ID NO: 7728474 - DNA, 20 bp, Homo sapiens
tctgggcagggcacatggaa

SEQ ID NO: 7728475 - DNA, 22 bp, Homo sapiens
tctgggcagttcggatcctctg

SEQ ID NO: 7728476 - DNA, 23 bp, Homo sapiens
tctgggcatatctagtcacatcg

SEQ ID NO: 7728477 - DNA, 22 bp, Homo sapiens
tctgggcagttcggatcctctg

SEQ ID NO: 7728478 - DNA, 22 bp, Homo sapiens
tctgggcagttcggatcctctg

SEQ ID NO: 7728479 - DNA, 22 bp, Homo sapiens
tctgggcagttcggatcctctg

SEQ ID NO: 7728480 - DNA, 22 bp, Homo sapiens
tctgggcagtacccctctccta

SEQ ID NO: 7728481 - DNA, 22 bp, Homo sapiens
tctgggcagtacccctctccta

SEQ ID NO: 7728482 - DNA, 19 bp, Homo sapiens
tctgggcagggccagcacc

SEQ ID NO: 7728483 - DNA, 22 bp, Homo sapiens
tctgcaaaagtgttcataaaga

SEQ ID NO: 7728484 - DNA, 20 bp, Homo sapiens
tctgcaaacaagttttagac

SEQ ID NO: 7728485 - DNA, 20 bp, Homo sapiens
tctgcaaacaagttttagac

SEQ ID NO: 7728486 - DNA, 22 bp, Homo sapiens
tctgcaaaagtgttcataaaga

SEQ ID NO: 7728487 - DNA, 22 bp, Homo sapiens
tctgcaaaagtgttcataaaga

SEQ ID NO: 7728488 - DNA, 22 bp, Homo sapiens
tctgatttatatatgcagatac

SEQ ID NO: 7728489 - DNA, 22 bp, Homo sapiens
tctgatttctcttgtggatgct

SEQ ID NO: 7728490 - DNA, 22 bp, Homo sapiens
tctgatttctcttgtggatgct

SEQ ID NO: 7728491 - DNA, 22 bp, Homo sapiens
tctgatttgtagctacatgtct

SEQ ID NO: 7728492 - DNA, 22 bp, Homo sapiens
tctgatttgtagctacatgtct

SEQ ID NO: 7728493 - DNA, 22 bp, Homo sapiens
tctgcaacagtgccctgtaaat

SEQ ID NO: 7728494 - DNA, 22 bp, Homo sapiens
tctgcaacagtgccctgtaaat

SEQ ID NO: 7728495 - DNA, 22 bp, Homo sapiens
tctgcaaatattagcttagaca

SEQ ID NO: 7728496 - DNA, 22 bp, Homo sapiens
tctgcaaacttaagttgaaata

SEQ ID NO: 7728497 - DNA, 22 bp, Homo sapiens
tctgcaaatattagcttagaca

SEQ ID NO: 7728498 - DNA, 22 bp, Homo sapiens
tctgcaaacccccatctatcat

SEQ ID NO: 7728499 - DNA, 22 bp, Homo sapiens
tctgcaacattcctctccccac

SEQ ID NO: 7728500 - DNA, 22 bp, Homo sapiens
tctgcaacattcctctccccac

SEQ ID NO: 7728501 - DNA, 22 bp, Homo sapiens
tctgcaacattcctctccccac

SEQ ID NO: 7728502 - DNA, 22 bp, Homo sapiens
tctgcaacattcctctccccac

SEQ ID NO: 7728503 - DNA, 22 bp, Homo sapiens
tctgcaagatcattaaagcaga

SEQ ID NO: 7728504 - DNA, 23 bp, Homo sapiens
tctgcaagataatgaagatgata

SEQ ID NO: 7728505 - DNA, 23 bp, Homo sapiens
tctgcaagataatgaagatgata

SEQ ID NO: 7728506 - DNA, 22 bp, Homo sapiens
tctgcaacgcactgcaaaacct

SEQ ID NO: 7728507 - DNA, 22 bp, Homo sapiens
tctgcaagagcttcaaggtaga

SEQ ID NO: 7728508 - DNA, 22 bp, Homo sapiens
tctgcaagcgtcacatgattct

SEQ ID NO: 7728509 - DNA, 22 bp, Homo sapiens
tctgcaagcgtcacatgattct

SEQ ID NO: 7728510 - DNA, 22 bp, Homo sapiens
tctgcaagctaaggaagcatct

SEQ ID NO: 7728511 - DNA, 22 bp, Homo sapiens
tctgcaagctaaggaagcatct

SEQ ID NO: 7728512 - DNA, 22 bp, Homo sapiens
tctgcaagctcagttctgactt

SEQ ID NO: 7728513 - DNA, 22 bp, Homo sapiens
tctgcaagctcagttctgactt

SEQ ID NO: 7728514 - DNA, 22 bp, Homo sapiens
tctgcaagatcattaaagcaga

SEQ ID NO: 7728515 - DNA, 22 bp, Homo sapiens
tctgcaagatggtcttagaggt

SEQ ID NO: 7728516 - DNA, 22 bp, Homo sapiens
tctgcaagatcattaaagcaga

SEQ ID NO: 7728517 - DNA, 22 bp, Homo sapiens
tctgcaagatggtcttagaggt

SEQ ID NO: 7728518 - DNA, 22 bp, Homo sapiens
tctgcaagcgtcacatgattct

SEQ ID NO: 7728519 - DNA, 22 bp, Homo sapiens
tctgattacttgagttatttag

SEQ ID NO: 7728520 - DNA, 22 bp, Homo sapiens
tctgatgttgtgacatcacttc

SEQ ID NO: 7728521 - DNA, 22 bp, Homo sapiens
tctgatgttgtgacatcacttc

SEQ ID NO: 7728522 - DNA, 22 bp, Homo sapiens
tctgattagagcattcttgagt

SEQ ID NO: 7728523 - DNA, 22 bp, Homo sapiens
tctgattagagcattcttgagt

SEQ ID NO: 7728524 - DNA, 22 bp, Homo sapiens
tctgattacttgagttatttag

SEQ ID NO: 7728525 - DNA, 22 bp, Homo sapiens
tctgattagcagtttagggaaa

SEQ ID NO: 7728526 - DNA, 22 bp, Homo sapiens
tctgattccagagcattgctca

SEQ ID NO: 7728527 - DNA, 22 bp, Homo sapiens
tctgattccagtgaccctagga

SEQ ID NO: 7728528 - DNA, 22 bp, Homo sapiens
tctgattgacctgtgaagcagc

SEQ ID NO: 7728529 - DNA, 22 bp, Homo sapiens
tctgattgacctgtgaagcagc

SEQ ID NO: 7728530 - DNA, 22 bp, Homo sapiens
tctgattgatgcagaccatatt

SEQ ID NO: 7728531 - DNA, 22 bp, Homo sapiens
tctgatttactggaaaaaagga

SEQ ID NO: 7728532 - DNA, 22 bp, Homo sapiens
tctgattgatgcagaccatatt

SEQ ID NO: 7728533 - DNA, 22 bp, Homo sapiens
tctgattagagcattcttgagt

SEQ ID NO: 7728534 - DNA, 22 bp, Homo sapiens
tctgattagctccatttgctaa

SEQ ID NO: 7728535 - DNA, 22 bp, Homo sapiens
tctgattcattcatgtgcacca

SEQ ID NO: 7728536 - DNA, 22 bp, Homo sapiens
tctgattagctccatttgctaa

SEQ ID NO: 7728537 - DNA, 22 bp, Homo sapiens
tctgattcattcatgtgcacca

SEQ ID NO: 7728538 - DNA, 21 bp, Homo sapiens
tctgatgttcacaccctgtat

SEQ ID NO: 7728539 - DNA, 22 bp, Homo sapiens
tctgatgttcctcagttctctt

SEQ ID NO: 7728540 - DNA, 23 bp, Homo sapiens
tctgatgttctcttatgctgtag

SEQ ID NO: 7728541 - DNA, 23 bp, Homo sapiens
tctgatgttctcttatgctgtag

SEQ ID NO: 7728542 - DNA, 23 bp, Homo sapiens
tctgatgttctcttatgctgtag

SEQ ID NO: 7728543 - DNA, 22 bp, Homo sapiens
tctgatgttgatgcttctgcct

SEQ ID NO: 7728544 - DNA, 22 bp, Homo sapiens
tctgatgttgcttctgcagaac

SEQ ID NO: 7728545 - DNA, 22 bp, Homo sapiens
tctgatgttgtgacatcacttc

SEQ ID NO: 7728546 - DNA, 22 bp, Homo sapiens
tctgatgtggagacactgtttt

SEQ ID NO: 7728547 - DNA, 22 bp, Homo sapiens
tctgatgtggcagctgcatcta

SEQ ID NO: 7728548 - DNA, 22 bp, Homo sapiens
tctgatgtctgaaatgctcttg

SEQ ID NO: 7728549 - DNA, 22 bp, Homo sapiens
tctgatgtctgaaatgctcttg

SEQ ID NO: 7728550 - DNA, 22 bp, Homo sapiens
tctgatgtctgaaatgctcttg

SEQ ID NO: 7728551 - DNA, 21 bp, Homo sapiens
tctgatgtgtttaatggtggg

SEQ ID NO: 7728552 - DNA, 22 bp, Homo sapiens
tctgatgtgtttaagaaagaag

SEQ ID NO: 7728553 - DNA, 21 bp, Homo sapiens
tctgatgtgtttaatggtggg

SEQ ID NO: 7728554 - DNA, 22 bp, Homo sapiens
tctgatgtgtttaagaaagaag

SEQ ID NO: 7728555 - DNA, 22 bp, Homo sapiens
tctgatgcaatgtaagtcttgg

SEQ ID NO: 7728556 - DNA, 21 bp, Homo sapiens
tctgatggtagatgagatgtg

SEQ ID NO: 7728557 - DNA, 21 bp, Homo sapiens
tctgatggtagatgagatgtg

SEQ ID NO: 7728558 - DNA, 21 bp, Homo sapiens
tctgatggtagatgagatgtg

SEQ ID NO: 7728559 - DNA, 21 bp, Homo sapiens
tctgatggtagatgagatgtg

SEQ ID NO: 7728560 - DNA, 21 bp, Homo sapiens
tctgatggtagatgagatgtg

SEQ ID NO: 7728561 - DNA, 22 bp, Homo sapiens
tctgatgtaagttcttccagag

SEQ ID NO: 7728562 - DNA, 21 bp, Homo sapiens
tctgatggtagatgagatgtg

SEQ ID NO: 7728563 - DNA, 22 bp, Homo sapiens
tctgatgtaagttcttccagag

SEQ ID NO: 7728564 - DNA, 22 bp, Homo sapiens
tctgatgtatcctaagaatcta

SEQ ID NO: 7728565 - DNA, 22 bp, Homo sapiens
tctgatgtatcctaagaatcta

SEQ ID NO: 7728566 - DNA, 23 bp, Homo sapiens
tctgatgtctctggaagctcatg

SEQ ID NO: 7728567 - DNA, 21 bp, Homo sapiens
tctgatggtagatgagatgtg

SEQ ID NO: 7728568 - DNA, 21 bp, Homo sapiens
tctgatggtagatgagatgtg

SEQ ID NO: 7728569 - DNA, 21 bp, Homo sapiens
tctgatggtagatgagatgtg

SEQ ID NO: 7728570 - DNA, 17 bp, Homo sapiens
tctgatgactagaggaa

SEQ ID NO: 7728571 - DNA, 22 bp, Homo sapiens
tctgatctgtgccttaggcctg

SEQ ID NO: 7728572 - DNA, 22 bp, Homo sapiens
tctgatctgtcagtcatgaagg

SEQ ID NO: 7728573 - DNA, 22 bp, Homo sapiens
tctgatcctttgtcttcttggg

SEQ ID NO: 7728574 - DNA, 22 bp, Homo sapiens
tctgatgataaagcatccttta

SEQ ID NO: 7728575 - DNA, 22 bp, Homo sapiens
tctgatgagggaaagtcttatg

SEQ ID NO: 7728576 - DNA, 22 bp, Homo sapiens
tctgatgcaatgtaagtcttgg

SEQ ID NO: 7728577 - DNA, 22 bp, Homo sapiens
tctgatcagaagtacttggttc

SEQ ID NO: 7728578 - DNA, 22 bp, Homo sapiens
tctgatccaatctgtgggctgt

SEQ ID NO: 7728579 - DNA, 22 bp, Homo sapiens
tctgaggttattgtctgccatt

SEQ ID NO: 7728580 - DNA, 22 bp, Homo sapiens
tctgatattggggtcagagtag

SEQ ID NO: 7728581 - DNA, 22 bp, Homo sapiens
tctgaggttccctcaactacct

SEQ ID NO: 7728582 - DNA, 22 bp, Homo sapiens
tctgaggttactgctttgtaga

SEQ ID NO: 7728583 - DNA, 22 bp, Homo sapiens
tctgaggttattgtctgccatt

SEQ ID NO: 7728584 - DNA, 22 bp, Homo sapiens
tctgaggttaatcctgctgcat

SEQ ID NO: 7728585 - DNA, 22 bp, Homo sapiens
tctgaggttactgctttgtaga

SEQ ID NO: 7728586 - DNA, 22 bp, Homo sapiens
tctgaggtgtcacaaggccagg

SEQ ID NO: 7728587 - DNA, 22 bp, Homo sapiens
tctgaggttaatcctgctgcat

SEQ ID NO: 7728588 - DNA, 22 bp, Homo sapiens
tctgaggtgtcacaaggccagg

SEQ ID NO: 7728589 - DNA, 23 bp, Homo sapiens
tctgaggtggctcttgctttgaa

SEQ ID NO: 7728590 - DNA, 23 bp, Homo sapiens
tctgaggtggctcttgctttgaa

SEQ ID NO: 7728591 - DNA, 22 bp, Homo sapiens
tctgaggtggacgatggagcct

SEQ ID NO: 7728592 - DNA, 22 bp, Homo sapiens
tctgaggtggacgatggagcct

SEQ ID NO: 7728593 - DNA, 22 bp, Homo sapiens
tctgaggtgtagctgggcttca

SEQ ID NO: 7728594 - DNA, 22 bp, Homo sapiens
tctgaggtggggctggagcatt

SEQ ID NO: 7728595 - DNA, 22 bp, Homo sapiens
tctgaggtggggctggagcatt

SEQ ID NO: 7728596 - DNA, 22 bp, Homo sapiens
tctgaggtggggctggagcatt

SEQ ID NO: 7728597 - DNA, 17 bp, Homo sapiens
tctgaggtgaggatgca

SEQ ID NO: 7728598 - DNA, 17 bp, Homo sapiens
tctgaggtgaggatgca

SEQ ID NO: 7728599 - DNA, 19 bp, Homo sapiens
tctgaggtggaactggggg

SEQ ID NO: 7728600 - DNA, 19 bp, Homo sapiens
tctgaggtggaactggggg

SEQ ID NO: 7728601 - DNA, 18 bp, Homo sapiens
tctgaggtggacgaggag

SEQ ID NO: 7728602 - DNA, 22 bp, Homo sapiens
tctgaggtggacgatggagcct

SEQ ID NO: 7728603 - DNA, 19 bp, Homo sapiens
tctgaggtggaactggggg

SEQ ID NO: 7728604 - DNA, 18 bp, Homo sapiens
tctgaggtggacgaggag

SEQ ID NO: 7728605 - DNA, 18 bp, Homo sapiens
tctgaggtggacgaggag

SEQ ID NO: 7728606 - DNA, 22 bp, Homo sapiens
tctgaggtcctgtgatttctct

SEQ ID NO: 7728607 - DNA, 22 bp, Homo sapiens
tctgaggtctatgactttgctt

SEQ ID NO: 7728608 - DNA, 22 bp, Homo sapiens
tctgaggtctcatgacttgcat

SEQ ID NO: 7728609 - DNA, 22 bp, Homo sapiens
tctgaggtctatgactttgctt

SEQ ID NO: 7728610 - DNA, 22 bp, Homo sapiens
tctgaggtctcatgacttgcat

SEQ ID NO: 7728611 - DNA, 22 bp, Homo sapiens
tctgaggtctcatgacttgcat

SEQ ID NO: 7728612 - DNA, 22 bp, Homo sapiens
tctgaggtcctactataagtgg

SEQ ID NO: 7728613 - DNA, 22 bp, Homo sapiens
tctgaggtcctgtgatttctct

SEQ ID NO: 7728614 - DNA, 22 bp, Homo sapiens
tctgaggtcctgtgatttctct

SEQ ID NO: 7728615 - DNA, 23 bp, Homo sapiens
tctgaggtccaccagtttgcaga

SEQ ID NO: 7728616 - DNA, 22 bp, Homo sapiens
tctgaggtcataaagcaacttt

SEQ ID NO: 7728617 - DNA, 22 bp, Homo sapiens
tctgaggtcattccaaggacat

SEQ ID NO: 7728618 - DNA, 22 bp, Homo sapiens
tctgaggtcattccaaggacat

SEQ ID NO: 7728619 - DNA, 22 bp, Homo sapiens
tctgaggtcattccaaggacat

SEQ ID NO: 7728620 - DNA, 23 bp, Homo sapiens
tctgaggtccaccagtttgcaga

SEQ ID NO: 7728621 - DNA, 22 bp, Homo sapiens
tctgaggtcagtgctgcagtta

SEQ ID NO: 7728622 - DNA, 22 bp, Homo sapiens
tctgaggtcataaagcaacttt

SEQ ID NO: 7728623 - DNA, 22 bp, Homo sapiens
tctgaggtcagtgctgcagtta

SEQ ID NO: 7728624 - DNA, 22 bp, Homo sapiens
tctgaggtcagtgctgcagtta

SEQ ID NO: 7728625 - DNA, 22 bp, Homo sapiens
tctgaggctatgttcaggctaa

SEQ ID NO: 7728626 - DNA, 22 bp, Homo sapiens
tctgaggctatgttcaggctaa

SEQ ID NO: 7728627 - DNA, 22 bp, Homo sapiens
tctgaggctaagagacagaggc

SEQ ID NO: 7728628 - DNA, 22 bp, Homo sapiens
tctgaggctaagagacagaggc

SEQ ID NO: 7728629 - DNA, 22 bp, Homo sapiens
tctgaggctaagagacagaggc

SEQ ID NO: 7728630 - DNA, 22 bp, Homo sapiens
tctgaggccttggcagctaagg

SEQ ID NO: 7728631 - DNA, 22 bp, Homo sapiens
tctgaggccttcagcatgaatc

SEQ ID NO: 7728632 - DNA, 22 bp, Homo sapiens
tctgaggccttggcagctaagg

SEQ ID NO: 7728633 - DNA, 22 bp, Homo sapiens
tctgaggccttgggacagaagt

SEQ ID NO: 7728634 - DNA, 22 bp, Homo sapiens
tctgaggccttgggacagaagt

SEQ ID NO: 7728635 - DNA, 17 bp, Homo sapiens
tctgaggcctctaggag

SEQ ID NO: 7728636 - DNA, 22 bp, Homo sapiens
tctgaggcctagagaggggctt

SEQ ID NO: 7728637 - DNA, 22 bp, Homo sapiens
tctgaggcctagagaggggctt

SEQ ID NO: 7728638 - DNA, 22 bp, Homo sapiens
tctgaggcctagagaggggctt

SEQ ID NO: 7728639 - DNA, 22 bp, Homo sapiens
tctgaggcctagagaggggctt

SEQ ID NO: 7728640 - DNA, 22 bp, Homo sapiens
tctgaggccctgcaggcagtgt

SEQ ID NO: 7728641 - DNA, 17 bp, Homo sapiens
tctgaggcctctaggag

SEQ ID NO: 7728642 - DNA, 17 bp, Homo sapiens
tctgaggcctctaggag

SEQ ID NO: 7728643 - DNA, 22 bp, Homo sapiens
tctgaggcctgaagcagcagag

SEQ ID NO: 7728644 - DNA, 22 bp, Homo sapiens
tctgaggccttcagcatgaatc

SEQ ID NO: 7728645 - DNA, 22 bp, Homo sapiens
tctgagcttttattatcaacct

SEQ ID NO: 7728646 - DNA, 22 bp, Homo sapiens
tctgagctttcttgtgctcaag

SEQ ID NO: 7728647 - DNA, 22 bp, Homo sapiens
tctgagctttcttgtgctcaag

SEQ ID NO: 7728648 - DNA, 22 bp, Homo sapiens
tctgagcttctgcctgctgcaa

SEQ ID NO: 7728649 - DNA, 22 bp, Homo sapiens
tctgagctttagctgggatttt

SEQ ID NO: 7728650 - DNA, 22 bp, Homo sapiens
tctgaggaaagagagtgggatg

SEQ ID NO: 7728651 - DNA, 22 bp, Homo sapiens
tctgaggaaagagagtgggatg

SEQ ID NO: 7728652 - DNA, 22 bp, Homo sapiens
tctgaggaagcagcaggaagtg

SEQ ID NO: 7728653 - DNA, 22 bp, Homo sapiens
tctgaggaagcagcaggaagtg

SEQ ID NO: 7728654 - DNA, 22 bp, Homo sapiens
tctgaggaaaagaggaggtagc

SEQ ID NO: 7728655 - DNA, 22 bp, Homo sapiens
tctgaggaaaagaggaggtagc

SEQ ID NO: 7728656 - DNA, 22 bp, Homo sapiens
tctgaggaaaagaggaggtagc

SEQ ID NO: 7728657 - DNA, 22 bp, Homo sapiens
tctgaggaaaagttcttgtcac

SEQ ID NO: 7728658 - DNA, 22 bp, Homo sapiens
tctgaggaaagagagtgggatg

SEQ ID NO: 7728659 - DNA, 22 bp, Homo sapiens
tctgaggaaaagttcttgtcac

SEQ ID NO: 7728660 - DNA, 22 bp, Homo sapiens
tctgaggaaaagttcttgtcac

SEQ ID NO: 7728661 - DNA, 22 bp, Homo sapiens
tctgaggaataagaaggaagtg

SEQ ID NO: 7728662 - DNA, 22 bp, Homo sapiens
tctgaggaactggcaaagatgg

SEQ ID NO: 7728663 - DNA, 22 bp, Homo sapiens
tctgaggaatcttgacacattt

SEQ ID NO: 7728664 - DNA, 22 bp, Homo sapiens
tctgaggaatcttgacacattt

SEQ ID NO: 7728665 - DNA, 22 bp, Homo sapiens
tctgaggaataagaaggaagtg

SEQ ID NO: 7728666 - DNA, 22 bp, Homo sapiens
tctgaggaatcttgacacattt

SEQ ID NO: 7728667 - DNA, 22 bp, Homo sapiens
tctgaggaaagagagtgggatg

SEQ ID NO: 7728668 - DNA, 22 bp, Homo sapiens
tctgaggaatcttgacacattt

SEQ ID NO: 7728669 - DNA, 22 bp, Homo sapiens
tctgaggaattctgcagtgaga

SEQ ID NO: 7728670 - DNA, 22 bp, Homo sapiens
tctgaggaattctgcagtgaga

SEQ ID NO: 7728671 - DNA, 18 bp, Homo sapiens
tctgaggaatggaagagc

SEQ ID NO: 7728672 - DNA, 18 bp, Homo sapiens
tctgaggaatggaagagc

SEQ ID NO: 7728673 - DNA, 18 bp, Homo sapiens
tctgaggaatggaagagc

SEQ ID NO: 7728674 - DNA, 18 bp, Homo sapiens
tctgaggaatggaagagc

SEQ ID NO: 7728675 - DNA, 22 bp, Homo sapiens
tctgaggacaaactgcatgctg

SEQ ID NO: 7728676 - DNA, 22 bp, Homo sapiens
tctgaggaattctgcagtgaga

SEQ ID NO: 7728677 - DNA, 22 bp, Homo sapiens
tctgaggacaaactgcatgctg

SEQ ID NO: 7728678 - DNA, 22 bp, Homo sapiens
tctgaggccctaccctgagcct

SEQ ID NO: 7728679 - DNA, 22 bp, Homo sapiens
tctgaggccctaccctgagcct

SEQ ID NO: 7728680 - DNA, 22 bp, Homo sapiens
tctgaggccctgcaggcagtgt

SEQ ID NO: 7728681 - DNA, 22 bp, Homo sapiens
tctgaggccctgcaggcagtgt

SEQ ID NO: 7728682 - DNA, 22 bp, Homo sapiens
tctgaggccctaccctgagcct

SEQ ID NO: 7728683 - DNA, 22 bp, Homo sapiens
tctgaggccctaccctgagcct

SEQ ID NO: 7728684 - DNA, 22 bp, Homo sapiens
tctgaggctgaatggactccgt

SEQ ID NO: 7728685 - DNA, 22 bp, Homo sapiens
tctgaggctgaatggactccgt

SEQ ID NO: 7728686 - DNA, 22 bp, Homo sapiens
tctgaggctatgttcaggctaa

SEQ ID NO: 7728687 - DNA, 22 bp, Homo sapiens
tctgaggctatgttcaggctaa

SEQ ID NO: 7728688 - DNA, 20 bp, Homo sapiens
tctgaggctgagcccagcgt

SEQ ID NO: 7728689 - DNA, 20 bp, Homo sapiens
tctgaggctgagcccagcgt

SEQ ID NO: 7728690 - DNA, 22 bp, Homo sapiens
tctgaggctgaatggactccgt

SEQ ID NO: 7728691 - DNA, 22 bp, Homo sapiens
tctgaggctgaatggactccgt

SEQ ID NO: 7728692 - DNA, 22 bp, Homo sapiens
tctgaggctgcatctatgtgac

SEQ ID NO: 7728693 - DNA, 22 bp, Homo sapiens
tctgaggctgcatctatgtgac

SEQ ID NO: 7728694 - DNA, 20 bp, Homo sapiens
tctgaggctgagctctactt

SEQ ID NO: 7728695 - DNA, 20 bp, Homo sapiens
tctgaggctgagcccagcgt

SEQ ID NO: 7728696 - DNA, 22 bp, Homo sapiens
tctgaggctgtctctgggctcc

SEQ ID NO: 7728697 - DNA, 22 bp, Homo sapiens
tctgaggctgcatctatgtgac

SEQ ID NO: 7728698 - DNA, 22 bp, Homo sapiens
tctgaggctgcatctatgtgac

SEQ ID NO: 7728699 - DNA, 22 bp, Homo sapiens
tctgaggcttcagactgtactg

SEQ ID NO: 7728700 - DNA, 22 bp, Homo sapiens
tctgaggctgtctctgggctcc

SEQ ID NO: 7728701 - DNA, 23 bp, Homo sapiens
tctgagggagtgggcagtggcac

SEQ ID NO: 7728702 - DNA, 23 bp, Homo sapiens
tctgagggagtgggcagtggcac

SEQ ID NO: 7728703 - DNA, 23 bp, Homo sapiens
tctgagggagtgggcagtggcac

SEQ ID NO: 7728704 - DNA, 23 bp, Homo sapiens
tctgagggagtgggcagtggcac

SEQ ID NO: 7728705 - DNA, 22 bp, Homo sapiens
tctgagggacaattttgatggt

SEQ ID NO: 7728706 - DNA, 19 bp, Homo sapiens
tctgagggagcacgaaggc

SEQ ID NO: 7728707 - DNA, 22 bp, Homo sapiens
tctgagggaatagctattgtag

SEQ ID NO: 7728708 - DNA, 22 bp, Homo sapiens
tctgagggaatagctattgtag

SEQ ID NO: 7728709 - DNA, 19 bp, Homo sapiens
tctgaggcttctccccttg

SEQ ID NO: 7728710 - DNA, 22 bp, Homo sapiens
tctgaggctgtctctgggctcc

SEQ ID NO: 7728711 - DNA, 19 bp, Homo sapiens
tctgaggcttctccccttg

SEQ ID NO: 7728712 - DNA, 22 bp, Homo sapiens
tctgagggttgtagagagggac

SEQ ID NO: 7728713 - DNA, 22 bp, Homo sapiens
tctgagggttgtagagagggac

SEQ ID NO: 7728714 - DNA, 22 bp, Homo sapiens
tctgaggtaccagctggtttat

SEQ ID NO: 7728715 - DNA, 22 bp, Homo sapiens
tctgagggttgtagagagggac

SEQ ID NO: 7728716 - DNA, 22 bp, Homo sapiens
tctgaggtcacagatttcaaga

SEQ ID NO: 7728717 - DNA, 20 bp, Homo sapiens
tctgaggtatgatagggtct

SEQ ID NO: 7728718 - DNA, 20 bp, Homo sapiens
tctgaggtatgatagggtct

SEQ ID NO: 7728719 - DNA, 20 bp, Homo sapiens
tctgaggtatgatagggtct

SEQ ID NO: 7728720 - DNA, 22 bp, Homo sapiens
tctgaggtcacagatttcaaga

SEQ ID NO: 7728721 - DNA, 22 bp, Homo sapiens
tctgaggtcacagatttcaaga

SEQ ID NO: 7728722 - DNA, 22 bp, Homo sapiens
tctgagggtgggagaaggagct

SEQ ID NO: 7728723 - DNA, 22 bp, Homo sapiens
tctgagggttactttattaggc

SEQ ID NO: 7728724 - DNA, 22 bp, Homo sapiens
tctgagggtgggagaaggagct

SEQ ID NO: 7728725 - DNA, 22 bp, Homo sapiens
tctgagggtgggagaaggagct

SEQ ID NO: 7728726 - DNA, 22 bp, Homo sapiens
tctgagggtgaggcccagaatc

SEQ ID NO: 7728727 - DNA, 22 bp, Homo sapiens
tctgagggtgggagaaggagct

SEQ ID NO: 7728728 - DNA, 22 bp, Homo sapiens
tctgagggttgtagagagggac

SEQ ID NO: 7728729 - DNA, 22 bp, Homo sapiens
tctgagggttgtagagagggac

SEQ ID NO: 7728730 - DNA, 22 bp, Homo sapiens
tctgagggttgtagagagggac

SEQ ID NO: 7728731 - DNA, 22 bp, Homo sapiens
tctgagggttgtagagagggac

SEQ ID NO: 7728732 - DNA, 22 bp, Homo sapiens
tctgagggttgtagagagggac

SEQ ID NO: 7728733 - DNA, 22 bp, Homo sapiens
tctgagggttggctggctgtag

SEQ ID NO: 7728734 - DNA, 22 bp, Homo sapiens
tctgagggttcttggtagttgg

SEQ ID NO: 7728735 - DNA, 22 bp, Homo sapiens
tctgagggttcttggtagttgg

SEQ ID NO: 7728736 - DNA, 22 bp, Homo sapiens
tctgagggttggctggctgtag

SEQ ID NO: 7728737 - DNA, 22 bp, Homo sapiens
tctgagggcttgaggggaagta

SEQ ID NO: 7728738 - DNA, 22 bp, Homo sapiens
tctgagggcttgaggggaagta

SEQ ID NO: 7728739 - DNA, 22 bp, Homo sapiens
tctgagggcttgaggggaagta

SEQ ID NO: 7728740 - DNA, 22 bp, Homo sapiens
tctgagggcttgaggggaagta

SEQ ID NO: 7728741 - DNA, 22 bp, Homo sapiens
tctgaggggccagggatctggg

SEQ ID NO: 7728742 - DNA, 22 bp, Homo sapiens
tctgaggggccagggatctggg

SEQ ID NO: 7728743 - DNA, 22 bp, Homo sapiens
tctgagggctgtactatgcacg

SEQ ID NO: 7728744 - DNA, 22 bp, Homo sapiens
tctgagggcttgaggggaagta

SEQ ID NO: 7728745 - DNA, 22 bp, Homo sapiens
tctgaggggccagggatctggg

SEQ ID NO: 7728746 - DNA, 22 bp, Homo sapiens
tctgagggctgtactatgcacg

SEQ ID NO: 7728747 - DNA, 22 bp, Homo sapiens
tctgagggatttgtcccttatc

SEQ ID NO: 7728748 - DNA, 22 bp, Homo sapiens
tctgagggatttgtcccttatc

SEQ ID NO: 7728749 - DNA, 23 bp, Homo sapiens
tctgagggagtgggcagtggcac

SEQ ID NO: 7728750 - DNA, 23 bp, Homo sapiens
tctgagggagtgggcagtggcac

SEQ ID NO: 7728751 - DNA, 23 bp, Homo sapiens
tctgagggagtgggcagtggcac

SEQ ID NO: 7728752 - DNA, 22 bp, Homo sapiens
tctgagggtaaggttaaggtag

SEQ ID NO: 7728753 - DNA, 19 bp, Homo sapiens
tctgagggtccagatgcat

SEQ ID NO: 7728754 - DNA, 19 bp, Homo sapiens
tctgagggtccagatgcat

SEQ ID NO: 7728755 - DNA, 19 bp, Homo sapiens
tctgagggtccagatgcat

SEQ ID NO: 7728756 - DNA, 22 bp, Homo sapiens
tctgagggggtgtttataagct

SEQ ID NO: 7728757 - DNA, 22 bp, Homo sapiens
tctgaggggctggaagggctgc

SEQ ID NO: 7728758 - DNA, 22 bp, Homo sapiens
tctgaggggctggaagggctgc

SEQ ID NO: 7728759 - DNA, 18 bp, Homo sapiens
tctgagggtgcgggagct

SEQ ID NO: 7728760 - DNA, 18 bp, Homo sapiens
tctgagggtgcgggagct

SEQ ID NO: 7728761 - DNA, 22 bp, Homo sapiens
tctgagggtgaggcccagaatc

SEQ ID NO: 7728762 - DNA, 19 bp, Homo sapiens
tctgagggtccagatgcat

SEQ ID NO: 7728763 - DNA, 22 bp, Homo sapiens
tctgacattttgagaatgacat

SEQ ID NO: 7728764 - DNA, 22 bp, Homo sapiens
tctgacattttgagaatgacat

SEQ ID NO: 7728765 - DNA, 22 bp, Homo sapiens
tctgacattagattaattggaa

SEQ ID NO: 7728766 - DNA, 22 bp, Homo sapiens
tctgacattttgagaatgacat

SEQ ID NO: 7728767 - DNA, 22 bp, Homo sapiens
tctgacattttgagaatgacat

SEQ ID NO: 7728768 - DNA, 22 bp, Homo sapiens
tctgacattttgagaatgacat

SEQ ID NO: 7728769 - DNA, 22 bp, Homo sapiens
tctgaccacagacaacctgcta

SEQ ID NO: 7728770 - DNA, 22 bp, Homo sapiens
tctgacattttgagaatgacat

SEQ ID NO: 7728771 - DNA, 22 bp, Homo sapiens
tctgacattttgagaatgacat

SEQ ID NO: 7728772 - DNA, 22 bp, Homo sapiens
tctgaccacagacaacctgcta

SEQ ID NO: 7728773 - DNA, 22 bp, Homo sapiens
tctgacccacaagcatcctgga

SEQ ID NO: 7728774 - DNA, 22 bp, Homo sapiens
tctgacccacaagcatcctgga

SEQ ID NO: 7728775 - DNA, 22 bp, Homo sapiens
tctgacccagatggcaccgtgg

SEQ ID NO: 7728776 - DNA, 20 bp, Homo sapiens
tctgacccagagcccaggct

SEQ ID NO: 7728777 - DNA, 20 bp, Homo sapiens
tctgacccagagcccaggct

SEQ ID NO: 7728778 - DNA, 22 bp, Homo sapiens
tctgacccgtggctctgcctcc

SEQ ID NO: 7728779 - DNA, 22 bp, Homo sapiens
tctgaccaggctggctcagggc

SEQ ID NO: 7728780 - DNA, 23 bp, Homo sapiens
tctgaccatttgacaacatcctg

SEQ ID NO: 7728781 - DNA, 23 bp, Homo sapiens
tctgacctcgtttgctgtgttct

SEQ ID NO: 7728782 - DNA, 22 bp, Homo sapiens
tctgactcccatattccacttc

SEQ ID NO: 7728783 - DNA, 22 bp, Homo sapiens
tctgaccctcagatcatgtcca

SEQ ID NO: 7728784 - DNA, 22 bp, Homo sapiens
tctgacttcctccacatctgtt

SEQ ID NO: 7728785 - DNA, 22 bp, Homo sapiens
tctgacttcctccacatctgtt

SEQ ID NO: 7728786 - DNA, 22 bp, Homo sapiens
tctgacttcctccacatctgtt

SEQ ID NO: 7728787 - DNA, 22 bp, Homo sapiens
tctgacttatttgtccttggtg

SEQ ID NO: 7728788 - DNA, 22 bp, Homo sapiens
tctgacttatttgtccttggtg

SEQ ID NO: 7728789 - DNA, 22 bp, Homo sapiens
tctgacttatttgtccttggtg

SEQ ID NO: 7728790 - DNA, 22 bp, Homo sapiens
tctgacttatttgtccttggtg

SEQ ID NO: 7728791 - DNA, 22 bp, Homo sapiens
tctgacttcctccacatctgtt

SEQ ID NO: 7728792 - DNA, 22 bp, Homo sapiens
tctgacttccttttctgatcca

SEQ ID NO: 7728793 - DNA, 22 bp, Homo sapiens
tctgacttcttcatccttgcca

SEQ ID NO: 7728794 - DNA, 22 bp, Homo sapiens
tctgacttcttcatccttgcca

SEQ ID NO: 7728795 - DNA, 21 bp, Homo sapiens
tctgacttgatctattctccc

SEQ ID NO: 7728796 - DNA, 22 bp, Homo sapiens
tctgacttcttcatccttgcca

SEQ ID NO: 7728797 - DNA, 21 bp, Homo sapiens
tctgacttgatctattctccc

SEQ ID NO: 7728798 - DNA, 22 bp, Homo sapiens
tctgacttggcgctcttgtctt

SEQ ID NO: 7728799 - DNA, 22 bp, Homo sapiens
tctgacttgcatcttaaaggag

SEQ ID NO: 7728800 - DNA, 22 bp, Homo sapiens
tctgacttgcatcttaaaggag

SEQ ID NO: 7728801 - DNA, 22 bp, Homo sapiens
tctgacttggcgctcttgtctt

SEQ ID NO: 7728802 - DNA, 22 bp, Homo sapiens
tctgacttggcgctcttgtctt

SEQ ID NO: 7728803 - DNA, 22 bp, Homo sapiens
tctgacttggcgctcttgtctt

SEQ ID NO: 7728804 - DNA, 22 bp, Homo sapiens
tctgacttggtgctaccagcca

SEQ ID NO: 7728805 - DNA, 22 bp, Homo sapiens
tctgacaatgaacaatctatag

SEQ ID NO: 7728806 - DNA, 22 bp, Homo sapiens
tctgacaatgaacaatctatag

SEQ ID NO: 7728807 - DNA, 22 bp, Homo sapiens
tctgacaatgaacaatctatag

SEQ ID NO: 7728808 - DNA, 21 bp, Homo sapiens
tctgacaatctcatttcaaac

SEQ ID NO: 7728809 - DNA, 21 bp, Homo sapiens
tctgacaatctcatttcaaac

SEQ ID NO: 7728810 - DNA, 22 bp, Homo sapiens
tctgaattttgatgtgcattga

SEQ ID NO: 7728811 - DNA, 22 bp, Homo sapiens
tctgaattttaactacacaaag

SEQ ID NO: 7728812 - DNA, 22 bp, Homo sapiens
tctgaattttgaaatcatggag

SEQ ID NO: 7728813 - DNA, 22 bp, Homo sapiens
tctgacaagtcaagtcttgact

SEQ ID NO: 7728814 - DNA, 22 bp, Homo sapiens
tctgacaagtcaagtcttgact

SEQ ID NO: 7728815 - DNA, 22 bp, Homo sapiens
tctgacaggattttttcaggca

SEQ ID NO: 7728816 - DNA, 22 bp, Homo sapiens
tctgacaggattttttcaggca

SEQ ID NO: 7728817 - DNA, 22 bp, Homo sapiens
tctgacagctccaggcagcaat

SEQ ID NO: 7728818 - DNA, 22 bp, Homo sapiens
tctgacagctccaggcagcaat

SEQ ID NO: 7728819 - DNA, 22 bp, Homo sapiens
tctgacagctccaggcagcaat

SEQ ID NO: 7728820 - DNA, 19 bp, Homo sapiens
tctgacagccccagtcaac

SEQ ID NO: 7728821 - DNA, 22 bp, Homo sapiens
tctgacagctccaggcagcaat

SEQ ID NO: 7728822 - DNA, 22 bp, Homo sapiens
tctgacagctccaggcagcaat

SEQ ID NO: 7728823 - DNA, 19 bp, Homo sapiens
tctgacagccccagtcaac

SEQ ID NO: 7728824 - DNA, 22 bp, Homo sapiens
tctgacagagaaggctcagcag

SEQ ID NO: 7728825 - DNA, 22 bp, Homo sapiens
tctgacagaggtggtagataca

SEQ ID NO: 7728826 - DNA, 22 bp, Homo sapiens
tctgacagaggtggtagataca

SEQ ID NO: 7728827 - DNA, 19 bp, Homo sapiens
tctgacacttacacacccc

SEQ ID NO: 7728828 - DNA, 22 bp, Homo sapiens
tctgacagtgtgaatattgact

SEQ ID NO: 7728829 - DNA, 22 bp, Homo sapiens
tctgacagttatataagcacca

SEQ ID NO: 7728830 - DNA, 22 bp, Homo sapiens
tctgacagttatataagcacca

SEQ ID NO: 7728831 - DNA, 22 bp, Homo sapiens
tctgacatagcaggacctaggc

SEQ ID NO: 7728832 - DNA, 22 bp, Homo sapiens
tctgacatgagggctgtggaga

SEQ ID NO: 7728833 - DNA, 22 bp, Homo sapiens
tctgacattagattaattggaa

SEQ ID NO: 7728834 - DNA, 22 bp, Homo sapiens
tctgacattagattaattggaa

SEQ ID NO: 7728835 - DNA, 22 bp, Homo sapiens
tctgacattagattaattggaa

SEQ ID NO: 7728836 - DNA, 22 bp, Homo sapiens
tctgacattagattaattggaa

SEQ ID NO: 7728837 - DNA, 22 bp, Homo sapiens
tctgacattagattaattggaa

SEQ ID NO: 7728838 - DNA, 22 bp, Homo sapiens
tctgacagggccaaacatgaca

SEQ ID NO: 7728839 - DNA, 22 bp, Homo sapiens
tctgacagggccaaacatgaca

SEQ ID NO: 7728840 - DNA, 22 bp, Homo sapiens
tctgacaggtcattttctatag

SEQ ID NO: 7728841 - DNA, 19 bp, Homo sapiens
tctgacagccccagtcaac

SEQ ID NO: 7728842 - DNA, 22 bp, Homo sapiens
tctgacaggtcattttctatag

SEQ ID NO: 7728843 - DNA, 22 bp, Homo sapiens
tctgacaggtgttcttccaggc

SEQ ID NO: 7728844 - DNA, 22 bp, Homo sapiens
tctgacaggtgttcttccaggc

SEQ ID NO: 7728845 - DNA, 22 bp, Homo sapiens
tctgacagtcacagtggaggat

SEQ ID NO: 7728846 - DNA, 22 bp, Homo sapiens
tctgacagtcacagtggaggat

SEQ ID NO: 7728847 - DNA, 22 bp, Homo sapiens
tctgacagtctcttctttagct

SEQ ID NO: 7728848 - DNA, 22 bp, Homo sapiens
tctgacagtctcttctttagct

SEQ ID NO: 7728849 - DNA, 22 bp, Homo sapiens
tctgacagtcacagtggaggat

SEQ ID NO: 7728850 - DNA, 22 bp, Homo sapiens
tctgacaggttgggatatggaa

SEQ ID NO: 7728851 - DNA, 22 bp, Homo sapiens
tctgacaggttgggatatggaa

SEQ ID NO: 7728852 - DNA, 22 bp, Homo sapiens
tctgacaggttgggatatggaa

SEQ ID NO: 7728853 - DNA, 22 bp, Homo sapiens
tctgagaatagtgccactgtgg

SEQ ID NO: 7728854 - DNA, 22 bp, Homo sapiens
tctgagaagtcctgtatttcta

SEQ ID NO: 7728855 - DNA, 22 bp, Homo sapiens
tctgagaataaaaattgcattt

SEQ ID NO: 7728856 - DNA, 23 bp, Homo sapiens
tctgagaaggtttcagccagact

SEQ ID NO: 7728857 - DNA, 23 bp, Homo sapiens
tctgagaaggtttcagccagact

SEQ ID NO: 7728858 - DNA, 23 bp, Homo sapiens
tctgagaaggtttcagccagact

SEQ ID NO: 7728859 - DNA, 23 bp, Homo sapiens
tctgagaaggtttcagccagact

SEQ ID NO: 7728860 - DNA, 22 bp, Homo sapiens
tctgagaaggtgcatcagctgc

SEQ ID NO: 7728861 - DNA, 22 bp, Homo sapiens
tctgagaaggtgcatcagctgc

SEQ ID NO: 7728862 - DNA, 22 bp, Homo sapiens
tctgagaagggtaggctccatt

SEQ ID NO: 7728863 - DNA, 22 bp, Homo sapiens
tctgagaagggtaggctccatt

SEQ ID NO: 7728864 - DNA, 22 bp, Homo sapiens
tctgagaatgagtgttttctta

SEQ ID NO: 7728865 - DNA, 17 bp, Homo sapiens
tctgagaatgctggagg

SEQ ID NO: 7728866 - DNA, 17 bp, Homo sapiens
tctgagaatgctggagg

SEQ ID NO: 7728867 - DNA, 17 bp, Homo sapiens
tctgagaatgctggagg

SEQ ID NO: 7728868 - DNA, 22 bp, Homo sapiens
tctgagaatggagctaaaaatc

SEQ ID NO: 7728869 - DNA, 22 bp, Homo sapiens
tctgagaatggagctaaaaatc

SEQ ID NO: 7728870 - DNA, 22 bp, Homo sapiens
tctgagaatggagctaaaaatc

SEQ ID NO: 7728871 - DNA, 17 bp, Homo sapiens
tctgagaatgctggagg

SEQ ID NO: 7728872 - DNA, 17 bp, Homo sapiens
tctgagaatgctggagg

SEQ ID NO: 7728873 - DNA, 22 bp, Homo sapiens
tctgagaagctagaggacaaag

SEQ ID NO: 7728874 - DNA, 22 bp, Homo sapiens
tctgagaagctagaggacaaag

SEQ ID NO: 7728875 - DNA, 22 bp, Homo sapiens
tctgagaagctagaggacaaag

SEQ ID NO: 7728876 - DNA, 22 bp, Homo sapiens
tctgagaagctagaggacaaag

SEQ ID NO: 7728877 - DNA, 22 bp, Homo sapiens
tctgagaagctagaggacaaag

SEQ ID NO: 7728878 - DNA, 22 bp, Homo sapiens
tctgagaagctagaggacaaag

SEQ ID NO: 7728879 - DNA, 22 bp, Homo sapiens
tctgagaaggaagctctgtgta

SEQ ID NO: 7728880 - DNA, 22 bp, Homo sapiens
tctgagaaggaagctctgtgta

SEQ ID NO: 7728881 - DNA, 22 bp, Homo sapiens
tctgagaaggaagctctgtgta

SEQ ID NO: 7728882 - DNA, 22 bp, Homo sapiens
tctgagaagggtaggctccatt

SEQ ID NO: 7728883 - DNA, 22 bp, Homo sapiens
tctgagaagctagaggacaaag

SEQ ID NO: 7728884 - DNA, 22 bp, Homo sapiens
tctgagaagcgggagcctgtga

SEQ ID NO: 7728885 - DNA, 22 bp, Homo sapiens
tctgagaagcgtgtctctgttt

SEQ ID NO: 7728886 - DNA, 22 bp, Homo sapiens
tctgagaagccctgtggggagg

SEQ ID NO: 7728887 - DNA, 22 bp, Homo sapiens
tctgagaagcgggagcctgtga

SEQ ID NO: 7728888 - DNA, 20 bp, Homo sapiens
tctgagaagccactgtccaa

SEQ ID NO: 7728889 - DNA, 20 bp, Homo sapiens
tctgagaagccactgtccaa

SEQ ID NO: 7728890 - DNA, 22 bp, Homo sapiens
tctgagaaatcagtggtgaata

SEQ ID NO: 7728891 - DNA, 22 bp, Homo sapiens
tctgagaaatcagtggtgaata

SEQ ID NO: 7728892 - DNA, 22 bp, Homo sapiens
tctgagaaatcagtggtgaata

SEQ ID NO: 7728893 - DNA, 22 bp, Homo sapiens
tctgagaaatttctttgtgatg

SEQ ID NO: 7728894 - DNA, 22 bp, Homo sapiens
tctgagaacataaattgacttc

SEQ ID NO: 7728895 - DNA, 22 bp, Homo sapiens
tctgagaacataaattgacttc

SEQ ID NO: 7728896 - DNA, 22 bp, Homo sapiens
tctgagaacatcatttcctaca

SEQ ID NO: 7728897 - DNA, 22 bp, Homo sapiens
tctgagaaaataggaaacttga

SEQ ID NO: 7728898 - DNA, 17 bp, Homo sapiens
tctgagaaaggagaatc

SEQ ID NO: 7728899 - DNA, 17 bp, Homo sapiens
tctgagaaaggagaatc

SEQ ID NO: 7728900 - DNA, 17 bp, Homo sapiens
tctgagaaaggagaatc

SEQ ID NO: 7728901 - DNA, 17 bp, Homo sapiens
tctgagaaaggagaatc

SEQ ID NO: 7728902 - DNA, 22 bp, Homo sapiens
tctgagaaagtactgtatgttc

SEQ ID NO: 7728903 - DNA, 22 bp, Homo sapiens
tctgagaaagtactgtatgttc

SEQ ID NO: 7728904 - DNA, 21 bp, Homo sapiens
tctgagaacttctgctgcagc

SEQ ID NO: 7728905 - DNA, 21 bp, Homo sapiens
tctgagaacttctgctgcagc

SEQ ID NO: 7728906 - DNA, 21 bp, Homo sapiens
tctgagaacttctgctgcagc

SEQ ID NO: 7728907 - DNA, 21 bp, Homo sapiens
tctgagaacttctgctgcagc

SEQ ID NO: 7728908 - DNA, 22 bp, Homo sapiens
tctgagaactccgggttagatc

SEQ ID NO: 7728909 - DNA, 21 bp, Homo sapiens
tctgagaacttctgctgcagc

SEQ ID NO: 7728910 - DNA, 21 bp, Homo sapiens
tctgagaacttctgctgcagc

SEQ ID NO: 7728911 - DNA, 20 bp, Homo sapiens
tctgagaagcaaacaatgtt

SEQ ID NO: 7728912 - DNA, 22 bp, Homo sapiens
tctgagaagcaccttctggaca

SEQ ID NO: 7728913 - DNA, 22 bp, Homo sapiens
tctgagaagcaccttctggaca

SEQ ID NO: 7728914 - DNA, 17 bp, Homo sapiens
tctgagaacttgaagca

SEQ ID NO: 7728915 - DNA, 21 bp, Homo sapiens
tctgagaacttctgctgcagc

SEQ ID NO: 7728916 - DNA, 20 bp, Homo sapiens
tctgagaagcaaacaatgtt

SEQ ID NO: 7728917 - DNA, 17 bp, Homo sapiens
tctgagaacttgaagca

SEQ ID NO: 7728918 - DNA, 17 bp, Homo sapiens
tctgagaacttgaagca

SEQ ID NO: 7728919 - DNA, 22 bp, Homo sapiens
tctgagccctgctgtttattga

SEQ ID NO: 7728920 - DNA, 22 bp, Homo sapiens
tctgagccctgctgtttattga

SEQ ID NO: 7728921 - DNA, 22 bp, Homo sapiens
tctgagccgtatggcttggcta

SEQ ID NO: 7728922 - DNA, 22 bp, Homo sapiens
tctgagccctcttttgcagccc

SEQ ID NO: 7728923 - DNA, 22 bp, Homo sapiens
tctgagccctcttttgcagccc

SEQ ID NO: 7728924 - DNA, 22 bp, Homo sapiens
tctgagctaatcctgttgccga

SEQ ID NO: 7728925 - DNA, 22 bp, Homo sapiens
tctgagctaatcctgttgccga

SEQ ID NO: 7728926 - DNA, 22 bp, Homo sapiens
tctgagcctatttcaaattcct

SEQ ID NO: 7728927 - DNA, 22 bp, Homo sapiens
tctgagctagtgatttataaga

SEQ ID NO: 7728928 - DNA, 22 bp, Homo sapiens
tctgagctatccagatagtatt

SEQ ID NO: 7728929 - DNA, 22 bp, Homo sapiens
tctgagctatgtaagacttgga

SEQ ID NO: 7728930 - DNA, 22 bp, Homo sapiens
tctgagctacgatgcctgtcac

SEQ ID NO: 7728931 - DNA, 21 bp, Homo sapiens
tctgagctgagtcctctaggt

SEQ ID NO: 7728932 - DNA, 21 bp, Homo sapiens
tctgagctgagtcctctaggt

SEQ ID NO: 7728933 - DNA, 21 bp, Homo sapiens
tctgagctgagtcctctaggt

SEQ ID NO: 7728934 - DNA, 21 bp, Homo sapiens
tctgagctgagtcctctaggt

SEQ ID NO: 7728935 - DNA, 22 bp, Homo sapiens
tctgagctctatctgtgggaat

SEQ ID NO: 7728936 - DNA, 22 bp, Homo sapiens
tctgagctcaagtgacagttag

SEQ ID NO: 7728937 - DNA, 22 bp, Homo sapiens
tctgagctatgtaagacttgga

SEQ ID NO: 7728938 - DNA, 22 bp, Homo sapiens
tctgagctcaagtgacagttag

SEQ ID NO: 7728939 - DNA, 19 bp, Homo sapiens
tctgagctgatatgacatt

SEQ ID NO: 7728940 - DNA, 21 bp, Homo sapiens
tctgagctgagtcctctaggt

SEQ ID NO: 7728941 - DNA, 22 bp, Homo sapiens
tctgagctgcccctttactttg

SEQ ID NO: 7728942 - DNA, 22 bp, Homo sapiens
tctgagctgcagagtggggtgg

SEQ ID NO: 7728943 - DNA, 22 bp, Homo sapiens
tctgagctgcccctttactttg

SEQ ID NO: 7728944 - DNA, 22 bp, Homo sapiens
tctgagctgtaagtagacaagg

SEQ ID NO: 7728945 - DNA, 22 bp, Homo sapiens
tctgagctgtaagtagacaagg

SEQ ID NO: 7728946 - DNA, 22 bp, Homo sapiens
tctgagctgggggcctggcatg

SEQ ID NO: 7728947 - DNA, 22 bp, Homo sapiens
tctgagctgggtcttgacagct

SEQ ID NO: 7728948 - DNA, 22 bp, Homo sapiens
tctgagctgggtcttgacagct

SEQ ID NO: 7728949 - DNA, 22 bp, Homo sapiens
tctgagctgggggcctggcatg

SEQ ID NO: 7728950 - DNA, 22 bp, Homo sapiens
tctgagctgctaggtatgcatt

SEQ ID NO: 7728951 - DNA, 22 bp, Homo sapiens
tctgagctgctaggtatgcatt

SEQ ID NO: 7728952 - DNA, 22 bp, Homo sapiens
tctgagctgctaggtatgcatt

SEQ ID NO: 7728953 - DNA, 22 bp, Homo sapiens
tctgagctgctaggtatgcatt

SEQ ID NO: 7728954 - DNA, 22 bp, Homo sapiens
tctgagctggagcccatcacct

SEQ ID NO: 7728955 - DNA, 22 bp, Homo sapiens
tctgagctggagcccatcacct

SEQ ID NO: 7728956 - DNA, 22 bp, Homo sapiens
tctgagctggagcccatcacct

SEQ ID NO: 7728957 - DNA, 22 bp, Homo sapiens
tctgagcttactcagggataca

SEQ ID NO: 7728958 - DNA, 22 bp, Homo sapiens
tctgagcttccctctgaggcag

SEQ ID NO: 7728959 - DNA, 22 bp, Homo sapiens
tctgagcttactcagggataca

SEQ ID NO: 7728960 - DNA, 22 bp, Homo sapiens
tctgagcttctgcatttccaac

SEQ ID NO: 7728961 - DNA, 22 bp, Homo sapiens
tctgagcttctgcctgctgcaa

SEQ ID NO: 7728962 - DNA, 22 bp, Homo sapiens
tctgagcttctgcatttccaac

SEQ ID NO: 7728963 - DNA, 22 bp, Homo sapiens
tctgagctgtggccattcttcc

SEQ ID NO: 7728964 - DNA, 22 bp, Homo sapiens
tctgagctgtggccattcttcc

SEQ ID NO: 7728965 - DNA, 22 bp, Homo sapiens
tctgagctgtggccattcttcc

SEQ ID NO: 7728966 - DNA, 23 bp, Homo sapiens
tctgagctgtcttttcagcagaa

SEQ ID NO: 7728967 - DNA, 23 bp, Homo sapiens
tctgagctgtcttttcagcagaa

SEQ ID NO: 7728968 - DNA, 22 bp, Homo sapiens
tctgagctgtaagtagacaagg

SEQ ID NO: 7728969 - DNA, 22 bp, Homo sapiens
tctgagccacctgagcccatgg

SEQ ID NO: 7728970 - DNA, 22 bp, Homo sapiens
tctgagccacctgagcccatgg

SEQ ID NO: 7728971 - DNA, 22 bp, Homo sapiens
tctgagccacagatgtcctgtt

SEQ ID NO: 7728972 - DNA, 22 bp, Homo sapiens
tctgagccacctgagcccatgg

SEQ ID NO: 7728973 - DNA, 22 bp, Homo sapiens
tctgagccacctgagcccatgg

SEQ ID NO: 7728974 - DNA, 22 bp, Homo sapiens
tctgagccacagatgtcctgtt

SEQ ID NO: 7728975 - DNA, 22 bp, Homo sapiens
tctgagccaatttctgtgtcca

SEQ ID NO: 7728976 - DNA, 22 bp, Homo sapiens
tctgagccacagatgtcctgtt

SEQ ID NO: 7728977 - DNA, 22 bp, Homo sapiens
tctgagccacagatgtcctgtt

SEQ ID NO: 7728978 - DNA, 22 bp, Homo sapiens
tctgagccaatttctgtgtcca

SEQ ID NO: 7728979 - DNA, 22 bp, Homo sapiens
tctgagcatatgcagcacctgg

SEQ ID NO: 7728980 - DNA, 22 bp, Homo sapiens
tctgagcatatgcagcacctgg

SEQ ID NO: 7728981 - DNA, 22 bp, Homo sapiens
tctgagcatatgcagcacctgg

SEQ ID NO: 7728982 - DNA, 22 bp, Homo sapiens
tctgagcatatgcagcacctgg

SEQ ID NO: 7728983 - DNA, 22 bp, Homo sapiens
tctgagcattgaattttcttcc

SEQ ID NO: 7728984 - DNA, 22 bp, Homo sapiens
tctgagcattgagctctccaaa

SEQ ID NO: 7728985 - DNA, 22 bp, Homo sapiens
tctgagcattttaggtggtatc

SEQ ID NO: 7728986 - DNA, 22 bp, Homo sapiens
tctgagccaaaataaacagcat

SEQ ID NO: 7728987 - DNA, 22 bp, Homo sapiens
tctgagccaatttctgtgtcca

SEQ ID NO: 7728988 - DNA, 22 bp, Homo sapiens
tctgagccagccacctccttca

SEQ ID NO: 7728989 - DNA, 22 bp, Homo sapiens
tctgagccagccacctccttca

SEQ ID NO: 7728990 - DNA, 22 bp, Homo sapiens
tctgagccagacaagacagcca

SEQ ID NO: 7728991 - DNA, 22 bp, Homo sapiens
tctgagccagggtctcctccct

SEQ ID NO: 7728992 - DNA, 22 bp, Homo sapiens
tctgagccagggtctcctccct

SEQ ID NO: 7728993 - DNA, 22 bp, Homo sapiens
tctgagccacctgccagtgctg

SEQ ID NO: 7728994 - DNA, 22 bp, Homo sapiens
tctgagccacctgccagtgctg

SEQ ID NO: 7728995 - DNA, 22 bp, Homo sapiens
tctgagccacctgccagtgctg

SEQ ID NO: 7728996 - DNA, 22 bp, Homo sapiens
tctgagccagacaagacagcca

SEQ ID NO: 7728997 - DNA, 22 bp, Homo sapiens
tctgagccagacaagacagcca

SEQ ID NO: 7728998 - DNA, 22 bp, Homo sapiens
tctgagccataagagtacagga

SEQ ID NO: 7728999 - DNA, 22 bp, Homo sapiens
tctgagccagggtctcctccct

SEQ ID NO: 7729000 - DNA, 22 bp, Homo sapiens
tctgagcccagtgagtctcgca

SEQ ID NO: 7729001 - DNA, 22 bp, Homo sapiens
tctgagcccagtgagtctcgca

SEQ ID NO: 7729002 - DNA, 22 bp, Homo sapiens
tctgagcccctagaactgagcg

SEQ ID NO: 7729003 - DNA, 22 bp, Homo sapiens
tctgagcccctagaactgagcg

SEQ ID NO: 7729004 - DNA, 22 bp, Homo sapiens
tctgagcccctagaactgagcg

SEQ ID NO: 7729005 - DNA, 22 bp, Homo sapiens
tctgagcagatgctcgctctcc

SEQ ID NO: 7729006 - DNA, 22 bp, Homo sapiens
tctgagcagatgctcgctctcc

SEQ ID NO: 7729007 - DNA, 22 bp, Homo sapiens
tctgagcagagcatcatttcag

SEQ ID NO: 7729008 - DNA, 22 bp, Homo sapiens
tctgagcagagcatcatttcag

SEQ ID NO: 7729009 - DNA, 22 bp, Homo sapiens
tctgagcagctttgttttgtgt

SEQ ID NO: 7729010 - DNA, 22 bp, Homo sapiens
tctgagcactgggcagtcggtg

SEQ ID NO: 7729011 - DNA, 22 bp, Homo sapiens
tctgagcagagcatcatttcag

SEQ ID NO: 7729012 - DNA, 22 bp, Homo sapiens
tctgagcactgggcagtcggtg

SEQ ID NO: 7729013 - DNA, 22 bp, Homo sapiens
tctgagcacatcacacagctca

SEQ ID NO: 7729014 - DNA, 22 bp, Homo sapiens
tctgagcacatcacacagctca

SEQ ID NO: 7729015 - DNA, 22 bp, Homo sapiens
tctgagagagggtcagatgcta

SEQ ID NO: 7729016 - DNA, 22 bp, Homo sapiens
tctgagagagggtcagatgcta

SEQ ID NO: 7729017 - DNA, 22 bp, Homo sapiens
tctgagagagggtcagatgcta

SEQ ID NO: 7729018 - DNA, 22 bp, Homo sapiens
tctgagagagggtcagatgcta

SEQ ID NO: 7729019 - DNA, 22 bp, Homo sapiens
tctgagagagggtcagatgcta

SEQ ID NO: 7729020 - DNA, 22 bp, Homo sapiens
tctgagagatacaaggaggcaa

SEQ ID NO: 7729021 - DNA, 22 bp, Homo sapiens
tctgagagatacaaggaggcaa

SEQ ID NO: 7729022 - DNA, 22 bp, Homo sapiens
tctgagagatacaaggaggcaa

SEQ ID NO: 7729023 - DNA, 22 bp, Homo sapiens
tctgagcacaattacttacatc

SEQ ID NO: 7729024 - DNA, 22 bp, Homo sapiens
tctgagcacaattacttacatc

SEQ ID NO: 7729025 - DNA, 22 bp, Homo sapiens
tctgagcacaattacttacatc

SEQ ID NO: 7729026 - DNA, 22 bp, Homo sapiens
tctgagcacatcacacagctca

SEQ ID NO: 7729027 - DNA, 22 bp, Homo sapiens
tctgagcacatcacacagctca

SEQ ID NO: 7729028 - DNA, 22 bp, Homo sapiens
tctgagcacatcacacagctca

SEQ ID NO: 7729029 - DNA, 22 bp, Homo sapiens
tctgagacttctgaagctagaa

SEQ ID NO: 7729030 - DNA, 20 bp, Homo sapiens
tctgagacttgtagtgtgga

SEQ ID NO: 7729031 - DNA, 22 bp, Homo sapiens
tctgagactttaacctggggcc

SEQ ID NO: 7729032 - DNA, 21 bp, Homo sapiens
tctgagactgggttagaatgt

SEQ ID NO: 7729033 - DNA, 22 bp, Homo sapiens
tctgagactgcagtgagccgct

SEQ ID NO: 7729034 - DNA, 22 bp, Homo sapiens
tctgagagagcacctatccact

SEQ ID NO: 7729035 - DNA, 22 bp, Homo sapiens
tctgagagagcacctatccact

SEQ ID NO: 7729036 - DNA, 22 bp, Homo sapiens
tctgagagagcacctatccact

SEQ ID NO: 7729037 - DNA, 23 bp, Homo sapiens
tctgagagaacaatgcctcctat

SEQ ID NO: 7729038 - DNA, 22 bp, Homo sapiens
tctgagactttaacctggggcc

SEQ ID NO: 7729039 - DNA, 23 bp, Homo sapiens
tctgagagaacaatgcctcctat

SEQ ID NO: 7729040 - DNA, 22 bp, Homo sapiens
tctgagacaacttagccctcga

SEQ ID NO: 7729041 - DNA, 22 bp, Homo sapiens
tctgagacaacttagccctcga

SEQ ID NO: 7729042 - DNA, 22 bp, Homo sapiens
tctgagacaggaagtggagggt

SEQ ID NO: 7729043 - DNA, 22 bp, Homo sapiens
tctgagaatggtggatgtggtg

SEQ ID NO: 7729044 - DNA, 20 bp, Homo sapiens
tctgagacctttccacaccc

SEQ ID NO: 7729045 - DNA, 22 bp, Homo sapiens
tctgagactccataagttgaaa

SEQ ID NO: 7729046 - DNA, 22 bp, Homo sapiens
tctgagacaggaagtggagggt

SEQ ID NO: 7729047 - DNA, 22 bp, Homo sapiens
tctgagacaggaagtggagggt

SEQ ID NO: 7729048 - DNA, 22 bp, Homo sapiens
tctgagacccatacaggcccac

SEQ ID NO: 7729049 - DNA, 22 bp, Homo sapiens
tctgcccaggacacctgccact

SEQ ID NO: 7729050 - DNA, 22 bp, Homo sapiens
tctgcccaggacacctgccact

SEQ ID NO: 7729051 - DNA, 22 bp, Homo sapiens
tctgcccaggacacctgccact

SEQ ID NO: 7729052 - DNA, 18 bp, Homo sapiens
tctgcccaggacttggac

SEQ ID NO: 7729053 - DNA, 18 bp, Homo sapiens
tctgcccaggacttggac

SEQ ID NO: 7729054 - DNA, 18 bp, Homo sapiens
tctgcccaggacttggac

SEQ ID NO: 7729055 - DNA, 22 bp, Homo sapiens
tctgcccaggaggtcccatggg

SEQ ID NO: 7729056 - DNA, 22 bp, Homo sapiens
tctgcccaggaggtcccatggg

SEQ ID NO: 7729057 - DNA, 19 bp, Homo sapiens
tctgcccagttgtctgccc

SEQ ID NO: 7729058 - DNA, 19 bp, Homo sapiens
tctgcccagttgtctgccc

SEQ ID NO: 7729059 - DNA, 19 bp, Homo sapiens
tctgcccagttgtctgccc

SEQ ID NO: 7729060 - DNA, 22 bp, Homo sapiens
tctgcccagggcagggcttgca

SEQ ID NO: 7729061 - DNA, 22 bp, Homo sapiens
tctgcccagggcagggcttgca

SEQ ID NO: 7729062 - DNA, 22 bp, Homo sapiens
tctgcccagggacaggacacag

SEQ ID NO: 7729063 - DNA, 22 bp, Homo sapiens
tctgcccagggacccacaggga

SEQ ID NO: 7729064 - DNA, 22 bp, Homo sapiens
tctgcccagggacccacaggga

SEQ ID NO: 7729065 - DNA, 22 bp, Homo sapiens
tctgcccagggacccacaggga

SEQ ID NO: 7729066 - DNA, 22 bp, Homo sapiens
tctgcccagggacccacaggga

SEQ ID NO: 7729067 - DNA, 22 bp, Homo sapiens
tctgcccagggacaggacacag

SEQ ID NO: 7729068 - DNA, 22 bp, Homo sapiens
tctgcccaggaggtcccatggg

SEQ ID NO: 7729069 - DNA, 22 bp, Homo sapiens
tctgcccactgctctgctgccc

SEQ ID NO: 7729070 - DNA, 22 bp, Homo sapiens
tctgcccactgctctgctgccc

SEQ ID NO: 7729071 - DNA, 22 bp, Homo sapiens
tctgcccactgctctgctgccc

SEQ ID NO: 7729072 - DNA, 20 bp, Homo sapiens
tctgcccaccccggctccca

SEQ ID NO: 7729073 - DNA, 22 bp, Homo sapiens
tctgcccactgctctgctgccc

SEQ ID NO: 7729074 - DNA, 22 bp, Homo sapiens
tctgcccactgctctgctgccc

SEQ ID NO: 7729075 - DNA, 22 bp, Homo sapiens
tctgcccaggacacctgccact

SEQ ID NO: 7729076 - DNA, 22 bp, Homo sapiens
tctgcccagccagacccaaggt

SEQ ID NO: 7729077 - DNA, 22 bp, Homo sapiens
tctgcccagctaaaaatgggag

SEQ ID NO: 7729078 - DNA, 22 bp, Homo sapiens
tctgcccagctaaaaatgggag

SEQ ID NO: 7729079 - DNA, 22 bp, Homo sapiens
tctgcccagctaaaaatgggag

SEQ ID NO: 7729080 - DNA, 22 bp, Homo sapiens
tctgcccagccagacccaaggt

SEQ ID NO: 7729081 - DNA, 22 bp, Homo sapiens
tctgcccagccagacccaaggt

SEQ ID NO: 7729082 - DNA, 22 bp, Homo sapiens
tctgcccagccagacccaaggt

SEQ ID NO: 7729083 - DNA, 22 bp, Homo sapiens
tctgcccaccagcggttgcata

SEQ ID NO: 7729084 - DNA, 22 bp, Homo sapiens
tctgcccaccagcggttgcata

SEQ ID NO: 7729085 - DNA, 20 bp, Homo sapiens
tctgcccaccccggctccca

SEQ ID NO: 7729086 - DNA, 22 bp, Homo sapiens
tctgcccacagtccaatagttg

SEQ ID NO: 7729087 - DNA, 22 bp, Homo sapiens
tctgcccacagtccaatagttg

SEQ ID NO: 7729088 - DNA, 22 bp, Homo sapiens
tctgcccacagtccaatagttg

SEQ ID NO: 7729089 - DNA, 22 bp, Homo sapiens
tctgcccacagcctcctgtcca

SEQ ID NO: 7729090 - DNA, 22 bp, Homo sapiens
tctgcccacagcctcctgtcca

SEQ ID NO: 7729091 - DNA, 22 bp, Homo sapiens
tctgcccacagcctcctgtcca

SEQ ID NO: 7729092 - DNA, 22 bp, Homo sapiens
tctgccctcattgctgcctgga

SEQ ID NO: 7729093 - DNA, 22 bp, Homo sapiens
tctgccctcattgctgcctgga

SEQ ID NO: 7729094 - DNA, 22 bp, Homo sapiens
tctgccctcattgctgcctgga

SEQ ID NO: 7729095 - DNA, 22 bp, Homo sapiens
tctgccctcagggtaatgatca

SEQ ID NO: 7729096 - DNA, 22 bp, Homo sapiens
tctgccctcattgctgcctgga

SEQ ID NO: 7729097 - DNA, 22 bp, Homo sapiens
tctgccctcattgctgcctgga

SEQ ID NO: 7729098 - DNA, 22 bp, Homo sapiens
tctgccctcattgctgcctgga

SEQ ID NO: 7729099 - DNA, 22 bp, Homo sapiens
tctgccctcattgctgcctgga

SEQ ID NO: 7729100 - DNA, 22 bp, Homo sapiens
tctgccctcattgctgcctgga

SEQ ID NO: 7729101 - DNA, 21 bp, Homo sapiens
tctgccctccaggagctcata

SEQ ID NO: 7729102 - DNA, 21 bp, Homo sapiens
tctgccctccaggagctcata

SEQ ID NO: 7729103 - DNA, 21 bp, Homo sapiens
tctgccctccaggagctcata

SEQ ID NO: 7729104 - DNA, 21 bp, Homo sapiens
tctgccctccaggagctcata

SEQ ID NO: 7729105 - DNA, 22 bp, Homo sapiens
tctgccctcgaggagcttgtgt

SEQ ID NO: 7729106 - DNA, 21 bp, Homo sapiens
tctgccctccaggagctcata

SEQ ID NO: 7729107 - DNA, 23 bp, Homo sapiens
tctgccctctgcctgtttttgta

SEQ ID NO: 7729108 - DNA, 22 bp, Homo sapiens
tctgccctcgaggagcttgtgt

SEQ ID NO: 7729109 - DNA, 22 bp, Homo sapiens
tctgcccagtttgtgctcaggt

SEQ ID NO: 7729110 - DNA, 22 bp, Homo sapiens
tctgcccagtttgtgctcaggt

SEQ ID NO: 7729111 - DNA, 22 bp, Homo sapiens
tctgcccagtttgtgctcaggt

SEQ ID NO: 7729112 - DNA, 19 bp, Homo sapiens
tctgcccagttgtctgccc

SEQ ID NO: 7729113 - DNA, 18 bp, Homo sapiens
tctgccccagccgcactg

SEQ ID NO: 7729114 - DNA, 22 bp, Homo sapiens
tctgcccagggcagggcttgca

SEQ ID NO: 7729115 - DNA, 22 bp, Homo sapiens
tctgcccattcttagagtctag

SEQ ID NO: 7729116 - DNA, 22 bp, Homo sapiens
tctgcccattcttagagtctag

SEQ ID NO: 7729117 - DNA, 22 bp, Homo sapiens
tctgccctaattcagtgcttag

SEQ ID NO: 7729118 - DNA, 22 bp, Homo sapiens
tctgccctaattcagtgcttag

SEQ ID NO: 7729119 - DNA, 22 bp, Homo sapiens
tctgccctaattcagtgcttag

SEQ ID NO: 7729120 - DNA, 22 bp, Homo sapiens
tctgccctaattcagtgcttag

SEQ ID NO: 7729121 - DNA, 22 bp, Homo sapiens
tctgccctaattcagtgcttag

SEQ ID NO: 7729122 - DNA, 22 bp, Homo sapiens
tctgccctaattcagtgcttag

SEQ ID NO: 7729123 - DNA, 18 bp, Homo sapiens
tctgccccagccgcactg

SEQ ID NO: 7729124 - DNA, 18 bp, Homo sapiens
tctgccccagccgcactg

SEQ ID NO: 7729125 - DNA, 22 bp, Homo sapiens
tctgcccctgctgggcacagag

SEQ ID NO: 7729126 - DNA, 18 bp, Homo sapiens
tctgccctgccattcact

SEQ ID NO: 7729127 - DNA, 18 bp, Homo sapiens
tctgccctgccattcact

SEQ ID NO: 7729128 - DNA, 18 bp, Homo sapiens
tctgccctgccattcact

SEQ ID NO: 7729129 - DNA, 22 bp, Homo sapiens
tctgccctgcagggagcagtaa

SEQ ID NO: 7729130 - DNA, 22 bp, Homo sapiens
tctgccctgcagggagcagtaa

SEQ ID NO: 7729131 - DNA, 18 bp, Homo sapiens
tctgccctgccattcact

SEQ ID NO: 7729132 - DNA, 22 bp, Homo sapiens
tctgccctgccattcactggaa

SEQ ID NO: 7729133 - DNA, 22 bp, Homo sapiens
tctgccctgccattcactggaa

SEQ ID NO: 7729134 - DNA, 22 bp, Homo sapiens
tctgccctggggtcagcctcca

SEQ ID NO: 7729135 - DNA, 22 bp, Homo sapiens
tctgccctggggtcagcctcca

SEQ ID NO: 7729136 - DNA, 22 bp, Homo sapiens
tctgccctgccattcactggaa

SEQ ID NO: 7729137 - DNA, 22 bp, Homo sapiens
tctgccctggggtcagcctcca

SEQ ID NO: 7729138 - DNA, 22 bp, Homo sapiens
tctgccctggggtcagcctcca

SEQ ID NO: 7729139 - DNA, 22 bp, Homo sapiens
tctgccctggggtcagcctcca

SEQ ID NO: 7729140 - DNA, 22 bp, Homo sapiens
tctgccctggggtcagcctcca

SEQ ID NO: 7729141 - DNA, 22 bp, Homo sapiens
tctgccctggggtcagcctcca

SEQ ID NO: 7729142 - DNA, 22 bp, Homo sapiens
tctgccctggggtcagcctcca

SEQ ID NO: 7729143 - DNA, 22 bp, Homo sapiens
tctgccctggggtcagcctcca

SEQ ID NO: 7729144 - DNA, 22 bp, Homo sapiens
tctgcccttggctctcttgttg

SEQ ID NO: 7729145 - DNA, 21 bp, Homo sapiens
tctgcctgagactttgctggt

SEQ ID NO: 7729146 - DNA, 22 bp, Homo sapiens
tctgcctgagcagagggaggcc

SEQ ID NO: 7729147 - DNA, 22 bp, Homo sapiens
tctgcctgagcagagggaggcc

SEQ ID NO: 7729148 - DNA, 21 bp, Homo sapiens
tctgcctgagactttgctggt

SEQ ID NO: 7729149 - DNA, 22 bp, Homo sapiens
tctgcctgagcagagggaggcc

SEQ ID NO: 7729150 - DNA, 22 bp, Homo sapiens
tctgcctgagcagagggaggcc

SEQ ID NO: 7729151 - DNA, 22 bp, Homo sapiens
tctgccgtgcgaggtcccacca

SEQ ID NO: 7729152 - DNA, 22 bp, Homo sapiens
tctgccgtgcgaggtcccacca

SEQ ID NO: 7729153 - DNA, 22 bp, Homo sapiens
tctgccgtgcgaggtcccacca

SEQ ID NO: 7729154 - DNA, 22 bp, Homo sapiens
tctgccgtgcgaggtcccacca

SEQ ID NO: 7729155 - DNA, 22 bp, Homo sapiens
tctgcccttggctctcttgttg

SEQ ID NO: 7729156 - DNA, 19 bp, Homo sapiens
tctgccgagctagaccact

SEQ ID NO: 7729157 - DNA, 22 bp, Homo sapiens
tctgcctgagggagctgaggaa

SEQ ID NO: 7729158 - DNA, 22 bp, Homo sapiens
tctgcctgagggagctgaggaa

SEQ ID NO: 7729159 - DNA, 18 bp, Homo sapiens
tctgcctgcagggcatct

SEQ ID NO: 7729160 - DNA, 18 bp, Homo sapiens
tctgcctgcagggcatct

SEQ ID NO: 7729161 - DNA, 18 bp, Homo sapiens
tctgcctgcagggcatct

SEQ ID NO: 7729162 - DNA, 18 bp, Homo sapiens
tctgcctgcagggcatct

SEQ ID NO: 7729163 - DNA, 18 bp, Homo sapiens
tctgcctgcagggcatct

SEQ ID NO: 7729164 - DNA, 22 bp, Homo sapiens
tctgcctgagggagctgaggaa

SEQ ID NO: 7729165 - DNA, 22 bp, Homo sapiens
tctgcctgagggagctgaggaa

SEQ ID NO: 7729166 - DNA, 22 bp, Homo sapiens
tctgcctgagggagctgaggaa

SEQ ID NO: 7729167 - DNA, 22 bp, Homo sapiens
tctgcctgagggagctgaggaa

SEQ ID NO: 7729168 - DNA, 22 bp, Homo sapiens
tctgcctgaggactgacaccag

SEQ ID NO: 7729169 - DNA, 22 bp, Homo sapiens
tctgcctgagggagctgaggaa

SEQ ID NO: 7729170 - DNA, 22 bp, Homo sapiens
tctgcctgagggagctgaggaa

SEQ ID NO: 7729171 - DNA, 22 bp, Homo sapiens
tctgcctgagggagctgaggaa

SEQ ID NO: 7729172 - DNA, 22 bp, Homo sapiens
tctgcctgagggagctgaggaa

SEQ ID NO: 7729173 - DNA, 22 bp, Homo sapiens
tctgcctgccagtctggtcctc

SEQ ID NO: 7729174 - DNA, 22 bp, Homo sapiens
tctgcctgccagtctggtcctc

SEQ ID NO: 7729175 - DNA, 22 bp, Homo sapiens
tctgcctgcagtgtggcagggc

SEQ ID NO: 7729176 - DNA, 22 bp, Homo sapiens
tctgcctgcagtgtggcagggc

SEQ ID NO: 7729177 - DNA, 22 bp, Homo sapiens
tctgcctgccagtctggtcctc

SEQ ID NO: 7729178 - DNA, 22 bp, Homo sapiens
tctgcctgccagtctggtcctc

SEQ ID NO: 7729179 - DNA, 22 bp, Homo sapiens
tctgcctgccgagaacacctac

SEQ ID NO: 7729180 - DNA, 22 bp, Homo sapiens
tctgcctgccgagaacacctac

SEQ ID NO: 7729181 - DNA, 22 bp, Homo sapiens
tctgcctgcgctcacggggccg

SEQ ID NO: 7729182 - DNA, 22 bp, Homo sapiens
tctgcctgcgctcacggggccg

SEQ ID NO: 7729183 - DNA, 22 bp, Homo sapiens
tctgcctgcgctcacggggccg

SEQ ID NO: 7729184 - DNA, 22 bp, Homo sapiens
tctgcctgcttcttcatagtct

SEQ ID NO: 7729185 - DNA, 22 bp, Homo sapiens
tctgcctgcttcttcatagtct

SEQ ID NO: 7729186 - DNA, 19 bp, Homo sapiens
tctgcctgcttgtaggggc

SEQ ID NO: 7729187 - DNA, 19 bp, Homo sapiens
tctgcctgcttgtaggggc

SEQ ID NO: 7729188 - DNA, 19 bp, Homo sapiens
tctgcctgcttgtaggggc

SEQ ID NO: 7729189 - DNA, 22 bp, Homo sapiens
tctgcctgcttcttcatagtct

SEQ ID NO: 7729190 - DNA, 22 bp, Homo sapiens
tctgcctgcttcttcatagtct

SEQ ID NO: 7729191 - DNA, 22 bp, Homo sapiens
tctgcctgctgcctgggggctc

SEQ ID NO: 7729192 - DNA, 22 bp, Homo sapiens
tctgcctggagagttcttctct

SEQ ID NO: 7729193 - DNA, 22 bp, Homo sapiens
tctgcctggagagttcttctct

SEQ ID NO: 7729194 - DNA, 22 bp, Homo sapiens
tctgcctggaccctggtgagct

SEQ ID NO: 7729195 - DNA, 22 bp, Homo sapiens
tctgcctggaccctggtgagct

SEQ ID NO: 7729196 - DNA, 22 bp, Homo sapiens
tctgcctggaccctggtgagct

SEQ ID NO: 7729197 - DNA, 22 bp, Homo sapiens
tctgcctggaccctggtgagct

SEQ ID NO: 7729198 - DNA, 22 bp, Homo sapiens
tctgcctggagagttcttctct

SEQ ID NO: 7729199 - DNA, 22 bp, Homo sapiens
tctgcctggagagttcttctct

SEQ ID NO: 7729200 - DNA, 22 bp, Homo sapiens
tctgcctggatgatggcagggc

SEQ ID NO: 7729201 - DNA, 22 bp, Homo sapiens
tctgcctgcggctgcaggtggc

SEQ ID NO: 7729202 - DNA, 22 bp, Homo sapiens
tctgcctgctaactcctgcacc

SEQ ID NO: 7729203 - DNA, 22 bp, Homo sapiens
tctgcctgctaactcctgcacc

SEQ ID NO: 7729204 - DNA, 22 bp, Homo sapiens
tctgcctgctaactcctgcacc

SEQ ID NO: 7729205 - DNA, 22 bp, Homo sapiens
tctgcctgctaactcctgcacc

SEQ ID NO: 7729206 - DNA, 22 bp, Homo sapiens
tctgcctgctaactcctgcacc

SEQ ID NO: 7729207 - DNA, 22 bp, Homo sapiens
tctgcctgctaactcctgcacc

SEQ ID NO: 7729208 - DNA, 22 bp, Homo sapiens
tctgcctgctaactcctgcacc

SEQ ID NO: 7729209 - DNA, 22 bp, Homo sapiens
tctgcctgctaactcctgcacc

SEQ ID NO: 7729210 - DNA, 22 bp, Homo sapiens
tctgcctgcgctcacggggccg

SEQ ID NO: 7729211 - DNA, 22 bp, Homo sapiens
tctgcctgcggctgcaggtggc

SEQ ID NO: 7729212 - DNA, 22 bp, Homo sapiens
tctgcctgcggctgcaggtggc

SEQ ID NO: 7729213 - DNA, 22 bp, Homo sapiens
tctgcctgcggctgcaggtggc

SEQ ID NO: 7729214 - DNA, 22 bp, Homo sapiens
tctgcctgcggctgcaggtggc

SEQ ID NO: 7729215 - DNA, 22 bp, Homo sapiens
tctgcctgcggctgcaggtggc

SEQ ID NO: 7729216 - DNA, 22 bp, Homo sapiens
tctgcctgcggctgcaggtggc

SEQ ID NO: 7729217 - DNA, 22 bp, Homo sapiens
tctgcctgcggctgcaggtggc

SEQ ID NO: 7729218 - DNA, 22 bp, Homo sapiens
tctgcctggcggactcccggaa

SEQ ID NO: 7729219 - DNA, 22 bp, Homo sapiens
tctgcctggcggactcccggaa

SEQ ID NO: 7729220 - DNA, 22 bp, Homo sapiens
tctgcctggctcatggcagtga

SEQ ID NO: 7729221 - DNA, 22 bp, Homo sapiens
tctgcctgggtgtggagcagag

SEQ ID NO: 7729222 - DNA, 22 bp, Homo sapiens
tctgcctggctcatggcagtga

SEQ ID NO: 7729223 - DNA, 22 bp, Homo sapiens
tctgcctggctcatggcagtga

SEQ ID NO: 7729224 - DNA, 22 bp, Homo sapiens
tctgcctggctcatggcagtga

SEQ ID NO: 7729225 - DNA, 22 bp, Homo sapiens
tctgcctgggtgtggagcagag

SEQ ID NO: 7729226 - DNA, 22 bp, Homo sapiens
tctgcctgggtgtggagcagag

SEQ ID NO: 7729227 - DNA, 22 bp, Homo sapiens
tctgcctgtagtcccacacctc

SEQ ID NO: 7729228 - DNA, 22 bp, Homo sapiens
tctgcctgtagtcccacacctc

SEQ ID NO: 7729229 - DNA, 22 bp, Homo sapiens
tctgcctgtacctcttttttgc

SEQ ID NO: 7729230 - DNA, 22 bp, Homo sapiens
tctgcctgtaatatttggagaa

SEQ ID NO: 7729231 - DNA, 22 bp, Homo sapiens
tctgcctgtaatatttggagaa

SEQ ID NO: 7729232 - DNA, 22 bp, Homo sapiens
tctgcctgtaatatttggagaa

SEQ ID NO: 7729233 - DNA, 22 bp, Homo sapiens
tctgcctggatgatggcagggc

SEQ ID NO: 7729234 - DNA, 22 bp, Homo sapiens
tctgcctggattccattctcca

SEQ ID NO: 7729235 - DNA, 22 bp, Homo sapiens
tctgcctggattccattctcca

SEQ ID NO: 7729236 - DNA, 22 bp, Homo sapiens
tctgcctggattccattctcca

SEQ ID NO: 7729237 - DNA, 22 bp, Homo sapiens
tctgcctggattttggaaagct

SEQ ID NO: 7729238 - DNA, 22 bp, Homo sapiens
tctgcctggattttggaaagct

SEQ ID NO: 7729239 - DNA, 22 bp, Homo sapiens
tctgcctggattttggaaagct

SEQ ID NO: 7729240 - DNA, 22 bp, Homo sapiens
tctgcctggcctggagggcaca

SEQ ID NO: 7729241 - DNA, 22 bp, Homo sapiens
tctgcctggcctggagggcaca

SEQ ID NO: 7729242 - DNA, 22 bp, Homo sapiens
tctgcctggcctggagggcaca

SEQ ID NO: 7729243 - DNA, 22 bp, Homo sapiens
tctgcctggcctggagggcaca

SEQ ID NO: 7729244 - DNA, 22 bp, Homo sapiens
tctgcctggcctggagggcaca

SEQ ID NO: 7729245 - DNA, 22 bp, Homo sapiens
tctgccttccccataatctgat

SEQ ID NO: 7729246 - DNA, 22 bp, Homo sapiens
tctgccttcgctgctccctgaa

SEQ ID NO: 7729247 - DNA, 20 bp, Homo sapiens
tctgccttatgaccttcgcc

SEQ ID NO: 7729248 - DNA, 22 bp, Homo sapiens
tctgccttccccataatctgat

SEQ ID NO: 7729249 - DNA, 22 bp, Homo sapiens
tctgccttccccataatctgat

SEQ ID NO: 7729250 - DNA, 22 bp, Homo sapiens
tctgccttagcaattgtcaagg

SEQ ID NO: 7729251 - DNA, 22 bp, Homo sapiens
tctgccttagcaattgtcaagg

SEQ ID NO: 7729252 - DNA, 20 bp, Homo sapiens
tctgccttagggggagcctc

SEQ ID NO: 7729253 - DNA, 22 bp, Homo sapiens
tctgcctgttgagcctaaggcc

SEQ ID NO: 7729254 - DNA, 22 bp, Homo sapiens
tctgcctgttgagcctaaggcc

SEQ ID NO: 7729255 - DNA, 22 bp, Homo sapiens
tctgcctgttcccgattccatg

SEQ ID NO: 7729256 - DNA, 22 bp, Homo sapiens
tctgcctgttcccgattccatg

SEQ ID NO: 7729257 - DNA, 22 bp, Homo sapiens
tctgcctgttcccgattccatg

SEQ ID NO: 7729258 - DNA, 22 bp, Homo sapiens
tctgcctgttgagcctaaggcc

SEQ ID NO: 7729259 - DNA, 22 bp, Homo sapiens
tctgcctgttgctagaatgtca

SEQ ID NO: 7729260 - DNA, 22 bp, Homo sapiens
tctgcctgttgctagaatgtca

SEQ ID NO: 7729261 - DNA, 22 bp, Homo sapiens
tctgcctgttcaagtcttctag

SEQ ID NO: 7729262 - DNA, 22 bp, Homo sapiens
tctgcctgttcaagtcttctag

SEQ ID NO: 7729263 - DNA, 22 bp, Homo sapiens
tctgcctgttcaagtcttctag

SEQ ID NO: 7729264 - DNA, 22 bp, Homo sapiens
tctgcctgttcaagtcttctag

SEQ ID NO: 7729265 - DNA, 22 bp, Homo sapiens
tctgcctgtggtggaggaagtt

SEQ ID NO: 7729266 - DNA, 22 bp, Homo sapiens
tctgcctgtggtggaggaagtt

SEQ ID NO: 7729267 - DNA, 22 bp, Homo sapiens
tctgcctgtggtggaggaagtt

SEQ ID NO: 7729268 - DNA, 22 bp, Homo sapiens
tctgcctgtggatacatgctct

SEQ ID NO: 7729269 - DNA, 22 bp, Homo sapiens
tctgcctgtggatacatgctct

SEQ ID NO: 7729270 - DNA, 22 bp, Homo sapiens
tctgcctgtgctgtgttttcat

SEQ ID NO: 7729271 - DNA, 22 bp, Homo sapiens
tctgcctgtgctgtgttttcat

SEQ ID NO: 7729272 - DNA, 22 bp, Homo sapiens
tctgcctgtctccttgaattgt

SEQ ID NO: 7729273 - DNA, 22 bp, Homo sapiens
tctgcctgtggatacatgctct

SEQ ID NO: 7729274 - DNA, 22 bp, Homo sapiens
tctgcctgtggatacatgctct

SEQ ID NO: 7729275 - DNA, 22 bp, Homo sapiens
tctgccttcttttagtcatctt

SEQ ID NO: 7729276 - DNA, 22 bp, Homo sapiens
tctgccttgaggtcctcagctc

SEQ ID NO: 7729277 - DNA, 22 bp, Homo sapiens
tctgccttgaggtcctcagctc

SEQ ID NO: 7729278 - DNA, 22 bp, Homo sapiens
tctgccttctatcttttgtctg

SEQ ID NO: 7729279 - DNA, 22 bp, Homo sapiens
tctgccttcttttagtcatctt

SEQ ID NO: 7729280 - DNA, 22 bp, Homo sapiens
tctgccttcgctgctccctgaa

SEQ ID NO: 7729281 - DNA, 22 bp, Homo sapiens
tctgccttcgctgctccctgaa

SEQ ID NO: 7729282 - DNA, 22 bp, Homo sapiens
tctgccttctatcttttgtctg

SEQ ID NO: 7729283 - DNA, 22 bp, Homo sapiens
tctgccttcgctgctccctgaa

SEQ ID NO: 7729284 - DNA, 22 bp, Homo sapiens
tctgccttcgctgctccctgaa

SEQ ID NO: 7729285 - DNA, 22 bp, Homo sapiens
tctgccttgatggcattgagaa

SEQ ID NO: 7729286 - DNA, 22 bp, Homo sapiens
tctgccttgatggcattgagaa

SEQ ID NO: 7729287 - DNA, 22 bp, Homo sapiens
tctgccttgaggtcctcagctc

SEQ ID NO: 7729288 - DNA, 22 bp, Homo sapiens
tctgccttgaggtcctcagctc

SEQ ID NO: 7729289 - DNA, 20 bp, Homo sapiens
tctgctcagccctcagtggc

SEQ ID NO: 7729290 - DNA, 22 bp, Homo sapiens
tctgctcagggagggtcactac

SEQ ID NO: 7729291 - DNA, 22 bp, Homo sapiens
tctgctcagccgatctgctccg

SEQ ID NO: 7729292 - DNA, 22 bp, Homo sapiens
tctgctctagttgcttcctgcc

SEQ ID NO: 7729293 - DNA, 22 bp, Homo sapiens
tctgctctagttgcttcctgcc

SEQ ID NO: 7729294 - DNA, 22 bp, Homo sapiens
tctgctctagttgcttcctgcc

SEQ ID NO: 7729295 - DNA, 22 bp, Homo sapiens
tctgctctagttgcttcctgcc

SEQ ID NO: 7729296 - DNA, 22 bp, Homo sapiens
tctgctcaggttacctagctag

SEQ ID NO: 7729297 - DNA, 22 bp, Homo sapiens
tctgctcagtgcttatctctaa

SEQ ID NO: 7729298 - DNA, 22 bp, Homo sapiens
tctgctcaggttacctagctag

SEQ ID NO: 7729299 - DNA, 22 bp, Homo sapiens
tctgccaggtggggagaggcca

SEQ ID NO: 7729300 - DNA, 22 bp, Homo sapiens
tctgccaggtggggagaggcca

SEQ ID NO: 7729301 - DNA, 22 bp, Homo sapiens
tctgccaggtggggagaggcca

SEQ ID NO: 7729302 - DNA, 22 bp, Homo sapiens
tctgccaggtggggagaggcca

SEQ ID NO: 7729303 - DNA, 21 bp, Homo sapiens
tctgccaggttagattgacta

SEQ ID NO: 7729304 - DNA, 21 bp, Homo sapiens
tctgccaggttagattgacta

SEQ ID NO: 7729305 - DNA, 21 bp, Homo sapiens
tctgccaggttagattgacta

SEQ ID NO: 7729306 - DNA, 22 bp, Homo sapiens
tctgccaggttgttatgctact

SEQ ID NO: 7729307 - DNA, 22 bp, Homo sapiens
tctgccagtattcacggcccgt

SEQ ID NO: 7729308 - DNA, 22 bp, Homo sapiens
tctgccagtattcacggcccgt

SEQ ID NO: 7729309 - DNA, 22 bp, Homo sapiens
tctgccagtattcacggcccgt

SEQ ID NO: 7729310 - DNA, 22 bp, Homo sapiens
tctgccagtggtttggccctga

SEQ ID NO: 7729311 - DNA, 22 bp, Homo sapiens
tctgccagtggattcttattct

SEQ ID NO: 7729312 - DNA, 22 bp, Homo sapiens
tctgccagtggtttggccctga

SEQ ID NO: 7729313 - DNA, 23 bp, Homo sapiens
tctgccagtgtgtgccaggagcc

SEQ ID NO: 7729314 - DNA, 22 bp, Homo sapiens
tctgccagtggtttggccctga

SEQ ID NO: 7729315 - DNA, 22 bp, Homo sapiens
tctgccagtgagcggggaatta

SEQ ID NO: 7729316 - DNA, 22 bp, Homo sapiens
tctgccagtgagcggggaatta

SEQ ID NO: 7729317 - DNA, 22 bp, Homo sapiens
tctgccagtgagcggggaatta

SEQ ID NO: 7729318 - DNA, 22 bp, Homo sapiens
tctgccagtgccagagtacata

SEQ ID NO: 7729319 - DNA, 22 bp, Homo sapiens
tctgccagtgccagagtacata

SEQ ID NO: 7729320 - DNA, 22 bp, Homo sapiens
tctgccagtgccagagtacata

SEQ ID NO: 7729321 - DNA, 22 bp, Homo sapiens
tctgccaggcttggtgctagat

SEQ ID NO: 7729322 - DNA, 22 bp, Homo sapiens
tctgccaggcttggtgctagat

SEQ ID NO: 7729323 - DNA, 22 bp, Homo sapiens
tctgccaggcttggtgctagat

SEQ ID NO: 7729324 - DNA, 22 bp, Homo sapiens
tctgccaggcttggtgctagat

SEQ ID NO: 7729325 - DNA, 22 bp, Homo sapiens
tctgccaggcctgcttccgggg

SEQ ID NO: 7729326 - DNA, 22 bp, Homo sapiens
tctgccaggcctgcttccgggg

SEQ ID NO: 7729327 - DNA, 22 bp, Homo sapiens
tctgccaggcctgcttccgggg

SEQ ID NO: 7729328 - DNA, 22 bp, Homo sapiens
tctgccaggcctgcttccgggg

SEQ ID NO: 7729329 - DNA, 16 bp, Homo sapiens
tctgccagggacaggc

SEQ ID NO: 7729330 - DNA, 16 bp, Homo sapiens
tctgccagggacaggc

SEQ ID NO: 7729331 - DNA, 22 bp, Homo sapiens
tctgccaggggcacttgcggct

SEQ ID NO: 7729332 - DNA, 16 bp, Homo sapiens
tctgccagggacaggc

SEQ ID NO: 7729333 - DNA, 22 bp, Homo sapiens
tctgccaggggcacttgcggct

SEQ ID NO: 7729334 - DNA, 22 bp, Homo sapiens
tctgccaggtggggagaggcca

SEQ ID NO: 7729335 - DNA, 22 bp, Homo sapiens
tctgccaggccacacagggcac

SEQ ID NO: 7729336 - DNA, 22 bp, Homo sapiens
tctgccaggccacacagggcac

SEQ ID NO: 7729337 - DNA, 22 bp, Homo sapiens
tctgccaggccacacagggcac

SEQ ID NO: 7729338 - DNA, 22 bp, Homo sapiens
tctgccaccaactgtcactaca

SEQ ID NO: 7729339 - DNA, 22 bp, Homo sapiens
tctgccaccaactgtcactaca

SEQ ID NO: 7729340 - DNA, 22 bp, Homo sapiens
tctgccacatgagggcacagca

SEQ ID NO: 7729341 - DNA, 22 bp, Homo sapiens
tctgccacatgagggcacagca

SEQ ID NO: 7729342 - DNA, 22 bp, Homo sapiens
tctgccacactggttcagtgga

SEQ ID NO: 7729343 - DNA, 23 bp, Homo sapiens
tctgccagttccttgatcatgga

SEQ ID NO: 7729344 - DNA, 23 bp, Homo sapiens
tctgccagttccttgatcatgga

SEQ ID NO: 7729345 - DNA, 23 bp, Homo sapiens
tctgccagttccttgatcatgga

SEQ ID NO: 7729346 - DNA, 22 bp, Homo sapiens
tctgccagtttatagacaagcc

SEQ ID NO: 7729347 - DNA, 22 bp, Homo sapiens
tctgccagtttatagacaagcc

SEQ ID NO: 7729348 - DNA, 22 bp, Homo sapiens
tctgccagtttatagacaagcc

SEQ ID NO: 7729349 - DNA, 22 bp, Homo sapiens
tctgccagtttatagacaagcc

SEQ ID NO: 7729350 - DNA, 17 bp, Homo sapiens
tctgccagttttagaat

SEQ ID NO: 7729351 - DNA, 21 bp, Homo sapiens
tctgccagtttctcttacttt

SEQ ID NO: 7729352 - DNA, 22 bp, Homo sapiens
tctgccatcaagatgctctggc

SEQ ID NO: 7729353 - DNA, 22 bp, Homo sapiens
tctgccatcaagatgctctggc

SEQ ID NO: 7729354 - DNA, 23 bp, Homo sapiens
tctgccagtgtgtgccaggagcc

SEQ ID NO: 7729355 - DNA, 23 bp, Homo sapiens
tctgccagtgtgtgccaggagcc

SEQ ID NO: 7729356 - DNA, 23 bp, Homo sapiens
tctgccagtgtgtgccaggagcc

SEQ ID NO: 7729357 - DNA, 23 bp, Homo sapiens
tctgccagtgtgtgccaggagcc

SEQ ID NO: 7729358 - DNA, 23 bp, Homo sapiens
tctgccagtgtgtgccaggagcc

SEQ ID NO: 7729359 - DNA, 23 bp, Homo sapiens
tctgccagttccttgatcatgga

SEQ ID NO: 7729360 - DNA, 22 bp, Homo sapiens
tctgccagttagaaactggtta

SEQ ID NO: 7729361 - DNA, 22 bp, Homo sapiens
tctgccagttagaaactggtta

SEQ ID NO: 7729362 - DNA, 22 bp, Homo sapiens
tctgccagttagaaactggtta

SEQ ID NO: 7729363 - DNA, 22 bp, Homo sapiens
tctgccagttagaaactggtta

SEQ ID NO: 7729364 - DNA, 23 bp, Homo sapiens
tctgccagtgtgtgccaggagcc

SEQ ID NO: 7729365 - DNA, 22 bp, Homo sapiens
tctgcccaaggctgtcactaga

SEQ ID NO: 7729366 - DNA, 22 bp, Homo sapiens
tctgcccaaggctgtcactaga

SEQ ID NO: 7729367 - DNA, 19 bp, Homo sapiens
tctgcccacaagaaaggga

SEQ ID NO: 7729368 - DNA, 19 bp, Homo sapiens
tctgcccacaagaaaggga

SEQ ID NO: 7729369 - DNA, 19 bp, Homo sapiens
tctgcccacaagaaaggga

SEQ ID NO: 7729370 - DNA, 21 bp, Homo sapiens
tctgcccacactggccactgc

SEQ ID NO: 7729371 - DNA, 21 bp, Homo sapiens
tctgcccacactggccactgc

SEQ ID NO: 7729372 - DNA, 22 bp, Homo sapiens
tctgcccacagcctcctgtcca

SEQ ID NO: 7729373 - DNA, 21 bp, Homo sapiens
tctgcccacactggccactgc

SEQ ID NO: 7729374 - DNA, 21 bp, Homo sapiens
tctgcccacactggccactgc

SEQ ID NO: 7729375 - DNA, 21 bp, Homo sapiens
tctgcccacactggccactgc

SEQ ID NO: 7729376 - DNA, 22 bp, Homo sapiens
tctgccatcttaattctctttt

SEQ ID NO: 7729377 - DNA, 22 bp, Homo sapiens
tctgccatgctaacttcagtat

SEQ ID NO: 7729378 - DNA, 22 bp, Homo sapiens
tctgcccaaggctgtcactaga

SEQ ID NO: 7729379 - DNA, 22 bp, Homo sapiens
tctgcccaaggctgtcactaga

SEQ ID NO: 7729380 - DNA, 22 bp, Homo sapiens
tctgcccaaggctgtcactaga

SEQ ID NO: 7729381 - DNA, 18 bp, Homo sapiens
tctgccatgtgaggacac

SEQ ID NO: 7729382 - DNA, 18 bp, Homo sapiens
tctgccatgtgaggacac

SEQ ID NO: 7729383 - DNA, 18 bp, Homo sapiens
tctgccatgtgaggacac

SEQ ID NO: 7729384 - DNA, 22 bp, Homo sapiens
tctgcaggtgttggaagggtca

SEQ ID NO: 7729385 - DNA, 22 bp, Homo sapiens
tctgcaggtgttggaagggtca

SEQ ID NO: 7729386 - DNA, 22 bp, Homo sapiens
tctgcaggtgttggaagggtca

SEQ ID NO: 7729387 - DNA, 22 bp, Homo sapiens
tctgcaggtgttggaagggtca

SEQ ID NO: 7729388 - DNA, 22 bp, Homo sapiens
tctgcatattgttaatggaatg

SEQ ID NO: 7729389 - DNA, 22 bp, Homo sapiens
tctgcatattgttaatggaatg

SEQ ID NO: 7729390 - DNA, 22 bp, Homo sapiens
tctgcatattgttaatggaatg

SEQ ID NO: 7729391 - DNA, 22 bp, Homo sapiens
tctgcatatttatcatgagtct

SEQ ID NO: 7729392 - DNA, 22 bp, Homo sapiens
tctgcatatttatcatgagtct

SEQ ID NO: 7729393 - DNA, 22 bp, Homo sapiens
tctgcatatttatcatgagtct

SEQ ID NO: 7729394 - DNA, 22 bp, Homo sapiens
tctgcaggtcacgctccagcct

SEQ ID NO: 7729395 - DNA, 22 bp, Homo sapiens
tctgcaggtcacgctccagcct

SEQ ID NO: 7729396 - DNA, 22 bp, Homo sapiens
tctgcaggtcacgctccagcct

SEQ ID NO: 7729397 - DNA, 22 bp, Homo sapiens
tctgcaggtcacgctccagcct

SEQ ID NO: 7729398 - DNA, 22 bp, Homo sapiens
tctgcaggtcacgctccagcct

SEQ ID NO: 7729399 - DNA, 22 bp, Homo sapiens
tctgcaggtagagctcaggaat

SEQ ID NO: 7729400 - DNA, 22 bp, Homo sapiens
tctgcaggtagagctcaggaat

SEQ ID NO: 7729401 - DNA, 22 bp, Homo sapiens
tctgcaggtcacgctccagcct

SEQ ID NO: 7729402 - DNA, 22 bp, Homo sapiens
tctgcaggtgggcccctagaat

SEQ ID NO: 7729403 - DNA, 22 bp, Homo sapiens
tctgcaggtgggcccctagaat

SEQ ID NO: 7729404 - DNA, 22 bp, Homo sapiens
tctgcaggtgggcccctagaat

SEQ ID NO: 7729405 - DNA, 22 bp, Homo sapiens
tctgcatgatgaacaaatgagc

SEQ ID NO: 7729406 - DNA, 22 bp, Homo sapiens
tctgcatgatgaacaaatgagc

SEQ ID NO: 7729407 - DNA, 22 bp, Homo sapiens
tctgcatcttcaatagccttcc

SEQ ID NO: 7729408 - DNA, 22 bp, Homo sapiens
tctgcatctgtgttgagtgccc

SEQ ID NO: 7729409 - DNA, 22 bp, Homo sapiens
tctgcatctgtgttgagtgccc

SEQ ID NO: 7729410 - DNA, 22 bp, Homo sapiens
tctgcatctcttataaatgatg

SEQ ID NO: 7729411 - DNA, 22 bp, Homo sapiens
tctgcatctgtgttgagtgccc

SEQ ID NO: 7729412 - DNA, 22 bp, Homo sapiens
tctgcatcttctgcacatgcca

SEQ ID NO: 7729413 - DNA, 22 bp, Homo sapiens
tctgcatcgaagggcttttggt

SEQ ID NO: 7729414 - DNA, 22 bp, Homo sapiens
tctgcatctcaggattcccttc

SEQ ID NO: 7729415 - DNA, 22 bp, Homo sapiens
tctgcatccgaacccgccaccg

SEQ ID NO: 7729416 - DNA, 22 bp, Homo sapiens
tctgcatcatttttcagagccg

SEQ ID NO: 7729417 - DNA, 22 bp, Homo sapiens
tctgcatccctcattgaacggc

SEQ ID NO: 7729418 - DNA, 22 bp, Homo sapiens
tctgcatcaggagaggcgggca

SEQ ID NO: 7729419 - DNA, 22 bp, Homo sapiens
tctgcatcatgatgtttgcaag

SEQ ID NO: 7729420 - DNA, 19 bp, Homo sapiens
tctgcatggcaggaagaga

SEQ ID NO: 7729421 - DNA, 22 bp, Homo sapiens
tctgcatggagaggagatgcta

SEQ ID NO: 7729422 - DNA, 19 bp, Homo sapiens
tctgcatggcaggaagaga

SEQ ID NO: 7729423 - DNA, 22 bp, Homo sapiens
tctgcattattggaaagtcctt

SEQ ID NO: 7729424 - DNA, 22 bp, Homo sapiens
tctgcattgtcccagaagtgac

SEQ ID NO: 7729425 - DNA, 22 bp, Homo sapiens
tctgcatttttaacaagatccc

SEQ ID NO: 7729426 - DNA, 22 bp, Homo sapiens
tctgcatttttaacaagatccc

SEQ ID NO: 7729427 - DNA, 22 bp, Homo sapiens
tctgcatttttacaagatcccc

SEQ ID NO: 7729428 - DNA, 21 bp, Homo sapiens
tctgcattttagcaagatctc

SEQ ID NO: 7729429 - DNA, 21 bp, Homo sapiens
tctgcattttagcaagatctc

SEQ ID NO: 7729430 - DNA, 22 bp, Homo sapiens
tctgcaggtagagctcaggaat

SEQ ID NO: 7729431 - DNA, 22 bp, Homo sapiens
tctgcaggtaagcgttcttgga

SEQ ID NO: 7729432 - DNA, 22 bp, Homo sapiens
tctgcagggtcccagcctcagc

SEQ ID NO: 7729433 - DNA, 22 bp, Homo sapiens
tctgcagggtcccagcctcagc

SEQ ID NO: 7729434 - DNA, 22 bp, Homo sapiens
tctgcagggcccttggctcctg

SEQ ID NO: 7729435 - DNA, 22 bp, Homo sapiens
tctgcagggcccttggctcctg

SEQ ID NO: 7729436 - DNA, 22 bp, Homo sapiens
tctgcagggatgtgaggggtga

SEQ ID NO: 7729437 - DNA, 22 bp, Homo sapiens
tctgcagggatgtgaggggtga

SEQ ID NO: 7729438 - DNA, 17 bp, Homo sapiens
tctgcagggggccgtgt

SEQ ID NO: 7729439 - DNA, 17 bp, Homo sapiens
tctgcagggggccgtgt

SEQ ID NO: 7729440 - DNA, 22 bp, Homo sapiens
tctgcaggcttataggatgggt

SEQ ID NO: 7729441 - DNA, 22 bp, Homo sapiens
tctgcaggcttataggatgggt

SEQ ID NO: 7729442 - DNA, 22 bp, Homo sapiens
tctgcaggcttataggatgggt

SEQ ID NO: 7729443 - DNA, 22 bp, Homo sapiens
tctgcaggctgtacaggaagca

SEQ ID NO: 7729444 - DNA, 22 bp, Homo sapiens
tctgcaggctctagatgaggtt

SEQ ID NO: 7729445 - DNA, 22 bp, Homo sapiens
tctgcaggctctagatgaggtt

SEQ ID NO: 7729446 - DNA, 22 bp, Homo sapiens
tctgcaggctgtacaggaagca

SEQ ID NO: 7729447 - DNA, 22 bp, Homo sapiens
tctgcaggctgtacaggaagca

SEQ ID NO: 7729448 - DNA, 22 bp, Homo sapiens
tctgcaggctgtacaggaagca

SEQ ID NO: 7729449 - DNA, 22 bp, Homo sapiens
tctgcaggctctagatgaggtt

SEQ ID NO: 7729450 - DNA, 22 bp, Homo sapiens
tctgcaggcttggagtggcagc

SEQ ID NO: 7729451 - DNA, 22 bp, Homo sapiens
tctgcaggcttggagtggcagc

SEQ ID NO: 7729452 - DNA, 22 bp, Homo sapiens
tctgcagggatgtgaggggtga

SEQ ID NO: 7729453 - DNA, 22 bp, Homo sapiens
tctgcagggatgtgaggggtga

SEQ ID NO: 7729454 - DNA, 22 bp, Homo sapiens
tctgcaggcttggagtggcagc

SEQ ID NO: 7729455 - DNA, 22 bp, Homo sapiens
tctgcaggcttataggatgggt

SEQ ID NO: 7729456 - DNA, 22 bp, Homo sapiens
tctgcaggcttggagtggcagc

SEQ ID NO: 7729457 - DNA, 22 bp, Homo sapiens
tctgcaggcctcgacaaggcca

SEQ ID NO: 7729458 - DNA, 22 bp, Homo sapiens
tctgcaggctctagatgaggtt

SEQ ID NO: 7729459 - DNA, 22 bp, Homo sapiens
tctgcaggctctagatgaggtt

SEQ ID NO: 7729460 - DNA, 22 bp, Homo sapiens
tctgcaggctctagatgaggtt

SEQ ID NO: 7729461 - DNA, 22 bp, Homo sapiens
tctgcaggctctagatgaggtt

SEQ ID NO: 7729462 - DNA, 22 bp, Homo sapiens
tctgcaggctctagatgaggtt

SEQ ID NO: 7729463 - DNA, 22 bp, Homo sapiens
tctgcaggcctcgacaaggcca

SEQ ID NO: 7729464 - DNA, 22 bp, Homo sapiens
tctgcaggatgcaaagtgtaca

SEQ ID NO: 7729465 - DNA, 22 bp, Homo sapiens
tctgcaggatggatgctcagaa

SEQ ID NO: 7729466 - DNA, 22 bp, Homo sapiens
tctgcaggatggatgctcagaa

SEQ ID NO: 7729467 - DNA, 22 bp, Homo sapiens
tctgcaggatggatgctcagaa

SEQ ID NO: 7729468 - DNA, 22 bp, Homo sapiens
tctgcaggatgcaaagtgtaca

SEQ ID NO: 7729469 - DNA, 22 bp, Homo sapiens
tctgcaggcatttttggttgtc

SEQ ID NO: 7729470 - DNA, 22 bp, Homo sapiens
tctgcaggatggatgctcagaa

SEQ ID NO: 7729471 - DNA, 22 bp, Homo sapiens
tctgcaggatggatgctcagaa

SEQ ID NO: 7729472 - DNA, 22 bp, Homo sapiens
tctgcaggatcagagccagagg

SEQ ID NO: 7729473 - DNA, 22 bp, Homo sapiens
tctgcaggatcagagccagagg

SEQ ID NO: 7729474 - DNA, 22 bp, Homo sapiens
tctgcaggatcagagccagagg

SEQ ID NO: 7729475 - DNA, 22 bp, Homo sapiens
tctgcaggatcagagccagagg

SEQ ID NO: 7729476 - DNA, 22 bp, Homo sapiens
tctgcaggatcagagccagagg

SEQ ID NO: 7729477 - DNA, 22 bp, Homo sapiens
tctgcaggaggctggctgcagg

SEQ ID NO: 7729478 - DNA, 22 bp, Homo sapiens
tctgcaggagcagggcgtggag

SEQ ID NO: 7729479 - DNA, 22 bp, Homo sapiens
tctgcaggagcagggcgtggag

SEQ ID NO: 7729480 - DNA, 22 bp, Homo sapiens
tctgcaggagcagggcgtggag

SEQ ID NO: 7729481 - DNA, 22 bp, Homo sapiens
tctgcaggagagtgccctagag

SEQ ID NO: 7729482 - DNA, 22 bp, Homo sapiens
tctgcaggagcagggcgtggag

SEQ ID NO: 7729483 - DNA, 22 bp, Homo sapiens
tctgcaggaggctggctgcagg

SEQ ID NO: 7729484 - DNA, 22 bp, Homo sapiens
tctgcaggaggctggctgcagg

SEQ ID NO: 7729485 - DNA, 22 bp, Homo sapiens
tctgcaggaggctggctgcagg

SEQ ID NO: 7729486 - DNA, 22 bp, Homo sapiens
tctgcaggactgaggcctgttt

SEQ ID NO: 7729487 - DNA, 22 bp, Homo sapiens
tctgcaggactgaggcctgttt

SEQ ID NO: 7729488 - DNA, 22 bp, Homo sapiens
tctgcaggagagtgccctagag

SEQ ID NO: 7729489 - DNA, 22 bp, Homo sapiens
tctgcaggagagtgccctagag

SEQ ID NO: 7729490 - DNA, 22 bp, Homo sapiens
tctgcaggagagtgccctagag

SEQ ID NO: 7729491 - DNA, 18 bp, Homo sapiens
tctgcaggacctcagggc

SEQ ID NO: 7729492 - DNA, 18 bp, Homo sapiens
tctgcaggacctcagggc

SEQ ID NO: 7729493 - DNA, 18 bp, Homo sapiens
tctgcaggacctcagggc

SEQ ID NO: 7729494 - DNA, 22 bp, Homo sapiens
tctgcaggaagctggcggctga

SEQ ID NO: 7729495 - DNA, 22 bp, Homo sapiens
tctgcaggaaaaaagtgcctgg

SEQ ID NO: 7729496 - DNA, 22 bp, Homo sapiens
tctgcagctttttggtggggtg

SEQ ID NO: 7729497 - DNA, 22 bp, Homo sapiens
tctgcagctttttggtggggtg

SEQ ID NO: 7729498 - DNA, 22 bp, Homo sapiens
tctgcaggaaaaaagtgcctgg

SEQ ID NO: 7729499 - DNA, 22 bp, Homo sapiens
tctgcaggaaaaaagtgcctgg

SEQ ID NO: 7729500 - DNA, 22 bp, Homo sapiens
tctgcaggaaaaaagtgcctgg

SEQ ID NO: 7729501 - DNA, 22 bp, Homo sapiens
tctgcagctttttggtggggtg

SEQ ID NO: 7729502 - DNA, 22 bp, Homo sapiens
tctgcagctttcccctgattta

SEQ ID NO: 7729503 - DNA, 22 bp, Homo sapiens
tctgcagcttgcacaggcaggc

SEQ ID NO: 7729504 - DNA, 22 bp, Homo sapiens
tctgcagctttcccctgattta

SEQ ID NO: 7729505 - DNA, 22 bp, Homo sapiens
tctgcagctttcccctgattta

SEQ ID NO: 7729506 - DNA, 22 bp, Homo sapiens
tctgcagcttgcacaggcaggc

SEQ ID NO: 7729507 - DNA, 22 bp, Homo sapiens
tctgcagcttgcacaggcaggc

SEQ ID NO: 7729508 - DNA, 22 bp, Homo sapiens
tctgcagcttcttgccagagag

SEQ ID NO: 7729509 - DNA, 22 bp, Homo sapiens
tctgcagcttcttgccagagag

SEQ ID NO: 7729510 - DNA, 22 bp, Homo sapiens
tctgcagcttactttcacatga

SEQ ID NO: 7729511 - DNA, 22 bp, Homo sapiens
tctgcagcttactttcacatga

SEQ ID NO: 7729512 - DNA, 22 bp, Homo sapiens
tctgcagcttactttcacatga

SEQ ID NO: 7729513 - DNA, 22 bp, Homo sapiens
tctgcagcttactttcacatga

SEQ ID NO: 7729514 - DNA, 22 bp, Homo sapiens
tctgcagcttactttcacatga

SEQ ID NO: 7729515 - DNA, 22 bp, Homo sapiens
tctgcagcttactttcacatga

SEQ ID NO: 7729516 - DNA, 22 bp, Homo sapiens
tctgcagcaacctttcacctcc

SEQ ID NO: 7729517 - DNA, 22 bp, Homo sapiens
tctgcagcacttaatgtttcgt

SEQ ID NO: 7729518 - DNA, 22 bp, Homo sapiens
tctgcagcaacctttcacctcc

SEQ ID NO: 7729519 - DNA, 22 bp, Homo sapiens
tctgcagcaacctttcacctcc

SEQ ID NO: 7729520 - DNA, 20 bp, Homo sapiens
tctgcagcacttgacaatgt

SEQ ID NO: 7729521 - DNA, 22 bp, Homo sapiens
tctgcagccagaggcatgaaaa

SEQ ID NO: 7729522 - DNA, 22 bp, Homo sapiens
tctgcagccagaggcatgaaaa

SEQ ID NO: 7729523 - DNA, 22 bp, Homo sapiens
tctgcagcccaaagtctcttag

SEQ ID NO: 7729524 - DNA, 22 bp, Homo sapiens
tctgcagcccaaagtctcttag

SEQ ID NO: 7729525 - DNA, 22 bp, Homo sapiens
tctgcagcccaaagtctcttag

SEQ ID NO: 7729526 - DNA, 22 bp, Homo sapiens
tctgcagcgtgcaggctggtgc

SEQ ID NO: 7729527 - DNA, 22 bp, Homo sapiens
tctgcagcgtgcaggctggtgc

SEQ ID NO: 7729528 - DNA, 22 bp, Homo sapiens
tctgcagcgtgcaggctggtgc

SEQ ID NO: 7729529 - DNA, 22 bp, Homo sapiens
tctgcagcgtgcaggctggtgc

SEQ ID NO: 7729530 - DNA, 22 bp, Homo sapiens
tctgcagaactttatgagcaaa

SEQ ID NO: 7729531 - DNA, 22 bp, Homo sapiens
tctgcagaactttatgagcaaa

SEQ ID NO: 7729532 - DNA, 22 bp, Homo sapiens
tctgcagaactttatgagcaaa

SEQ ID NO: 7729533 - DNA, 22 bp, Homo sapiens
tctgcagaaagtggctcagtgg

SEQ ID NO: 7729534 - DNA, 22 bp, Homo sapiens
tctgcagaaagtggctcagtgg

SEQ ID NO: 7729535 - DNA, 22 bp, Homo sapiens
tctgcagaaagtggctcagtgg

SEQ ID NO: 7729536 - DNA, 22 bp, Homo sapiens
tctgcagaagaattaaggacag

SEQ ID NO: 7729537 - DNA, 22 bp, Homo sapiens
tctgcagaagaattaaggacag

SEQ ID NO: 7729538 - DNA, 22 bp, Homo sapiens
tctgcagaagaattaaggacag

SEQ ID NO: 7729539 - DNA, 22 bp, Homo sapiens
tctgcagaagaattaaggacag

SEQ ID NO: 7729540 - DNA, 22 bp, Homo sapiens
tctgcagaactttatgagcaaa

SEQ ID NO: 7729541 - DNA, 22 bp, Homo sapiens
tctgcaccctgtggtcctctag

SEQ ID NO: 7729542 - DNA, 22 bp, Homo sapiens
tctgcaccctgacctctgtttc

SEQ ID NO: 7729543 - DNA, 21 bp, Homo sapiens
tctgcaccccagcctgagtga

SEQ ID NO: 7729544 - DNA, 22 bp, Homo sapiens
tctgcaccccgcagggtcaggt

SEQ ID NO: 7729545 - DNA, 18 bp, Homo sapiens
tctgcactcctgagagag

SEQ ID NO: 7729546 - DNA, 18 bp, Homo sapiens
tctgcactcctgagagag

SEQ ID NO: 7729547 - DNA, 18 bp, Homo sapiens
tctgcactcctgagagag

SEQ ID NO: 7729548 - DNA, 18 bp, Homo sapiens
tctgcactcctgagagag

SEQ ID NO: 7729549 - DNA, 22 bp, Homo sapiens
tctgcagaaactgtgactatgt

SEQ ID NO: 7729550 - DNA, 22 bp, Homo sapiens
tctgcagaaactgtgactatgt

SEQ ID NO: 7729551 - DNA, 22 bp, Homo sapiens
tctgcagaaactgtgactatgt

SEQ ID NO: 7729552 - DNA, 22 bp, Homo sapiens
tctgcagaaactgtgactatgt

SEQ ID NO: 7729553 - DNA, 22 bp, Homo sapiens
tctgcagaaactgtgactatgt

SEQ ID NO: 7729554 - DNA, 22 bp, Homo sapiens
tctgcactcctgtttcacctgg

SEQ ID NO: 7729555 - DNA, 22 bp, Homo sapiens
tctgcactcctgtttcacctgg

SEQ ID NO: 7729556 - DNA, 22 bp, Homo sapiens
tctgcactcctgtttcacctgg

SEQ ID NO: 7729557 - DNA, 22 bp, Homo sapiens
tctgcactgggagcatgtctgg

SEQ ID NO: 7729558 - DNA, 22 bp, Homo sapiens
tctgcactgggagcatgtctgg

SEQ ID NO: 7729559 - DNA, 22 bp, Homo sapiens
tctgcacagattctctgagaat

SEQ ID NO: 7729560 - DNA, 22 bp, Homo sapiens
tctgcacataggtaggctggaa

SEQ ID NO: 7729561 - DNA, 22 bp, Homo sapiens
tctgcacatcccccaaagtatt

SEQ ID NO: 7729562 - DNA, 22 bp, Homo sapiens
tctgcacaggcgtaggttgact

SEQ ID NO: 7729563 - DNA, 21 bp, Homo sapiens
tctgcaccccagcctgagtga

SEQ ID NO: 7729564 - DNA, 22 bp, Homo sapiens
tctgcacattttaccaatactc

SEQ ID NO: 7729565 - DNA, 22 bp, Homo sapiens
tctgcacatggcgctggtcctg

SEQ ID NO: 7729566 - DNA, 22 bp, Homo sapiens
tctgcacatcccccaaagtatt

SEQ ID NO: 7729567 - DNA, 22 bp, Homo sapiens
tctgcacatggcgctggtcctg

SEQ ID NO: 7729568 - DNA, 22 bp, Homo sapiens
tctgcacatggcgctggtcctg

SEQ ID NO: 7729569 - DNA, 22 bp, Homo sapiens
tctgcacatgtagtaaatatta

SEQ ID NO: 7729570 - DNA, 22 bp, Homo sapiens
tctgcacatgtagtaaatatta

SEQ ID NO: 7729571 - DNA, 22 bp, Homo sapiens
tctgcacatgtagtaaatatta

SEQ ID NO: 7729572 - DNA, 22 bp, Homo sapiens
tctgcacaccgccaggctgact

SEQ ID NO: 7729573 - DNA, 22 bp, Homo sapiens
tctgcacacttttattgacctc

SEQ ID NO: 7729574 - DNA, 22 bp, Homo sapiens
tctgcacagagacccttgccag

SEQ ID NO: 7729575 - DNA, 22 bp, Homo sapiens
tctgcacagattctctgagaat

SEQ ID NO: 7729576 - DNA, 22 bp, Homo sapiens
tctgcacaaaactgtcgcagaa

SEQ ID NO: 7729577 - DNA, 22 bp, Homo sapiens
tctgcacaaaactgtcgcagaa

SEQ ID NO: 7729578 - DNA, 22 bp, Homo sapiens
tctgcacacaatttatctttct

SEQ ID NO: 7729579 - DNA, 22 bp, Homo sapiens
tctgcaagtagatgacagtgag

SEQ ID NO: 7729580 - DNA, 22 bp, Homo sapiens
tctgcaagtagatgacagtgag

SEQ ID NO: 7729581 - DNA, 22 bp, Homo sapiens
tctgcaagctcagttctgactt

SEQ ID NO: 7729582 - DNA, 22 bp, Homo sapiens
tctgcaagggcacagccaaccc

SEQ ID NO: 7729583 - DNA, 22 bp, Homo sapiens
tctgcaaggggttctttaggcc

SEQ ID NO: 7729584 - DNA, 22 bp, Homo sapiens
tctgcaagtttatcacttggga

SEQ ID NO: 7729585 - DNA, 19 bp, Homo sapiens
tctgcaagtgtcagaggcg

SEQ ID NO: 7729586 - DNA, 22 bp, Homo sapiens
tctgcaagtgacccgggcccag

SEQ ID NO: 7729587 - DNA, 19 bp, Homo sapiens
tctgcaagtgtcagaggcg

SEQ ID NO: 7729588 - DNA, 22 bp, Homo sapiens
ttccaggaaaacagttggaagt

SEQ ID NO: 7729589 - DNA, 22 bp, Homo sapiens
ttccaggaacaaactcacctta

SEQ ID NO: 7729590 - DNA, 22 bp, Homo sapiens
ttccaggaacaaactcacctta

SEQ ID NO: 7729591 - DNA, 22 bp, Homo sapiens
ttccaggaacaaactcacctta

SEQ ID NO: 7729592 - DNA, 22 bp, Homo sapiens
ttccaggaacaaactcacctta

SEQ ID NO: 7729593 - DNA, 22 bp, Homo sapiens
ttccaggaacaaactcacctta

SEQ ID NO: 7729594 - DNA, 22 bp, Homo sapiens
aacatacatatttcagtgtcca

SEQ ID NO: 7729595 - DNA, 22 bp, Homo sapiens
aacatataaactcttaagttca

SEQ ID NO: 7729596 - DNA, 22 bp, Homo sapiens
aaagattatggcattgaaatac

SEQ ID NO: 7729597 - DNA, 22 bp, Homo sapiens
aagattatttaagacaggaacc

SEQ ID NO: 7729598 - DNA, 22 bp, Homo sapiens
aagattatggcagataacaatt

SEQ ID NO: 7729599 - DNA, 22 bp, Homo sapiens
aagataaactcttgatttctga

SEQ ID NO: 7729600 - DNA, 22 bp, Homo sapiens
aaatactagaattcagagttga

SEQ ID NO: 7729601 - DNA, 20 bp, Homo sapiens
aaacattcatgtacaagtga

SEQ ID NO: 7729602 - DNA, 22 bp, Homo sapiens
aaaactaaatacgctttgcctc

SEQ ID NO: 7729603 - DNA, 22 bp, Homo sapiens
aaaattattcatggcttttgga

SEQ ID NO: 7729604 - DNA, 22 bp, Homo sapiens
aaaattatggagtatcccaaag

SEQ ID NO: 7729605 - DNA, 22 bp, Homo sapiens
aaaattatagatctagtgcctg

SEQ ID NO: 7729606 - DNA, 22 bp, Homo sapiens
aaattattctcatgtgtttctt

SEQ ID NO: 7729607 - DNA, 22 bp, Homo sapiens
aacatctactaagtgccaggca

SEQ ID NO: 7729608 - DNA, 22 bp, Homo sapiens
aagtgtatatatgacttataaa

SEQ ID NO: 7729609 - DNA, 22 bp, Homo sapiens
aactttcttggatgtctcaaca

SEQ ID NO: 7729610 - DNA, 22 bp, Homo sapiens
aatttccagaccccatccacag

SEQ ID NO: 7729611 - DNA, 22 bp, Homo sapiens
aatttccaaatttctgtcacac

SEQ ID NO: 7729612 - DNA, 22 bp, Homo sapiens
aatttccagatcagatgactca

SEQ ID NO: 7729613 - DNA, 22 bp, Homo sapiens
aagcaatatactgatatgatta

SEQ ID NO: 7729614 - DNA, 22 bp, Homo sapiens
acacatatatacatatttgtgc

SEQ ID NO: 7729615 - DNA, 22 bp, Homo sapiens
aagcaatagcaacaactttaca

SEQ ID NO: 7729616 - DNA, 22 bp, Homo sapiens
acattgtttgagaatacagatg

SEQ ID NO: 7729617 - DNA, 23 bp, Homo sapiens
actataaagttgttctgatttac

SEQ ID NO: 7729618 - DNA, 23 bp, Homo sapiens
aatgatttcatgatgatagcagc

SEQ ID NO: 7729619 - DNA, 22 bp, Homo sapiens
aatgatttcccctacacagaag

SEQ ID NO: 7729620 - DNA, 22 bp, Homo sapiens
acaagcatgggctttgacatca

SEQ ID NO: 7729621 - DNA, 22 bp, Homo sapiens
acagatgtacactcatatataa

SEQ ID NO: 7729622 - DNA, 22 bp, Homo sapiens
acagttatctttgaaatagaga

SEQ ID NO: 7729623 - DNA, 22 bp, Homo sapiens
acatgattttagtatcataata

SEQ ID NO: 7729624 - DNA, 22 bp, Homo sapiens
acttcatgcagaagagagctgt

SEQ ID NO: 7729625 - DNA, 22 bp, Homo sapiens
atatatttgagaatattcatga

SEQ ID NO: 7729626 - DNA, 22 bp, Homo sapiens
atcatttccctttagatcacaa

SEQ ID NO: 7729627 - DNA, 23 bp, Homo sapiens
atcattctccaatctggagcagg

SEQ ID NO: 7729628 - DNA, 21 bp, Homo sapiens
atcattctggaaaattcaagc

SEQ ID NO: 7729629 - DNA, 22 bp, Homo sapiens
atcattctgatggtcaatgcta

SEQ ID NO: 7729630 - DNA, 22 bp, Homo sapiens
atcacaaaggctgcttcatgat

SEQ ID NO: 7729631 - DNA, 22 bp, Homo sapiens
agccttgttggtctgagtttgg

SEQ ID NO: 7729632 - DNA, 22 bp, Homo sapiens
caaatgatactgtttttagtct

SEQ ID NO: 7729633 - DNA, 22 bp, Homo sapiens
caaatgatagagccgattatca

SEQ ID NO: 7729634 - DNA, 22 bp, Homo sapiens
agcagcattatgatatatctta

SEQ ID NO: 7729635 - DNA, 22 bp, Homo sapiens
attcttcatacagacaagtcct

SEQ ID NO: 7729636 - DNA, 22 bp, Homo sapiens
attcttcatcactaccttgtga

SEQ ID NO: 7729637 - DNA, 22 bp, Homo sapiens
attcttcatacctactgaggtt

SEQ ID NO: 7729638 - DNA, 22 bp, Homo sapiens
attcttcattgttgattcatgt

SEQ ID NO: 7729639 - DNA, 23 bp, Homo sapiens
attcttcattatcttctagaaaa

SEQ ID NO: 7729640 - DNA, 22 bp, Homo sapiens
attcttcatcagagatgcacta

SEQ ID NO: 7729641 - DNA, 22 bp, Homo sapiens
attcttcatttactgttacttg

SEQ ID NO: 7729642 - DNA, 22 bp, Homo sapiens
atttgctttcaggtataaaagg

SEQ ID NO: 7729643 - DNA, 22 bp, Homo sapiens
atttgctttaaggtataaaagg

SEQ ID NO: 7729644 - DNA, 22 bp, Homo sapiens
atttgcttgtgctatgaaagtt

SEQ ID NO: 7729645 - DNA, 22 bp, Homo sapiens
atttgcttatctccacagttgt

SEQ ID NO: 7729646 - DNA, 22 bp, Homo sapiens
atttgcttctgtgaaatcaagt

SEQ ID NO: 7729647 - DNA, 22 bp, Homo sapiens
atttcattgaagttaattcttc

SEQ ID NO: 7729648 - DNA, 22 bp, Homo sapiens
atgtgtctttgagactctgcta

SEQ ID NO: 7729649 - DNA, 22 bp, Homo sapiens
atggagttctttaaattcacag

SEQ ID NO: 7729650 - DNA, 22 bp, Homo sapiens
cagcttctgtctgattagcaag

SEQ ID NO: 7729651 - DNA, 22 bp, Homo sapiens
ccatgagcttcctatatagggt

SEQ ID NO: 7729652 - DNA, 22 bp, Homo sapiens
ccatgagcttcaactgacacag

SEQ ID NO: 7729653 - DNA, 22 bp, Homo sapiens
ccatgagccaggctgaggaagc

SEQ ID NO: 7729654 - DNA, 22 bp, Homo sapiens
ctcagtgtgaatgctcagtaaa

SEQ ID NO: 7729655 - DNA, 22 bp, Homo sapiens
ctcttcttggcccccatgaggg

SEQ ID NO: 7729656 - DNA, 22 bp, Homo sapiens
ctcttagtaatgccatgaagca

SEQ ID NO: 7729657 - DNA, 22 bp, Homo sapiens
ctcttctttagtccagaccatc

SEQ ID NO: 7729658 - DNA, 22 bp, Homo sapiens
ctcttcttgtctctggttagaa

SEQ ID NO: 7729659 - DNA, 22 bp, Homo sapiens
atactttctgaccaattaattg

SEQ ID NO: 7729660 - DNA, 22 bp, Homo sapiens
atacaactttatctgtaatgag

SEQ ID NO: 7729661 - DNA, 22 bp, Homo sapiens
ataaatatcactgttgtccctc

SEQ ID NO: 7729662 - DNA, 20 bp, Homo sapiens
ataaaataactgccacaaga

SEQ ID NO: 7729663 - DNA, 22 bp, Homo sapiens
agtttgaaatgttggcaatatt

SEQ ID NO: 7729664 - DNA, 22 bp, Homo sapiens
agtttgaattgaaatgcagatg

SEQ ID NO: 7729665 - DNA, 22 bp, Homo sapiens
agtttgaaagtattgacagaag

SEQ ID NO: 7729666 - DNA, 22 bp, Homo sapiens
atcattctagtccttatggtct

SEQ ID NO: 7729667 - DNA, 22 bp, Homo sapiens
atcattctattgttgagctgcc

SEQ ID NO: 7729668 - DNA, 22 bp, Homo sapiens
ctgggtaagttcctaaggctca

SEQ ID NO: 7729669 - DNA, 22 bp, Homo sapiens
atataatacaacctgctaagtg

SEQ ID NO: 7729670 - DNA, 20 bp, Homo sapiens
gtaaaatatggtctttgggt

SEQ ID NO: 7729671 - DNA, 22 bp, Homo sapiens
cactgagctgatagaattccag

SEQ ID NO: 7729672 - DNA, 22 bp, Homo sapiens
ggatgttgattgaatggccatt

SEQ ID NO: 7729673 - DNA, 22 bp, Homo sapiens
caagatgtgcctaatcagacct

SEQ ID NO: 7729674 - DNA, 22 bp, Homo sapiens
cacaatttccttgcttcacttt

SEQ ID NO: 7729675 - DNA, 22 bp, Homo sapiens
cacaatttgttttatcagtatt

SEQ ID NO: 7729676 - DNA, 22 bp, Homo sapiens
cacaatgtatatgtatatcaaa

SEQ ID NO: 7729677 - DNA, 22 bp, Homo sapiens
cacaatgtggtttgtcatcttt

SEQ ID NO: 7729678 - DNA, 20 bp, Homo sapiens
atcttcttggccagcttgct

SEQ ID NO: 7729679 - DNA, 22 bp, Homo sapiens
atctacccactgaacacaatat

SEQ ID NO: 7729680 - DNA, 23 bp, Homo sapiens
atttctaggggattttctggtgc

SEQ ID NO: 7729681 - DNA, 21 bp, Homo sapiens
atttcagagcacacaagtaaa

SEQ ID NO: 7729682 - DNA, 22 bp, Homo sapiens
atttcagattcagaaatgtagg

SEQ ID NO: 7729683 - DNA, 22 bp, Homo sapiens
atttcagatgaccaaatggaaa

SEQ ID NO: 7729684 - DNA, 22 bp, Homo sapiens
attaaaattccaaggtatgcca

SEQ ID NO: 7729685 - DNA, 22 bp, Homo sapiens
attattcttatgtcatcatggc

SEQ ID NO: 7729686 - DNA, 22 bp, Homo sapiens
attcttcagaatatctggcact

SEQ ID NO: 7729687 - DNA, 22 bp, Homo sapiens
attcttcagcaggggacactat

SEQ ID NO: 7729688 - DNA, 22 bp, Homo sapiens
attcttaattgccatgctgtat

SEQ ID NO: 7729689 - DNA, 22 bp, Homo sapiens
attcttattatagtaaaacagt

SEQ ID NO: 7729690 - DNA, 22 bp, Homo sapiens
attcttcacacctgttcctgtt

SEQ ID NO: 7729691 - DNA, 22 bp, Homo sapiens
attcttcacaaatatatagaag

SEQ ID NO: 7729692 - DNA, 22 bp, Homo sapiens
attcttatttaaatagagtctg

SEQ ID NO: 7729693 - DNA, 22 bp, Homo sapiens
attcttcaaagagtgtcaaagt

SEQ ID NO: 7729694 - DNA, 22 bp, Homo sapiens
attcttcactgtttcagaatga

SEQ ID NO: 7729695 - DNA, 22 bp, Homo sapiens
attcttcacctgagtcagtcta

SEQ ID NO: 7729696 - DNA, 22 bp, Homo sapiens
attcttcacatggataggatct

SEQ ID NO: 7729697 - DNA, 22 bp, Homo sapiens
attcttcacataagtgctgtac

SEQ ID NO: 7729698 - DNA, 22 bp, Homo sapiens
attcttcaccatggataatttg

SEQ ID NO: 7729699 - DNA, 22 bp, Homo sapiens
tcagttctttatttcacagtga

SEQ ID NO: 7729700 - DNA, 22 bp, Homo sapiens
tcagttctgctagaaaaacagt

SEQ ID NO: 7729701 - DNA, 22 bp, Homo sapiens
tcatttcaatgatactactaag

SEQ ID NO: 7729702 - DNA, 22 bp, Homo sapiens
tctctcttcaacccttaactag

SEQ ID NO: 7729703 - DNA, 22 bp, Homo sapiens
tctgtcttcatcagcatgtgat

SEQ ID NO: 7729704 - DNA, 22 bp, Homo sapiens
ccaaatgtgcctgtttcaacaa

SEQ ID NO: 7729705 - DNA, 22 bp, Homo sapiens
ccactgaggcaggcagtatcta

SEQ ID NO: 7729706 - DNA, 22 bp, Homo sapiens
gttcttcagaggggaaagaacc

SEQ ID NO: 7729707 - DNA, 22 bp, Homo sapiens
gttcttcagcattagaagtcat

SEQ ID NO: 7729708 - DNA, 22 bp, Homo sapiens
gttcttcagattccatttcagt

SEQ ID NO: 7729709 - DNA, 22 bp, Homo sapiens
gttcttcaggccatcctcccag

SEQ ID NO: 7729710 - DNA, 22 bp, Homo sapiens
gttcttcacatttcattgagga

SEQ ID NO: 7729711 - DNA, 22 bp, Homo sapiens
gttcttcaaagtgacaactaaa

SEQ ID NO: 7729712 - DNA, 22 bp, Homo sapiens
cagcttctgctatcgaacatct

SEQ ID NO: 7729713 - DNA, 22 bp, Homo sapiens
taaacatttgttattcttgttt

SEQ ID NO: 7729714 - DNA, 22 bp, Homo sapiens
gttttctgattagcaaatctga

SEQ ID NO: 7729715 - DNA, 22 bp, Homo sapiens
taaaatagcatgtgcagtgaaa

SEQ ID NO: 7729716 - DNA, 22 bp, Homo sapiens
taacattaggtagacataagcc

SEQ ID NO: 7729717 - DNA, 22 bp, Homo sapiens
tacatcataataatacttagaa

SEQ ID NO: 7729718 - DNA, 22 bp, Homo sapiens
ttgatacaggctctatttcatc

SEQ ID NO: 7729719 - DNA, 22 bp, Homo sapiens
ttgatacatttttaggataaac

SEQ ID NO: 7729720 - DNA, 20 bp, Homo sapiens
tttcagttggttaatggcat

SEQ ID NO: 7729721 - DNA, 22 bp, Homo sapiens
tttcagttgtcctgttaatagc

SEQ ID NO: 7729722 - DNA, 20 bp, Homo sapiens
tttcagttatcttgaccttc

SEQ ID NO: 7729723 - DNA, 22 bp, Homo sapiens
tttcagttcagtttattatatc

SEQ ID NO: 7729724 - DNA, 22 bp, Homo sapiens
tttcagttactgctatatcatt

SEQ ID NO: 7729725 - DNA, 22 bp, Homo sapiens
ctaatcatctttctcttaaagc

SEQ ID NO: 7729726 - DNA, 22 bp, Homo sapiens
ctaatacaccctattgcttgtt

SEQ ID NO: 7729727 - DNA, 22 bp, Homo sapiens
ttcattcttgggatcagagagt

SEQ ID NO: 7729728 - DNA, 22 bp, Homo sapiens
ttcattcttatttgtgatctgg

SEQ ID NO: 7729729 - DNA, 22 bp, Homo sapiens
ttcattcttgtctttgtatagt

SEQ ID NO: 7729730 - DNA, 19 bp, Homo sapiens
ttcattctcttattgttgt

SEQ ID NO: 7729731 - DNA, 22 bp, Homo sapiens
ttcattctgggctctaaggaac

SEQ ID NO: 7729732 - DNA, 22 bp, Homo sapiens
ttcattctgcagttctcagctc

SEQ ID NO: 7729733 - DNA, 20 bp, Homo sapiens
ttgagcttttagtacagaca

SEQ ID NO: 7729734 - DNA, 22 bp, Homo sapiens
ctatttcaaggcccagatatga

SEQ ID NO: 7729735 - DNA, 22 bp, Homo sapiens
ctggagttagagtagacactga

SEQ ID NO: 7729736 - DNA, 22 bp, Homo sapiens
tgtcctcttccagtgctccttc

SEQ ID NO: 7729737 - DNA, 22 bp, Homo sapiens
tgtccatggatagagctgctcg

SEQ ID NO: 7729738 - DNA, 22 bp, Homo sapiens
cctggactcaggctgtgggcac

SEQ ID NO: 7729739 - DNA, 22 bp, Homo sapiens
tgtgtgtcagagtctccatggt

SEQ ID NO: 7729740 - DNA, 22 bp, Homo sapiens
cttgggaatgctaacagatgac

SEQ ID NO: 7729741 - DNA, 22 bp, Homo sapiens
cttgaagttgcaaaacattaat

SEQ ID NO: 7729742 - DNA, 22 bp, Homo sapiens
gatcttctagcagaagtaattt

SEQ ID NO: 7729743 - DNA, 22 bp, Homo sapiens
gatcttctatgtaatgaagtgt

SEQ ID NO: 7729744 - DNA, 22 bp, Homo sapiens
gatcttctctttagtagaaaca

SEQ ID NO: 7729745 - DNA, 22 bp, Homo sapiens
gatgagcattgtttcatgtgtt

SEQ ID NO: 7729746 - DNA, 22 bp, Homo sapiens
gcacaattatttatgcagtatg

SEQ ID NO: 7729747 - DNA, 22 bp, Homo sapiens
gattttattagcccaaactttg

SEQ ID NO: 7729748 - DNA, 22 bp, Homo sapiens
gattttatatggcatactgtgg

SEQ ID NO: 7729749 - DNA, 21 bp, Homo sapiens
gatttgcagaaactagacagg

SEQ ID NO: 7729750 - DNA, 22 bp, Homo sapiens
gcatgtgtggaggagatgtgct

SEQ ID NO: 7729751 - DNA, 22 bp, Homo sapiens
gcatgtgttggtttatgcatgt

SEQ ID NO: 7729752 - DNA, 22 bp, Homo sapiens
gcatgtgttattttatgtatga

SEQ ID NO: 7729753 - DNA, 22 bp, Homo sapiens
gctctctttttccagtggtggt

SEQ ID NO: 7729754 - DNA, 22 bp, Homo sapiens
gtgtcccaggcctctggaatta

SEQ ID NO: 7729755 - DNA, 22 bp, Homo sapiens
gttctctctgcttccaagatgg

SEQ ID NO: 7729756 - DNA, 22 bp, Homo sapiens
gtggaatgtccttgatcataag

SEQ ID NO: 7729757 - DNA, 22 bp, Homo sapiens
gtggaatgaatagatttgcatt

SEQ ID NO: 7729758 - DNA, 22 bp, Homo sapiens
gtccatgattctgtgtagtaga

SEQ ID NO: 7729759 - DNA, 22 bp, Homo sapiens
gtccatgattctgtgacaccct

SEQ ID NO: 7729760 - DNA, 22 bp, Homo sapiens
gtccatgactgtgactcacatg

SEQ ID NO: 7729761 - DNA, 22 bp, Homo sapiens
gtcccaggtgggctccacctct

SEQ ID NO: 7729762 - DNA, 22 bp, Homo sapiens
gtcccataagtagtgcaacttg

SEQ ID NO: 7729763 - DNA, 22 bp, Homo sapiens
gtaaaatagaataacgtggcta

SEQ ID NO: 7729764 - DNA, 22 bp, Homo sapiens
tctgggaatttattggcacttt

SEQ ID NO: 7729765 - DNA, 22 bp, Homo sapiens
tctgggaatgaataagacctgt

SEQ ID NO: 7729766 - DNA, 22 bp, Homo sapiens
tctgggaagtcctctgtcatgc

SEQ ID NO: 7729767 - DNA, 22 bp, Homo sapiens
tctgggaacacacgtcacttca

SEQ ID NO: 7729768 - DNA, 22 bp, Homo sapiens
tctgggaacagcctggctgtgt

SEQ ID NO: 7729769 - DNA, 22 bp, Homo sapiens
tctgggaaatgctgttccttgt

SEQ ID NO: 7729770 - DNA, 22 bp, Homo sapiens
tctgggaagctgcgtgcctgtt

SEQ ID NO: 7729771 - DNA, 22 bp, Homo sapiens
tctgggaagctggtcctgttct

SEQ ID NO: 7729772 - DNA, 22 bp, Homo sapiens
tctgggaaccagtgcggctggg

SEQ ID NO: 7729773 - DNA, 22 bp, Homo sapiens
tctgggaactgagctcccctag

SEQ ID NO: 7729774 - DNA, 22 bp, Homo sapiens
tctgggaactctgtcatttccc

SEQ ID NO: 7729775 - DNA, 22 bp, Homo sapiens
tcttagcacagctatataagtt

SEQ ID NO: 7729776 - DNA, 22 bp, Homo sapiens
tcttaaagagcgcaatttgagg

SEQ ID NO: 7729777 - DNA, 22 bp, Homo sapiens
tctgtggattttagtgttcatg

SEQ ID NO: 7729778 - DNA, 22 bp, Homo sapiens
tctgtccctgagagctcaggag

SEQ ID NO: 7729779 - DNA, 22 bp, Homo sapiens
tctttccatggccacacagtct

SEQ ID NO: 7729780 - DNA, 22 bp, Homo sapiens
tctttccaaggactctgtagca

SEQ ID NO: 7729781 - DNA, 22 bp, Homo sapiens
tcttcaattagatttaccaatt

SEQ ID NO: 7729782 - DNA, 22 bp, Homo sapiens
tcttcaagttccaaagtgcagg

SEQ ID NO: 7729783 - DNA, 22 bp, Homo sapiens
tcttcacatggaacatgaagct

SEQ ID NO: 7729784 - DNA, 22 bp, Homo sapiens
tcttcacatgaccttcatgtct

SEQ ID NO: 7729785 - DNA, 22 bp, Homo sapiens
tcttcagatggccagttgtccc

SEQ ID NO: 7729786 - DNA, 22 bp, Homo sapiens
tcttcacaggagcctgcctgcc

SEQ ID NO: 7729787 - DNA, 18 bp, Homo sapiens
tcttccaacactgacacc

SEQ ID NO: 7729788 - DNA, 22 bp, Homo sapiens
tcttccaaggttgcacactatc

SEQ ID NO: 7729789 - DNA, 22 bp, Homo sapiens
tcttctccagtgcttctgcaca

SEQ ID NO: 7729790 - DNA, 22 bp, Homo sapiens
tcttcttcctcatttatacata

SEQ ID NO: 7729791 - DNA, 22 bp, Homo sapiens
tcttcttcccatccctcaaatg

SEQ ID NO: 7729792 - DNA, 22 bp, Homo sapiens
taagaacttcggacatgttatc

SEQ ID NO: 7729793 - DNA, 22 bp, Homo sapiens
tccttctttccccctagtcatt

SEQ ID NO: 7729794 - DNA, 22 bp, Homo sapiens
tccttctttgacaagtggcaga

SEQ ID NO: 7729795 - DNA, 22 bp, Homo sapiens
tcgagctctggagccaaggatg

SEQ ID NO: 7729796 - DNA, 22 bp, Homo sapiens
tctaaagaagagggttctgcgg

SEQ ID NO: 7729797 - DNA, 22 bp, Homo sapiens
tctaacctttgaaactgctttc

SEQ ID NO: 7729798 - DNA, 22 bp, Homo sapiens
tctacccagagctatgacctga

SEQ ID NO: 7729799 - DNA, 22 bp, Homo sapiens
tctctctttttaatcatgtaat

SEQ ID NO: 7729800 - DNA, 22 bp, Homo sapiens
tctgaaagaagggcagtctttt

SEQ ID NO: 7729801 - DNA, 22 bp, Homo sapiens
tctctttctatatgtgagtctt

SEQ ID NO: 7729802 - DNA, 23 bp, Homo sapiens
tctctttcaagagcttaatgtgc

SEQ ID NO: 7729803 - DNA, 22 bp, Homo sapiens
tctgaaatgcaaatttgactga

SEQ ID NO: 7729804 - DNA, 22 bp, Homo sapiens
tgatttcctaggtctggagaag

SEQ ID NO: 7729805 - DNA, 17 bp, Homo sapiens
tgatagttcattttaag

SEQ ID NO: 7729806 - DNA, 22 bp, Homo sapiens
tgcatgtgtttgccacagtgag

SEQ ID NO: 7729807 - DNA, 22 bp, Homo sapiens
tgcatggaggaagatgaatgca

SEQ ID NO: 7729808 - DNA, 22 bp, Homo sapiens
tgcatggactcatcagacaaga

SEQ ID NO: 7729809 - DNA, 22 bp, Homo sapiens
tgcctggaaggcccatgggaag

SEQ ID NO: 7729810 - DNA, 19 bp, Homo sapiens
tgcctggacaaatgtgggg

SEQ ID NO: 7729811 - DNA, 22 bp, Homo sapiens
tgcctggattcggttgttgtca

SEQ ID NO: 7729812 - DNA, 22 bp, Homo sapiens
tgcccacatggtgccatggcca

SEQ ID NO: 7729813 - DNA, 22 bp, Homo sapiens
tgaaacatttgatgatctttgg

SEQ ID NO: 7729814 - DNA, 22 bp, Homo sapiens
tgaaagcacaagttctaacagg

SEQ ID NO: 7729815 - DNA, 22 bp, Homo sapiens
tgaatcatggataaatagctta

SEQ ID NO: 7729816 - DNA, 22 bp, Homo sapiens
tgagatgtaaggtatgcttact

SEQ ID NO: 7729817 - DNA, 22 bp, Homo sapiens
tggaaatggatctgatgagtct

SEQ ID NO: 7729818 - DNA, 22 bp, Homo sapiens
tggaaagtctcttttgactgta

SEQ ID NO: 7729819 - DNA, 22 bp, Homo sapiens
tggaaatgtatttgggcatgcc

SEQ ID NO: 7729820 - DNA, 22 bp, Homo sapiens
tgccttgcacataatatacatt

SEQ ID NO: 7729821 - DNA, 22 bp, Homo sapiens
tgctggaataatttcatgttaa

SEQ ID NO: 7729822 - DNA, 22 bp, Homo sapiens
tgcttagacgtcaagtacagcc

SEQ ID NO: 7729823 - DNA, 22 bp, Homo sapiens
tgtccctctgaggcttccctgg

SEQ ID NO: 7729824 - DNA, 22 bp, Homo sapiens
tgtcctcagatatgtctactct

SEQ ID NO: 7729825 - DNA, 22 bp, Homo sapiens
ttcattctttgaatctgaggta

SEQ ID NO: 7729826 - DNA, 19 bp, Homo sapiens
ttcattctttctacttacc

SEQ ID NO: 7729827 - DNA, 23 bp, Homo sapiens
ttccagagtccacatctgccacc

SEQ ID NO: 7729828 - DNA, 22 bp, Homo sapiens
ttatgatttgccacagattggt

SEQ ID NO: 7729829 - DNA, 22 bp, Homo sapiens
tgttcttctagattgcctttta

SEQ ID NO: 7729830 - DNA, 22 bp, Homo sapiens
tgttttaagagcgcactttata

SEQ ID NO: 7729831 - DNA, 22 bp, Homo sapiens
tgttttaaagccattgcctttc

SEQ ID NO: 7729832 - DNA, 22 bp, Homo sapiens
tgtcttcagcaaatgcctttct

SEQ ID NO: 7729833 - DNA, 22 bp, Homo sapiens
tgtgatatttgagtattgtcaa

SEQ ID NO: 7729834 - DNA, 20 bp, Homo sapiens
agattattcctaagatttct

SEQ ID NO: 7729835 - DNA, 22 bp, Homo sapiens
acattcttaacagttaaaaact

SEQ ID NO: 7729836 - DNA, 22 bp, Homo sapiens
accttgatgcctttccaagatg

SEQ ID NO: 7729837 - DNA, 22 bp, Homo sapiens
aatatcagcacttttgtggtat

SEQ ID NO: 7729838 - DNA, 22 bp, Homo sapiens
aatatcagtatattgtatcagt

SEQ ID NO: 7729839 - DNA, 22 bp, Homo sapiens
aatctttccctattaaatgtgg

SEQ ID NO: 7729840 - DNA, 22 bp, Homo sapiens
aatcttctttcttaacagtaca

SEQ ID NO: 7729841 - DNA, 22 bp, Homo sapiens
aatcttctacttgacagttctc

SEQ ID NO: 7729842 - DNA, 22 bp, Homo sapiens
aaatataatttctgcctcaata

SEQ ID NO: 7729843 - DNA, 22 bp, Homo sapiens
aaaagtctgctctcatttcaga

SEQ ID NO: 7729844 - DNA, 19 bp, Homo sapiens
aaaaacttagtccagaaag

SEQ ID NO: 7729845 - DNA, 22 bp, Homo sapiens
aaacatgaatagatattaaaca

SEQ ID NO: 7729846 - DNA, 22 bp, Homo sapiens
aacattctattttgctaaaaca

SEQ ID NO: 7729847 - DNA, 22 bp, Homo sapiens
acactaatgagaaaggaattaa

SEQ ID NO: 7729848 - DNA, 22 bp, Homo sapiens
aagacaatttgatactagttgc

SEQ ID NO: 7729849 - DNA, 22 bp, Homo sapiens
aacattctggttctaaaaacct

SEQ ID NO: 7729850 - DNA, 22 bp, Homo sapiens
aacatttcagcaaataagaaca

SEQ ID NO: 7729851 - DNA, 22 bp, Homo sapiens
aagtttgcatagattaagcatt

SEQ ID NO: 7729852 - DNA, 22 bp, Homo sapiens
aagtatttcgttctgaaaaagt

SEQ ID NO: 7729853 - DNA, 22 bp, Homo sapiens
aaattgttgatctacagtaagg

SEQ ID NO: 7729854 - DNA, 22 bp, Homo sapiens
aaattataggtgccaccttgga

SEQ ID NO: 7729855 - DNA, 22 bp, Homo sapiens
aaattattacaagctagttggc

SEQ ID NO: 7729856 - DNA, 22 bp, Homo sapiens
agacctggattccaatcctacc

SEQ ID NO: 7729857 - DNA, 22 bp, Homo sapiens
atctgcttgaatgagcaacagg

SEQ ID NO: 7729858 - DNA, 19 bp, Homo sapiens
atctgcctgttatcacata

SEQ ID NO: 7729859 - DNA, 22 bp, Homo sapiens
attttcagagacatctggactt

SEQ ID NO: 7729860 - DNA, 22 bp, Homo sapiens
acatacatatgtttaaatgcat

SEQ ID NO: 7729861 - DNA, 23 bp, Homo sapiens
acatacatggagataaagtgatg

SEQ ID NO: 7729862 - DNA, 22 bp, Homo sapiens
agtaccatgcttcctgactggt

SEQ ID NO: 7729863 - DNA, 22 bp, Homo sapiens
agtacatatagtaatttagcca

SEQ ID NO: 7729864 - DNA, 22 bp, Homo sapiens
actttctgcagtgttggaaatg

SEQ ID NO: 7729865 - DNA, 22 bp, Homo sapiens
atacaaagacaaatctcaatct

SEQ ID NO: 7729866 - DNA, 22 bp, Homo sapiens
cccatgaggtggaggttgcagt

SEQ ID NO: 7729867 - DNA, 22 bp, Homo sapiens
cccatgagacctggtttaaggc

SEQ ID NO: 7729868 - DNA, 22 bp, Homo sapiens
cccatgagattctgaatttggc

SEQ ID NO: 7729869 - DNA, 17 bp, Homo sapiens
cccatgagcccactccc

SEQ ID NO: 7729870 - DNA, 22 bp, Homo sapiens
ctagcctgggatttgaacttat

SEQ ID NO: 7729871 - DNA, 22 bp, Homo sapiens
agtaaaaattgaggtgcaaaat

SEQ ID NO: 7729872 - DNA, 22 bp, Homo sapiens
atagtttgaaggctgttctact

SEQ ID NO: 7729873 - DNA, 22 bp, Homo sapiens
atagtttgtgaaacacagcagt

SEQ ID NO: 7729874 - DNA, 22 bp, Homo sapiens
atacacatgtgtatgtgcatgc

SEQ ID NO: 7729875 - DNA, 22 bp, Homo sapiens
atacacatatgtgtgtatatgt

SEQ ID NO: 7729876 - DNA, 21 bp, Homo sapiens
atacacatacacataaatgtg

SEQ ID NO: 7729877 - DNA, 22 bp, Homo sapiens
agttctcaagacaattacctgt

SEQ ID NO: 7729878 - DNA, 22 bp, Homo sapiens
agttcttcataaccttactgtg

SEQ ID NO: 7729879 - DNA, 22 bp, Homo sapiens
ataaagatttctttttctctac

SEQ ID NO: 7729880 - DNA, 22 bp, Homo sapiens
cttctgtgcttcacagttgcca

SEQ ID NO: 7729881 - DNA, 22 bp, Homo sapiens
cttaacatcctgcatttttctt

SEQ ID NO: 7729882 - DNA, 22 bp, Homo sapiens
atccatgatcaatttattacta

SEQ ID NO: 7729883 - DNA, 20 bp, Homo sapiens
atccatgagagtctggattc

SEQ ID NO: 7729884 - DNA, 22 bp, Homo sapiens
atccatgaaggtacttctcagg

SEQ ID NO: 7729885 - DNA, 22 bp, Homo sapiens
atccatgattagtaggataaag

SEQ ID NO: 7729886 - DNA, 22 bp, Homo sapiens
cttccttctgaagcatagaagc

SEQ ID NO: 7729887 - DNA, 22 bp, Homo sapiens
attgttatgaaaataagatgtt

SEQ ID NO: 7729888 - DNA, 21 bp, Homo sapiens
gcaaatgttcaggaaaaaaga

SEQ ID NO: 7729889 - DNA, 22 bp, Homo sapiens
gcagaagtcagaccatctgaat

SEQ ID NO: 7729890 - DNA, 22 bp, Homo sapiens
atttgcaaagtcgtatctgtga

SEQ ID NO: 7729891 - DNA, 22 bp, Homo sapiens
caaatctatatgttgatattct

SEQ ID NO: 7729892 - DNA, 22 bp, Homo sapiens
atgtttcaccagcaaattacct

SEQ ID NO: 7729893 - DNA, 22 bp, Homo sapiens
atgtttcagatacagatcaaat

SEQ ID NO: 7729894 - DNA, 21 bp, Homo sapiens
atgtcaaatgctttattttat

SEQ ID NO: 7729895 - DNA, 22 bp, Homo sapiens
gaagcacatggctatagctatt

SEQ ID NO: 7729896 - DNA, 22 bp, Homo sapiens
ggcttggaccagtcacagtggt

SEQ ID NO: 7729897 - DNA, 22 bp, Homo sapiens
ggcttggaaattgcaggacaca

SEQ ID NO: 7729898 - DNA, 22 bp, Homo sapiens
ggcttggaaatggtaatgagct

SEQ ID NO: 7729899 - DNA, 22 bp, Homo sapiens
cacagcataatgaaatatactt

SEQ ID NO: 7729900 - DNA, 22 bp, Homo sapiens
catgtggttcaagtactccaca

SEQ ID NO: 7729901 - DNA, 22 bp, Homo sapiens
tcagtgtgaggtcttccacccg

SEQ ID NO: 7729902 - DNA, 22 bp, Homo sapiens
tcagtgtgagtaccatgctcag

SEQ ID NO: 7729903 - DNA, 22 bp, Homo sapiens
tctcagtgtgttttctctcaga

SEQ ID NO: 7729904 - DNA, 22 bp, Homo sapiens
catttccacttctgaaaactgg

SEQ ID NO: 7729905 - DNA, 22 bp, Homo sapiens
catttccagctcctgcatcatg

SEQ ID NO: 7729906 - DNA, 22 bp, Homo sapiens
ccacagctgaccgcaggtgagc

SEQ ID NO: 7729907 - DNA, 22 bp, Homo sapiens
tacagctaggcaaaaatgacat

SEQ ID NO: 7729908 - DNA, 22 bp, Homo sapiens
tagttttacttgcgatgataat

SEQ ID NO: 7729909 - DNA, 18 bp, Homo sapiens
tgcttggagcatttacca

SEQ ID NO: 7729910 - DNA, 22 bp, Homo sapiens
gagagaaatgtgcagtttgggc

SEQ ID NO: 7729911 - DNA, 22 bp, Homo sapiens
cttctcaaagttgtgaatcagg

SEQ ID NO: 7729912 - DNA, 22 bp, Homo sapiens
cttaaaatctggcagttagcta

SEQ ID NO: 7729913 - DNA, 22 bp, Homo sapiens
ctgtggaaaatttgtatgtaat

SEQ ID NO: 7729914 - DNA, 22 bp, Homo sapiens
ctgtggaaataaacaatgctaa

SEQ ID NO: 7729915 - DNA, 21 bp, Homo sapiens
ctgtggaagggaactagaggg

SEQ ID NO: 7729916 - DNA, 22 bp, Homo sapiens
ctgtggaaggcctgtcctgaaa

SEQ ID NO: 7729917 - DNA, 22 bp, Homo sapiens
ctttgcaatagaggcacacatg

SEQ ID NO: 7729918 - DNA, 22 bp, Homo sapiens
ctttgcaaactgtcacactttc

SEQ ID NO: 7729919 - DNA, 22 bp, Homo sapiens
ctttgcaaacgattaccacatg

SEQ ID NO: 7729920 - DNA, 22 bp, Homo sapiens
cttttccactgagcctcacaaa

SEQ ID NO: 7729921 - DNA, 23 bp, Homo sapiens
tttgaagttgactgccttccaga

SEQ ID NO: 7729922 - DNA, 22 bp, Homo sapiens
tttcaaagttgggaattgtaat

SEQ ID NO: 7729923 - DNA, 22 bp, Homo sapiens
tttcaaagtcaatatcattacc

SEQ ID NO: 7729924 - DNA, 22 bp, Homo sapiens
ctgcatcacagcaggaggcaca

SEQ ID NO: 7729925 - DNA, 22 bp, Homo sapiens
ctgaggaagacagcagctgtgt

SEQ ID NO: 7729926 - DNA, 22 bp, Homo sapiens
ttgcactaggaaaaggcagcca

SEQ ID NO: 7729927 - DNA, 23 bp, Homo sapiens
ttgcacattggagctggtcttct

SEQ ID NO: 7729928 - DNA, 22 bp, Homo sapiens
ttctcttttgtgatgtgagatg

SEQ ID NO: 7729929 - DNA, 22 bp, Homo sapiens
ttctgaaagccaattcattgaa

SEQ ID NO: 7729930 - DNA, 22 bp, Homo sapiens
ttcttcagtcccactagccaca

SEQ ID NO: 7729931 - DNA, 22 bp, Homo sapiens
ttcttaactggaaaatgtcaga

SEQ ID NO: 7729932 - DNA, 22 bp, Homo sapiens
ttcttaactcaaatatatatcc

SEQ ID NO: 7729933 - DNA, 22 bp, Homo sapiens
ttgaagttgtagttcagtgaag

SEQ ID NO: 7729934 - DNA, 22 bp, Homo sapiens
ttgaaatatcaagttattagtg

SEQ ID NO: 7729935 - DNA, 22 bp, Homo sapiens
ttcttcatgctgttgctgcttg

SEQ ID NO: 7729936 - DNA, 22 bp, Homo sapiens
ttcttcagtttggtaaatgtaa

SEQ ID NO: 7729937 - DNA, 21 bp, Homo sapiens
ttcttcagtttaatataaaat

SEQ ID NO: 7729938 - DNA, 22 bp, Homo sapiens
ttcttcagtgtagcaactgtat

SEQ ID NO: 7729939 - DNA, 22 bp, Homo sapiens
ttatttcattgatttctaagac

SEQ ID NO: 7729940 - DNA, 22 bp, Homo sapiens
ccttcttctgtgtggcccaaga

SEQ ID NO: 7729941 - DNA, 22 bp, Homo sapiens
ttatcctggattatatatgtga

SEQ ID NO: 7729942 - DNA, 22 bp, Homo sapiens
ttaaaatagccagtgcccctct

SEQ ID NO: 7729943 - DNA, 22 bp, Homo sapiens
cctgtcacgatgactgcactct

SEQ ID NO: 7729944 - DNA, 22 bp, Homo sapiens
gcatctaaataaacgtgggagt

SEQ ID NO: 7729945 - DNA, 22 bp, Homo sapiens
gcatctaaacttgcatcattgt

SEQ ID NO: 7729946 - DNA, 22 bp, Homo sapiens
gcatctaatccagtccagcatc

SEQ ID NO: 7729947 - DNA, 22 bp, Homo sapiens
gctgggaagtgcaagatcaagg

SEQ ID NO: 7729948 - DNA, 22 bp, Homo sapiens
ggacctggcaatttgcatctct

SEQ ID NO: 7729949 - DNA, 22 bp, Homo sapiens
gtcttcttgtgttgcctgtctt

SEQ ID NO: 7729950 - DNA, 22 bp, Homo sapiens
gtcttcttgttttgaaggaaat

SEQ ID NO: 7729951 - DNA, 22 bp, Homo sapiens
gtcttctttaacctactaaagc

SEQ ID NO: 7729952 - DNA, 22 bp, Homo sapiens
gtcttcttttcagtctgcttgt

SEQ ID NO: 7729953 - DNA, 22 bp, Homo sapiens
gtcttcaacaataactaccact

SEQ ID NO: 7729954 - DNA, 22 bp, Homo sapiens
gtcttcaatagagcctcaattt

SEQ ID NO: 7729955 - DNA, 22 bp, Homo sapiens
gtcattcttaacaactcagtag

SEQ ID NO: 7729956 - DNA, 22 bp, Homo sapiens
tatgttattttcatacaacaga

SEQ ID NO: 7729957 - DNA, 22 bp, Homo sapiens
tatttcagggagaataaatttg

SEQ ID NO: 7729958 - DNA, 22 bp, Homo sapiens
tatttcagccctactacttggc

SEQ ID NO: 7729959 - DNA, 22 bp, Homo sapiens
tatttcagcaagaagaatgtgg

SEQ ID NO: 7729960 - DNA, 22 bp, Homo sapiens
tatttctaagagatatctgtac

SEQ ID NO: 7729961 - DNA, 22 bp, Homo sapiens
tatttccaggccccactctaga

SEQ ID NO: 7729962 - DNA, 22 bp, Homo sapiens
tatttccatgttagaactaagt

SEQ ID NO: 7729963 - DNA, 22 bp, Homo sapiens
tatttccagcagtaagaagaca

SEQ ID NO: 7729964 - DNA, 22 bp, Homo sapiens
tatcaatacatgttatcagtgt

SEQ ID NO: 7729965 - DNA, 22 bp, Homo sapiens
tagaagcagtaatagaaatagg

SEQ ID NO: 7729966 - DNA, 22 bp, Homo sapiens
tactgcatggtggagtggagct

SEQ ID NO: 7729967 - DNA, 22 bp, Homo sapiens
tactgcataactggcatgtggg

SEQ ID NO: 7729968 - DNA, 22 bp, Homo sapiens
tactaaatagtttaattcctca

SEQ ID NO: 7729969 - DNA, 22 bp, Homo sapiens
taagttcataagcttattctta

SEQ ID NO: 7729970 - DNA, 22 bp, Homo sapiens
gtttataaggcccaatatttct

SEQ ID NO: 7729971 - DNA, 22 bp, Homo sapiens
gttataaaatgcacagttgttt

SEQ ID NO: 7729972 - DNA, 22 bp, Homo sapiens
taacaatagtgtttgctagtca

SEQ ID NO: 7729973 - DNA, 22 bp, Homo sapiens
gttttataattgcttcataaga

SEQ ID NO: 7729974 - DNA, 22 bp, Homo sapiens
gttttataggctgttgctatat

SEQ ID NO: 7729975 - DNA, 22 bp, Homo sapiens
gttttataggtgaaatattact

SEQ ID NO: 7729976 - DNA, 22 bp, Homo sapiens
tcacaatttggatacagctatg

SEQ ID NO: 7729977 - DNA, 22 bp, Homo sapiens
tcacatgagtattattttccaa

SEQ ID NO: 7729978 - DNA, 22 bp, Homo sapiens
ttgaaagacttctcctgtgaaa

SEQ ID NO: 7729979 - DNA, 22 bp, Homo sapiens
ttctgggagagaaagggccttg

SEQ ID NO: 7729980 - DNA, 22 bp, Homo sapiens
ttcttcagcctaccttgacctc

SEQ ID NO: 7729981 - DNA, 22 bp, Homo sapiens
ttctgggacatctggacagttt

SEQ ID NO: 7729982 - DNA, 21 bp, Homo sapiens
ttctgggaaatgagctggggc

SEQ ID NO: 7729983 - DNA, 22 bp, Homo sapiens
ttcttcttctggctgcacctgg

SEQ ID NO: 7729984 - DNA, 22 bp, Homo sapiens
ttcttcttgaaactttaggttg

SEQ ID NO: 7729985 - DNA, 22 bp, Homo sapiens
ttcttcttcatttctgacgatg

SEQ ID NO: 7729986 - DNA, 22 bp, Homo sapiens
ttcttcttaatgtcctgggaac

SEQ ID NO: 7729987 - DNA, 22 bp, Homo sapiens
ttcttcttcaagtgctgcattc

SEQ ID NO: 7729988 - DNA, 22 bp, Homo sapiens
ttccctctcacttaaagcttgg

SEQ ID NO: 7729989 - DNA, 22 bp, Homo sapiens
ttctctttgacattattcaggt

SEQ ID NO: 7729990 - DNA, 21 bp, Homo sapiens
ttcaaaatggtgtgtttgtct

SEQ ID NO: 7729991 - DNA, 22 bp, Homo sapiens
ttatttaatgtgatctgaagag

SEQ ID NO: 7729992 - DNA, 22 bp, Homo sapiens
ttatttaaaagtggtaagattc

SEQ ID NO: 7729993 - DNA, 22 bp, Homo sapiens
ttccatgagctctgagttcaca

SEQ ID NO: 7729994 - DNA, 18 bp, Homo sapiens
ttccatgattcctttcac

SEQ ID NO: 7729995 - DNA, 22 bp, Homo sapiens
ttccatgaaatgtgttatgctt

SEQ ID NO: 7729996 - DNA, 22 bp, Homo sapiens
ttccatgaaggagactgagaag

SEQ ID NO: 7729997 - DNA, 22 bp, Homo sapiens
ttccatgaagggcagcctctca

SEQ ID NO: 7729998 - DNA, 22 bp, Homo sapiens
ttccatgacaccgagggaagtc

SEQ ID NO: 7729999 - DNA, 22 bp, Homo sapiens
ttccatgaaagtgaaatggagc

SEQ ID NO: 7730000 - DNA, 22 bp, Homo sapiens
ttccaagagtaaattcaaattg

SEQ ID NO: 7730001 - DNA, 22 bp, Homo sapiens
ttccaagagctttaattgttga

SEQ ID NO: 7730002 - DNA, 22 bp, Homo sapiens
ttcagaatatttgttttacatg

SEQ ID NO: 7730003 - DNA, 22 bp, Homo sapiens
ttcagaagtagctaagcagtca

SEQ ID NO: 7730004 - DNA, 22 bp, Homo sapiens
ttcagaatgtgaccttatttgg

SEQ ID NO: 7730005 - DNA, 22 bp, Homo sapiens
ttcatcaatgtgtttaataatg

SEQ ID NO: 7730006 - DNA, 22 bp, Homo sapiens
ttggaattcaagttgtagctta

SEQ ID NO: 7730007 - DNA, 22 bp, Homo sapiens
ttgcttcagtagctctttaaag

SEQ ID NO: 7730008 - DNA, 22 bp, Homo sapiens
tttccaggtattaatactgtat

SEQ ID NO: 7730009 - DNA, 22 bp, Homo sapiens
tttcccagaggtatgaataagt

SEQ ID NO: 7730010 - DNA, 22 bp, Homo sapiens
tttccatgttggtgaaatgagg

SEQ ID NO: 7730011 - DNA, 22 bp, Homo sapiens
tttcacattagatatgtcattt

SEQ ID NO: 7730012 - DNA, 22 bp, Homo sapiens
tttcagtgtatcttccaaaagc

SEQ ID NO: 7730013 - DNA, 22 bp, Homo sapiens
tttcagtttttgctcgatgtat

SEQ ID NO: 7730014 - DNA, 20 bp, Homo sapiens
tttcaagtcagcaattctca

SEQ ID NO: 7730015 - DNA, 22 bp, Homo sapiens
tttcacaactgcttatttgaga

SEQ ID NO: 7730016 - DNA, 19 bp, Homo sapiens
tttgcagtggttcctttgt

SEQ ID NO: 7730017 - DNA, 22 bp, Homo sapiens
tttgcagtgtcagcttctgtgt

SEQ ID NO: 7730018 - DNA, 22 bp, Homo sapiens
tttgaaatatgaggcattatga

SEQ ID NO: 7730019 - DNA, 22 bp, Homo sapiens
tttgaaattaagatattgtcca

SEQ ID NO: 7730020 - DNA, 22 bp, Homo sapiens
tttctagggctcttgtcttctg

SEQ ID NO: 7730021 - DNA, 22 bp, Homo sapiens
tttctaggcacagtgtcttccc

SEQ ID NO: 7730022 - DNA, 22 bp, Homo sapiens
tttctaggtcttccatactgcc

SEQ ID NO: 7730023 - DNA, 22 bp, Homo sapiens
tttctagtctcgatctcttaat

SEQ ID NO: 7730024 - DNA, 22 bp, Homo sapiens
tttgacatggaataactcattt

SEQ ID NO: 7730025 - DNA, 23 bp, Homo sapiens
ttttccagaatcgactctgtaga

SEQ ID NO: 7730026 - DNA, 20 bp, Homo sapiens
ttttccagaaagtatcattg

SEQ ID NO: 7730027 - DNA, 22 bp, Homo sapiens
ttttccagagctgtctcttgca

SEQ ID NO: 7730028 - DNA, 22 bp, Homo sapiens
ttttccagattggacttagtcc

SEQ ID NO: 7730029 - DNA, 21 bp, Homo sapiens
acagcaagccttcacatgagt

SEQ ID NO: 7730030 - DNA, 22 bp, Homo sapiens
acagaaattgggcaaatggaag

SEQ ID NO: 7730031 - DNA, 22 bp, Homo sapiens
acaaatgtggacatggataatg

SEQ ID NO: 7730032 - DNA, 22 bp, Homo sapiens
acaaatgtctcctcttttgtta

SEQ ID NO: 7730033 - DNA, 22 bp, Homo sapiens
acaaatgtgtctaattgtgcct

SEQ ID NO: 7730034 - DNA, 22 bp, Homo sapiens
acaaatatggtactcggagaaa

SEQ ID NO: 7730035 - DNA, 19 bp, Homo sapiens
acaaatgatgttgcactga

SEQ ID NO: 7730036 - DNA, 22 bp, Homo sapiens
accatcctgaaaccttcatgct

SEQ ID NO: 7730037 - DNA, 22 bp, Homo sapiens
acagtacataatcctgagtctg

SEQ ID NO: 7730038 - DNA, 22 bp, Homo sapiens
aataattagtgggacagagaac

SEQ ID NO: 7730039 - DNA, 22 bp, Homo sapiens
aatcataattgtatacattcat

SEQ ID NO: 7730040 - DNA, 22 bp, Homo sapiens
aatatatgtggtattgaccagc

SEQ ID NO: 7730041 - DNA, 22 bp, Homo sapiens
aatatcaacagtgtccttctaa

SEQ ID NO: 7730042 - DNA, 22 bp, Homo sapiens
aaaaatctatgactgcttctcc

SEQ ID NO: 7730043 - DNA, 22 bp, Homo sapiens
aaagataatgtttccttattct

SEQ ID NO: 7730044 - DNA, 22 bp, Homo sapiens
aaatgtattgcataggatattt

SEQ ID NO: 7730045 - DNA, 22 bp, Homo sapiens
acagaattgaaagtataatctg

SEQ ID NO: 7730046 - DNA, 22 bp, Homo sapiens
aaatgtttctacttgtgagcat

SEQ ID NO: 7730047 - DNA, 22 bp, Homo sapiens
aaatgttttgctcccatgtggt

SEQ ID NO: 7730048 - DNA, 22 bp, Homo sapiens
aacagtaaagacagaatttatc

SEQ ID NO: 7730049 - DNA, 22 bp, Homo sapiens
aatataatgctgttttatgcca

SEQ ID NO: 7730050 - DNA, 21 bp, Homo sapiens
aatcatacaaaacatgtcagg

SEQ ID NO: 7730051 - DNA, 22 bp, Homo sapiens
aatcattcttatttcacagcaa

SEQ ID NO: 7730052 - DNA, 22 bp, Homo sapiens
caaatagtatgagcaatgattc

SEQ ID NO: 7730053 - DNA, 22 bp, Homo sapiens
caaatagtgtcacattgtgagg

SEQ ID NO: 7730054 - DNA, 22 bp, Homo sapiens
caaatagtttttcatgtattat

SEQ ID NO: 7730055 - DNA, 22 bp, Homo sapiens
cagagaaaaaatcctgctctca

SEQ ID NO: 7730056 - DNA, 22 bp, Homo sapiens
agaagttgtaggtttgcatatt

SEQ ID NO: 7730057 - DNA, 22 bp, Homo sapiens
agaagtcatttatgttagatga

SEQ ID NO: 7730058 - DNA, 22 bp, Homo sapiens
agacaaatggagtatgagcaac

SEQ ID NO: 7730059 - DNA, 22 bp, Homo sapiens
agacaaatggtaattatgtcta

SEQ ID NO: 7730060 - DNA, 22 bp, Homo sapiens
attccagttgggttctaataca

SEQ ID NO: 7730061 - DNA, 22 bp, Homo sapiens
attattattgttgatgttaggg

SEQ ID NO: 7730062 - DNA, 22 bp, Homo sapiens
attattatatagggaaagtccc

SEQ ID NO: 7730063 - DNA, 16 bp, Homo sapiens
atttccagattatgca

SEQ ID NO: 7730064 - DNA, 22 bp, Homo sapiens
atacagatgttgaatgttatat

SEQ ID NO: 7730065 - DNA, 22 bp, Homo sapiens
acttcttcttcagctgggggat

SEQ ID NO: 7730066 - DNA, 22 bp, Homo sapiens
atatttcatggggttccatact

SEQ ID NO: 7730067 - DNA, 22 bp, Homo sapiens
atattcttccaaaacatcattt

SEQ ID NO: 7730068 - DNA, 22 bp, Homo sapiens
acagtctacttgagcttgtata

SEQ ID NO: 7730069 - DNA, 22 bp, Homo sapiens
acagtcattagatacaatgtct

SEQ ID NO: 7730070 - DNA, 22 bp, Homo sapiens
catataaatacaacatgtgtta

SEQ ID NO: 7730071 - DNA, 22 bp, Homo sapiens
cattaaaatatctcatggtgtt

SEQ ID NO: 7730072 - DNA, 22 bp, Homo sapiens
agtcatatgacccttcacaaac

SEQ ID NO: 7730073 - DNA, 22 bp, Homo sapiens
ctccatgaatttgagctttgtg

SEQ ID NO: 7730074 - DNA, 15 bp, Homo sapiens
ctccatgattttgca

SEQ ID NO: 7730075 - DNA, 22 bp, Homo sapiens
agttttcacactcaccaaaagg

SEQ ID NO: 7730076 - DNA, 22 bp, Homo sapiens
ctggaaattggagatgatgttt

SEQ ID NO: 7730077 - DNA, 22 bp, Homo sapiens
atacatatatggtacttcctgg

SEQ ID NO: 7730078 - DNA, 22 bp, Homo sapiens
atcattctagctgttgtgttga

SEQ ID NO: 7730079 - DNA, 22 bp, Homo sapiens
atcattactcctgtaaaattgt

SEQ ID NO: 7730080 - DNA, 22 bp, Homo sapiens
cttcagaggggactcaaagtca

SEQ ID NO: 7730081 - DNA, 22 bp, Homo sapiens
cttcagagtgcagaagattggg

SEQ ID NO: 7730082 - DNA, 22 bp, Homo sapiens
cttcagaatccagaatcagaat

SEQ ID NO: 7730083 - DNA, 22 bp, Homo sapiens
atatcaaacgaagttattttaa

SEQ ID NO: 7730084 - DNA, 22 bp, Homo sapiens
atatcagtatctatgtatttgt

SEQ ID NO: 7730085 - DNA, 22 bp, Homo sapiens
attcacaaaatgatatagatac

SEQ ID NO: 7730086 - DNA, 22 bp, Homo sapiens
attctgatatcttattctagct

SEQ ID NO: 7730087 - DNA, 22 bp, Homo sapiens
attctctttgtataacatcttg

SEQ ID NO: 7730088 - DNA, 22 bp, Homo sapiens
attatataggacttgcccttcc

SEQ ID NO: 7730089 - DNA, 22 bp, Homo sapiens
attatctatgtagaatgatttt

SEQ ID NO: 7730090 - DNA, 22 bp, Homo sapiens
atttcccatgtgaatcaattgg

SEQ ID NO: 7730091 - DNA, 22 bp, Homo sapiens
atttcccagctttgatcagttt

SEQ ID NO: 7730092 - DNA, 22 bp, Homo sapiens
atttcaaggctattaatataaa

SEQ ID NO: 7730093 - DNA, 22 bp, Homo sapiens
attttgatgctatctaatgaat

SEQ ID NO: 7730094 - DNA, 22 bp, Homo sapiens
gaagtacagttttatctagcca

SEQ ID NO: 7730095 - DNA, 22 bp, Homo sapiens
atgatgttgataaattacttta

SEQ ID NO: 7730096 - DNA, 22 bp, Homo sapiens
atctttctatttctaaaaacta

SEQ ID NO: 7730097 - DNA, 22 bp, Homo sapiens
atctttctccatatacatcttt

SEQ ID NO: 7730098 - DNA, 22 bp, Homo sapiens
atctttcagggccatttgtatt

SEQ ID NO: 7730099 - DNA, 22 bp, Homo sapiens
atctttcaatcaggaaaaatct

SEQ ID NO: 7730100 - DNA, 22 bp, Homo sapiens
atctttcagtttcataccaatt

SEQ ID NO: 7730101 - DNA, 23 bp, Homo sapiens
atgtatttaaatttcagtgatga

SEQ ID NO: 7730102 - DNA, 22 bp, Homo sapiens
atgtatttctatgtagtgaaga

SEQ ID NO: 7730103 - DNA, 22 bp, Homo sapiens
atgttatagttataaaatgagg

SEQ ID NO: 7730104 - DNA, 22 bp, Homo sapiens
cacatgagtcctgccaggtatg

SEQ ID NO: 7730105 - DNA, 22 bp, Homo sapiens
cacaaatgtgcagaaatgtgag

SEQ ID NO: 7730106 - DNA, 22 bp, Homo sapiens
cacaaatggccgtgttcaaaga

SEQ ID NO: 7730107 - DNA, 22 bp, Homo sapiens
cacaaatggttgtagacattaa

SEQ ID NO: 7730108 - DNA, 22 bp, Homo sapiens
caatacttccttgttagaggca

SEQ ID NO: 7730109 - DNA, 22 bp, Homo sapiens
ccatggcaatggtcagtctatt

SEQ ID NO: 7730110 - DNA, 22 bp, Homo sapiens
tgacccatggtctgatcatagg

SEQ ID NO: 7730111 - DNA, 22 bp, Homo sapiens
tgaaagcagcaccaataccatt

SEQ ID NO: 7730112 - DNA, 22 bp, Homo sapiens
tctctcttgtcaccccatctgc

SEQ ID NO: 7730113 - DNA, 22 bp, Homo sapiens
cattcattagaatagatatgta

SEQ ID NO: 7730114 - DNA, 22 bp, Homo sapiens
tcattctttaccaagttgtcac

SEQ ID NO: 7730115 - DNA, 22 bp, Homo sapiens
tcattcttgatcactagttagt

SEQ ID NO: 7730116 - DNA, 22 bp, Homo sapiens
tatttcagtcacttcttctctg

SEQ ID NO: 7730117 - DNA, 22 bp, Homo sapiens
tatttccaagctgaatccaatg

SEQ ID NO: 7730118 - DNA, 22 bp, Homo sapiens
tatttccaaaagcctattatga

SEQ ID NO: 7730119 - DNA, 22 bp, Homo sapiens
tatttccacctattattttctg

SEQ ID NO: 7730120 - DNA, 22 bp, Homo sapiens
tcacaaatgaggaaatcgagca

SEQ ID NO: 7730121 - DNA, 22 bp, Homo sapiens
tatttgaaagtgtacaaaaact

SEQ ID NO: 7730122 - DNA, 22 bp, Homo sapiens
tcacaaatattttaacagtagg

SEQ ID NO: 7730123 - DNA, 22 bp, Homo sapiens
tatcatcttgttgtcatgcagc

SEQ ID NO: 7730124 - DNA, 22 bp, Homo sapiens
ttttgcttgagtgcacaaaatg

SEQ ID NO: 7730125 - DNA, 22 bp, Homo sapiens
ctcttcttatggccgtggctga

SEQ ID NO: 7730126 - DNA, 22 bp, Homo sapiens
ctcttcttgaaagaggaattca

SEQ ID NO: 7730127 - DNA, 22 bp, Homo sapiens
tttgcaaagtgactattatatg

SEQ ID NO: 7730128 - DNA, 18 bp, Homo sapiens
tttgcaaaggaagtatgg

SEQ ID NO: 7730129 - DNA, 22 bp, Homo sapiens
tttgcaaagaaattattgctgt

SEQ ID NO: 7730130 - DNA, 22 bp, Homo sapiens
tttccaagactccagttctccc

SEQ ID NO: 7730131 - DNA, 22 bp, Homo sapiens
tttccaagagcttatttctgaa

SEQ ID NO: 7730132 - DNA, 22 bp, Homo sapiens
tttcagtttatgtcttgaatta

SEQ ID NO: 7730133 - DNA, 22 bp, Homo sapiens
tttcagtttccagctttgtcat

SEQ ID NO: 7730134 - DNA, 22 bp, Homo sapiens
tttattcatcatctgttcatat

SEQ ID NO: 7730135 - DNA, 22 bp, Homo sapiens
ttatttcatgtaaaatttatgt

SEQ ID NO: 7730136 - DNA, 22 bp, Homo sapiens
ttatccaagcagaagctgcaca

SEQ ID NO: 7730137 - DNA, 22 bp, Homo sapiens
ttcaaatacattctttgccact

SEQ ID NO: 7730138 - DNA, 22 bp, Homo sapiens
ttaagatagaacccagtagtct

SEQ ID NO: 7730139 - DNA, 22 bp, Homo sapiens
gacctggaggatcctcttcttg

SEQ ID NO: 7730140 - DNA, 22 bp, Homo sapiens
gaaattattgctagagactgca

SEQ ID NO: 7730141 - DNA, 22 bp, Homo sapiens
cttgcttcattagtgtcttagt

SEQ ID NO: 7730142 - DNA, 19 bp, Homo sapiens
cttcttcttggcagccaag

SEQ ID NO: 7730143 - DNA, 22 bp, Homo sapiens
cttcttcatgtattgatagtct

SEQ ID NO: 7730144 - DNA, 20 bp, Homo sapiens
cttcttcattaaccctactg

SEQ ID NO: 7730145 - DNA, 22 bp, Homo sapiens
ctttccaagaatgcagatacct

SEQ ID NO: 7730146 - DNA, 22 bp, Homo sapiens
ctttccaatgcatttccaatgt

SEQ ID NO: 7730147 - DNA, 20 bp, Homo sapiens
cttcttcagcctatgcttca

SEQ ID NO: 7730148 - DNA, 20 bp, Homo sapiens
cttcttcagtagtttgttct

SEQ ID NO: 7730149 - DNA, 22 bp, Homo sapiens
cttcttcataggcagtcctgtt

SEQ ID NO: 7730150 - DNA, 22 bp, Homo sapiens
cttcttcagttgcatgtattgg

SEQ ID NO: 7730151 - DNA, 22 bp, Homo sapiens
cttcttcatctgtaaaacttgg

SEQ ID NO: 7730152 - DNA, 22 bp, Homo sapiens
cttcttcagcacaatattgatg

SEQ ID NO: 7730153 - DNA, 22 bp, Homo sapiens
cttcttcaatagcaagcgcata

SEQ ID NO: 7730154 - DNA, 22 bp, Homo sapiens
cttcttcacactggtctgaagc

SEQ ID NO: 7730155 - DNA, 22 bp, Homo sapiens
cttcttcaacctgaaagtttca

SEQ ID NO: 7730156 - DNA, 22 bp, Homo sapiens
cttcttcaagagaatgggagac

SEQ ID NO: 7730157 - DNA, 20 bp, Homo sapiens
ctgtggaattttaccatgcg

SEQ ID NO: 7730158 - DNA, 22 bp, Homo sapiens
ctgtggaattgatgcttagtgt

SEQ ID NO: 7730159 - DNA, 22 bp, Homo sapiens
gcattctttttaggaggttcct

SEQ ID NO: 7730160 - DNA, 22 bp, Homo sapiens
gcagttctacttatccatagac

SEQ ID NO: 7730161 - DNA, 22 bp, Homo sapiens
gctctcttggtggctgtcctgg

SEQ ID NO: 7730162 - DNA, 22 bp, Homo sapiens
gtcactgtatccaggttccagc

SEQ ID NO: 7730163 - DNA, 22 bp, Homo sapiens
gtctatatattgcttgaataat

SEQ ID NO: 7730164 - DNA, 22 bp, Homo sapiens
ggttatataattcagtgctttc

SEQ ID NO: 7730165 - DNA, 22 bp, Homo sapiens
tccatgtgttttcctgtccaca

SEQ ID NO: 7730166 - DNA, 22 bp, Homo sapiens
tcatacatctgtcctggagctc

SEQ ID NO: 7730167 - DNA, 22 bp, Homo sapiens
tcatttccctcctacaaagagg

SEQ ID NO: 7730168 - DNA, 22 bp, Homo sapiens
tcaaataccagcaatttcatgt

SEQ ID NO: 7730169 - DNA, 22 bp, Homo sapiens
tcaaataatgccattcatcatc

SEQ ID NO: 7730170 - DNA, 22 bp, Homo sapiens
tatttgcaacataaaactctga

SEQ ID NO: 7730171 - DNA, 22 bp, Homo sapiens
tatgaaacattcatacaaataa

SEQ ID NO: 7730172 - DNA, 22 bp, Homo sapiens
gttatacatatgtgttaacaaa

SEQ ID NO: 7730173 - DNA, 22 bp, Homo sapiens
gttatatatagtatttctctga

SEQ ID NO: 7730174 - DNA, 22 bp, Homo sapiens
gttatcatgcttcatcatcact

SEQ ID NO: 7730175 - DNA, 22 bp, Homo sapiens
gttcttcatcttaaccatctgt

SEQ ID NO: 7730176 - DNA, 22 bp, Homo sapiens
gttcttcatcattaacactctg

SEQ ID NO: 7730177 - DNA, 22 bp, Homo sapiens
gttcttcatcattttagatagg

SEQ ID NO: 7730178 - DNA, 22 bp, Homo sapiens
gttcttcagtaaaattaaatgt

SEQ ID NO: 7730179 - DNA, 22 bp, Homo sapiens
gttcttcaggctgtgctctaga

SEQ ID NO: 7730180 - DNA, 22 bp, Homo sapiens
gttcttcagtcacatcacagaa

SEQ ID NO: 7730181 - DNA, 22 bp, Homo sapiens
taaaacttaactatccagatta

SEQ ID NO: 7730182 - DNA, 22 bp, Homo sapiens
tacacacatgcatttgccttat

SEQ ID NO: 7730183 - DNA, 22 bp, Homo sapiens
tacacacagaggccatgggatt

SEQ ID NO: 7730184 - DNA, 20 bp, Homo sapiens
tacagaatgcaataaaatgg

SEQ ID NO: 7730185 - DNA, 21 bp, Homo sapiens
tacagaatgcgcttcagtctg

SEQ ID NO: 7730186 - DNA, 22 bp, Homo sapiens
tacaacattgtgttgcttcata

SEQ ID NO: 7730187 - DNA, 22 bp, Homo sapiens
taattattctagtcacatagca

SEQ ID NO: 7730188 - DNA, 22 bp, Homo sapiens
taattattatgacaacaattgc

SEQ ID NO: 7730189 - DNA, 22 bp, Homo sapiens
taatatctacttcatagagttt

SEQ ID NO: 7730190 - DNA, 23 bp, Homo sapiens
taattcacatatacattgcttca

SEQ ID NO: 7730191 - DNA, 22 bp, Homo sapiens
taattatttgaagacattagag

SEQ ID NO: 7730192 - DNA, 22 bp, Homo sapiens
taattccaagttgagacatgca

SEQ ID NO: 7730193 - DNA, 22 bp, Homo sapiens
tactatctcttctaacttcaga

SEQ ID NO: 7730194 - DNA, 22 bp, Homo sapiens
ttgacaatgtcctttgaatttc

SEQ ID NO: 7730195 - DNA, 22 bp, Homo sapiens
ttgacacagatcaatattcaac

SEQ ID NO: 7730196 - DNA, 22 bp, Homo sapiens
ttgacacagttttctcattaag

SEQ ID NO: 7730197 - DNA, 22 bp, Homo sapiens
tttcactagaacgttcttgttt

SEQ ID NO: 7730198 - DNA, 22 bp, Homo sapiens
tttcagaaagctgaacatatga

SEQ ID NO: 7730199 - DNA, 22 bp, Homo sapiens
tttcatgaggggcaaaatctca

SEQ ID NO: 7730200 - DNA, 22 bp, Homo sapiens
tttcatgagattcctccacatc

SEQ ID NO: 7730201 - DNA, 22 bp, Homo sapiens
tttcatggctaggactagagtg

SEQ ID NO: 7730202 - DNA, 22 bp, Homo sapiens
tttcccagttccctgctctata

SEQ ID NO: 7730203 - DNA, 23 bp, Homo sapiens
tttcaaattactctgcagatgac

SEQ ID NO: 7730204 - DNA, 23 bp, Homo sapiens
tttcaactcctgccattatttct

SEQ ID NO: 7730205 - DNA, 23 bp, Homo sapiens
tttatccaactctgtaatctctc

SEQ ID NO: 7730206 - DNA, 22 bp, Homo sapiens
tttagaagttcacacatttaaa

SEQ ID NO: 7730207 - DNA, 22 bp, Homo sapiens
ttctccaacacaagcatgatgt

SEQ ID NO: 7730208 - DNA, 22 bp, Homo sapiens
ttctgtgaatcttttttcccac

SEQ ID NO: 7730209 - DNA, 22 bp, Homo sapiens
ttctgtgattgacatgtggctt

SEQ ID NO: 7730210 - DNA, 22 bp, Homo sapiens
ttcttatagaagcaaccattgt

SEQ ID NO: 7730211 - DNA, 22 bp, Homo sapiens
ttgaacattggcaatttcatat

SEQ ID NO: 7730212 - DNA, 22 bp, Homo sapiens
ttcttttctttaggcattgtgt

SEQ ID NO: 7730213 - DNA, 22 bp, Homo sapiens
ttcttcaaccatctacataaac

SEQ ID NO: 7730214 - DNA, 22 bp, Homo sapiens
ttcttcaacaaggacactgtta

SEQ ID NO: 7730215 - DNA, 22 bp, Homo sapiens
ttcttcaaatagcagggagtca

SEQ ID NO: 7730216 - DNA, 22 bp, Homo sapiens
ttcttcaattttccatatactg

SEQ ID NO: 7730217 - DNA, 22 bp, Homo sapiens
ttcttcaatgtgccctgttttc

SEQ ID NO: 7730218 - DNA, 21 bp, Homo sapiens
ttcttcaaagaagaaggcaca

SEQ ID NO: 7730219 - DNA, 22 bp, Homo sapiens
ttcttcaaacaaaagtggcatg

SEQ ID NO: 7730220 - DNA, 22 bp, Homo sapiens
ttcttcaaaacaacactggcct

SEQ ID NO: 7730221 - DNA, 22 bp, Homo sapiens
ttatagaaggagcattcactta

SEQ ID NO: 7730222 - DNA, 22 bp, Homo sapiens
ttatactaaaacgcattgaatt

SEQ ID NO: 7730223 - DNA, 22 bp, Homo sapiens
ttatacatgtgttttgagatga

SEQ ID NO: 7730224 - DNA, 22 bp, Homo sapiens
ttcaaacagtgtagaatatatg

SEQ ID NO: 7730225 - DNA, 22 bp, Homo sapiens
ttattcttttctccagaatccc

SEQ ID NO: 7730226 - DNA, 22 bp, Homo sapiens
ttattctttaaacatatatgtt

SEQ ID NO: 7730227 - DNA, 22 bp, Homo sapiens
ttattatagattatgcaagatt

SEQ ID NO: 7730228 - DNA, 22 bp, Homo sapiens
ttcagcaagaccaccatgtacc

SEQ ID NO: 7730229 - DNA, 22 bp, Homo sapiens
tttttataactcttttgtgaca

SEQ ID NO: 7730230 - DNA, 22 bp, Homo sapiens
tttttcagccatgaattacact

SEQ ID NO: 7730231 - DNA, 22 bp, Homo sapiens
tttgaatgcaggacatacagaa

SEQ ID NO: 7730232 - DNA, 22 bp, Homo sapiens
acatgcatacacgtacatacct

SEQ ID NO: 7730233 - DNA, 22 bp, Homo sapiens
acatgcataggagaagtcttta

SEQ ID NO: 7730234 - DNA, 22 bp, Homo sapiens
aagtataagctattcttcatga

SEQ ID NO: 7730235 - DNA, 22 bp, Homo sapiens
aagtccatgatcaagatgtggc

SEQ ID NO: 7730236 - DNA, 22 bp, Homo sapiens
aatgcatatgtaggcaagcagt

SEQ ID NO: 7730237 - DNA, 21 bp, Homo sapiens
aatgcattaacataaagctga

SEQ ID NO: 7730238 - DNA, 22 bp, Homo sapiens
acacaagttctaaagattgcgc

SEQ ID NO: 7730239 - DNA, 22 bp, Homo sapiens
acacaatgcatatttttccaga

SEQ ID NO: 7730240 - DNA, 22 bp, Homo sapiens
acacatattcatatgtacttac

SEQ ID NO: 7730241 - DNA, 18 bp, Homo sapiens
aatttccatatgaattgc

SEQ ID NO: 7730242 - DNA, 22 bp, Homo sapiens
aatgtattcctcatgcaagagt

SEQ ID NO: 7730243 - DNA, 22 bp, Homo sapiens
acaatacaggcttctggactta

SEQ ID NO: 7730244 - DNA, 22 bp, Homo sapiens
acaacattatacatagaaagct

SEQ ID NO: 7730245 - DNA, 22 bp, Homo sapiens
acaacattcttaaatacactga

SEQ ID NO: 7730246 - DNA, 22 bp, Homo sapiens
acacaaattgtaggataattgc

SEQ ID NO: 7730247 - DNA, 22 bp, Homo sapiens
aaatatagtaaatgcatagttc

SEQ ID NO: 7730248 - DNA, 22 bp, Homo sapiens
aaatatagtgacacttatagtc

SEQ ID NO: 7730249 - DNA, 22 bp, Homo sapiens
aacatgatggggaagaacaaga

SEQ ID NO: 7730250 - DNA, 21 bp, Homo sapiens
aaatacagaaacttgttttca

SEQ ID NO: 7730251 - DNA, 22 bp, Homo sapiens
aaatacagagttgcttaaaagc

SEQ ID NO: 7730252 - DNA, 22 bp, Homo sapiens
aaaataacttctactatttgca

SEQ ID NO: 7730253 - DNA, 22 bp, Homo sapiens
aaaatactgtggagtgttgaaa

SEQ ID NO: 7730254 - DNA, 22 bp, Homo sapiens
aaaacagtttaggcatcacagt

SEQ ID NO: 7730255 - DNA, 22 bp, Homo sapiens
aatgaaatgtagcttatccata

SEQ ID NO: 7730256 - DNA, 19 bp, Homo sapiens
aatacagtgttatagaatt

SEQ ID NO: 7730257 - DNA, 22 bp, Homo sapiens
aatacatatggaattccatgtt

SEQ ID NO: 7730258 - DNA, 22 bp, Homo sapiens
aatacagtaattttgatgagtt

SEQ ID NO: 7730259 - DNA, 22 bp, Homo sapiens
aatacagtaggtaatagttcat

SEQ ID NO: 7730260 - DNA, 22 bp, Homo sapiens
aatatccacactgtgtccctgc

SEQ ID NO: 7730261 - DNA, 22 bp, Homo sapiens
aatataattttattcctagagt

SEQ ID NO: 7730262 - DNA, 23 bp, Homo sapiens
acagaaatcatttgtaaggtacc

SEQ ID NO: 7730263 - DNA, 22 bp, Homo sapiens
acaatattgtacccagaagttt

SEQ ID NO: 7730264 - DNA, 22 bp, Homo sapiens
acaatgtgtttttatacatttg

SEQ ID NO: 7730265 - DNA, 22 bp, Homo sapiens
acaaatatttactgaatccact

SEQ ID NO: 7730266 - DNA, 22 bp, Homo sapiens
attgtataacagcatgtatttt

SEQ ID NO: 7730267 - DNA, 22 bp, Homo sapiens
agtgtgtctgatcacttgtgag

SEQ ID NO: 7730268 - DNA, 22 bp, Homo sapiens
agtgtgtccagaaatctgtatt

SEQ ID NO: 7730269 - DNA, 22 bp, Homo sapiens
acatgtaaaaggaacatgcatg

SEQ ID NO: 7730270 - DNA, 22 bp, Homo sapiens
acatatattactagtaaagaca

SEQ ID NO: 7730271 - DNA, 21 bp, Homo sapiens
acagcatgtttgtgtgtttgc

SEQ ID NO: 7730272 - DNA, 20 bp, Homo sapiens
agcttcttctgtctaatttt

SEQ ID NO: 7730273 - DNA, 22 bp, Homo sapiens
agcttcttggctcagcacttgg

SEQ ID NO: 7730274 - DNA, 23 bp, Homo sapiens
ccacagagctgccaattcctgtg

SEQ ID NO: 7730275 - DNA, 22 bp, Homo sapiens
ccacagagcattagatttcaga

SEQ ID NO: 7730276 - DNA, 22 bp, Homo sapiens
ccacagagacagggtccttgct

SEQ ID NO: 7730277 - DNA, 23 bp, Homo sapiens
ccactagcacctgttcaacttct

SEQ ID NO: 7730278 - DNA, 22 bp, Homo sapiens
cataatatactacattgatgaa

SEQ ID NO: 7730279 - DNA, 22 bp, Homo sapiens
agtattgtgactcaagtattct

SEQ ID NO: 7730280 - DNA, 22 bp, Homo sapiens
agtccatggttctgactcatct

SEQ ID NO: 7730281 - DNA, 22 bp, Homo sapiens
agttataatctgctactgatat

SEQ ID NO: 7730282 - DNA, 22 bp, Homo sapiens
ctgcattagtcatgctttgcag

SEQ ID NO: 7730283 - DNA, 22 bp, Homo sapiens
agttatatgtgaaaacacgtat

SEQ ID NO: 7730284 - DNA, 22 bp, Homo sapiens
agttattactctttaacatatt

SEQ ID NO: 7730285 - DNA, 21 bp, Homo sapiens
ataagcatgctgattacattt

SEQ ID NO: 7730286 - DNA, 22 bp, Homo sapiens
ataagcatgttagaatatttga

SEQ ID NO: 7730287 - DNA, 22 bp, Homo sapiens
atacaacagaaaatgattattc

SEQ ID NO: 7730288 - DNA, 22 bp, Homo sapiens
atacaactttacatgcaattcc

SEQ ID NO: 7730289 - DNA, 22 bp, Homo sapiens
atactaaagtatagaacttagt

SEQ ID NO: 7730290 - DNA, 21 bp, Homo sapiens
atacattctattaagcattta

SEQ ID NO: 7730291 - DNA, 22 bp, Homo sapiens
atacatacatgtatgcacatac

SEQ ID NO: 7730292 - DNA, 19 bp, Homo sapiens
atacagatgtatccatgat

SEQ ID NO: 7730293 - DNA, 22 bp, Homo sapiens
ctggctgggagcgagctgctca

SEQ ID NO: 7730294 - DNA, 22 bp, Homo sapiens
atttccatagagcgtctcacag

SEQ ID NO: 7730295 - DNA, 22 bp, Homo sapiens
atttccagtcctaatgatctgg

SEQ ID NO: 7730296 - DNA, 22 bp, Homo sapiens
atttccaggagaaaggatttta

SEQ ID NO: 7730297 - DNA, 22 bp, Homo sapiens
attttactactccaattaatga

SEQ ID NO: 7730298 - DNA, 22 bp, Homo sapiens
attttactttgtgaatattgac

SEQ ID NO: 7730299 - DNA, 22 bp, Homo sapiens
caaatgatacctattactaggc

SEQ ID NO: 7730300 - DNA, 22 bp, Homo sapiens
caaatactgggtaagttaattt

SEQ ID NO: 7730301 - DNA, 22 bp, Homo sapiens
attgtgcaaatattatctgtag

SEQ ID NO: 7730302 - DNA, 22 bp, Homo sapiens
attcttcagtatgtgtggattg

SEQ ID NO: 7730303 - DNA, 22 bp, Homo sapiens
attcataacggcaaatgtcacc

SEQ ID NO: 7730304 - DNA, 22 bp, Homo sapiens
attcaaattaagttaattcagc

SEQ ID NO: 7730305 - DNA, 22 bp, Homo sapiens
attagtaaaacattgtatatgt

SEQ ID NO: 7730306 - DNA, 20 bp, Homo sapiens
atgtgtctgtaaacaactct

SEQ ID NO: 7730307 - DNA, 22 bp, Homo sapiens
atgttcttccaaatctgtaaca

SEQ ID NO: 7730308 - DNA, 22 bp, Homo sapiens
atgttcttgttcaaatgtcagt

SEQ ID NO: 7730309 - DNA, 22 bp, Homo sapiens
atgttctttcagccagtgcatc

SEQ ID NO: 7730310 - DNA, 22 bp, Homo sapiens
atgatatttgcaatgtgcttgc

SEQ ID NO: 7730311 - DNA, 22 bp, Homo sapiens
atgaaacacacacgcgcatact

SEQ ID NO: 7730312 - DNA, 22 bp, Homo sapiens
atgaaacagtgtgtatagcaaa

SEQ ID NO: 7730313 - DNA, 22 bp, Homo sapiens
gtcatatacactgcatgtaatc

SEQ ID NO: 7730314 - DNA, 22 bp, Homo sapiens
caaatgtaaattcttttgaagc

SEQ ID NO: 7730315 - DNA, 22 bp, Homo sapiens
caaatgtataaatgtactttct

SEQ ID NO: 7730316 - DNA, 22 bp, Homo sapiens
caaatgtattctcacttcaggg

SEQ ID NO: 7730317 - DNA, 22 bp, Homo sapiens
tcttccctaatcaccatcttca

SEQ ID NO: 7730318 - DNA, 22 bp, Homo sapiens
tcttcagaggaagtcagtcttt

SEQ ID NO: 7730319 - DNA, 22 bp, Homo sapiens
tcttcagagtgaaagtctgtga

SEQ ID NO: 7730320 - DNA, 22 bp, Homo sapiens
tcttcagacccttagctgtgat

SEQ ID NO: 7730321 - DNA, 22 bp, Homo sapiens
tcttcagactccaaatgtttta

SEQ ID NO: 7730322 - DNA, 22 bp, Homo sapiens
tcttcagataaagggagagtat

SEQ ID NO: 7730323 - DNA, 22 bp, Homo sapiens
tctttcaatgagcattctttcc

SEQ ID NO: 7730324 - DNA, 22 bp, Homo sapiens
tgacagttaaggtatacattca

SEQ ID NO: 7730325 - DNA, 22 bp, Homo sapiens
taatacagaagtgtattaaaat

SEQ ID NO: 7730326 - DNA, 21 bp, Homo sapiens
taataattccactacagagta

SEQ ID NO: 7730327 - DNA, 22 bp, Homo sapiens
taatgtcaaggtgatagatttg

SEQ ID NO: 7730328 - DNA, 22 bp, Homo sapiens
taatgtcagcatagtttatttt

SEQ ID NO: 7730329 - DNA, 22 bp, Homo sapiens
cataatatctccgattacttgc

SEQ ID NO: 7730330 - DNA, 22 bp, Homo sapiens
cagttcttaataccatgtggtt

SEQ ID NO: 7730331 - DNA, 22 bp, Homo sapiens
cagttcttatttggccagtgtc

SEQ ID NO: 7730332 - DNA, 22 bp, Homo sapiens
cagttctttgtggggagttctc

SEQ ID NO: 7730333 - DNA, 22 bp, Homo sapiens
cattcatttatgaaatatctat

SEQ ID NO: 7730334 - DNA, 22 bp, Homo sapiens
cattcttacacaatattttaat

SEQ ID NO: 7730335 - DNA, 22 bp, Homo sapiens
cattcttatatttactcattca

SEQ ID NO: 7730336 - DNA, 22 bp, Homo sapiens
cattgttaattggtatcttaca

SEQ ID NO: 7730337 - DNA, 22 bp, Homo sapiens
ctcttcttgctagactgagtgc

SEQ ID NO: 7730338 - DNA, 22 bp, Homo sapiens
ctcttcttgcctgatgaggcag

SEQ ID NO: 7730339 - DNA, 22 bp, Homo sapiens
ttttcagttccatctctgctct

SEQ ID NO: 7730340 - DNA, 22 bp, Homo sapiens
ttttcagaggcctaagaggttt

SEQ ID NO: 7730341 - DNA, 22 bp, Homo sapiens
ttttcagtaatgtctacataat

SEQ ID NO: 7730342 - DNA, 22 bp, Homo sapiens
ttttcagtgggcaatgatgtga

SEQ ID NO: 7730343 - DNA, 22 bp, Homo sapiens
ttcttttcctacacagcgattt

SEQ ID NO: 7730344 - DNA, 22 bp, Homo sapiens
ttgaaatactgcattgttcagt

SEQ ID NO: 7730345 - DNA, 22 bp, Homo sapiens
tttcctagttctaagaaatgta

SEQ ID NO: 7730346 - DNA, 22 bp, Homo sapiens
tttcctaggagattgatcacat

SEQ ID NO: 7730347 - DNA, 22 bp, Homo sapiens
tttccagagcatgtctgctcag

SEQ ID NO: 7730348 - DNA, 20 bp, Homo sapiens
tttcacagtccctgtttcct

SEQ ID NO: 7730349 - DNA, 22 bp, Homo sapiens
tttcacaaatgtctttaacttg

SEQ ID NO: 7730350 - DNA, 21 bp, Homo sapiens
tttcacaaaagtatgtgacaa

SEQ ID NO: 7730351 - DNA, 19 bp, Homo sapiens
ttcacaattatgaaattag

SEQ ID NO: 7730352 - DNA, 22 bp, Homo sapiens
ttcagcaaatggactgttcagg

SEQ ID NO: 7730353 - DNA, 22 bp, Homo sapiens
ttcagcaaacacgatgcttgtt

SEQ ID NO: 7730354 - DNA, 22 bp, Homo sapiens
ctgtcccttcattattcactac

SEQ ID NO: 7730355 - DNA, 22 bp, Homo sapiens
cttgtccccagcaggttggttt

SEQ ID NO: 7730356 - DNA, 22 bp, Homo sapiens
cttgcacacatgtacatgtgta

SEQ ID NO: 7730357 - DNA, 22 bp, Homo sapiens
ctgcatcagtggatatgatggt

SEQ ID NO: 7730358 - DNA, 22 bp, Homo sapiens
ctggcttgcagctcatcataaa

SEQ ID NO: 7730359 - DNA, 22 bp, Homo sapiens
ctgggaaatggcttcgagctca

SEQ ID NO: 7730360 - DNA, 22 bp, Homo sapiens
gaatacatgatacatgaactgc

SEQ ID NO: 7730361 - DNA, 22 bp, Homo sapiens
gaatacattggaaatcagaata

SEQ ID NO: 7730362 - DNA, 23 bp, Homo sapiens
gtaaaatacgcagtgcagtgtga

SEQ ID NO: 7730363 - DNA, 22 bp, Homo sapiens
gcaaatattcaagacttttcca

SEQ ID NO: 7730364 - DNA, 22 bp, Homo sapiens
gctggcttgatagtttctgctt

SEQ ID NO: 7730365 - DNA, 22 bp, Homo sapiens
tccatgagtttgaggaaaagag

SEQ ID NO: 7730366 - DNA, 20 bp, Homo sapiens
tccatgagttagagactata

SEQ ID NO: 7730367 - DNA, 22 bp, Homo sapiens
tccatgagggacactggatgct

SEQ ID NO: 7730368 - DNA, 22 bp, Homo sapiens
tccatgaggcagggaggctggc

SEQ ID NO: 7730369 - DNA, 22 bp, Homo sapiens
tccatgaggaccaaattcgtag

SEQ ID NO: 7730370 - DNA, 22 bp, Homo sapiens
tccatgagctagctttccaaag

SEQ ID NO: 7730371 - DNA, 22 bp, Homo sapiens
tccatgagctagggattcatca

SEQ ID NO: 7730372 - DNA, 23 bp, Homo sapiens
tccatgagatgtgggcttctagt

SEQ ID NO: 7730373 - DNA, 22 bp, Homo sapiens
tccatgagaacccttggagata

SEQ ID NO: 7730374 - DNA, 22 bp, Homo sapiens
tccatgagacagatactgtaag

SEQ ID NO: 7730375 - DNA, 22 bp, Homo sapiens
tccatgagaggtaactttacaa

SEQ ID NO: 7730376 - DNA, 17 bp, Homo sapiens
tccatgagacatgaaga

SEQ ID NO: 7730377 - DNA, 22 bp, Homo sapiens
tcacaaatagctatattaagga

SEQ ID NO: 7730378 - DNA, 22 bp, Homo sapiens
tcagtcttccctccagtgcaac

SEQ ID NO: 7730379 - DNA, 22 bp, Homo sapiens
tcagtctttgcttatgacaata

SEQ ID NO: 7730380 - DNA, 22 bp, Homo sapiens
tcattatcctagtatcttgaat

SEQ ID NO: 7730381 - DNA, 22 bp, Homo sapiens
tcattattttggactggagtgt

SEQ ID NO: 7730382 - DNA, 22 bp, Homo sapiens
tagaaacatcagctaaccaaaa

SEQ ID NO: 7730383 - DNA, 22 bp, Homo sapiens
tagaaataaatctgcagctggg

SEQ ID NO: 7730384 - DNA, 22 bp, Homo sapiens
tattcaaagtaccttcattgcc

SEQ ID NO: 7730385 - DNA, 22 bp, Homo sapiens
tattattaaatggcagaatttt

SEQ ID NO: 7730386 - DNA, 22 bp, Homo sapiens
tatctaaaggatttaatttagt

SEQ ID NO: 7730387 - DNA, 22 bp, Homo sapiens
tatctaaatggaatattccaga

SEQ ID NO: 7730388 - DNA, 22 bp, Homo sapiens
tatatcatggagattaacattc

SEQ ID NO: 7730389 - DNA, 22 bp, Homo sapiens
tacagtaagatgaaatagcaat

SEQ ID NO: 7730390 - DNA, 22 bp, Homo sapiens
tacaaagtagaaattcagtaaa

SEQ ID NO: 7730391 - DNA, 22 bp, Homo sapiens
tacaaagtaatgtataatatcg

SEQ ID NO: 7730392 - DNA, 22 bp, Homo sapiens
taaaatgatctctcatgttctt

SEQ ID NO: 7730393 - DNA, 22 bp, Homo sapiens
taaattatgtcacatgactctg

SEQ ID NO: 7730394 - DNA, 22 bp, Homo sapiens
taaattatgttccatgtccttt

SEQ ID NO: 7730395 - DNA, 22 bp, Homo sapiens
taaattatggctggcagagcag

SEQ ID NO: 7730396 - DNA, 21 bp, Homo sapiens
ttccagagattgtttcacctg

SEQ ID NO: 7730397 - DNA, 22 bp, Homo sapiens
ttctacaatatgaataatgaag

SEQ ID NO: 7730398 - DNA, 22 bp, Homo sapiens
ttcaactaatgtttattttatg

SEQ ID NO: 7730399 - DNA, 22 bp, Homo sapiens
ttcaactattatgaataaaatt

SEQ ID NO: 7730400 - DNA, 22 bp, Homo sapiens
ttcaactagatttatacaattc

SEQ ID NO: 7730401 - DNA, 22 bp, Homo sapiens
ttcagtaaaacactgcaatgtc

SEQ ID NO: 7730402 - DNA, 22 bp, Homo sapiens
ttcatgtgataaatgtgtgact

SEQ ID NO: 7730403 - DNA, 22 bp, Homo sapiens
ttcatgtgaatatatttgtctt

SEQ ID NO: 7730404 - DNA, 22 bp, Homo sapiens
ttctcttttcaccagttgctaa

SEQ ID NO: 7730405 - DNA, 22 bp, Homo sapiens
ttcttacagagtttacagagcc

SEQ ID NO: 7730406 - DNA, 22 bp, Homo sapiens
ttcttctttatctcagtatcct

SEQ ID NO: 7730407 - DNA, 22 bp, Homo sapiens
ttcttcttgtctgccctcacat

SEQ ID NO: 7730408 - DNA, 21 bp, Homo sapiens
ttcttcttggactgttttggc

SEQ ID NO: 7730409 - DNA, 22 bp, Homo sapiens
ttcttctttcctataattaatt

SEQ ID NO: 7730410 - DNA, 22 bp, Homo sapiens
ttcttctttccccctgtggtac

SEQ ID NO: 7730411 - DNA, 22 bp, Homo sapiens
ttcttaaaacttatggacaggt

SEQ ID NO: 7730412 - DNA, 23 bp, Homo sapiens
ttctttcaagaagttcacagtgc

SEQ ID NO: 7730413 - DNA, 23 bp, Homo sapiens
ttgatttcaaatgcagagaacac

SEQ ID NO: 7730414 - DNA, 22 bp, Homo sapiens
ttacacaacatctgtattatta

SEQ ID NO: 7730415 - DNA, 22 bp, Homo sapiens
ttaaatattttcagcagggtca

SEQ ID NO: 7730416 - DNA, 22 bp, Homo sapiens
ttaaatattatgttgtctgcaa

SEQ ID NO: 7730417 - DNA, 22 bp, Homo sapiens
ttaacatacatcatgaacaatg

SEQ ID NO: 7730418 - DNA, 22 bp, Homo sapiens
tgtgttattgccactgaagacc

SEQ ID NO: 7730419 - DNA, 22 bp, Homo sapiens
tgtttgaactgaataacatagt

SEQ ID NO: 7730420 - DNA, 23 bp, Homo sapiens
tttggacttgtgactcttctcct

SEQ ID NO: 7730421 - DNA, 22 bp, Homo sapiens
tttggacttagcctgcagaatt

SEQ ID NO: 7730422 - DNA, 22 bp, Homo sapiens
tttgcagtgattcttgcagtga

SEQ ID NO: 7730423 - DNA, 22 bp, Homo sapiens
tttgcaaataccatgaaacttg

SEQ ID NO: 7730424 - DNA, 22 bp, Homo sapiens
tttgcagtagacatcttatttt

SEQ ID NO: 7730425 - DNA, 22 bp, Homo sapiens
tttgcactagcatttgtccatg

SEQ ID NO: 7730426 - DNA, 22 bp, Homo sapiens
ttttatagctgaatagtattcc

SEQ ID NO: 7730427 - DNA, 22 bp, Homo sapiens
tttcaaagaccattaactatca

SEQ ID NO: 7730428 - DNA, 22 bp, Homo sapiens
tttcaaagagttgtaaattact

SEQ ID NO: 7730429 - DNA, 20 bp, Homo sapiens
tttctgtgagaaacactgtt

SEQ ID NO: 7730430 - DNA, 20 bp, Homo sapiens
tttctgtgcccaggtctgtt

SEQ ID NO: 7730431 - DNA, 22 bp, Homo sapiens
tttcttcattcaccttcacccc

SEQ ID NO: 7730432 - DNA, 22 bp, Homo sapiens
tttcttcatagaccttgtcttg

SEQ ID NO: 7730433 - DNA, 22 bp, Homo sapiens
tttcttcagccttcacaacctg

SEQ ID NO: 7730434 - DNA, 22 bp, Homo sapiens
tttcttcacagggtattgggtg

SEQ ID NO: 7730435 - DNA, 21 bp, Homo sapiens
tttcttcactttgccccatgt

SEQ ID NO: 7730436 - DNA, 23 bp, Homo sapiens
tttcttcagaagccttgcgaggc

SEQ ID NO: 7730437 - DNA, 22 bp, Homo sapiens
tttcttcagagagagctttccc

SEQ ID NO: 7730438 - DNA, 22 bp, Homo sapiens
tttcttcagccactccaaactg

SEQ ID NO: 7730439 - DNA, 22 bp, Homo sapiens
tttcttcaattgctaacaagga

SEQ ID NO: 7730440 - DNA, 22 bp, Homo sapiens
tttcaaacctacttgtatgttt

SEQ ID NO: 7730441 - DNA, 22 bp, Homo sapiens
tttcaaaattttgcagtggtaa

SEQ ID NO: 7730442 - DNA, 22 bp, Homo sapiens
tttcaaacatatcttcattact

SEQ ID NO: 7730443 - DNA, 22 bp, Homo sapiens
tttaaaatcagatgggagttgg

SEQ ID NO: 7730444 - DNA, 22 bp, Homo sapiens
tttaaaatttagacctctccac

SEQ ID NO: 7730445 - DNA, 22 bp, Homo sapiens
ttgttttatctttctacagact

SEQ ID NO: 7730446 - DNA, 22 bp, Homo sapiens
ttgttataaagactaaatatgt

SEQ ID NO: 7730447 - DNA, 22 bp, Homo sapiens
caaggcctatgcacacctagga

SEQ ID NO: 7730448 - DNA, 22 bp, Homo sapiens
caaggccttcgtctcctagctt

SEQ ID NO: 7730449 - DNA, 22 bp, Homo sapiens
gctgttcacattttgggccaaa

SEQ ID NO: 7730450 - DNA, 22 bp, Homo sapiens
cacaggagaaaggggaagctcg

SEQ ID NO: 7730451 - DNA, 20 bp, Homo sapiens
ggagctggcatccagcctct

SEQ ID NO: 7730452 - DNA, 22 bp, Homo sapiens
ggctgggaggatgacttgctac

SEQ ID NO: 7730453 - DNA, 22 bp, Homo sapiens
ggcctgggctccgggagttact

SEQ ID NO: 7730454 - DNA, 22 bp, Homo sapiens
ggctgaggcggcgatgcccttg

SEQ ID NO: 7730455 - DNA, 20 bp, Homo sapiens
cagcaggctatggggcaccc

SEQ ID NO: 7730456 - DNA, 22 bp, Homo sapiens
gtcccaggaacattctggctag

SEQ ID NO: 7730457 - DNA, 22 bp, Homo sapiens
gtcccaggcaggccactggcag

SEQ ID NO: 7730458 - DNA, 22 bp, Homo sapiens
gtcccaggagttgctgggcctt

SEQ ID NO: 7730459 - DNA, 22 bp, Homo sapiens
cagcagctggtgagacacagcc

SEQ ID NO: 7730460 - DNA, 22 bp, Homo sapiens
cagccaggtatgggcgtgcggg

SEQ ID NO: 7730461 - DNA, 22 bp, Homo sapiens
cagccagggtcaggcagcttct

SEQ ID NO: 7730462 - DNA, 22 bp, Homo sapiens
cagccaggggctggcgtgttga

SEQ ID NO: 7730463 - DNA, 22 bp, Homo sapiens
cagccagggagggcaaatgaga

SEQ ID NO: 7730464 - DNA, 22 bp, Homo sapiens
cagccctcaggtcctcagcagc

SEQ ID NO: 7730465 - DNA, 22 bp, Homo sapiens
cagccaggcctggtgaccaaag

SEQ ID NO: 7730466 - DNA, 22 bp, Homo sapiens
cagcctggcctgggactgctga

SEQ ID NO: 7730467 - DNA, 22 bp, Homo sapiens
cagcctggtccccggctcaccc

SEQ ID NO: 7730468 - DNA, 22 bp, Homo sapiens
cagcctgggctccagagtccct

SEQ ID NO: 7730469 - DNA, 22 bp, Homo sapiens
cagcctggacagcgaccagagt

SEQ ID NO: 7730470 - DNA, 22 bp, Homo sapiens
cagcctggagccacagcccagg

SEQ ID NO: 7730471 - DNA, 22 bp, Homo sapiens
cagcctctttccacatcaggca

SEQ ID NO: 7730472 - DNA, 21 bp, Homo sapiens
cagaggggctagcctggctgc

SEQ ID NO: 7730473 - DNA, 22 bp, Homo sapiens
ggtgacagtggttaaaatttgt

SEQ ID NO: 7730474 - DNA, 22 bp, Homo sapiens
cagagcctctcagaggtcagac

SEQ ID NO: 7730475 - DNA, 22 bp, Homo sapiens
cagaggagaattgcgggatcat

SEQ ID NO: 7730476 - DNA, 22 bp, Homo sapiens
cagagccgggagccagtcacag

SEQ ID NO: 7730477 - DNA, 19 bp, Homo sapiens
cagagcctcagagctagaa

SEQ ID NO: 7730478 - DNA, 22 bp, Homo sapiens
gggccagagcttggcagctggg

SEQ ID NO: 7730479 - DNA, 22 bp, Homo sapiens
gggcagcatgtcactagcatgg

SEQ ID NO: 7730480 - DNA, 22 bp, Homo sapiens
cagaccagaaggaagccgacaa

SEQ ID NO: 7730481 - DNA, 22 bp, Homo sapiens
cagacctcagtcctcagtagga

SEQ ID NO: 7730482 - DNA, 22 bp, Homo sapiens
gaccacacttttcccctgctag

SEQ ID NO: 7730483 - DNA, 22 bp, Homo sapiens
gaccacagagcacggcctgctt

SEQ ID NO: 7730484 - DNA, 22 bp, Homo sapiens
gactacaacaataagaacagct

SEQ ID NO: 7730485 - DNA, 22 bp, Homo sapiens
atgtcctcggctctgtgctgct

SEQ ID NO: 7730486 - DNA, 22 bp, Homo sapiens
atgtcctggcccgaggatggag

SEQ ID NO: 7730487 - DNA, 18 bp, Homo sapiens
atggtctcatactgggag

SEQ ID NO: 7730488 - DNA, 22 bp, Homo sapiens
gcaggcctggtttacatggtag

SEQ ID NO: 7730489 - DNA, 22 bp, Homo sapiens
gcagggctgatggcttccctca

SEQ ID NO: 7730490 - DNA, 22 bp, Homo sapiens
gcagggctgcagagggcactgt

SEQ ID NO: 7730491 - DNA, 22 bp, Homo sapiens
gctgaccatgaattaagcatct

SEQ ID NO: 7730492 - DNA, 20 bp, Homo sapiens
gctgaccataaatcacactg

SEQ ID NO: 7730493 - DNA, 22 bp, Homo sapiens
gctgaccattaggaggacgata

SEQ ID NO: 7730494 - DNA, 22 bp, Homo sapiens
gcctgacctcttctgccctggg

SEQ ID NO: 7730495 - DNA, 21 bp, Homo sapiens
gcctgaccttactactggggt

SEQ ID NO: 7730496 - DNA, 22 bp, Homo sapiens
cttcctcccggcccatgctctg

SEQ ID NO: 7730497 - DNA, 22 bp, Homo sapiens
cttccaggttctggttgggaag

SEQ ID NO: 7730498 - DNA, 22 bp, Homo sapiens
atctgcaggatgttaggatgat

SEQ ID NO: 7730499 - DNA, 22 bp, Homo sapiens
ctgctgccaagggtgccacagg

SEQ ID NO: 7730500 - DNA, 22 bp, Homo sapiens
ctgctgccattagggcacagac

SEQ ID NO: 7730501 - DNA, 22 bp, Homo sapiens
ctggctccatccttgagctctg

SEQ ID NO: 7730502 - DNA, 22 bp, Homo sapiens
ctgcagggtttttcaaggacaa

SEQ ID NO: 7730503 - DNA, 20 bp, Homo sapiens
ctgcagggttagaggctcca

SEQ ID NO: 7730504 - DNA, 22 bp, Homo sapiens
ctgcagagatgaagaaggtggc

SEQ ID NO: 7730505 - DNA, 22 bp, Homo sapiens
agtgtctgcgggcagaggagcg

SEQ ID NO: 7730506 - DNA, 22 bp, Homo sapiens
agtgtctgcctgggaggagcat

SEQ ID NO: 7730507 - DNA, 22 bp, Homo sapiens
ctctgcctgtctcatcctgcaa

SEQ ID NO: 7730508 - DNA, 22 bp, Homo sapiens
ctctgcagtgtaacagcgcttg

SEQ ID NO: 7730509 - DNA, 22 bp, Homo sapiens
ctctgcctgccactgttcaggc

SEQ ID NO: 7730510 - DNA, 22 bp, Homo sapiens
ctctgcaggggaggcatgcact

SEQ ID NO: 7730511 - DNA, 22 bp, Homo sapiens
ctctgcaggcacccagggtggg

SEQ ID NO: 7730512 - DNA, 23 bp, Homo sapiens
ctctgcaggagagtgggcagggc

SEQ ID NO: 7730513 - DNA, 22 bp, Homo sapiens
ctcctgggtcattgccagcaaa

SEQ ID NO: 7730514 - DNA, 22 bp, Homo sapiens
ctccctccaaataagactcggg

SEQ ID NO: 7730515 - DNA, 22 bp, Homo sapiens
ctccctccctacgtgagctcac

SEQ ID NO: 7730516 - DNA, 22 bp, Homo sapiens
ctccagagatccattgaatgta

SEQ ID NO: 7730517 - DNA, 22 bp, Homo sapiens
ctccagagatacacggtcttgc

SEQ ID NO: 7730518 - DNA, 22 bp, Homo sapiens
ctccagagccagtgcttttcca

SEQ ID NO: 7730519 - DNA, 22 bp, Homo sapiens
agtcctctggagtatgccttat

SEQ ID NO: 7730520 - DNA, 22 bp, Homo sapiens
aggtttgttttggaaagatcat

SEQ ID NO: 7730521 - DNA, 22 bp, Homo sapiens
aggtttgttaaaccagattgct

SEQ ID NO: 7730522 - DNA, 22 bp, Homo sapiens
aggtttgtgtcttgcttaaggt

SEQ ID NO: 7730523 - DNA, 23 bp, Homo sapiens
aggtttgtctcagaggcagagtt

SEQ ID NO: 7730524 - DNA, 22 bp, Homo sapiens
cctgttcaagttgcagggctgg

SEQ ID NO: 7730525 - DNA, 22 bp, Homo sapiens
cctgttcaccatggtcacgtgc

SEQ ID NO: 7730526 - DNA, 22 bp, Homo sapiens
cctggctctggttccctcagct

SEQ ID NO: 7730527 - DNA, 22 bp, Homo sapiens
cctggctctgcgtgcagctccg

SEQ ID NO: 7730528 - DNA, 21 bp, Homo sapiens
cctgccaggaaactgagtgtc

SEQ ID NO: 7730529 - DNA, 22 bp, Homo sapiens
cctgccagctgtgggccagcct

SEQ ID NO: 7730530 - DNA, 22 bp, Homo sapiens
cctgccagatcccctgagctga

SEQ ID NO: 7730531 - DNA, 23 bp, Homo sapiens
cctggcacacagttgacatggaa

SEQ ID NO: 7730532 - DNA, 18 bp, Homo sapiens
cctggcacactggctcat

SEQ ID NO: 7730533 - DNA, 22 bp, Homo sapiens
aggtcctctcccagggtactgc

SEQ ID NO: 7730534 - DNA, 22 bp, Homo sapiens
aggagccagtggagttcctgcc

SEQ ID NO: 7730535 - DNA, 23 bp, Homo sapiens
aggagccaggaaccagcttcccc

SEQ ID NO: 7730536 - DNA, 22 bp, Homo sapiens
aggagccagattctctcacttt

SEQ ID NO: 7730537 - DNA, 22 bp, Homo sapiens
aggagccaggaaacctgctctg

SEQ ID NO: 7730538 - DNA, 22 bp, Homo sapiens
ccacggccacccgctcatgggc

SEQ ID NO: 7730539 - DNA, 22 bp, Homo sapiens
ccacctggggctgtggcccctt

SEQ ID NO: 7730540 - DNA, 22 bp, Homo sapiens
ccacccagccagatgcaggaag

SEQ ID NO: 7730541 - DNA, 22 bp, Homo sapiens
ccacagtgttttgtcacattag

SEQ ID NO: 7730542 - DNA, 22 bp, Homo sapiens
caggagaaatgtggctgctacc

SEQ ID NO: 7730543 - DNA, 22 bp, Homo sapiens
caggactggaagtctcaagaga

SEQ ID NO: 7730544 - DNA, 22 bp, Homo sapiens
caggactgatgttcctccagcc

SEQ ID NO: 7730545 - DNA, 22 bp, Homo sapiens
caggactgaagggcacagggaa

SEQ ID NO: 7730546 - DNA, 22 bp, Homo sapiens
caggagcccagagtcctcagct

SEQ ID NO: 7730547 - DNA, 22 bp, Homo sapiens
caggagcagagggtggtcagca

SEQ ID NO: 7730548 - DNA, 22 bp, Homo sapiens
caggagcatgctgatgccagaa

SEQ ID NO: 7730549 - DNA, 22 bp, Homo sapiens
caggcagcgtcctgcttcctgt

SEQ ID NO: 7730550 - DNA, 22 bp, Homo sapiens
caggcagcctgcggtctgcaca

SEQ ID NO: 7730551 - DNA, 22 bp, Homo sapiens
aggaagaaacctactagagttt

SEQ ID NO: 7730552 - DNA, 18 bp, Homo sapiens
ccagaggcccgggcaggc

SEQ ID NO: 7730553 - DNA, 22 bp, Homo sapiens
ccagccagcaagctcccagttc

SEQ ID NO: 7730554 - DNA, 22 bp, Homo sapiens
ccagccagatgataagctctat

SEQ ID NO: 7730555 - DNA, 22 bp, Homo sapiens
ccagccagaagtccgggcttct

SEQ ID NO: 7730556 - DNA, 22 bp, Homo sapiens
ccagccagggaaactttttctt

SEQ ID NO: 7730557 - DNA, 22 bp, Homo sapiens
ccagccagtatattccaaagcc

SEQ ID NO: 7730558 - DNA, 22 bp, Homo sapiens
ccagccaggctggctgtggagg

SEQ ID NO: 7730559 - DNA, 22 bp, Homo sapiens
ccagccaggcattgcaaactga

SEQ ID NO: 7730560 - DNA, 22 bp, Homo sapiens
ccagccagctgcccttggggcc

SEQ ID NO: 7730561 - DNA, 22 bp, Homo sapiens
ccagccagccttgatctgagta

SEQ ID NO: 7730562 - DNA, 22 bp, Homo sapiens
ccagccagctggttggacgcct

SEQ ID NO: 7730563 - DNA, 22 bp, Homo sapiens
ccaggcacggtggctcatgcct

SEQ ID NO: 7730564 - DNA, 22 bp, Homo sapiens
aggctcagcctgggcctagagc

SEQ ID NO: 7730565 - DNA, 22 bp, Homo sapiens
ccaggcctttcttcttggtctg

SEQ ID NO: 7730566 - DNA, 22 bp, Homo sapiens
ccaggccttctgaggacactct

SEQ ID NO: 7730567 - DNA, 22 bp, Homo sapiens
ccaggcctgtgttgtgtggagg

SEQ ID NO: 7730568 - DNA, 20 bp, Homo sapiens
ccaggcctgggcctgctcta

SEQ ID NO: 7730569 - DNA, 22 bp, Homo sapiens
ccagggcagcagaattggggca

SEQ ID NO: 7730570 - DNA, 22 bp, Homo sapiens
ccagtgtgaccatctgttagct

SEQ ID NO: 7730571 - DNA, 22 bp, Homo sapiens
aggctgtgggaatggctgcttg

SEQ ID NO: 7730572 - DNA, 22 bp, Homo sapiens
ccctgaggcacaggccacgtat

SEQ ID NO: 7730573 - DNA, 22 bp, Homo sapiens
cccaggcctggtctgggccagt

SEQ ID NO: 7730574 - DNA, 22 bp, Homo sapiens
agggcctgtgaattctccctgc

SEQ ID NO: 7730575 - DNA, 21 bp, Homo sapiens
agggcctgtgctctccaggtc

SEQ ID NO: 7730576 - DNA, 22 bp, Homo sapiens
cctcagggaggcctctgtggct

SEQ ID NO: 7730577 - DNA, 22 bp, Homo sapiens
agggctgggctgcttgttgtca

SEQ ID NO: 7730578 - DNA, 23 bp, Homo sapiens
cctcaggggacctgtgagcctga

SEQ ID NO: 7730579 - DNA, 22 bp, Homo sapiens
cctcagggccatctctgtccct

SEQ ID NO: 7730580 - DNA, 18 bp, Homo sapiens
cctcaggggacctggcag

SEQ ID NO: 7730581 - DNA, 22 bp, Homo sapiens
cctcagggtctgaggagaccgt

SEQ ID NO: 7730582 - DNA, 22 bp, Homo sapiens
cctcagggtcatcctagtaata

SEQ ID NO: 7730583 - DNA, 22 bp, Homo sapiens
cctcagggtctctcacagcacc

SEQ ID NO: 7730584 - DNA, 22 bp, Homo sapiens
aggggaaggccagcctgtagag

SEQ ID NO: 7730585 - DNA, 22 bp, Homo sapiens
acaggaagaaagtgcagtagat

SEQ ID NO: 7730586 - DNA, 22 bp, Homo sapiens
acaggcctggtgctgctgacag

SEQ ID NO: 7730587 - DNA, 22 bp, Homo sapiens
acaggccttggtcctgacctaa

SEQ ID NO: 7730588 - DNA, 22 bp, Homo sapiens
acagggccaagtaaaccctacc

SEQ ID NO: 7730589 - DNA, 21 bp, Homo sapiens
acagggcatgcagctggctgt

SEQ ID NO: 7730590 - DNA, 22 bp, Homo sapiens
acagggcaggtggctactggtc

SEQ ID NO: 7730591 - DNA, 22 bp, Homo sapiens
acagggccaggtgagaggtgct

SEQ ID NO: 7730592 - DNA, 22 bp, Homo sapiens
acagggccacatgtaaacagat

SEQ ID NO: 7730593 - DNA, 22 bp, Homo sapiens
acagggccattatctgttctag

SEQ ID NO: 7730594 - DNA, 22 bp, Homo sapiens
acagggccctgtgggccccact

SEQ ID NO: 7730595 - DNA, 22 bp, Homo sapiens
acagggcctggctccaaaagat

SEQ ID NO: 7730596 - DNA, 22 bp, Homo sapiens
acagggcctcagccagggcaga

SEQ ID NO: 7730597 - DNA, 22 bp, Homo sapiens
acagggcccttagatcctttta

SEQ ID NO: 7730598 - DNA, 22 bp, Homo sapiens
acagggccttatatccagaagg

SEQ ID NO: 7730599 - DNA, 22 bp, Homo sapiens
aggcagtgtgtagctggaagag

SEQ ID NO: 7730600 - DNA, 22 bp, Homo sapiens
aggcaggggagctggaagggta

SEQ ID NO: 7730601 - DNA, 22 bp, Homo sapiens
aggctgggaaatgtagtcttcc

SEQ ID NO: 7730602 - DNA, 22 bp, Homo sapiens
aggctgggaaatgtattccagc

SEQ ID NO: 7730603 - DNA, 22 bp, Homo sapiens
aggctgggaaacctgaagttgt

SEQ ID NO: 7730604 - DNA, 22 bp, Homo sapiens
aggctgtgatgagcctcatgga

SEQ ID NO: 7730605 - DNA, 22 bp, Homo sapiens
agggccagcactcctggcagga

SEQ ID NO: 7730606 - DNA, 22 bp, Homo sapiens
agggccagcagcttggccaacc

SEQ ID NO: 7730607 - DNA, 22 bp, Homo sapiens
agggcacaagactctgagcccc

SEQ ID NO: 7730608 - DNA, 22 bp, Homo sapiens
agtgggagccagcagcttgggg

SEQ ID NO: 7730609 - DNA, 22 bp, Homo sapiens
agtgggaggaagtggtgatatt

SEQ ID NO: 7730610 - DNA, 22 bp, Homo sapiens
aggttccttatggggatggcta

SEQ ID NO: 7730611 - DNA, 22 bp, Homo sapiens
agaggccctggctagagcagct

SEQ ID NO: 7730612 - DNA, 22 bp, Homo sapiens
agaggccagggacactgctcaa

SEQ ID NO: 7730613 - DNA, 19 bp, Homo sapiens
agaggcctcagcagctggc

SEQ ID NO: 7730614 - DNA, 22 bp, Homo sapiens
agaggccggccgagcccatggg

SEQ ID NO: 7730615 - DNA, 22 bp, Homo sapiens
agatttatgtggtcacactcag

SEQ ID NO: 7730616 - DNA, 23 bp, Homo sapiens
atgccaggctgcctggccagcct

SEQ ID NO: 7730617 - DNA, 22 bp, Homo sapiens
atgccaggctgtttggcctcag

SEQ ID NO: 7730618 - DNA, 22 bp, Homo sapiens
atgccagggtcatcccctgggt

SEQ ID NO: 7730619 - DNA, 22 bp, Homo sapiens
agagaacagcattgcagctttg

SEQ ID NO: 7730620 - DNA, 22 bp, Homo sapiens
agagaacacgtgcatctgcaat

SEQ ID NO: 7730621 - DNA, 22 bp, Homo sapiens
agagcctgttttgtgggagatg

SEQ ID NO: 7730622 - DNA, 22 bp, Homo sapiens
agagccagcatttgggccctgc

SEQ ID NO: 7730623 - DNA, 22 bp, Homo sapiens
agagaacatgacgtaatagtgg

SEQ ID NO: 7730624 - DNA, 22 bp, Homo sapiens
cagagccatcccagcctgtggt

SEQ ID NO: 7730625 - DNA, 22 bp, Homo sapiens
cagagccataaaggtgaaagag

SEQ ID NO: 7730626 - DNA, 22 bp, Homo sapiens
cagagccatccaggtgcctgtt

SEQ ID NO: 7730627 - DNA, 22 bp, Homo sapiens
cagagccaggcctgccctcttt

SEQ ID NO: 7730628 - DNA, 22 bp, Homo sapiens
cagagccagggctaggaactgg

SEQ ID NO: 7730629 - DNA, 22 bp, Homo sapiens
cagagccaggtctaggagtctc

SEQ ID NO: 7730630 - DNA, 22 bp, Homo sapiens
agccaggctcaaggcctgctcc

SEQ ID NO: 7730631 - DNA, 22 bp, Homo sapiens
agccaggctgcagttggctggc

SEQ ID NO: 7730632 - DNA, 16 bp, Homo sapiens
agccaggctgcctcgg

SEQ ID NO: 7730633 - DNA, 22 bp, Homo sapiens
agccagggaggtggaggttgca

SEQ ID NO: 7730634 - DNA, 22 bp, Homo sapiens
cagagtgagggcctgcacctgc

SEQ ID NO: 7730635 - DNA, 17 bp, Homo sapiens
cagaggagctttggggg

SEQ ID NO: 7730636 - DNA, 22 bp, Homo sapiens
agccctcttcccagatgcctca

SEQ ID NO: 7730637 - DNA, 22 bp, Homo sapiens
agcctgagtgcttaggactgtt

SEQ ID NO: 7730638 - DNA, 22 bp, Homo sapiens
cagctgggtggctcttctgctc

SEQ ID NO: 7730639 - DNA, 22 bp, Homo sapiens
cagcctctgacaccacagtcgt

SEQ ID NO: 7730640 - DNA, 22 bp, Homo sapiens
cagcccaggtctctcttccagt

SEQ ID NO: 7730641 - DNA, 22 bp, Homo sapiens
cagcctcctgggacactcaccg

SEQ ID NO: 7730642 - DNA, 22 bp, Homo sapiens
cagcctctaagcacagcctctc

SEQ ID NO: 7730643 - DNA, 22 bp, Homo sapiens
cagcactggggccactggagtt

SEQ ID NO: 7730644 - DNA, 22 bp, Homo sapiens
cagcactgggaccactagaaca

SEQ ID NO: 7730645 - DNA, 22 bp, Homo sapiens
cagcactgttcccagaccactg

SEQ ID NO: 7730646 - DNA, 22 bp, Homo sapiens
agcgcaggaacacgtctgcctt

SEQ ID NO: 7730647 - DNA, 22 bp, Homo sapiens
cacacttgcttcagagtcaagt

SEQ ID NO: 7730648 - DNA, 22 bp, Homo sapiens
cacagctgcacagaggaggtgc

SEQ ID NO: 7730649 - DNA, 22 bp, Homo sapiens
caaggaaacatgaaatgcattg

SEQ ID NO: 7730650 - DNA, 22 bp, Homo sapiens
acacagaagctttttctattcc

SEQ ID NO: 7730651 - DNA, 23 bp, Homo sapiens
acaacaggaaatcagacctgaac

SEQ ID NO: 7730652 - DNA, 22 bp, Homo sapiens
agagcctggctcccagctaccg

SEQ ID NO: 7730653 - DNA, 22 bp, Homo sapiens
acagaactttctgatcctgagc

SEQ ID NO: 7730654 - DNA, 22 bp, Homo sapiens
acctgcctctaagcagcaggtg

SEQ ID NO: 7730655 - DNA, 22 bp, Homo sapiens
acctgcctcagtgcagctggat

SEQ ID NO: 7730656 - DNA, 22 bp, Homo sapiens
acctgcctatcagctgcctgct

SEQ ID NO: 7730657 - DNA, 22 bp, Homo sapiens
acctctcttgtagctgctggtg

SEQ ID NO: 7730658 - DNA, 15 bp, Homo sapiens
acctctctcgctggc

SEQ ID NO: 7730659 - DNA, 22 bp, Homo sapiens
acctctctgggcctgcttcctg

SEQ ID NO: 7730660 - DNA, 22 bp, Homo sapiens
aagggcacagggaaagagtgca

SEQ ID NO: 7730661 - DNA, 22 bp, Homo sapiens
aagggctggatctctctgagca

SEQ ID NO: 7730662 - DNA, 22 bp, Homo sapiens
acagctggaggggctgcagagg

SEQ ID NO: 7730663 - DNA, 22 bp, Homo sapiens
gtgtgccaggaactggctgctg

SEQ ID NO: 7730664 - DNA, 22 bp, Homo sapiens
gtgtgccaccagtcaaggtgaa

SEQ ID NO: 7730665 - DNA, 22 bp, Homo sapiens
gtgctcaggttcccatgagtgc

SEQ ID NO: 7730666 - DNA, 22 bp, Homo sapiens
gttcaggaagtctcagctggga

SEQ ID NO: 7730667 - DNA, 22 bp, Homo sapiens
gttcagagaaagagacacctta

SEQ ID NO: 7730668 - DNA, 19 bp, Homo sapiens
tacaggaggcctgcaatct

SEQ ID NO: 7730669 - DNA, 22 bp, Homo sapiens
tacaggaggattatcaaaggat

SEQ ID NO: 7730670 - DNA, 22 bp, Homo sapiens
tacaggagctgctctgtgatac

SEQ ID NO: 7730671 - DNA, 22 bp, Homo sapiens
tacaggagcacaaaagagttga

SEQ ID NO: 7730672 - DNA, 22 bp, Homo sapiens
tcagtgtgttactttctcctat

SEQ ID NO: 7730673 - DNA, 21 bp, Homo sapiens
tcagcagcttttgcagtccct

SEQ ID NO: 7730674 - DNA, 22 bp, Homo sapiens
tcagcactttgaagcagaagga

SEQ ID NO: 7730675 - DNA, 22 bp, Homo sapiens
tcagcacttggatttcagagat

SEQ ID NO: 7730676 - DNA, 22 bp, Homo sapiens
tcagagctcctaagggctgatt

SEQ ID NO: 7730677 - DNA, 22 bp, Homo sapiens
tcagagcttatctcttgctgga

SEQ ID NO: 7730678 - DNA, 22 bp, Homo sapiens
tcagagctttggagaccaggaa

SEQ ID NO: 7730679 - DNA, 22 bp, Homo sapiens
tcagagccaatcatggtgcatt

SEQ ID NO: 7730680 - DNA, 22 bp, Homo sapiens
tcagagccctgctcctccccaa

SEQ ID NO: 7730681 - DNA, 22 bp, Homo sapiens
tcagcactggcgctgggcaggt

SEQ ID NO: 7730682 - DNA, 19 bp, Homo sapiens
tccagggcaggaacatgta

SEQ ID NO: 7730683 - DNA, 22 bp, Homo sapiens
tccagggcagggtgcgcatggg

SEQ ID NO: 7730684 - DNA, 22 bp, Homo sapiens
tccagggccacagaggatgcta

SEQ ID NO: 7730685 - DNA, 22 bp, Homo sapiens
tccaggaggtttggaggaagca

SEQ ID NO: 7730686 - DNA, 22 bp, Homo sapiens
tccaggagggttttctgccttc

SEQ ID NO: 7730687 - DNA, 22 bp, Homo sapiens
tccaggagggggagccgtgccg

SEQ ID NO: 7730688 - DNA, 22 bp, Homo sapiens
tccaggaggtatgagtggcccc

SEQ ID NO: 7730689 - DNA, 22 bp, Homo sapiens
tccaggcagggttaagggtcct

SEQ ID NO: 7730690 - DNA, 22 bp, Homo sapiens
tccaggagtgataaggccactg

SEQ ID NO: 7730691 - DNA, 21 bp, Homo sapiens
tccaggagtggctgggcaggg

SEQ ID NO: 7730692 - DNA, 22 bp, Homo sapiens
tccaggccacatggatggcgat

SEQ ID NO: 7730693 - DNA, 22 bp, Homo sapiens
tccaggccacgacctcctggat

SEQ ID NO: 7730694 - DNA, 22 bp, Homo sapiens
tccaggcatcccccaggacaga

SEQ ID NO: 7730695 - DNA, 22 bp, Homo sapiens
tccaggccactgcagaggctct

SEQ ID NO: 7730696 - DNA, 22 bp, Homo sapiens
tccaggctgcaaggccacaggg

SEQ ID NO: 7730697 - DNA, 22 bp, Homo sapiens
tccagagctacttgctcaactt

SEQ ID NO: 7730698 - DNA, 18 bp, Homo sapiens
tccagagctactgtggtg

SEQ ID NO: 7730699 - DNA, 22 bp, Homo sapiens
tccagagctaattcagcagctg

SEQ ID NO: 7730700 - DNA, 22 bp, Homo sapiens
tccagagccttcgataagaaga

SEQ ID NO: 7730701 - DNA, 22 bp, Homo sapiens
tccagagcctttctgcttgaca

SEQ ID NO: 7730702 - DNA, 22 bp, Homo sapiens
tccagagcctgcgcactggctg

SEQ ID NO: 7730703 - DNA, 22 bp, Homo sapiens
tccagagcaggtggtcagaagg

SEQ ID NO: 7730704 - DNA, 22 bp, Homo sapiens
tccagagcatgcagatcatcaa

SEQ ID NO: 7730705 - DNA, 17 bp, Homo sapiens
tccagagcacagagctc

SEQ ID NO: 7730706 - DNA, 23 bp, Homo sapiens
tccagagctcatgctctcaacca

SEQ ID NO: 7730707 - DNA, 22 bp, Homo sapiens
tccagagctctgggcatagctg

SEQ ID NO: 7730708 - DNA, 22 bp, Homo sapiens
tccagagctgggtctgtgctca

SEQ ID NO: 7730709 - DNA, 22 bp, Homo sapiens
tccagagctgagggtcagtaga

SEQ ID NO: 7730710 - DNA, 18 bp, Homo sapiens
tccagagctggtgcttct

SEQ ID NO: 7730711 - DNA, 22 bp, Homo sapiens
gctgggaacacagccatgagag

SEQ ID NO: 7730712 - DNA, 22 bp, Homo sapiens
ggacacagggctcactctctct

SEQ ID NO: 7730713 - DNA, 22 bp, Homo sapiens
gctcccactgcagccctgagcc

SEQ ID NO: 7730714 - DNA, 21 bp, Homo sapiens
gctcagagtattgcactgttt

SEQ ID NO: 7730715 - DNA, 23 bp, Homo sapiens
gctcagcctcagcaggcccagga

SEQ ID NO: 7730716 - DNA, 22 bp, Homo sapiens
gctcagccgaacttcagagcag

SEQ ID NO: 7730717 - DNA, 22 bp, Homo sapiens
gccttgggcacaggcagggccc

SEQ ID NO: 7730718 - DNA, 22 bp, Homo sapiens
gctgaggctcaagtcatgggtc

SEQ ID NO: 7730719 - DNA, 22 bp, Homo sapiens
gctcctccaatatggactcctc

SEQ ID NO: 7730720 - DNA, 22 bp, Homo sapiens
gctcctccctgtgcagacccag

SEQ ID NO: 7730721 - DNA, 22 bp, Homo sapiens
gctgctccagctgtgctgcaga

SEQ ID NO: 7730722 - DNA, 19 bp, Homo sapiens
gctgctcctggctgaccac

SEQ ID NO: 7730723 - DNA, 22 bp, Homo sapiens
gctgcctgtgcgggtcgctagg

SEQ ID NO: 7730724 - DNA, 22 bp, Homo sapiens
gctgcctgtgcactttctcgta

SEQ ID NO: 7730725 - DNA, 19 bp, Homo sapiens
gctgcctgtcttagccagt

SEQ ID NO: 7730726 - DNA, 22 bp, Homo sapiens
gctgcctgtctgtttcttttat

SEQ ID NO: 7730727 - DNA, 22 bp, Homo sapiens
gctgcctgtctgctgacccagg

SEQ ID NO: 7730728 - DNA, 22 bp, Homo sapiens
gctgcctgtggcccttctgggt

SEQ ID NO: 7730729 - DNA, 22 bp, Homo sapiens
gctgcctgtgtggccactcact

SEQ ID NO: 7730730 - DNA, 22 bp, Homo sapiens
gctgcctgttgaagggtctgtg

SEQ ID NO: 7730731 - DNA, 20 bp, Homo sapiens
gctgcctgtttctgtaagta

SEQ ID NO: 7730732 - DNA, 22 bp, Homo sapiens
gctgcctgtcctgaggagtccg

SEQ ID NO: 7730733 - DNA, 22 bp, Homo sapiens
gcagactgtacctggaagaggg

SEQ ID NO: 7730734 - DNA, 22 bp, Homo sapiens
gcagaggcatttctgacgctgc

SEQ ID NO: 7730735 - DNA, 22 bp, Homo sapiens
gcagaggcagggccctcctcca

SEQ ID NO: 7730736 - DNA, 22 bp, Homo sapiens
gcagggctgttcaggagggtgg

SEQ ID NO: 7730737 - DNA, 22 bp, Homo sapiens
gcagggctgaaggtcccaggcc

SEQ ID NO: 7730738 - DNA, 22 bp, Homo sapiens
gcagggctggggctgctcctga

SEQ ID NO: 7730739 - DNA, 22 bp, Homo sapiens
gcagcccagagcgcaggacccc

SEQ ID NO: 7730740 - DNA, 22 bp, Homo sapiens
gcagcccaggaccctggacaga

SEQ ID NO: 7730741 - DNA, 22 bp, Homo sapiens
gccaggcaggccacgctgtgtt

SEQ ID NO: 7730742 - DNA, 22 bp, Homo sapiens
gccagggctgtgcaggtttgtt

SEQ ID NO: 7730743 - DNA, 22 bp, Homo sapiens
gccagggcaggggagcatctgc

SEQ ID NO: 7730744 - DNA, 22 bp, Homo sapiens
gccagggtcctgaagaccaagt

SEQ ID NO: 7730745 - DNA, 22 bp, Homo sapiens
gccagggtggcagaaggcccca

SEQ ID NO: 7730746 - DNA, 22 bp, Homo sapiens
gccagggtgagggctgagaggt

SEQ ID NO: 7730747 - DNA, 22 bp, Homo sapiens
gcccagccctgaggtcacagct

SEQ ID NO: 7730748 - DNA, 22 bp, Homo sapiens
gtcctgggcatgcagggctttc

SEQ ID NO: 7730749 - DNA, 17 bp, Homo sapiens
gtcctgggaggagagag

SEQ ID NO: 7730750 - DNA, 22 bp, Homo sapiens
gtccacagggatggccacacat

SEQ ID NO: 7730751 - DNA, 18 bp, Homo sapiens
gtccacagccctcacagc

SEQ ID NO: 7730752 - DNA, 22 bp, Homo sapiens
gtctgcctctattgcctacctg

SEQ ID NO: 7730753 - DNA, 22 bp, Homo sapiens
gtctgcctggaggcagctgctg

SEQ ID NO: 7730754 - DNA, 22 bp, Homo sapiens
gtcctggggaatacagaagccg

SEQ ID NO: 7730755 - DNA, 22 bp, Homo sapiens
gggccacacagaacctcctggt

SEQ ID NO: 7730756 - DNA, 22 bp, Homo sapiens
ggggctggtggtggtttctcca

SEQ ID NO: 7730757 - DNA, 22 bp, Homo sapiens
ggggctgggatttgaacccagg

SEQ ID NO: 7730758 - DNA, 22 bp, Homo sapiens
ggctgggccgcggctacccaga

SEQ ID NO: 7730759 - DNA, 22 bp, Homo sapiens
ggctgggcctctccctcagctg

SEQ ID NO: 7730760 - DNA, 21 bp, Homo sapiens
ggctgggcaggacccacccct

SEQ ID NO: 7730761 - DNA, 22 bp, Homo sapiens
ggctgggctgcggctgtacctg

SEQ ID NO: 7730762 - DNA, 22 bp, Homo sapiens
ggctgggaggccgtgctgacct

SEQ ID NO: 7730763 - DNA, 22 bp, Homo sapiens
ggctgacctcgcccctacatct

SEQ ID NO: 7730764 - DNA, 22 bp, Homo sapiens
gggcacagctgctacccagtgc

SEQ ID NO: 7730765 - DNA, 22 bp, Homo sapiens
gggagacccccaatgccaggtc

SEQ ID NO: 7730766 - DNA, 22 bp, Homo sapiens
ggcctgacaagtgggaagaggc

SEQ ID NO: 7730767 - DNA, 22 bp, Homo sapiens
ggcctgactaatcaggatgaat

SEQ ID NO: 7730768 - DNA, 22 bp, Homo sapiens
ggcctgactgacctgattctaa

SEQ ID NO: 7730769 - DNA, 22 bp, Homo sapiens
ggcctgacatttgcatcaacac

SEQ ID NO: 7730770 - DNA, 22 bp, Homo sapiens
ggcctgacttgatcggctctct

SEQ ID NO: 7730771 - DNA, 23 bp, Homo sapiens
ggcctcagcgcacagaaactgct

SEQ ID NO: 7730772 - DNA, 21 bp, Homo sapiens
ggcctcagccacctggctctg

SEQ ID NO: 7730773 - DNA, 19 bp, Homo sapiens
ggccaggctgactgtggtc

SEQ ID NO: 7730774 - DNA, 18 bp, Homo sapiens
ggcatgtgagtgctgagg

SEQ ID NO: 7730775 - DNA, 22 bp, Homo sapiens
ggccatgccaggctgcctggga

SEQ ID NO: 7730776 - DNA, 22 bp, Homo sapiens
ggccatgcctggtctggcacca

SEQ ID NO: 7730777 - DNA, 22 bp, Homo sapiens
gaccctggctggagctggcctg

SEQ ID NO: 7730778 - DNA, 22 bp, Homo sapiens
gacacagagataggcctgtgtt

SEQ ID NO: 7730779 - DNA, 22 bp, Homo sapiens
gacaggccaggggctgaggtgg

SEQ ID NO: 7730780 - DNA, 22 bp, Homo sapiens
gaacccaacctcacttggggta

SEQ ID NO: 7730781 - DNA, 22 bp, Homo sapiens
gagccaggtttgaatctcagtc

SEQ ID NO: 7730782 - DNA, 22 bp, Homo sapiens
gagcctggacatctcaggccca

SEQ ID NO: 7730783 - DNA, 22 bp, Homo sapiens
gagctaggttttccagtcgcat

SEQ ID NO: 7730784 - DNA, 22 bp, Homo sapiens
gagctaggctagggggagtcgc

SEQ ID NO: 7730785 - DNA, 22 bp, Homo sapiens
gaggagcctggccccacatcca

SEQ ID NO: 7730786 - DNA, 22 bp, Homo sapiens
gagccaggttggaggctgcagt

SEQ ID NO: 7730787 - DNA, 22 bp, Homo sapiens
gagccaggtcgggccgcggcga

SEQ ID NO: 7730788 - DNA, 16 bp, Homo sapiens
gagccaggtgccttga

SEQ ID NO: 7730789 - DNA, 22 bp, Homo sapiens
gagccaggggtcagctccgagg

SEQ ID NO: 7730790 - DNA, 22 bp, Homo sapiens
gagccagggctgtgagctgagc

SEQ ID NO: 7730791 - DNA, 22 bp, Homo sapiens
gagccaagatcgcaccactgca

SEQ ID NO: 7730792 - DNA, 22 bp, Homo sapiens
ctgggccactccagatgcccac

SEQ ID NO: 7730793 - DNA, 22 bp, Homo sapiens
ctgggcaggagggctctatgga

SEQ ID NO: 7730794 - DNA, 19 bp, Homo sapiens
ctgggccagagctgtcctc

SEQ ID NO: 7730795 - DNA, 22 bp, Homo sapiens
ctgccaccatgccccagcagag

SEQ ID NO: 7730796 - DNA, 22 bp, Homo sapiens
ctggcagcttcaggacactcgg

SEQ ID NO: 7730797 - DNA, 22 bp, Homo sapiens
ctggccagcctcccaggtaccc

SEQ ID NO: 7730798 - DNA, 22 bp, Homo sapiens
ctggccagctgacagcagggct

SEQ ID NO: 7730799 - DNA, 22 bp, Homo sapiens
ctggccaggcatcccctgatcc

SEQ ID NO: 7730800 - DNA, 22 bp, Homo sapiens
ctggctgcctatagtctccctt

SEQ ID NO: 7730801 - DNA, 19 bp, Homo sapiens
ctggccaggccaggggccc

SEQ ID NO: 7730802 - DNA, 22 bp, Homo sapiens
ctggccaggccccttgcagggc

SEQ ID NO: 7730803 - DNA, 22 bp, Homo sapiens
cttgtcagccaattgtggattt

SEQ ID NO: 7730804 - DNA, 22 bp, Homo sapiens
cttcagggtgacgcaggctgca

SEQ ID NO: 7730805 - DNA, 23 bp, Homo sapiens
ctgtcctgccatccacagcggcc

SEQ ID NO: 7730806 - DNA, 22 bp, Homo sapiens
ctgtcctgaggcaggtggcctg

SEQ ID NO: 7730807 - DNA, 22 bp, Homo sapiens
ctgtcctggggaaagccagccc

SEQ ID NO: 7730808 - DNA, 22 bp, Homo sapiens
ctgtgccactgggggccggcaa

SEQ ID NO: 7730809 - DNA, 22 bp, Homo sapiens
ctgtgccactgccccaggcctc

SEQ ID NO: 7730810 - DNA, 22 bp, Homo sapiens
ctgttcagcgttggcgttaggg

SEQ ID NO: 7730811 - DNA, 22 bp, Homo sapiens
cgccaggcttggtagctcatgc

SEQ ID NO: 7730812 - DNA, 23 bp, Homo sapiens
ctatggaataccaatgattctca

SEQ ID NO: 7730813 - DNA, 22 bp, Homo sapiens
cctgtctctgcagggccctgcc

SEQ ID NO: 7730814 - DNA, 22 bp, Homo sapiens
tgttcagcatcaggaaagcttt

SEQ ID NO: 7730815 - DNA, 20 bp, Homo sapiens
tgttccaggaggccagggct

SEQ ID NO: 7730816 - DNA, 22 bp, Homo sapiens
cctgggcaatatagtgaggccc

SEQ ID NO: 7730817 - DNA, 22 bp, Homo sapiens
cctgggatttgcgccagacctt

SEQ ID NO: 7730818 - DNA, 22 bp, Homo sapiens
cctgggcaaatgccagagacaa

SEQ ID NO: 7730819 - DNA, 22 bp, Homo sapiens
cctgggcaacatagtgagaccc

SEQ ID NO: 7730820 - DNA, 22 bp, Homo sapiens
cctgggcaacatagtgagacct

SEQ ID NO: 7730821 - DNA, 21 bp, Homo sapiens
tttcacaaaagtatgtgacaa

SEQ ID NO: 7730822 - DNA, 22 bp, Homo sapiens
ctctccaggagctcagagtcta

SEQ ID NO: 7730823 - DNA, 22 bp, Homo sapiens
ctctccaggctgggacaggacc

SEQ ID NO: 7730824 - DNA, 22 bp, Homo sapiens
ctcccggctgctccggctcccg

SEQ ID NO: 7730825 - DNA, 22 bp, Homo sapiens
ctcccggcacttggcatgtcat

SEQ ID NO: 7730826 - DNA, 20 bp, Homo sapiens
ctcccctctacagagggctg

SEQ ID NO: 7730827 - DNA, 22 bp, Homo sapiens
ctccaagggtcttccaccagga

SEQ ID NO: 7730828 - DNA, 22 bp, Homo sapiens
ctccagcctcatctcctggctg

SEQ ID NO: 7730829 - DNA, 22 bp, Homo sapiens
ctcttccatattactcagggta

SEQ ID NO: 7730830 - DNA, 22 bp, Homo sapiens
ctgcagggagcagatggcgtgt

SEQ ID NO: 7730831 - DNA, 22 bp, Homo sapiens
ctgcaccatccttcatgctctg

SEQ ID NO: 7730832 - DNA, 22 bp, Homo sapiens
ctgaggccgtctgggtctgcag

SEQ ID NO: 7730833 - DNA, 22 bp, Homo sapiens
ctgaggccagctgcagagctct

SEQ ID NO: 7730834 - DNA, 22 bp, Homo sapiens
ctgaggccagagtgggcctctt

SEQ ID NO: 7730835 - DNA, 22 bp, Homo sapiens
ctgaggccagaacccgaccctg

SEQ ID NO: 7730836 - DNA, 22 bp, Homo sapiens
ctgaggcagagggcagaccaga

SEQ ID NO: 7730837 - DNA, 22 bp, Homo sapiens
ctgaccagaccccaggaggctg

SEQ ID NO: 7730838 - DNA, 19 bp, Homo sapiens
tccaggagcaaagccagtt

SEQ ID NO: 7730839 - DNA, 22 bp, Homo sapiens
ccaaggcccctgtggtctagcc

SEQ ID NO: 7730840 - DNA, 22 bp, Homo sapiens
ccacactgaacctcagtgtctt

SEQ ID NO: 7730841 - DNA, 22 bp, Homo sapiens
tcctgggagcccttgctccacc

SEQ ID NO: 7730842 - DNA, 22 bp, Homo sapiens
tcctgggagcatggtgccgtga

SEQ ID NO: 7730843 - DNA, 22 bp, Homo sapiens
tcctgggagagtttgattcatt

SEQ ID NO: 7730844 - DNA, 22 bp, Homo sapiens
tcctgggagcacatggtcctgc

SEQ ID NO: 7730845 - DNA, 22 bp, Homo sapiens
tcctgggagcatgaagagggat

SEQ ID NO: 7730846 - DNA, 22 bp, Homo sapiens
tcctgggaggaacatttaccta

SEQ ID NO: 7730847 - DNA, 22 bp, Homo sapiens
tcctgggactctttatcagaga

SEQ ID NO: 7730848 - DNA, 22 bp, Homo sapiens
tcctgggagagtgggactgtat

SEQ ID NO: 7730849 - DNA, 22 bp, Homo sapiens
tcctgggactttcaaggctagg

SEQ ID NO: 7730850 - DNA, 22 bp, Homo sapiens
tcctgggagacccagctgtgga

SEQ ID NO: 7730851 - DNA, 22 bp, Homo sapiens
ccagagaccagaacatggggat

SEQ ID NO: 7730852 - DNA, 22 bp, Homo sapiens
ccagagacaaggagctggagtc

SEQ ID NO: 7730853 - DNA, 22 bp, Homo sapiens
tcagagagttttcactagggtg

SEQ ID NO: 7730854 - DNA, 22 bp, Homo sapiens
cagctcagacgcaggtcgagca

SEQ ID NO: 7730855 - DNA, 22 bp, Homo sapiens
caggctcaaggctgacttccat

SEQ ID NO: 7730856 - DNA, 22 bp, Homo sapiens
caggcctctccttagtctggca

SEQ ID NO: 7730857 - DNA, 19 bp, Homo sapiens
caggcctctggtctgctgt

SEQ ID NO: 7730858 - DNA, 22 bp, Homo sapiens
caggcctcgaggagacagctac

SEQ ID NO: 7730859 - DNA, 22 bp, Homo sapiens
caggcctctatggtcagctgag

SEQ ID NO: 7730860 - DNA, 22 bp, Homo sapiens
caggcccagggagggagaccaa

SEQ ID NO: 7730861 - DNA, 22 bp, Homo sapiens
caggcctcctatgagcactagc

SEQ ID NO: 7730862 - DNA, 22 bp, Homo sapiens
caggcctgcaggaaaggctccc

SEQ ID NO: 7730863 - DNA, 22 bp, Homo sapiens
caggcctcttccatgcagcagc

SEQ ID NO: 7730864 - DNA, 19 bp, Homo sapiens
caggcctcttaccctctct

SEQ ID NO: 7730865 - DNA, 22 bp, Homo sapiens
cagggacagagactgcaccttg

SEQ ID NO: 7730866 - DNA, 22 bp, Homo sapiens
caggctgccctagcttggacat

SEQ ID NO: 7730867 - DNA, 22 bp, Homo sapiens
cagggctcttccggagcaggga

SEQ ID NO: 7730868 - DNA, 20 bp, Homo sapiens
cagggctctgggcctggcct

SEQ ID NO: 7730869 - DNA, 22 bp, Homo sapiens
cagggccattggcgtggctgtc

SEQ ID NO: 7730870 - DNA, 22 bp, Homo sapiens
cagggccagttctcgcagcagt

SEQ ID NO: 7730871 - DNA, 22 bp, Homo sapiens
cagggccagggctccatttcct

SEQ ID NO: 7730872 - DNA, 22 bp, Homo sapiens
cagggccaggctgatggcctgg

SEQ ID NO: 7730873 - DNA, 22 bp, Homo sapiens
cagggccagggctatggtgaag

SEQ ID NO: 7730874 - DNA, 22 bp, Homo sapiens
caggtgcccagctcctgctgtg

SEQ ID NO: 7730875 - DNA, 16 bp, Homo sapiens
caggtgcctctcccga

SEQ ID NO: 7730876 - DNA, 22 bp, Homo sapiens
caggtgaatcacttgagtccag

SEQ ID NO: 7730877 - DNA, 22 bp, Homo sapiens
ccagggcttcccacgtgccctg

SEQ ID NO: 7730878 - DNA, 22 bp, Homo sapiens
tgagaccttggggagccctgtt

SEQ ID NO: 7730879 - DNA, 22 bp, Homo sapiens
tgaggcagaaattcctgttttc

SEQ ID NO: 7730880 - DNA, 22 bp, Homo sapiens
ccatgcctcgggaagagtctgt

SEQ ID NO: 7730881 - DNA, 19 bp, Homo sapiens
ccaggccatcccagttccc

SEQ ID NO: 7730882 - DNA, 18 bp, Homo sapiens
ccaggccatgaacctctg

SEQ ID NO: 7730883 - DNA, 22 bp, Homo sapiens
ccaggctctgtgtgggctagag

SEQ ID NO: 7730884 - DNA, 22 bp, Homo sapiens
ccaggctgaatatgttccaggg

SEQ ID NO: 7730885 - DNA, 22 bp, Homo sapiens
ccaggcctggacgggtggcctg

SEQ ID NO: 7730886 - DNA, 22 bp, Homo sapiens
tcttcagagcatttctgaggta

SEQ ID NO: 7730887 - DNA, 22 bp, Homo sapiens
ccaggccagagtgcagtggcac

SEQ ID NO: 7730888 - DNA, 22 bp, Homo sapiens
ccaggccagcgctggctggagg

SEQ ID NO: 7730889 - DNA, 22 bp, Homo sapiens
ccaggccagcctggagcatggc

SEQ ID NO: 7730890 - DNA, 22 bp, Homo sapiens
ccaggccagcaggcacacctgc

SEQ ID NO: 7730891 - DNA, 22 bp, Homo sapiens
ccaggcaacggagcccactgcc

SEQ ID NO: 7730892 - DNA, 22 bp, Homo sapiens
ccaggagacccagggaaggagc

SEQ ID NO: 7730893 - DNA, 22 bp, Homo sapiens
ccaggagactgtactgatattt

SEQ ID NO: 7730894 - DNA, 22 bp, Homo sapiens
ccaggagacaaagatgactgct

SEQ ID NO: 7730895 - DNA, 17 bp, Homo sapiens
ccaggagagatgcttgt

SEQ ID NO: 7730896 - DNA, 22 bp, Homo sapiens
ccaggagaataatggcagatta

SEQ ID NO: 7730897 - DNA, 22 bp, Homo sapiens
ccaggagaagcatctgagtgta

SEQ ID NO: 7730898 - DNA, 22 bp, Homo sapiens
ccaggacctggagctctatgaa

SEQ ID NO: 7730899 - DNA, 22 bp, Homo sapiens
tctggcagctcagttcaggtct

SEQ ID NO: 7730900 - DNA, 22 bp, Homo sapiens
tctggcctgaaagtccatgctt

SEQ ID NO: 7730901 - DNA, 22 bp, Homo sapiens
ccagagacgtcggtcagggcgc

SEQ ID NO: 7730902 - DNA, 22 bp, Homo sapiens
tggagcaggactgctgccctca

SEQ ID NO: 7730903 - DNA, 22 bp, Homo sapiens
ccctgaccatcccgcactgact

SEQ ID NO: 7730904 - DNA, 22 bp, Homo sapiens
ccctctctcaggctgacagcct

SEQ ID NO: 7730905 - DNA, 22 bp, Homo sapiens
ccccttccttcctcagacagcc

SEQ ID NO: 7730906 - DNA, 22 bp, Homo sapiens
tgctgggatatagcttctaggg

SEQ ID NO: 7730907 - DNA, 22 bp, Homo sapiens
tgctgggattacagtcatgagc

SEQ ID NO: 7730908 - DNA, 22 bp, Homo sapiens
tgcctgtgtggggtctgccgcc

SEQ ID NO: 7730909 - DNA, 22 bp, Homo sapiens
tgcctgtgtggtctgcgcatta

SEQ ID NO: 7730910 - DNA, 22 bp, Homo sapiens
tgccagctgacagcagagacaa

SEQ ID NO: 7730911 - DNA, 22 bp, Homo sapiens
tgccaggctaagtggaggactt

SEQ ID NO: 7730912 - DNA, 22 bp, Homo sapiens
cccaggctagaaaggccaacaa

SEQ ID NO: 7730913 - DNA, 22 bp, Homo sapiens
cccaggctcccaggtgggacaa

SEQ ID NO: 7730914 - DNA, 19 bp, Homo sapiens
cccaggctacatggagagg

SEQ ID NO: 7730915 - DNA, 22 bp, Homo sapiens
cctgagcctgcagccgagcaga

SEQ ID NO: 7730916 - DNA, 22 bp, Homo sapiens
tgggctggagcttgttgcttcc

SEQ ID NO: 7730917 - DNA, 22 bp, Homo sapiens
tgggctggcccaccacacctcg

SEQ ID NO: 7730918 - DNA, 21 bp, Homo sapiens
cctgagcctgtttatccagaa

SEQ ID NO: 7730919 - DNA, 22 bp, Homo sapiens
tggctgggagctggaactgggc

SEQ ID NO: 7730920 - DNA, 18 bp, Homo sapiens
cctctgcctttgtagagc

SEQ ID NO: 7730921 - DNA, 21 bp, Homo sapiens
cctctgctcgggcatgcgttt

SEQ ID NO: 7730922 - DNA, 22 bp, Homo sapiens
cctctgctctggtccatgtgct

SEQ ID NO: 7730923 - DNA, 19 bp, Homo sapiens
tggagcagggcccttgttt

SEQ ID NO: 7730924 - DNA, 22 bp, Homo sapiens
cctcaggcttgtgagccttcag

SEQ ID NO: 7730925 - DNA, 22 bp, Homo sapiens
cctcaggctgtcttccttctgg

SEQ ID NO: 7730926 - DNA, 22 bp, Homo sapiens
cctcaggcctgccagagcccca

SEQ ID NO: 7730927 - DNA, 22 bp, Homo sapiens
cctcaggctctgggtgcctacc

SEQ ID NO: 7730928 - DNA, 22 bp, Homo sapiens
tggcctggggaagaccatgggc

SEQ ID NO: 7730929 - DNA, 22 bp, Homo sapiens
tggcctgggcctgccggtgcaa

SEQ ID NO: 7730930 - DNA, 22 bp, Homo sapiens
cctccaagcttcatctcaacca

SEQ ID NO: 7730931 - DNA, 18 bp, Homo sapiens
cctcagggagatccagtg

SEQ ID NO: 7730932 - DNA, 18 bp, Homo sapiens
cctcagggagagagacgc

SEQ ID NO: 7730933 - DNA, 23 bp, Homo sapiens
tttgttcactcctgggaaagaca

SEQ ID NO: 7730934 - DNA, 22 bp, Homo sapiens
tgttctggagataagaggtaga

SEQ ID NO: 7730935 - DNA, 22 bp, Homo sapiens
tgtggcagtctcactggagggc

SEQ ID NO: 7730936 - DNA, 22 bp, Homo sapiens
tcccctgcagatgagggcagtg

SEQ ID NO: 7730937 - DNA, 22 bp, Homo sapiens
ttccagagctttgcgcttggaa

SEQ ID NO: 7730938 - DNA, 22 bp, Homo sapiens
ttccagagcccatgctctaggc

SEQ ID NO: 7730939 - DNA, 22 bp, Homo sapiens
ttcctctggggccaggccaaca

SEQ ID NO: 7730940 - DNA, 22 bp, Homo sapiens
caaggccttgctgtctcctcct

SEQ ID NO: 7730941 - DNA, 22 bp, Homo sapiens
ggaagctgaggcccagtgaagg

SEQ ID NO: 7730942 - DNA, 22 bp, Homo sapiens
ggagagcagggtcctgagatac

SEQ ID NO: 7730943 - DNA, 22 bp, Homo sapiens
gctgcctgatttacatagtgaa

SEQ ID NO: 7730944 - DNA, 17 bp, Homo sapiens
gctgcctgcaactgact

SEQ ID NO: 7730945 - DNA, 22 bp, Homo sapiens
gctgcctgcacagagctgcttt

SEQ ID NO: 7730946 - DNA, 22 bp, Homo sapiens
gctgcctgcctgcatttaatcc

SEQ ID NO: 7730947 - DNA, 22 bp, Homo sapiens
gctgcctgcctagttccacagt

SEQ ID NO: 7730948 - DNA, 22 bp, Homo sapiens
gctgcctgccctgggtcatctg

SEQ ID NO: 7730949 - DNA, 22 bp, Homo sapiens
gctgcctgccttgcctggagga

SEQ ID NO: 7730950 - DNA, 21 bp, Homo sapiens
gctgcctgcccctcgggggct

SEQ ID NO: 7730951 - DNA, 18 bp, Homo sapiens
gctgcctgcattcctcac

SEQ ID NO: 7730952 - DNA, 22 bp, Homo sapiens
gctgcctgcagtgttttcccag

SEQ ID NO: 7730953 - DNA, 18 bp, Homo sapiens
cacaggagccacactcac

SEQ ID NO: 7730954 - DNA, 22 bp, Homo sapiens
ggagagcctccacggcttctgt

SEQ ID NO: 7730955 - DNA, 22 bp, Homo sapiens
cacagggcaggtactctcagag

SEQ ID NO: 7730956 - DNA, 22 bp, Homo sapiens
ggccaggctgctgggaccccgc

SEQ ID NO: 7730957 - DNA, 22 bp, Homo sapiens
ggccaggctgccctgggagcag

SEQ ID NO: 7730958 - DNA, 22 bp, Homo sapiens
ggccaggctggtctcagacttc

SEQ ID NO: 7730959 - DNA, 22 bp, Homo sapiens
ggccaggctggttccttgacct

SEQ ID NO: 7730960 - DNA, 22 bp, Homo sapiens
cacctggagtagcaaggtaatt

SEQ ID NO: 7730961 - DNA, 22 bp, Homo sapiens
cacctggatatgtttcagcttg

SEQ ID NO: 7730962 - DNA, 22 bp, Homo sapiens
cacctgccctttcttgctccac

SEQ ID NO: 7730963 - DNA, 22 bp, Homo sapiens
cacctgcctgcaggggctccac

SEQ ID NO: 7730964 - DNA, 18 bp, Homo sapiens
cagacactctgctctgca

SEQ ID NO: 7730965 - DNA, 22 bp, Homo sapiens
cagagccaaacctcagggcccg

SEQ ID NO: 7730966 - DNA, 22 bp, Homo sapiens
cagagccaacgccacctgccca

SEQ ID NO: 7730967 - DNA, 22 bp, Homo sapiens
cagagccacagcctccagattt

SEQ ID NO: 7730968 - DNA, 22 bp, Homo sapiens
cagagacaatgtctctgcttgt

SEQ ID NO: 7730969 - DNA, 22 bp, Homo sapiens
cagagcacctgctcattgccag

SEQ ID NO: 7730970 - DNA, 22 bp, Homo sapiens
cagagccagcccactgttcccg

SEQ ID NO: 7730971 - DNA, 22 bp, Homo sapiens
cagagccagcagtggggacagg

SEQ ID NO: 7730972 - DNA, 22 bp, Homo sapiens
cagagccactgtctgccaggca

SEQ ID NO: 7730973 - DNA, 22 bp, Homo sapiens
gggctgtgtaatgtgctctttt

SEQ ID NO: 7730974 - DNA, 20 bp, Homo sapiens
gggctgtgcctcctcgtggt

SEQ ID NO: 7730975 - DNA, 21 bp, Homo sapiens
ggggcagagctaggccctgca

SEQ ID NO: 7730976 - DNA, 22 bp, Homo sapiens
ggggcagatggaacagagcaca

SEQ ID NO: 7730977 - DNA, 22 bp, Homo sapiens
gggtacagttcttccagtgtca

SEQ ID NO: 7730978 - DNA, 22 bp, Homo sapiens
cagccctcatctcagcttcttt

SEQ ID NO: 7730979 - DNA, 22 bp, Homo sapiens
cagccctctgaagaggcgcttg

SEQ ID NO: 7730980 - DNA, 22 bp, Homo sapiens
cagccctcctaccctgccaggc

SEQ ID NO: 7730981 - DNA, 20 bp, Homo sapiens
cagccctccagtggaggcag

SEQ ID NO: 7730982 - DNA, 22 bp, Homo sapiens
gtccagagaggcaggaggctac

SEQ ID NO: 7730983 - DNA, 22 bp, Homo sapiens
gtccagagatggacgagcagat

SEQ ID NO: 7730984 - DNA, 20 bp, Homo sapiens
gtccagagtaatgtgctgac

SEQ ID NO: 7730985 - DNA, 22 bp, Homo sapiens
cagccaggagcctctgcaacta

SEQ ID NO: 7730986 - DNA, 22 bp, Homo sapiens
cagccaggagctccccctgctc

SEQ ID NO: 7730987 - DNA, 22 bp, Homo sapiens
cagccaggcccagatcatgctg

SEQ ID NO: 7730988 - DNA, 22 bp, Homo sapiens
cagccaggatggagaactgttg

SEQ ID NO: 7730989 - DNA, 22 bp, Homo sapiens
cagccaggcccccgagtcgttg

SEQ ID NO: 7730990 - DNA, 22 bp, Homo sapiens
cagcagcctacaatgcacagaa

SEQ ID NO: 7730991 - DNA, 22 bp, Homo sapiens
cagcagccactagagggctcac

SEQ ID NO: 7730992 - DNA, 22 bp, Homo sapiens
gaggttccccattgtactggct

SEQ ID NO: 7730993 - DNA, 22 bp, Homo sapiens
gagccccaggacagctctagtt

SEQ ID NO: 7730994 - DNA, 22 bp, Homo sapiens
gaagccttgaactgcaaacccc

SEQ ID NO: 7730995 - DNA, 22 bp, Homo sapiens
gaagcctttgcctaaaacatta

SEQ ID NO: 7730996 - DNA, 20 bp, Homo sapiens
gccttccagttcagtggcac

SEQ ID NO: 7730997 - DNA, 19 bp, Homo sapiens
gcccaggggcccgatgctg

SEQ ID NO: 7730998 - DNA, 22 bp, Homo sapiens
gcccagggtgaagtgcagttgt

SEQ ID NO: 7730999 - DNA, 22 bp, Homo sapiens
gccatgcctgtgtctccaggcc

SEQ ID NO: 7731000 - DNA, 22 bp, Homo sapiens
gccatggcccataccaggtgca

SEQ ID NO: 7731001 - DNA, 18 bp, Homo sapiens
gccagccaggcgttgctc

SEQ ID NO: 7731002 - DNA, 20 bp, Homo sapiens
gcagggcatcttggccccca

SEQ ID NO: 7731003 - DNA, 17 bp, Homo sapiens
ctgggcctctgcccttt

SEQ ID NO: 7731004 - DNA, 22 bp, Homo sapiens
ctgtccagctgaccagagcagc

SEQ ID NO: 7731005 - DNA, 21 bp, Homo sapiens
ctgtccacatcacagagcctc

SEQ ID NO: 7731006 - DNA, 22 bp, Homo sapiens
ctggggaggcagggctgcccct

SEQ ID NO: 7731007 - DNA, 21 bp, Homo sapiens
ctgtccagtaattcctggcac

SEQ ID NO: 7731008 - DNA, 22 bp, Homo sapiens
ctgtgcctggggggcagagctg

SEQ ID NO: 7731009 - DNA, 22 bp, Homo sapiens
ctggccagtgcctgtgggcccc

SEQ ID NO: 7731010 - DNA, 22 bp, Homo sapiens
ctggccaggcttgggacagaca

SEQ ID NO: 7731011 - DNA, 22 bp, Homo sapiens
ctgccctctagaggaggactga

SEQ ID NO: 7731012 - DNA, 18 bp, Homo sapiens
ctgcctgctctccagctt

SEQ ID NO: 7731013 - DNA, 22 bp, Homo sapiens
ctcctcagctgggaggagtccc

SEQ ID NO: 7731014 - DNA, 22 bp, Homo sapiens
ctcccaggggagtcatctgctt

SEQ ID NO: 7731015 - DNA, 22 bp, Homo sapiens
ctcctctcaaaagtaggttgac

SEQ ID NO: 7731016 - DNA, 22 bp, Homo sapiens
ctcctctccatcagcgccaccc

SEQ ID NO: 7731017 - DNA, 22 bp, Homo sapiens
ctcctctcaggctggatggcgc

SEQ ID NO: 7731018 - DNA, 22 bp, Homo sapiens
cctgggcagggctggactctca

SEQ ID NO: 7731019 - DNA, 22 bp, Homo sapiens
cctgggcagggagaccaggctc

SEQ ID NO: 7731020 - DNA, 22 bp, Homo sapiens
cctgggcaggccggacgctggg

SEQ ID NO: 7731021 - DNA, 22 bp, Homo sapiens
cctgggcaggtgtggcttcccc

SEQ ID NO: 7731022 - DNA, 22 bp, Homo sapiens
cctggccagcagccccttcctc

SEQ ID NO: 7731023 - DNA, 22 bp, Homo sapiens
cctggccagccagggctggggt

SEQ ID NO: 7731024 - DNA, 22 bp, Homo sapiens
cctgcctgcgtcctctgagggc

SEQ ID NO: 7731025 - DNA, 22 bp, Homo sapiens
cctgcctgcggcccgcggggag

SEQ ID NO: 7731026 - DNA, 22 bp, Homo sapiens
cctgcctggctgtcagcagagc

SEQ ID NO: 7731027 - DNA, 22 bp, Homo sapiens
cctgcctggcccaccttgccac

SEQ ID NO: 7731028 - DNA, 22 bp, Homo sapiens
cgcctgggagtccacacctgct

SEQ ID NO: 7731029 - DNA, 22 bp, Homo sapiens
cgtgattggcttctgcattgga

SEQ ID NO: 7731030 - DNA, 22 bp, Homo sapiens
cctggtgaatgttcatggactg

SEQ ID NO: 7731031 - DNA, 22 bp, Homo sapiens
aggattgtgcctccagtcagaa

SEQ ID NO: 7731032 - DNA, 20 bp, Homo sapiens
cagtgcctgccccttgggtt

SEQ ID NO: 7731033 - DNA, 22 bp, Homo sapiens
cagggcctctcatcccacgggc

SEQ ID NO: 7731034 - DNA, 22 bp, Homo sapiens
cagggcctcgaagcctctgggc

SEQ ID NO: 7731035 - DNA, 22 bp, Homo sapiens
cagggcctgagggctgctctgc

SEQ ID NO: 7731036 - DNA, 22 bp, Homo sapiens
cagggcctctgtgggctctctc

SEQ ID NO: 7731037 - DNA, 22 bp, Homo sapiens
cagggctccctgcagcctctgt

SEQ ID NO: 7731038 - DNA, 22 bp, Homo sapiens
cagggctcccaaatatctcttc

SEQ ID NO: 7731039 - DNA, 22 bp, Homo sapiens
cagggctccccagagagcctct

SEQ ID NO: 7731040 - DNA, 22 bp, Homo sapiens
cagggctcgctcttgcccttcg

SEQ ID NO: 7731041 - DNA, 22 bp, Homo sapiens
cagggctcgctgccagcttcag

SEQ ID NO: 7731042 - DNA, 22 bp, Homo sapiens
cagggtgactgccctggccact

SEQ ID NO: 7731043 - DNA, 22 bp, Homo sapiens
caggtcctttagtgtccagaac

SEQ ID NO: 7731044 - DNA, 22 bp, Homo sapiens
caggctccactgtaggcagctc

SEQ ID NO: 7731045 - DNA, 22 bp, Homo sapiens
caggctcagatgccctgcgctg

SEQ ID NO: 7731046 - DNA, 22 bp, Homo sapiens
agctgggcttggccaggtcgct

SEQ ID NO: 7731047 - DNA, 22 bp, Homo sapiens
ccagcctccatgtagatagctg

SEQ ID NO: 7731048 - DNA, 22 bp, Homo sapiens
ccaggagagcagaagcccaggc

SEQ ID NO: 7731049 - DNA, 22 bp, Homo sapiens
ccaggagagcattgcacagagg

SEQ ID NO: 7731050 - DNA, 22 bp, Homo sapiens
ccaggagagcgccctcccggcc

SEQ ID NO: 7731051 - DNA, 22 bp, Homo sapiens
ccaggagatttttccatagcac

SEQ ID NO: 7731052 - DNA, 22 bp, Homo sapiens
ccatgggacctacctcctgtgc

SEQ ID NO: 7731053 - DNA, 21 bp, Homo sapiens
cccagagcctagggagggcac

SEQ ID NO: 7731054 - DNA, 22 bp, Homo sapiens
cccagagccgctcccctacttc

SEQ ID NO: 7731055 - DNA, 22 bp, Homo sapiens
cccagagcatgtgctgcctttg

SEQ ID NO: 7731056 - DNA, 22 bp, Homo sapiens
ccagggtgaccagctggcctag

SEQ ID NO: 7731057 - DNA, 22 bp, Homo sapiens
aggctccttgctcacaggctca

SEQ ID NO: 7731058 - DNA, 22 bp, Homo sapiens
aggctcctgcaggtgaggtgct

SEQ ID NO: 7731059 - DNA, 22 bp, Homo sapiens
aggctcctgatcctggggtctg

SEQ ID NO: 7731060 - DNA, 20 bp, Homo sapiens
aggctcctccaggatgtgtg

SEQ ID NO: 7731061 - DNA, 22 bp, Homo sapiens
aggctcctagcctgtggctggt

SEQ ID NO: 7731062 - DNA, 22 bp, Homo sapiens
aggctccaaattaccaagctct

SEQ ID NO: 7731063 - DNA, 22 bp, Homo sapiens
aggctccaccctacagagctcc

SEQ ID NO: 7731064 - DNA, 22 bp, Homo sapiens
ccaggagctggagggtgcagtg

SEQ ID NO: 7731065 - DNA, 22 bp, Homo sapiens
ccaggagctggcatgtggagag

SEQ ID NO: 7731066 - DNA, 16 bp, Homo sapiens
agggccagaagcatca

SEQ ID NO: 7731067 - DNA, 22 bp, Homo sapiens
agggccagagtctgtgtagata

SEQ ID NO: 7731068 - DNA, 22 bp, Homo sapiens
agggccagaggcaccttgcagc

SEQ ID NO: 7731069 - DNA, 22 bp, Homo sapiens
agggccagaatccctcagtcta

SEQ ID NO: 7731070 - DNA, 22 bp, Homo sapiens
cctgaggccctggctgtgctga

SEQ ID NO: 7731071 - DNA, 22 bp, Homo sapiens
ccctctctcggttgctgtggtt

SEQ ID NO: 7731072 - DNA, 22 bp, Homo sapiens
ccctctcttagaagaaacacag

SEQ ID NO: 7731073 - DNA, 22 bp, Homo sapiens
ccctctctgacttctgaacttg

SEQ ID NO: 7731074 - DNA, 22 bp, Homo sapiens
ccctctctgctgcatagaggaa

SEQ ID NO: 7731075 - DNA, 22 bp, Homo sapiens
ccctctctctatcgggccccag

SEQ ID NO: 7731076 - DNA, 22 bp, Homo sapiens
ccctctgctcaggtgcataggc

SEQ ID NO: 7731077 - DNA, 22 bp, Homo sapiens
cccagggctgtagaatgtccaa

SEQ ID NO: 7731078 - DNA, 22 bp, Homo sapiens
cccagggcttgagtcatccatg

SEQ ID NO: 7731079 - DNA, 22 bp, Homo sapiens
cccagggcttttctcactagac

SEQ ID NO: 7731080 - DNA, 22 bp, Homo sapiens
acagtgtgacaattgtgtcaga

SEQ ID NO: 7731081 - DNA, 22 bp, Homo sapiens
acagtgtgtgggaaatgtgact

SEQ ID NO: 7731082 - DNA, 22 bp, Homo sapiens
aggagcagaccgtagtcctgca

SEQ ID NO: 7731083 - DNA, 22 bp, Homo sapiens
aggagcactaattcctgcagag

SEQ ID NO: 7731084 - DNA, 22 bp, Homo sapiens
aggaagaatgtttacatatcaa

SEQ ID NO: 7731085 - DNA, 22 bp, Homo sapiens
acagctgggaactcacacagca

SEQ ID NO: 7731086 - DNA, 21 bp, Homo sapiens
aggcctcttcatggccatgat

SEQ ID NO: 7731087 - DNA, 22 bp, Homo sapiens
aggcctctgggtctcctctgac

SEQ ID NO: 7731088 - DNA, 22 bp, Homo sapiens
agggcagcagcccatggctctg

SEQ ID NO: 7731089 - DNA, 22 bp, Homo sapiens
accaggcctggctgggcagcca

SEQ ID NO: 7731090 - DNA, 22 bp, Homo sapiens
agggcagcagctcctcctagct

SEQ ID NO: 7731091 - DNA, 22 bp, Homo sapiens
actagggctcaggcctacctag

SEQ ID NO: 7731092 - DNA, 22 bp, Homo sapiens
aggtctcccaagggccagggag

SEQ ID NO: 7731093 - DNA, 22 bp, Homo sapiens
attgcctgccactctgtgagga

SEQ ID NO: 7731094 - DNA, 22 bp, Homo sapiens
attccaggattccaggacaaat

SEQ ID NO: 7731095 - DNA, 22 bp, Homo sapiens
attccaggcaaagcagagaaga

SEQ ID NO: 7731096 - DNA, 22 bp, Homo sapiens
attccaggaagtgtgggaccaa

SEQ ID NO: 7731097 - DNA, 22 bp, Homo sapiens
attccaggagctaactgtggtc

SEQ ID NO: 7731098 - DNA, 23 bp, Homo sapiens
attccaggaaatacttggctttc

SEQ ID NO: 7731099 - DNA, 21 bp, Homo sapiens
agaggccttacaggatagacc

SEQ ID NO: 7731100 - DNA, 22 bp, Homo sapiens
agagcctgtgggagatgcagct

SEQ ID NO: 7731101 - DNA, 22 bp, Homo sapiens
agagcctgttcggaggcgcccc

SEQ ID NO: 7731102 - DNA, 22 bp, Homo sapiens
agagcctggtctgagataggac

SEQ ID NO: 7731103 - DNA, 22 bp, Homo sapiens
agagcctgggcagctcctctgg

SEQ ID NO: 7731104 - DNA, 22 bp, Homo sapiens
agagcctgggaatttgcatgtt

SEQ ID NO: 7731105 - DNA, 22 bp, Homo sapiens
agagcctgcagtggagaccttg

SEQ ID NO: 7731106 - DNA, 22 bp, Homo sapiens
agagccagcaactctagccctg

SEQ ID NO: 7731107 - DNA, 22 bp, Homo sapiens
agagccagaccattgccgtgca

SEQ ID NO: 7731108 - DNA, 22 bp, Homo sapiens
agagccagatggagccgtgtgt

SEQ ID NO: 7731109 - DNA, 22 bp, Homo sapiens
agagccacggcaggcctaggaa

SEQ ID NO: 7731110 - DNA, 23 bp, Homo sapiens
agacccagagactggctctgctc

SEQ ID NO: 7731111 - DNA, 22 bp, Homo sapiens
agaccagggtcccacagagtct

SEQ ID NO: 7731112 - DNA, 22 bp, Homo sapiens
agctcaggcaactctgggcccc

SEQ ID NO: 7731113 - DNA, 22 bp, Homo sapiens
cagcagctccaaagaatagcca

SEQ ID NO: 7731114 - DNA, 22 bp, Homo sapiens
agcctgactaataggagttgag

SEQ ID NO: 7731115 - DNA, 22 bp, Homo sapiens
agcctgagctgcctgccgcctc

SEQ ID NO: 7731116 - DNA, 22 bp, Homo sapiens
cagcagctcactcaggtggctc

SEQ ID NO: 7731117 - DNA, 22 bp, Homo sapiens
agcctggagttcccaggagaag

SEQ ID NO: 7731118 - DNA, 22 bp, Homo sapiens
agcctccctatgcaccttcagg

SEQ ID NO: 7731119 - DNA, 22 bp, Homo sapiens
agcagccacccagctgctcatt

SEQ ID NO: 7731120 - DNA, 22 bp, Homo sapiens
agcagctgctccacttgcttaa

SEQ ID NO: 7731121 - DNA, 22 bp, Homo sapiens
agcagctgatggggaaggagtt

SEQ ID NO: 7731122 - DNA, 22 bp, Homo sapiens
agcagctgatcaaagcacttat

SEQ ID NO: 7731123 - DNA, 23 bp, Homo sapiens
cactgccttcagttgcttcacct

SEQ ID NO: 7731124 - DNA, 22 bp, Homo sapiens
cacccagggctgtgcctgccca

SEQ ID NO: 7731125 - DNA, 22 bp, Homo sapiens
aatataatgctgttttatgcca

SEQ ID NO: 7731126 - DNA, 20 bp, Homo sapiens
aacagggggctgcagagggc

SEQ ID NO: 7731127 - DNA, 22 bp, Homo sapiens
aaccaccattctctcctcttcc

SEQ ID NO: 7731128 - DNA, 22 bp, Homo sapiens
acactggataccactgttatta

SEQ ID NO: 7731129 - DNA, 22 bp, Homo sapiens
aagattgttttggatgctaact

SEQ ID NO: 7731130 - DNA, 23 bp, Homo sapiens
aaataggagtatctggatcatga

SEQ ID NO: 7731131 - DNA, 22 bp, Homo sapiens
aaataggaatgtggtcctggga

SEQ ID NO: 7731132 - DNA, 22 bp, Homo sapiens
actgcctgtttggcatggcccc

SEQ ID NO: 7731133 - DNA, 22 bp, Homo sapiens
accccaggagctgtgcctagtc

SEQ ID NO: 7731134 - DNA, 22 bp, Homo sapiens
accccagggctgccagcctcct

SEQ ID NO: 7731135 - DNA, 22 bp, Homo sapiens
agaggccccaggtgagcatgcc

SEQ ID NO: 7731136 - DNA, 22 bp, Homo sapiens
agccatgggctcccagtccttt

SEQ ID NO: 7731137 - DNA, 22 bp, Homo sapiens
tactgtgtgcccagccgagctg

SEQ ID NO: 7731138 - DNA, 22 bp, Homo sapiens
tagggcagccacccaggctgct

SEQ ID NO: 7731139 - DNA, 22 bp, Homo sapiens
tcagggcatctcttaagtggtg

SEQ ID NO: 7731140 - DNA, 22 bp, Homo sapiens
tcagggccgccggggatctcgc

SEQ ID NO: 7731141 - DNA, 19 bp, Homo sapiens
tcagggccgcagagggtac

SEQ ID NO: 7731142 - DNA, 22 bp, Homo sapiens
tcagggccggggctgtggcgag

SEQ ID NO: 7731143 - DNA, 22 bp, Homo sapiens
tcagggctgcagaagaggcagg

SEQ ID NO: 7731144 - DNA, 22 bp, Homo sapiens
tcagggctgcatacaggagata

SEQ ID NO: 7731145 - DNA, 22 bp, Homo sapiens
tcagggcctttgcagttgtttt

SEQ ID NO: 7731146 - DNA, 22 bp, Homo sapiens
tcagggcaggacagtgtaggcc

SEQ ID NO: 7731147 - DNA, 21 bp, Homo sapiens
tcagggcagtgggaggttcct

SEQ ID NO: 7731148 - DNA, 19 bp, Homo sapiens
tcagggcagtccggtcccc

SEQ ID NO: 7731149 - DNA, 22 bp, Homo sapiens
tcagggcaggttaacttgggtg

SEQ ID NO: 7731150 - DNA, 22 bp, Homo sapiens
tcagggcaggcgagcagctgct

SEQ ID NO: 7731151 - DNA, 19 bp, Homo sapiens
tcacagtgcagaaccctcc

SEQ ID NO: 7731152 - DNA, 22 bp, Homo sapiens
tcagccagctgtgtgcttctgc

SEQ ID NO: 7731153 - DNA, 22 bp, Homo sapiens
tcagccagagggggcaaaggaa

SEQ ID NO: 7731154 - DNA, 22 bp, Homo sapiens
tcagctggagatgagaaccgaa

SEQ ID NO: 7731155 - DNA, 16 bp, Homo sapiens
tcccaggccaggtgga

SEQ ID NO: 7731156 - DNA, 22 bp, Homo sapiens
tccaggccttgacaggtcagtt

SEQ ID NO: 7731157 - DNA, 22 bp, Homo sapiens
tccaggctggacatgaggcggg

SEQ ID NO: 7731158 - DNA, 22 bp, Homo sapiens
tccagggcttgacagggtgcct

SEQ ID NO: 7731159 - DNA, 22 bp, Homo sapiens
tccagggctgggttggctcagc

SEQ ID NO: 7731160 - DNA, 22 bp, Homo sapiens
tcccaggctggggccaggtgac

SEQ ID NO: 7731161 - DNA, 20 bp, Homo sapiens
tcccaggctgggctccagct

SEQ ID NO: 7731162 - DNA, 22 bp, Homo sapiens
tcccaggctaccagtgaggtca

SEQ ID NO: 7731163 - DNA, 20 bp, Homo sapiens
tcccaggctccaccctagac

SEQ ID NO: 7731164 - DNA, 23 bp, Homo sapiens
tcctcagcatgttttgtcatgta

SEQ ID NO: 7731165 - DNA, 22 bp, Homo sapiens
tcctcaggggtttcaggtgtac

SEQ ID NO: 7731166 - DNA, 22 bp, Homo sapiens
tcctcaggtcaaagcaggagaa

SEQ ID NO: 7731167 - DNA, 19 bp, Homo sapiens
tcctcaggggctcacagac

SEQ ID NO: 7731168 - DNA, 22 bp, Homo sapiens
tcctgcaggcttgagtcctcag

SEQ ID NO: 7731169 - DNA, 16 bp, Homo sapiens
gggctgggggattctg

SEQ ID NO: 7731170 - DNA, 18 bp, Homo sapiens
gggctgtgttcatgccca

SEQ ID NO: 7731171 - DNA, 22 bp, Homo sapiens
ggggcattgtgtctgggttcct

SEQ ID NO: 7731172 - DNA, 22 bp, Homo sapiens
ggggccagcttcgcgtgctctt

SEQ ID NO: 7731173 - DNA, 22 bp, Homo sapiens
ggggccagcactgtgcctttgt

SEQ ID NO: 7731174 - DNA, 22 bp, Homo sapiens
gggtgcagcagagctcctctgt

SEQ ID NO: 7731175 - DNA, 18 bp, Homo sapiens
gtgccaggaggcgcagcc

SEQ ID NO: 7731176 - DNA, 20 bp, Homo sapiens
gtgccaggcaagacaggtgg

SEQ ID NO: 7731177 - DNA, 22 bp, Homo sapiens
gtgccaggcccagggagcgggg

SEQ ID NO: 7731178 - DNA, 22 bp, Homo sapiens
gtgccagggagtggaggagctt

SEQ ID NO: 7731179 - DNA, 22 bp, Homo sapiens
gtgccaggcctattgttaaact

SEQ ID NO: 7731180 - DNA, 22 bp, Homo sapiens
gtgccagggggcactgaacaga

SEQ ID NO: 7731181 - DNA, 22 bp, Homo sapiens
gtgccaggtgctaagctgtgct

SEQ ID NO: 7731182 - DNA, 21 bp, Homo sapiens
gtccagagagccggctcctga

SEQ ID NO: 7731183 - DNA, 23 bp, Homo sapiens
gtcctctggagagaaaggcagta

SEQ ID NO: 7731184 - DNA, 22 bp, Homo sapiens
gtccaggctgacccctagagga

SEQ ID NO: 7731185 - DNA, 22 bp, Homo sapiens
gtcctctgtgtaggctgcagac

SEQ ID NO: 7731186 - DNA, 22 bp, Homo sapiens
gtcctggcccactggcaggctg

SEQ ID NO: 7731187 - DNA, 22 bp, Homo sapiens
ggcagggccctgattcctgggg

SEQ ID NO: 7731188 - DNA, 20 bp, Homo sapiens
ggcagggcatcaacagctct

SEQ ID NO: 7731189 - DNA, 22 bp, Homo sapiens
ggcagggcttgtctctgtgatg

SEQ ID NO: 7731190 - DNA, 21 bp, Homo sapiens
ggcagcctgacccccagagag

SEQ ID NO: 7731191 - DNA, 18 bp, Homo sapiens
ggcagcctggacatgctc

SEQ ID NO: 7731192 - DNA, 21 bp, Homo sapiens
ggcctcccggaccgcagcgcc

SEQ ID NO: 7731193 - DNA, 22 bp, Homo sapiens
ggcctccaggcctactcagggc

SEQ ID NO: 7731194 - DNA, 22 bp, Homo sapiens
ggcctctctggcatggctgccc

SEQ ID NO: 7731195 - DNA, 22 bp, Homo sapiens
gggagccagcagggcatggagc

SEQ ID NO: 7731196 - DNA, 22 bp, Homo sapiens
ggctgtgctttgcccaaagggc

SEQ ID NO: 7731197 - DNA, 22 bp, Homo sapiens
ggctgtggggggagcctgcccg

SEQ ID NO: 7731198 - DNA, 22 bp, Homo sapiens
ggctgcatgccaggctttgagc

SEQ ID NO: 7731199 - DNA, 19 bp, Homo sapiens
ggctggagtggccatctgt

SEQ ID NO: 7731200 - DNA, 22 bp, Homo sapiens
gggctcagaggagtggcctggg

SEQ ID NO: 7731201 - DNA, 22 bp, Homo sapiens
gggctcagacatccctcctgga

SEQ ID NO: 7731202 - DNA, 22 bp, Homo sapiens
gctctcttggtggctgtcctgg

SEQ ID NO: 7731203 - DNA, 22 bp, Homo sapiens
gctctcttgacagcttgctgtt

SEQ ID NO: 7731204 - DNA, 22 bp, Homo sapiens
gctctccaggggctcccaggat

SEQ ID NO: 7731205 - DNA, 22 bp, Homo sapiens
gctctccaggtctcatgcactg

SEQ ID NO: 7731206 - DNA, 22 bp, Homo sapiens
gctggccaaagtgtacctggag

SEQ ID NO: 7731207 - DNA, 22 bp, Homo sapiens
gctgcctgaaatgttgcctagc

SEQ ID NO: 7731208 - DNA, 22 bp, Homo sapiens
gctgcctgaagtgtctacactg

SEQ ID NO: 7731209 - DNA, 22 bp, Homo sapiens
ggagctggctacagagaactcc

SEQ ID NO: 7731210 - DNA, 22 bp, Homo sapiens
ggagaagaggagctggaagcct

SEQ ID NO: 7731211 - DNA, 22 bp, Homo sapiens
ggacaggcccggggagcctgga

SEQ ID NO: 7731212 - DNA, 22 bp, Homo sapiens
gctgtcctgggaacaggcacta

SEQ ID NO: 7731213 - DNA, 23 bp, Homo sapiens
gctgtcctcctgggcccagcagc

SEQ ID NO: 7731214 - DNA, 22 bp, Homo sapiens
gctggccaggaagagtctcaga

SEQ ID NO: 7731215 - DNA, 22 bp, Homo sapiens
gctggccacactgctgatggag

SEQ ID NO: 7731216 - DNA, 22 bp, Homo sapiens
gccaggctctcagtgactgccc

SEQ ID NO: 7731217 - DNA, 22 bp, Homo sapiens
gccaggctccaggccctcctga

SEQ ID NO: 7731218 - DNA, 22 bp, Homo sapiens
gccaggctaagaaaggtgtgat

SEQ ID NO: 7731219 - DNA, 22 bp, Homo sapiens
gccagaccagctgtgattccag

SEQ ID NO: 7731220 - DNA, 22 bp, Homo sapiens
gcctcaggtgcatctctcattc

SEQ ID NO: 7731221 - DNA, 22 bp, Homo sapiens
gcctcagggggagaggccagct

SEQ ID NO: 7731222 - DNA, 22 bp, Homo sapiens
gccctcagaggacagctgactt

SEQ ID NO: 7731223 - DNA, 22 bp, Homo sapiens
gcctccctccaccactgcaggt

SEQ ID NO: 7731224 - DNA, 22 bp, Homo sapiens
gcctccctgtttcctgctccaa

SEQ ID NO: 7731225 - DNA, 22 bp, Homo sapiens
gcagggcagctgaagctaggtg

SEQ ID NO: 7731226 - DNA, 22 bp, Homo sapiens
gcagggcagcttagtccctgtc

SEQ ID NO: 7731227 - DNA, 22 bp, Homo sapiens
gcagggccagtgcagagaggaa

SEQ ID NO: 7731228 - DNA, 22 bp, Homo sapiens
gcagggccaggtacaagaagca

SEQ ID NO: 7731229 - DNA, 22 bp, Homo sapiens
gcagggccagggctcaggctgt

SEQ ID NO: 7731230 - DNA, 22 bp, Homo sapiens
gcagggcatgggccctgtctgc

SEQ ID NO: 7731231 - DNA, 22 bp, Homo sapiens
gcaggtgaaagtgagtagtgag

SEQ ID NO: 7731232 - DNA, 19 bp, Homo sapiens
gcaggtgagccgtggctcc

SEQ ID NO: 7731233 - DNA, 22 bp, Homo sapiens
gcagcccaagcctgagcatcct

SEQ ID NO: 7731234 - DNA, 22 bp, Homo sapiens
gcacagagacagtcctgagatc

SEQ ID NO: 7731235 - DNA, 22 bp, Homo sapiens
ctgtgaggccctgggtgctgga

SEQ ID NO: 7731236 - DNA, 22 bp, Homo sapiens
ctgggatgtctatagaacactt

SEQ ID NO: 7731237 - DNA, 22 bp, Homo sapiens
ctgggatggctttcctgcatta

SEQ ID NO: 7731238 - DNA, 22 bp, Homo sapiens
ctggggggctactgacagagga

SEQ ID NO: 7731239 - DNA, 22 bp, Homo sapiens
cttccaggtccttcttgagaag

SEQ ID NO: 7731240 - DNA, 22 bp, Homo sapiens
cttccaggtaggcctaaggcag

SEQ ID NO: 7731241 - DNA, 22 bp, Homo sapiens
cttccagggtccaggaagagcc

SEQ ID NO: 7731242 - DNA, 22 bp, Homo sapiens
ctttcctctggcactgtctggt

SEQ ID NO: 7731243 - DNA, 22 bp, Homo sapiens
gagcacagatcctggagccaca

SEQ ID NO: 7731244 - DNA, 22 bp, Homo sapiens
gagagacagcacacagtgtggg

SEQ ID NO: 7731245 - DNA, 22 bp, Homo sapiens
gagctgggtctccaccttggca

SEQ ID NO: 7731246 - DNA, 22 bp, Homo sapiens
gagctgggatttgaacctggga

SEQ ID NO: 7731247 - DNA, 22 bp, Homo sapiens
gaggtgcttcctttgggctctg

SEQ ID NO: 7731248 - DNA, 22 bp, Homo sapiens
gaggcctggtttgcatgagaat

SEQ ID NO: 7731249 - DNA, 22 bp, Homo sapiens
gaggccttcctctcaagcacat

SEQ ID NO: 7731250 - DNA, 22 bp, Homo sapiens
gaggcctgtagtcatggatgta

SEQ ID NO: 7731251 - DNA, 22 bp, Homo sapiens
gagggcctctgtgggtgctcac

SEQ ID NO: 7731252 - DNA, 22 bp, Homo sapiens
cgggctggctgcagctgctgga

SEQ ID NO: 7731253 - DNA, 22 bp, Homo sapiens
cgagagccggaaggggcggtgc

SEQ ID NO: 7731254 - DNA, 23 bp, Homo sapiens
ctcagaggcctgtccagggtggt

SEQ ID NO: 7731255 - DNA, 22 bp, Homo sapiens
ctcagggcagtatggctgagag

SEQ ID NO: 7731256 - DNA, 18 bp, Homo sapiens
ctcagggcatcagtctgg

SEQ ID NO: 7731257 - DNA, 22 bp, Homo sapiens
ctcagggctggaaagccaggaa

SEQ ID NO: 7731258 - DNA, 21 bp, Homo sapiens
ctcagggcttggtgtcctcat

SEQ ID NO: 7731259 - DNA, 18 bp, Homo sapiens
ctccagagctgtgagaca

SEQ ID NO: 7731260 - DNA, 22 bp, Homo sapiens
ctccagaggaaagcacatagtg

SEQ ID NO: 7731261 - DNA, 22 bp, Homo sapiens
ctccagaggatgcaggtgaggg

SEQ ID NO: 7731262 - DNA, 22 bp, Homo sapiens
ctccagagggtcagactctgag

SEQ ID NO: 7731263 - DNA, 22 bp, Homo sapiens
ctccagaggcgacttgcatcac

SEQ ID NO: 7731264 - DNA, 22 bp, Homo sapiens
ctccagaggttctcatctggga

SEQ ID NO: 7731265 - DNA, 22 bp, Homo sapiens
ctccagaggtccccgcggcact

SEQ ID NO: 7731266 - DNA, 22 bp, Homo sapiens
ctccagagtcatcgagcattcc

SEQ ID NO: 7731267 - DNA, 22 bp, Homo sapiens
ctccagagtcacactgcctggg

SEQ ID NO: 7731268 - DNA, 22 bp, Homo sapiens
ctcagagcacttttgaaagctc

SEQ ID NO: 7731269 - DNA, 22 bp, Homo sapiens
ctcagagcacagtttatgacag

SEQ ID NO: 7731270 - DNA, 17 bp, Homo sapiens
ctcagagcaggacagaa

SEQ ID NO: 7731271 - DNA, 22 bp, Homo sapiens
ctcagagccccaggagggtgtg

SEQ ID NO: 7731272 - DNA, 22 bp, Homo sapiens
ttctgcaggatgctctggtggt

SEQ ID NO: 7731273 - DNA, 22 bp, Homo sapiens
ctccttcacgcaggctgccatg

SEQ ID NO: 7731274 - DNA, 22 bp, Homo sapiens
ctccaggcccctggccttctgc

SEQ ID NO: 7731275 - DNA, 22 bp, Homo sapiens
ctctggcctgcttcctcaggta

SEQ ID NO: 7731276 - DNA, 22 bp, Homo sapiens
ctctgcagagcctccagcccag

SEQ ID NO: 7731277 - DNA, 22 bp, Homo sapiens
ctctgcagaatttgagctgctc

SEQ ID NO: 7731278 - DNA, 22 bp, Homo sapiens
ctctgcagaggcccaaggctga

SEQ ID NO: 7731279 - DNA, 22 bp, Homo sapiens
tttgttcattagtacagttgta

SEQ ID NO: 7731280 - DNA, 21 bp, Homo sapiens
tttgttcaggcaagttacagt

SEQ ID NO: 7731281 - DNA, 20 bp, Homo sapiens
ctcttccggaggggcgctcc

SEQ ID NO: 7731282 - DNA, 22 bp, Homo sapiens
ctgaggtctagacaccccaggg

SEQ ID NO: 7731283 - DNA, 22 bp, Homo sapiens
ctgaggcctggccccaccacag

SEQ ID NO: 7731284 - DNA, 22 bp, Homo sapiens
ctgcccacagttctctgccatg

SEQ ID NO: 7731285 - DNA, 22 bp, Homo sapiens
ctgcccccaggctgcatggctg

SEQ ID NO: 7731286 - DNA, 22 bp, Homo sapiens
ctgcccattcaaccagctacag

SEQ ID NO: 7731287 - DNA, 22 bp, Homo sapiens
ctgcccatctgcagacatgcgt

SEQ ID NO: 7731288 - DNA, 22 bp, Homo sapiens
ctgccttccaaccccagactcc

SEQ ID NO: 7731289 - DNA, 22 bp, Homo sapiens
ctgcctggggaatgtgaggatt

SEQ ID NO: 7731290 - DNA, 22 bp, Homo sapiens
ctggagagttggaagatggact

SEQ ID NO: 7731291 - DNA, 22 bp, Homo sapiens
ctggaagggagcactgtagaga

SEQ ID NO: 7731292 - DNA, 22 bp, Homo sapiens
cagggccttatcctgccattga

SEQ ID NO: 7731293 - DNA, 22 bp, Homo sapiens
cagggccttcgtaagtgtccgg

SEQ ID NO: 7731294 - DNA, 22 bp, Homo sapiens
cagggcctgtcacgacgctcat

SEQ ID NO: 7731295 - DNA, 22 bp, Homo sapiens
cagggcctcattgtcagtcctg

SEQ ID NO: 7731296 - DNA, 22 bp, Homo sapiens
cagggcctggagctgggcctgc

SEQ ID NO: 7731297 - DNA, 22 bp, Homo sapiens
cagggcagagggaaactccttt

SEQ ID NO: 7731298 - DNA, 22 bp, Homo sapiens
cagggcacttaaattgcctcgt

SEQ ID NO: 7731299 - DNA, 22 bp, Homo sapiens
cagggcacagatcggggcgcac

SEQ ID NO: 7731300 - DNA, 22 bp, Homo sapiens
cagggcacagttatggaggtgg

SEQ ID NO: 7731301 - DNA, 22 bp, Homo sapiens
cagggcacggagaagtcacccc

SEQ ID NO: 7731302 - DNA, 22 bp, Homo sapiens
tcacaacaggaaggaccagctg

SEQ ID NO: 7731303 - DNA, 23 bp, Homo sapiens
tcagcagcagaagtgctgggatg

SEQ ID NO: 7731304 - DNA, 22 bp, Homo sapiens
cagtgggattgggattggaacc

SEQ ID NO: 7731305 - DNA, 22 bp, Homo sapiens
cagtgggagcaaatacactcat

SEQ ID NO: 7731306 - DNA, 22 bp, Homo sapiens
cagtgggacatgggcactgggc

SEQ ID NO: 7731307 - DNA, 22 bp, Homo sapiens
tccagaccatgtgagaggcgca

SEQ ID NO: 7731308 - DNA, 22 bp, Homo sapiens
tccaggcccgagatgggctgga

SEQ ID NO: 7731309 - DNA, 22 bp, Homo sapiens
tccaggctcagtcaagcacttc

SEQ ID NO: 7731310 - DNA, 22 bp, Homo sapiens
tccaggcccctgcctgggcctg

SEQ ID NO: 7731311 - DNA, 22 bp, Homo sapiens
tccaggccccagcaccttggga

SEQ ID NO: 7731312 - DNA, 20 bp, Homo sapiens
tccagctgggaacagctgat

SEQ ID NO: 7731313 - DNA, 22 bp, Homo sapiens
tccaggcccatggagcagagct

SEQ ID NO: 7731314 - DNA, 20 bp, Homo sapiens
tccaggctcctccacttagt

SEQ ID NO: 7731315 - DNA, 22 bp, Homo sapiens
tcctcaggcggtgaggaggggc

SEQ ID NO: 7731316 - DNA, 22 bp, Homo sapiens
tcctcaggatctaggagtgctt

SEQ ID NO: 7731317 - DNA, 22 bp, Homo sapiens
ccagccctgcctctcagggccc

SEQ ID NO: 7731318 - DNA, 22 bp, Homo sapiens
ccagccctgtaaggatgaggca

SEQ ID NO: 7731319 - DNA, 22 bp, Homo sapiens
ccagccctgtttatgtgtcact

SEQ ID NO: 7731320 - DNA, 22 bp, Homo sapiens
ccacccttgggttcggaggccg

SEQ ID NO: 7731321 - DNA, 21 bp, Homo sapiens
tcctctgcagtgaggtggcct

SEQ ID NO: 7731322 - DNA, 18 bp, Homo sapiens
tcctctctttccccaggg

SEQ ID NO: 7731323 - DNA, 22 bp, Homo sapiens
tcctctctgcactggccctgcc

SEQ ID NO: 7731324 - DNA, 22 bp, Homo sapiens
ccacattcaccagctgcacgac

SEQ ID NO: 7731325 - DNA, 22 bp, Homo sapiens
ccacctcctcggccatgtgacg

SEQ ID NO: 7731326 - DNA, 21 bp, Homo sapiens
ccagcctcagatcagggagct

SEQ ID NO: 7731327 - DNA, 22 bp, Homo sapiens
ccagcccttgctgaagggtggc

SEQ ID NO: 7731328 - DNA, 22 bp, Homo sapiens
ccaggctcagcgcgcacgtctg

SEQ ID NO: 7731329 - DNA, 23 bp, Homo sapiens
ccaggctaaatgttagagtctga

SEQ ID NO: 7731330 - DNA, 22 bp, Homo sapiens
tgaccacacttgatcactctga

SEQ ID NO: 7731331 - DNA, 23 bp, Homo sapiens
ccagggcccctacaccactgtcc

SEQ ID NO: 7731332 - DNA, 22 bp, Homo sapiens
ccagggccagtaagattggcat

SEQ ID NO: 7731333 - DNA, 22 bp, Homo sapiens
ccagggcatgggaagaactgaa

SEQ ID NO: 7731334 - DNA, 22 bp, Homo sapiens
ccagggcatgtccaagacttag

SEQ ID NO: 7731335 - DNA, 22 bp, Homo sapiens
ccagggccaagagacctcgagg

SEQ ID NO: 7731336 - DNA, 22 bp, Homo sapiens
ccagggcatgtaactaatggtg

SEQ ID NO: 7731337 - DNA, 23 bp, Homo sapiens
tgagcacctaatgctgggcactg

SEQ ID NO: 7731338 - DNA, 22 bp, Homo sapiens
ccagggttgcagggagccagca

SEQ ID NO: 7731339 - DNA, 22 bp, Homo sapiens
ccatggccgccgctgctcagga

SEQ ID NO: 7731340 - DNA, 22 bp, Homo sapiens
cccaagcagggtgcagaggcat

SEQ ID NO: 7731341 - DNA, 22 bp, Homo sapiens
tgaggcagtgctgggaagcctg

SEQ ID NO: 7731342 - DNA, 22 bp, Homo sapiens
ccagtgtgggctggtggaggac

SEQ ID NO: 7731343 - DNA, 22 bp, Homo sapiens
ccagtgtgttccctgcctcact

SEQ ID NO: 7731344 - DNA, 22 bp, Homo sapiens
cccaggaggcagaagttgcagt

SEQ ID NO: 7731345 - DNA, 22 bp, Homo sapiens
tgccctcagtttcacatgagtg

SEQ ID NO: 7731346 - DNA, 22 bp, Homo sapiens
cccaggactaatgagctctacg

SEQ ID NO: 7731347 - DNA, 22 bp, Homo sapiens
cccaggactcggcactctcctt

SEQ ID NO: 7731348 - DNA, 21 bp, Homo sapiens
tggcctcccacacttccatgg

SEQ ID NO: 7731349 - DNA, 22 bp, Homo sapiens
tggcctcccctaacagcctctt

SEQ ID NO: 7731350 - DNA, 22 bp, Homo sapiens
cctcagcatcctggtgaagtag

SEQ ID NO: 7731351 - DNA, 22 bp, Homo sapiens
ccctgtggaggcagcatcctgc

SEQ ID NO: 7731352 - DNA, 22 bp, Homo sapiens
ccctgggataccagacaccaga

SEQ ID NO: 7731353 - DNA, 22 bp, Homo sapiens
ccctgggatggattggcaggaa

SEQ ID NO: 7731354 - DNA, 22 bp, Homo sapiens
cctcacagccctcctctagcac

SEQ ID NO: 7731355 - DNA, 22 bp, Homo sapiens
tgcctgcctgcatagtcccacg

SEQ ID NO: 7731356 - DNA, 22 bp, Homo sapiens
tgcctgcctctggcagccctgc

SEQ ID NO: 7731357 - DNA, 22 bp, Homo sapiens
tgcctgcctcaggccgagtgct

SEQ ID NO: 7731358 - DNA, 22 bp, Homo sapiens
tgcctgcctctggagcccatcc

SEQ ID NO: 7731359 - DNA, 22 bp, Homo sapiens
tgcctgccctttccacacagcc

SEQ ID NO: 7731360 - DNA, 22 bp, Homo sapiens
tgcctccaggaggggcagctct

SEQ ID NO: 7731361 - DNA, 22 bp, Homo sapiens
tgcctccatgtttcagcatcta

SEQ ID NO: 7731362 - DNA, 17 bp, Homo sapiens
tgcctccagcagggtga

SEQ ID NO: 7731363 - DNA, 22 bp, Homo sapiens
tgcctccaccattgctcacttt

SEQ ID NO: 7731364 - DNA, 22 bp, Homo sapiens
tgcctccaacagcccatcctag

SEQ ID NO: 7731365 - DNA, 22 bp, Homo sapiens
ccctgcctctgaagctgctcag

SEQ ID NO: 7731366 - DNA, 22 bp, Homo sapiens
ccctgccttgttggagcctatg

SEQ ID NO: 7731367 - DNA, 22 bp, Homo sapiens
ccctgccttggggtccacaccg

SEQ ID NO: 7731368 - DNA, 22 bp, Homo sapiens
tgggagcccaagggagctgccg

SEQ ID NO: 7731369 - DNA, 22 bp, Homo sapiens
tgggccagcaattgctgctcag

SEQ ID NO: 7731370 - DNA, 22 bp, Homo sapiens
cctcttctgcttcaggagcact

SEQ ID NO: 7731371 - DNA, 22 bp, Homo sapiens
cctgcaccacactcactgctca

SEQ ID NO: 7731372 - DNA, 22 bp, Homo sapiens
cctgccaggagctggtgctgca

SEQ ID NO: 7731373 - DNA, 22 bp, Homo sapiens
cctgactctggccaggccagct

SEQ ID NO: 7731374 - DNA, 22 bp, Homo sapiens
cctgaccacccttggacaaggt

SEQ ID NO: 7731375 - DNA, 19 bp, Homo sapiens
cctgaccagactttgcttc

SEQ ID NO: 7731376 - DNA, 22 bp, Homo sapiens
cctgaccatttgccacatgggt

SEQ ID NO: 7731377 - DNA, 22 bp, Homo sapiens
cctgaccagagtgagggcttag

SEQ ID NO: 7731378 - DNA, 22 bp, Homo sapiens
cctgaccagcaggacgggggca

SEQ ID NO: 7731379 - DNA, 21 bp, Homo sapiens
cctgaccattcagcttgtctt

SEQ ID NO: 7731380 - DNA, 22 bp, Homo sapiens
cctgaccaacgtggtgaaaccc

SEQ ID NO: 7731381 - DNA, 21 bp, Homo sapiens
cctgaccaatacttgatcaaa

SEQ ID NO: 7731382 - DNA, 19 bp, Homo sapiens
cctgaccacacaggccttg

SEQ ID NO: 7731383 - DNA, 22 bp, Homo sapiens
cctgaggcttgggagttccgcc

SEQ ID NO: 7731384 - DNA, 22 bp, Homo sapiens
cctgaggcttaatctgtcccaa

SEQ ID NO: 7731385 - DNA, 22 bp, Homo sapiens
cctgaggctcgcgcgcccctgg

SEQ ID NO: 7731386 - DNA, 22 bp, Homo sapiens
cctgaggctccacctccagaga

SEQ ID NO: 7731387 - DNA, 20 bp, Homo sapiens
cctgcctgcctcggctcatt

SEQ ID NO: 7731388 - DNA, 22 bp, Homo sapiens
cctgcctgtccctcagtccaca

SEQ ID NO: 7731389 - DNA, 22 bp, Homo sapiens
cctgcctgtcatcgcctgcgcc

SEQ ID NO: 7731390 - DNA, 22 bp, Homo sapiens
cctgcctgtactagagacccag

SEQ ID NO: 7731391 - DNA, 22 bp, Homo sapiens
cctgccaggctttgggcttctg

SEQ ID NO: 7731392 - DNA, 22 bp, Homo sapiens
cctgccaggcgagtctaggcca

SEQ ID NO: 7731393 - DNA, 22 bp, Homo sapiens
tgtacagttttaactctgaggg

SEQ ID NO: 7731394 - DNA, 22 bp, Homo sapiens
cctggagggcgccgcacagtcc

SEQ ID NO: 7731395 - DNA, 21 bp, Homo sapiens
tttgttcacacacagggcagc

SEQ ID NO: 7731396 - DNA, 22 bp, Homo sapiens
tttgttcaatccagacaatagc

SEQ ID NO: 7731397 - DNA, 22 bp, Homo sapiens
tttgttcaaaaattataagata

SEQ ID NO: 7731398 - DNA, 22 bp, Homo sapiens
ttcagagcttagaatggactac

SEQ ID NO: 7731399 - DNA, 22 bp, Homo sapiens
ttcagagcccaaatggagatta

SEQ ID NO: 7731400 - DNA, 22 bp, Homo sapiens
ttccagggaagagcaaggcagt

SEQ ID NO: 7731401 - DNA, 18 bp, Homo sapiens
tcctgcctgcgggctccc

SEQ ID NO: 7731402 - DNA, 19 bp, Homo sapiens
tcctgcctggggccgcctg

SEQ ID NO: 7731403 - DNA, 18 bp, Homo sapiens
tcctgcctgtgccccagg

SEQ ID NO: 7731404 - DNA, 22 bp, Homo sapiens
ttcctggcgccacggagccggt

SEQ ID NO: 7731405 - DNA, 22 bp, Homo sapiens
ttcctggcctctctctgagcag

SEQ ID NO: 7731406 - DNA, 22 bp, Homo sapiens
ttcctggcattatgggaggctg

SEQ ID NO: 7731407 - DNA, 22 bp, Homo sapiens
ttgtcaggtgggagaacagtca

SEQ ID NO: 7731408 - DNA, 22 bp, Homo sapiens
ttgtcaggcctatgagagatct

SEQ ID NO: 7731409 - DNA, 22 bp, Homo sapiens
ttgtcagggactggaaaagaaa

SEQ ID NO: 7731410 - DNA, 22 bp, Homo sapiens
cacaggagagctgggaggtgcc

SEQ ID NO: 7731411 - DNA, 18 bp, Homo sapiens
cacaggagatgacctgac

SEQ ID NO: 7731412 - DNA, 22 bp, Homo sapiens
cacaggagaggttaatgggggc

SEQ ID NO: 7731413 - DNA, 19 bp, Homo sapiens
cacagctctgctcagggaa

SEQ ID NO: 7731414 - DNA, 22 bp, Homo sapiens
gctggccatagaagccaaagag

SEQ ID NO: 7731415 - DNA, 22 bp, Homo sapiens
gcttccagcaccagcagagggg

SEQ ID NO: 7731416 - DNA, 22 bp, Homo sapiens
ggctgggacgatgaggattagt

SEQ ID NO: 7731417 - DNA, 22 bp, Homo sapiens
ggctgggagccccacagagtca

SEQ ID NO: 7731418 - DNA, 23 bp, Homo sapiens
ggctgggagctccgggtgcacgt

SEQ ID NO: 7731419 - DNA, 22 bp, Homo sapiens
ggctgggagctggacaggccgg

SEQ ID NO: 7731420 - DNA, 22 bp, Homo sapiens
cactgcctccccaggctccaca

SEQ ID NO: 7731421 - DNA, 22 bp, Homo sapiens
cactgcctctgcctcctgggtt

SEQ ID NO: 7731422 - DNA, 22 bp, Homo sapiens
cacccaggacaaaatatggaat

SEQ ID NO: 7731423 - DNA, 22 bp, Homo sapiens
cacccaggcaaggattctgcaa

SEQ ID NO: 7731424 - DNA, 22 bp, Homo sapiens
cacccaggcaggtggctgagaa

SEQ ID NO: 7731425 - DNA, 22 bp, Homo sapiens
ggcccagaggggttgagcatct

SEQ ID NO: 7731426 - DNA, 22 bp, Homo sapiens
ggcccagaagccagaagcctcc

SEQ ID NO: 7731427 - DNA, 22 bp, Homo sapiens
ggcccagagctccctggcacct

SEQ ID NO: 7731428 - DNA, 22 bp, Homo sapiens
cagctcccagagtgaccagcag

SEQ ID NO: 7731429 - DNA, 22 bp, Homo sapiens
gtgcctggtttggggaatgttc

SEQ ID NO: 7731430 - DNA, 22 bp, Homo sapiens
gtgcctggtatgtaggtagcgg

SEQ ID NO: 7731431 - DNA, 22 bp, Homo sapiens
gtgcctggggttgagctatgaa

SEQ ID NO: 7731432 - DNA, 22 bp, Homo sapiens
gtgcctggtttggggagtgttc

SEQ ID NO: 7731433 - DNA, 22 bp, Homo sapiens
gtgcctgggggtaatgtaggat

SEQ ID NO: 7731434 - DNA, 22 bp, Homo sapiens
gtgcctgggacttgctccggat

SEQ ID NO: 7731435 - DNA, 22 bp, Homo sapiens
gtgcctgggcatgagcttgttg

SEQ ID NO: 7731436 - DNA, 20 bp, Homo sapiens
cagcctccactcactcagct

SEQ ID NO: 7731437 - DNA, 22 bp, Homo sapiens
gggctcaggcctggcctctcac

SEQ ID NO: 7731438 - DNA, 22 bp, Homo sapiens
ggtgcagcctccccagtgacag

SEQ ID NO: 7731439 - DNA, 22 bp, Homo sapiens
cagcactgctgctgtacacaca

SEQ ID NO: 7731440 - DNA, 22 bp, Homo sapiens
ggtgtctggacagtgagccagg

SEQ ID NO: 7731441 - DNA, 22 bp, Homo sapiens
ggtgtctgttgcctcctggtta

SEQ ID NO: 7731442 - DNA, 22 bp, Homo sapiens
atgcctcctgtgccactgtgat

SEQ ID NO: 7731443 - DNA, 22 bp, Homo sapiens
cttgaggctgcactccagggcc

SEQ ID NO: 7731444 - DNA, 22 bp, Homo sapiens
gaagaaacaggggcttggggag

SEQ ID NO: 7731445 - DNA, 22 bp, Homo sapiens
gctcaggggaatgggctgccgt

SEQ ID NO: 7731446 - DNA, 22 bp, Homo sapiens
gcctggctcgggcactcgccag

SEQ ID NO: 7731447 - DNA, 23 bp, Homo sapiens
gctcaggcatcattcttcctggc

SEQ ID NO: 7731448 - DNA, 22 bp, Homo sapiens
gcctgcctagaattgcagcttt

SEQ ID NO: 7731449 - DNA, 19 bp, Homo sapiens
gccctcctcactgagctct

SEQ ID NO: 7731450 - DNA, 22 bp, Homo sapiens
gcagaggctctttaatgcttag

SEQ ID NO: 7731451 - DNA, 22 bp, Homo sapiens
gcagaggctgggtgtcccagtc

SEQ ID NO: 7731452 - DNA, 22 bp, Homo sapiens
gcagcctgttgtaccagcctgt

SEQ ID NO: 7731453 - DNA, 19 bp, Homo sapiens
gcagccaggtgctctacct

SEQ ID NO: 7731454 - DNA, 22 bp, Homo sapiens
attgttcagagaagggaagaat

SEQ ID NO: 7731455 - DNA, 20 bp, Homo sapiens
gccacagttttctcactgca

SEQ ID NO: 7731456 - DNA, 22 bp, Homo sapiens
gcaggagcaatggcctatcaga

SEQ ID NO: 7731457 - DNA, 22 bp, Homo sapiens
gcaggagcaaactgcagtgtgg

SEQ ID NO: 7731458 - DNA, 22 bp, Homo sapiens
ctgctgtgggcagggtagctgg

SEQ ID NO: 7731459 - DNA, 22 bp, Homo sapiens
ctgctgcccagtgtgcattggg

SEQ ID NO: 7731460 - DNA, 22 bp, Homo sapiens
ctgcctggtctcaggcatgggg

SEQ ID NO: 7731461 - DNA, 22 bp, Homo sapiens
ctgcctggaaggagcaagggga

SEQ ID NO: 7731462 - DNA, 22 bp, Homo sapiens
ctgcctgggttcaagtcctgtt

SEQ ID NO: 7731463 - DNA, 22 bp, Homo sapiens
ctgcctgtgccaatgctccttt

SEQ ID NO: 7731464 - DNA, 20 bp, Homo sapiens
ctggccagaacgcctacaca

SEQ ID NO: 7731465 - DNA, 22 bp, Homo sapiens
ctggccactggaggtggcaccc

SEQ ID NO: 7731466 - DNA, 22 bp, Homo sapiens
ctggccagaggttcctctgccc

SEQ ID NO: 7731467 - DNA, 22 bp, Homo sapiens
agtaaaaattgaggtgcaaaat

SEQ ID NO: 7731468 - DNA, 22 bp, Homo sapiens
ccttccaggttttggctccatt

SEQ ID NO: 7731469 - DNA, 22 bp, Homo sapiens
ccttccaggtgcaggcaagcct

SEQ ID NO: 7731470 - DNA, 22 bp, Homo sapiens
ctaggcagactgagctctaggg

SEQ ID NO: 7731471 - DNA, 22 bp, Homo sapiens
agtcctgggtctggagaatgga

SEQ ID NO: 7731472 - DNA, 22 bp, Homo sapiens
aggtcagacacagtgctgggtg

SEQ ID NO: 7731473 - DNA, 22 bp, Homo sapiens
ccttccagggagcaggcagtgt

SEQ ID NO: 7731474 - DNA, 22 bp, Homo sapiens
ccttccaggagtctctgcaggt

SEQ ID NO: 7731475 - DNA, 22 bp, Homo sapiens
ccttccagagttcagtctgccc

SEQ ID NO: 7731476 - DNA, 22 bp, Homo sapiens
cctgggtatagaagagccgctg

SEQ ID NO: 7731477 - DNA, 22 bp, Homo sapiens
cctggggctctgcacagagcag

SEQ ID NO: 7731478 - DNA, 22 bp, Homo sapiens
agtgtcctcctctgggagccag

SEQ ID NO: 7731479 - DNA, 22 bp, Homo sapiens
cccatgggttttcctccctgcc

SEQ ID NO: 7731480 - DNA, 22 bp, Homo sapiens
ccctcccagatgggcttgaggt

SEQ ID NO: 7731481 - DNA, 23 bp, Homo sapiens
cccaggagcctgagtcctctctg

SEQ ID NO: 7731482 - DNA, 18 bp, Homo sapiens
cccaggctttgtgggtct

SEQ ID NO: 7731483 - DNA, 22 bp, Homo sapiens
cccaggctggaattccaggcct

SEQ ID NO: 7731484 - DNA, 22 bp, Homo sapiens
cccaggctgatgggatgggcca

SEQ ID NO: 7731485 - DNA, 22 bp, Homo sapiens
cccaggaggtcgaagctgcagt

SEQ ID NO: 7731486 - DNA, 22 bp, Homo sapiens
agggcctggaactgtgggcagg

SEQ ID NO: 7731487 - DNA, 22 bp, Homo sapiens
agggcctgctctatcactctca

SEQ ID NO: 7731488 - DNA, 22 bp, Homo sapiens
agggctggcatctctaatgctg

SEQ ID NO: 7731489 - DNA, 22 bp, Homo sapiens
agggctggcaagggattgaaat

SEQ ID NO: 7731490 - DNA, 22 bp, Homo sapiens
agggctggagggtactagttta

SEQ ID NO: 7731491 - DNA, 22 bp, Homo sapiens
agggctggagccacagctggga

SEQ ID NO: 7731492 - DNA, 22 bp, Homo sapiens
cctcaggccagggggcggccag

SEQ ID NO: 7731493 - DNA, 22 bp, Homo sapiens
cctcaggccctgtccctgcgcc

SEQ ID NO: 7731494 - DNA, 22 bp, Homo sapiens
agggcgacaatggagagcgttt

SEQ ID NO: 7731495 - DNA, 22 bp, Homo sapiens
agggctggctccgttaccttga

SEQ ID NO: 7731496 - DNA, 22 bp, Homo sapiens
agggctggctaggtgcgttccc

SEQ ID NO: 7731497 - DNA, 22 bp, Homo sapiens
agggctggccacatgatttggt

SEQ ID NO: 7731498 - DNA, 22 bp, Homo sapiens
aggctgggaaggtaaagttgta

SEQ ID NO: 7731499 - DNA, 20 bp, Homo sapiens
aggctggggtgttttgccca

SEQ ID NO: 7731500 - DNA, 22 bp, Homo sapiens
aggctgggtacctgtcatatgc

SEQ ID NO: 7731501 - DNA, 22 bp, Homo sapiens
aggctgggcaccgttttgatcc

SEQ ID NO: 7731502 - DNA, 22 bp, Homo sapiens
aggctgggctccgcccaactcc

SEQ ID NO: 7731503 - DNA, 22 bp, Homo sapiens
aggctggggaattgaatttgct

SEQ ID NO: 7731504 - DNA, 22 bp, Homo sapiens
ccagggctggaccagtgcttgg

SEQ ID NO: 7731505 - DNA, 22 bp, Homo sapiens
ccagggctccattgctcatcct

SEQ ID NO: 7731506 - DNA, 22 bp, Homo sapiens
ccagggcaggagaaagactcac

SEQ ID NO: 7731507 - DNA, 22 bp, Homo sapiens
ccagggcctgagggcgacgccc

SEQ ID NO: 7731508 - DNA, 22 bp, Homo sapiens
ccagggcctgccacttagcaag

SEQ ID NO: 7731509 - DNA, 22 bp, Homo sapiens
ccagaccctccattcaagctcc

SEQ ID NO: 7731510 - DNA, 22 bp, Homo sapiens
ccagaccctgctctggggctct

SEQ ID NO: 7731511 - DNA, 22 bp, Homo sapiens
ccagaccctttcttggcatgtg

SEQ ID NO: 7731512 - DNA, 22 bp, Homo sapiens
ccagagctgagggagcctgagc

SEQ ID NO: 7731513 - DNA, 20 bp, Homo sapiens
ccagagctgatggctgcccg

SEQ ID NO: 7731514 - DNA, 22 bp, Homo sapiens
ccagagcctggcatctgcataa

SEQ ID NO: 7731515 - DNA, 17 bp, Homo sapiens
aggcctctgccggtgcc

SEQ ID NO: 7731516 - DNA, 22 bp, Homo sapiens
aggcctctggaggtggcagtgt

SEQ ID NO: 7731517 - DNA, 22 bp, Homo sapiens
aggcctgtaatcccagcacttt

SEQ ID NO: 7731518 - DNA, 22 bp, Homo sapiens
aggcctgtctgaggtccccact

SEQ ID NO: 7731519 - DNA, 22 bp, Homo sapiens
cagggttgcatgcatctgtggg

SEQ ID NO: 7731520 - DNA, 22 bp, Homo sapiens
cagggttgattccttctgaggg

SEQ ID NO: 7731521 - DNA, 22 bp, Homo sapiens
cagggttgatgaattgtctgta

SEQ ID NO: 7731522 - DNA, 22 bp, Homo sapiens
caggtcctggcatcaggcaggt

SEQ ID NO: 7731523 - DNA, 23 bp, Homo sapiens
agctgggccaggtggtcagacct

SEQ ID NO: 7731524 - DNA, 22 bp, Homo sapiens
agctgggcagactgcagtggtt

SEQ ID NO: 7731525 - DNA, 22 bp, Homo sapiens
agctgcctgccatgccgctggt

SEQ ID NO: 7731526 - DNA, 22 bp, Homo sapiens
aggagccacctaggagctgttt

SEQ ID NO: 7731527 - DNA, 22 bp, Homo sapiens
aggagccaaattactagctctg

SEQ ID NO: 7731528 - DNA, 22 bp, Homo sapiens
actctcttgggggagagcagag

SEQ ID NO: 7731529 - DNA, 22 bp, Homo sapiens
actctgcctttcagcagatgaa

SEQ ID NO: 7731530 - DNA, 21 bp, Homo sapiens
actctgccagtctcctgcact

SEQ ID NO: 7731531 - DNA, 22 bp, Homo sapiens
actgcctgccttccaggtactg

SEQ ID NO: 7731532 - DNA, 22 bp, Homo sapiens
actgcctggcctggcctcactg

SEQ ID NO: 7731533 - DNA, 22 bp, Homo sapiens
actgcctgagctattggaaaag

SEQ ID NO: 7731534 - DNA, 20 bp, Homo sapiens
aggagccattgactgcagca

SEQ ID NO: 7731535 - DNA, 22 bp, Homo sapiens
aggaaggcttctttggtcttct

SEQ ID NO: 7731536 - DNA, 22 bp, Homo sapiens
agctgggatgaggagcatcctt

SEQ ID NO: 7731537 - DNA, 22 bp, Homo sapiens
agctgggaggctcctctgtgac

SEQ ID NO: 7731538 - DNA, 22 bp, Homo sapiens
agctgggaggtgggcagtgaga

SEQ ID NO: 7731539 - DNA, 22 bp, Homo sapiens
agctgggagcagagccacagcc

SEQ ID NO: 7731540 - DNA, 22 bp, Homo sapiens
agctgggagctgaaggctgatt

SEQ ID NO: 7731541 - DNA, 22 bp, Homo sapiens
agctgggatgataacctcagtc

SEQ ID NO: 7731542 - DNA, 22 bp, Homo sapiens
aggctccacggtcactggctct

SEQ ID NO: 7731543 - DNA, 22 bp, Homo sapiens
aggctccagcagccagaggaag

SEQ ID NO: 7731544 - DNA, 22 bp, Homo sapiens
aggctccagcccaaggctgcag

SEQ ID NO: 7731545 - DNA, 22 bp, Homo sapiens
aggcttcccaagcagctgcaaa

SEQ ID NO: 7731546 - DNA, 19 bp, Homo sapiens
accaggagacagtgagctt

SEQ ID NO: 7731547 - DNA, 22 bp, Homo sapiens
agggcctcgggctcagtgggtc

SEQ ID NO: 7731548 - DNA, 22 bp, Homo sapiens
agggcctcgaaggcagagggat

SEQ ID NO: 7731549 - DNA, 22 bp, Homo sapiens
accaggagtctagcctagtcaa

SEQ ID NO: 7731550 - DNA, 19 bp, Homo sapiens
accaggagtatcagagctg

SEQ ID NO: 7731551 - DNA, 22 bp, Homo sapiens
acccatgtttatttgtgtggtt

SEQ ID NO: 7731552 - DNA, 22 bp, Homo sapiens
agggcctgacacccttgccagc

SEQ ID NO: 7731553 - DNA, 22 bp, Homo sapiens
agggcctctggaacactgaggg

SEQ ID NO: 7731554 - DNA, 22 bp, Homo sapiens
agggcctgagctctcctccagt

SEQ ID NO: 7731555 - DNA, 22 bp, Homo sapiens
acccagggttcctgggtcccag

SEQ ID NO: 7731556 - DNA, 22 bp, Homo sapiens
agaggctccttcactctggcac

SEQ ID NO: 7731557 - DNA, 22 bp, Homo sapiens
atctgcctggctccaggtgagc

SEQ ID NO: 7731558 - DNA, 23 bp, Homo sapiens
agagcctgaaagacttctggcac

SEQ ID NO: 7731559 - DNA, 22 bp, Homo sapiens
agagcctgagcctgaaagccct

SEQ ID NO: 7731560 - DNA, 22 bp, Homo sapiens
agagcctgagcctgatcttgaa

SEQ ID NO: 7731561 - DNA, 22 bp, Homo sapiens
agagcctgaggccctgagaggg

SEQ ID NO: 7731562 - DNA, 22 bp, Homo sapiens
agagcctgcagctgtgaagaaa

SEQ ID NO: 7731563 - DNA, 22 bp, Homo sapiens
agagccaggccaggccggggca

SEQ ID NO: 7731564 - DNA, 22 bp, Homo sapiens
agcagggcaaagtcaggctaac

SEQ ID NO: 7731565 - DNA, 19 bp, Homo sapiens
agcagctggaggtggagtg

SEQ ID NO: 7731566 - DNA, 17 bp, Homo sapiens
agcagctggcacaggag

SEQ ID NO: 7731567 - DNA, 23 bp, Homo sapiens
agcagccctgggacctggcctgc

SEQ ID NO: 7731568 - DNA, 21 bp, Homo sapiens
agcctgggaggcggaggttgc

SEQ ID NO: 7731569 - DNA, 22 bp, Homo sapiens
agcctgggagacactaagttgt

SEQ ID NO: 7731570 - DNA, 22 bp, Homo sapiens
agcctgggaatttagagttcgg

SEQ ID NO: 7731571 - DNA, 22 bp, Homo sapiens
agcctgggcaacagagcaaaac

SEQ ID NO: 7731572 - DNA, 22 bp, Homo sapiens
agcctgggcaactccattcact

SEQ ID NO: 7731573 - DNA, 22 bp, Homo sapiens
agcctgggcaacaacacagcga

SEQ ID NO: 7731574 - DNA, 17 bp, Homo sapiens
agcctgggaaggagtga

SEQ ID NO: 7731575 - DNA, 22 bp, Homo sapiens
agcctggggcacttctccaaac

SEQ ID NO: 7731576 - DNA, 22 bp, Homo sapiens
agcctggggtttcagtttgcac

SEQ ID NO: 7731577 - DNA, 22 bp, Homo sapiens
agcctgggccctgcctcttctc

SEQ ID NO: 7731578 - DNA, 18 bp, Homo sapiens
agcctgggctctgcctgg

SEQ ID NO: 7731579 - DNA, 22 bp, Homo sapiens
agcctgggcctggcttcccgcc

SEQ ID NO: 7731580 - DNA, 22 bp, Homo sapiens
agcctgggtttttattaaggag

SEQ ID NO: 7731581 - DNA, 22 bp, Homo sapiens
agcctgggttagggttcttccc

SEQ ID NO: 7731582 - DNA, 22 bp, Homo sapiens
agctaggacaggtagagatggg

SEQ ID NO: 7731583 - DNA, 22 bp, Homo sapiens
agccctgggcgttactgggatg

SEQ ID NO: 7731584 - DNA, 22 bp, Homo sapiens
agccctggagcaaaggtgtctt

SEQ ID NO: 7731585 - DNA, 22 bp, Homo sapiens
agccaggccagactcacaccct

SEQ ID NO: 7731586 - DNA, 22 bp, Homo sapiens
cagagaccctaggcaggtgaca

SEQ ID NO: 7731587 - DNA, 22 bp, Homo sapiens
cagagacccctggcatggtggt

SEQ ID NO: 7731588 - DNA, 20 bp, Homo sapiens
cagagaccaggccaggtgtc

SEQ ID NO: 7731589 - DNA, 22 bp, Homo sapiens
cagagaactccagtggctggcg

SEQ ID NO: 7731590 - DNA, 22 bp, Homo sapiens
agccaggccttttctcaaggtt

SEQ ID NO: 7731591 - DNA, 22 bp, Homo sapiens
agccaggccagctgtcttgagt

SEQ ID NO: 7731592 - DNA, 22 bp, Homo sapiens
agccaggccttagggagaggca

SEQ ID NO: 7731593 - DNA, 20 bp, Homo sapiens
agccaggcctcaagttaagt

SEQ ID NO: 7731594 - DNA, 22 bp, Homo sapiens
cagagctcagagctgccaggca

SEQ ID NO: 7731595 - DNA, 22 bp, Homo sapiens
aagaggttgtctgtgatgagtt

SEQ ID NO: 7731596 - DNA, 22 bp, Homo sapiens
acagagcttaggatgactccca

SEQ ID NO: 7731597 - DNA, 22 bp, Homo sapiens
aagagccgctccggccagggag

SEQ ID NO: 7731598 - DNA, 20 bp, Homo sapiens
acctgggattagatacccaa

SEQ ID NO: 7731599 - DNA, 22 bp, Homo sapiens
acctgggaaagccgtggaaagg

SEQ ID NO: 7731600 - DNA, 22 bp, Homo sapiens
acctgggaaaaggagtggccat

SEQ ID NO: 7731601 - DNA, 22 bp, Homo sapiens
acctgggaagatctttgaagct

SEQ ID NO: 7731602 - DNA, 22 bp, Homo sapiens
acctgggaacgctttgtggagg

SEQ ID NO: 7731603 - DNA, 20 bp, Homo sapiens
acctgggaaaaccttttcct

SEQ ID NO: 7731604 - DNA, 22 bp, Homo sapiens
acctgggagagaggagccggcg

SEQ ID NO: 7731605 - DNA, 22 bp, Homo sapiens
acctgggaggcagaggttgcag

SEQ ID NO: 7731606 - DNA, 22 bp, Homo sapiens
acctgggaggcggaggttgcag

SEQ ID NO: 7731607 - DNA, 22 bp, Homo sapiens
acctgggagtatgcagtggtga

SEQ ID NO: 7731608 - DNA, 22 bp, Homo sapiens
acctgggagtcacacctgagaa

SEQ ID NO: 7731609 - DNA, 22 bp, Homo sapiens
acctgggatggggccaggttta

SEQ ID NO: 7731610 - DNA, 22 bp, Homo sapiens
actgaccagatctttgagctta

SEQ ID NO: 7731611 - DNA, 22 bp, Homo sapiens
actgaccagatatgtcatacct

SEQ ID NO: 7731612 - DNA, 21 bp, Homo sapiens
actgaccacttctgcctgtct

SEQ ID NO: 7731613 - DNA, 22 bp, Homo sapiens
accacccagccagcttctccct

SEQ ID NO: 7731614 - DNA, 22 bp, Homo sapiens
accacagtttagtccaatgaca

SEQ ID NO: 7731615 - DNA, 22 bp, Homo sapiens
acagtgtcatcagtttctcaac

SEQ ID NO: 7731616 - DNA, 22 bp, Homo sapiens
acaggtgattcaggctctggga

SEQ ID NO: 7731617 - DNA, 22 bp, Homo sapiens
acaggagcaacagactaagaca

SEQ ID NO: 7731618 - DNA, 20 bp, Homo sapiens
acaggagatctgaggaaagg

SEQ ID NO: 7731619 - DNA, 22 bp, Homo sapiens
acaggagctctagggacagcac

SEQ ID NO: 7731620 - DNA, 22 bp, Homo sapiens
acaggaggagcagctgtgtgcc

SEQ ID NO: 7731621 - DNA, 23 bp, Homo sapiens
agaggccaacttcttgcccctcc

SEQ ID NO: 7731622 - DNA, 22 bp, Homo sapiens
agacactggcactggggaagcc

SEQ ID NO: 7731623 - DNA, 22 bp, Homo sapiens
agactgagactggggaaagaca

SEQ ID NO: 7731624 - DNA, 22 bp, Homo sapiens
agagatcccttctgcctgggga

SEQ ID NO: 7731625 - DNA, 18 bp, Homo sapiens
acagaactcaggggcacc

SEQ ID NO: 7731626 - DNA, 18 bp, Homo sapiens
acagaactgagatttgag

SEQ ID NO: 7731627 - DNA, 20 bp, Homo sapiens
acagaactgagaacagtctc

SEQ ID NO: 7731628 - DNA, 22 bp, Homo sapiens
acagaactgcagacagtgccaa

SEQ ID NO: 7731629 - DNA, 22 bp, Homo sapiens
agccaggctactccttgctgac

SEQ ID NO: 7731630 - DNA, 20 bp, Homo sapiens
agccaggctcaagctccccc

SEQ ID NO: 7731631 - DNA, 22 bp, Homo sapiens
agccaggctaaatgagccatga

SEQ ID NO: 7731632 - DNA, 22 bp, Homo sapiens
agccaggcgggtctttgctcct

SEQ ID NO: 7731633 - DNA, 22 bp, Homo sapiens
agccaggcgcagtggcttatgc

SEQ ID NO: 7731634 - DNA, 22 bp, Homo sapiens
agcctggctgggaagagcctct

SEQ ID NO: 7731635 - DNA, 22 bp, Homo sapiens
agcctgtgacattgactatgaa

SEQ ID NO: 7731636 - DNA, 22 bp, Homo sapiens
agctcaggccggagctacaggc

SEQ ID NO: 7731637 - DNA, 22 bp, Homo sapiens
agctcagggccatcggcccttt

SEQ ID NO: 7731638 - DNA, 22 bp, Homo sapiens
agctcaggctctgcagggacta

SEQ ID NO: 7731639 - DNA, 22 bp, Homo sapiens
agctcaggtcattccagggatg

SEQ ID NO: 7731640 - DNA, 22 bp, Homo sapiens
agctcagggctccaggaccgct

SEQ ID NO: 7731641 - DNA, 22 bp, Homo sapiens
acacacagaaggaagccccact

SEQ ID NO: 7731642 - DNA, 23 bp, Homo sapiens
agcagccagagatcctcggccct

SEQ ID NO: 7731643 - DNA, 22 bp, Homo sapiens
acacagaacctcatagcctctc

SEQ ID NO: 7731644 - DNA, 22 bp, Homo sapiens
agcagctgagccccagctgtga

SEQ ID NO: 7731645 - DNA, 22 bp, Homo sapiens
agcagctgaccagtgagtcctg

SEQ ID NO: 7731646 - DNA, 22 bp, Homo sapiens
agcagggcttctgtgcctgtgc

SEQ ID NO: 7731647 - DNA, 22 bp, Homo sapiens
agcagggctgtgctccttccga

SEQ ID NO: 7731648 - DNA, 22 bp, Homo sapiens
agcagggcctctggcactggtc

SEQ ID NO: 7731649 - DNA, 22 bp, Homo sapiens
agcagggctttgtctctgtgaa

SEQ ID NO: 7731650 - DNA, 22 bp, Homo sapiens
tcaggagctatggactgtcaaa

SEQ ID NO: 7731651 - DNA, 22 bp, Homo sapiens
tcaggagcctgaaagaggtcta

SEQ ID NO: 7731652 - DNA, 22 bp, Homo sapiens
tcaggagcatatattgatgtct

SEQ ID NO: 7731653 - DNA, 22 bp, Homo sapiens
tcaggagcaggttgtttggttt

SEQ ID NO: 7731654 - DNA, 20 bp, Homo sapiens
tcaggagcctaggacatgat

SEQ ID NO: 7731655 - DNA, 22 bp, Homo sapiens
tcaggagcagggggaagctctg

SEQ ID NO: 7731656 - DNA, 19 bp, Homo sapiens
tcaggagcagcttctgaac

SEQ ID NO: 7731657 - DNA, 22 bp, Homo sapiens
tcaggagctcttccctggtgtg

SEQ ID NO: 7731658 - DNA, 22 bp, Homo sapiens
tcaggagctcaggctgatggaa

SEQ ID NO: 7731659 - DNA, 22 bp, Homo sapiens
tcaggagctgcactgggcccac

SEQ ID NO: 7731660 - DNA, 22 bp, Homo sapiens
tcaggagcttagatgctttgac

SEQ ID NO: 7731661 - DNA, 22 bp, Homo sapiens
tcaggagcttggtagtgtgatt

SEQ ID NO: 7731662 - DNA, 22 bp, Homo sapiens
tcaggagcagccttggagagcg

SEQ ID NO: 7731663 - DNA, 22 bp, Homo sapiens
tcaggagcagctgtaggaaggg

SEQ ID NO: 7731664 - DNA, 22 bp, Homo sapiens
tcaggagcagcatgggtgagag

SEQ ID NO: 7731665 - DNA, 22 bp, Homo sapiens
tcaggcctttcttcagagcttc

SEQ ID NO: 7731666 - DNA, 22 bp, Homo sapiens
tcagggcacaggcctgtgggtt

SEQ ID NO: 7731667 - DNA, 22 bp, Homo sapiens
tcagggcagcctaaggcacctc

SEQ ID NO: 7731668 - DNA, 22 bp, Homo sapiens
tccagcccgggggcaggtgacc

SEQ ID NO: 7731669 - DNA, 22 bp, Homo sapiens
tccagccctcagccaagtggaa

SEQ ID NO: 7731670 - DNA, 22 bp, Homo sapiens
tccaggagctcatccacgtcaa

SEQ ID NO: 7731671 - DNA, 21 bp, Homo sapiens
tccaggccatggtggggaggc

SEQ ID NO: 7731672 - DNA, 22 bp, Homo sapiens
tccaggcccagacggggtgagg

SEQ ID NO: 7731673 - DNA, 22 bp, Homo sapiens
tccaggcccactcggtggggct

SEQ ID NO: 7731674 - DNA, 21 bp, Homo sapiens
tccaggcctcaggaagggatg

SEQ ID NO: 7731675 - DNA, 22 bp, Homo sapiens
tccaggccgcaggggcagcccc

SEQ ID NO: 7731676 - DNA, 22 bp, Homo sapiens
tccaggccctgggatgggagca

SEQ ID NO: 7731677 - DNA, 22 bp, Homo sapiens
tcccttcatcagtgagcaagcc

SEQ ID NO: 7731678 - DNA, 22 bp, Homo sapiens
tcctccctaaatcctagactgt

SEQ ID NO: 7731679 - DNA, 22 bp, Homo sapiens
gtgtgtccttgggcctctgcag

SEQ ID NO: 7731680 - DNA, 22 bp, Homo sapiens
gtgtgtgtatctgcctatcaca

SEQ ID NO: 7731681 - DNA, 22 bp, Homo sapiens
gttccaggtggtcacagagctc

SEQ ID NO: 7731682 - DNA, 22 bp, Homo sapiens
tacaggagagatttagtaatca

SEQ ID NO: 7731683 - DNA, 17 bp, Homo sapiens
tacaggagagcaggaac

SEQ ID NO: 7731684 - DNA, 23 bp, Homo sapiens
tagccaggcccagcatggacacc

SEQ ID NO: 7731685 - DNA, 22 bp, Homo sapiens
tagccaggcaattatgggtgat

SEQ ID NO: 7731686 - DNA, 21 bp, Homo sapiens
taggacagcccccctgccctc

SEQ ID NO: 7731687 - DNA, 18 bp, Homo sapiens
taggttacagccagccag

SEQ ID NO: 7731688 - DNA, 23 bp, Homo sapiens
gtcagggctggggtcagagtgac

SEQ ID NO: 7731689 - DNA, 23 bp, Homo sapiens
gtcagggcagctcccagcccaac

SEQ ID NO: 7731690 - DNA, 22 bp, Homo sapiens
gtgcctccctgttgactagggt

SEQ ID NO: 7731691 - DNA, 22 bp, Homo sapiens
gtgcctccaggctcgactagtc

SEQ ID NO: 7731692 - DNA, 22 bp, Homo sapiens
gtgctgggccctgagaccaggg

SEQ ID NO: 7731693 - DNA, 22 bp, Homo sapiens
gggtccagagcctcagcccaga

SEQ ID NO: 7731694 - DNA, 21 bp, Homo sapiens
ggtcagggggtgcctccaggt

SEQ ID NO: 7731695 - DNA, 22 bp, Homo sapiens
ggtcaggggctgctctacagag

SEQ ID NO: 7731696 - DNA, 22 bp, Homo sapiens
ggtcagggctcttccagtggct

SEQ ID NO: 7731697 - DNA, 22 bp, Homo sapiens
gggcctccggggtgagctgtgg

SEQ ID NO: 7731698 - DNA, 22 bp, Homo sapiens
gggcctccgtgtgctggtgctc

SEQ ID NO: 7731699 - DNA, 22 bp, Homo sapiens
gggctgggaatggctaagtatg

SEQ ID NO: 7731700 - DNA, 22 bp, Homo sapiens
gggctgggatggcttgaagatt

SEQ ID NO: 7731701 - DNA, 22 bp, Homo sapiens
gggctgggcatggtgttccctc

SEQ ID NO: 7731702 - DNA, 22 bp, Homo sapiens
gggctgggattgcttgctgtga

SEQ ID NO: 7731703 - DNA, 22 bp, Homo sapiens
gggctggggctcaataatttgt

SEQ ID NO: 7731704 - DNA, 22 bp, Homo sapiens
ggggcagaagtagtgcccctga

SEQ ID NO: 7731705 - DNA, 22 bp, Homo sapiens
ggctgagggtatagctgtccca

SEQ ID NO: 7731706 - DNA, 22 bp, Homo sapiens
ggctggagacaacgtcctgccc

SEQ ID NO: 7731707 - DNA, 22 bp, Homo sapiens
ggctgtgcctctggcagcacat

SEQ ID NO: 7731708 - DNA, 22 bp, Homo sapiens
gggagctggagctggaagactc

SEQ ID NO: 7731709 - DNA, 22 bp, Homo sapiens
ggagatggccacgtcactcagt

SEQ ID NO: 7731710 - DNA, 22 bp, Homo sapiens
ggccaggagcaagccaggctct

SEQ ID NO: 7731711 - DNA, 22 bp, Homo sapiens
ggccaggcgatgacccctccac

SEQ ID NO: 7731712 - DNA, 22 bp, Homo sapiens
ggccaggccaagagggttggaa

SEQ ID NO: 7731713 - DNA, 22 bp, Homo sapiens
ggcctcagaccggagctggcca

SEQ ID NO: 7731714 - DNA, 22 bp, Homo sapiens
ggcctggctcttgcccagcctg

SEQ ID NO: 7731715 - DNA, 22 bp, Homo sapiens
ggcctggctggttcagtaccct

SEQ ID NO: 7731716 - DNA, 19 bp, Homo sapiens
ggcctggctatccctgctg

SEQ ID NO: 7731717 - DNA, 22 bp, Homo sapiens
ggcctggcctcccttcctagcg

SEQ ID NO: 7731718 - DNA, 22 bp, Homo sapiens
ggcctggcagagcgcgcggctg

SEQ ID NO: 7731719 - DNA, 23 bp, Homo sapiens
ggcctggcccagggccctgatga

SEQ ID NO: 7731720 - DNA, 22 bp, Homo sapiens
gctgggaagagatgcacatgat

SEQ ID NO: 7731721 - DNA, 22 bp, Homo sapiens
gctgggacaggcttggccctgt

SEQ ID NO: 7731722 - DNA, 22 bp, Homo sapiens
gctgggactgagacagtgacct

SEQ ID NO: 7731723 - DNA, 22 bp, Homo sapiens
gctgccatggtccaggctccag

SEQ ID NO: 7731724 - DNA, 22 bp, Homo sapiens
gctgtgagaaacagggagtgtc

SEQ ID NO: 7731725 - DNA, 19 bp, Homo sapiens
gctgtgaaagcagccatat

SEQ ID NO: 7731726 - DNA, 22 bp, Homo sapiens
gctgtgcagccaagtgcctctg

SEQ ID NO: 7731727 - DNA, 22 bp, Homo sapiens
gctgtgcaggtccccactgcct

SEQ ID NO: 7731728 - DNA, 22 bp, Homo sapiens
gctctccactgaccacggggca

SEQ ID NO: 7731729 - DNA, 21 bp, Homo sapiens
gctctccagggccagcccagg

SEQ ID NO: 7731730 - DNA, 22 bp, Homo sapiens
gctcaggcctggcccatgggac

SEQ ID NO: 7731731 - DNA, 22 bp, Homo sapiens
gctcaggcctccagaggggcaa

SEQ ID NO: 7731732 - DNA, 22 bp, Homo sapiens
gctgccagctgcggcccacgcg

SEQ ID NO: 7731733 - DNA, 22 bp, Homo sapiens
gctgccaggccctggggctatg

SEQ ID NO: 7731734 - DNA, 22 bp, Homo sapiens
gccttccacctaggcctctgct

SEQ ID NO: 7731735 - DNA, 22 bp, Homo sapiens
gcctggctgcttagcctacttc

SEQ ID NO: 7731736 - DNA, 22 bp, Homo sapiens
gcctcagggataggatgagcat

SEQ ID NO: 7731737 - DNA, 22 bp, Homo sapiens
gcctcaggccgccctgctgctc

SEQ ID NO: 7731738 - DNA, 22 bp, Homo sapiens
gcctggggaacttgatcctgtc

SEQ ID NO: 7731739 - DNA, 23 bp, Homo sapiens
gcctggcttccaaggtaggggag

SEQ ID NO: 7731740 - DNA, 22 bp, Homo sapiens
gcctggctggtagagggggctc

SEQ ID NO: 7731741 - DNA, 22 bp, Homo sapiens
gccttcaggtgctgccaggcta

SEQ ID NO: 7731742 - DNA, 22 bp, Homo sapiens
gcctggtgtccagaggcgagtg

SEQ ID NO: 7731743 - DNA, 22 bp, Homo sapiens
gcctggggtctctgactcacag

SEQ ID NO: 7731744 - DNA, 22 bp, Homo sapiens
gcagggctcagccgctcccacc

SEQ ID NO: 7731745 - DNA, 22 bp, Homo sapiens
gcagggctctgctgtagtccta

SEQ ID NO: 7731746 - DNA, 22 bp, Homo sapiens
gcagggctccccaggcccgagg

SEQ ID NO: 7731747 - DNA, 22 bp, Homo sapiens
gccagagcatcgcaccctccat

SEQ ID NO: 7731748 - DNA, 22 bp, Homo sapiens
gccagagcagaatagagtggcc

SEQ ID NO: 7731749 - DNA, 22 bp, Homo sapiens
gccagagccggcttcacaggat

SEQ ID NO: 7731750 - DNA, 22 bp, Homo sapiens
gccagagccacttttgggtgat

SEQ ID NO: 7731751 - DNA, 22 bp, Homo sapiens
gccagagcatgcactgcctgca

SEQ ID NO: 7731752 - DNA, 22 bp, Homo sapiens
gccagagcacaggctggtagta

SEQ ID NO: 7731753 - DNA, 22 bp, Homo sapiens
gccagccccttagggctctccc

SEQ ID NO: 7731754 - DNA, 21 bp, Homo sapiens
gccagccatgcttgcctaggc

SEQ ID NO: 7731755 - DNA, 22 bp, Homo sapiens
gccagagcttcccccgagtgtg

SEQ ID NO: 7731756 - DNA, 22 bp, Homo sapiens
gccaggaccctggagggcatct

SEQ ID NO: 7731757 - DNA, 22 bp, Homo sapiens
gccaggacggtgaatgggctac

SEQ ID NO: 7731758 - DNA, 20 bp, Homo sapiens
gcctcagccaacccatgggg

SEQ ID NO: 7731759 - DNA, 22 bp, Homo sapiens
gcccagggctgcaagtggacgc

SEQ ID NO: 7731760 - DNA, 22 bp, Homo sapiens
gcccaggggagtagtcaattta

SEQ ID NO: 7731761 - DNA, 22 bp, Homo sapiens
gcccagtggtaaaagcaggcct

SEQ ID NO: 7731762 - DNA, 22 bp, Homo sapiens
gcagggctaatggggcaagtag

SEQ ID NO: 7731763 - DNA, 22 bp, Homo sapiens
gcagggctaggtcttctagggc

SEQ ID NO: 7731764 - DNA, 22 bp, Homo sapiens
gcagggccttagcagcggctgc

SEQ ID NO: 7731765 - DNA, 22 bp, Homo sapiens
gcagggccttggtcatcttttt

SEQ ID NO: 7731766 - DNA, 22 bp, Homo sapiens
gcactgcctgtgagccctggtt

SEQ ID NO: 7731767 - DNA, 22 bp, Homo sapiens
gcactgccacataatctcagca

SEQ ID NO: 7731768 - DNA, 22 bp, Homo sapiens
gagggggaaagtccctggagtc

SEQ ID NO: 7731769 - DNA, 22 bp, Homo sapiens
gagggggacgtatcctggtatg

SEQ ID NO: 7731770 - DNA, 22 bp, Homo sapiens
gagggggagatgtgcacacact

SEQ ID NO: 7731771 - DNA, 18 bp, Homo sapiens
cctgtcacgtccaggcct

SEQ ID NO: 7731772 - DNA, 22 bp, Homo sapiens
cctgtggagctttcagcagctc

SEQ ID NO: 7731773 - DNA, 22 bp, Homo sapiens
cctgtggaccaggaggcagccc

SEQ ID NO: 7731774 - DNA, 22 bp, Homo sapiens
cctggggagagaaagcccagcc

SEQ ID NO: 7731775 - DNA, 22 bp, Homo sapiens
cctggggagaagagcttccccc

SEQ ID NO: 7731776 - DNA, 22 bp, Homo sapiens
tggttccactaacctgagagcc

SEQ ID NO: 7731777 - DNA, 22 bp, Homo sapiens
ccttggggtgttggaggcagcc

SEQ ID NO: 7731778 - DNA, 22 bp, Homo sapiens
ccttgggaggctcccagggaga

SEQ ID NO: 7731779 - DNA, 22 bp, Homo sapiens
ccttgggatgcataagagccca

SEQ ID NO: 7731780 - DNA, 21 bp, Homo sapiens
ccttgggatgcaagtgagact

SEQ ID NO: 7731781 - DNA, 22 bp, Homo sapiens
ctcagcccagcccaggaccagg

SEQ ID NO: 7731782 - DNA, 22 bp, Homo sapiens
ttcagggcgttgtggctgactg

SEQ ID NO: 7731783 - DNA, 22 bp, Homo sapiens
cggctggtgtcgggcacagcaa

SEQ ID NO: 7731784 - DNA, 22 bp, Homo sapiens
cggctgggttcggctgcaggcc

SEQ ID NO: 7731785 - DNA, 22 bp, Homo sapiens
cgggagcctctgggtcacactg

SEQ ID NO: 7731786 - DNA, 22 bp, Homo sapiens
ctgagcacctgctgtgtgccag

SEQ ID NO: 7731787 - DNA, 22 bp, Homo sapiens
ctgcctgcaggacacctcgcta

SEQ ID NO: 7731788 - DNA, 22 bp, Homo sapiens
ctgcctgagtggaggtcgaggg

SEQ ID NO: 7731789 - DNA, 22 bp, Homo sapiens
ctgcctgaactgggtgagcaag

SEQ ID NO: 7731790 - DNA, 22 bp, Homo sapiens
ctgctccacaccgtccatactc

SEQ ID NO: 7731791 - DNA, 20 bp, Homo sapiens
ctgctccacccggctctcag

SEQ ID NO: 7731792 - DNA, 23 bp, Homo sapiens
ctgctccaggacagcatggaggt

SEQ ID NO: 7731793 - DNA, 22 bp, Homo sapiens
ctgctgcctgattgcagacctc

SEQ ID NO: 7731794 - DNA, 22 bp, Homo sapiens
ctgctgccttccaaaggccagg

SEQ ID NO: 7731795 - DNA, 19 bp, Homo sapiens
ctgctgccggagactcgtc

SEQ ID NO: 7731796 - DNA, 22 bp, Homo sapiens
ctcaggcttgggaggaggccca

SEQ ID NO: 7731797 - DNA, 22 bp, Homo sapiens
ctcaggctgccctgacagcccc

SEQ ID NO: 7731798 - DNA, 21 bp, Homo sapiens
ctcaggctggcagcaggctag

SEQ ID NO: 7731799 - DNA, 19 bp, Homo sapiens
ctcctcagtcccagaggtc

SEQ ID NO: 7731800 - DNA, 22 bp, Homo sapiens
ctcctcagtcaggtctagggtc

SEQ ID NO: 7731801 - DNA, 22 bp, Homo sapiens
ctctgcttgtgtcaggcatgct

SEQ ID NO: 7731802 - DNA, 21 bp, Homo sapiens
ctctgctgtctaccagctgtt

SEQ ID NO: 7731803 - DNA, 22 bp, Homo sapiens
cttctggcgttggaggtctgag

SEQ ID NO: 7731804 - DNA, 22 bp, Homo sapiens
cttctggcaaaacaggcagaaa

SEQ ID NO: 7731805 - DNA, 19 bp, Homo sapiens
cttctggccctgagccacc

SEQ ID NO: 7731806 - DNA, 23 bp, Homo sapiens
cttctcagaagtctgtgccagga

SEQ ID NO: 7731807 - DNA, 22 bp, Homo sapiens
cttccaggacaccagggtagta

SEQ ID NO: 7731808 - DNA, 22 bp, Homo sapiens
ctgctgtgtggattcaatggct

SEQ ID NO: 7731809 - DNA, 23 bp, Homo sapiens
ctgctgtgttggtctcgatggga

SEQ ID NO: 7731810 - DNA, 22 bp, Homo sapiens
ctgggacatggtgctgtcttta

SEQ ID NO: 7731811 - DNA, 22 bp, Homo sapiens
ctgggaccagtgaagcaactca

SEQ ID NO: 7731812 - DNA, 22 bp, Homo sapiens
ctgggacatagatcagcctttt

SEQ ID NO: 7731813 - DNA, 22 bp, Homo sapiens
ctgggccttgatcacacaggtg

SEQ ID NO: 7731814 - DNA, 22 bp, Homo sapiens
ctgggcagctaccaccactgct

SEQ ID NO: 7731815 - DNA, 22 bp, Homo sapiens
ctgggcagctgtatcagggagt

SEQ ID NO: 7731816 - DNA, 22 bp, Homo sapiens
ctgggcagagctaacacctgag

SEQ ID NO: 7731817 - DNA, 22 bp, Homo sapiens
ctgggcagaattttaggatggc

SEQ ID NO: 7731818 - DNA, 22 bp, Homo sapiens
ctgggatgtgaggagcgcctct

SEQ ID NO: 7731819 - DNA, 22 bp, Homo sapiens
ctggggagaagcgactcggctg

SEQ ID NO: 7731820 - DNA, 20 bp, Homo sapiens
ctggggagctgctcccacga

SEQ ID NO: 7731821 - DNA, 22 bp, Homo sapiens
gagaccccagctcagcctccag

SEQ ID NO: 7731822 - DNA, 22 bp, Homo sapiens
gaccaggcccaggtgcaaggga

SEQ ID NO: 7731823 - DNA, 22 bp, Homo sapiens
gacactggatttctagaaatgt

SEQ ID NO: 7731824 - DNA, 22 bp, Homo sapiens
gacactggcttgtcccgccatc

SEQ ID NO: 7731825 - DNA, 22 bp, Homo sapiens
gagcccagattggaatttccca

SEQ ID NO: 7731826 - DNA, 22 bp, Homo sapiens
gagcccagctgcggccctcagc

SEQ ID NO: 7731827 - DNA, 22 bp, Homo sapiens
gagcccagctctacctcagact

SEQ ID NO: 7731828 - DNA, 22 bp, Homo sapiens
gagcccaggaagtggaggctga

SEQ ID NO: 7731829 - DNA, 22 bp, Homo sapiens
gaggagcccccactgggctcac

SEQ ID NO: 7731830 - DNA, 22 bp, Homo sapiens
tgcagggctaagtcagagcctg

SEQ ID NO: 7731831 - DNA, 20 bp, Homo sapiens
tgctcaggatggagaggtgt

SEQ ID NO: 7731832 - DNA, 22 bp, Homo sapiens
tgctcaggacagtggaacctaa

SEQ ID NO: 7731833 - DNA, 19 bp, Homo sapiens
tgctcaggccaaggagccc

SEQ ID NO: 7731834 - DNA, 22 bp, Homo sapiens
tgctcaggccagccggacagag

SEQ ID NO: 7731835 - DNA, 22 bp, Homo sapiens
tgctcagggacaatggagaggg

SEQ ID NO: 7731836 - DNA, 22 bp, Homo sapiens
tgctcagggagcttcctggtgg

SEQ ID NO: 7731837 - DNA, 22 bp, Homo sapiens
ccctccctttgcagcagtgcat

SEQ ID NO: 7731838 - DNA, 22 bp, Homo sapiens
tggagacctctacccatctcct

SEQ ID NO: 7731839 - DNA, 22 bp, Homo sapiens
ccctgggagtccactgatgtca

SEQ ID NO: 7731840 - DNA, 22 bp, Homo sapiens
ccctgggagctgcctggctgac

SEQ ID NO: 7731841 - DNA, 22 bp, Homo sapiens
ccctgggaggcttccaggcaga

SEQ ID NO: 7731842 - DNA, 22 bp, Homo sapiens
ccctgggagaagttgagggctg

SEQ ID NO: 7731843 - DNA, 22 bp, Homo sapiens
ccctgggaagtattccagctat

SEQ ID NO: 7731844 - DNA, 22 bp, Homo sapiens
ccctgggacccgctgcagaggc

SEQ ID NO: 7731845 - DNA, 22 bp, Homo sapiens
cctctcccctcccaaggcggga

SEQ ID NO: 7731846 - DNA, 22 bp, Homo sapiens
tgggacagggaatctgatcccc

SEQ ID NO: 7731847 - DNA, 22 bp, Homo sapiens
cctcctctgtgcagctgtgggt

SEQ ID NO: 7731848 - DNA, 22 bp, Homo sapiens
cctcccaccgtatctcagtggc

SEQ ID NO: 7731849 - DNA, 22 bp, Homo sapiens
cctcccacttcttgctgaggtc

SEQ ID NO: 7731850 - DNA, 22 bp, Homo sapiens
cctcccacatcctagctctgct

SEQ ID NO: 7731851 - DNA, 22 bp, Homo sapiens
cctccagggcccctctcactgg

SEQ ID NO: 7731852 - DNA, 22 bp, Homo sapiens
cctgcctcccagaggtcctcta

SEQ ID NO: 7731853 - DNA, 22 bp, Homo sapiens
cctgcctgaaggtcagccaccc

SEQ ID NO: 7731854 - DNA, 19 bp, Homo sapiens
cctgcctgagctgtccctc

SEQ ID NO: 7731855 - DNA, 19 bp, Homo sapiens
cctgcctgaccccggctac

SEQ ID NO: 7731856 - DNA, 22 bp, Homo sapiens
cctgcccagagcccctttcact

SEQ ID NO: 7731857 - DNA, 22 bp, Homo sapiens
cctgcccagcttcacctcaggc

SEQ ID NO: 7731858 - DNA, 22 bp, Homo sapiens
ccaggagagcaaaggtcactct

SEQ ID NO: 7731859 - DNA, 22 bp, Homo sapiens
ccaggagcagatatggacataa

SEQ ID NO: 7731860 - DNA, 22 bp, Homo sapiens
ccaggagcaccaggcctgtgcc

SEQ ID NO: 7731861 - DNA, 22 bp, Homo sapiens
ccaggagcaggagctgcagctg

SEQ ID NO: 7731862 - DNA, 22 bp, Homo sapiens
ccaggagcaggagctggacaga

SEQ ID NO: 7731863 - DNA, 22 bp, Homo sapiens
ccaggagcattaagagaacata

SEQ ID NO: 7731864 - DNA, 22 bp, Homo sapiens
ccaggagccactcaggcccaca

SEQ ID NO: 7731865 - DNA, 19 bp, Homo sapiens
ccaggagcagtggtgagct

SEQ ID NO: 7731866 - DNA, 22 bp, Homo sapiens
tctgttcagaaatggaagtgcc

SEQ ID NO: 7731867 - DNA, 19 bp, Homo sapiens
ccaggcctcctgggaggtc

SEQ ID NO: 7731868 - DNA, 22 bp, Homo sapiens
ccaggcctcctgtgagtggacc

SEQ ID NO: 7731869 - DNA, 19 bp, Homo sapiens
ccaggcctctggggcctgt

SEQ ID NO: 7731870 - DNA, 23 bp, Homo sapiens
ccaggcctctcagagggtgtgcc

SEQ ID NO: 7731871 - DNA, 22 bp, Homo sapiens
ccaggcctgcatctgctgcgca

SEQ ID NO: 7731872 - DNA, 22 bp, Homo sapiens
ccagggcctcgtgttctgagtg

SEQ ID NO: 7731873 - DNA, 22 bp, Homo sapiens
ccagggctcgggtgcttagtca

SEQ ID NO: 7731874 - DNA, 22 bp, Homo sapiens
ccagggctctatgagggtggag

SEQ ID NO: 7731875 - DNA, 22 bp, Homo sapiens
ccagggctctgcttctgccatg

SEQ ID NO: 7731876 - DNA, 22 bp, Homo sapiens
ccagggctgccgcatccctggt

SEQ ID NO: 7731877 - DNA, 22 bp, Homo sapiens
ccagggctgagctgtgaccatg

SEQ ID NO: 7731878 - DNA, 22 bp, Homo sapiens
ccagggcatcacatccagtgtt

SEQ ID NO: 7731879 - DNA, 22 bp, Homo sapiens
ccagggcagtgggagaaggtgc

SEQ ID NO: 7731880 - DNA, 22 bp, Homo sapiens
ccagggcacgttgggacagtac

SEQ ID NO: 7731881 - DNA, 22 bp, Homo sapiens
ccagggcagggaccacgtgtct

SEQ ID NO: 7731882 - DNA, 22 bp, Homo sapiens
ccagggcaattatttggagggt

SEQ ID NO: 7731883 - DNA, 22 bp, Homo sapiens
ccagggcaacgctgtctcagag

SEQ ID NO: 7731884 - DNA, 22 bp, Homo sapiens
tgcagggccttctagaccatgg

SEQ ID NO: 7731885 - DNA, 22 bp, Homo sapiens
tgcagggccttgggtctttctt

SEQ ID NO: 7731886 - DNA, 22 bp, Homo sapiens
cccagagctgggtgggcagcgg

SEQ ID NO: 7731887 - DNA, 22 bp, Homo sapiens
cccagagctgagggggcacgtt

SEQ ID NO: 7731888 - DNA, 22 bp, Homo sapiens
ccagtggacttctccctgtggt

SEQ ID NO: 7731889 - DNA, 22 bp, Homo sapiens
ccagggctgcctggccgtgtgt

SEQ ID NO: 7731890 - DNA, 22 bp, Homo sapiens
ccagggctgctcattggctggt

SEQ ID NO: 7731891 - DNA, 20 bp, Homo sapiens
cagggccacgctccaaggca

SEQ ID NO: 7731892 - DNA, 22 bp, Homo sapiens
cagggccaccctctgctgggtg

SEQ ID NO: 7731893 - DNA, 21 bp, Homo sapiens
cagggccaatcctgacctcta

SEQ ID NO: 7731894 - DNA, 22 bp, Homo sapiens
cagggccaagttggtgcctttt

SEQ ID NO: 7731895 - DNA, 22 bp, Homo sapiens
caggctccctgcaggccagtga

SEQ ID NO: 7731896 - DNA, 22 bp, Homo sapiens
caggctccctgggcagtggcag

SEQ ID NO: 7731897 - DNA, 22 bp, Homo sapiens
caggctccctaagtcagcagcc

SEQ ID NO: 7731898 - DNA, 20 bp, Homo sapiens
caggctccgcaggactaggg

SEQ ID NO: 7731899 - DNA, 22 bp, Homo sapiens
caggctcctcactcatgctccc

SEQ ID NO: 7731900 - DNA, 22 bp, Homo sapiens
caggctcccgaaatcacccatg

SEQ ID NO: 7731901 - DNA, 22 bp, Homo sapiens
caggctcccacaagctcccagc

SEQ ID NO: 7731902 - DNA, 22 bp, Homo sapiens
caggctcccaccctcctgcagc

SEQ ID NO: 7731903 - DNA, 22 bp, Homo sapiens
caggctccagcttcctgctcag

SEQ ID NO: 7731904 - DNA, 22 bp, Homo sapiens
caggccctgccttgagggacct

SEQ ID NO: 7731905 - DNA, 22 bp, Homo sapiens
caggccctcaggcaagggctct

SEQ ID NO: 7731906 - DNA, 22 bp, Homo sapiens
caggccacacggcggctccctg

SEQ ID NO: 7731907 - DNA, 22 bp, Homo sapiens
cagggcagtttgtgcctatgag

SEQ ID NO: 7731908 - DNA, 22 bp, Homo sapiens
cagggccaagctgcagcatctg

SEQ ID NO: 7731909 - DNA, 22 bp, Homo sapiens
cagggagaggcatcatagggaa

SEQ ID NO: 7731910 - DNA, 22 bp, Homo sapiens
ccacagggataggaatggggct

SEQ ID NO: 7731911 - DNA, 22 bp, Homo sapiens
ccacagggcacaagggaggttg

SEQ ID NO: 7731912 - DNA, 22 bp, Homo sapiens
tcctggccttagcgaggcggtc

SEQ ID NO: 7731913 - DNA, 21 bp, Homo sapiens
tcctgccttagtccagagcag

SEQ ID NO: 7731914 - DNA, 23 bp, Homo sapiens
tcctgctgaaagctccagctggc

SEQ ID NO: 7731915 - DNA, 22 bp, Homo sapiens
ccagagccagagaggtgcctgc

SEQ ID NO: 7731916 - DNA, 22 bp, Homo sapiens
ccagagcccagggtcatgcagg

SEQ ID NO: 7731917 - DNA, 22 bp, Homo sapiens
ccagagcccagcacacggtgct

SEQ ID NO: 7731918 - DNA, 19 bp, Homo sapiens
ccagagcccgccagatggg

SEQ ID NO: 7731919 - DNA, 22 bp, Homo sapiens
ccagagcccctgagcttccctg

SEQ ID NO: 7731920 - DNA, 22 bp, Homo sapiens
ccagagccggctccctcagctt

SEQ ID NO: 7731921 - DNA, 22 bp, Homo sapiens
ccagagccggattgtgaagtgc

SEQ ID NO: 7731922 - DNA, 22 bp, Homo sapiens
ccagagcctcgcccggagcctc

SEQ ID NO: 7731923 - DNA, 22 bp, Homo sapiens
ccagagcctaagatctgatcct

SEQ ID NO: 7731924 - DNA, 22 bp, Homo sapiens
ccagagcctcaacacaggtcct

SEQ ID NO: 7731925 - DNA, 21 bp, Homo sapiens
ccagagcctgagaggattatg

SEQ ID NO: 7731926 - DNA, 22 bp, Homo sapiens
ccagagcctgctgagccccatt

SEQ ID NO: 7731927 - DNA, 22 bp, Homo sapiens
tcagtgtgagtaccatgctcag

SEQ ID NO: 7731928 - DNA, 22 bp, Homo sapiens
tcagtgtgattaggctatctga

SEQ ID NO: 7731929 - DNA, 22 bp, Homo sapiens
tcagtgtgaggggctgggtcct

SEQ ID NO: 7731930 - DNA, 21 bp, Homo sapiens
tcagtgtgactggcaaattga

SEQ ID NO: 7731931 - DNA, 22 bp, Homo sapiens
tcagtgtgaattcaggagccta

SEQ ID NO: 7731932 - DNA, 22 bp, Homo sapiens
tcagtgtgcacgatacagattg

SEQ ID NO: 7731933 - DNA, 23 bp, Homo sapiens
tcagtgtgcaagaatggagaagc

SEQ ID NO: 7731934 - DNA, 22 bp, Homo sapiens
tcagtgtgtacactgagcattt

SEQ ID NO: 7731935 - DNA, 22 bp, Homo sapiens
tcagtgtgtaattctttgtttc

SEQ ID NO: 7731936 - DNA, 22 bp, Homo sapiens
tccaggctttggggcaggagcg

SEQ ID NO: 7731937 - DNA, 22 bp, Homo sapiens
tccaggctgtgcgcaccgtgtg

SEQ ID NO: 7731938 - DNA, 22 bp, Homo sapiens
tccaggcttgagaccaggctct

SEQ ID NO: 7731939 - DNA, 22 bp, Homo sapiens
ttgctcaggcttagagctacta

SEQ ID NO: 7731940 - DNA, 22 bp, Homo sapiens
ttgctcagctgtgagatatcca

SEQ ID NO: 7731941 - DNA, 22 bp, Homo sapiens
ttgcttcatcagagtaaacaag

SEQ ID NO: 7731942 - DNA, 22 bp, Homo sapiens
ttgcctggatggtccccagaga

SEQ ID NO: 7731943 - DNA, 22 bp, Homo sapiens
ttgcctggattctaccacagaa

SEQ ID NO: 7731944 - DNA, 22 bp, Homo sapiens
ttgcctggactctgctggtatt

SEQ ID NO: 7731945 - DNA, 22 bp, Homo sapiens
ttgcctggtcctgtgggtgctg

SEQ ID NO: 7731946 - DNA, 22 bp, Homo sapiens
ttgcctccttttaaggaaatca

SEQ ID NO: 7731947 - DNA, 22 bp, Homo sapiens
ttgcctcccagcatgggcagct

SEQ ID NO: 7731948 - DNA, 22 bp, Homo sapiens
ttgccagggctttggtggcatc

SEQ ID NO: 7731949 - DNA, 22 bp, Homo sapiens
ttgccagggtcaggatgagatc

SEQ ID NO: 7731950 - DNA, 22 bp, Homo sapiens
ttgccagggaacagggagaggc

SEQ ID NO: 7731951 - DNA, 22 bp, Homo sapiens
ttgccaggagacaaagtgggcc

SEQ ID NO: 7731952 - DNA, 22 bp, Homo sapiens
ttgttcaggcctgggacagttt

SEQ ID NO: 7731953 - DNA, 19 bp, Homo sapiens
ttcccctccccagggatag

SEQ ID NO: 7731954 - DNA, 22 bp, Homo sapiens
tcctctgctggaagggcaagag

SEQ ID NO: 7731955 - DNA, 22 bp, Homo sapiens
ttatggaatttgcaaaaggtta

SEQ ID NO: 7731956 - DNA, 17 bp, Homo sapiens
ttctcttcctggatagt

SEQ ID NO: 7731957 - DNA, 22 bp, Homo sapiens
ttctcctcactgcagcctttca

SEQ ID NO: 7731958 - DNA, 19 bp, Homo sapiens
gccaggcctggacctgcag

SEQ ID NO: 7731959 - DNA, 22 bp, Homo sapiens
gccaggccctgggcacttcgtg

SEQ ID NO: 7731960 - DNA, 22 bp, Homo sapiens
gccaggcctgcaagtgctggtg

SEQ ID NO: 7731961 - DNA, 22 bp, Homo sapiens
gccaggccactcccgggtcctg

SEQ ID NO: 7731962 - DNA, 19 bp, Homo sapiens
gccaggagggctctggctg

SEQ ID NO: 7731963 - DNA, 22 bp, Homo sapiens
gcctccagggtagaggaggaag

SEQ ID NO: 7731964 - DNA, 22 bp, Homo sapiens
gcctctctcgggcttgtagcgg

SEQ ID NO: 7731965 - DNA, 22 bp, Homo sapiens
gcctctctccttggcttgcagt

SEQ ID NO: 7731966 - DNA, 22 bp, Homo sapiens
gcctccagcccacgcaggcctg

SEQ ID NO: 7731967 - DNA, 18 bp, Homo sapiens
gcctgggaggaggaaatg

SEQ ID NO: 7731968 - DNA, 22 bp, Homo sapiens
gcctgggagattaattaggaag

SEQ ID NO: 7731969 - DNA, 22 bp, Homo sapiens
gcctgggagcacatcggggtcc

SEQ ID NO: 7731970 - DNA, 22 bp, Homo sapiens
gcctgggagagggatagtgcag

SEQ ID NO: 7731971 - DNA, 22 bp, Homo sapiens
gcctgggagatgcgttgtggcc

SEQ ID NO: 7731972 - DNA, 18 bp, Homo sapiens
gcctgcctagagcttgcc

SEQ ID NO: 7731973 - DNA, 22 bp, Homo sapiens
gcctctctgggctgccgaggct

SEQ ID NO: 7731974 - DNA, 22 bp, Homo sapiens
gcctctctctacccagtatgat

SEQ ID NO: 7731975 - DNA, 22 bp, Homo sapiens
gcctgtcccgcaccggagcccg

SEQ ID NO: 7731976 - DNA, 22 bp, Homo sapiens
gcctgtccccaggagagtccgg

SEQ ID NO: 7731977 - DNA, 22 bp, Homo sapiens
gcctgtccactaaacagccaag

SEQ ID NO: 7731978 - DNA, 23 bp, Homo sapiens
gcctgggagttgcgatctgcccg

SEQ ID NO: 7731979 - DNA, 22 bp, Homo sapiens
gcctgggagtgcacagtgaggt

SEQ ID NO: 7731980 - DNA, 22 bp, Homo sapiens
gcctgggagggcagcagtgtgg

SEQ ID NO: 7731981 - DNA, 16 bp, Homo sapiens
gcctgggagggaacag

SEQ ID NO: 7731982 - DNA, 22 bp, Homo sapiens
gcctgtccttgtgaggtcccag

SEQ ID NO: 7731983 - DNA, 22 bp, Homo sapiens
gcctgtcctatacaggcggctg

SEQ ID NO: 7731984 - DNA, 22 bp, Homo sapiens
gcctgtcctggatgctctgcaa

SEQ ID NO: 7731985 - DNA, 22 bp, Homo sapiens
cttgcctgctggagcagggctc

SEQ ID NO: 7731986 - DNA, 22 bp, Homo sapiens
cttgttcatctcattgggactg

SEQ ID NO: 7731987 - DNA, 22 bp, Homo sapiens
gagccaggcccgtacttgctgt

SEQ ID NO: 7731988 - DNA, 22 bp, Homo sapiens
gagccaggaggcagagactgca

SEQ ID NO: 7731989 - DNA, 22 bp, Homo sapiens
gagccaggaagaaggccttact

SEQ ID NO: 7731990 - DNA, 22 bp, Homo sapiens
gagccaggagatacctaagggg

SEQ ID NO: 7731991 - DNA, 22 bp, Homo sapiens
atggcagggactgtggcccttg

SEQ ID NO: 7731992 - DNA, 23 bp, Homo sapiens
gagaacagccacagagagctgtg

SEQ ID NO: 7731993 - DNA, 22 bp, Homo sapiens
gagctgggcctcagaacacagt

SEQ ID NO: 7731994 - DNA, 19 bp, Homo sapiens
gctcctggatgacctgtgg

SEQ ID NO: 7731995 - DNA, 18 bp, Homo sapiens
gctcctggaccaggtcac

SEQ ID NO: 7731996 - DNA, 22 bp, Homo sapiens
ggaggccttgcctgcaggcaca

SEQ ID NO: 7731997 - DNA, 22 bp, Homo sapiens
cacagggcaggccccaggcctc

SEQ ID NO: 7731998 - DNA, 22 bp, Homo sapiens
cacagggcagagggtccgtggc

SEQ ID NO: 7731999 - DNA, 22 bp, Homo sapiens
ggcagagcttgcagtgagccga

SEQ ID NO: 7732000 - DNA, 22 bp, Homo sapiens
ggcagagccttctggagctcgc

SEQ ID NO: 7732001 - DNA, 21 bp, Homo sapiens
ggcagagctggggcctccagc

SEQ ID NO: 7732002 - DNA, 22 bp, Homo sapiens
cactgcctgctggctgtcactt

SEQ ID NO: 7732003 - DNA, 22 bp, Homo sapiens
caccctggcctcgctctctgca

SEQ ID NO: 7732004 - DNA, 22 bp, Homo sapiens
ggcagctgagatcatgctgttg

SEQ ID NO: 7732005 - DNA, 22 bp, Homo sapiens
ggcagctgaagaggaactttgg

SEQ ID NO: 7732006 - DNA, 19 bp, Homo sapiens
ggtgtgccaaatgggaatg

SEQ ID NO: 7732007 - DNA, 22 bp, Homo sapiens
cagcagctacttggagcagcag

SEQ ID NO: 7732008 - DNA, 22 bp, Homo sapiens
cagccaggttcaagtccttata

SEQ ID NO: 7732009 - DNA, 22 bp, Homo sapiens
cactggcccagccaggcctgtt

SEQ ID NO: 7732010 - DNA, 22 bp, Homo sapiens
cactggcccataaaggcctggg

SEQ ID NO: 7732011 - DNA, 22 bp, Homo sapiens
cagaggccagtggacaagggcc

SEQ ID NO: 7732012 - DNA, 19 bp, Homo sapiens
cagaggccagaagcacagg

SEQ ID NO: 7732013 - DNA, 22 bp, Homo sapiens
cagaggcctatccagtgtccat

SEQ ID NO: 7732014 - DNA, 22 bp, Homo sapiens
cagaggcctcacttccagccag

SEQ ID NO: 7732015 - DNA, 21 bp, Homo sapiens
cagaggcctcatgctctgtgc

SEQ ID NO: 7732016 - DNA, 22 bp, Homo sapiens
ggggaagaatgctctctagaga

SEQ ID NO: 7732017 - DNA, 22 bp, Homo sapiens
cagaggccacctgtggccactg

SEQ ID NO: 7732018 - DNA, 22 bp, Homo sapiens
cagagccctagtcctgatggcc

SEQ ID NO: 7732019 - DNA, 22 bp, Homo sapiens
cagagccctgggcacatggtag

SEQ ID NO: 7732020 - DNA, 22 bp, Homo sapiens
cagagccctcaaggccgatgca

SEQ ID NO: 7732021 - DNA, 22 bp, Homo sapiens
cagagccagctgtccttggcat

SEQ ID NO: 7732022 - DNA, 22 bp, Homo sapiens
cagagcccatggcacatgtgga

SEQ ID NO: 7732023 - DNA, 21 bp, Homo sapiens
cagagctctttctgcttgctg

SEQ ID NO: 7732024 - DNA, 22 bp, Homo sapiens
gggcgcagccaatcctggccct

SEQ ID NO: 7732025 - DNA, 19 bp, Homo sapiens
cagagctgctggcctcgtc

SEQ ID NO: 7732026 - DNA, 22 bp, Homo sapiens
ctgggaatgagcaggtggctcc

SEQ ID NO: 7732027 - DNA, 22 bp, Homo sapiens
ctgggaaggggaaggtcctctc

SEQ ID NO: 7732028 - DNA, 22 bp, Homo sapiens
ctgggagacaagagagggctga

SEQ ID NO: 7732029 - DNA, 22 bp, Homo sapiens
ctgggagagaagcgaagctggg

SEQ ID NO: 7732030 - DNA, 22 bp, Homo sapiens
ctgggcacacagtgactctgca

SEQ ID NO: 7732031 - DNA, 22 bp, Homo sapiens
ctgggcaccaggcatgacaggg

SEQ ID NO: 7732032 - DNA, 22 bp, Homo sapiens
ctgggcagtggtggcccttccc

SEQ ID NO: 7732033 - DNA, 22 bp, Homo sapiens
ctgtccagtctttagcaagctg

SEQ ID NO: 7732034 - DNA, 21 bp, Homo sapiens
ctgtcctcagatgtggacgag

SEQ ID NO: 7732035 - DNA, 22 bp, Homo sapiens
ctgtcctccggccacctacagt

SEQ ID NO: 7732036 - DNA, 19 bp, Homo sapiens
ctgtgcaggccgggctgag

SEQ ID NO: 7732037 - DNA, 22 bp, Homo sapiens
ctgccaggcctcatcccagcca

SEQ ID NO: 7732038 - DNA, 22 bp, Homo sapiens
ctgccaggcagcagagggagaa

SEQ ID NO: 7732039 - DNA, 22 bp, Homo sapiens
ctgccaggactgacgtcttcag

SEQ ID NO: 7732040 - DNA, 22 bp, Homo sapiens
ctgccaggcactgggctctgca

SEQ ID NO: 7732041 - DNA, 22 bp, Homo sapiens
ctgagggtcaacttgattgtat

SEQ ID NO: 7732042 - DNA, 22 bp, Homo sapiens
ctgaggcctctgttcaccagaa

SEQ ID NO: 7732043 - DNA, 22 bp, Homo sapiens
ctgaggcctctttccttggctt

SEQ ID NO: 7732044 - DNA, 22 bp, Homo sapiens
ctgaggcctctctccttggctt

SEQ ID NO: 7732045 - DNA, 22 bp, Homo sapiens
ctgaggcctctctcctgggctt

SEQ ID NO: 7732046 - DNA, 22 bp, Homo sapiens
ctgaggcctctcccactccagc

SEQ ID NO: 7732047 - DNA, 22 bp, Homo sapiens
ctgaggcctcactgtagtccct

SEQ ID NO: 7732048 - DNA, 22 bp, Homo sapiens
ctgcccactatgttgtcatggg

SEQ ID NO: 7732049 - DNA, 22 bp, Homo sapiens
ctcttagtaatgccatgaagca

SEQ ID NO: 7732050 - DNA, 22 bp, Homo sapiens
ctccagagagtccagctctggg

SEQ ID NO: 7732051 - DNA, 22 bp, Homo sapiens
ctcctgccaccgcggtgtcctg

SEQ ID NO: 7732052 - DNA, 20 bp, Homo sapiens
ctcagtgtggcctgagtgtt

SEQ ID NO: 7732053 - DNA, 22 bp, Homo sapiens
ctccagagacacttctcatgat

SEQ ID NO: 7732054 - DNA, 22 bp, Homo sapiens
ctccagagagaaaggaggccgc

SEQ ID NO: 7732055 - DNA, 22 bp, Homo sapiens
ctcagagggtacaggtgaaccc

SEQ ID NO: 7732056 - DNA, 23 bp, Homo sapiens
ctcagaggtgtttttcacttact

SEQ ID NO: 7732057 - DNA, 22 bp, Homo sapiens
agggtctgtttaccacctcttt

SEQ ID NO: 7732058 - DNA, 22 bp, Homo sapiens
cctgcccagggtcaccacagag

SEQ ID NO: 7732059 - DNA, 22 bp, Homo sapiens
cctgcccaggagtctctctgtg

SEQ ID NO: 7732060 - DNA, 22 bp, Homo sapiens
cctgcccagcttcccgagtgca

SEQ ID NO: 7732061 - DNA, 23 bp, Homo sapiens
cctgcccaggaatccggcggcgt

SEQ ID NO: 7732062 - DNA, 22 bp, Homo sapiens
cctctctcttgtagtccctgcc

SEQ ID NO: 7732063 - DNA, 22 bp, Homo sapiens
cctggcagcgtgccgagctgcg

SEQ ID NO: 7732064 - DNA, 22 bp, Homo sapiens
cctggccactcaggtgtggggc

SEQ ID NO: 7732065 - DNA, 19 bp, Homo sapiens
cctggccagacttctgccc

SEQ ID NO: 7732066 - DNA, 22 bp, Homo sapiens
cctggccagaggcgtgcctgtg

SEQ ID NO: 7732067 - DNA, 22 bp, Homo sapiens
cctggccacagggctctgcatt

SEQ ID NO: 7732068 - DNA, 22 bp, Homo sapiens
cctggccacccagccttggcca

SEQ ID NO: 7732069 - DNA, 22 bp, Homo sapiens
cctggccaatctagggctgtta

SEQ ID NO: 7732070 - DNA, 21 bp, Homo sapiens
cctggccaatctgatagggtt

SEQ ID NO: 7732071 - DNA, 22 bp, Homo sapiens
cctggctgcttcctctgccatg

SEQ ID NO: 7732072 - DNA, 22 bp, Homo sapiens
cctgggaaggtgaggccctgga

SEQ ID NO: 7732073 - DNA, 22 bp, Homo sapiens
ccccagggactggtttcatgga

SEQ ID NO: 7732074 - DNA, 22 bp, Homo sapiens
cctccaggccttgcaggttaac

SEQ ID NO: 7732075 - DNA, 22 bp, Homo sapiens
cctccaggataagtcagggcct

SEQ ID NO: 7732076 - DNA, 22 bp, Homo sapiens
cctcccagtgcctccagagcag

SEQ ID NO: 7732077 - DNA, 22 bp, Homo sapiens
agggccaggatcacagccaaga

SEQ ID NO: 7732078 - DNA, 18 bp, Homo sapiens
agggccagctgtgagtag

SEQ ID NO: 7732079 - DNA, 22 bp, Homo sapiens
agggccaggaacacctgaaggg

SEQ ID NO: 7732080 - DNA, 22 bp, Homo sapiens
agggccagctagagccctcgcc

SEQ ID NO: 7732081 - DNA, 22 bp, Homo sapiens
agggccagccgacttccagcct

SEQ ID NO: 7732082 - DNA, 22 bp, Homo sapiens
ccctgggattgccttggccttg

SEQ ID NO: 7732083 - DNA, 21 bp, Homo sapiens
ccctgggatgggcttggactt

SEQ ID NO: 7732084 - DNA, 22 bp, Homo sapiens
ccctgggattcaatttcactct

SEQ ID NO: 7732085 - DNA, 22 bp, Homo sapiens
ccctggcccctcactccgaggc

SEQ ID NO: 7732086 - DNA, 22 bp, Homo sapiens
agggcagcctgagtgctggccc

SEQ ID NO: 7732087 - DNA, 22 bp, Homo sapiens
agggccagccccaccctctctg

SEQ ID NO: 7732088 - DNA, 22 bp, Homo sapiens
agggcagcagctgtccctgaga

SEQ ID NO: 7732089 - DNA, 22 bp, Homo sapiens
aggccgcctggggagaggccct

SEQ ID NO: 7732090 - DNA, 22 bp, Homo sapiens
aggcagtggctgagaccagggg

SEQ ID NO: 7732091 - DNA, 22 bp, Homo sapiens
aggcctcctggctccaggcctt

SEQ ID NO: 7732092 - DNA, 22 bp, Homo sapiens
aggcctctctccttggcttgta

SEQ ID NO: 7732093 - DNA, 17 bp, Homo sapiens
aggcctccctccaggcc

SEQ ID NO: 7732094 - DNA, 22 bp, Homo sapiens
aggcctccagctgagttttgct

SEQ ID NO: 7732095 - DNA, 22 bp, Homo sapiens
aggcctccagccacatgccagt

SEQ ID NO: 7732096 - DNA, 22 bp, Homo sapiens
aggcctcctgcagggatgagtg

SEQ ID NO: 7732097 - DNA, 22 bp, Homo sapiens
ccaggcctagcccctgagggta

SEQ ID NO: 7732098 - DNA, 22 bp, Homo sapiens
aggctccacggcaggatgctgt

SEQ ID NO: 7732099 - DNA, 22 bp, Homo sapiens
aggctccattccaggagctaga

SEQ ID NO: 7732100 - DNA, 22 bp, Homo sapiens
ccaggctctatccctccttctt

SEQ ID NO: 7732101 - DNA, 22 bp, Homo sapiens
ccaggctctgagcctcactctt

SEQ ID NO: 7732102 - DNA, 21 bp, Homo sapiens
agctgcagcccaaaggcctgt

SEQ ID NO: 7732103 - DNA, 22 bp, Homo sapiens
agctgggaagactggaagacag

SEQ ID NO: 7732104 - DNA, 22 bp, Homo sapiens
agctgggaagagttttctgcag

SEQ ID NO: 7732105 - DNA, 22 bp, Homo sapiens
agctgggacagacaactatgtt

SEQ ID NO: 7732106 - DNA, 23 bp, Homo sapiens
agctgggaattttctgaagcttt

SEQ ID NO: 7732107 - DNA, 22 bp, Homo sapiens
agctgggactcaactgtctggg

SEQ ID NO: 7732108 - DNA, 22 bp, Homo sapiens
caggcctcaggggctcaggctg

SEQ ID NO: 7732109 - DNA, 22 bp, Homo sapiens
caggcctcatggtgtgtccttc

SEQ ID NO: 7732110 - DNA, 22 bp, Homo sapiens
caggcctcaccagcggagctgc

SEQ ID NO: 7732111 - DNA, 22 bp, Homo sapiens
caggcctcagagagtggcgggg

SEQ ID NO: 7732112 - DNA, 22 bp, Homo sapiens
caggcctcagggctgtccgtag

SEQ ID NO: 7732113 - DNA, 22 bp, Homo sapiens
caggcctgggcttcggggctga

SEQ ID NO: 7732114 - DNA, 22 bp, Homo sapiens
caggcctcccggtgcacactga

SEQ ID NO: 7732115 - DNA, 22 bp, Homo sapiens
cagggccagcgcccaggcccag

SEQ ID NO: 7732116 - DNA, 22 bp, Homo sapiens
cagggccagcccactagcgagg

SEQ ID NO: 7732117 - DNA, 22 bp, Homo sapiens
cagggccagccgcagcatccac

SEQ ID NO: 7732118 - DNA, 22 bp, Homo sapiens
cagggccagagagggctggctg

SEQ ID NO: 7732119 - DNA, 22 bp, Homo sapiens
cagggccagccatcctgctggg

SEQ ID NO: 7732120 - DNA, 22 bp, Homo sapiens
aggaggaattgacacagaagcc

SEQ ID NO: 7732121 - DNA, 22 bp, Homo sapiens
aggagaggctctaactctgtgt

SEQ ID NO: 7732122 - DNA, 22 bp, Homo sapiens
aggagaggcatcaagaaaatcg

SEQ ID NO: 7732123 - DNA, 22 bp, Homo sapiens
agaagaggggtgtccctgtggc

SEQ ID NO: 7732124 - DNA, 22 bp, Homo sapiens
agacacagcaataactactgtt

SEQ ID NO: 7732125 - DNA, 22 bp, Homo sapiens
agcacagagttgctcactgccg

SEQ ID NO: 7732126 - DNA, 22 bp, Homo sapiens
cacaggagctgtggggcagtgt

SEQ ID NO: 7732127 - DNA, 22 bp, Homo sapiens
cacaggaggaggccagagcgta

SEQ ID NO: 7732128 - DNA, 22 bp, Homo sapiens
cacaggagccctgaggcctccc

SEQ ID NO: 7732129 - DNA, 23 bp, Homo sapiens
agcagctgtggtttaccttagta

SEQ ID NO: 7732130 - DNA, 23 bp, Homo sapiens
agcagctgtggagttttgcattt

SEQ ID NO: 7732131 - DNA, 22 bp, Homo sapiens
cacaggagggagcgggcagcca

SEQ ID NO: 7732132 - DNA, 22 bp, Homo sapiens
cacaggaggttaggaagtggtc

SEQ ID NO: 7732133 - DNA, 22 bp, Homo sapiens
cacaggaggcaatggtaagatt

SEQ ID NO: 7732134 - DNA, 22 bp, Homo sapiens
cacaggaggaggtgcccgggcc

SEQ ID NO: 7732135 - DNA, 22 bp, Homo sapiens
cacagggctttgatggctgagt

SEQ ID NO: 7732136 - DNA, 22 bp, Homo sapiens
cacagggccttgtgtgactgca

SEQ ID NO: 7732137 - DNA, 22 bp, Homo sapiens
cacagggcctggggcagctgct

SEQ ID NO: 7732138 - DNA, 22 bp, Homo sapiens
agcagggcctgagtgacctaac

SEQ ID NO: 7732139 - DNA, 22 bp, Homo sapiens
agcaggtgatcgcgtgtgctcc

SEQ ID NO: 7732140 - DNA, 19 bp, Homo sapiens
agctcctcacctctcgcgg

SEQ ID NO: 7732141 - DNA, 22 bp, Homo sapiens
agctcctcctgagtgtctggga

SEQ ID NO: 7732142 - DNA, 22 bp, Homo sapiens
agctcctctagatctgccactt

SEQ ID NO: 7732143 - DNA, 20 bp, Homo sapiens
agctcctctgcccattcttc

SEQ ID NO: 7732144 - DNA, 22 bp, Homo sapiens
agcctccatctcccatctgtga

SEQ ID NO: 7732145 - DNA, 22 bp, Homo sapiens
agccctcctcacatcagcgtcc

SEQ ID NO: 7732146 - DNA, 22 bp, Homo sapiens
agccctccatctgtgctcaggc

SEQ ID NO: 7732147 - DNA, 22 bp, Homo sapiens
cagcacaggcccctctctccca

SEQ ID NO: 7732148 - DNA, 22 bp, Homo sapiens
agccctagagctggaggtcagt

SEQ ID NO: 7732149 - DNA, 23 bp, Homo sapiens
cagagctggctcagagctgcctg

SEQ ID NO: 7732150 - DNA, 23 bp, Homo sapiens
agccaggggatcttgggccctgg

SEQ ID NO: 7732151 - DNA, 22 bp, Homo sapiens
agccaggcagggctctcgctct

SEQ ID NO: 7732152 - DNA, 21 bp, Homo sapiens
agccaggcaagcacccccact

SEQ ID NO: 7732153 - DNA, 22 bp, Homo sapiens
agccaggcagactctctttctt

SEQ ID NO: 7732154 - DNA, 22 bp, Homo sapiens
agccaggattggctgagcctta

SEQ ID NO: 7732155 - DNA, 22 bp, Homo sapiens
agccaggacatctctagctgct

SEQ ID NO: 7732156 - DNA, 22 bp, Homo sapiens
atccagagacccaaggacagaa

SEQ ID NO: 7732157 - DNA, 22 bp, Homo sapiens
agttgccttcccccagagccaa

SEQ ID NO: 7732158 - DNA, 21 bp, Homo sapiens
actgcctgtctccatagtcta

SEQ ID NO: 7732159 - DNA, 22 bp, Homo sapiens
agggctggtatgtccatgaaag

SEQ ID NO: 7732160 - DNA, 22 bp, Homo sapiens
acctgccttctcaaggacatga

SEQ ID NO: 7732161 - DNA, 22 bp, Homo sapiens
acatggagctcaaacatgagtg

SEQ ID NO: 7732162 - DNA, 22 bp, Homo sapiens
aggcctgtttcttgtccagctc

SEQ ID NO: 7732163 - DNA, 22 bp, Homo sapiens
aggcctgtttccttgggttgct

SEQ ID NO: 7732164 - DNA, 22 bp, Homo sapiens
aggcctgtctggggctcagcca

SEQ ID NO: 7732165 - DNA, 22 bp, Homo sapiens
aggcctgttccttcctgggcac

SEQ ID NO: 7732166 - DNA, 17 bp, Homo sapiens
acccaggctctatcttg

SEQ ID NO: 7732167 - DNA, 22 bp, Homo sapiens
acccaggctgcttctcagtggc

SEQ ID NO: 7732168 - DNA, 22 bp, Homo sapiens
agggcctgggatgtcctcctag

SEQ ID NO: 7732169 - DNA, 22 bp, Homo sapiens
agggcctggtgacctgggtcct

SEQ ID NO: 7732170 - DNA, 22 bp, Homo sapiens
acccgggcaaggattctgagag

SEQ ID NO: 7732171 - DNA, 20 bp, Homo sapiens
accaggcccggtgtctcctc

SEQ ID NO: 7732172 - DNA, 22 bp, Homo sapiens
accaggccctccagctgcgtgg

SEQ ID NO: 7732173 - DNA, 19 bp, Homo sapiens
accaggcctcagaggccct

SEQ ID NO: 7732174 - DNA, 22 bp, Homo sapiens
acaggcctgatgccttggctgg

SEQ ID NO: 7732175 - DNA, 18 bp, Homo sapiens
acaggcctcagtcctgca

SEQ ID NO: 7732176 - DNA, 22 bp, Homo sapiens
agctgcctgtcctaggccatca

SEQ ID NO: 7732177 - DNA, 22 bp, Homo sapiens
agcctctccagagcctggcaga

SEQ ID NO: 7732178 - DNA, 22 bp, Homo sapiens
agcctctcagagtgctgggatt

SEQ ID NO: 7732179 - DNA, 22 bp, Homo sapiens
agcctctctgatgtgacagcta

SEQ ID NO: 7732180 - DNA, 22 bp, Homo sapiens
acagagccaaaaggacatagta

SEQ ID NO: 7732181 - DNA, 22 bp, Homo sapiens
acagagctaatgttgcataggc

SEQ ID NO: 7732182 - DNA, 22 bp, Homo sapiens
agccagggtgagagggctttgt

SEQ ID NO: 7732183 - DNA, 22 bp, Homo sapiens
acagagactgggatgcctgcct

SEQ ID NO: 7732184 - DNA, 22 bp, Homo sapiens
agcagctgtactttcatctgtt

SEQ ID NO: 7732185 - DNA, 22 bp, Homo sapiens
acacagaagatctcttaatgct

SEQ ID NO: 7732186 - DNA, 22 bp, Homo sapiens
agcagctggggcctgtgacgat

SEQ ID NO: 7732187 - DNA, 22 bp, Homo sapiens
agcagctgggtccggcggagca

SEQ ID NO: 7732188 - DNA, 22 bp, Homo sapiens
agcagctggtaggagtggccac

SEQ ID NO: 7732189 - DNA, 22 bp, Homo sapiens
agagggggtgtcagcactgcag

SEQ ID NO: 7732190 - DNA, 22 bp, Homo sapiens
agaggctctttgagctgggaga

SEQ ID NO: 7732191 - DNA, 22 bp, Homo sapiens
agaccctgttagttccagtctt

SEQ ID NO: 7732192 - DNA, 22 bp, Homo sapiens
agagcctggcaaaaggtcctgc

SEQ ID NO: 7732193 - DNA, 22 bp, Homo sapiens
agagcctggacttttctgagcc

SEQ ID NO: 7732194 - DNA, 22 bp, Homo sapiens
agagcctggaggttctgctgaa

SEQ ID NO: 7732195 - DNA, 22 bp, Homo sapiens
agagcctggacctgagctacaa

SEQ ID NO: 7732196 - DNA, 22 bp, Homo sapiens
agagcctgcatctagcctcaga

SEQ ID NO: 7732197 - DNA, 22 bp, Homo sapiens
agagccaggtgtagtctcggag

SEQ ID NO: 7732198 - DNA, 22 bp, Homo sapiens
agagccaggctctacctgggtt

SEQ ID NO: 7732199 - DNA, 22 bp, Homo sapiens
agagccaggcggctgggcacct

SEQ ID NO: 7732200 - DNA, 21 bp, Homo sapiens
aatcaggaagtgtgtgtcctg

SEQ ID NO: 7732201 - DNA, 22 bp, Homo sapiens
aaggctccctcttctcgagtgt

SEQ ID NO: 7732202 - DNA, 22 bp, Homo sapiens
aaggcctcaggtgaggctgccc

SEQ ID NO: 7732203 - DNA, 22 bp, Homo sapiens
aaggcctccctgtgtgcaggtg

SEQ ID NO: 7732204 - DNA, 22 bp, Homo sapiens
aaggcctccgccaatggcagag

SEQ ID NO: 7732205 - DNA, 22 bp, Homo sapiens
aaggccttgccgaaggatgcca

SEQ ID NO: 7732206 - DNA, 22 bp, Homo sapiens
accaggcccaccgcatgctcct

SEQ ID NO: 7732207 - DNA, 22 bp, Homo sapiens
acagggcagagaggcaggcttg

SEQ ID NO: 7732208 - DNA, 22 bp, Homo sapiens
acagggcagagtgaaatgctat

SEQ ID NO: 7732209 - DNA, 20 bp, Homo sapiens
aagaaaacgtcttcagggga

SEQ ID NO: 7732210 - DNA, 22 bp, Homo sapiens
aagaacagattcagcctgaact

SEQ ID NO: 7732211 - DNA, 22 bp, Homo sapiens
aacatgtatcgctttttaatat

SEQ ID NO: 7732212 - DNA, 22 bp, Homo sapiens
aatggctctgatgttgttgtga

SEQ ID NO: 7732213 - DNA, 22 bp, Homo sapiens
aactaggagtttttcttgagaa

SEQ ID NO: 7732214 - DNA, 22 bp, Homo sapiens
aacccaggaggcagaggctgca

SEQ ID NO: 7732215 - DNA, 22 bp, Homo sapiens
aacccaggagttggaggctgtg

SEQ ID NO: 7732216 - DNA, 22 bp, Homo sapiens
aacccagggtgaggggagtcta

SEQ ID NO: 7732217 - DNA, 22 bp, Homo sapiens
aaagcctgggttcctcactatc

SEQ ID NO: 7732218 - DNA, 22 bp, Homo sapiens
gtccagggggcttaagcaaact

SEQ ID NO: 7732219 - DNA, 20 bp, Homo sapiens
gtctgaggagcagtgggaaa

SEQ ID NO: 7732220 - DNA, 22 bp, Homo sapiens
gtctggcagatcgagcagccca

SEQ ID NO: 7732221 - DNA, 22 bp, Homo sapiens
gtctggcctgccagctctggtg

SEQ ID NO: 7732222 - DNA, 22 bp, Homo sapiens
gtctggcacataagaggagctc

SEQ ID NO: 7732223 - DNA, 22 bp, Homo sapiens
gtgcctggcacacagaaggcaa

SEQ ID NO: 7732224 - DNA, 22 bp, Homo sapiens
gtgcctggcagggtcagctgct

SEQ ID NO: 7732225 - DNA, 22 bp, Homo sapiens
gtgcctggcatgcgccggtgct

SEQ ID NO: 7732226 - DNA, 22 bp, Homo sapiens
gtgcctggagctaatgtgtata

SEQ ID NO: 7732227 - DNA, 20 bp, Homo sapiens
gtgcctggagaagaggctgt

SEQ ID NO: 7732228 - DNA, 22 bp, Homo sapiens
gtgacaatattagctcaggggc

SEQ ID NO: 7732229 - DNA, 22 bp, Homo sapiens
gtgcctggaactgggtaggctg

SEQ ID NO: 7732230 - DNA, 22 bp, Homo sapiens
gtgcctggaccctctttccgga

SEQ ID NO: 7732231 - DNA, 22 bp, Homo sapiens
gtgcctggaatgcgcctcggcg

SEQ ID NO: 7732232 - DNA, 22 bp, Homo sapiens
gtgcctgagccagctgcagctc

SEQ ID NO: 7732233 - DNA, 22 bp, Homo sapiens
gtgaccacttcaaattctagat

SEQ ID NO: 7732234 - DNA, 22 bp, Homo sapiens
gtggcagcaaatgcctggacta

SEQ ID NO: 7732235 - DNA, 22 bp, Homo sapiens
gtggccagaggtcccatgtgtc

SEQ ID NO: 7732236 - DNA, 22 bp, Homo sapiens
gtggccagctgtcagcaccctt

SEQ ID NO: 7732237 - DNA, 22 bp, Homo sapiens
gtgtgtccctcctctcctgagt

SEQ ID NO: 7732238 - DNA, 22 bp, Homo sapiens
gtgtcaggcagtcagcatggag

SEQ ID NO: 7732239 - DNA, 19 bp, Homo sapiens
gtgtcaggatgtgcagggg

SEQ ID NO: 7732240 - DNA, 22 bp, Homo sapiens
ggctgctctgccttccagctgg

SEQ ID NO: 7732241 - DNA, 22 bp, Homo sapiens
ggcttccagctgggccttggag

SEQ ID NO: 7732242 - DNA, 22 bp, Homo sapiens
ggcctgggcccactgtcaagag

SEQ ID NO: 7732243 - DNA, 22 bp, Homo sapiens
ggcctgggcctttgtgttttga

SEQ ID NO: 7732244 - DNA, 22 bp, Homo sapiens
ggccttcctggcggctcagggt

SEQ ID NO: 7732245 - DNA, 22 bp, Homo sapiens
ggctcaggatgagccttctcat

SEQ ID NO: 7732246 - DNA, 22 bp, Homo sapiens
ggctcaggccagaccacgactc

SEQ ID NO: 7732247 - DNA, 22 bp, Homo sapiens
ggctcaggtttccttcccagct

SEQ ID NO: 7732248 - DNA, 22 bp, Homo sapiens
ggccagaggccacagctgtgtc

SEQ ID NO: 7732249 - DNA, 22 bp, Homo sapiens
ggccagaggccatcctcctgct

SEQ ID NO: 7732250 - DNA, 22 bp, Homo sapiens
ggccagagagccgctgttagga

SEQ ID NO: 7732251 - DNA, 22 bp, Homo sapiens
ggccagactgagtgaggtcaag

SEQ ID NO: 7732252 - DNA, 22 bp, Homo sapiens
ggccagagaagtcagacccttg

SEQ ID NO: 7732253 - DNA, 22 bp, Homo sapiens
ggccagacatatcgctcccaaa

SEQ ID NO: 7732254 - DNA, 22 bp, Homo sapiens
gggctagcctcttccctgctcc

SEQ ID NO: 7732255 - DNA, 22 bp, Homo sapiens
ggggacagtcgatctagtgatt

SEQ ID NO: 7732256 - DNA, 23 bp, Homo sapiens
ggggacagagggcagcccgcatc

SEQ ID NO: 7732257 - DNA, 22 bp, Homo sapiens
ggggaccctcaggactgcgtct

SEQ ID NO: 7732258 - DNA, 22 bp, Homo sapiens
gggcctgttctgattggcagat

SEQ ID NO: 7732259 - DNA, 22 bp, Homo sapiens
gggcctgtgtgttcaggagcct

SEQ ID NO: 7732260 - DNA, 22 bp, Homo sapiens
gggcctgtatgggtctcagata

SEQ ID NO: 7732261 - DNA, 22 bp, Homo sapiens
gggcccagccctctgctcactg

SEQ ID NO: 7732262 - DNA, 22 bp, Homo sapiens
gggccaggtggaccccagcctc

SEQ ID NO: 7732263 - DNA, 22 bp, Homo sapiens
gggcagcagagccctgccgagt

SEQ ID NO: 7732264 - DNA, 18 bp, Homo sapiens
gggcagcacagcagcctc

SEQ ID NO: 7732265 - DNA, 22 bp, Homo sapiens
ggaagaaatgctcttctatgcg

SEQ ID NO: 7732266 - DNA, 22 bp, Homo sapiens
ggaagaaagcacacaaacttga

SEQ ID NO: 7732267 - DNA, 22 bp, Homo sapiens
ggcagctctgctccttggctcc

SEQ ID NO: 7732268 - DNA, 19 bp, Homo sapiens
ggcagctggacgctgttca

SEQ ID NO: 7732269 - DNA, 22 bp, Homo sapiens
ggcaggcctgagaggcagggct

SEQ ID NO: 7732270 - DNA, 22 bp, Homo sapiens
ggcacagagctccagccttggc

SEQ ID NO: 7732271 - DNA, 22 bp, Homo sapiens
ggaggccttgaggccaggagct

SEQ ID NO: 7732272 - DNA, 22 bp, Homo sapiens
ggaggtgggagcctccagtggt

SEQ ID NO: 7732273 - DNA, 22 bp, Homo sapiens
gctctctttttccagtggtggt

SEQ ID NO: 7732274 - DNA, 22 bp, Homo sapiens
gctctctttccatgtggaggat

SEQ ID NO: 7732275 - DNA, 22 bp, Homo sapiens
gctctctttgtgccacttaagg

SEQ ID NO: 7732276 - DNA, 22 bp, Homo sapiens
gctctctttcacagaggtagga

SEQ ID NO: 7732277 - DNA, 22 bp, Homo sapiens
gctctctttaaactgcatggct

SEQ ID NO: 7732278 - DNA, 21 bp, Homo sapiens
gctctgccacttaccagattt

SEQ ID NO: 7732279 - DNA, 22 bp, Homo sapiens
gctcctggccagcacagggccc

SEQ ID NO: 7732280 - DNA, 22 bp, Homo sapiens
gctcagagatgtctgctgcctt

SEQ ID NO: 7732281 - DNA, 22 bp, Homo sapiens
gctcagagataaaactgatcag

SEQ ID NO: 7732282 - DNA, 22 bp, Homo sapiens
gctgcctgaatgaaccttgttc

SEQ ID NO: 7732283 - DNA, 22 bp, Homo sapiens
gctgcctggagaggcagggatg

SEQ ID NO: 7732284 - DNA, 22 bp, Homo sapiens
gctgcctggagctcagcctgcc

SEQ ID NO: 7732285 - DNA, 22 bp, Homo sapiens
gctgcctggctgatgaaaattc

SEQ ID NO: 7732286 - DNA, 22 bp, Homo sapiens
gctgcctggatttgcaatcctc

SEQ ID NO: 7732287 - DNA, 22 bp, Homo sapiens
gctgcctgggcaggaggcgctg

SEQ ID NO: 7732288 - DNA, 22 bp, Homo sapiens
gctgcctggctttagtccactt

SEQ ID NO: 7732289 - DNA, 22 bp, Homo sapiens
gctgcctgctcacccggcctgg

SEQ ID NO: 7732290 - DNA, 22 bp, Homo sapiens
gctgcctgatcatacaccaggg

SEQ ID NO: 7732291 - DNA, 22 bp, Homo sapiens
gctgcctgatgtccagcaggac

SEQ ID NO: 7732292 - DNA, 22 bp, Homo sapiens
gctgcctgcttcatgtgggaga

SEQ ID NO: 7732293 - DNA, 22 bp, Homo sapiens
gctgcctggaataacggctggc

SEQ ID NO: 7732294 - DNA, 22 bp, Homo sapiens
gctgcctgctcggctcctggga

SEQ ID NO: 7732295 - DNA, 22 bp, Homo sapiens
gctgcctggtttctcagctgca

SEQ ID NO: 7732296 - DNA, 22 bp, Homo sapiens
gctgcctgtcccaggatgagga

SEQ ID NO: 7732297 - DNA, 22 bp, Homo sapiens
gctgcctgggctggcattccca

SEQ ID NO: 7732298 - DNA, 22 bp, Homo sapiens
gctggcctgagggccgaggctc

SEQ ID NO: 7732299 - DNA, 22 bp, Homo sapiens
gctggcctgaccagccacaggc

SEQ ID NO: 7732300 - DNA, 22 bp, Homo sapiens
gctgggcaccggagagacccca

SEQ ID NO: 7732301 - DNA, 22 bp, Homo sapiens
gctgggagttactgtctccttt

SEQ ID NO: 7732302 - DNA, 22 bp, Homo sapiens
gctggcctgggcagcctgtcgg

SEQ ID NO: 7732303 - DNA, 22 bp, Homo sapiens
gctggcctgctgggcaccaccg

SEQ ID NO: 7732304 - DNA, 20 bp, Homo sapiens
gcctgcctcagctagctgag

SEQ ID NO: 7732305 - DNA, 22 bp, Homo sapiens
gcctgcctcaaaatcccagttc

SEQ ID NO: 7732306 - DNA, 18 bp, Homo sapiens
gcctgccaactcctgatc

SEQ ID NO: 7732307 - DNA, 22 bp, Homo sapiens
gcctgccaaaagaagctgctgg

SEQ ID NO: 7732308 - DNA, 18 bp, Homo sapiens
gcctgccatccccacagc

SEQ ID NO: 7732309 - DNA, 18 bp, Homo sapiens
gcctgccagccgagggac

SEQ ID NO: 7732310 - DNA, 22 bp, Homo sapiens
gcctgccttcggtgcgcagcgg

SEQ ID NO: 7732311 - DNA, 19 bp, Homo sapiens
gcctgcctgggtttctgag

SEQ ID NO: 7732312 - DNA, 22 bp, Homo sapiens
gcctgcctgctgtgtgcaagtt

SEQ ID NO: 7732313 - DNA, 21 bp, Homo sapiens
gcctgcctgcgtgaccctctt

SEQ ID NO: 7732314 - DNA, 22 bp, Homo sapiens
gcctgcctgctgtcatctgcct

SEQ ID NO: 7732315 - DNA, 22 bp, Homo sapiens
gcctgccttttggaggcacatt

SEQ ID NO: 7732316 - DNA, 22 bp, Homo sapiens
gcctggcctgaactaggaggtg

SEQ ID NO: 7732317 - DNA, 22 bp, Homo sapiens
gcctgggaaatggtggggtcag

SEQ ID NO: 7732318 - DNA, 21 bp, Homo sapiens
gcctgggaaatctgggaagcc

SEQ ID NO: 7732319 - DNA, 22 bp, Homo sapiens
gcctgggaaagagtagggaaat

SEQ ID NO: 7732320 - DNA, 22 bp, Homo sapiens
gcctggccaacgtggtgaaacc

SEQ ID NO: 7732321 - DNA, 17 bp, Homo sapiens
gcctggcccagcctggc

SEQ ID NO: 7732322 - DNA, 22 bp, Homo sapiens
gcctggccgctccgagctccgc

SEQ ID NO: 7732323 - DNA, 22 bp, Homo sapiens
gcctggcccagggctcttgttg

SEQ ID NO: 7732324 - DNA, 22 bp, Homo sapiens
gcctgggactgcagatccccag

SEQ ID NO: 7732325 - DNA, 23 bp, Homo sapiens
gcctgggactggtagtgtgacct

SEQ ID NO: 7732326 - DNA, 22 bp, Homo sapiens
gcctgggactggatgtgtttgt

SEQ ID NO: 7732327 - DNA, 23 bp, Homo sapiens
gcctgggactcaggaggagctca

SEQ ID NO: 7732328 - DNA, 21 bp, Homo sapiens
gcctgggaagagaaaggtaag

SEQ ID NO: 7732329 - DNA, 22 bp, Homo sapiens
gcctgggacccttagctcttgg

SEQ ID NO: 7732330 - DNA, 22 bp, Homo sapiens
gcctgggaagactaagtgggag

SEQ ID NO: 7732331 - DNA, 22 bp, Homo sapiens
gcctgggaactctgatctcctg

SEQ ID NO: 7732332 - DNA, 21 bp, Homo sapiens
gcctgggatagtggcctccgg

SEQ ID NO: 7732333 - DNA, 22 bp, Homo sapiens
gcctgggagaatgacctccaac

SEQ ID NO: 7732334 - DNA, 18 bp, Homo sapiens
gcctgggagaagtttcac

SEQ ID NO: 7732335 - DNA, 22 bp, Homo sapiens
gcctgggatagaggcaatgcat

SEQ ID NO: 7732336 - DNA, 19 bp, Homo sapiens
gcctgggatgggcagaact

SEQ ID NO: 7732337 - DNA, 22 bp, Homo sapiens
gcctgggattcccagaggggca

SEQ ID NO: 7732338 - DNA, 20 bp, Homo sapiens
gcctgggattatccactggt

SEQ ID NO: 7732339 - DNA, 22 bp, Homo sapiens
gcctgggattctcaaaggggtg

SEQ ID NO: 7732340 - DNA, 22 bp, Homo sapiens
gcctgggattgtgtaagtgaat

SEQ ID NO: 7732341 - DNA, 22 bp, Homo sapiens
gcctgtgtggatgcgccggtgc

SEQ ID NO: 7732342 - DNA, 22 bp, Homo sapiens
gccagtgtgtcatccggctgca

SEQ ID NO: 7732343 - DNA, 22 bp, Homo sapiens
gccaggctgactcccccggcct

SEQ ID NO: 7732344 - DNA, 22 bp, Homo sapiens
gccaggctgctccagggaggcc

SEQ ID NO: 7732345 - DNA, 22 bp, Homo sapiens
gccaggctgctggctgctgtcc

SEQ ID NO: 7732346 - DNA, 23 bp, Homo sapiens
gccatggctgccccacaggcctc

SEQ ID NO: 7732347 - DNA, 19 bp, Homo sapiens
gccatgggctggcagcaga

SEQ ID NO: 7732348 - DNA, 22 bp, Homo sapiens
gccatggggagggcagcgcctg

SEQ ID NO: 7732349 - DNA, 22 bp, Homo sapiens
gccatggggctcagctgcacta

SEQ ID NO: 7732350 - DNA, 22 bp, Homo sapiens
gccatgggtctgctggctcagc

SEQ ID NO: 7732351 - DNA, 22 bp, Homo sapiens
gccctctcggcatagcaggggc

SEQ ID NO: 7732352 - DNA, 22 bp, Homo sapiens
gccctctcttctgcagcctcca

SEQ ID NO: 7732353 - DNA, 22 bp, Homo sapiens
gccgtgtcatctgcgggtggca

SEQ ID NO: 7732354 - DNA, 22 bp, Homo sapiens
gcatggcttcggggtgctgcct

SEQ ID NO: 7732355 - DNA, 22 bp, Homo sapiens
gcagggcagccacaggccccct

SEQ ID NO: 7732356 - DNA, 22 bp, Homo sapiens
gcagggcagacctccagcctat

SEQ ID NO: 7732357 - DNA, 22 bp, Homo sapiens
gcagggcacagacagtgccaag

SEQ ID NO: 7732358 - DNA, 22 bp, Homo sapiens
gcagagccctgggggtatggtg

SEQ ID NO: 7732359 - DNA, 21 bp, Homo sapiens
gcagagcctgaggttcttgag

SEQ ID NO: 7732360 - DNA, 22 bp, Homo sapiens
gcagagcctgtgtctgagcaaa

SEQ ID NO: 7732361 - DNA, 22 bp, Homo sapiens
gcagagcctgggggtctgcgga

SEQ ID NO: 7732362 - DNA, 18 bp, Homo sapiens
gcagctgacactggagtt

SEQ ID NO: 7732363 - DNA, 22 bp, Homo sapiens
gcaggagaaatgaagattgggt

SEQ ID NO: 7732364 - DNA, 22 bp, Homo sapiens
gcaggagacaactgtaaggaga

SEQ ID NO: 7732365 - DNA, 22 bp, Homo sapiens
gcaggagctgctctcctgacga

SEQ ID NO: 7732366 - DNA, 22 bp, Homo sapiens
gcaggagctcgtttccaggctg

SEQ ID NO: 7732367 - DNA, 22 bp, Homo sapiens
gcagagccaggagagacccttg

SEQ ID NO: 7732368 - DNA, 22 bp, Homo sapiens
gcagagccagaatggccaggac

SEQ ID NO: 7732369 - DNA, 22 bp, Homo sapiens
gcagagccaggagcccaggatc

SEQ ID NO: 7732370 - DNA, 22 bp, Homo sapiens
gcagagccaggctggggcaggt

SEQ ID NO: 7732371 - DNA, 22 bp, Homo sapiens
gcagagccccattgctggcggg

SEQ ID NO: 7732372 - DNA, 22 bp, Homo sapiens
gatgtacaaagagaggatttca

SEQ ID NO: 7732373 - DNA, 22 bp, Homo sapiens
gagctgggacatgggtcctctc

SEQ ID NO: 7732374 - DNA, 22 bp, Homo sapiens
gagctggaagtctgtggtcaga

SEQ ID NO: 7732375 - DNA, 22 bp, Homo sapiens
gagctggaggaccaggactggg

SEQ ID NO: 7732376 - DNA, 22 bp, Homo sapiens
gagctggaggcagtgctgaggt

SEQ ID NO: 7732377 - DNA, 22 bp, Homo sapiens
gaggaagggctgcctgccgggc

SEQ ID NO: 7732378 - DNA, 20 bp, Homo sapiens
gaggcctcagcctcagctcc

SEQ ID NO: 7732379 - DNA, 18 bp, Homo sapiens
gaggcctgagaaccaggt

SEQ ID NO: 7732380 - DNA, 22 bp, Homo sapiens
gaggcctcttctttgttaacct

SEQ ID NO: 7732381 - DNA, 21 bp, Homo sapiens
gaggcctcagcctcagctcct

SEQ ID NO: 7732382 - DNA, 22 bp, Homo sapiens
gaggcctcaggaatgtcgtgtg

SEQ ID NO: 7732383 - DNA, 22 bp, Homo sapiens
gaggcctctgtcccaccaggga

SEQ ID NO: 7732384 - DNA, 22 bp, Homo sapiens
ctggctgggagctcgcctgcgg

SEQ ID NO: 7732385 - DNA, 22 bp, Homo sapiens
gacccagggtttctgcacaggg

SEQ ID NO: 7732386 - DNA, 22 bp, Homo sapiens
gacccaggagagagggttgcat

SEQ ID NO: 7732387 - DNA, 22 bp, Homo sapiens
gacccaggagtgcagagagtgg

SEQ ID NO: 7732388 - DNA, 22 bp, Homo sapiens
gacccagggtggtcacctgaaa

SEQ ID NO: 7732389 - DNA, 22 bp, Homo sapiens
gacccagggtatccagagctgc

SEQ ID NO: 7732390 - DNA, 22 bp, Homo sapiens
gagagctccttcaggaagcttc

SEQ ID NO: 7732391 - DNA, 22 bp, Homo sapiens
gagagctaggccactggggctt

SEQ ID NO: 7732392 - DNA, 22 bp, Homo sapiens
gagaaaagcgaaggacctggag

SEQ ID NO: 7732393 - DNA, 20 bp, Homo sapiens
gacaggagagttaggtaggt

SEQ ID NO: 7732394 - DNA, 17 bp, Homo sapiens
gaaggcctgcacaggcc

SEQ ID NO: 7732395 - DNA, 22 bp, Homo sapiens
gaaggcctcactctgcagcata

SEQ ID NO: 7732396 - DNA, 22 bp, Homo sapiens
cctgggccttgacctcgtgggc

SEQ ID NO: 7732397 - DNA, 22 bp, Homo sapiens
cctgggcctcacccagctcttg

SEQ ID NO: 7732398 - DNA, 22 bp, Homo sapiens
cctgggcatcaacaagcagaga

SEQ ID NO: 7732399 - DNA, 22 bp, Homo sapiens
cctgggccctcaccgccggtgg

SEQ ID NO: 7732400 - DNA, 21 bp, Homo sapiens
cctgggccaaattccctggac

SEQ ID NO: 7732401 - DNA, 19 bp, Homo sapiens
cctggctctgagcccagcc

SEQ ID NO: 7732402 - DNA, 21 bp, Homo sapiens
cctggctgcacagttgctggt

SEQ ID NO: 7732403 - DNA, 21 bp, Homo sapiens
cctggagacaaagacagggtg

SEQ ID NO: 7732404 - DNA, 22 bp, Homo sapiens
cctggagacctgatggcagcgg

SEQ ID NO: 7732405 - DNA, 22 bp, Homo sapiens
cctgccagtgaagctgacgggc

SEQ ID NO: 7732406 - DNA, 22 bp, Homo sapiens
cctgcccacagagagggtgcat

SEQ ID NO: 7732407 - DNA, 22 bp, Homo sapiens
cctggcacgaagggctgaggtt

SEQ ID NO: 7732408 - DNA, 22 bp, Homo sapiens
cctggcagttttgcccaggatt

SEQ ID NO: 7732409 - DNA, 22 bp, Homo sapiens
cctggccagggtctgggctgct

SEQ ID NO: 7732410 - DNA, 22 bp, Homo sapiens
cctggccagtttccaggccctg

SEQ ID NO: 7732411 - DNA, 22 bp, Homo sapiens
cctggccatagggcccaggaaa

SEQ ID NO: 7732412 - DNA, 22 bp, Homo sapiens
cctggccaggctctcagcactg

SEQ ID NO: 7732413 - DNA, 22 bp, Homo sapiens
cctggccaggctccaagtactg

SEQ ID NO: 7732414 - DNA, 22 bp, Homo sapiens
cctggccaggcatggagtcaca

SEQ ID NO: 7732415 - DNA, 22 bp, Homo sapiens
cctggccagctaattgcccatc

SEQ ID NO: 7732416 - DNA, 23 bp, Homo sapiens
cctggcagcaaacgaggaggtta

SEQ ID NO: 7732417 - DNA, 21 bp, Homo sapiens
cctggctccagaacttccggt

SEQ ID NO: 7732418 - DNA, 22 bp, Homo sapiens
cctggcctcgtgctcacggctc

SEQ ID NO: 7732419 - DNA, 22 bp, Homo sapiens
cctggctcgctgacctcagggg

SEQ ID NO: 7732420 - DNA, 22 bp, Homo sapiens
cctggctctctgcagatcctgg

SEQ ID NO: 7732421 - DNA, 22 bp, Homo sapiens
cctggctccgtgtcacgtgccc

SEQ ID NO: 7732422 - DNA, 22 bp, Homo sapiens
cctggctccctgcacagggctc

SEQ ID NO: 7732423 - DNA, 22 bp, Homo sapiens
cctccctttgttgcaagggaaa

SEQ ID NO: 7732424 - DNA, 22 bp, Homo sapiens
cctcccttggccatagccagcc

SEQ ID NO: 7732425 - DNA, 22 bp, Homo sapiens
cctccaagtttgactcaggaca

SEQ ID NO: 7732426 - DNA, 22 bp, Homo sapiens
cctccagcattactggcccatg

SEQ ID NO: 7732427 - DNA, 22 bp, Homo sapiens
cctccagccttcctgaagagcc

SEQ ID NO: 7732428 - DNA, 23 bp, Homo sapiens
cctctctttttaggtggtgtttg

SEQ ID NO: 7732429 - DNA, 22 bp, Homo sapiens
cctctctttcctacaccttgga

SEQ ID NO: 7732430 - DNA, 22 bp, Homo sapiens
cctctcttggatgtggatgggt

SEQ ID NO: 7732431 - DNA, 22 bp, Homo sapiens
cctctcttggccgcagtcttct

SEQ ID NO: 7732432 - DNA, 22 bp, Homo sapiens
tggctgcctcagtgtccctgca

SEQ ID NO: 7732433 - DNA, 22 bp, Homo sapiens
tggctgccctcatgggcctgat

SEQ ID NO: 7732434 - DNA, 16 bp, Homo sapiens
cctctcttattcctcc

SEQ ID NO: 7732435 - DNA, 23 bp, Homo sapiens
ccctggccttggggcacaggctg

SEQ ID NO: 7732436 - DNA, 22 bp, Homo sapiens
ccctccaccaagcagggcgcca

SEQ ID NO: 7732437 - DNA, 19 bp, Homo sapiens
ccctggagaataccctgga

SEQ ID NO: 7732438 - DNA, 22 bp, Homo sapiens
ccctccagggagccatgctggg

SEQ ID NO: 7732439 - DNA, 22 bp, Homo sapiens
cccaggagggtggcctctgccc

SEQ ID NO: 7732440 - DNA, 22 bp, Homo sapiens
tgccaggcgattgctatcagca

SEQ ID NO: 7732441 - DNA, 21 bp, Homo sapiens
tgccaggcctgagctggggtc

SEQ ID NO: 7732442 - DNA, 22 bp, Homo sapiens
ccccagggaagctttgcttact

SEQ ID NO: 7732443 - DNA, 22 bp, Homo sapiens
cccccaggggctccgcctcgtg

SEQ ID NO: 7732444 - DNA, 22 bp, Homo sapiens
tgcctgggacatgctgtggact

SEQ ID NO: 7732445 - DNA, 20 bp, Homo sapiens
tgcctgggaaggcgtggagg

SEQ ID NO: 7732446 - DNA, 22 bp, Homo sapiens
tgcctgggactgtactaaattt

SEQ ID NO: 7732447 - DNA, 22 bp, Homo sapiens
tgcctgggactctgttatcttg

SEQ ID NO: 7732448 - DNA, 22 bp, Homo sapiens
tgcctgggagtgaccaagactc

SEQ ID NO: 7732449 - DNA, 22 bp, Homo sapiens
cccaggctcctagaggcccaga

SEQ ID NO: 7732450 - DNA, 22 bp, Homo sapiens
tgcctgggctcaccgcctcttt

SEQ ID NO: 7732451 - DNA, 22 bp, Homo sapiens
tgcctgggccttcccacctctg

SEQ ID NO: 7732452 - DNA, 22 bp, Homo sapiens
tgcctgggatctgtgccctttg

SEQ ID NO: 7732453 - DNA, 22 bp, Homo sapiens
cccaggctgagttagaggtgtc

SEQ ID NO: 7732454 - DNA, 22 bp, Homo sapiens
ctgcctggaatgccagcttctc

SEQ ID NO: 7732455 - DNA, 22 bp, Homo sapiens
ctgcctgctctatccaggcctg

SEQ ID NO: 7732456 - DNA, 22 bp, Homo sapiens
ctgcctggaccggcagccctcc

SEQ ID NO: 7732457 - DNA, 22 bp, Homo sapiens
ctgcctggatgaatggcgcctt

SEQ ID NO: 7732458 - DNA, 22 bp, Homo sapiens
ctgcctggccacaacccagggt

SEQ ID NO: 7732459 - DNA, 22 bp, Homo sapiens
ctgcctggcatggagaagagaa

SEQ ID NO: 7732460 - DNA, 22 bp, Homo sapiens
ctgcctggcctgatctccacgc

SEQ ID NO: 7732461 - DNA, 22 bp, Homo sapiens
ctgcctggcccagggatgggcc

SEQ ID NO: 7732462 - DNA, 22 bp, Homo sapiens
ctgcctgggccatgcccagtcc

SEQ ID NO: 7732463 - DNA, 22 bp, Homo sapiens
ctggacagaaaccagtcctggg

SEQ ID NO: 7732464 - DNA, 22 bp, Homo sapiens
ctggacagaagtggctgggcag

SEQ ID NO: 7732465 - DNA, 22 bp, Homo sapiens
ctggacagaaaaggccactgga

SEQ ID NO: 7732466 - DNA, 22 bp, Homo sapiens
ctggccagttgtcctggcttgg

SEQ ID NO: 7732467 - DNA, 22 bp, Homo sapiens
ctggcctgagcacagcggctgc

SEQ ID NO: 7732468 - DNA, 22 bp, Homo sapiens
ctggcctgcagatcccagggtc

SEQ ID NO: 7732469 - DNA, 22 bp, Homo sapiens
ctggcatgccttgggtgcctct

SEQ ID NO: 7732470 - DNA, 23 bp, Homo sapiens
ctggccaccatctttctggcttc

SEQ ID NO: 7732471 - DNA, 22 bp, Homo sapiens
ctggccaggcggcccctgcatg

SEQ ID NO: 7732472 - DNA, 22 bp, Homo sapiens
ctggatccatcgggtcccgagt

SEQ ID NO: 7732473 - DNA, 22 bp, Homo sapiens
ctggatcccgtctgagcctcct

SEQ ID NO: 7732474 - DNA, 22 bp, Homo sapiens
ctggcagcagcttctggatcga

SEQ ID NO: 7732475 - DNA, 22 bp, Homo sapiens
ctggcaccccacactgtccacg

SEQ ID NO: 7732476 - DNA, 22 bp, Homo sapiens
ctgccaggcctccgctgtcccc

SEQ ID NO: 7732477 - DNA, 22 bp, Homo sapiens
ctgccaggcctggggtgctgtc

SEQ ID NO: 7732478 - DNA, 22 bp, Homo sapiens
ctgccaggggcctcacaggcca

SEQ ID NO: 7732479 - DNA, 22 bp, Homo sapiens
ctgccaggctgtcccaggtccg

SEQ ID NO: 7732480 - DNA, 22 bp, Homo sapiens
ctgcctccaggctcaccttgac

SEQ ID NO: 7732481 - DNA, 22 bp, Homo sapiens
ctgcctcctcacgtccacagtg

SEQ ID NO: 7732482 - DNA, 22 bp, Homo sapiens
ctgcctgcgttgcctcgtgcct

SEQ ID NO: 7732483 - DNA, 22 bp, Homo sapiens
ctgcctcctggctgatgggtag

SEQ ID NO: 7732484 - DNA, 22 bp, Homo sapiens
ctgccgtgagctttcgcgagcc

SEQ ID NO: 7732485 - DNA, 22 bp, Homo sapiens
ctgccatgcagttagtccctca

SEQ ID NO: 7732486 - DNA, 22 bp, Homo sapiens
ctgccatccacggcccactcat

SEQ ID NO: 7732487 - DNA, 22 bp, Homo sapiens
ctgccatctgagggtccagcct

SEQ ID NO: 7732488 - DNA, 22 bp, Homo sapiens
ctgccaggtgagctccaggcct

SEQ ID NO: 7732489 - DNA, 22 bp, Homo sapiens
ctgccaggttggcgctcgctct

SEQ ID NO: 7732490 - DNA, 22 bp, Homo sapiens
ctgcagagcatgaggaggtctg

SEQ ID NO: 7732491 - DNA, 19 bp, Homo sapiens
ctgaaaaacattctcagga

SEQ ID NO: 7732492 - DNA, 22 bp, Homo sapiens
ctctcctctgaagtggtgaccc

SEQ ID NO: 7732493 - DNA, 22 bp, Homo sapiens
ctctggcttagtatgctccaaa

SEQ ID NO: 7732494 - DNA, 22 bp, Homo sapiens
cggctggggctgtccccatgac

SEQ ID NO: 7732495 - DNA, 22 bp, Homo sapiens
cggctgggtagaggtgccgggt

SEQ ID NO: 7732496 - DNA, 23 bp, Homo sapiens
cggctgctcggccgagtcctcgg

SEQ ID NO: 7732497 - DNA, 22 bp, Homo sapiens
ctctccctcattgggttccatt

SEQ ID NO: 7732498 - DNA, 22 bp, Homo sapiens
ctcctctttagccccagctgga

SEQ ID NO: 7732499 - DNA, 22 bp, Homo sapiens
ctcctctttacccgcatggtct

SEQ ID NO: 7732500 - DNA, 22 bp, Homo sapiens
ctcctcttggaatgcgtggctc

SEQ ID NO: 7732501 - DNA, 22 bp, Homo sapiens
ctccagggcagcatggcagtgg

SEQ ID NO: 7732502 - DNA, 22 bp, Homo sapiens
ctccagggggcatccacacagc

SEQ ID NO: 7732503 - DNA, 22 bp, Homo sapiens
ctccaggcgcttaccaagcgct

SEQ ID NO: 7732504 - DNA, 22 bp, Homo sapiens
tacagggcatgtgcagacacat

SEQ ID NO: 7732505 - DNA, 22 bp, Homo sapiens
tacagggctgagtgagacatgg

SEQ ID NO: 7732506 - DNA, 22 bp, Homo sapiens
caggcagccaggggacctgtcc

SEQ ID NO: 7732507 - DNA, 22 bp, Homo sapiens
caggagccgccaggcacgttgg

SEQ ID NO: 7732508 - DNA, 22 bp, Homo sapiens
caggagagatatgagtccccac

SEQ ID NO: 7732509 - DNA, 22 bp, Homo sapiens
caggaggcccggccacagccca

SEQ ID NO: 7732510 - DNA, 22 bp, Homo sapiens
cagctgtgatatgcctgcctga

SEQ ID NO: 7732511 - DNA, 22 bp, Homo sapiens
cagcccagccgagggcctggct

SEQ ID NO: 7732512 - DNA, 19 bp, Homo sapiens
gtggccagggcaggggctg

SEQ ID NO: 7732513 - DNA, 22 bp, Homo sapiens
cagctgcctatgacctagcctc

SEQ ID NO: 7732514 - DNA, 22 bp, Homo sapiens
cagctgcctgcaacacaagctt

SEQ ID NO: 7732515 - DNA, 22 bp, Homo sapiens
gtgtgctgcccaactcgcagat

SEQ ID NO: 7732516 - DNA, 22 bp, Homo sapiens
gtgtctgttatacagaggagac

SEQ ID NO: 7732517 - DNA, 22 bp, Homo sapiens
ccactgccagctttgtcctccc

SEQ ID NO: 7732518 - DNA, 23 bp, Homo sapiens
ccacctggactctgggcaggtgc

SEQ ID NO: 7732519 - DNA, 22 bp, Homo sapiens
ccagagctgatgggcccagggt

SEQ ID NO: 7732520 - DNA, 20 bp, Homo sapiens
ccagacagcacctgcctggt

SEQ ID NO: 7732521 - DNA, 22 bp, Homo sapiens
ccagagctgattcctgggactt

SEQ ID NO: 7732522 - DNA, 22 bp, Homo sapiens
ccagagcttcggggcggctgta

SEQ ID NO: 7732523 - DNA, 23 bp, Homo sapiens
tcctcccaaatttcagcctcatt

SEQ ID NO: 7732524 - DNA, 22 bp, Homo sapiens
tcctcccaacttttccatctca

SEQ ID NO: 7732525 - DNA, 22 bp, Homo sapiens
ccacagctctagctccctccca

SEQ ID NO: 7732526 - DNA, 22 bp, Homo sapiens
tcccagggcagctgtccagaag

SEQ ID NO: 7732527 - DNA, 21 bp, Homo sapiens
tcccagggccaggtgccatca

SEQ ID NO: 7732528 - DNA, 21 bp, Homo sapiens
tctgtcagaaaagctgaggct

SEQ ID NO: 7732529 - DNA, 22 bp, Homo sapiens
ccagctggtgggtctttctctg

SEQ ID NO: 7732530 - DNA, 22 bp, Homo sapiens
ccagctggtgacatccccaacc

SEQ ID NO: 7732531 - DNA, 22 bp, Homo sapiens
ccagctggtttatattccccac

SEQ ID NO: 7732532 - DNA, 22 bp, Homo sapiens
tctgcctgagaagtggggtgcc

SEQ ID NO: 7732533 - DNA, 22 bp, Homo sapiens
tctgcctgaaattcacatgtaa

SEQ ID NO: 7732534 - DNA, 22 bp, Homo sapiens
tctgcctctttcaggcctggca

SEQ ID NO: 7732535 - DNA, 22 bp, Homo sapiens
tctctcttcaacccttaactag

SEQ ID NO: 7732536 - DNA, 22 bp, Homo sapiens
tctctcttcagagataccttgc

SEQ ID NO: 7732537 - DNA, 23 bp, Homo sapiens
tctctcttagctatgcttatggc

SEQ ID NO: 7732538 - DNA, 22 bp, Homo sapiens
tctctcttctttgttaagaatg

SEQ ID NO: 7732539 - DNA, 22 bp, Homo sapiens
tctctcttcatgcttttagaat

SEQ ID NO: 7732540 - DNA, 22 bp, Homo sapiens
tctctcttgtcaccccatctgc

SEQ ID NO: 7732541 - DNA, 22 bp, Homo sapiens
tctctcttgaagtattagctag

SEQ ID NO: 7732542 - DNA, 22 bp, Homo sapiens
ccagccagtcccgcatgaccgc

SEQ ID NO: 7732543 - DNA, 22 bp, Homo sapiens
ccagccagtccagcattggtgt

SEQ ID NO: 7732544 - DNA, 21 bp, Homo sapiens
ccagcccagcctccttctctt

SEQ ID NO: 7732545 - DNA, 22 bp, Homo sapiens
ccagcccaaacaagccgccttc

SEQ ID NO: 7732546 - DNA, 19 bp, Homo sapiens
ccagcccatagtccatcac

SEQ ID NO: 7732547 - DNA, 22 bp, Homo sapiens
ccagccctcactgaggcctctc

SEQ ID NO: 7732548 - DNA, 22 bp, Homo sapiens
tctgaggcagcttgccactcta

SEQ ID NO: 7732549 - DNA, 22 bp, Homo sapiens
tctgaggcccctgggcaggatg

SEQ ID NO: 7732550 - DNA, 22 bp, Homo sapiens
tctgaggccccagccctgcaca

SEQ ID NO: 7732551 - DNA, 22 bp, Homo sapiens
tctgaggcccagttcaactctt

SEQ ID NO: 7732552 - DNA, 22 bp, Homo sapiens
tctgaggcatacccaggccccc

SEQ ID NO: 7732553 - DNA, 19 bp, Homo sapiens
tctgcctctggtcaggctc

SEQ ID NO: 7732554 - DNA, 22 bp, Homo sapiens
tctgcctcgctaacagcagcca

SEQ ID NO: 7732555 - DNA, 22 bp, Homo sapiens
tctgccagccctgtgagtcttg

SEQ ID NO: 7732556 - DNA, 22 bp, Homo sapiens
tctgccagcaccatgatccttc

SEQ ID NO: 7732557 - DNA, 22 bp, Homo sapiens
catgggaataggttgttcttgg

SEQ ID NO: 7732558 - DNA, 20 bp, Homo sapiens
tccagcccagcagcctgaca

SEQ ID NO: 7732559 - DNA, 22 bp, Homo sapiens
tcagggccctggacaaccctcc

SEQ ID NO: 7732560 - DNA, 22 bp, Homo sapiens
tcagggccctcacttgcatagg

SEQ ID NO: 7732561 - DNA, 22 bp, Homo sapiens
tcagggccatcttttgcctcaa

SEQ ID NO: 7732562 - DNA, 22 bp, Homo sapiens
tcagggccaggactaggatgag

SEQ ID NO: 7732563 - DNA, 22 bp, Homo sapiens
tcagggcccagagctcaggcaa

SEQ ID NO: 7732564 - DNA, 19 bp, Homo sapiens
tcagggccatgagcgccac

SEQ ID NO: 7732565 - DNA, 22 bp, Homo sapiens
tcagggcattcaagaggcctgg

SEQ ID NO: 7732566 - DNA, 22 bp, Homo sapiens
tcagggccacaacaccagagtc

SEQ ID NO: 7732567 - DNA, 22 bp, Homo sapiens
tcagggccacgcggaggtgacg

SEQ ID NO: 7732568 - DNA, 22 bp, Homo sapiens
tcagggcatggctgcacttggc

SEQ ID NO: 7732569 - DNA, 22 bp, Homo sapiens
tcagccctgggacccagggatg

SEQ ID NO: 7732570 - DNA, 22 bp, Homo sapiens
tcagccctagcctcagtccagg

SEQ ID NO: 7732571 - DNA, 22 bp, Homo sapiens
tcagccctgaggacagaggcag

SEQ ID NO: 7732572 - DNA, 22 bp, Homo sapiens
cagtgctgagagcctggccagg

SEQ ID NO: 7732573 - DNA, 22 bp, Homo sapiens
cagtgctgcatctccatgccag

SEQ ID NO: 7732574 - DNA, 22 bp, Homo sapiens
cagtcctctcactcaggccttt

SEQ ID NO: 7732575 - DNA, 20 bp, Homo sapiens
tgtgagagggtggcttgccc

SEQ ID NO: 7732576 - DNA, 22 bp, Homo sapiens
tgtgcctgtcaccctcagagag

SEQ ID NO: 7732577 - DNA, 22 bp, Homo sapiens
tgtgcctgagtctcggcccacc

SEQ ID NO: 7732578 - DNA, 22 bp, Homo sapiens
tgtgcctggatctctgtgacaa

SEQ ID NO: 7732579 - DNA, 22 bp, Homo sapiens
tgtgtcagaaggcaatggggat

SEQ ID NO: 7732580 - DNA, 23 bp, Homo sapiens
ttccagagtccacatctgccacc

SEQ ID NO: 7732581 - DNA, 22 bp, Homo sapiens
ttccagagtcagccactgggag

SEQ ID NO: 7732582 - DNA, 22 bp, Homo sapiens
ttccagaggcttcagggaagaa

SEQ ID NO: 7732583 - DNA, 22 bp, Homo sapiens
ttccagaggttctcagccctgt

SEQ ID NO: 7732584 - DNA, 22 bp, Homo sapiens
ttccagaggggaggtggcagcc

SEQ ID NO: 7732585 - DNA, 22 bp, Homo sapiens
ttccagaggctctaggggagaa

SEQ ID NO: 7732586 - DNA, 22 bp, Homo sapiens
tgtcctgggaggcggggtccag

SEQ ID NO: 7732587 - DNA, 22 bp, Homo sapiens
tgtcctgggaactcacagtcca

SEQ ID NO: 7732588 - DNA, 22 bp, Homo sapiens
tgtcctgggtcaaatcctggtc

SEQ ID NO: 7732589 - DNA, 22 bp, Homo sapiens
tgtcctggggacaagaggccct

SEQ ID NO: 7732590 - DNA, 22 bp, Homo sapiens
tgtcctggtgctccaggtggct

SEQ ID NO: 7732591 - DNA, 22 bp, Homo sapiens
tgtcctgggtcaaccaggtcga

SEQ ID NO: 7732592 - DNA, 22 bp, Homo sapiens
tgtccagggatggggtcaggga

SEQ ID NO: 7732593 - DNA, 22 bp, Homo sapiens
tgtccaggtcagcagcagggac

SEQ ID NO: 7732594 - DNA, 22 bp, Homo sapiens
tgggctggtgagggatcattta

SEQ ID NO: 7732595 - DNA, 22 bp, Homo sapiens
tgggctggctgaggcattcact

SEQ ID NO: 7732596 - DNA, 22 bp, Homo sapiens
tgggctggcgtggagagtttag

SEQ ID NO: 7732597 - DNA, 22 bp, Homo sapiens
tgggctggctgaacttcaacct

SEQ ID NO: 7732598 - DNA, 22 bp, Homo sapiens
tgggcctctgccacgctccccc

SEQ ID NO: 7732599 - DNA, 22 bp, Homo sapiens
tgggcctcatgcccagccaccc

SEQ ID NO: 7732600 - DNA, 22 bp, Homo sapiens
tgggccagttggtgactacaaa

SEQ ID NO: 7732601 - DNA, 22 bp, Homo sapiens
tgggccagttatttcacctctg

SEQ ID NO: 7732602 - DNA, 22 bp, Homo sapiens
tgggccagtccagccccaggga

SEQ ID NO: 7732603 - DNA, 22 bp, Homo sapiens
tgggccagtagctactcgcaag

SEQ ID NO: 7732604 - DNA, 22 bp, Homo sapiens
tgggccagctccctgcccctgg

SEQ ID NO: 7732605 - DNA, 22 bp, Homo sapiens
tgggccagctgaagtgccgccc

SEQ ID NO: 7732606 - DNA, 22 bp, Homo sapiens
tgggcagccatcccagcctctc

SEQ ID NO: 7732607 - DNA, 23 bp, Homo sapiens
tgggcagcttctgcatgcccacc

SEQ ID NO: 7732608 - DNA, 22 bp, Homo sapiens
tgggcagcatcctccacagtca

SEQ ID NO: 7732609 - DNA, 22 bp, Homo sapiens
tgggcagcaaagactgtgtgct

SEQ ID NO: 7732610 - DNA, 22 bp, Homo sapiens
tgggcacagaatagatggccca

SEQ ID NO: 7732611 - DNA, 22 bp, Homo sapiens
tgggatggcatcctgggccttg

SEQ ID NO: 7732612 - DNA, 22 bp, Homo sapiens
tgcttccctcacttcacctggc

SEQ ID NO: 7732613 - DNA, 22 bp, Homo sapiens
tgctgggctgttcctgtccatg

SEQ ID NO: 7732614 - DNA, 22 bp, Homo sapiens
tgctgggcttgaaagctgctaa

SEQ ID NO: 7732615 - DNA, 22 bp, Homo sapiens
tgctgggcttcacccccacagt

SEQ ID NO: 7732616 - DNA, 23 bp, Homo sapiens
tgctgtccaacagactggccatg

SEQ ID NO: 7732617 - DNA, 22 bp, Homo sapiens
tgctgccagccaggccatggag

SEQ ID NO: 7732618 - DNA, 22 bp, Homo sapiens
tgctgcctaataagtcgagggt

SEQ ID NO: 7732619 - DNA, 22 bp, Homo sapiens
tgcctgtgtatttccggcctgc

SEQ ID NO: 7732620 - DNA, 22 bp, Homo sapiens
tgcctgggtgccctctgctcct

SEQ ID NO: 7732621 - DNA, 22 bp, Homo sapiens
tgcctgggtgtaaagggccaac

SEQ ID NO: 7732622 - DNA, 22 bp, Homo sapiens
tgcctgggtgctggctggtcac

SEQ ID NO: 7732623 - DNA, 22 bp, Homo sapiens
tgcctgggctcggtagccatcg

SEQ ID NO: 7732624 - DNA, 22 bp, Homo sapiens
tgcctggggattgctctgggcc

SEQ ID NO: 7732625 - DNA, 22 bp, Homo sapiens
tgcctgggaaccaatcctggct

SEQ ID NO: 7732626 - DNA, 22 bp, Homo sapiens
tgcctgggtccaggccaagcct

SEQ ID NO: 7732627 - DNA, 22 bp, Homo sapiens
tgcctgggggactaaggccaaa

SEQ ID NO: 7732628 - DNA, 22 bp, Homo sapiens
tgcctggccctgacagccctgg

SEQ ID NO: 7732629 - DNA, 20 bp, Homo sapiens
tgcctggcctttctctgccc

SEQ ID NO: 7732630 - DNA, 22 bp, Homo sapiens
tgcctggctctatcagtggtgg

SEQ ID NO: 7732631 - DNA, 22 bp, Homo sapiens
tgcctggctgaggtgacaggtt

SEQ ID NO: 7732632 - DNA, 22 bp, Homo sapiens
tgctccaccctcacactcttcc

SEQ ID NO: 7732633 - DNA, 22 bp, Homo sapiens
tgctctggtcctccctcggcgc

SEQ ID NO: 7732634 - DNA, 22 bp, Homo sapiens
tgctgaggcatttggacagagt

SEQ ID NO: 7732635 - DNA, 22 bp, Homo sapiens
tgctgagggagcatcaaagaaa

SEQ ID NO: 7732636 - DNA, 22 bp, Homo sapiens
tggaccacatagtgaggccccc

SEQ ID NO: 7732637 - DNA, 22 bp, Homo sapiens
tggagccagagcgcagcctggg

SEQ ID NO: 7732638 - DNA, 22 bp, Homo sapiens
tggagaggagcaccatggccat

SEQ ID NO: 7732639 - DNA, 22 bp, Homo sapiens
tggagagcccgagacatcctgt

SEQ ID NO: 7732640 - DNA, 19 bp, Homo sapiens
tggagaggaaatgctgctc

SEQ ID NO: 7732641 - DNA, 22 bp, Homo sapiens
tggagagctatttggacctcca

SEQ ID NO: 7732642 - DNA, 22 bp, Homo sapiens
tggagagcgtgcttagcactct

SEQ ID NO: 7732643 - DNA, 22 bp, Homo sapiens
tggcctgatacttccagagttc

SEQ ID NO: 7732644 - DNA, 22 bp, Homo sapiens
tggcctgagttgtctgcaggcc

SEQ ID NO: 7732645 - DNA, 22 bp, Homo sapiens
tggccagacagagaggctttgt

SEQ ID NO: 7732646 - DNA, 17 bp, Homo sapiens
tggccagagcaggcccc

SEQ ID NO: 7732647 - DNA, 22 bp, Homo sapiens
tggccagagtccagtgagcctt

SEQ ID NO: 7732648 - DNA, 22 bp, Homo sapiens
tggcagggtcttgctgtgttgc

SEQ ID NO: 7732649 - DNA, 22 bp, Homo sapiens
tggcagggcctgctcatcatcc

SEQ ID NO: 7732650 - DNA, 22 bp, Homo sapiens
tggcagggagttcgttcacaac

SEQ ID NO: 7732651 - DNA, 22 bp, Homo sapiens
tggattcacaccattctcctgc

SEQ ID NO: 7732652 - DNA, 20 bp, Homo sapiens
tggcacagaacccttgccta

SEQ ID NO: 7732653 - DNA, 22 bp, Homo sapiens
tgggagaatcttgctctgctac

SEQ ID NO: 7732654 - DNA, 22 bp, Homo sapiens
tgggagagtctaaaaccgaggt

SEQ ID NO: 7732655 - DNA, 19 bp, Homo sapiens
tggctgggcgtgcctccgt

SEQ ID NO: 7732656 - DNA, 22 bp, Homo sapiens
tggctggggagccccgactccc

SEQ ID NO: 7732657 - DNA, 22 bp, Homo sapiens
tggctggggccacagttttcct

SEQ ID NO: 7732658 - DNA, 22 bp, Homo sapiens
tggctggggcctgaatcctgca

SEQ ID NO: 7732659 - DNA, 19 bp, Homo sapiens
tggctgggtgccaatggcc

SEQ ID NO: 7732660 - DNA, 22 bp, Homo sapiens
tggctgggggtgctatagctgc

SEQ ID NO: 7732661 - DNA, 22 bp, Homo sapiens
tggctgggtgctatccagtact

SEQ ID NO: 7732662 - DNA, 22 bp, Homo sapiens
tggctgggcccccacctgcctc

SEQ ID NO: 7732663 - DNA, 22 bp, Homo sapiens
tggctgggccgggccttgtgcc

SEQ ID NO: 7732664 - DNA, 22 bp, Homo sapiens
tgggaacagaggacttgactgt

SEQ ID NO: 7732665 - DNA, 22 bp, Homo sapiens
tggcctgggtcacaccagggtc

SEQ ID NO: 7732666 - DNA, 22 bp, Homo sapiens
tggctcaagtaacaaaaatata

SEQ ID NO: 7732667 - DNA, 22 bp, Homo sapiens
tgagagcctgtgttcaaatgcc

SEQ ID NO: 7732668 - DNA, 21 bp, Homo sapiens
tgagagcctccaaccggctac

SEQ ID NO: 7732669 - DNA, 22 bp, Homo sapiens
tgagagccagaagggcctgagg

SEQ ID NO: 7732670 - DNA, 23 bp, Homo sapiens
tgagagcctggcagcctgggttc

SEQ ID NO: 7732671 - DNA, 22 bp, Homo sapiens
tgagaacattcctcttcctggc

SEQ ID NO: 7732672 - DNA, 20 bp, Homo sapiens
tgagcctgctgtaggaggcc

SEQ ID NO: 7732673 - DNA, 22 bp, Homo sapiens
tgagccaggcactgctcctgga

SEQ ID NO: 7732674 - DNA, 22 bp, Homo sapiens
tgagccagataagggctcacgc

SEQ ID NO: 7732675 - DNA, 22 bp, Homo sapiens
tgaggcctacccccctgtgttt

SEQ ID NO: 7732676 - DNA, 17 bp, Homo sapiens
tgaggcctgcatcagtg

SEQ ID NO: 7732677 - DNA, 22 bp, Homo sapiens
tgaggcctgacagaccaagcct

SEQ ID NO: 7732678 - DNA, 22 bp, Homo sapiens
tgaggcctctgtgccatccagg

SEQ ID NO: 7732679 - DNA, 22 bp, Homo sapiens
tgaggcaggaggattgcaggat

SEQ ID NO: 7732680 - DNA, 22 bp, Homo sapiens
tgaggcaggagaatggcgggaa

SEQ ID NO: 7732681 - DNA, 23 bp, Homo sapiens
tgaggcaggcggatcacgaggtc

SEQ ID NO: 7732682 - DNA, 22 bp, Homo sapiens
tgaggcaggagttcaggctgcg

SEQ ID NO: 7732683 - DNA, 22 bp, Homo sapiens
tgcccagggtggagtgcagcgg

SEQ ID NO: 7732684 - DNA, 22 bp, Homo sapiens
tgcccaggctggagtgcagagg

SEQ ID NO: 7732685 - DNA, 22 bp, Homo sapiens
tgcccaggctggagtgcagtgg

SEQ ID NO: 7732686 - DNA, 22 bp, Homo sapiens
tgcccagggtggagtgcagtgg

SEQ ID NO: 7732687 - DNA, 22 bp, Homo sapiens
tgccaggctccggaacgacagt

SEQ ID NO: 7732688 - DNA, 22 bp, Homo sapiens
tgccaggctgaacagggtctta

SEQ ID NO: 7732689 - DNA, 20 bp, Homo sapiens
tgccaggctgcacgcctgcc

SEQ ID NO: 7732690 - DNA, 22 bp, Homo sapiens
tgccaggctgtcctgggcctgg

SEQ ID NO: 7732691 - DNA, 22 bp, Homo sapiens
tgccaggctgtcaattcaccca

SEQ ID NO: 7732692 - DNA, 22 bp, Homo sapiens
tgccaggctgccctccagtctg

SEQ ID NO: 7732693 - DNA, 20 bp, Homo sapiens
tgccagggccagcagaggct

SEQ ID NO: 7732694 - DNA, 21 bp, Homo sapiens
tgccagggatttacagagcct

SEQ ID NO: 7732695 - DNA, 22 bp, Homo sapiens
tgccaggcttagagcaggggct

SEQ ID NO: 7732696 - DNA, 22 bp, Homo sapiens
tgccaggctttggtcaaaggct

SEQ ID NO: 7732697 - DNA, 22 bp, Homo sapiens
tgccaggggacctagggatgtc

SEQ ID NO: 7732698 - DNA, 22 bp, Homo sapiens
tgccagggccatagggagtcta

SEQ ID NO: 7732699 - DNA, 22 bp, Homo sapiens
tgccatggaatcacctccagct

SEQ ID NO: 7732700 - DNA, 22 bp, Homo sapiens
tgccatggaagtggccagacct

SEQ ID NO: 7732701 - DNA, 22 bp, Homo sapiens
tgccagggtcctgagggccttg

SEQ ID NO: 7732702 - DNA, 22 bp, Homo sapiens
tgccagggtgtcaggagagcta

SEQ ID NO: 7732703 - DNA, 22 bp, Homo sapiens
tgccaggccacgtagcttcaag

SEQ ID NO: 7732704 - DNA, 22 bp, Homo sapiens
tgccaggcccagctccagagct

SEQ ID NO: 7732705 - DNA, 22 bp, Homo sapiens
tgccaggccaattctatttgac

SEQ ID NO: 7732706 - DNA, 22 bp, Homo sapiens
tgccaggccaatgaaggcaggg

SEQ ID NO: 7732707 - DNA, 22 bp, Homo sapiens
tgccaggctcaggatgtccctg

SEQ ID NO: 7732708 - DNA, 22 bp, Homo sapiens
tgccaggccctcccacagatta

SEQ ID NO: 7732709 - DNA, 22 bp, Homo sapiens
tgccaggcatgtagtagacttg

SEQ ID NO: 7732710 - DNA, 22 bp, Homo sapiens
tgccaggcatatggcctctttg

SEQ ID NO: 7732711 - DNA, 22 bp, Homo sapiens
tgccaggcagtgtcagattgag

SEQ ID NO: 7732712 - DNA, 22 bp, Homo sapiens
tgccaggcaggaccctagaacc

SEQ ID NO: 7732713 - DNA, 22 bp, Homo sapiens
tgccaggcacgtgagagtggcc

SEQ ID NO: 7732714 - DNA, 20 bp, Homo sapiens
tgccaggcacggagtgcatg

SEQ ID NO: 7732715 - DNA, 22 bp, Homo sapiens
tgcctggcaagaggggctggct

SEQ ID NO: 7732716 - DNA, 22 bp, Homo sapiens
tgcctggcaatgccagaagcca

SEQ ID NO: 7732717 - DNA, 19 bp, Homo sapiens
tgcctggcaccagctccac

SEQ ID NO: 7732718 - DNA, 22 bp, Homo sapiens
tgcctggcacagagcaggtggc

SEQ ID NO: 7732719 - DNA, 22 bp, Homo sapiens
tgcctggcatctagccctggga

SEQ ID NO: 7732720 - DNA, 22 bp, Homo sapiens
tgcctggcactcctggagctca

SEQ ID NO: 7732721 - DNA, 22 bp, Homo sapiens
tgcctggcaccccagtctgcac

SEQ ID NO: 7732722 - DNA, 20 bp, Homo sapiens
tgcctgcccaggtcctgcac

SEQ ID NO: 7732723 - DNA, 22 bp, Homo sapiens
tgcctgccccacaaggggttgc

SEQ ID NO: 7732724 - DNA, 22 bp, Homo sapiens
tgcctgcccacgactacagcag

SEQ ID NO: 7732725 - DNA, 22 bp, Homo sapiens
tgcctgccacgcttgctaccac

SEQ ID NO: 7732726 - DNA, 22 bp, Homo sapiens
tgcctgccaggcaacctgggag

SEQ ID NO: 7732727 - DNA, 22 bp, Homo sapiens
tgcctgactgctgccaccacta

SEQ ID NO: 7732728 - DNA, 20 bp, Homo sapiens
tgcctgacttcagcatcagt

SEQ ID NO: 7732729 - DNA, 22 bp, Homo sapiens
tgcctgaggagtcagggcaggt

SEQ ID NO: 7732730 - DNA, 22 bp, Homo sapiens
tgcctccctggcaagtctctcc

SEQ ID NO: 7732731 - DNA, 22 bp, Homo sapiens
tgcctccctctctgccactgga

SEQ ID NO: 7732732 - DNA, 22 bp, Homo sapiens
tgcctctctaacccatgcccaa

SEQ ID NO: 7732733 - DNA, 22 bp, Homo sapiens
tgcctccattcctgggtcattg

SEQ ID NO: 7732734 - DNA, 22 bp, Homo sapiens
tgcctcagagttgtccctacca

SEQ ID NO: 7732735 - DNA, 22 bp, Homo sapiens
tgcctaggctggagtgtagtgg

SEQ ID NO: 7732736 - DNA, 23 bp, Homo sapiens
tgcagggcaagttagagacccca

SEQ ID NO: 7732737 - DNA, 22 bp, Homo sapiens
tgcagggcagatatgactgtag

SEQ ID NO: 7732738 - DNA, 22 bp, Homo sapiens
tgcagggcacggtgcgcgtggg

SEQ ID NO: 7732739 - DNA, 22 bp, Homo sapiens
tgcagggctataactccattct

SEQ ID NO: 7732740 - DNA, 22 bp, Homo sapiens
tgcagggccctcattcctgtcc

SEQ ID NO: 7732741 - DNA, 22 bp, Homo sapiens
tgcagggcccctctgcatgagt

SEQ ID NO: 7732742 - DNA, 22 bp, Homo sapiens
tgcagggcatagggtccagttt

SEQ ID NO: 7732743 - DNA, 22 bp, Homo sapiens
tgcagggccatggtggcggctg

SEQ ID NO: 7732744 - DNA, 22 bp, Homo sapiens
tgcagggcttcctcttggagtt

SEQ ID NO: 7732745 - DNA, 19 bp, Homo sapiens
tgcagggctgcgcctgggg

SEQ ID NO: 7732746 - DNA, 20 bp, Homo sapiens
tgcagggctgcctcccagct

SEQ ID NO: 7732747 - DNA, 20 bp, Homo sapiens
tgcagggctctgcttctctc

SEQ ID NO: 7732748 - DNA, 22 bp, Homo sapiens
tgcagagggacagccacagctc

SEQ ID NO: 7732749 - DNA, 22 bp, Homo sapiens
tgcacagggagggggccagctc

SEQ ID NO: 7732750 - DNA, 21 bp, Homo sapiens
tgcacagggcccaggagagcc

SEQ ID NO: 7732751 - DNA, 22 bp, Homo sapiens
tctgaagaaatacagctggggt

SEQ ID NO: 7732752 - DNA, 22 bp, Homo sapiens
tctcttccctttatggtatgtg

SEQ ID NO: 7732753 - DNA, 22 bp, Homo sapiens
tctcttcctcagcctggggcct

SEQ ID NO: 7732754 - DNA, 22 bp, Homo sapiens
tctcttcctagtgatgggcttt

SEQ ID NO: 7732755 - DNA, 22 bp, Homo sapiens
tctctcttttttgaacccgctc

SEQ ID NO: 7732756 - DNA, 22 bp, Homo sapiens
tctctctttttaatcatgtaat

SEQ ID NO: 7732757 - DNA, 21 bp, Homo sapiens
tctctgagacactctggagcc

SEQ ID NO: 7732758 - DNA, 22 bp, Homo sapiens
tctctcagggggaaggctgaag

SEQ ID NO: 7732759 - DNA, 22 bp, Homo sapiens
tctctcagactccccatggttt

SEQ ID NO: 7732760 - DNA, 23 bp, Homo sapiens
tctccctcatgcctaggcctggg

SEQ ID NO: 7732761 - DNA, 22 bp, Homo sapiens
tctccttcgaggcccagctccc

SEQ ID NO: 7732762 - DNA, 22 bp, Homo sapiens
tctcctctgcgcggcagtgccc

SEQ ID NO: 7732763 - DNA, 22 bp, Homo sapiens
tctcctccagaggctgtgggga

SEQ ID NO: 7732764 - DNA, 23 bp, Homo sapiens
tctcctcctagatacagtcatgg

SEQ ID NO: 7732765 - DNA, 21 bp, Homo sapiens
tctcctcccggggagaggccg

SEQ ID NO: 7732766 - DNA, 22 bp, Homo sapiens
tctcagcctcacctctatggag

SEQ ID NO: 7732767 - DNA, 22 bp, Homo sapiens
tctcagggagagctgctggcat

SEQ ID NO: 7732768 - DNA, 18 bp, Homo sapiens
tctcagcccagctccggc

SEQ ID NO: 7732769 - DNA, 22 bp, Homo sapiens
tctcagaggtgccctggcatct

SEQ ID NO: 7732770 - DNA, 22 bp, Homo sapiens
tctcagagatgttagggaagag

SEQ ID NO: 7732771 - DNA, 19 bp, Homo sapiens
tctcagagccctagaggcc

SEQ ID NO: 7732772 - DNA, 22 bp, Homo sapiens
tctcagggtttgtacaagtgta

SEQ ID NO: 7732773 - DNA, 22 bp, Homo sapiens
tccttcagaggacggcagccag

SEQ ID NO: 7732774 - DNA, 17 bp, Homo sapiens
tccttcagggcctcaca

SEQ ID NO: 7732775 - DNA, 22 bp, Homo sapiens
tccttaggcaatttgggagagt

SEQ ID NO: 7732776 - DNA, 22 bp, Homo sapiens
tcctggccatgcaagatgagga

SEQ ID NO: 7732777 - DNA, 22 bp, Homo sapiens
tcctggccaagtagatgtggcg

SEQ ID NO: 7732778 - DNA, 22 bp, Homo sapiens
tcctggcctagagtttgtgttc

SEQ ID NO: 7732779 - DNA, 22 bp, Homo sapiens
tcctggccgccgcgtggggccg

SEQ ID NO: 7732780 - DNA, 22 bp, Homo sapiens
tcctggcccactatgccagcat

SEQ ID NO: 7732781 - DNA, 22 bp, Homo sapiens
tcctggcccggccgggcctgct

SEQ ID NO: 7732782 - DNA, 17 bp, Homo sapiens
tcctggcctggtgtgtg

SEQ ID NO: 7732783 - DNA, 20 bp, Homo sapiens
tcctggcctccctggggctc

SEQ ID NO: 7732784 - DNA, 22 bp, Homo sapiens
tcctggctcgattgctaccaat

SEQ ID NO: 7732785 - DNA, 22 bp, Homo sapiens
tcctgggaactcggaaagctct

SEQ ID NO: 7732786 - DNA, 18 bp, Homo sapiens
tcctgggaacttgctagc

SEQ ID NO: 7732787 - DNA, 22 bp, Homo sapiens
tcctgggaagagacctgagcat

SEQ ID NO: 7732788 - DNA, 22 bp, Homo sapiens
tcctgggaagactgtgaggaca

SEQ ID NO: 7732789 - DNA, 18 bp, Homo sapiens
tcctgggaaaggcataca

SEQ ID NO: 7732790 - DNA, 22 bp, Homo sapiens
tcctgggaccgagggaagagct

SEQ ID NO: 7732791 - DNA, 22 bp, Homo sapiens
tcctgggaccctgggtgcagag

SEQ ID NO: 7732792 - DNA, 22 bp, Homo sapiens
tcctgggactcaacttagaagg

SEQ ID NO: 7732793 - DNA, 22 bp, Homo sapiens
tcctgggactctgcctcaggct

SEQ ID NO: 7732794 - DNA, 22 bp, Homo sapiens
tcctgggaggcaggaccccttt

SEQ ID NO: 7732795 - DNA, 22 bp, Homo sapiens
tcctgggaggcggaggttgcag

SEQ ID NO: 7732796 - DNA, 22 bp, Homo sapiens
tcctgggaggctgtgcctggct

SEQ ID NO: 7732797 - DNA, 22 bp, Homo sapiens
tcctgggaagtggctggctgag

SEQ ID NO: 7732798 - DNA, 22 bp, Homo sapiens
tcctgggaagcgccggcctgcg

SEQ ID NO: 7732799 - DNA, 21 bp, Homo sapiens
tcctgggaagcactggggtgg

SEQ ID NO: 7732800 - DNA, 22 bp, Homo sapiens
tcctgggaagttgcatcaccgt

SEQ ID NO: 7732801 - DNA, 22 bp, Homo sapiens
tcctgggacaccccaatatgag

SEQ ID NO: 7732802 - DNA, 22 bp, Homo sapiens
tcctgggacaagccgtggaagt

SEQ ID NO: 7732803 - DNA, 22 bp, Homo sapiens
tcctgggaccaggcacctactg

SEQ ID NO: 7732804 - DNA, 22 bp, Homo sapiens
tcctgggattctgcatttctaa

SEQ ID NO: 7732805 - DNA, 22 bp, Homo sapiens
tcctgggattaaggtggtgatt

SEQ ID NO: 7732806 - DNA, 22 bp, Homo sapiens
tcctgggatttgcccttttctc

SEQ ID NO: 7732807 - DNA, 22 bp, Homo sapiens
tcctgggaggtaaaccagcatc

SEQ ID NO: 7732808 - DNA, 22 bp, Homo sapiens
tcctgggagtaaaagctgccct

SEQ ID NO: 7732809 - DNA, 22 bp, Homo sapiens
tcctgggagtaattgagtcatg

SEQ ID NO: 7732810 - DNA, 21 bp, Homo sapiens
tcctgggagtctgagatcctg

SEQ ID NO: 7732811 - DNA, 22 bp, Homo sapiens
tcctgggagtggccatgtaatg

SEQ ID NO: 7732812 - DNA, 22 bp, Homo sapiens
tcctgggatactaagaaatttt

SEQ ID NO: 7732813 - DNA, 22 bp, Homo sapiens
tcctgggatcaagtgatcctcc

SEQ ID NO: 7732814 - DNA, 22 bp, Homo sapiens
tcctgggatgaggaaacaagga

SEQ ID NO: 7732815 - DNA, 22 bp, Homo sapiens
tcctgggatgacttttgaaatg

SEQ ID NO: 7732816 - DNA, 22 bp, Homo sapiens
tcctgggatgcataaaatatgt

SEQ ID NO: 7732817 - DNA, 19 bp, Homo sapiens
tcctgggctgggccaggtc

SEQ ID NO: 7732818 - DNA, 22 bp, Homo sapiens
tcctggggttttggccgcagct

SEQ ID NO: 7732819 - DNA, 22 bp, Homo sapiens
tcttcctccctacagagctcag

SEQ ID NO: 7732820 - DNA, 20 bp, Homo sapiens
tcttccaggtacagtctgca

SEQ ID NO: 7732821 - DNA, 22 bp, Homo sapiens
tcttccaggagggtgggcaaac

SEQ ID NO: 7732822 - DNA, 20 bp, Homo sapiens
tcttccagcttctggtagaa

SEQ ID NO: 7732823 - DNA, 22 bp, Homo sapiens
tcttccagcttctggtggctgc

SEQ ID NO: 7732824 - DNA, 22 bp, Homo sapiens
tcttccagaatctcagagggct

SEQ ID NO: 7732825 - DNA, 19 bp, Homo sapiens
tcttccagcatctgggggc

SEQ ID NO: 7732826 - DNA, 22 bp, Homo sapiens
tcttcagattgcactgagcaag

SEQ ID NO: 7732827 - DNA, 22 bp, Homo sapiens
tctgtgcaagtatttgacattt

SEQ ID NO: 7732828 - DNA, 20 bp, Homo sapiens
tctggctctttgctcctccc

SEQ ID NO: 7732829 - DNA, 22 bp, Homo sapiens
tctggcagaggaaggaggcctg

SEQ ID NO: 7732830 - DNA, 22 bp, Homo sapiens
tctgcagcttgcacaggcaggc

SEQ ID NO: 7732831 - DNA, 23 bp, Homo sapiens
tctgccagtgtgtgccaggagcc

SEQ ID NO: 7732832 - DNA, 22 bp, Homo sapiens
tctgccaggccacacagggcac

SEQ ID NO: 7732833 - DNA, 22 bp, Homo sapiens
tctgcctgtgctgtgttttcat

SEQ ID NO: 7732834 - DNA, 22 bp, Homo sapiens
tctgcctgttcaagtcttctag

SEQ ID NO: 7732835 - DNA, 22 bp, Homo sapiens
tctgcctgttcccgattccatg

SEQ ID NO: 7732836 - DNA, 22 bp, Homo sapiens
tctgcctggcctggagggcaca

SEQ ID NO: 7732837 - DNA, 22 bp, Homo sapiens
tctgcctgtagtcccacacctc

SEQ ID NO: 7732838 - DNA, 22 bp, Homo sapiens
tctgcctggcggactcccggaa

SEQ ID NO: 7732839 - DNA, 22 bp, Homo sapiens
tctgcctgcggctgcaggtggc

SEQ ID NO: 7732840 - DNA, 22 bp, Homo sapiens
tctgcctgctaactcctgcacc

SEQ ID NO: 7732841 - DNA, 22 bp, Homo sapiens
tctgcctggatgatggcagggc

SEQ ID NO: 7732842 - DNA, 22 bp, Homo sapiens
tctgcctggaccctggtgagct

SEQ ID NO: 7732843 - DNA, 22 bp, Homo sapiens
tctgcctggagagttcttctct

SEQ ID NO: 7732844 - DNA, 19 bp, Homo sapiens
tctgcctgcttgtaggggc

SEQ ID NO: 7732845 - DNA, 22 bp, Homo sapiens
tctgcctgccgagaacacctac

SEQ ID NO: 7732846 - DNA, 22 bp, Homo sapiens
tctgcctgcagtgtggcagggc

SEQ ID NO: 7732847 - DNA, 22 bp, Homo sapiens
tctgcctgccagtctggtcctc

SEQ ID NO: 7732848 - DNA, 22 bp, Homo sapiens
tctgcctgaggactgacaccag

SEQ ID NO: 7732849 - DNA, 22 bp, Homo sapiens
tctgcctgagggagctgaggaa

SEQ ID NO: 7732850 - DNA, 18 bp, Homo sapiens
tctgcctgcagggcatct

SEQ ID NO: 7732851 - DNA, 22 bp, Homo sapiens
tctgcctgagcagagggaggcc

SEQ ID NO: 7732852 - DNA, 22 bp, Homo sapiens
tctgaccagtgagctctgaaat

SEQ ID NO: 7732853 - DNA, 23 bp, Homo sapiens
tctgaccatttgacaacatcctg

SEQ ID NO: 7732854 - DNA, 22 bp, Homo sapiens
tctgaccaggctcagccaaggc

SEQ ID NO: 7732855 - DNA, 22 bp, Homo sapiens
tctgaccaggctggctcagggc

SEQ ID NO: 7732856 - DNA, 22 bp, Homo sapiens
tctgaccacagacaacctgcta

SEQ ID NO: 7732857 - DNA, 23 bp, Homo sapiens
tctgaccaagttttgcatgccac

SEQ ID NO: 7732858 - DNA, 19 bp, Homo sapiens
tctgaggcttctccccttg

SEQ ID NO: 7732859 - DNA, 22 bp, Homo sapiens
tctgaggctgtctctgggctcc

SEQ ID NO: 7732860 - DNA, 20 bp, Homo sapiens
tctgaggctgagcccagcgt

SEQ ID NO: 7732861 - DNA, 20 bp, Homo sapiens
tctgaggctgagctctactt

SEQ ID NO: 7732862 - DNA, 22 bp, Homo sapiens
tctgaggctgaatggactccgt

SEQ ID NO: 7732863 - DNA, 22 bp, Homo sapiens
tctgaggccctaccctgagcct

SEQ ID NO: 7732864 - DNA, 22 bp, Homo sapiens
tctgaggcctgaagcagcagag

SEQ ID NO: 7732865 - DNA, 22 bp, Homo sapiens
tctgaggccctgcaggcagtgt

SEQ ID NO: 7732866 - DNA, 22 bp, Homo sapiens
tctgaggcctagagaggggctt

SEQ ID NO: 7732867 - DNA, 17 bp, Homo sapiens
tctgaggcctctaggag

SEQ ID NO: 7732868 - DNA, 22 bp, Homo sapiens
tctgaggccttggcagctaagg

SEQ ID NO: 7732869 - DNA, 22 bp, Homo sapiens
tctgaggctatgttcaggctaa

SEQ ID NO: 7732870 - DNA, 22 bp, Homo sapiens
aaagcctgggttcctcactatc

SEQ ID NO: 7732871 - DNA, 22 bp, Homo sapiens
aaaggcaggactgcagcatagg

SEQ ID NO: 7732872 - DNA, 22 bp, Homo sapiens
aaagattatggcattgaaatac

SEQ ID NO: 7732873 - DNA, 22 bp, Homo sapiens
aaagattagataagatagattt

SEQ ID NO: 7732874 - DNA, 22 bp, Homo sapiens
aaagattaaggtattgttagct

SEQ ID NO: 7732875 - DNA, 22 bp, Homo sapiens
aaagatttatgaagttcaatta

SEQ ID NO: 7732876 - DNA, 22 bp, Homo sapiens
aaagatttaagaataatttgtg

SEQ ID NO: 7732877 - DNA, 22 bp, Homo sapiens
aaagatttatgaagttcaatta

SEQ ID NO: 7732878 - DNA, 22 bp, Homo sapiens
aaagattgaaagagaatttgtc

SEQ ID NO: 7732879 - DNA, 22 bp, Homo sapiens
aaagcagaggttgcagtgagct

SEQ ID NO: 7732880 - DNA, 22 bp, Homo sapiens
aaagcagaggtgatatgactta

SEQ ID NO: 7732881 - DNA, 22 bp, Homo sapiens
aaatacatttacagtcgtggct

SEQ ID NO: 7732882 - DNA, 22 bp, Homo sapiens
aagaggtaaccatagcaaccac

SEQ ID NO: 7732883 - DNA, 22 bp, Homo sapiens
aagaggtaatgactgcttgagt

SEQ ID NO: 7732884 - DNA, 22 bp, Homo sapiens
aagaggtagcagtcacaaaaga

SEQ ID NO: 7732885 - DNA, 23 bp, Homo sapiens
aaagtttgaagcaacagtagttg

SEQ ID NO: 7732886 - DNA, 22 bp, Homo sapiens
aaagtttggatccagcaaaaga

SEQ ID NO: 7732887 - DNA, 22 bp, Homo sapiens
aaagtttgttgcttacaaagaa

SEQ ID NO: 7732888 - DNA, 22 bp, Homo sapiens
aaagttttagctgtccagttcc

SEQ ID NO: 7732889 - DNA, 22 bp, Homo sapiens
aagagggagggcaaaggcactg

SEQ ID NO: 7732890 - DNA, 22 bp, Homo sapiens
aagagggaaattgttggctgct

SEQ ID NO: 7732891 - DNA, 23 bp, Homo sapiens
aaagtgacttttataccactaac

SEQ ID NO: 7732892 - DNA, 22 bp, Homo sapiens
aaagtgcaaggattacaggcat

SEQ ID NO: 7732893 - DNA, 22 bp, Homo sapiens
aaagtgcactagaatccagatt

SEQ ID NO: 7732894 - DNA, 20 bp, Homo sapiens
aaagtgcacagatacagctc

SEQ ID NO: 7732895 - DNA, 22 bp, Homo sapiens
aagaccctatactcagtgaccc

SEQ ID NO: 7732896 - DNA, 22 bp, Homo sapiens
aagattatggcagataacaatt

SEQ ID NO: 7732897 - DNA, 22 bp, Homo sapiens
aagcagcatatgacagcatcca

SEQ ID NO: 7732898 - DNA, 22 bp, Homo sapiens
aagatgttgcaagggactcttc

SEQ ID NO: 7732899 - DNA, 22 bp, Homo sapiens
aagatgttgggtgcctccggaa

SEQ ID NO: 7732900 - DNA, 22 bp, Homo sapiens
aagatgttgcattagaatacct

SEQ ID NO: 7732901 - DNA, 22 bp, Homo sapiens
aagatgttgtcgttagtgatga

SEQ ID NO: 7732902 - DNA, 22 bp, Homo sapiens
aagatgtttagatttatacaat

SEQ ID NO: 7732903 - DNA, 18 bp, Homo sapiens
aagatgtttaatgggaag

SEQ ID NO: 7732904 - DNA, 22 bp, Homo sapiens
aagatgtttaggtaaaaagttt

SEQ ID NO: 7732905 - DNA, 22 bp, Homo sapiens
aagatgttttaatatttcgagg

SEQ ID NO: 7732906 - DNA, 22 bp, Homo sapiens
aaatctttccctttactatcca

SEQ ID NO: 7732907 - DNA, 22 bp, Homo sapiens
aaatgcatgtagaataatagag

SEQ ID NO: 7732908 - DNA, 22 bp, Homo sapiens
aagcctaaatgatgctattatg

SEQ ID NO: 7732909 - DNA, 22 bp, Homo sapiens
aaacagctttcagaatctctca

SEQ ID NO: 7732910 - DNA, 22 bp, Homo sapiens
aaacagcttgtttcaggaaagt

SEQ ID NO: 7732911 - DNA, 22 bp, Homo sapiens
aaaaggatgttttcatgaaaca

SEQ ID NO: 7732912 - DNA, 22 bp, Homo sapiens
aaaaatacttcacttctgggtg

SEQ ID NO: 7732913 - DNA, 22 bp, Homo sapiens
aaaaagatgtcctgaagtttag

SEQ ID NO: 7732914 - DNA, 22 bp, Homo sapiens
aaaaagtattggccatggttga

SEQ ID NO: 7732915 - DNA, 22 bp, Homo sapiens
aaaatattttagggccaggaga

SEQ ID NO: 7732916 - DNA, 22 bp, Homo sapiens
aaagagccagctacctcagttt

SEQ ID NO: 7732917 - DNA, 22 bp, Homo sapiens
aaacatgtttagaaagcagctg

SEQ ID NO: 7732918 - DNA, 22 bp, Homo sapiens
aaacagctgtcattgttttaaa

SEQ ID NO: 7732919 - DNA, 22 bp, Homo sapiens
aaacagctggtctcaaatgttc

SEQ ID NO: 7732920 - DNA, 22 bp, Homo sapiens
aaacagctcaagaagttactct

SEQ ID NO: 7732921 - DNA, 22 bp, Homo sapiens
aaacagctccttagtttccatc

SEQ ID NO: 7732922 - DNA, 22 bp, Homo sapiens
aaacagctgcagtacacggcct

SEQ ID NO: 7732923 - DNA, 22 bp, Homo sapiens
aaacagctgcactgctgatgtc

SEQ ID NO: 7732924 - DNA, 22 bp, Homo sapiens
aaacagctgggaggtagaggcg

SEQ ID NO: 7732925 - DNA, 22 bp, Homo sapiens
aaacagattgaaattcgtagta

SEQ ID NO: 7732926 - DNA, 22 bp, Homo sapiens
aaacagctaagtacattcaagg

SEQ ID NO: 7732927 - DNA, 22 bp, Homo sapiens
aaacagctaatggccaggaata

SEQ ID NO: 7732928 - DNA, 22 bp, Homo sapiens
aaacagctacttctgtataatg

SEQ ID NO: 7732929 - DNA, 20 bp, Homo sapiens
aaacagctaaaccagctctc

SEQ ID NO: 7732930 - DNA, 22 bp, Homo sapiens
aaacagataatgctataaatgg

SEQ ID NO: 7732931 - DNA, 22 bp, Homo sapiens
aaatagttcagccacggtgact

SEQ ID NO: 7732932 - DNA, 23 bp, Homo sapiens
aaagactctccagagggaagtag

SEQ ID NO: 7732933 - DNA, 22 bp, Homo sapiens
aaagactttcacctagcaaaga

SEQ ID NO: 7732934 - DNA, 21 bp, Homo sapiens
aaagatgtttcatctgagaaa

SEQ ID NO: 7732935 - DNA, 21 bp, Homo sapiens
aaagatgtttcatctgagaaa

SEQ ID NO: 7732936 - DNA, 22 bp, Homo sapiens
aatggccatatcattgcagagc

SEQ ID NO: 7732937 - DNA, 22 bp, Homo sapiens
aatggctctgatgttgttgtga

SEQ ID NO: 7732938 - DNA, 22 bp, Homo sapiens
aatgacaagacatagtctctga

SEQ ID NO: 7732939 - DNA, 22 bp, Homo sapiens
aatgacaaatatggaagcctga

SEQ ID NO: 7732940 - DNA, 22 bp, Homo sapiens
aatgacaagacatagtctctga

SEQ ID NO: 7732941 - DNA, 22 bp, Homo sapiens
aacctgagataataggagagta

SEQ ID NO: 7732942 - DNA, 22 bp, Homo sapiens
aacctgttccctggtccttgac

SEQ ID NO: 7732943 - DNA, 22 bp, Homo sapiens
aatagatactacttagatgtag

SEQ ID NO: 7732944 - DNA, 22 bp, Homo sapiens
aatagatgggttaaacagcaaa

SEQ ID NO: 7732945 - DNA, 22 bp, Homo sapiens
aatagactccagggtctatttt

SEQ ID NO: 7732946 - DNA, 22 bp, Homo sapiens
aatagaggagctttggactccc

SEQ ID NO: 7732947 - DNA, 22 bp, Homo sapiens
aacagcttactcaatggtgatt

SEQ ID NO: 7732948 - DNA, 22 bp, Homo sapiens
aacagcttgagactggatatgc

SEQ ID NO: 7732949 - DNA, 22 bp, Homo sapiens
aacagcttcatcacatggcata

SEQ ID NO: 7732950 - DNA, 22 bp, Homo sapiens
aacagcttagaaatgttgctaa

SEQ ID NO: 7732951 - DNA, 22 bp, Homo sapiens
aaattcaattaactttcatgct

SEQ ID NO: 7732952 - DNA, 22 bp, Homo sapiens
aaggctgagccagggcccctat

SEQ ID NO: 7732953 - DNA, 22 bp, Homo sapiens
aaggcagatataaagactagag

SEQ ID NO: 7732954 - DNA, 22 bp, Homo sapiens
aaatgtcaaggtgatagatgca

SEQ ID NO: 7732955 - DNA, 22 bp, Homo sapiens
aaatgtcagaagctttacttct

SEQ ID NO: 7732956 - DNA, 22 bp, Homo sapiens
aaatgcatgtgctatagatgtg

SEQ ID NO: 7732957 - DNA, 22 bp, Homo sapiens
aaggaagacacagatgaagtga

SEQ ID NO: 7732958 - DNA, 22 bp, Homo sapiens
aaggctggtcagatgtggtgaa

SEQ ID NO: 7732959 - DNA, 22 bp, Homo sapiens
aaggctggttccatccctggtg

SEQ ID NO: 7732960 - DNA, 22 bp, Homo sapiens
aaatttctggaagtgtcagagt

SEQ ID NO: 7732961 - DNA, 22 bp, Homo sapiens
aaatttcttgaggctctctagc

SEQ ID NO: 7732962 - DNA, 22 bp, Homo sapiens
aacacagacatagtgattacag

SEQ ID NO: 7732963 - DNA, 22 bp, Homo sapiens
aacacagttttccaaaatagag

SEQ ID NO: 7732964 - DNA, 22 bp, Homo sapiens
aacagacagaaaaatgtgatct

SEQ ID NO: 7732965 - DNA, 22 bp, Homo sapiens
aagaaatggcttcatctgagta

SEQ ID NO: 7732966 - DNA, 22 bp, Homo sapiens
aattctcaggaatttcatctgt

SEQ ID NO: 7732967 - DNA, 22 bp, Homo sapiens
aattctcaggaatttcatctgt

SEQ ID NO: 7732968 - DNA, 22 bp, Homo sapiens
aatttgttagcatactctagtt

SEQ ID NO: 7732969 - DNA, 22 bp, Homo sapiens
aatttcagatgtcataaatata

SEQ ID NO: 7732970 - DNA, 22 bp, Homo sapiens
aagagcaagtgggtagtgaagc

SEQ ID NO: 7732971 - DNA, 22 bp, Homo sapiens
acacaaagttggatgacaaaat

SEQ ID NO: 7732972 - DNA, 22 bp, Homo sapiens
acacaaacagtctatagcacca

SEQ ID NO: 7732973 - DNA, 21 bp, Homo sapiens
acacaaacctcctcagcctgg

SEQ ID NO: 7732974 - DNA, 22 bp, Homo sapiens
aagagactatggtgtctatgaa

SEQ ID NO: 7732975 - DNA, 22 bp, Homo sapiens
aagagaaggccctgacccaccc

SEQ ID NO: 7732976 - DNA, 22 bp, Homo sapiens
aagcaataatcccaaagtgctg

SEQ ID NO: 7732977 - DNA, 22 bp, Homo sapiens
aagatgttagggtggaagggat

SEQ ID NO: 7732978 - DNA, 22 bp, Homo sapiens
aagatgttaggaaagttagggt

SEQ ID NO: 7732979 - DNA, 22 bp, Homo sapiens
aagatgttagaggtcatgcaga

SEQ ID NO: 7732980 - DNA, 22 bp, Homo sapiens
aagatgttagattatggggaca

SEQ ID NO: 7732981 - DNA, 22 bp, Homo sapiens
aagatgttactcaaccaggata

SEQ ID NO: 7732982 - DNA, 22 bp, Homo sapiens
aagatgttaaatctgtagaatt

SEQ ID NO: 7732983 - DNA, 22 bp, Homo sapiens
aagatgttaaattgggggcatt

SEQ ID NO: 7732984 - DNA, 22 bp, Homo sapiens
aagatggcttagagtcctggtg

SEQ ID NO: 7732985 - DNA, 22 bp, Homo sapiens
aagatgtaaaggcaatataaag

SEQ ID NO: 7732986 - DNA, 22 bp, Homo sapiens
aagatgaatcagtatgtgtcct

SEQ ID NO: 7732987 - DNA, 22 bp, Homo sapiens
aagcaatatactgatatgatta

SEQ ID NO: 7732988 - DNA, 22 bp, Homo sapiens
aagcaatgtgttaatgaatgag

SEQ ID NO: 7732989 - DNA, 19 bp, Homo sapiens
aagcaatgttgtgaatcta

SEQ ID NO: 7732990 - DNA, 22 bp, Homo sapiens
aagcagaactgggaagtagtgg

SEQ ID NO: 7732991 - DNA, 22 bp, Homo sapiens
aagcagacagagaatgggtttg

SEQ ID NO: 7732992 - DNA, 22 bp, Homo sapiens
aagcagaatttaatagaaaggt

SEQ ID NO: 7732993 - DNA, 22 bp, Homo sapiens
aagcagcttccctggctcctgg

SEQ ID NO: 7732994 - DNA, 22 bp, Homo sapiens
aagcagcttccccaaagtgcct

SEQ ID NO: 7732995 - DNA, 22 bp, Homo sapiens
aagcagctttctttcctgtgaa

SEQ ID NO: 7732996 - DNA, 22 bp, Homo sapiens
aagcagcttttgaagagtgagg

SEQ ID NO: 7732997 - DNA, 22 bp, Homo sapiens
aagcagcttttgaagagtgagg

SEQ ID NO: 7732998 - DNA, 21 bp, Homo sapiens
aagcagcttaataaagtatgt

SEQ ID NO: 7732999 - DNA, 22 bp, Homo sapiens
aagcagcttaaattagagcctg

SEQ ID NO: 7733000 - DNA, 22 bp, Homo sapiens
aagcagctggaagagtaagatg

SEQ ID NO: 7733001 - DNA, 22 bp, Homo sapiens
aagcagctgtgtgacataatct

SEQ ID NO: 7733002 - DNA, 22 bp, Homo sapiens
aagcagctgcaggttcaaagga

SEQ ID NO: 7733003 - DNA, 22 bp, Homo sapiens
acagcagagacactcaggaggc

SEQ ID NO: 7733004 - DNA, 22 bp, Homo sapiens
aagctgctggtgactgggctga

SEQ ID NO: 7733005 - DNA, 22 bp, Homo sapiens
aagcattttagtaatgaacttg

SEQ ID NO: 7733006 - DNA, 22 bp, Homo sapiens
aaggagagtacaggagttggta

SEQ ID NO: 7733007 - DNA, 22 bp, Homo sapiens
aaggagctcccggcagaccagg

SEQ ID NO: 7733008 - DNA, 22 bp, Homo sapiens
aaggagctgggagggacacatg

SEQ ID NO: 7733009 - DNA, 22 bp, Homo sapiens
aagctggactctgccatttact

SEQ ID NO: 7733010 - DNA, 22 bp, Homo sapiens
aaggagacatttgcagagcacc

SEQ ID NO: 7733011 - DNA, 22 bp, Homo sapiens
aaggagagagctttgctggaac

SEQ ID NO: 7733012 - DNA, 22 bp, Homo sapiens
acagtctttaatttctttgtgg

SEQ ID NO: 7733013 - DNA, 22 bp, Homo sapiens
aaggaggaattctgagttcatg

SEQ ID NO: 7733014 - DNA, 22 bp, Homo sapiens
aaggaggcaccctgagcctgcc

SEQ ID NO: 7733015 - DNA, 20 bp, Homo sapiens
acatatgaatgatagagcca

SEQ ID NO: 7733016 - DNA, 22 bp, Homo sapiens
aagggcttttaagatttatcct

SEQ ID NO: 7733017 - DNA, 19 bp, Homo sapiens
acccagagccctttgcagg

SEQ ID NO: 7733018 - DNA, 22 bp, Homo sapiens
acccagagctgggcttggcaaa

SEQ ID NO: 7733019 - DNA, 22 bp, Homo sapiens
accctgagaaagtcacatgcat

SEQ ID NO: 7733020 - DNA, 22 bp, Homo sapiens
acccagagtcatgtttattccc

SEQ ID NO: 7733021 - DNA, 18 bp, Homo sapiens
aaggcctagtccctctct

SEQ ID NO: 7733022 - DNA, 22 bp, Homo sapiens
aaggctctgcaaaacctccaag

SEQ ID NO: 7733023 - DNA, 22 bp, Homo sapiens
acatttctggagtttctcaaca

SEQ ID NO: 7733024 - DNA, 22 bp, Homo sapiens
acatttgtgcaacgtatccaca

SEQ ID NO: 7733025 - DNA, 22 bp, Homo sapiens
acatttctcttgatgtctctat

SEQ ID NO: 7733026 - DNA, 17 bp, Homo sapiens
aatcagatttctgagga

SEQ ID NO: 7733027 - DNA, 22 bp, Homo sapiens
aatcataattcaaataagctta

SEQ ID NO: 7733028 - DNA, 22 bp, Homo sapiens
agaaatgacaagactgatcagg

SEQ ID NO: 7733029 - DNA, 22 bp, Homo sapiens
agaaatgaatatgtagtggtta

SEQ ID NO: 7733030 - DNA, 22 bp, Homo sapiens
agaaatctttgaagtgtaatgt

SEQ ID NO: 7733031 - DNA, 22 bp, Homo sapiens
agaagcagaaaagggcactttt

SEQ ID NO: 7733032 - DNA, 22 bp, Homo sapiens
agaagcagaaggaagcagggcc

SEQ ID NO: 7733033 - DNA, 22 bp, Homo sapiens
agaaatgacacacatgagacat

SEQ ID NO: 7733034 - DNA, 22 bp, Homo sapiens
agaaatgacacacatgagacat

SEQ ID NO: 7733035 - DNA, 22 bp, Homo sapiens
actgggctggttagttttacta

SEQ ID NO: 7733036 - DNA, 22 bp, Homo sapiens
actgggctggggctcattctcc

SEQ ID NO: 7733037 - DNA, 22 bp, Homo sapiens
actgggctgcttgagtgccttc

SEQ ID NO: 7733038 - DNA, 22 bp, Homo sapiens
actgggctgtggacacccagcg

SEQ ID NO: 7733039 - DNA, 22 bp, Homo sapiens
actgggctgttccttatttcta

SEQ ID NO: 7733040 - DNA, 22 bp, Homo sapiens
actgggctgtaaagagaggcaa

SEQ ID NO: 7733041 - DNA, 23 bp, Homo sapiens
actgggcttatgaggaggcttgt

SEQ ID NO: 7733042 - DNA, 22 bp, Homo sapiens
actgggctgttttttgagtgga

SEQ ID NO: 7733043 - DNA, 22 bp, Homo sapiens
actgggcttatttcttgtgaac

SEQ ID NO: 7733044 - DNA, 22 bp, Homo sapiens
actgggcttatgctgtggagta

SEQ ID NO: 7733045 - DNA, 22 bp, Homo sapiens
actgggcttcacttggcacatc

SEQ ID NO: 7733046 - DNA, 19 bp, Homo sapiens
actgggcttgtcctcgtgg

SEQ ID NO: 7733047 - DNA, 22 bp, Homo sapiens
aatcagaaagaggtcatgttgc

SEQ ID NO: 7733048 - DNA, 22 bp, Homo sapiens
aatcacatctcattcaacagcc

SEQ ID NO: 7733049 - DNA, 22 bp, Homo sapiens
actttcttatccatgatctcac

SEQ ID NO: 7733050 - DNA, 22 bp, Homo sapiens
actttcttcttatgcattaagg

SEQ ID NO: 7733051 - DNA, 22 bp, Homo sapiens
actttcttaggctgtataaatg

SEQ ID NO: 7733052 - DNA, 22 bp, Homo sapiens
actataaaaggataaaccagaa

SEQ ID NO: 7733053 - DNA, 22 bp, Homo sapiens
actcagacgaaaacatgaacat

SEQ ID NO: 7733054 - DNA, 20 bp, Homo sapiens
acgtggccaccagtggctta

SEQ ID NO: 7733055 - DNA, 22 bp, Homo sapiens
aagtctcagaaaactagtgtgg

SEQ ID NO: 7733056 - DNA, 22 bp, Homo sapiens
acctaaatctacctcatgtttt

SEQ ID NO: 7733057 - DNA, 22 bp, Homo sapiens
acctaataaaggtaaattctgt

SEQ ID NO: 7733058 - DNA, 22 bp, Homo sapiens
actctggcagcagaaccagtgt

SEQ ID NO: 7733059 - DNA, 22 bp, Homo sapiens
actctggcactgggtacctcag

SEQ ID NO: 7733060 - DNA, 22 bp, Homo sapiens
actctggcaagcttccacttcc

SEQ ID NO: 7733061 - DNA, 22 bp, Homo sapiens
actctggccatcttggaccttg

SEQ ID NO: 7733062 - DNA, 22 bp, Homo sapiens
actctggccaggtgcggtatgt

SEQ ID NO: 7733063 - DNA, 22 bp, Homo sapiens
actctggccccaggatctgtgt

SEQ ID NO: 7733064 - DNA, 22 bp, Homo sapiens
actctggccctcctgctgccag

SEQ ID NO: 7733065 - DNA, 22 bp, Homo sapiens
actctggctattcactataata

SEQ ID NO: 7733066 - DNA, 22 bp, Homo sapiens
actctggcgggcgggcgagcca

SEQ ID NO: 7733067 - DNA, 22 bp, Homo sapiens
actctggctgccttgtgagcat

SEQ ID NO: 7733068 - DNA, 22 bp, Homo sapiens
actgcactccagcctgggtaac

SEQ ID NO: 7733069 - DNA, 22 bp, Homo sapiens
actgcactccaacctgggtgac

SEQ ID NO: 7733070 - DNA, 22 bp, Homo sapiens
actgcactccaacctgggtgac

SEQ ID NO: 7733071 - DNA, 22 bp, Homo sapiens
actgcgctccagcctgggtgac

SEQ ID NO: 7733072 - DNA, 22 bp, Homo sapiens
actgcactccagcctgggtgac

SEQ ID NO: 7733073 - DNA, 22 bp, Homo sapiens
actggccaggcagcagtagctt

SEQ ID NO: 7733074 - DNA, 22 bp, Homo sapiens
agagcagtcaggctaggacact

SEQ ID NO: 7733075 - DNA, 22 bp, Homo sapiens
agagacagggttttgccatgtt

SEQ ID NO: 7733076 - DNA, 22 bp, Homo sapiens
agagacaggatatctgctcatg

SEQ ID NO: 7733077 - DNA, 22 bp, Homo sapiens
aattaaaaaaggagagcttgct

SEQ ID NO: 7733078 - DNA, 22 bp, Homo sapiens
agagacagatctgagggacctc

SEQ ID NO: 7733079 - DNA, 22 bp, Homo sapiens
agagacaggatatctgctcatg

SEQ ID NO: 7733080 - DNA, 18 bp, Homo sapiens
aatgtgaatatttacttc

SEQ ID NO: 7733081 - DNA, 22 bp, Homo sapiens
agaagcagactctgaggcaagg

SEQ ID NO: 7733082 - DNA, 22 bp, Homo sapiens
aatggagacttcaaaatggatt

SEQ ID NO: 7733083 - DNA, 22 bp, Homo sapiens
agaggctctaatcccctccaca

SEQ ID NO: 7733084 - DNA, 22 bp, Homo sapiens
agaggctctaataccagcatgg

SEQ ID NO: 7733085 - DNA, 22 bp, Homo sapiens
agaggctctgccgcctcaggta

SEQ ID NO: 7733086 - DNA, 22 bp, Homo sapiens
agaggctctggtgcagcatgca

SEQ ID NO: 7733087 - DNA, 22 bp, Homo sapiens
agaggccctctctctcctgatg

SEQ ID NO: 7733088 - DNA, 22 bp, Homo sapiens
aattgcaacaggtagacttttc

SEQ ID NO: 7733089 - DNA, 22 bp, Homo sapiens
agagggggtgtcagcactgcag

SEQ ID NO: 7733090 - DNA, 23 bp, Homo sapiens
acaaagtaattcctgcttccaaa

SEQ ID NO: 7733091 - DNA, 19 bp, Homo sapiens
acaaagctgtgagcagctt

SEQ ID NO: 7733092 - DNA, 22 bp, Homo sapiens
acaatcacacatgcaattatac

SEQ ID NO: 7733093 - DNA, 22 bp, Homo sapiens
acaatagacaaagtgaatggct

SEQ ID NO: 7733094 - DNA, 22 bp, Homo sapiens
acaatgaacgctttttaactgt

SEQ ID NO: 7733095 - DNA, 22 bp, Homo sapiens
acaatgaagataatgttgcagt

SEQ ID NO: 7733096 - DNA, 22 bp, Homo sapiens
acaatgaatatcatgaagtact

SEQ ID NO: 7733097 - DNA, 22 bp, Homo sapiens
acaatgaatatcatgaagtact

SEQ ID NO: 7733098 - DNA, 22 bp, Homo sapiens
acaatgcaattgtaaggtgtgt

SEQ ID NO: 7733099 - DNA, 22 bp, Homo sapiens
acaatgcaataggagctagaaa

SEQ ID NO: 7733100 - DNA, 22 bp, Homo sapiens
acaatgcaataggagctagaaa

SEQ ID NO: 7733101 - DNA, 22 bp, Homo sapiens
agataactcattttgtatatcc

SEQ ID NO: 7733102 - DNA, 22 bp, Homo sapiens
agataaattcctaagatttcag

SEQ ID NO: 7733103 - DNA, 22 bp, Homo sapiens
agcagctggtaggagtggccac

SEQ ID NO: 7733104 - DNA, 22 bp, Homo sapiens
acacagagtatttagaaggggt

SEQ ID NO: 7733105 - DNA, 22 bp, Homo sapiens
agcagatgtttcagagcaggct

SEQ ID NO: 7733106 - DNA, 22 bp, Homo sapiens
agcagatgtttcagagcaggct

SEQ ID NO: 7733107 - DNA, 22 bp, Homo sapiens
agcagatggtgtcatgggatgg

SEQ ID NO: 7733108 - DNA, 22 bp, Homo sapiens
agcagatgcgtctgagtgggag

SEQ ID NO: 7733109 - DNA, 22 bp, Homo sapiens
agcagatgaatcccagataaag

SEQ ID NO: 7733110 - DNA, 23 bp, Homo sapiens
acaatgcactttaaatggttccc

SEQ ID NO: 7733111 - DNA, 22 bp, Homo sapiens
acaatgcatacctagcagctca

SEQ ID NO: 7733112 - DNA, 22 bp, Homo sapiens
acaatgcaccagcatcttcacc

SEQ ID NO: 7733113 - DNA, 22 bp, Homo sapiens
acacatgtttccaaaagcaccc

SEQ ID NO: 7733114 - DNA, 22 bp, Homo sapiens
acacatgtatggcacttacatt

SEQ ID NO: 7733115 - DNA, 22 bp, Homo sapiens
acactgagtattgagtagggta

SEQ ID NO: 7733116 - DNA, 22 bp, Homo sapiens
acactgacgcttgacagtcacc

SEQ ID NO: 7733117 - DNA, 22 bp, Homo sapiens
acacattataggcaatcaaaag

SEQ ID NO: 7733118 - DNA, 22 bp, Homo sapiens
acagatgatttttatgaaaaca

SEQ ID NO: 7733119 - DNA, 22 bp, Homo sapiens
acagatgatgtgcacagataga

SEQ ID NO: 7733120 - DNA, 22 bp, Homo sapiens
acagatgagttaaagcagagtg

SEQ ID NO: 7733121 - DNA, 22 bp, Homo sapiens
acagatgaggtgtttggagagc

SEQ ID NO: 7733122 - DNA, 22 bp, Homo sapiens
acagatgaggctggcgagggca

SEQ ID NO: 7733123 - DNA, 22 bp, Homo sapiens
acagatgagttaaagcagagtg

SEQ ID NO: 7733124 - DNA, 22 bp, Homo sapiens
acagatgagttagaataggcag

SEQ ID NO: 7733125 - DNA, 22 bp, Homo sapiens
agcctctcttatcccttcaaag

SEQ ID NO: 7733126 - DNA, 22 bp, Homo sapiens
agctcctgcaccaggggcccct

SEQ ID NO: 7733127 - DNA, 22 bp, Homo sapiens
agctcctgcccaggaaggctct

SEQ ID NO: 7733128 - DNA, 22 bp, Homo sapiens
agctcctgctctttgtccctaa

SEQ ID NO: 7733129 - DNA, 22 bp, Homo sapiens
agctcctgcgcacggtgcacac

SEQ ID NO: 7733130 - DNA, 22 bp, Homo sapiens
agctgggtacagcctgtgccta

SEQ ID NO: 7733131 - DNA, 22 bp, Homo sapiens
acagctcagacatcactgctct

SEQ ID NO: 7733132 - DNA, 22 bp, Homo sapiens
acagctcatttgtaaaacggag

SEQ ID NO: 7733133 - DNA, 22 bp, Homo sapiens
acagctcagacatcactgctct

SEQ ID NO: 7733134 - DNA, 22 bp, Homo sapiens
acagctcctaacaaaggctctc

SEQ ID NO: 7733135 - DNA, 22 bp, Homo sapiens
acagctcttaggcagaaccaac

SEQ ID NO: 7733136 - DNA, 22 bp, Homo sapiens
agctttatgcttcctacaagct

SEQ ID NO: 7733137 - DNA, 22 bp, Homo sapiens
acagctgtgttttataatcagc

SEQ ID NO: 7733138 - DNA, 22 bp, Homo sapiens
acaggctgggcgcttcctgcgg

SEQ ID NO: 7733139 - DNA, 22 bp, Homo sapiens
acaggctgctgggctccgtgct

SEQ ID NO: 7733140 - DNA, 19 bp, Homo sapiens
aggaatggaattaattctg

SEQ ID NO: 7733141 - DNA, 22 bp, Homo sapiens
acagttcaagtcttagacaaca

SEQ ID NO: 7733142 - DNA, 22 bp, Homo sapiens
acagttcaagtcttagacaaca

SEQ ID NO: 7733143 - DNA, 22 bp, Homo sapiens
acagtgcaaataggactgtctt

SEQ ID NO: 7733144 - DNA, 22 bp, Homo sapiens
acagtgcacatcctgagtgatt

SEQ ID NO: 7733145 - DNA, 22 bp, Homo sapiens
acagtgcaaacttttgtctcct

SEQ ID NO: 7733146 - DNA, 22 bp, Homo sapiens
acagtgcaaaccctcgggaaag

SEQ ID NO: 7733147 - DNA, 22 bp, Homo sapiens
acataaatagattattgggagg

SEQ ID NO: 7733148 - DNA, 22 bp, Homo sapiens
aggcagctggaggcagagacta

SEQ ID NO: 7733149 - DNA, 22 bp, Homo sapiens
aggagctgttttgttcagcaaa

SEQ ID NO: 7733150 - DNA, 22 bp, Homo sapiens
aggaggaaagaaggcccccagc

SEQ ID NO: 7733151 - DNA, 22 bp, Homo sapiens
aggagtcctcatgtctgtgcga

SEQ ID NO: 7733152 - DNA, 22 bp, Homo sapiens
agggagctaggatcctgaaggt

SEQ ID NO: 7733153 - DNA, 22 bp, Homo sapiens
acatttgtcttctttcagatta

SEQ ID NO: 7733154 - DNA, 22 bp, Homo sapiens
agggaagaatcactgggatgtt

SEQ ID NO: 7733155 - DNA, 22 bp, Homo sapiens
agggcctgggatgtcctcctag

SEQ ID NO: 7733156 - DNA, 22 bp, Homo sapiens
agggcctgggccagcacccttt

SEQ ID NO: 7733157 - DNA, 22 bp, Homo sapiens
agggcatctctaacagtctcct

SEQ ID NO: 7733158 - DNA, 22 bp, Homo sapiens
agggcatctagttccctctctt

SEQ ID NO: 7733159 - DNA, 22 bp, Homo sapiens
agggcagtgggaaagcctgctc

SEQ ID NO: 7733160 - DNA, 22 bp, Homo sapiens
agggcagcttccatagtctggc

SEQ ID NO: 7733161 - DNA, 22 bp, Homo sapiens
aggccttaccatagctgtagca

SEQ ID NO: 7733162 - DNA, 22 bp, Homo sapiens
aggctaggctgatgcctcttcc

SEQ ID NO: 7733163 - DNA, 22 bp, Homo sapiens
aggctaggccttgccctggaac

SEQ ID NO: 7733164 - DNA, 22 bp, Homo sapiens
aggctgatgctggctgaggctg

SEQ ID NO: 7733165 - DNA, 22 bp, Homo sapiens
acatggaagcaaagttctattt

SEQ ID NO: 7733166 - DNA, 22 bp, Homo sapiens
aggccctgtccatggtgctgaa

SEQ ID NO: 7733167 - DNA, 22 bp, Homo sapiens
aggcagggctgggattagactc

SEQ ID NO: 7733168 - DNA, 22 bp, Homo sapiens
acatgaaagttattctgagttg

SEQ ID NO: 7733169 - DNA, 22 bp, Homo sapiens
aggtactaccagggattttcag

SEQ ID NO: 7733170 - DNA, 22 bp, Homo sapiens
agggctttcggcactctgaggg

SEQ ID NO: 7733171 - DNA, 22 bp, Homo sapiens
agggctttcggcactctgaggg

SEQ ID NO: 7733172 - DNA, 22 bp, Homo sapiens
agggctttacttctcagttcta

SEQ ID NO: 7733173 - DNA, 22 bp, Homo sapiens
agggctttaatgattattttct

SEQ ID NO: 7733174 - DNA, 20 bp, Homo sapiens
agggtggggacgttctgact

SEQ ID NO: 7733175 - DNA, 22 bp, Homo sapiens
agggtgggctagactcttcccc

SEQ ID NO: 7733176 - DNA, 22 bp, Homo sapiens
acctcccagctctgagcttggg

SEQ ID NO: 7733177 - DNA, 22 bp, Homo sapiens
agggtggggtgctacatcttta

SEQ ID NO: 7733178 - DNA, 22 bp, Homo sapiens
actaaagtcctgttgtagcata

SEQ ID NO: 7733179 - DNA, 22 bp, Homo sapiens
actaaagtgttggagaatgagg

SEQ ID NO: 7733180 - DNA, 22 bp, Homo sapiens
actaaatagttttgacagaaca

SEQ ID NO: 7733181 - DNA, 22 bp, Homo sapiens
actaaatagttttgacagaaca

SEQ ID NO: 7733182 - DNA, 22 bp, Homo sapiens
accttcaactcaaagtgtccca

SEQ ID NO: 7733183 - DNA, 21 bp, Homo sapiens
accttcaagccagaggtggtc

SEQ ID NO: 7733184 - DNA, 22 bp, Homo sapiens
accttcaagaaacatttccttg

SEQ ID NO: 7733185 - DNA, 22 bp, Homo sapiens
acctgtttacctgcacctgttt

SEQ ID NO: 7733186 - DNA, 22 bp, Homo sapiens
acctgttttagtctttaatcat

SEQ ID NO: 7733187 - DNA, 22 bp, Homo sapiens
acctgttttcagaaaatgcaga

SEQ ID NO: 7733188 - DNA, 22 bp, Homo sapiens
actaaagtcagactgcattgat

SEQ ID NO: 7733189 - DNA, 22 bp, Homo sapiens
acgtttgctttctttggcctgg

SEQ ID NO: 7733190 - DNA, 23 bp, Homo sapiens
actgcctgtgccgatctctctca

SEQ ID NO: 7733191 - DNA, 22 bp, Homo sapiens
actgcaacacctcctgggttca

SEQ ID NO: 7733192 - DNA, 22 bp, Homo sapiens
actgcaacctccacctcctggg

SEQ ID NO: 7733193 - DNA, 22 bp, Homo sapiens
agtggctgcttctggttgctcc

SEQ ID NO: 7733194 - DNA, 22 bp, Homo sapiens
agtggctgctatgatcaggaca

SEQ ID NO: 7733195 - DNA, 22 bp, Homo sapiens
agtggctgccaagatataattc

SEQ ID NO: 7733196 - DNA, 22 bp, Homo sapiens
agtggctgccaagagcaatgct

SEQ ID NO: 7733197 - DNA, 22 bp, Homo sapiens
agtggctgattacaaactgagt

SEQ ID NO: 7733198 - DNA, 22 bp, Homo sapiens
agtggctgctgactttaataca

SEQ ID NO: 7733199 - DNA, 22 bp, Homo sapiens
agtggctgctggagtggagatg

SEQ ID NO: 7733200 - DNA, 22 bp, Homo sapiens
agtggctgatgtaggcagtggg

SEQ ID NO: 7733201 - DNA, 23 bp, Homo sapiens
agtggctgagagtgtttcatatg

SEQ ID NO: 7733202 - DNA, 20 bp, Homo sapiens
agtggctgatggaaagaagc

SEQ ID NO: 7733203 - DNA, 22 bp, Homo sapiens
agtggctgagtgactgtgactc

SEQ ID NO: 7733204 - DNA, 22 bp, Homo sapiens
agtctggggtctggtagaacga

SEQ ID NO: 7733205 - DNA, 22 bp, Homo sapiens
agtctgggtgtgaatgaacttg

SEQ ID NO: 7733206 - DNA, 21 bp, Homo sapiens
agtctggggaagggatcccag

SEQ ID NO: 7733207 - DNA, 22 bp, Homo sapiens
agtctgggagaaggtgagatta

SEQ ID NO: 7733208 - DNA, 22 bp, Homo sapiens
agtctctggactgggagatggc

SEQ ID NO: 7733209 - DNA, 22 bp, Homo sapiens
agtctctggactgggagatggc

SEQ ID NO: 7733210 - DNA, 22 bp, Homo sapiens
agtctctgcatgatgcagcaca

SEQ ID NO: 7733211 - DNA, 22 bp, Homo sapiens
agtctctggggaggagtggaaa

SEQ ID NO: 7733212 - DNA, 20 bp, Homo sapiens
agtctctgtagtgcctgaga

SEQ ID NO: 7733213 - DNA, 22 bp, Homo sapiens
agtctctgaggttcagatgcct

SEQ ID NO: 7733214 - DNA, 22 bp, Homo sapiens
agtttagacaaagtcttgcatt

SEQ ID NO: 7733215 - DNA, 22 bp, Homo sapiens
actgtctgtcctgctctccgtg

SEQ ID NO: 7733216 - DNA, 22 bp, Homo sapiens
actgtctgtgccagatgctggg

SEQ ID NO: 7733217 - DNA, 22 bp, Homo sapiens
actgtctgtacttcttgcaagg

SEQ ID NO: 7733218 - DNA, 22 bp, Homo sapiens
actgtctgctggcccctggtta

SEQ ID NO: 7733219 - DNA, 22 bp, Homo sapiens
acttagaattaaatatttttgg

SEQ ID NO: 7733220 - DNA, 22 bp, Homo sapiens
actgtgtgctggacatgatgtt

SEQ ID NO: 7733221 - DNA, 22 bp, Homo sapiens
atcagagtgggtctggcatgag

SEQ ID NO: 7733222 - DNA, 22 bp, Homo sapiens
atatgaaaagaagtcaccattg

SEQ ID NO: 7733223 - DNA, 22 bp, Homo sapiens
acttgggagggtgtgggcagct

SEQ ID NO: 7733224 - DNA, 22 bp, Homo sapiens
atataatagtttcataaaggct

SEQ ID NO: 7733225 - DNA, 22 bp, Homo sapiens
cagaagcattccagcaaatagt

SEQ ID NO: 7733226 - DNA, 22 bp, Homo sapiens
cagaagcagtgagagatgtgca

SEQ ID NO: 7733227 - DNA, 22 bp, Homo sapiens
cagaagcctgcctcagatgcac

SEQ ID NO: 7733228 - DNA, 23 bp, Homo sapiens
cagaaatgacagtaagcaccctg

SEQ ID NO: 7733229 - DNA, 22 bp, Homo sapiens
cagagcaacaccctttacatcg

SEQ ID NO: 7733230 - DNA, 22 bp, Homo sapiens
cagagatttttatgcacaccaa

SEQ ID NO: 7733231 - DNA, 23 bp, Homo sapiens
cagagctggctcagagctgcctg

SEQ ID NO: 7733232 - DNA, 22 bp, Homo sapiens
cagagctggcctgtgatttttg

SEQ ID NO: 7733233 - DNA, 22 bp, Homo sapiens
agccccttgcacttccccacgc

SEQ ID NO: 7733234 - DNA, 22 bp, Homo sapiens
agccccttgcacttccccacgc

SEQ ID NO: 7733235 - DNA, 22 bp, Homo sapiens
agccccttgctgccctctagag

SEQ ID NO: 7733236 - DNA, 22 bp, Homo sapiens
agccccttgtgggcgcacagca

SEQ ID NO: 7733237 - DNA, 19 bp, Homo sapiens
agccccttggtactgtcct

SEQ ID NO: 7733238 - DNA, 19 bp, Homo sapiens
agccccttggtactgtcct

SEQ ID NO: 7733239 - DNA, 22 bp, Homo sapiens
agcccggcttccccggttgcta

SEQ ID NO: 7733240 - DNA, 22 bp, Homo sapiens
cagagctgcttcccagtttgtg

SEQ ID NO: 7733241 - DNA, 22 bp, Homo sapiens
cagcacagggacaatagcagat

SEQ ID NO: 7733242 - DNA, 22 bp, Homo sapiens
agcctccatctcccatctgtga

SEQ ID NO: 7733243 - DNA, 22 bp, Homo sapiens
cagcagaaatggattttgagat

SEQ ID NO: 7733244 - DNA, 22 bp, Homo sapiens
agcctccaaatgtcaggtcccg

SEQ ID NO: 7733245 - DNA, 22 bp, Homo sapiens
cagcagaggcacgtctgtgaat

SEQ ID NO: 7733246 - DNA, 22 bp, Homo sapiens
cagcagcagtggctgcagaaca

SEQ ID NO: 7733247 - DNA, 22 bp, Homo sapiens
cagcagcagtggctgcagaaca

SEQ ID NO: 7733248 - DNA, 22 bp, Homo sapiens
cagcagcagccccaggaaggtt

SEQ ID NO: 7733249 - DNA, 22 bp, Homo sapiens
cagcagcagcttagtggtcccc

SEQ ID NO: 7733250 - DNA, 22 bp, Homo sapiens
cagcagcatgaattcgagccac

SEQ ID NO: 7733251 - DNA, 22 bp, Homo sapiens
cagcagcatcaggtctgtggtt

SEQ ID NO: 7733252 - DNA, 22 bp, Homo sapiens
cagccctggccccaggtggtct

SEQ ID NO: 7733253 - DNA, 22 bp, Homo sapiens
cagccctggcctcttcgctttc

SEQ ID NO: 7733254 - DNA, 22 bp, Homo sapiens
cagccctggctagggcgagggc

SEQ ID NO: 7733255 - DNA, 22 bp, Homo sapiens
cagccctgggagttggggccga

SEQ ID NO: 7733256 - DNA, 22 bp, Homo sapiens
cagccagagaaagggcactgcc

SEQ ID NO: 7733257 - DNA, 22 bp, Homo sapiens
cagccagcctctcaaccatgca

SEQ ID NO: 7733258 - DNA, 22 bp, Homo sapiens
cagcaggaggcatggcttccct

SEQ ID NO: 7733259 - DNA, 22 bp, Homo sapiens
agctcagaactgcagacatgtg

SEQ ID NO: 7733260 - DNA, 22 bp, Homo sapiens
agctcagaagcctatgcatagt

SEQ ID NO: 7733261 - DNA, 23 bp, Homo sapiens
agcaggtaggttgaaattttcct

SEQ ID NO: 7733262 - DNA, 22 bp, Homo sapiens
cacagtccagactcctggagtt

SEQ ID NO: 7733263 - DNA, 22 bp, Homo sapiens
cacagtcccattcgagagtaat

SEQ ID NO: 7733264 - DNA, 22 bp, Homo sapiens
agcagttgtagtcatggaaaat

SEQ ID NO: 7733265 - DNA, 22 bp, Homo sapiens
agcagtttggaaaatactagaa

SEQ ID NO: 7733266 - DNA, 22 bp, Homo sapiens
agcagttttagggagacacatt

SEQ ID NO: 7733267 - DNA, 20 bp, Homo sapiens
agcagtttcctaactcagct

SEQ ID NO: 7733268 - DNA, 22 bp, Homo sapiens
agcagtttgaatcaatggccag

SEQ ID NO: 7733269 - DNA, 22 bp, Homo sapiens
agcataaaggcactagaaagag

SEQ ID NO: 7733270 - DNA, 22 bp, Homo sapiens
agcagtttttataacactggaa

SEQ ID NO: 7733271 - DNA, 22 bp, Homo sapiens
agcataagttggtacagccact

SEQ ID NO: 7733272 - DNA, 22 bp, Homo sapiens
cacagggccttgtgtgactgca

SEQ ID NO: 7733273 - DNA, 22 bp, Homo sapiens
cacaggaggttaggaagtggtc

SEQ ID NO: 7733274 - DNA, 22 bp, Homo sapiens
agcagctgtggaaaagtaacta

SEQ ID NO: 7733275 - DNA, 18 bp, Homo sapiens
agcagctgtgccacactg

SEQ ID NO: 7733276 - DNA, 18 bp, Homo sapiens
agcagctgtcagaatgcc

SEQ ID NO: 7733277 - DNA, 19 bp, Homo sapiens
agcagctgtagatagacac

SEQ ID NO: 7733278 - DNA, 22 bp, Homo sapiens
agcagctgtcccttaacatcag

SEQ ID NO: 7733279 - DNA, 22 bp, Homo sapiens
caatgacatggataatcatatt

SEQ ID NO: 7733280 - DNA, 22 bp, Homo sapiens
agcagctgtggggacaagggta

SEQ ID NO: 7733281 - DNA, 22 bp, Homo sapiens
agcagcttatcttggagaggca

SEQ ID NO: 7733282 - DNA, 22 bp, Homo sapiens
agcagctgttagaaacaggaag

SEQ ID NO: 7733283 - DNA, 22 bp, Homo sapiens
agcacagagttgcagagagcgt

SEQ ID NO: 7733284 - DNA, 22 bp, Homo sapiens
agcacagataacatggagtgga

SEQ ID NO: 7733285 - DNA, 22 bp, Homo sapiens
agcacagagctcggggaatgga

SEQ ID NO: 7733286 - DNA, 22 bp, Homo sapiens
agcacagactggtcccaggtct

SEQ ID NO: 7733287 - DNA, 19 bp, Homo sapiens
agcacagacaagaccagca

SEQ ID NO: 7733288 - DNA, 22 bp, Homo sapiens
caaatattccaggtacatccct

SEQ ID NO: 7733289 - DNA, 21 bp, Homo sapiens
agcacagcatatccaatgtca

SEQ ID NO: 7733290 - DNA, 20 bp, Homo sapiens
agcacagcgcggtgttcctt

SEQ ID NO: 7733291 - DNA, 22 bp, Homo sapiens
caaatgcaggtcagcaggtgtc

SEQ ID NO: 7733292 - DNA, 22 bp, Homo sapiens
caaatgcatagaaagatgaaac

SEQ ID NO: 7733293 - DNA, 22 bp, Homo sapiens
agcagaagaggtcttgttgctg

SEQ ID NO: 7733294 - DNA, 17 bp, Homo sapiens
agcagaagtcagaggga

SEQ ID NO: 7733295 - DNA, 17 bp, Homo sapiens
agcagaagtcagaggga

SEQ ID NO: 7733296 - DNA, 17 bp, Homo sapiens
agcagaagtcagaggga

SEQ ID NO: 7733297 - DNA, 22 bp, Homo sapiens
agcagcattatgatatatctta

SEQ ID NO: 7733298 - DNA, 22 bp, Homo sapiens
agcagcatgttgggatgtgaaa

SEQ ID NO: 7733299 - DNA, 22 bp, Homo sapiens
agcagcatggatgggcctcagc

SEQ ID NO: 7733300 - DNA, 22 bp, Homo sapiens
agcagcatggctgactaaagac

SEQ ID NO: 7733301 - DNA, 22 bp, Homo sapiens
agcagcatcttctaagtaaggc

SEQ ID NO: 7733302 - DNA, 22 bp, Homo sapiens
agcagcatcttctgttctccgc

SEQ ID NO: 7733303 - DNA, 20 bp, Homo sapiens
agcagcattgttctagagca

SEQ ID NO: 7733304 - DNA, 22 bp, Homo sapiens
caatgaaaatttaagttgcagc

SEQ ID NO: 7733305 - DNA, 22 bp, Homo sapiens
caatgaaagcaactgcctataa

SEQ ID NO: 7733306 - DNA, 22 bp, Homo sapiens
caatgaaattgagatccagaga

SEQ ID NO: 7733307 - DNA, 22 bp, Homo sapiens
agcagcatctcttattgcagtg

SEQ ID NO: 7733308 - DNA, 22 bp, Homo sapiens
agcagcatattgtgtcttcata

SEQ ID NO: 7733309 - DNA, 22 bp, Homo sapiens
agcagcatatcagagaaagtca

SEQ ID NO: 7733310 - DNA, 22 bp, Homo sapiens
agcagcatagatgctatccgag

SEQ ID NO: 7733311 - DNA, 22 bp, Homo sapiens
agcagcacccagagccatgtct

SEQ ID NO: 7733312 - DNA, 22 bp, Homo sapiens
agcagcacctgtcctcgctgct

SEQ ID NO: 7733313 - DNA, 22 bp, Homo sapiens
agcagcacgagtccacaaatcc

SEQ ID NO: 7733314 - DNA, 22 bp, Homo sapiens
agcagcaatggaaagcaacaca

SEQ ID NO: 7733315 - DNA, 22 bp, Homo sapiens
agcagcacacgggagaaagaca

SEQ ID NO: 7733316 - DNA, 22 bp, Homo sapiens
agcagcaaggaagcgaggatgg

SEQ ID NO: 7733317 - DNA, 22 bp, Homo sapiens
agcagcaagcagtgcacgggtt

SEQ ID NO: 7733318 - DNA, 22 bp, Homo sapiens
agcagaatctgtccttggaaga

SEQ ID NO: 7733319 - DNA, 22 bp, Homo sapiens
agacagtgatggacaggcagac

SEQ ID NO: 7733320 - DNA, 20 bp, Homo sapiens
agaagaggatacaaccaggc

SEQ ID NO: 7733321 - DNA, 20 bp, Homo sapiens
agaagaggatacaaccaggc

SEQ ID NO: 7733322 - DNA, 22 bp, Homo sapiens
agaagatgtcactgcagacagc

SEQ ID NO: 7733323 - DNA, 22 bp, Homo sapiens
agaagattattagagactttgt

SEQ ID NO: 7733324 - DNA, 22 bp, Homo sapiens
agaagagcctggggaccatggc

SEQ ID NO: 7733325 - DNA, 22 bp, Homo sapiens
agaagagaactgccaaacactt

SEQ ID NO: 7733326 - DNA, 22 bp, Homo sapiens
atctttgtgctaatgtagttct

SEQ ID NO: 7733327 - DNA, 22 bp, Homo sapiens
agaatcaattcactgctgcagc

SEQ ID NO: 7733328 - DNA, 20 bp, Homo sapiens
atctttgtctctgtagttgt

SEQ ID NO: 7733329 - DNA, 22 bp, Homo sapiens
agaaggctcatttgactgcatt

SEQ ID NO: 7733330 - DNA, 22 bp, Homo sapiens
agaaggctcatttgactgcatt

SEQ ID NO: 7733331 - DNA, 22 bp, Homo sapiens
agaaggctggccatggtgccct

SEQ ID NO: 7733332 - DNA, 22 bp, Homo sapiens
agaaggccaagaagaagcctat

SEQ ID NO: 7733333 - DNA, 22 bp, Homo sapiens
agaaggccaatagggtgcactg

SEQ ID NO: 7733334 - DNA, 22 bp, Homo sapiens
agaaggccagatggacggggct

SEQ ID NO: 7733335 - DNA, 22 bp, Homo sapiens
agaaggctcactaagagtgact

SEQ ID NO: 7733336 - DNA, 22 bp, Homo sapiens
agaaggctaaagaaacagattg

SEQ ID NO: 7733337 - DNA, 22 bp, Homo sapiens
agaaggcctaacttgggggcaa

SEQ ID NO: 7733338 - DNA, 22 bp, Homo sapiens
atggataaatacttggtggtat

SEQ ID NO: 7733339 - DNA, 22 bp, Homo sapiens
atggataatcatgaactttgag

SEQ ID NO: 7733340 - DNA, 22 bp, Homo sapiens
atggataagtcaaagagtatcc

SEQ ID NO: 7733341 - DNA, 22 bp, Homo sapiens
atggagttctgccagcgctgct

SEQ ID NO: 7733342 - DNA, 22 bp, Homo sapiens
atggaaatacagccagagcaga

SEQ ID NO: 7733343 - DNA, 19 bp, Homo sapiens
atggaaaatgccagactga

SEQ ID NO: 7733344 - DNA, 22 bp, Homo sapiens
atgcttggatgctgccatggga

SEQ ID NO: 7733345 - DNA, 22 bp, Homo sapiens
atggaaatatctttagagctta

SEQ ID NO: 7733346 - DNA, 22 bp, Homo sapiens
atggaaatatctttagagctta

SEQ ID NO: 7733347 - DNA, 22 bp, Homo sapiens
atggaaatcgatgtctaagtta

SEQ ID NO: 7733348 - DNA, 22 bp, Homo sapiens
atgtacaggatggtgctcatct

SEQ ID NO: 7733349 - DNA, 22 bp, Homo sapiens
atgtacagccacttcacagtta

SEQ ID NO: 7733350 - DNA, 22 bp, Homo sapiens
atgtacagtggaaactaacaaa

SEQ ID NO: 7733351 - DNA, 22 bp, Homo sapiens
atgtacagtttctagactcaaa

SEQ ID NO: 7733352 - DNA, 22 bp, Homo sapiens
atgggaggcagcagagcccagc

SEQ ID NO: 7733353 - DNA, 22 bp, Homo sapiens
atgtttctgagtgtatatacat

SEQ ID NO: 7733354 - DNA, 22 bp, Homo sapiens
attaaagacagcagatggatgg

SEQ ID NO: 7733355 - DNA, 22 bp, Homo sapiens
attagcattgctactctcaaga

SEQ ID NO: 7733356 - DNA, 22 bp, Homo sapiens
attacagtggacagctatgcac

SEQ ID NO: 7733357 - DNA, 22 bp, Homo sapiens
attaaatactgcaggctaagca

SEQ ID NO: 7733358 - DNA, 22 bp, Homo sapiens
attcagcagttcctgcttcagt

SEQ ID NO: 7733359 - DNA, 22 bp, Homo sapiens
attcagcataatcagtagcttg

SEQ ID NO: 7733360 - DNA, 22 bp, Homo sapiens
attcacaattagaagtagataa

SEQ ID NO: 7733361 - DNA, 22 bp, Homo sapiens
attcacactgtatacacaggat

SEQ ID NO: 7733362 - DNA, 22 bp, Homo sapiens
attcacactgtatacacaggat

SEQ ID NO: 7733363 - DNA, 22 bp, Homo sapiens
agagggagtgaaatggaataga

SEQ ID NO: 7733364 - DNA, 22 bp, Homo sapiens
attctggacaaggcaagctcct

SEQ ID NO: 7733365 - DNA, 22 bp, Homo sapiens
attcagctgactttgattcatt

SEQ ID NO: 7733366 - DNA, 22 bp, Homo sapiens
attctctgtttccaagatgaaa

SEQ ID NO: 7733367 - DNA, 22 bp, Homo sapiens
attctctgtgtctgctttccca

SEQ ID NO: 7733368 - DNA, 22 bp, Homo sapiens
atttcattgaagttaattcttc

SEQ ID NO: 7733369 - DNA, 22 bp, Homo sapiens
agatgacaaatcaggggacggg

SEQ ID NO: 7733370 - DNA, 23 bp, Homo sapiens
agatgaaagcttcccatcacagt

SEQ ID NO: 7733371 - DNA, 22 bp, Homo sapiens
agatgaaatttgtgttgagttg

SEQ ID NO: 7733372 - DNA, 22 bp, Homo sapiens
agatgaagactcaggagcaggt

SEQ ID NO: 7733373 - DNA, 22 bp, Homo sapiens
agatgaagatatctgcaggggc

SEQ ID NO: 7733374 - DNA, 22 bp, Homo sapiens
agatgaaaagataagcagcaat

SEQ ID NO: 7733375 - DNA, 22 bp, Homo sapiens
agatgaaagatttttatagaga

SEQ ID NO: 7733376 - DNA, 22 bp, Homo sapiens
agatgtaaactctcatgtcatt

SEQ ID NO: 7733377 - DNA, 22 bp, Homo sapiens
agatgtaccaggtattacagga

SEQ ID NO: 7733378 - DNA, 22 bp, Homo sapiens
atttgcttctgctaaacaactt

SEQ ID NO: 7733379 - DNA, 22 bp, Homo sapiens
agatgtggatcctagggtagaa

SEQ ID NO: 7733380 - DNA, 22 bp, Homo sapiens
agatgtggaacactagactgct

SEQ ID NO: 7733381 - DNA, 22 bp, Homo sapiens
agatgtggaaagaagttagaag

SEQ ID NO: 7733382 - DNA, 22 bp, Homo sapiens
agatgtgagaatcaagtgacca

SEQ ID NO: 7733383 - DNA, 22 bp, Homo sapiens
agaggtatgtgtcagtgcttat

SEQ ID NO: 7733384 - DNA, 22 bp, Homo sapiens
agaggtatatattctccatatt

SEQ ID NO: 7733385 - DNA, 22 bp, Homo sapiens
agagtggcttctttgacatgct

SEQ ID NO: 7733386 - DNA, 23 bp, Homo sapiens
atttacaggttaaatgaaatcag

SEQ ID NO: 7733387 - DNA, 22 bp, Homo sapiens
aggagaggcatcaagaaaatcg

SEQ ID NO: 7733388 - DNA, 22 bp, Homo sapiens
aggagaggcatcaagaaaatcg

SEQ ID NO: 7733389 - DNA, 22 bp, Homo sapiens
aggagaggggtaggattaattt

SEQ ID NO: 7733390 - DNA, 22 bp, Homo sapiens
aggagagagaacacttgggtcc

SEQ ID NO: 7733391 - DNA, 22 bp, Homo sapiens
aggagctaattcataagccact

SEQ ID NO: 7733392 - DNA, 20 bp, Homo sapiens
aggaggcaatgtagataagc

SEQ ID NO: 7733393 - DNA, 22 bp, Homo sapiens
aggagctgagtcagcccgacag

SEQ ID NO: 7733394 - DNA, 22 bp, Homo sapiens
cagtctctcttgtagtgcagct

SEQ ID NO: 7733395 - DNA, 22 bp, Homo sapiens
cagtctctctccttgcaggcgt

SEQ ID NO: 7733396 - DNA, 19 bp, Homo sapiens
aggagaagactctctcccc

SEQ ID NO: 7733397 - DNA, 22 bp, Homo sapiens
aggagacagaatttaaatttgg

SEQ ID NO: 7733398 - DNA, 22 bp, Homo sapiens
aggacagcagtgctggcacttg

SEQ ID NO: 7733399 - DNA, 22 bp, Homo sapiens
cagtcctgctggccttccctgg

SEQ ID NO: 7733400 - DNA, 22 bp, Homo sapiens
cagtcctgctggccttccctgg

SEQ ID NO: 7733401 - DNA, 22 bp, Homo sapiens
cagtcctggagcccttcttggc

SEQ ID NO: 7733402 - DNA, 22 bp, Homo sapiens
cagtcctgggagacttacccag

SEQ ID NO: 7733403 - DNA, 20 bp, Homo sapiens
cagtcctgccccttggggac

SEQ ID NO: 7733404 - DNA, 22 bp, Homo sapiens
cagtcctgctagtgtgaaaagc

SEQ ID NO: 7733405 - DNA, 22 bp, Homo sapiens
cagtcctgcccaggctgacaga

SEQ ID NO: 7733406 - DNA, 20 bp, Homo sapiens
aggacagcagctgccacttg

SEQ ID NO: 7733407 - DNA, 22 bp, Homo sapiens
cagtcctgagccaatcatgatg

SEQ ID NO: 7733408 - DNA, 22 bp, Homo sapiens
cagtcctgaatactggacggtg

SEQ ID NO: 7733409 - DNA, 22 bp, Homo sapiens
cagtcctgaggaagagctgctg

SEQ ID NO: 7733410 - DNA, 22 bp, Homo sapiens
cagtcctgagctcctgggctga

SEQ ID NO: 7733411 - DNA, 20 bp, Homo sapiens
cagtcctgcaggcgggagaa

SEQ ID NO: 7733412 - DNA, 22 bp, Homo sapiens
aggaagctgctaagaaacaatg

SEQ ID NO: 7733413 - DNA, 22 bp, Homo sapiens
aggaagctgggaaactgacatt

SEQ ID NO: 7733414 - DNA, 20 bp, Homo sapiens
aggaagctgagatgtagagg

SEQ ID NO: 7733415 - DNA, 19 bp, Homo sapiens
aggaaggaacctgagtctg

SEQ ID NO: 7733416 - DNA, 19 bp, Homo sapiens
aggaaggaacctgagtctg

SEQ ID NO: 7733417 - DNA, 22 bp, Homo sapiens
aggaaggaagagacaccatttg

SEQ ID NO: 7733418 - DNA, 19 bp, Homo sapiens
aggaaggaacctgagtctg

SEQ ID NO: 7733419 - DNA, 20 bp, Homo sapiens
aggaaggaagtttgcatgga

SEQ ID NO: 7733420 - DNA, 22 bp, Homo sapiens
aggaaggactccatggtccgtc

SEQ ID NO: 7733421 - DNA, 22 bp, Homo sapiens
aggaaggactgcagcatttggt

SEQ ID NO: 7733422 - DNA, 21 bp, Homo sapiens
catttacatgacagattggtt

SEQ ID NO: 7733423 - DNA, 22 bp, Homo sapiens
aggcagcatttctgcttatcca

SEQ ID NO: 7733424 - DNA, 19 bp, Homo sapiens
aggcagcattctggggctt

SEQ ID NO: 7733425 - DNA, 19 bp, Homo sapiens
aggcagaggcttggctagc

SEQ ID NO: 7733426 - DNA, 22 bp, Homo sapiens
cattccaagtatatacatgata

SEQ ID NO: 7733427 - DNA, 22 bp, Homo sapiens
cattcaaaagctccatgtttgt

SEQ ID NO: 7733428 - DNA, 22 bp, Homo sapiens
catgcctgtatttctgatctat

SEQ ID NO: 7733429 - DNA, 22 bp, Homo sapiens
catggccaggcccagggcccag

SEQ ID NO: 7733430 - DNA, 22 bp, Homo sapiens
catggccaggccaagagagtac

SEQ ID NO: 7733431 - DNA, 22 bp, Homo sapiens
catggccagggcagatggcagg

SEQ ID NO: 7733432 - DNA, 22 bp, Homo sapiens
catggccagggagagagaatgt

SEQ ID NO: 7733433 - DNA, 22 bp, Homo sapiens
catgcctgtaatcccagctctt

SEQ ID NO: 7733434 - DNA, 22 bp, Homo sapiens
catgcctgcctggtgggcgtgg

SEQ ID NO: 7733435 - DNA, 22 bp, Homo sapiens
aggaggcactcactctcagggt

SEQ ID NO: 7733436 - DNA, 21 bp, Homo sapiens
aggaaaggaagtccccagggt

SEQ ID NO: 7733437 - DNA, 20 bp, Homo sapiens
aggaaagcctgtgtgagtct

SEQ ID NO: 7733438 - DNA, 22 bp, Homo sapiens
aggaaagatggaaggaggataa

SEQ ID NO: 7733439 - DNA, 22 bp, Homo sapiens
aggaaagactggggccccagaa

SEQ ID NO: 7733440 - DNA, 22 bp, Homo sapiens
aggaaagatggaaggaggataa

SEQ ID NO: 7733441 - DNA, 22 bp, Homo sapiens
aggaaagaagtacattctcatg

SEQ ID NO: 7733442 - DNA, 18 bp, Homo sapiens
aggaaagacgaagagggc

SEQ ID NO: 7733443 - DNA, 22 bp, Homo sapiens
aggaaatgtagtcctcatctcc

SEQ ID NO: 7733444 - DNA, 22 bp, Homo sapiens
aggaaccagacagaactgaatg

SEQ ID NO: 7733445 - DNA, 22 bp, Homo sapiens
aggaagctcctggagagccagt

SEQ ID NO: 7733446 - DNA, 22 bp, Homo sapiens
aggaagctcattttgacatatc

SEQ ID NO: 7733447 - DNA, 18 bp, Homo sapiens
aggaagcaggaggaaggc

SEQ ID NO: 7733448 - DNA, 22 bp, Homo sapiens
aggaagctcaaagccatgatgt

SEQ ID NO: 7733449 - DNA, 22 bp, Homo sapiens
caggcctggagtgcaatggcac

SEQ ID NO: 7733450 - DNA, 22 bp, Homo sapiens
caggcctggagtgcaatggcac

SEQ ID NO: 7733451 - DNA, 22 bp, Homo sapiens
caggcctggctgcagctcgcct

SEQ ID NO: 7733452 - DNA, 22 bp, Homo sapiens
caggcctggggctggcttccag

SEQ ID NO: 7733453 - DNA, 22 bp, Homo sapiens
agctgtggcagcagccgtggca

SEQ ID NO: 7733454 - DNA, 21 bp, Homo sapiens
caggccccaggcctggggtgc

SEQ ID NO: 7733455 - DNA, 22 bp, Homo sapiens
agcttggtggccctcctggctg

SEQ ID NO: 7733456 - DNA, 22 bp, Homo sapiens
agcttgggcaacacagcaagac

SEQ ID NO: 7733457 - DNA, 22 bp, Homo sapiens
agcttaaactctttgaagttat

SEQ ID NO: 7733458 - DNA, 22 bp, Homo sapiens
cagcttgaaatattaggagatg

SEQ ID NO: 7733459 - DNA, 22 bp, Homo sapiens
agctgaggccacgagtgaaggg

SEQ ID NO: 7733460 - DNA, 22 bp, Homo sapiens
cagcttctgtttattgtgtgcc

SEQ ID NO: 7733461 - DNA, 22 bp, Homo sapiens
cagcttctgctcatggaggggt

SEQ ID NO: 7733462 - DNA, 22 bp, Homo sapiens
cagcttctgtttctagcccctg

SEQ ID NO: 7733463 - DNA, 22 bp, Homo sapiens
cagcttcttacgagctggtact

SEQ ID NO: 7733464 - DNA, 22 bp, Homo sapiens
cagcttcttcagtcctggagct

SEQ ID NO: 7733465 - DNA, 22 bp, Homo sapiens
cagctctcacacttagcttcta

SEQ ID NO: 7733466 - DNA, 22 bp, Homo sapiens
cagctctgaagaaaggtgtcta

SEQ ID NO: 7733467 - DNA, 22 bp, Homo sapiens
agctctggaactcccggctgct

SEQ ID NO: 7733468 - DNA, 22 bp, Homo sapiens
cagctcctgcctgggcagctgt

SEQ ID NO: 7733469 - DNA, 22 bp, Homo sapiens
agctcctgtgtgaagcctccct

SEQ ID NO: 7733470 - DNA, 22 bp, Homo sapiens
caggacacttgttcttctctgc

SEQ ID NO: 7733471 - DNA, 22 bp, Homo sapiens
agctgctgagccaggctgatgt

SEQ ID NO: 7733472 - DNA, 22 bp, Homo sapiens
agctgctgaatgacactgcaag

SEQ ID NO: 7733473 - DNA, 22 bp, Homo sapiens
ccaggctctgcaaaatcaggct

SEQ ID NO: 7733474 - DNA, 22 bp, Homo sapiens
ccaggctctgccaggcccttga

SEQ ID NO: 7733475 - DNA, 22 bp, Homo sapiens
aggctccacggcaggatgctgt

SEQ ID NO: 7733476 - DNA, 22 bp, Homo sapiens
ccaggcctagcccctgagggta

SEQ ID NO: 7733477 - DNA, 22 bp, Homo sapiens
aggctccataccatctccggag

SEQ ID NO: 7733478 - DNA, 22 bp, Homo sapiens
aggctccattcatgtgaaggca

SEQ ID NO: 7733479 - DNA, 22 bp, Homo sapiens
aggcctcagtttgtcatctgta

SEQ ID NO: 7733480 - DNA, 22 bp, Homo sapiens
aggcctcagttcttgccaggtg

SEQ ID NO: 7733481 - DNA, 22 bp, Homo sapiens
aggcctcagctcagtgtgacag

SEQ ID NO: 7733482 - DNA, 22 bp, Homo sapiens
aggcctcagcctgccaggcctg

SEQ ID NO: 7733483 - DNA, 22 bp, Homo sapiens
ccaggcatggggagagccagat

SEQ ID NO: 7733484 - DNA, 20 bp, Homo sapiens
aggctctgccattgtccctg

SEQ ID NO: 7733485 - DNA, 22 bp, Homo sapiens
aggctctgccaattccttcctc

SEQ ID NO: 7733486 - DNA, 20 bp, Homo sapiens
aggctctgcctgcaggccca

SEQ ID NO: 7733487 - DNA, 22 bp, Homo sapiens
aggctctgatcaggtggctgtg

SEQ ID NO: 7733488 - DNA, 22 bp, Homo sapiens
aggctctgagtagagctgccag

SEQ ID NO: 7733489 - DNA, 19 bp, Homo sapiens
ccagtgcaaggtaagatag

SEQ ID NO: 7733490 - DNA, 22 bp, Homo sapiens
ccagtgcacaatggaacaactc

SEQ ID NO: 7733491 - DNA, 22 bp, Homo sapiens
ccagtgcacagccaggcaggtg

SEQ ID NO: 7733492 - DNA, 22 bp, Homo sapiens
ccagtctgctgtggtaggaaga

SEQ ID NO: 7733493 - DNA, 22 bp, Homo sapiens
ccagttccagtgctcacatcca

SEQ ID NO: 7733494 - DNA, 22 bp, Homo sapiens
ccagtgcaccaagaggcctaga

SEQ ID NO: 7733495 - DNA, 22 bp, Homo sapiens
ccagtgcaccatttccctctgt

SEQ ID NO: 7733496 - DNA, 22 bp, Homo sapiens
ccagtgcaccatttccctctgt

SEQ ID NO: 7733497 - DNA, 22 bp, Homo sapiens
aggcagtttatccccagagcct

SEQ ID NO: 7733498 - DNA, 22 bp, Homo sapiens
aggcagtttaggcagcgattta

SEQ ID NO: 7733499 - DNA, 22 bp, Homo sapiens
aggcagttgttgctgagcagct

SEQ ID NO: 7733500 - DNA, 22 bp, Homo sapiens
aggcccagtgtggcttcctgga

SEQ ID NO: 7733501 - DNA, 20 bp, Homo sapiens
aggccccaggaaactctcag

SEQ ID NO: 7733502 - DNA, 22 bp, Homo sapiens
aggccccaaagcagtgcaagta

SEQ ID NO: 7733503 - DNA, 22 bp, Homo sapiens
aggcccagtagtcgacggcgct

SEQ ID NO: 7733504 - DNA, 22 bp, Homo sapiens
aggcccagtagtgctgccttta

SEQ ID NO: 7733505 - DNA, 22 bp, Homo sapiens
aggccagcttccagaggggcag

SEQ ID NO: 7733506 - DNA, 22 bp, Homo sapiens
aggccagcctcaggcagggacc

SEQ ID NO: 7733507 - DNA, 22 bp, Homo sapiens
agggaggagaatggactccttc

SEQ ID NO: 7733508 - DNA, 22 bp, Homo sapiens
ccctggcccctcactccgaggc

SEQ ID NO: 7733509 - DNA, 22 bp, Homo sapiens
agggccagggaaacgatcagca

SEQ ID NO: 7733510 - DNA, 20 bp, Homo sapiens
cctccaggcacacccatgtg

SEQ ID NO: 7733511 - DNA, 22 bp, Homo sapiens
cctcagtgagatgctcagcgaa

SEQ ID NO: 7733512 - DNA, 22 bp, Homo sapiens
cctcagtgacctattgcattca

SEQ ID NO: 7733513 - DNA, 22 bp, Homo sapiens
cctcagagacagtaactggaat

SEQ ID NO: 7733514 - DNA, 22 bp, Homo sapiens
ccctgttttaagttgatattga

SEQ ID NO: 7733515 - DNA, 22 bp, Homo sapiens
cccttcaagctctctgggtttt

SEQ ID NO: 7733516 - DNA, 22 bp, Homo sapiens
cccttcagctgagtgggacagc

SEQ ID NO: 7733517 - DNA, 22 bp, Homo sapiens
cctcaaagtagagggagatgag

SEQ ID NO: 7733518 - DNA, 22 bp, Homo sapiens
cctcaaaggcctggcaccagaa

SEQ ID NO: 7733519 - DNA, 22 bp, Homo sapiens
cctcaaagcggtatgcagacgg

SEQ ID NO: 7733520 - DNA, 22 bp, Homo sapiens
agggaggaaggaactccttcta

SEQ ID NO: 7733521 - DNA, 22 bp, Homo sapiens
ccccatgaagtagggtctctga

SEQ ID NO: 7733522 - DNA, 22 bp, Homo sapiens
agggaaggaggccatgtgtccc

SEQ ID NO: 7733523 - DNA, 22 bp, Homo sapiens
agggagaggttgaaacctcagt

SEQ ID NO: 7733524 - DNA, 22 bp, Homo sapiens
ccataatctggctttgagagag

SEQ ID NO: 7733525 - DNA, 22 bp, Homo sapiens
ccataatcgtgtgttaaataat

SEQ ID NO: 7733526 - DNA, 22 bp, Homo sapiens
cccagcctctgtttgctcctct

SEQ ID NO: 7733527 - DNA, 22 bp, Homo sapiens
cccagctccttggatgggcagg

SEQ ID NO: 7733528 - DNA, 22 bp, Homo sapiens
cccagctccttacagggccgaa

SEQ ID NO: 7733529 - DNA, 22 bp, Homo sapiens
cccagcctgatctcggccagct

SEQ ID NO: 7733530 - DNA, 22 bp, Homo sapiens
aggctgttttgtataaactgga

SEQ ID NO: 7733531 - DNA, 22 bp, Homo sapiens
cccagctctaggagtggtggca

SEQ ID NO: 7733532 - DNA, 23 bp, Homo sapiens
cctggctggattctctgcattca

SEQ ID NO: 7733533 - DNA, 22 bp, Homo sapiens
cctggctcttcagaggttccta

SEQ ID NO: 7733534 - DNA, 22 bp, Homo sapiens
cctggctctgtcctcgcgcaaa

SEQ ID NO: 7733535 - DNA, 22 bp, Homo sapiens
cctggctgctttcactatggag

SEQ ID NO: 7733536 - DNA, 22 bp, Homo sapiens
cctggctgcttcctctgccatg

SEQ ID NO: 7733537 - DNA, 22 bp, Homo sapiens
cctggccaatctagggctgtta

SEQ ID NO: 7733538 - DNA, 22 bp, Homo sapiens
cctggccacagggctctgcatt

SEQ ID NO: 7733539 - DNA, 22 bp, Homo sapiens
cctggccacccagccttggcca

SEQ ID NO: 7733540 - DNA, 22 bp, Homo sapiens
cctggaccaaacactggcctgg

SEQ ID NO: 7733541 - DNA, 22 bp, Homo sapiens
cctgctgctatgaaggtgacag

SEQ ID NO: 7733542 - DNA, 22 bp, Homo sapiens
cctgcccccgtcagaggtgatg

SEQ ID NO: 7733543 - DNA, 22 bp, Homo sapiens
cctgccctaatccagagactag

SEQ ID NO: 7733544 - DNA, 22 bp, Homo sapiens
cctgccctagagatgacacaat

SEQ ID NO: 7733545 - DNA, 22 bp, Homo sapiens
agggtctgtggatgcatctggg

SEQ ID NO: 7733546 - DNA, 22 bp, Homo sapiens
agggtctgttgtttgttctgga

SEQ ID NO: 7733547 - DNA, 22 bp, Homo sapiens
agggtctgtatttctggcaagc

SEQ ID NO: 7733548 - DNA, 22 bp, Homo sapiens
agggtgaatctcacaactctta

SEQ ID NO: 7733549 - DNA, 22 bp, Homo sapiens
agggtctgaccaccagtaggga

SEQ ID NO: 7733550 - DNA, 22 bp, Homo sapiens
agggtctgaccaccagtaggga

SEQ ID NO: 7733551 - DNA, 22 bp, Homo sapiens
agggtctgactcctctggcaag

SEQ ID NO: 7733552 - DNA, 20 bp, Homo sapiens
agggtctgatgtggtggccc

SEQ ID NO: 7733553 - DNA, 20 bp, Homo sapiens
agggtctgatgtggtggccc

SEQ ID NO: 7733554 - DNA, 21 bp, Homo sapiens
agggtcctacagggctcagga

SEQ ID NO: 7733555 - DNA, 20 bp, Homo sapiens
agggtcagtagcacagagct

SEQ ID NO: 7733556 - DNA, 22 bp, Homo sapiens
agggtcctgagcctggggcgca

SEQ ID NO: 7733557 - DNA, 22 bp, Homo sapiens
agggtcctgggtgcagttgctt

SEQ ID NO: 7733558 - DNA, 22 bp, Homo sapiens
agggtccttctgttcctgagca

SEQ ID NO: 7733559 - DNA, 22 bp, Homo sapiens
aggtgggaacccagcagggccc

SEQ ID NO: 7733560 - DNA, 22 bp, Homo sapiens
ccttgctgttagcctacattat

SEQ ID NO: 7733561 - DNA, 22 bp, Homo sapiens
ccttgctcaagctagtgacggg

SEQ ID NO: 7733562 - DNA, 22 bp, Homo sapiens
ccttggattttgtgcccacgcc

SEQ ID NO: 7733563 - DNA, 22 bp, Homo sapiens
aggtggggctgggaaagattcc

SEQ ID NO: 7733564 - DNA, 22 bp, Homo sapiens
aggtgctgtttgtcagcagttt

SEQ ID NO: 7733565 - DNA, 22 bp, Homo sapiens
aggtgctgggcagcagtcattg

SEQ ID NO: 7733566 - DNA, 17 bp, Homo sapiens
aggtgctggagcatcag

SEQ ID NO: 7733567 - DNA, 22 bp, Homo sapiens
aggtgctggagtagaagaaaaa

SEQ ID NO: 7733568 - DNA, 22 bp, Homo sapiens
aggtgcctatctggtctctgca

SEQ ID NO: 7733569 - DNA, 22 bp, Homo sapiens
cctttgtgaggtcctgtggggg

SEQ ID NO: 7733570 - DNA, 22 bp, Homo sapiens
cctttgtgaatatgcagaaaat

SEQ ID NO: 7733571 - DNA, 22 bp, Homo sapiens
cctttgtggtggcccagtgtgg

SEQ ID NO: 7733572 - DNA, 22 bp, Homo sapiens
cctttgtggggcggtgggtaat

SEQ ID NO: 7733573 - DNA, 22 bp, Homo sapiens
aggtgggggctgtgtccttgac

SEQ ID NO: 7733574 - DNA, 19 bp, Homo sapiens
cggcccctcctctcgcgcc

SEQ ID NO: 7733575 - DNA, 23 bp, Homo sapiens
ctcagaggtgtttttcacttact

SEQ ID NO: 7733576 - DNA, 22 bp, Homo sapiens
ctcagacccccagagctgctaa

SEQ ID NO: 7733577 - DNA, 22 bp, Homo sapiens
ctcagacacagccccacgaagt

SEQ ID NO: 7733578 - DNA, 22 bp, Homo sapiens
ctcaacatttaacagtgaaaaa

SEQ ID NO: 7733579 - DNA, 22 bp, Homo sapiens
ctcaacatgcctactcagtctg

SEQ ID NO: 7733580 - DNA, 22 bp, Homo sapiens
ctcaaatgtttccacttctgct

SEQ ID NO: 7733581 - DNA, 22 bp, Homo sapiens
cggggttcatccatgctgtggc

SEQ ID NO: 7733582 - DNA, 22 bp, Homo sapiens
ctcagtgtgagtgagaagtgca

SEQ ID NO: 7733583 - DNA, 22 bp, Homo sapiens
ctcagtgtcttattgtacacat

SEQ ID NO: 7733584 - DNA, 22 bp, Homo sapiens
ctcagtgctttggatcctggat

SEQ ID NO: 7733585 - DNA, 20 bp, Homo sapiens
ctcagtgtattctgggtgct

SEQ ID NO: 7733586 - DNA, 22 bp, Homo sapiens
ctcagtgtcacgttttgcctta

SEQ ID NO: 7733587 - DNA, 22 bp, Homo sapiens
ctcagtgttaaatataaggtat

SEQ ID NO: 7733588 - DNA, 22 bp, Homo sapiens
agtgaattctccacccagtagg

SEQ ID NO: 7733589 - DNA, 22 bp, Homo sapiens
agtgaatttaaaacactgagga

SEQ ID NO: 7733590 - DNA, 22 bp, Homo sapiens
agtctccacttgacatcagcag

SEQ ID NO: 7733591 - DNA, 23 bp, Homo sapiens
agtctcagctggaaacatgtgtc

SEQ ID NO: 7733592 - DNA, 22 bp, Homo sapiens
ctcagggacttggatcctggcc

SEQ ID NO: 7733593 - DNA, 22 bp, Homo sapiens
ctcagggacgttagaggacagg

SEQ ID NO: 7733594 - DNA, 22 bp, Homo sapiens
ctcagggaggagcttctgggcc

SEQ ID NO: 7733595 - DNA, 22 bp, Homo sapiens
ctcagggaggccctgggaccct

SEQ ID NO: 7733596 - DNA, 22 bp, Homo sapiens
ctcagcacactcccatctaatt

SEQ ID NO: 7733597 - DNA, 22 bp, Homo sapiens
ctcagctctgacaggaggcatc

SEQ ID NO: 7733598 - DNA, 22 bp, Homo sapiens
agtctcagctacttgggaggct

SEQ ID NO: 7733599 - DNA, 22 bp, Homo sapiens
agtctcagcaagcatggctagt

SEQ ID NO: 7733600 - DNA, 22 bp, Homo sapiens
ctcagctgcagcctggctggca

SEQ ID NO: 7733601 - DNA, 18 bp, Homo sapiens
ctccttggagaagaggcc

SEQ ID NO: 7733602 - DNA, 22 bp, Homo sapiens
ctccagagagtccagctctggg

SEQ ID NO: 7733603 - DNA, 22 bp, Homo sapiens
agtgctggaaagggacggagga

SEQ ID NO: 7733604 - DNA, 22 bp, Homo sapiens
agtgctggagggaggcaggttc

SEQ ID NO: 7733605 - DNA, 22 bp, Homo sapiens
ctcctgaggaaaagcttggtca

SEQ ID NO: 7733606 - DNA, 22 bp, Homo sapiens
agtgctggattacaggcgtgag

SEQ ID NO: 7733607 - DNA, 22 bp, Homo sapiens
agtgctggcccatagctgctgg

SEQ ID NO: 7733608 - DNA, 22 bp, Homo sapiens
agtgctgggattgcaggcatga

SEQ ID NO: 7733609 - DNA, 22 bp, Homo sapiens
agtgctgggattacaggcataa

SEQ ID NO: 7733610 - DNA, 22 bp, Homo sapiens
ctctgtcctatgcttgatagaa

SEQ ID NO: 7733611 - DNA, 19 bp, Homo sapiens
ctctggagaacaatagtgc

SEQ ID NO: 7733612 - DNA, 22 bp, Homo sapiens
ctctggacagcaggtgctgtgg

SEQ ID NO: 7733613 - DNA, 22 bp, Homo sapiens
ctctgctgcaggaaggcgtgca

SEQ ID NO: 7733614 - DNA, 22 bp, Homo sapiens
ctctggagaacgctatggatct

SEQ ID NO: 7733615 - DNA, 22 bp, Homo sapiens
agtggctgttccaggtgaggac

SEQ ID NO: 7733616 - DNA, 22 bp, Homo sapiens
agtggctgtgaaatacatggga

SEQ ID NO: 7733617 - DNA, 22 bp, Homo sapiens
agtggctgttcattttacacaa

SEQ ID NO: 7733618 - DNA, 22 bp, Homo sapiens
agtggctgtttataggtgggta

SEQ ID NO: 7733619 - DNA, 20 bp, Homo sapiens
ctgctctgctttgcaggtgg

SEQ ID NO: 7733620 - DNA, 22 bp, Homo sapiens
ctgctctggcgtactcggcatc

SEQ ID NO: 7733621 - DNA, 22 bp, Homo sapiens
ctgctctggtctcttcatgttt

SEQ ID NO: 7733622 - DNA, 22 bp, Homo sapiens
ataatcaaagtcctatgacatc

SEQ ID NO: 7733623 - DNA, 22 bp, Homo sapiens
ataatatttggataggacagta

SEQ ID NO: 7733624 - DNA, 22 bp, Homo sapiens
ataatatttgcattactgtgat

SEQ ID NO: 7733625 - DNA, 22 bp, Homo sapiens
atacttgaggttgtataaatat

SEQ ID NO: 7733626 - DNA, 22 bp, Homo sapiens
ctggagtcttaggttatggtga

SEQ ID NO: 7733627 - DNA, 22 bp, Homo sapiens
ctggagggatgtagggtgtatt

SEQ ID NO: 7733628 - DNA, 22 bp, Homo sapiens
ctggagggagattcaaaggagg

SEQ ID NO: 7733629 - DNA, 22 bp, Homo sapiens
ctgaggcatgaatgtgggcttt

SEQ ID NO: 7733630 - DNA, 22 bp, Homo sapiens
agttggagaagaggtcgggaat

SEQ ID NO: 7733631 - DNA, 22 bp, Homo sapiens
agttggagtgaacatgagattg

SEQ ID NO: 7733632 - DNA, 22 bp, Homo sapiens
ctgaggctgggctgagggtata

SEQ ID NO: 7733633 - DNA, 22 bp, Homo sapiens
ctgagggaacttgggcaagtct

SEQ ID NO: 7733634 - DNA, 21 bp, Homo sapiens
ctgccaggatagcatgcaggc

SEQ ID NO: 7733635 - DNA, 22 bp, Homo sapiens
ataaatatcactgttgtccctc

SEQ ID NO: 7733636 - DNA, 22 bp, Homo sapiens
ataaatagtgtgtcataaagtc

SEQ ID NO: 7733637 - DNA, 22 bp, Homo sapiens
ataaatagtgtgtcataaagtc

SEQ ID NO: 7733638 - DNA, 22 bp, Homo sapiens
ataaatagtgctgccatgagta

SEQ ID NO: 7733639 - DNA, 22 bp, Homo sapiens
agtttgtaaacttgagctagcc

SEQ ID NO: 7733640 - DNA, 22 bp, Homo sapiens
agtttggaagaatttggtctgt

SEQ ID NO: 7733641 - DNA, 22 bp, Homo sapiens
ctgtcttttactatcatttact

SEQ ID NO: 7733642 - DNA, 22 bp, Homo sapiens
ctgtcttttcatactttccctc

SEQ ID NO: 7733643 - DNA, 22 bp, Homo sapiens
ctgtcttttcttctcattgatg

SEQ ID NO: 7733644 - DNA, 22 bp, Homo sapiens
ctgtgatgacaggcagggccaa

SEQ ID NO: 7733645 - DNA, 18 bp, Homo sapiens
ctgtcttttttctctcca

SEQ ID NO: 7733646 - DNA, 22 bp, Homo sapiens
ctgtccagtctttagcaagctg

SEQ ID NO: 7733647 - DNA, 18 bp, Homo sapiens
ctgggtctccaggctgcc

SEQ ID NO: 7733648 - DNA, 22 bp, Homo sapiens
ctgggtcccggcttctatccac

SEQ ID NO: 7733649 - DNA, 22 bp, Homo sapiens
ctgggtcccctcagtgacactg

SEQ ID NO: 7733650 - DNA, 22 bp, Homo sapiens
ctgggtctaaaaattctcagat

SEQ ID NO: 7733651 - DNA, 22 bp, Homo sapiens
ctgggtctcaggagttctgagg

SEQ ID NO: 7733652 - DNA, 22 bp, Homo sapiens
ctgggtcccacagcctgctggg

SEQ ID NO: 7733653 - DNA, 22 bp, Homo sapiens
atccaaagtagattaagtcaca

SEQ ID NO: 7733654 - DNA, 22 bp, Homo sapiens
atccaaaggtgacacagaatac

SEQ ID NO: 7733655 - DNA, 20 bp, Homo sapiens
atccctcttcctagagtccc

SEQ ID NO: 7733656 - DNA, 22 bp, Homo sapiens
atccctctctgcatgactgtgt

SEQ ID NO: 7733657 - DNA, 23 bp, Homo sapiens
atccacattacagtatcatacaa

SEQ ID NO: 7733658 - DNA, 22 bp, Homo sapiens
ctgggcagtggtggcccttccc

SEQ ID NO: 7733659 - DNA, 22 bp, Homo sapiens
ctgggcagtggtggcatctttg

SEQ ID NO: 7733660 - DNA, 20 bp, Homo sapiens
ctgggcaggtgtttgatctc

SEQ ID NO: 7733661 - DNA, 22 bp, Homo sapiens
atatttctctcagacatggaag

SEQ ID NO: 7733662 - DNA, 22 bp, Homo sapiens
atatttactgctgtggtgaagg

SEQ ID NO: 7733663 - DNA, 22 bp, Homo sapiens
atatggtaagagtatatttact

SEQ ID NO: 7733664 - DNA, 22 bp, Homo sapiens
ctgggcaatatgctgggcctgg

SEQ ID NO: 7733665 - DNA, 19 bp, Homo sapiens
ctgggaggtgttcagagaa

SEQ ID NO: 7733666 - DNA, 22 bp, Homo sapiens
ctgggagagcctttcctgagtc

SEQ ID NO: 7733667 - DNA, 22 bp, Homo sapiens
ctgggaagtagaatcagatgag

SEQ ID NO: 7733668 - DNA, 22 bp, Homo sapiens
ctgggaagcttcgagcaggaaa

SEQ ID NO: 7733669 - DNA, 22 bp, Homo sapiens
atataatacaacctgctaagtg

SEQ ID NO: 7733670 - DNA, 22 bp, Homo sapiens
atataatacaacctgctaagtg

SEQ ID NO: 7733671 - DNA, 19 bp, Homo sapiens
cagagctgctggcctcgtc

SEQ ID NO: 7733672 - DNA, 23 bp, Homo sapiens
ggggaaagaccatgcttgaggac

SEQ ID NO: 7733673 - DNA, 22 bp, Homo sapiens
ggggaaagccagccctgcttcc

SEQ ID NO: 7733674 - DNA, 22 bp, Homo sapiens
ggggaaaggccatggcaagaac

SEQ ID NO: 7733675 - DNA, 21 bp, Homo sapiens
cagagctgaagggtgtagtgt

SEQ ID NO: 7733676 - DNA, 22 bp, Homo sapiens
cagagctgagtcttcaaggttg

SEQ ID NO: 7733677 - DNA, 22 bp, Homo sapiens
gggcacagagaaggttttagtg

SEQ ID NO: 7733678 - DNA, 22 bp, Homo sapiens
gggcacagagggtcttgaagaa

SEQ ID NO: 7733679 - DNA, 22 bp, Homo sapiens
cagagcccctgggttgggagct

SEQ ID NO: 7733680 - DNA, 22 bp, Homo sapiens
gggcgagggcgaaagcgagagc

SEQ ID NO: 7733681 - DNA, 22 bp, Homo sapiens
cagagctgtcatttgccagtga

SEQ ID NO: 7733682 - DNA, 22 bp, Homo sapiens
cagagctggtgttacaagtcca

SEQ ID NO: 7733683 - DNA, 20 bp, Homo sapiens
ggggaagaaaaggatgtgat

SEQ ID NO: 7733684 - DNA, 22 bp, Homo sapiens
cagagctggtgtgtcctggcat

SEQ ID NO: 7733685 - DNA, 22 bp, Homo sapiens
cagaggcctatccagtgtccat

SEQ ID NO: 7733686 - DNA, 22 bp, Homo sapiens
cagaggcccagtgagagggctg

SEQ ID NO: 7733687 - DNA, 19 bp, Homo sapiens
cagaggccagaagcacagg

SEQ ID NO: 7733688 - DNA, 22 bp, Homo sapiens
cagaggccaggctgcctgactg

SEQ ID NO: 7733689 - DNA, 22 bp, Homo sapiens
cagaggccagtggacaagggcc

SEQ ID NO: 7733690 - DNA, 22 bp, Homo sapiens
cagaggccagggggctcacaaa

SEQ ID NO: 7733691 - DNA, 22 bp, Homo sapiens
gggtctccatgttaacatcact

SEQ ID NO: 7733692 - DNA, 22 bp, Homo sapiens
cagaggcctggcttggacacct

SEQ ID NO: 7733693 - DNA, 22 bp, Homo sapiens
cagaggtagccgagtgcaatcg

SEQ ID NO: 7733694 - DNA, 22 bp, Homo sapiens
cagaggttacctagagcaagaa

SEQ ID NO: 7733695 - DNA, 22 bp, Homo sapiens
cagagtaaacctgtcatcaaga

SEQ ID NO: 7733696 - DNA, 22 bp, Homo sapiens
cagaggtgtacagagggaggcc

SEQ ID NO: 7733697 - DNA, 22 bp, Homo sapiens
cagaggtagggagctatgttat

SEQ ID NO: 7733698 - DNA, 22 bp, Homo sapiens
gggaaaaataatgcacagatat

SEQ ID NO: 7733699 - DNA, 22 bp, Homo sapiens
gggaaagaccttcctggggtgt

SEQ ID NO: 7733700 - DNA, 22 bp, Homo sapiens
gggaaagaccctgagtcttatt

SEQ ID NO: 7733701 - DNA, 22 bp, Homo sapiens
gggaaagagtgcttgtccagag

SEQ ID NO: 7733702 - DNA, 22 bp, Homo sapiens
gggaaagaagaagagccatttt

SEQ ID NO: 7733703 - DNA, 22 bp, Homo sapiens
gggacagacccatgggccaggt

SEQ ID NO: 7733704 - DNA, 22 bp, Homo sapiens
gggaaggaggtggcttgaagtg

SEQ ID NO: 7733705 - DNA, 22 bp, Homo sapiens
gggacaatggaggcctctctcc

SEQ ID NO: 7733706 - DNA, 22 bp, Homo sapiens
gggaaggaggtggacctgcccc

SEQ ID NO: 7733707 - DNA, 22 bp, Homo sapiens
gggaaggaaagttattagcaga

SEQ ID NO: 7733708 - DNA, 22 bp, Homo sapiens
gggaaggacacagccatgactg

SEQ ID NO: 7733709 - DNA, 22 bp, Homo sapiens
gggaaggacacagccatgactg

SEQ ID NO: 7733710 - DNA, 22 bp, Homo sapiens
gggaaggaaagttattagcaga

SEQ ID NO: 7733711 - DNA, 22 bp, Homo sapiens
gggcacagaagtctaagacatc

SEQ ID NO: 7733712 - DNA, 22 bp, Homo sapiens
gggagcaggacataatagcaat

SEQ ID NO: 7733713 - DNA, 22 bp, Homo sapiens
cagacagaaggctccttgaggt

SEQ ID NO: 7733714 - DNA, 21 bp, Homo sapiens
cagcccagagcagtggggcca

SEQ ID NO: 7733715 - DNA, 22 bp, Homo sapiens
cagccactggtgccaggctgtt

SEQ ID NO: 7733716 - DNA, 22 bp, Homo sapiens
cagcattttcttaatgtaggtg

SEQ ID NO: 7733717 - DNA, 22 bp, Homo sapiens
cagcatttggaggagaggcttt

SEQ ID NO: 7733718 - DNA, 22 bp, Homo sapiens
cagcatttcaggaggctgaggt

SEQ ID NO: 7733719 - DNA, 22 bp, Homo sapiens
cagcccagcagggtctggccct

SEQ ID NO: 7733720 - DNA, 22 bp, Homo sapiens
cagcagctacctgctcttgtgg

SEQ ID NO: 7733721 - DNA, 22 bp, Homo sapiens
cagcagctaaggcatgttcctg

SEQ ID NO: 7733722 - DNA, 22 bp, Homo sapiens
cagcagcaaatctagaagagga

SEQ ID NO: 7733723 - DNA, 22 bp, Homo sapiens
cagcagcaaatctagaagagga

SEQ ID NO: 7733724 - DNA, 22 bp, Homo sapiens
cagcagcaaatctagaagagga

SEQ ID NO: 7733725 - DNA, 22 bp, Homo sapiens
cagcagcaaggtgagggtggag

SEQ ID NO: 7733726 - DNA, 22 bp, Homo sapiens
cagcagcaacaatagcggtcac

SEQ ID NO: 7733727 - DNA, 22 bp, Homo sapiens
cagcagcaacaacggaagcctt

SEQ ID NO: 7733728 - DNA, 22 bp, Homo sapiens
cagcagcaacaacggaagcctt

SEQ ID NO: 7733729 - DNA, 22 bp, Homo sapiens
cagcagcagagatactggtttc

SEQ ID NO: 7733730 - DNA, 22 bp, Homo sapiens
cagcagcagattcagcgtctgg

SEQ ID NO: 7733731 - DNA, 22 bp, Homo sapiens
cagcagcactctgcgggtcccc

SEQ ID NO: 7733732 - DNA, 22 bp, Homo sapiens
cagcagcaaggtgagggtggag

SEQ ID NO: 7733733 - DNA, 22 bp, Homo sapiens
cagcaataatgtctacaaatct

SEQ ID NO: 7733734 - DNA, 22 bp, Homo sapiens
ggttctctaactttgactggag

SEQ ID NO: 7733735 - DNA, 23 bp, Homo sapiens
ggttcctgagcagggatctggaa

SEQ ID NO: 7733736 - DNA, 22 bp, Homo sapiens
ggttccagagtatttcatttca

SEQ ID NO: 7733737 - DNA, 22 bp, Homo sapiens
gggtgggagaaatgagtatcta

SEQ ID NO: 7733738 - DNA, 22 bp, Homo sapiens
ggtgggggagacttggtcaaga

SEQ ID NO: 7733739 - DNA, 22 bp, Homo sapiens
ggtggggtcacgacagagggaa

SEQ ID NO: 7733740 - DNA, 22 bp, Homo sapiens
ggcagctgagatcatgctgttg

SEQ ID NO: 7733741 - DNA, 22 bp, Homo sapiens
caccataaccaacatgtcagtt

SEQ ID NO: 7733742 - DNA, 22 bp, Homo sapiens
ggcagctgattagcatcaagga

SEQ ID NO: 7733743 - DNA, 22 bp, Homo sapiens
ggcagctgagcatggctacctt

SEQ ID NO: 7733744 - DNA, 22 bp, Homo sapiens
caccctggctggaggtgcagtg

SEQ ID NO: 7733745 - DNA, 22 bp, Homo sapiens
caccctggaaagaaggtctggg

SEQ ID NO: 7733746 - DNA, 22 bp, Homo sapiens
ggcagtttctcaggcaggggta

SEQ ID NO: 7733747 - DNA, 22 bp, Homo sapiens
ggcagtttcatcaggagaaaag

SEQ ID NO: 7733748 - DNA, 22 bp, Homo sapiens
ggcagtttggcaggatggaggg

SEQ ID NO: 7733749 - DNA, 22 bp, Homo sapiens
ggcagttttaacagaggtagta

SEQ ID NO: 7733750 - DNA, 22 bp, Homo sapiens
ggcatagatttctttaggttta

SEQ ID NO: 7733751 - DNA, 22 bp, Homo sapiens
ggcatagcggctcagcgtccag

SEQ ID NO: 7733752 - DNA, 22 bp, Homo sapiens
caccccagtctaaaaccagcct

SEQ ID NO: 7733753 - DNA, 22 bp, Homo sapiens
cactggaatggatagagcagag

SEQ ID NO: 7733754 - DNA, 22 bp, Homo sapiens
ggctatatcctcacaagatgga

SEQ ID NO: 7733755 - DNA, 22 bp, Homo sapiens
ggcctcctcaccctgctcaggc

SEQ ID NO: 7733756 - DNA, 22 bp, Homo sapiens
ggcctcctgttggctagtgtga

SEQ ID NO: 7733757 - DNA, 22 bp, Homo sapiens
cactgaagcctgggagtaagac

SEQ ID NO: 7733758 - DNA, 22 bp, Homo sapiens
cacagtggcaaaggggcttggg

SEQ ID NO: 7733759 - DNA, 22 bp, Homo sapiens
cacagtggcaaaggggcttggg

SEQ ID NO: 7733760 - DNA, 22 bp, Homo sapiens
cacagtggctttgctggtctcg

SEQ ID NO: 7733761 - DNA, 22 bp, Homo sapiens
cacagtggaagtccaggatccc

SEQ ID NO: 7733762 - DNA, 22 bp, Homo sapiens
ggcagcatgtgtggtccgctgg

SEQ ID NO: 7733763 - DNA, 22 bp, Homo sapiens
ggcagcatgggtgcctttgtga

SEQ ID NO: 7733764 - DNA, 22 bp, Homo sapiens
ggcagagatgtgggtcagaatc

SEQ ID NO: 7733765 - DNA, 22 bp, Homo sapiens
ggcactggaaggatcatgtgag

SEQ ID NO: 7733766 - DNA, 22 bp, Homo sapiens
cacagcttgggctctgacaata

SEQ ID NO: 7733767 - DNA, 22 bp, Homo sapiens
cacagcttgtttagtgactcac

SEQ ID NO: 7733768 - DNA, 20 bp, Homo sapiens
cacagcttgccttttatgac

SEQ ID NO: 7733769 - DNA, 22 bp, Homo sapiens
cacagcttcttccattccactc

SEQ ID NO: 7733770 - DNA, 22 bp, Homo sapiens
cacagcttctgtctgacccatg

SEQ ID NO: 7733771 - DNA, 22 bp, Homo sapiens
cacagcttctgagtgaggattt

SEQ ID NO: 7733772 - DNA, 22 bp, Homo sapiens
cacagcttctccttgatatcgc

SEQ ID NO: 7733773 - DNA, 22 bp, Homo sapiens
cacagcttctccccgctgcggc

SEQ ID NO: 7733774 - DNA, 22 bp, Homo sapiens
ggaggcggaagttgcagtgagc

SEQ ID NO: 7733775 - DNA, 22 bp, Homo sapiens
ggaggcggagcttgcagtgagc

SEQ ID NO: 7733776 - DNA, 22 bp, Homo sapiens
cacagctggtgcactagctctg

SEQ ID NO: 7733777 - DNA, 22 bp, Homo sapiens
cacagcttcagtttctgacttg

SEQ ID NO: 7733778 - DNA, 22 bp, Homo sapiens
cacagcttatgccactgattgg

SEQ ID NO: 7733779 - DNA, 22 bp, Homo sapiens
cacagcttagaaaagaagccat

SEQ ID NO: 7733780 - DNA, 22 bp, Homo sapiens
cacagcttcccgtgcatggaga

SEQ ID NO: 7733781 - DNA, 22 bp, Homo sapiens
cacagcttcccaaagtggacct

SEQ ID NO: 7733782 - DNA, 22 bp, Homo sapiens
cacagcttccattagaatgaga

SEQ ID NO: 7733783 - DNA, 22 bp, Homo sapiens
ggatgttctggggttctcttgt

SEQ ID NO: 7733784 - DNA, 22 bp, Homo sapiens
ggagggagggctagaccaaaga

SEQ ID NO: 7733785 - DNA, 22 bp, Homo sapiens
ggaggcggaggctgcagtgagc

SEQ ID NO: 7733786 - DNA, 22 bp, Homo sapiens
ggatctgggctctgccaatcag

SEQ ID NO: 7733787 - DNA, 22 bp, Homo sapiens
caaagtatcaactcccacactg

SEQ ID NO: 7733788 - DNA, 22 bp, Homo sapiens
caaagtatgaaccagtttctct

SEQ ID NO: 7733789 - DNA, 22 bp, Homo sapiens
caaagtatatttcatagtctca

SEQ ID NO: 7733790 - DNA, 22 bp, Homo sapiens
caaagtatattggattgaatgg

SEQ ID NO: 7733791 - DNA, 22 bp, Homo sapiens
caaagtatagtgtaggatggca

SEQ ID NO: 7733792 - DNA, 22 bp, Homo sapiens
caaagtaatttggagatatata

SEQ ID NO: 7733793 - DNA, 22 bp, Homo sapiens
caacatgtgttagacaatagac

SEQ ID NO: 7733794 - DNA, 22 bp, Homo sapiens
caagatgtggtgggctgagttt

SEQ ID NO: 7733795 - DNA, 22 bp, Homo sapiens
caaggagaaaacggcttctgaa

SEQ ID NO: 7733796 - DNA, 22 bp, Homo sapiens
caaggagagtaattgaatgaga

SEQ ID NO: 7733797 - DNA, 22 bp, Homo sapiens
caaggagataaaatgttgagct

SEQ ID NO: 7733798 - DNA, 22 bp, Homo sapiens
caagaggagcaggcaggtgtgc

SEQ ID NO: 7733799 - DNA, 22 bp, Homo sapiens
caagatgacaaggctggaggct

SEQ ID NO: 7733800 - DNA, 22 bp, Homo sapiens
gctgctggagctttgcagaagg

SEQ ID NO: 7733801 - DNA, 22 bp, Homo sapiens
gctgctggagagcgagactgtt

SEQ ID NO: 7733802 - DNA, 22 bp, Homo sapiens
cacaatgtatatgtatatcaaa

SEQ ID NO: 7733803 - DNA, 22 bp, Homo sapiens
ggaaaagacagaattctagaat

SEQ ID NO: 7733804 - DNA, 22 bp, Homo sapiens
cacaaaggagaatgtcagcata

SEQ ID NO: 7733805 - DNA, 22 bp, Homo sapiens
cacacattaatatcaaaggctc

SEQ ID NO: 7733806 - DNA, 22 bp, Homo sapiens
cacaattccatggcattctttg

SEQ ID NO: 7733807 - DNA, 23 bp, Homo sapiens
cacacctgttaagaagagtgcct

SEQ ID NO: 7733808 - DNA, 20 bp, Homo sapiens
gctgtctgacagttcccaga

SEQ ID NO: 7733809 - DNA, 22 bp, Homo sapiens
gctgtctgcatctctagagctt

SEQ ID NO: 7733810 - DNA, 22 bp, Homo sapiens
gctgtgcttgcatgagtgtctg

SEQ ID NO: 7733811 - DNA, 22 bp, Homo sapiens
gctgtctgccgcaggctgccac

SEQ ID NO: 7733812 - DNA, 21 bp, Homo sapiens
gctgtctcctccttgcaccag

SEQ ID NO: 7733813 - DNA, 22 bp, Homo sapiens
gcttccaggtcattctcaccct

SEQ ID NO: 7733814 - DNA, 18 bp, Homo sapiens
gcttctcatttctaagca

SEQ ID NO: 7733815 - DNA, 22 bp, Homo sapiens
gcttctctcaggagcatcagcc

SEQ ID NO: 7733816 - DNA, 22 bp, Homo sapiens
atggtccttatggccgtgatat

SEQ ID NO: 7733817 - DNA, 22 bp, Homo sapiens
gagctgggcctcagaacacagt

SEQ ID NO: 7733818 - DNA, 22 bp, Homo sapiens
gagctgggcctgcgagtgctgc

SEQ ID NO: 7733819 - DNA, 21 bp, Homo sapiens
gagctgggcgaggctccgggg

SEQ ID NO: 7733820 - DNA, 21 bp, Homo sapiens
gagctgggcgaggctccgggg

SEQ ID NO: 7733821 - DNA, 22 bp, Homo sapiens
gaggggagcccccatcctccag

SEQ ID NO: 7733822 - DNA, 16 bp, Homo sapiens
gaggggagcagtaggc

SEQ ID NO: 7733823 - DNA, 22 bp, Homo sapiens
gaggggagacagggaaatcagt

SEQ ID NO: 7733824 - DNA, 22 bp, Homo sapiens
atggcagggaccaagctgtcat

SEQ ID NO: 7733825 - DNA, 22 bp, Homo sapiens
atggcagggactgtggcccttg

SEQ ID NO: 7733826 - DNA, 22 bp, Homo sapiens
atggcagggcccttggctccca

SEQ ID NO: 7733827 - DNA, 22 bp, Homo sapiens
gagaggaagccttctgtacttg

SEQ ID NO: 7733828 - DNA, 22 bp, Homo sapiens
gagaggaaagaaccaatgaccc

SEQ ID NO: 7733829 - DNA, 22 bp, Homo sapiens
atggctgcccacgttggtgctt

SEQ ID NO: 7733830 - DNA, 22 bp, Homo sapiens
atggctgcatcatcctggttga

SEQ ID NO: 7733831 - DNA, 22 bp, Homo sapiens
atggctgccccaaattgttgct

SEQ ID NO: 7733832 - DNA, 22 bp, Homo sapiens
atggctgcctgggcgctggccg

SEQ ID NO: 7733833 - DNA, 22 bp, Homo sapiens
atggctgctctggatggagtcc

SEQ ID NO: 7733834 - DNA, 19 bp, Homo sapiens
atggctgctgattggggat

SEQ ID NO: 7733835 - DNA, 22 bp, Homo sapiens
atggctgctttcccttagcacc

SEQ ID NO: 7733836 - DNA, 22 bp, Homo sapiens
atggcccaaactgcaattactt

SEQ ID NO: 7733837 - DNA, 22 bp, Homo sapiens
atggaggatgtgcagcatgggc

SEQ ID NO: 7733838 - DNA, 22 bp, Homo sapiens
atggaagactaacagaaacatg

SEQ ID NO: 7733839 - DNA, 22 bp, Homo sapiens
atggaagctgaaaaagacacgg

SEQ ID NO: 7733840 - DNA, 22 bp, Homo sapiens
atggacttaagagtcagaagct

SEQ ID NO: 7733841 - DNA, 22 bp, Homo sapiens
atggaaatggagtgtgcttgct

SEQ ID NO: 7733842 - DNA, 22 bp, Homo sapiens
atggaaatgtaacttctgattc

SEQ ID NO: 7733843 - DNA, 22 bp, Homo sapiens
atggaacaggctcagagatgct

SEQ ID NO: 7733844 - DNA, 21 bp, Homo sapiens
atggaaattggcaaatgctac

SEQ ID NO: 7733845 - DNA, 22 bp, Homo sapiens
atggaaaaggctgatttcatta

SEQ ID NO: 7733846 - DNA, 22 bp, Homo sapiens
gacagaggtgtccttgagtcca

SEQ ID NO: 7733847 - DNA, 22 bp, Homo sapiens
cttgtggcaggtggatggtgcc

SEQ ID NO: 7733848 - DNA, 22 bp, Homo sapiens
cttttattttgaattaagggct

SEQ ID NO: 7733849 - DNA, 22 bp, Homo sapiens
atgaaattaatcaacacataca

SEQ ID NO: 7733850 - DNA, 22 bp, Homo sapiens
cttttcatgagtctgttatggg

SEQ ID NO: 7733851 - DNA, 19 bp, Homo sapiens
cttttcatcaacagccaat

SEQ ID NO: 7733852 - DNA, 22 bp, Homo sapiens
atgaaatgctgagaggtgcttc

SEQ ID NO: 7733853 - DNA, 22 bp, Homo sapiens
atgaaatgctgagaggtgcttc

SEQ ID NO: 7733854 - DNA, 22 bp, Homo sapiens
atgaaatgtatgagtctgggtt

SEQ ID NO: 7733855 - DNA, 22 bp, Homo sapiens
atgaaatgtattcagatatgta

SEQ ID NO: 7733856 - DNA, 22 bp, Homo sapiens
atgaaatatcttgaagaaattc

SEQ ID NO: 7733857 - DNA, 22 bp, Homo sapiens
atgaaatgagtcaatgcgacta

SEQ ID NO: 7733858 - DNA, 22 bp, Homo sapiens
cttgcctttgtcttcaaaggct

SEQ ID NO: 7733859 - DNA, 22 bp, Homo sapiens
cttgcctttgtcttcaaaggct

SEQ ID NO: 7733860 - DNA, 22 bp, Homo sapiens
atctactcctgaatatatctag

SEQ ID NO: 7733861 - DNA, 22 bp, Homo sapiens
atctactcagtaactgcttagg

SEQ ID NO: 7733862 - DNA, 22 bp, Homo sapiens
atctacataaaacgaatacata

SEQ ID NO: 7733863 - DNA, 22 bp, Homo sapiens
atctagattaggtataagagct

SEQ ID NO: 7733864 - DNA, 22 bp, Homo sapiens
atcttctcatgtgtaatgaggt

SEQ ID NO: 7733865 - DNA, 22 bp, Homo sapiens
cttggcccagttgccaaggaaa

SEQ ID NO: 7733866 - DNA, 22 bp, Homo sapiens
atgcagaaagcggcaaacaggt

SEQ ID NO: 7733867 - DNA, 22 bp, Homo sapiens
atgcagaatgagttcacgatct

SEQ ID NO: 7733868 - DNA, 22 bp, Homo sapiens
atgcagaattgctaagtatctg

SEQ ID NO: 7733869 - DNA, 22 bp, Homo sapiens
atgcaaaattaccattctgttc

SEQ ID NO: 7733870 - DNA, 22 bp, Homo sapiens
atgcaaaagtaattgcaatttt

SEQ ID NO: 7733871 - DNA, 22 bp, Homo sapiens
atgcaaaagtagttgcagtttt

SEQ ID NO: 7733872 - DNA, 22 bp, Homo sapiens
atgcaaatcttaagtatgtgtg

SEQ ID NO: 7733873 - DNA, 22 bp, Homo sapiens
atgcaaagcaccacactaagat

SEQ ID NO: 7733874 - DNA, 22 bp, Homo sapiens
atgcaaagcacacacagaatcc

SEQ ID NO: 7733875 - DNA, 22 bp, Homo sapiens
atgcaaataagtgcaggcgtgg

SEQ ID NO: 7733876 - DNA, 21 bp, Homo sapiens
atgcatgttccataaagtggg

SEQ ID NO: 7733877 - DNA, 22 bp, Homo sapiens
atgattcaagaaaataggatgg

SEQ ID NO: 7733878 - DNA, 22 bp, Homo sapiens
atgaggtattcgtaatatttcc

SEQ ID NO: 7733879 - DNA, 22 bp, Homo sapiens
atgaggtatctcatttcctgaa

SEQ ID NO: 7733880 - DNA, 22 bp, Homo sapiens
atgaggtagtattagaaggaga

SEQ ID NO: 7733881 - DNA, 22 bp, Homo sapiens
atgaggtactagtatatacgta

SEQ ID NO: 7733882 - DNA, 23 bp, Homo sapiens
atgaggtaaagatcagctttaaa

SEQ ID NO: 7733883 - DNA, 19 bp, Homo sapiens
atgaggaactgaggctcag

SEQ ID NO: 7733884 - DNA, 19 bp, Homo sapiens
atgaagattggtaaattca

SEQ ID NO: 7733885 - DNA, 22 bp, Homo sapiens
gaaagcacagttctgaccatgt

SEQ ID NO: 7733886 - DNA, 22 bp, Homo sapiens
gaaagcaatttgtgtaatctgt

SEQ ID NO: 7733887 - DNA, 22 bp, Homo sapiens
gaaagcaagttgactgcagaat

SEQ ID NO: 7733888 - DNA, 23 bp, Homo sapiens
gcctgtgcctatgcccagctctg

SEQ ID NO: 7733889 - DNA, 22 bp, Homo sapiens
gcctgtgcatagcagcggactc

SEQ ID NO: 7733890 - DNA, 22 bp, Homo sapiens
gcgagcctctggagtcctctgg

SEQ ID NO: 7733891 - DNA, 22 bp, Homo sapiens
caaacattccgcttctcccagg

SEQ ID NO: 7733892 - DNA, 22 bp, Homo sapiens
gcctctctccttggcttgcagt

SEQ ID NO: 7733893 - DNA, 22 bp, Homo sapiens
gcctccagctggggcatttcag

SEQ ID NO: 7733894 - DNA, 22 bp, Homo sapiens
gcctccccaagcagcagggatt

SEQ ID NO: 7733895 - DNA, 22 bp, Homo sapiens
atttacagaagcatgtaatagc

SEQ ID NO: 7733896 - DNA, 22 bp, Homo sapiens
gccagctggctgcaggtcccag

SEQ ID NO: 7733897 - DNA, 22 bp, Homo sapiens
attgctttagaaagaaaaatat

SEQ ID NO: 7733898 - DNA, 22 bp, Homo sapiens
attggaaatacagtagaaaaat

SEQ ID NO: 7733899 - DNA, 21 bp, Homo sapiens
atttacaaaacagtcccttcc

SEQ ID NO: 7733900 - DNA, 22 bp, Homo sapiens
atttaaattttctgatggagag

SEQ ID NO: 7733901 - DNA, 22 bp, Homo sapiens
atttcaagtgttgagctcataa

SEQ ID NO: 7733902 - DNA, 22 bp, Homo sapiens
atttctaaagagggtggtttgg

SEQ ID NO: 7733903 - DNA, 22 bp, Homo sapiens
atttcagcagcccatgtttgga

SEQ ID NO: 7733904 - DNA, 22 bp, Homo sapiens
attctattttttaagaagtagt

SEQ ID NO: 7733905 - DNA, 22 bp, Homo sapiens
attctcagggagtattttctat

SEQ ID NO: 7733906 - DNA, 22 bp, Homo sapiens
attctcaatggctactttcata

SEQ ID NO: 7733907 - DNA, 22 bp, Homo sapiens
attctcaaacaagtggtttgat

SEQ ID NO: 7733908 - DNA, 22 bp, Homo sapiens
attgaaaaatgactattgctta

SEQ ID NO: 7733909 - DNA, 20 bp, Homo sapiens
attgacagaaagtgttcacc

SEQ ID NO: 7733910 - DNA, 22 bp, Homo sapiens
attgacaagaaagatattttta

SEQ ID NO: 7733911 - DNA, 22 bp, Homo sapiens
attgacaaccctggtatgagca

SEQ ID NO: 7733912 - DNA, 22 bp, Homo sapiens
attcagtcaaaccactggtcat

SEQ ID NO: 7733913 - DNA, 22 bp, Homo sapiens
attcagtcaaaaatgatggaga

SEQ ID NO: 7733914 - DNA, 22 bp, Homo sapiens
attattgtgataggtgtcagtg

SEQ ID NO: 7733915 - DNA, 22 bp, Homo sapiens
attattggacacttcttctgca

SEQ ID NO: 7733916 - DNA, 22 bp, Homo sapiens
attctacacaacatgatgatgg

SEQ ID NO: 7733917 - DNA, 22 bp, Homo sapiens
attctacacaaagcaagaagac

SEQ ID NO: 7733918 - DNA, 22 bp, Homo sapiens
attattcaatcatattaaaagt

SEQ ID NO: 7733919 - DNA, 22 bp, Homo sapiens
attagaattatgcttgctaatg

SEQ ID NO: 7733920 - DNA, 22 bp, Homo sapiens
attagaagaggctgacgaatgt

SEQ ID NO: 7733921 - DNA, 17 bp, Homo sapiens
gcaagggatgggagatt

SEQ ID NO: 7733922 - DNA, 22 bp, Homo sapiens
attacaagggtctgactggagg

SEQ ID NO: 7733923 - DNA, 22 bp, Homo sapiens
attaaaactaaaatgcctgatt

SEQ ID NO: 7733924 - DNA, 22 bp, Homo sapiens
gatgagggcctggtggctgtgc

SEQ ID NO: 7733925 - DNA, 22 bp, Homo sapiens
atgtgttcacgtgcacatgtgc

SEQ ID NO: 7733926 - DNA, 22 bp, Homo sapiens
cagtcctgggcacagccctggg

SEQ ID NO: 7733927 - DNA, 22 bp, Homo sapiens
cagtcctgggcacagccctggg

SEQ ID NO: 7733928 - DNA, 22 bp, Homo sapiens
cagtcctgggcaggtcaggcca

SEQ ID NO: 7733929 - DNA, 22 bp, Homo sapiens
cagtcctggggaccaggctgag

SEQ ID NO: 7733930 - DNA, 22 bp, Homo sapiens
cagtcctggggaccaggctgag

SEQ ID NO: 7733931 - DNA, 22 bp, Homo sapiens
cagtcctgggtgcagcaggaaa

SEQ ID NO: 7733932 - DNA, 20 bp, Homo sapiens
cagtcctgtccctgctgccc

SEQ ID NO: 7733933 - DNA, 22 bp, Homo sapiens
cagtcctgttcctggagtagtt

SEQ ID NO: 7733934 - DNA, 22 bp, Homo sapiens
cagtcctgtgtcccttggtggg

SEQ ID NO: 7733935 - DNA, 22 bp, Homo sapiens
cagtcctgtctttatgacttca

SEQ ID NO: 7733936 - DNA, 20 bp, Homo sapiens
tatttacaacttagagcctc

SEQ ID NO: 7733937 - DNA, 22 bp, Homo sapiens
cagtgagtaagtagacagctta

SEQ ID NO: 7733938 - DNA, 22 bp, Homo sapiens
cagtctcagaggtgggagtggg

SEQ ID NO: 7733939 - DNA, 22 bp, Homo sapiens
cagtctccaaatcagtctgaat

SEQ ID NO: 7733940 - DNA, 22 bp, Homo sapiens
cagtctcaccctggaggcccca

SEQ ID NO: 7733941 - DNA, 17 bp, Homo sapiens
cagtgatcattacatta

SEQ ID NO: 7733942 - DNA, 22 bp, Homo sapiens
cagtgcagacgtggagggggca

SEQ ID NO: 7733943 - DNA, 22 bp, Homo sapiens
cagtgcagacgtggagggggca

SEQ ID NO: 7733944 - DNA, 22 bp, Homo sapiens
cagtgctgagagcctggccagg

SEQ ID NO: 7733945 - DNA, 22 bp, Homo sapiens
cagtgctgacagggaggaacct

SEQ ID NO: 7733946 - DNA, 22 bp, Homo sapiens
cagtgctggctgttaggacagt

SEQ ID NO: 7733947 - DNA, 22 bp, Homo sapiens
cagtgctgggcagaggagagcg

SEQ ID NO: 7733948 - DNA, 21 bp, Homo sapiens
cagtgctgcctaatagggagt

SEQ ID NO: 7733949 - DNA, 22 bp, Homo sapiens
cagtgctggagatgggtggaac

SEQ ID NO: 7733950 - DNA, 22 bp, Homo sapiens
cagtgctggaggctggagggaa

SEQ ID NO: 7733951 - DNA, 19 bp, Homo sapiens
cagtgctgttcattcagtg

SEQ ID NO: 7733952 - DNA, 23 bp, Homo sapiens
cagtgctggttctgcctgtgggg

SEQ ID NO: 7733953 - DNA, 22 bp, Homo sapiens
cagtgctgtgctggaagctgtt

SEQ ID NO: 7733954 - DNA, 22 bp, Homo sapiens
tcacttcccagacggggtggca

SEQ ID NO: 7733955 - DNA, 22 bp, Homo sapiens
caggggccaggctgtctgctgt

SEQ ID NO: 7733956 - DNA, 22 bp, Homo sapiens
cagggtcttataaggccaattt

SEQ ID NO: 7733957 - DNA, 22 bp, Homo sapiens
caggggcctggctgtctaggaa

SEQ ID NO: 7733958 - DNA, 22 bp, Homo sapiens
tataatatgaggcaggagtgat

SEQ ID NO: 7733959 - DNA, 22 bp, Homo sapiens
caggtctgcagacagggccatg

SEQ ID NO: 7733960 - DNA, 22 bp, Homo sapiens
caggtctgcagacagggccatg

SEQ ID NO: 7733961 - DNA, 22 bp, Homo sapiens
caggtctgagtcacatgttcat

SEQ ID NO: 7733962 - DNA, 22 bp, Homo sapiens
caggtctgagtcacatgttcat

SEQ ID NO: 7733963 - DNA, 17 bp, Homo sapiens
caggtctgaggccaggc

SEQ ID NO: 7733964 - DNA, 17 bp, Homo sapiens
caggtctgaggccaggc

SEQ ID NO: 7733965 - DNA, 22 bp, Homo sapiens
caggtctgggttgatggcctgg

SEQ ID NO: 7733966 - DNA, 22 bp, Homo sapiens
caggtctggcatcagctgtgtg

SEQ ID NO: 7733967 - DNA, 22 bp, Homo sapiens
caggtctggcatcagctgtgtg

SEQ ID NO: 7733968 - DNA, 17 bp, Homo sapiens
caggtctgaggccaggc

SEQ ID NO: 7733969 - DNA, 22 bp, Homo sapiens
caggtctgaagagtcacatgcc

SEQ ID NO: 7733970 - DNA, 22 bp, Homo sapiens
tatacagattaacagatttaaa

SEQ ID NO: 7733971 - DNA, 22 bp, Homo sapiens
tatacagctatggcaagacaaa

SEQ ID NO: 7733972 - DNA, 21 bp, Homo sapiens
tatacagcaaagtctggagca

SEQ ID NO: 7733973 - DNA, 22 bp, Homo sapiens
tatacaggaactgttggctccc

SEQ ID NO: 7733974 - DNA, 22 bp, Homo sapiens
tatacaggaaattttggaacag

SEQ ID NO: 7733975 - DNA, 22 bp, Homo sapiens
tatacagatggaaagatacaca

SEQ ID NO: 7733976 - DNA, 20 bp, Homo sapiens
tattgcctaaataccagaat

SEQ ID NO: 7733977 - DNA, 22 bp, Homo sapiens
tatgtgcattattaccagtgga

SEQ ID NO: 7733978 - DNA, 18 bp, Homo sapiens
caggtctgtctgcctccc

SEQ ID NO: 7733979 - DNA, 22 bp, Homo sapiens
caggtctgtttccatcagtgct

SEQ ID NO: 7733980 - DNA, 22 bp, Homo sapiens
caggtctgtgtgccatttccaa

SEQ ID NO: 7733981 - DNA, 18 bp, Homo sapiens
caggtctgtctgcctccc

SEQ ID NO: 7733982 - DNA, 22 bp, Homo sapiens
caggtctttgttgcagcatgga

SEQ ID NO: 7733983 - DNA, 22 bp, Homo sapiens
caggtgaaaaagcaaccatatt

SEQ ID NO: 7733984 - DNA, 22 bp, Homo sapiens
caggtcttttctactggtggag

SEQ ID NO: 7733985 - DNA, 20 bp, Homo sapiens
caggtcttcatgtggctgtc

SEQ ID NO: 7733986 - DNA, 22 bp, Homo sapiens
caggtctggtgagagaacagtt

SEQ ID NO: 7733987 - DNA, 22 bp, Homo sapiens
tatggcttctgctttcttgact

SEQ ID NO: 7733988 - DNA, 21 bp, Homo sapiens
caggtctggtgaacactctca

SEQ ID NO: 7733989 - DNA, 22 bp, Homo sapiens
tatggcagttacccttgatgat

SEQ ID NO: 7733990 - DNA, 22 bp, Homo sapiens
tcagccctagcctcagtccagg

SEQ ID NO: 7733991 - DNA, 22 bp, Homo sapiens
cagtttcttagtgacacaaatc

SEQ ID NO: 7733992 - DNA, 22 bp, Homo sapiens
catcacagaaataaacatacct

SEQ ID NO: 7733993 - DNA, 22 bp, Homo sapiens
tcaggaagtgcctaggctggcc

SEQ ID NO: 7733994 - DNA, 22 bp, Homo sapiens
tcaggaagtctcaattagctac

SEQ ID NO: 7733995 - DNA, 22 bp, Homo sapiens
tcaggaagtggtaaaggatgtt

SEQ ID NO: 7733996 - DNA, 22 bp, Homo sapiens
tcaggaagtggtaaaggatgtt

SEQ ID NO: 7733997 - DNA, 23 bp, Homo sapiens
catatgaattttagaggcagttt

SEQ ID NO: 7733998 - DNA, 20 bp, Homo sapiens
tccagcccagcagcctgaca

SEQ ID NO: 7733999 - DNA, 22 bp, Homo sapiens
catgtacatgcctactatcaat

SEQ ID NO: 7734000 - DNA, 18 bp, Homo sapiens
catgtctgcgccacaagg

SEQ ID NO: 7734001 - DNA, 22 bp, Homo sapiens
catggccagccctgaggttcag

SEQ ID NO: 7734002 - DNA, 22 bp, Homo sapiens
catggccaggcacgcgcatagc

SEQ ID NO: 7734003 - DNA, 22 bp, Homo sapiens
catgcaaacacgtaaacattca

SEQ ID NO: 7734004 - DNA, 22 bp, Homo sapiens
catgcaaatggtggctaaatgg

SEQ ID NO: 7734005 - DNA, 23 bp, Homo sapiens
catgcaaacactattgcatttgg

SEQ ID NO: 7734006 - DNA, 22 bp, Homo sapiens
catgcaaagcgttttgaccagc

SEQ ID NO: 7734007 - DNA, 22 bp, Homo sapiens
tcatggggctcttcaagtggag

SEQ ID NO: 7734008 - DNA, 22 bp, Homo sapiens
tcatggggccacagctgccagc

SEQ ID NO: 7734009 - DNA, 22 bp, Homo sapiens
catgagaagtggccttcaaaaa

SEQ ID NO: 7734010 - DNA, 22 bp, Homo sapiens
catgagaaggttttggcatata

SEQ ID NO: 7734011 - DNA, 22 bp, Homo sapiens
tcaggtgggacctgctaggaca

SEQ ID NO: 7734012 - DNA, 22 bp, Homo sapiens
tctgccagccctgtgagtcttg

SEQ ID NO: 7734013 - DNA, 22 bp, Homo sapiens
tctgccagaagttctgagagta

SEQ ID NO: 7734014 - DNA, 22 bp, Homo sapiens
tctgccagaagccagggtctgg

SEQ ID NO: 7734015 - DNA, 22 bp, Homo sapiens
ccagctcctcttgtctctagca

SEQ ID NO: 7734016 - DNA, 21 bp, Homo sapiens
ccagctccaggaccttggatc

SEQ ID NO: 7734017 - DNA, 23 bp, Homo sapiens
ccagctccgtgagcctcgggctc

SEQ ID NO: 7734018 - DNA, 22 bp, Homo sapiens
ccagctccaggactgggagctg

SEQ ID NO: 7734019 - DNA, 22 bp, Homo sapiens
ccagctccttctgtctgtggag

SEQ ID NO: 7734020 - DNA, 22 bp, Homo sapiens
ccagctcctgggtcttagtcag

SEQ ID NO: 7734021 - DNA, 22 bp, Homo sapiens
ccagctctaaacggctctgtgg

SEQ ID NO: 7734022 - DNA, 22 bp, Homo sapiens
ccagcctgggtgttagaagaca

SEQ ID NO: 7734023 - DNA, 22 bp, Homo sapiens
ccagcctggggaggcagcttct

SEQ ID NO: 7734024 - DNA, 22 bp, Homo sapiens
ccagctagtaagcacctgcatc

SEQ ID NO: 7734025 - DNA, 22 bp, Homo sapiens
ccagctaggcttgcactcttgt

SEQ ID NO: 7734026 - DNA, 23 bp, Homo sapiens
ccagcgctcactcagagcatgtt

SEQ ID NO: 7734027 - DNA, 22 bp, Homo sapiens
ccagctccaagtttgggcatca

SEQ ID NO: 7734028 - DNA, 22 bp, Homo sapiens
ccagcctggagggcagtggtgg

SEQ ID NO: 7734029 - DNA, 22 bp, Homo sapiens
ccagcctggagggcagtggtgg

SEQ ID NO: 7734030 - DNA, 21 bp, Homo sapiens
ccagcctcagatcagggagct

SEQ ID NO: 7734031 - DNA, 22 bp, Homo sapiens
tctgaggcccagttcaactctt

SEQ ID NO: 7734032 - DNA, 22 bp, Homo sapiens
tctgaggcccctgggcaggatg

SEQ ID NO: 7734033 - DNA, 22 bp, Homo sapiens
tctgaggcagcttgccactcta

SEQ ID NO: 7734034 - DNA, 22 bp, Homo sapiens
ccagcccatgcccttatagcat

SEQ ID NO: 7734035 - DNA, 22 bp, Homo sapiens
ccagccccgggaacctggccgt

SEQ ID NO: 7734036 - DNA, 22 bp, Homo sapiens
ccagcccaaacaagccgccttc

SEQ ID NO: 7734037 - DNA, 22 bp, Homo sapiens
tctgaaatctgtaagcactagc

SEQ ID NO: 7734038 - DNA, 22 bp, Homo sapiens
tctcttgggaggaaagagagaa

SEQ ID NO: 7734039 - DNA, 22 bp, Homo sapiens
ccagctggttaaaatagagaaa

SEQ ID NO: 7734040 - DNA, 22 bp, Homo sapiens
tctggagccttggatgggaaag

SEQ ID NO: 7734041 - DNA, 22 bp, Homo sapiens
ccagctggtaagtgatggagcc

SEQ ID NO: 7734042 - DNA, 22 bp, Homo sapiens
ccagctggtaagtgatggagcc

SEQ ID NO: 7734043 - DNA, 22 bp, Homo sapiens
ccagctgggtccctgctggggc

SEQ ID NO: 7734044 - DNA, 22 bp, Homo sapiens
ccagctggggaagtggggcata

SEQ ID NO: 7734045 - DNA, 22 bp, Homo sapiens
tctggagctggagggcaaggca

SEQ ID NO: 7734046 - DNA, 22 bp, Homo sapiens
tctggagcttgaagctttggtt

SEQ ID NO: 7734047 - DNA, 22 bp, Homo sapiens
tctgtcttagccatctcaggct

SEQ ID NO: 7734048 - DNA, 17 bp, Homo sapiens
tctgtctgtggtccact

SEQ ID NO: 7734049 - DNA, 21 bp, Homo sapiens
tctgtcttcctcagcctaagg

SEQ ID NO: 7734050 - DNA, 22 bp, Homo sapiens
tctgtcttggccagccatctgg

SEQ ID NO: 7734051 - DNA, 21 bp, Homo sapiens
ccaggaaggactgagctccct

SEQ ID NO: 7734052 - DNA, 22 bp, Homo sapiens
ccaggaagcggtgagggctgcc

SEQ ID NO: 7734053 - DNA, 22 bp, Homo sapiens
ccaggaagcggtgagggctgcc

SEQ ID NO: 7734054 - DNA, 22 bp, Homo sapiens
ccaggaagcggtgagggctgcc

SEQ ID NO: 7734055 - DNA, 21 bp, Homo sapiens
tcccagggccaggtgccatca

SEQ ID NO: 7734056 - DNA, 22 bp, Homo sapiens
tcccagggtcagtggtgaggcc

SEQ ID NO: 7734057 - DNA, 22 bp, Homo sapiens
tcccagggctctagagtgctgg

SEQ ID NO: 7734058 - DNA, 22 bp, Homo sapiens
tccctgctcagctcacctggca

SEQ ID NO: 7734059 - DNA, 22 bp, Homo sapiens
tccctgcttggaatgaccctta

SEQ ID NO: 7734060 - DNA, 21 bp, Homo sapiens
tccctgctttctggcccagtc

SEQ ID NO: 7734061 - DNA, 17 bp, Homo sapiens
ccacagcctggcacttg

SEQ ID NO: 7734062 - DNA, 22 bp, Homo sapiens
ccacagagttgatgcaataaga

SEQ ID NO: 7734063 - DNA, 22 bp, Homo sapiens
ccacagagtccgcatttgaggc

SEQ ID NO: 7734064 - DNA, 22 bp, Homo sapiens
ccacagaagatggggagagtgg

SEQ ID NO: 7734065 - DNA, 22 bp, Homo sapiens
ccacagaatcgctagtggagca

SEQ ID NO: 7734066 - DNA, 22 bp, Homo sapiens
tcctcccacataggacaatggg

SEQ ID NO: 7734067 - DNA, 23 bp, Homo sapiens
tcctcccaaatttcagcctcatt

SEQ ID NO: 7734068 - DNA, 22 bp, Homo sapiens
ccaaatcaccagcacgatcatt

SEQ ID NO: 7734069 - DNA, 22 bp, Homo sapiens
ccaaatagtctttcattgaatt

SEQ ID NO: 7734070 - DNA, 18 bp, Homo sapiens
ccagagctggctcctcgc

SEQ ID NO: 7734071 - DNA, 22 bp, Homo sapiens
tctcccaacatgtggaggtcag

SEQ ID NO: 7734072 - DNA, 22 bp, Homo sapiens
tctcccaaggcacagaaagagt

SEQ ID NO: 7734073 - DNA, 21 bp, Homo sapiens
tctcccaaggaggtcctgagg

SEQ ID NO: 7734074 - DNA, 22 bp, Homo sapiens
tctccataggcagttcataaca

SEQ ID NO: 7734075 - DNA, 22 bp, Homo sapiens
tctctaaagcctggaagaggag

SEQ ID NO: 7734076 - DNA, 22 bp, Homo sapiens
tctcccaagtgaccaggaaaga

SEQ ID NO: 7734077 - DNA, 22 bp, Homo sapiens
ccagatctaagtccaaagtact

SEQ ID NO: 7734078 - DNA, 22 bp, Homo sapiens
tctctacagacactgttgactt

SEQ ID NO: 7734079 - DNA, 22 bp, Homo sapiens
tctctacataacctcaatactc

SEQ ID NO: 7734080 - DNA, 21 bp, Homo sapiens
tctctacaaattatgttaggt

SEQ ID NO: 7734081 - DNA, 22 bp, Homo sapiens
ccagaggagcaggctggctcca

SEQ ID NO: 7734082 - DNA, 22 bp, Homo sapiens
ccacagtccgggctggcaggac

SEQ ID NO: 7734083 - DNA, 22 bp, Homo sapiens
tcctggggagggttctggctcc

SEQ ID NO: 7734084 - DNA, 22 bp, Homo sapiens
tcctggggagggttctggctcc

SEQ ID NO: 7734085 - DNA, 22 bp, Homo sapiens
tcctggtgctgacacccatagc

SEQ ID NO: 7734086 - DNA, 22 bp, Homo sapiens
ccagaatccaaaacgttttgag

SEQ ID NO: 7734087 - DNA, 22 bp, Homo sapiens
ccagaagcaaaacagacagttt

SEQ ID NO: 7734088 - DNA, 22 bp, Homo sapiens
gtgtctgcttgctgagcattta

SEQ ID NO: 7734089 - DNA, 19 bp, Homo sapiens
gtgtctgcctttgtgccac

SEQ ID NO: 7734090 - DNA, 22 bp, Homo sapiens
gtgtctgcacataggatctcaa

SEQ ID NO: 7734091 - DNA, 22 bp, Homo sapiens
gtgtgctgttgttcaggtagaa

SEQ ID NO: 7734092 - DNA, 22 bp, Homo sapiens
gtgtgctgagtgactgtcatca

SEQ ID NO: 7734093 - DNA, 22 bp, Homo sapiens
gtgtggccctgcgtcctgagtc

SEQ ID NO: 7734094 - DNA, 20 bp, Homo sapiens
gtgtggccaggagctgcgct

SEQ ID NO: 7734095 - DNA, 21 bp, Homo sapiens
gtgtggatatgtgacaggtgg

SEQ ID NO: 7734096 - DNA, 22 bp, Homo sapiens
gtgtggccgtgtatccatggct

SEQ ID NO: 7734097 - DNA, 22 bp, Homo sapiens
cagctgggtgatcttgggcagg

SEQ ID NO: 7734098 - DNA, 22 bp, Homo sapiens
gtggggcagtggcctgggagca

SEQ ID NO: 7734099 - DNA, 22 bp, Homo sapiens
gtggccagtggtgggcgccctg

SEQ ID NO: 7734100 - DNA, 22 bp, Homo sapiens
cagctctgtgcaggcctgggga

SEQ ID NO: 7734101 - DNA, 22 bp, Homo sapiens
cagctctggctattgaggacca

SEQ ID NO: 7734102 - DNA, 20 bp, Homo sapiens
cagctctgggaaagaggcca

SEQ ID NO: 7734103 - DNA, 22 bp, Homo sapiens
cagctctggcagagcccaaccc

SEQ ID NO: 7734104 - DNA, 22 bp, Homo sapiens
cagctctggcgtcagggagcga

SEQ ID NO: 7734105 - DNA, 22 bp, Homo sapiens
cagctctgctgggaggatgcag

SEQ ID NO: 7734106 - DNA, 22 bp, Homo sapiens
cagcccagccgagggcctggct

SEQ ID NO: 7734107 - DNA, 22 bp, Homo sapiens
gtggctttataggaagaggaac

SEQ ID NO: 7734108 - DNA, 22 bp, Homo sapiens
gtggcttcttcttgggagctgc

SEQ ID NO: 7734109 - DNA, 22 bp, Homo sapiens
gtggcttctgcggtgtgcgcag

SEQ ID NO: 7734110 - DNA, 22 bp, Homo sapiens
cagctgagttactctgaggtct

SEQ ID NO: 7734111 - DNA, 22 bp, Homo sapiens
cagctctgttgccctggaaacg

SEQ ID NO: 7734112 - DNA, 22 bp, Homo sapiens
cagctctgttgccaaagtgggc

SEQ ID NO: 7734113 - DNA, 22 bp, Homo sapiens
cagctgtggggagcttgggcca

SEQ ID NO: 7734114 - DNA, 22 bp, Homo sapiens
cagcttcatgacaaacagtttt

SEQ ID NO: 7734115 - DNA, 21 bp, Homo sapiens
cagcttctgaaggtgtaggaa

SEQ ID NO: 7734116 - DNA, 22 bp, Homo sapiens
cagcttctccattcttctggct

SEQ ID NO: 7734117 - DNA, 22 bp, Homo sapiens
cagcttctccggcctggtgcgg

SEQ ID NO: 7734118 - DNA, 22 bp, Homo sapiens
cagcttctatttatctttgtgt

SEQ ID NO: 7734119 - DNA, 22 bp, Homo sapiens
cagcttctagcatcggctttga

SEQ ID NO: 7734120 - DNA, 22 bp, Homo sapiens
cagcttctaccatcaggaaatt

SEQ ID NO: 7734121 - DNA, 22 bp, Homo sapiens
cagcttctcagaaagctgaggt

SEQ ID NO: 7734122 - DNA, 22 bp, Homo sapiens
cagcttctccagatgaccctca

SEQ ID NO: 7734123 - DNA, 20 bp, Homo sapiens
cagcttggatgagaggctga

SEQ ID NO: 7734124 - DNA, 22 bp, Homo sapiens
cagcttggaggaggatctaaga

SEQ ID NO: 7734125 - DNA, 22 bp, Homo sapiens
cagcttggcttccgctttactg

SEQ ID NO: 7734126 - DNA, 22 bp, Homo sapiens
cagcttggattttggcacgtgt

SEQ ID NO: 7734127 - DNA, 22 bp, Homo sapiens
cagcttggcttcacattctgta

SEQ ID NO: 7734128 - DNA, 22 bp, Homo sapiens
cagcttggcgaatgtaggtatg

SEQ ID NO: 7734129 - DNA, 22 bp, Homo sapiens
cagcttgggggcgctggcctca

SEQ ID NO: 7734130 - DNA, 22 bp, Homo sapiens
cagcttgggagtttggttttat

SEQ ID NO: 7734131 - DNA, 22 bp, Homo sapiens
gttattaaagtatttgatgtta

SEQ ID NO: 7734132 - DNA, 22 bp, Homo sapiens
caggaaagagctgccaggcagg

SEQ ID NO: 7734133 - DNA, 21 bp, Homo sapiens
caggaaagaaaacgtacatat

SEQ ID NO: 7734134 - DNA, 22 bp, Homo sapiens
caggaaagagctgccaggcagg

SEQ ID NO: 7734135 - DNA, 22 bp, Homo sapiens
gttcacacttttgatatgtgaa

SEQ ID NO: 7734136 - DNA, 22 bp, Homo sapiens
cagcttgggtcaggtgcctgct

SEQ ID NO: 7734137 - DNA, 22 bp, Homo sapiens
gttcttcaccaaggtcagaggc

SEQ ID NO: 7734138 - DNA, 21 bp, Homo sapiens
gttcttagttatattctcaat

SEQ ID NO: 7734139 - DNA, 22 bp, Homo sapiens
gttcctgaaagatgagtaatta

SEQ ID NO: 7734140 - DNA, 22 bp, Homo sapiens
gttcctgaagggactggtgcag

SEQ ID NO: 7734141 - DNA, 22 bp, Homo sapiens
gttctgggaaggtggacctgtt

SEQ ID NO: 7734142 - DNA, 22 bp, Homo sapiens
gttcctgactgtggagtttggt

SEQ ID NO: 7734143 - DNA, 22 bp, Homo sapiens
gttcacagtgttttctttgcat

SEQ ID NO: 7734144 - DNA, 22 bp, Homo sapiens
gttcacagtgttttctttgcat

SEQ ID NO: 7734145 - DNA, 22 bp, Homo sapiens
caggaaaggtagtcacaatgta

SEQ ID NO: 7734146 - DNA, 22 bp, Homo sapiens
caggaaagccgagtgccatagg

SEQ ID NO: 7734147 - DNA, 22 bp, Homo sapiens
gttggccattaattggaggaca

SEQ ID NO: 7734148 - DNA, 22 bp, Homo sapiens
gttggctttgctctctgtccta

SEQ ID NO: 7734149 - DNA, 22 bp, Homo sapiens
caggaaattggctatttgggat

SEQ ID NO: 7734150 - DNA, 22 bp, Homo sapiens
caggaaatttatgttctactta

SEQ ID NO: 7734151 - DNA, 22 bp, Homo sapiens
caggaaattgcaacagtctgag

SEQ ID NO: 7734152 - DNA, 22 bp, Homo sapiens
caggaaatgtataattttataa

SEQ ID NO: 7734153 - DNA, 22 bp, Homo sapiens
caggaaatgggtcgttttataa

SEQ ID NO: 7734154 - DNA, 22 bp, Homo sapiens
caggaaattcttttgtttgtgc

SEQ ID NO: 7734155 - DNA, 23 bp, Homo sapiens
caggaaatgttcttgaagcctga

SEQ ID NO: 7734156 - DNA, 22 bp, Homo sapiens
caggaaataaaaagtatcttct

SEQ ID NO: 7734157 - DNA, 22 bp, Homo sapiens
caggaaatggctgaataaattc

SEQ ID NO: 7734158 - DNA, 22 bp, Homo sapiens
caggaacagggtgtcctggcag

SEQ ID NO: 7734159 - DNA, 19 bp, Homo sapiens
caggaacatggagggaggg

SEQ ID NO: 7734160 - DNA, 22 bp, Homo sapiens
caggaacagcaccaggagctag

SEQ ID NO: 7734161 - DNA, 22 bp, Homo sapiens
caggaacatgttggaaagaaat

SEQ ID NO: 7734162 - DNA, 22 bp, Homo sapiens
caggaacattgtagaattgaaa

SEQ ID NO: 7734163 - DNA, 22 bp, Homo sapiens
gtttcctgcgtgtgccactcat

SEQ ID NO: 7734164 - DNA, 22 bp, Homo sapiens
gtttcctggaaacattaggaga

SEQ ID NO: 7734165 - DNA, 22 bp, Homo sapiens
gtttcctgaccctggcccagca

SEQ ID NO: 7734166 - DNA, 22 bp, Homo sapiens
gtttcctgactgtggaattata

SEQ ID NO: 7734167 - DNA, 18 bp, Homo sapiens
gtttcctgaggtgaaggg

SEQ ID NO: 7734168 - DNA, 22 bp, Homo sapiens
gtttcctgatgtgggagatctt

SEQ ID NO: 7734169 - DNA, 22 bp, Homo sapiens
gtttcctgaaatagagtactgg

SEQ ID NO: 7734170 - DNA, 22 bp, Homo sapiens
gtttcctgggccccaacccaga

SEQ ID NO: 7734171 - DNA, 22 bp, Homo sapiens
gtttcctgtggccacagaataa

SEQ ID NO: 7734172 - DNA, 22 bp, Homo sapiens
gtttcctgtgggaactcggctg

SEQ ID NO: 7734173 - DNA, 22 bp, Homo sapiens
gtttcctgtttctcagcagccc

SEQ ID NO: 7734174 - DNA, 22 bp, Homo sapiens
gtttgccttttagataggaatg

SEQ ID NO: 7734175 - DNA, 22 bp, Homo sapiens
gtttgcctgtgatgtacatttc

SEQ ID NO: 7734176 - DNA, 22 bp, Homo sapiens
gtttgcctgccgacgctctcat

SEQ ID NO: 7734177 - DNA, 22 bp, Homo sapiens
caggagcttctgcccatggcca

SEQ ID NO: 7734178 - DNA, 22 bp, Homo sapiens
caggagctggatctccttgcgg

SEQ ID NO: 7734179 - DNA, 22 bp, Homo sapiens
caggaggaaatgtgaccctgct

SEQ ID NO: 7734180 - DNA, 22 bp, Homo sapiens
caggagagcccgggtccgggct

SEQ ID NO: 7734181 - DNA, 22 bp, Homo sapiens
caggagctcacagtctttgggt

SEQ ID NO: 7734182 - DNA, 22 bp, Homo sapiens
caggagctcaagaccaccctgg

SEQ ID NO: 7734183 - DNA, 22 bp, Homo sapiens
caggagctggataggaccacaa

SEQ ID NO: 7734184 - DNA, 22 bp, Homo sapiens
taaagcatgtactgtgtgctag

SEQ ID NO: 7734185 - DNA, 22 bp, Homo sapiens
taaagcatgtactgtgtgctag

SEQ ID NO: 7734186 - DNA, 22 bp, Homo sapiens
taaagcatgtgttagaagtgca

SEQ ID NO: 7734187 - DNA, 22 bp, Homo sapiens
taaagcatgtttcagtaaggtt

SEQ ID NO: 7734188 - DNA, 22 bp, Homo sapiens
taaagccacgctggaaatcagg

SEQ ID NO: 7734189 - DNA, 22 bp, Homo sapiens
taaatcaagaatatcagcttgt

SEQ ID NO: 7734190 - DNA, 22 bp, Homo sapiens
taaatagagaatcagcttggag

SEQ ID NO: 7734191 - DNA, 22 bp, Homo sapiens
taaagtgcatgcggggccagat

SEQ ID NO: 7734192 - DNA, 22 bp, Homo sapiens
taaagtgcccagggaaagcggg

SEQ ID NO: 7734193 - DNA, 22 bp, Homo sapiens
taaatagaatctaaactgctca

SEQ ID NO: 7734194 - DNA, 22 bp, Homo sapiens
taaagtgcagattgtgattcag

SEQ ID NO: 7734195 - DNA, 22 bp, Homo sapiens
taaagtgcaggctactcagaag

SEQ ID NO: 7734196 - DNA, 22 bp, Homo sapiens
taaagtgcagactcccggaaac

SEQ ID NO: 7734197 - DNA, 22 bp, Homo sapiens
taaaaagttgaaaggacttatc

SEQ ID NO: 7734198 - DNA, 22 bp, Homo sapiens
taaaaatcttatgaatggcaag

SEQ ID NO: 7734199 - DNA, 22 bp, Homo sapiens
gttttctctgagatgcctttct

SEQ ID NO: 7734200 - DNA, 22 bp, Homo sapiens
gttttctcatctcctcaatggt

SEQ ID NO: 7734201 - DNA, 22 bp, Homo sapiens
gttttcctgttgagtagtattc

SEQ ID NO: 7734202 - DNA, 22 bp, Homo sapiens
taaaaagtagtgagaatggcgc

SEQ ID NO: 7734203 - DNA, 22 bp, Homo sapiens
gtttggatagtgagagatactt

SEQ ID NO: 7734204 - DNA, 22 bp, Homo sapiens
caggaagggggatccttggaag

SEQ ID NO: 7734205 - DNA, 22 bp, Homo sapiens
caggaatgactgcagatggggc

SEQ ID NO: 7734206 - DNA, 22 bp, Homo sapiens
caggcaggagaggaggatttct

SEQ ID NO: 7734207 - DNA, 23 bp, Homo sapiens
caggcaggatgaggactacactc

SEQ ID NO: 7734208 - DNA, 22 bp, Homo sapiens
taatttactcagatgttcaatc

SEQ ID NO: 7734209 - DNA, 22 bp, Homo sapiens
taatttacttgcaaataacaat

SEQ ID NO: 7734210 - DNA, 22 bp, Homo sapiens
tacagcttaaaaaagccaactt

SEQ ID NO: 7734211 - DNA, 22 bp, Homo sapiens
tacaaatgtattttattttggt

SEQ ID NO: 7734212 - DNA, 22 bp, Homo sapiens
tacaaatgagttgtatgaacca

SEQ ID NO: 7734213 - DNA, 22 bp, Homo sapiens
tacaaatgaccatagccactta

SEQ ID NO: 7734214 - DNA, 22 bp, Homo sapiens
tacagtaacatgttgtacaagc

SEQ ID NO: 7734215 - DNA, 22 bp, Homo sapiens
taacagaaaggggacagaaata

SEQ ID NO: 7734216 - DNA, 22 bp, Homo sapiens
taacttctttggtttaaagaga

SEQ ID NO: 7734217 - DNA, 22 bp, Homo sapiens
taacttgataagtattctctgc

SEQ ID NO: 7734218 - DNA, 22 bp, Homo sapiens
taactttggggacacttctctt

SEQ ID NO: 7734219 - DNA, 22 bp, Homo sapiens
taagatgtaagatcagagcttg

SEQ ID NO: 7734220 - DNA, 22 bp, Homo sapiens
taagatgtacaaccacttctct

SEQ ID NO: 7734221 - DNA, 22 bp, Homo sapiens
taagcaaagtttataaggctct

SEQ ID NO: 7734222 - DNA, 22 bp, Homo sapiens
taagatgtctaagaggagatgc

SEQ ID NO: 7734223 - DNA, 22 bp, Homo sapiens
taagcaaataatgcatcaaggg

SEQ ID NO: 7734224 - DNA, 22 bp, Homo sapiens
taagcaaatagctagatcagag

SEQ ID NO: 7734225 - DNA, 22 bp, Homo sapiens
ctccagggggcatccacacagc

SEQ ID NO: 7734226 - DNA, 22 bp, Homo sapiens
tttaaaaaactagtctgagtct

SEQ ID NO: 7734227 - DNA, 22 bp, Homo sapiens
ctccagtgagtgagcaggcgac

SEQ ID NO: 7734228 - DNA, 22 bp, Homo sapiens
ctccaggttttacaaggtctat

SEQ ID NO: 7734229 - DNA, 22 bp, Homo sapiens
ctccaggtgcagaaggactcag

SEQ ID NO: 7734230 - DNA, 22 bp, Homo sapiens
ttgttaaaatgcatattctggt

SEQ ID NO: 7734231 - DNA, 22 bp, Homo sapiens
ctccagggttccccgatccact

SEQ ID NO: 7734232 - DNA, 22 bp, Homo sapiens
ctcagtgcttctagcttgatga

SEQ ID NO: 7734233 - DNA, 22 bp, Homo sapiens
ttggatcttatgaaggtggcat

SEQ ID NO: 7734234 - DNA, 22 bp, Homo sapiens
ttggctgctgaaatatgttctg

SEQ ID NO: 7734235 - DNA, 22 bp, Homo sapiens
ttggccacactcactagagccc

SEQ ID NO: 7734236 - DNA, 22 bp, Homo sapiens
ttggccacaatccaagccttgg

SEQ ID NO: 7734237 - DNA, 22 bp, Homo sapiens
ctcctctgtctggccctgagcc

SEQ ID NO: 7734238 - DNA, 22 bp, Homo sapiens
ctcctctgtctaccacgagggt

SEQ ID NO: 7734239 - DNA, 22 bp, Homo sapiens
ctcctctggcttcctggaggca

SEQ ID NO: 7734240 - DNA, 22 bp, Homo sapiens
ctcctctgggtcctggtggcca

SEQ ID NO: 7734241 - DNA, 22 bp, Homo sapiens
tttacagttccatgtgataggc

SEQ ID NO: 7734242 - DNA, 22 bp, Homo sapiens
tttacagttaagaaatgttacc

SEQ ID NO: 7734243 - DNA, 22 bp, Homo sapiens
tttacagttaagaaatgttacc

SEQ ID NO: 7734244 - DNA, 22 bp, Homo sapiens
tttaaatttagaagaaacactg

SEQ ID NO: 7734245 - DNA, 22 bp, Homo sapiens
tttaaattctgtctgccgctta

SEQ ID NO: 7734246 - DNA, 22 bp, Homo sapiens
tttaaatttgtgtttagagggt

SEQ ID NO: 7734247 - DNA, 22 bp, Homo sapiens
ctctcctcagaacaggccctct

SEQ ID NO: 7734248 - DNA, 22 bp, Homo sapiens
ctcctgggctgggaactcagcc

SEQ ID NO: 7734249 - DNA, 18 bp, Homo sapiens
ctcctgggctgcagatgc

SEQ ID NO: 7734250 - DNA, 22 bp, Homo sapiens
ctcctgggaggatgcggacccg

SEQ ID NO: 7734251 - DNA, 22 bp, Homo sapiens
ctcctgggagcagggatggatg

SEQ ID NO: 7734252 - DNA, 22 bp, Homo sapiens
ctcctgggagctgtggcagagc

SEQ ID NO: 7734253 - DNA, 22 bp, Homo sapiens
ctcctgggctcaagtgatcctc

SEQ ID NO: 7734254 - DNA, 21 bp, Homo sapiens
ctcctgggctaagatatagtg

SEQ ID NO: 7734255 - DNA, 22 bp, Homo sapiens
ttcattcccttatattagcatt

SEQ ID NO: 7734256 - DNA, 22 bp, Homo sapiens
ttcattccttctgtaccttgcc

SEQ ID NO: 7734257 - DNA, 22 bp, Homo sapiens
cgctgggggaacagcgagggtg

SEQ ID NO: 7734258 - DNA, 22 bp, Homo sapiens
ttcacagtttaatggcaaggat

SEQ ID NO: 7734259 - DNA, 22 bp, Homo sapiens
ttcacagtttgctgggacagga

SEQ ID NO: 7734260 - DNA, 22 bp, Homo sapiens
ttcacataaatagatcacatca

SEQ ID NO: 7734261 - DNA, 22 bp, Homo sapiens
ttcacatctataacttagataa

SEQ ID NO: 7734262 - DNA, 22 bp, Homo sapiens
ttcacagtgtgatctatgggca

SEQ ID NO: 7734263 - DNA, 22 bp, Homo sapiens
ctaatttaatgaatgagtctta

SEQ ID NO: 7734264 - DNA, 22 bp, Homo sapiens
ctaatttaatgaatgagtctta

SEQ ID NO: 7734265 - DNA, 22 bp, Homo sapiens
ttccaggatgggctgtcctact

SEQ ID NO: 7734266 - DNA, 22 bp, Homo sapiens
ttccaaagttagttattagaaa

SEQ ID NO: 7734267 - DNA, 22 bp, Homo sapiens
ttccaaagttattcaagcagta

SEQ ID NO: 7734268 - DNA, 22 bp, Homo sapiens
ttccaaagtcatgttgctgata

SEQ ID NO: 7734269 - DNA, 22 bp, Homo sapiens
ttccaaactgccaattcagaag

SEQ ID NO: 7734270 - DNA, 22 bp, Homo sapiens
ttccggaaggttctctagaatt

SEQ ID NO: 7734271 - DNA, 22 bp, Homo sapiens
ttcccacattctttacattcat

SEQ ID NO: 7734272 - DNA, 22 bp, Homo sapiens
ctagggccaaaggctgtgatgc

SEQ ID NO: 7734273 - DNA, 22 bp, Homo sapiens
ttctgtccactgctggggcctc

SEQ ID NO: 7734274 - DNA, 22 bp, Homo sapiens
ctaggccagttaggaagagaag

SEQ ID NO: 7734275 - DNA, 22 bp, Homo sapiens
ctaggcccatgaggtttgctgg

SEQ ID NO: 7734276 - DNA, 22 bp, Homo sapiens
ctaggccagagagacctcatga

SEQ ID NO: 7734277 - DNA, 22 bp, Homo sapiens
ctaggccacagggcaaaaagga

SEQ ID NO: 7734278 - DNA, 22 bp, Homo sapiens
ctaggcagactgagctctaggg

SEQ ID NO: 7734279 - DNA, 22 bp, Homo sapiens
ttgataaaatgatatcttcttt

SEQ ID NO: 7734280 - DNA, 22 bp, Homo sapiens
ttgagcttgaggagttatttga

SEQ ID NO: 7734281 - DNA, 22 bp, Homo sapiens
ctcagcagtatactctgaagat

SEQ ID NO: 7734282 - DNA, 22 bp, Homo sapiens
ctcagcagtatactctgaagat

SEQ ID NO: 7734283 - DNA, 22 bp, Homo sapiens
ttcttgtttattaagatataaa

SEQ ID NO: 7734284 - DNA, 22 bp, Homo sapiens
ctctggctggctgggcctcagt

SEQ ID NO: 7734285 - DNA, 22 bp, Homo sapiens
ctctggctgtcccgatgagcag

SEQ ID NO: 7734286 - DNA, 22 bp, Homo sapiens
ctctggctgcctctcaggcctg

SEQ ID NO: 7734287 - DNA, 19 bp, Homo sapiens
ctctgggcaagtcacttaa

SEQ ID NO: 7734288 - DNA, 22 bp, Homo sapiens
ctctgggcaagtttcttcatga

SEQ ID NO: 7734289 - DNA, 22 bp, Homo sapiens
ctctgggcaagtatgatagaaa

SEQ ID NO: 7734290 - DNA, 22 bp, Homo sapiens
ctctgggcaaagatgcctcatc

SEQ ID NO: 7734291 - DNA, 18 bp, Homo sapiens
ctctgggagaggcataca

SEQ ID NO: 7734292 - DNA, 22 bp, Homo sapiens
ctctgggcaggacgccaggcct

SEQ ID NO: 7734293 - DNA, 22 bp, Homo sapiens
ctctgggccaccgctggtgtat

SEQ ID NO: 7734294 - DNA, 22 bp, Homo sapiens
ctctgggcaggaccagtggacc

SEQ ID NO: 7734295 - DNA, 22 bp, Homo sapiens
ctctgggcaccaaagagcagct

SEQ ID NO: 7734296 - DNA, 22 bp, Homo sapiens
ctctgggcacattttccaggac

SEQ ID NO: 7734297 - DNA, 17 bp, Homo sapiens
ctctgggcagcctgggg

SEQ ID NO: 7734298 - DNA, 17 bp, Homo sapiens
ctctgggcagcctgggg

SEQ ID NO: 7734299 - DNA, 22 bp, Homo sapiens
ctctgggcactgtatgggttct

SEQ ID NO: 7734300 - DNA, 22 bp, Homo sapiens
ctctgggctgaatggctgaacc

SEQ ID NO: 7734301 - DNA, 22 bp, Homo sapiens
ctctgggctgaatggctgaacc

SEQ ID NO: 7734302 - DNA, 22 bp, Homo sapiens
ctctgggctccttcagcccttt

SEQ ID NO: 7734303 - DNA, 23 bp, Homo sapiens
ctctgggcgggcaggtcagcctc

SEQ ID NO: 7734304 - DNA, 22 bp, Homo sapiens
ctctgggcggcccaggccaacc

SEQ ID NO: 7734305 - DNA, 22 bp, Homo sapiens
ctctgggcggcccaggccaacc

SEQ ID NO: 7734306 - DNA, 22 bp, Homo sapiens
ctctgggccatgctactgctct

SEQ ID NO: 7734307 - DNA, 21 bp, Homo sapiens
ctctgggccattttcttccac

SEQ ID NO: 7734308 - DNA, 22 bp, Homo sapiens
ctctgggcccacttaaatctgg

SEQ ID NO: 7734309 - DNA, 22 bp, Homo sapiens
ttttgttttcttagaaacctgg

SEQ ID NO: 7734310 - DNA, 22 bp, Homo sapiens
ctctggtcaagcaaagaggttt

SEQ ID NO: 7734311 - DNA, 22 bp, Homo sapiens
ctctggtcatttggaagagcat

SEQ ID NO: 7734312 - DNA, 22 bp, Homo sapiens
ctctgggttcactgaggctctg

SEQ ID NO: 7734313 - DNA, 22 bp, Homo sapiens
ctgactgtctcttctcccatga

SEQ ID NO: 7734314 - DNA, 22 bp, Homo sapiens
ctgaagagactggagggggcat

SEQ ID NO: 7734315 - DNA, 22 bp, Homo sapiens
ctgaagagaaagggagctcttc

SEQ ID NO: 7734316 - DNA, 20 bp, Homo sapiens
ctgaagagactggaggggca

SEQ ID NO: 7734317 - DNA, 22 bp, Homo sapiens
ctgattctttgaagatgcaccc

SEQ ID NO: 7734318 - DNA, 22 bp, Homo sapiens
ctgaggcagaaaaagcaagggt

SEQ ID NO: 7734319 - DNA, 22 bp, Homo sapiens
ctgattaactgaactgaattta

SEQ ID NO: 7734320 - DNA, 22 bp, Homo sapiens
ctgaggcacccatcttctcctg

SEQ ID NO: 7734321 - DNA, 22 bp, Homo sapiens
ctgaggcactgtcagctgaggc

SEQ ID NO: 7734322 - DNA, 22 bp, Homo sapiens
ctgaggcactggtaatgggcat

SEQ ID NO: 7734323 - DNA, 22 bp, Homo sapiens
ctgcctcagcgttgtggcccta

SEQ ID NO: 7734324 - DNA, 22 bp, Homo sapiens
ctgccaggcctccgctgtcccc

SEQ ID NO: 7734325 - DNA, 22 bp, Homo sapiens
ctggatctaaaggtggatgtag

SEQ ID NO: 7734326 - DNA, 22 bp, Homo sapiens
ctggatctgaacatcggtatca

SEQ ID NO: 7734327 - DNA, 22 bp, Homo sapiens
ctggatctgtcttttggatccc

SEQ ID NO: 7734328 - DNA, 22 bp, Homo sapiens
ctggatctgtttgtgcttgtgg

SEQ ID NO: 7734329 - DNA, 22 bp, Homo sapiens
ctggatctgtcccctttttgtt

SEQ ID NO: 7734330 - DNA, 21 bp, Homo sapiens
ctggatctgtcatcgagtttt

SEQ ID NO: 7734331 - DNA, 22 bp, Homo sapiens
ctggatcttgctgcattgagaa

SEQ ID NO: 7734332 - DNA, 22 bp, Homo sapiens
ctggatcttcagagatcaccag

SEQ ID NO: 7734333 - DNA, 22 bp, Homo sapiens
ctggatgctgagaggtaccaag

SEQ ID NO: 7734334 - DNA, 22 bp, Homo sapiens
ctggattctttcataaaagtca

SEQ ID NO: 7734335 - DNA, 23 bp, Homo sapiens
ctggccaccatctttctggcttc

SEQ ID NO: 7734336 - DNA, 22 bp, Homo sapiens
ctggccaccaagagcttgctca

SEQ ID NO: 7734337 - DNA, 22 bp, Homo sapiens
ctggccacatgtgtgctgagca

SEQ ID NO: 7734338 - DNA, 22 bp, Homo sapiens
ctggcatgaaatggcatctcat

SEQ ID NO: 7734339 - DNA, 22 bp, Homo sapiens
ctggcctgagcacagcggctgc

SEQ ID NO: 7734340 - DNA, 22 bp, Homo sapiens
ctggcctgaggccgccttcaga

SEQ ID NO: 7734341 - DNA, 22 bp, Homo sapiens
ctggcctgaggccgccttcaga

SEQ ID NO: 7734342 - DNA, 22 bp, Homo sapiens
ctggcctgagaatgctaccctt

SEQ ID NO: 7734343 - DNA, 22 bp, Homo sapiens
ctggcccagagagcagagctta

SEQ ID NO: 7734344 - DNA, 22 bp, Homo sapiens
ctggcccagagagcagagctta

SEQ ID NO: 7734345 - DNA, 22 bp, Homo sapiens
ctggcccagagagcagagctta

SEQ ID NO: 7734346 - DNA, 22 bp, Homo sapiens
ctggcccagagctctggccttt

SEQ ID NO: 7734347 - DNA, 22 bp, Homo sapiens
ctggcccagagctctggccttt

SEQ ID NO: 7734348 - DNA, 22 bp, Homo sapiens
ctggcccagagctctggccttt

SEQ ID NO: 7734349 - DNA, 20 bp, Homo sapiens
ctggcccaggatgatggcgc

SEQ ID NO: 7734350 - DNA, 22 bp, Homo sapiens
ctggctccaggtcatgcactca

SEQ ID NO: 7734351 - DNA, 23 bp, Homo sapiens
ctggctccgaagactccaggatc

SEQ ID NO: 7734352 - DNA, 22 bp, Homo sapiens
ctggcctggcaggggacctcta

SEQ ID NO: 7734353 - DNA, 22 bp, Homo sapiens
ctggcctggcgcagtggctcac

SEQ ID NO: 7734354 - DNA, 22 bp, Homo sapiens
ctggctccaccccaggaggatg

SEQ ID NO: 7734355 - DNA, 23 bp, Homo sapiens
ctggctctgtaggtggcatcctt

SEQ ID NO: 7734356 - DNA, 22 bp, Homo sapiens
ctggctctgggctaagctccca

SEQ ID NO: 7734357 - DNA, 22 bp, Homo sapiens
ctggaaggttctttgtgtgcct

SEQ ID NO: 7734358 - DNA, 22 bp, Homo sapiens
ctgcctggcatggagaagagaa

SEQ ID NO: 7734359 - DNA, 21 bp, Homo sapiens
ctggagtcattttctgagtag

SEQ ID NO: 7734360 - DNA, 22 bp, Homo sapiens
ctggagtctccccaggagcgtg

SEQ ID NO: 7734361 - DNA, 22 bp, Homo sapiens
ctggaggggctggcatggtagc

SEQ ID NO: 7734362 - DNA, 22 bp, Homo sapiens
ctggaggagcatggactggagt

SEQ ID NO: 7734363 - DNA, 22 bp, Homo sapiens
ctggaggaccacagaagctggt

SEQ ID NO: 7734364 - DNA, 22 bp, Homo sapiens
ctggagctctccagagccccgt

SEQ ID NO: 7734365 - DNA, 22 bp, Homo sapiens
ctggagctctgtgtgttcctga

SEQ ID NO: 7734366 - DNA, 22 bp, Homo sapiens
ctggaggacagaggccatgtct

SEQ ID NO: 7734367 - DNA, 22 bp, Homo sapiens
ctggactcatccatagaggtga

SEQ ID NO: 7734368 - DNA, 19 bp, Homo sapiens
ctggacctggaggcccgga

SEQ ID NO: 7734369 - DNA, 21 bp, Homo sapiens
tgctcagtaaatgctgagtga

SEQ ID NO: 7734370 - DNA, 22 bp, Homo sapiens
cccaggctcctgactcattcta

SEQ ID NO: 7734371 - DNA, 22 bp, Homo sapiens
tgcctgggatctgtgccctttg

SEQ ID NO: 7734372 - DNA, 22 bp, Homo sapiens
cccaggctcctagaggcccaga

SEQ ID NO: 7734373 - DNA, 22 bp, Homo sapiens
tgcctgggagtgaccaagactc

SEQ ID NO: 7734374 - DNA, 21 bp, Homo sapiens
cccctcatacactctccttgc

SEQ ID NO: 7734375 - DNA, 22 bp, Homo sapiens
cccctcctggccacactgtcag

SEQ ID NO: 7734376 - DNA, 22 bp, Homo sapiens
cccctctccctcacttatcaat

SEQ ID NO: 7734377 - DNA, 22 bp, Homo sapiens
ccctcagcttctccctgcagct

SEQ ID NO: 7734378 - DNA, 21 bp, Homo sapiens
ccctcaggaaacagaatgcac

SEQ ID NO: 7734379 - DNA, 22 bp, Homo sapiens
tgctgcagatcagctgagtcct

SEQ ID NO: 7734380 - DNA, 22 bp, Homo sapiens
ccccactctcggccagataggc

SEQ ID NO: 7734381 - DNA, 22 bp, Homo sapiens
tgccaagtggagctcaggaatc

SEQ ID NO: 7734382 - DNA, 22 bp, Homo sapiens
tgccaagtttctctcagggact

SEQ ID NO: 7734383 - DNA, 22 bp, Homo sapiens
cccagcctactctgccatagca

SEQ ID NO: 7734384 - DNA, 22 bp, Homo sapiens
cccagcctttgcttcctggttc

SEQ ID NO: 7734385 - DNA, 22 bp, Homo sapiens
cccagctctggaaggtggggga

SEQ ID NO: 7734386 - DNA, 22 bp, Homo sapiens
cccagctcttcctgggagctaa

SEQ ID NO: 7734387 - DNA, 22 bp, Homo sapiens
cccagctcttttagcggcatct

SEQ ID NO: 7734388 - DNA, 22 bp, Homo sapiens
cccagctcttcaagtcaccccc

SEQ ID NO: 7734389 - DNA, 18 bp, Homo sapiens
cccagctggtgggtcagt

SEQ ID NO: 7734390 - DNA, 22 bp, Homo sapiens
tgcattaagtgtctgcatatgg

SEQ ID NO: 7734391 - DNA, 22 bp, Homo sapiens
tgcattaagggcctggagatac

SEQ ID NO: 7734392 - DNA, 22 bp, Homo sapiens
tgcattaaggtaattgtataat

SEQ ID NO: 7734393 - DNA, 22 bp, Homo sapiens
tgcattaagaatttctgaggat

SEQ ID NO: 7734394 - DNA, 22 bp, Homo sapiens
tgcattaagcacacttttgaat

SEQ ID NO: 7734395 - DNA, 22 bp, Homo sapiens
tgcattaaggccattgaaattt

SEQ ID NO: 7734396 - DNA, 22 bp, Homo sapiens
tgcattaaaatgatggagaaat

SEQ ID NO: 7734397 - DNA, 22 bp, Homo sapiens
tgcattaaaatgtgcctctctt

SEQ ID NO: 7734398 - DNA, 22 bp, Homo sapiens
tgcattaaatataatctgttga

SEQ ID NO: 7734399 - DNA, 22 bp, Homo sapiens
ccctccagagcctggacattct

SEQ ID NO: 7734400 - DNA, 22 bp, Homo sapiens
ccctcagttttccagtgtgggc

SEQ ID NO: 7734401 - DNA, 22 bp, Homo sapiens
ccctcagtctggctgggaagac

SEQ ID NO: 7734402 - DNA, 22 bp, Homo sapiens
ccctccagagcttgacctgctg

SEQ ID NO: 7734403 - DNA, 22 bp, Homo sapiens
tggagctgagaagtggagctct

SEQ ID NO: 7734404 - DNA, 22 bp, Homo sapiens
tggagctgactcacaccagcta

SEQ ID NO: 7734405 - DNA, 17 bp, Homo sapiens
ccctggctctaggtgga

SEQ ID NO: 7734406 - DNA, 22 bp, Homo sapiens
tggagctgagcacctccagggc

SEQ ID NO: 7734407 - DNA, 18 bp, Homo sapiens
tggagctgagggcaatgc

SEQ ID NO: 7734408 - DNA, 22 bp, Homo sapiens
tggatctggttccctgagcctt

SEQ ID NO: 7734409 - DNA, 21 bp, Homo sapiens
tggatctgtgatctggggcac

SEQ ID NO: 7734410 - DNA, 22 bp, Homo sapiens
tggatctgactggcttttcttc

SEQ ID NO: 7734411 - DNA, 18 bp, Homo sapiens
tggatctttatgaggctg

SEQ ID NO: 7734412 - DNA, 22 bp, Homo sapiens
tggatgagggctgagcactggg

SEQ ID NO: 7734413 - DNA, 22 bp, Homo sapiens
cctaggccctcaaagagcataa

SEQ ID NO: 7734414 - DNA, 22 bp, Homo sapiens
tggccaggcaggtagaacggcc

SEQ ID NO: 7734415 - DNA, 22 bp, Homo sapiens
cctaggcttgttttcatcagct

SEQ ID NO: 7734416 - DNA, 22 bp, Homo sapiens
cctaggccttactttcctgtgc

SEQ ID NO: 7734417 - DNA, 22 bp, Homo sapiens
cctagtccccaggaggtcagtg

SEQ ID NO: 7734418 - DNA, 21 bp, Homo sapiens
tggccagctggagtctccaca

SEQ ID NO: 7734419 - DNA, 23 bp, Homo sapiens
tggcagctgtgtaagagaaagca

SEQ ID NO: 7734420 - DNA, 22 bp, Homo sapiens
tggcagcttcctgctcatagga

SEQ ID NO: 7734421 - DNA, 22 bp, Homo sapiens
tggcacaggaatttagatgcag

SEQ ID NO: 7734422 - DNA, 22 bp, Homo sapiens
tggcaaggccacaggtgcagtt

SEQ ID NO: 7734423 - DNA, 22 bp, Homo sapiens
tggcacagggcttggtcgctca

SEQ ID NO: 7734424 - DNA, 22 bp, Homo sapiens
tggcacagtcctgggtgcctgc

SEQ ID NO: 7734425 - DNA, 22 bp, Homo sapiens
tggcacaggatctcagcggcca

SEQ ID NO: 7734426 - DNA, 22 bp, Homo sapiens
tggcacaggagcactgccctgg

SEQ ID NO: 7734427 - DNA, 22 bp, Homo sapiens
tggctgccttccctgctggagg

SEQ ID NO: 7734428 - DNA, 22 bp, Homo sapiens
tggctgccgactggctcttggc

SEQ ID NO: 7734429 - DNA, 21 bp, Homo sapiens
tggctgcctacatgctgcagg

SEQ ID NO: 7734430 - DNA, 22 bp, Homo sapiens
tggctgcctagtgtctgagcag

SEQ ID NO: 7734431 - DNA, 21 bp, Homo sapiens
tggctgcctggctctgtggtt

SEQ ID NO: 7734432 - DNA, 22 bp, Homo sapiens
cctctaggatgtggctggagga

SEQ ID NO: 7734433 - DNA, 23 bp, Homo sapiens
cctctaataaacttgaccttgtg

SEQ ID NO: 7734434 - DNA, 22 bp, Homo sapiens
cctctggggcatcagacaaagg

SEQ ID NO: 7734435 - DNA, 22 bp, Homo sapiens
cctctgggggcttccttaccct

SEQ ID NO: 7734436 - DNA, 22 bp, Homo sapiens
cctctgggctgcctgcacgggt

SEQ ID NO: 7734437 - DNA, 22 bp, Homo sapiens
cctctgggctggaaaattaatg

SEQ ID NO: 7734438 - DNA, 22 bp, Homo sapiens
cctctggctgtaccactggcac

SEQ ID NO: 7734439 - DNA, 22 bp, Homo sapiens
cctctgggttagtttagggagc

SEQ ID NO: 7734440 - DNA, 18 bp, Homo sapiens
cctctgggttttgttccc

SEQ ID NO: 7734441 - DNA, 22 bp, Homo sapiens
cctctggggtgagtgggccact

SEQ ID NO: 7734442 - DNA, 22 bp, Homo sapiens
cctctggggtctagcaatagca

SEQ ID NO: 7734443 - DNA, 22 bp, Homo sapiens
cctctgggggtcctcagagtct

SEQ ID NO: 7734444 - DNA, 22 bp, Homo sapiens
cctctgggtgggaggccgggcg

SEQ ID NO: 7734445 - DNA, 22 bp, Homo sapiens
cctctgggtgacagactcttgg

SEQ ID NO: 7734446 - DNA, 22 bp, Homo sapiens
cctctgggtatctgtggaagta

SEQ ID NO: 7734447 - DNA, 22 bp, Homo sapiens
cctccactctggcctctcaggt

SEQ ID NO: 7734448 - DNA, 22 bp, Homo sapiens
cctccactctggcctctcaggt

SEQ ID NO: 7734449 - DNA, 22 bp, Homo sapiens
cctccctggtggctctggtcta

SEQ ID NO: 7734450 - DNA, 22 bp, Homo sapiens
cctcctctgggaagattcagag

SEQ ID NO: 7734451 - DNA, 21 bp, Homo sapiens
tggctcagttgctgggcacag

SEQ ID NO: 7734452 - DNA, 22 bp, Homo sapiens
tggccctgctatgatcctgcaa

SEQ ID NO: 7734453 - DNA, 22 bp, Homo sapiens
tggcccctgaggagcatcagcc

SEQ ID NO: 7734454 - DNA, 22 bp, Homo sapiens
tggcccctgaggagcgtcagcc

SEQ ID NO: 7734455 - DNA, 22 bp, Homo sapiens
tggcccctggcacacggaggat

SEQ ID NO: 7734456 - DNA, 18 bp, Homo sapiens
tggccccttatcagtcct

SEQ ID NO: 7734457 - DNA, 20 bp, Homo sapiens
tggcccagtggggcagggtg

SEQ ID NO: 7734458 - DNA, 22 bp, Homo sapiens
cctggctcccggaacagggtct

SEQ ID NO: 7734459 - DNA, 22 bp, Homo sapiens
cctggctccctggacctcatta

SEQ ID NO: 7734460 - DNA, 22 bp, Homo sapiens
cctggctccgtgtcacgtgccc

SEQ ID NO: 7734461 - DNA, 22 bp, Homo sapiens
cctggctcctgcacagatcttt

SEQ ID NO: 7734462 - DNA, 22 bp, Homo sapiens
cctggctcctgcacagatcttt

SEQ ID NO: 7734463 - DNA, 22 bp, Homo sapiens
cctggctcctgcctctgcaggg

SEQ ID NO: 7734464 - DNA, 22 bp, Homo sapiens
cctggctcctgcctctgcaggg

SEQ ID NO: 7734465 - DNA, 22 bp, Homo sapiens
cctggctctctgcagatcctgg

SEQ ID NO: 7734466 - DNA, 22 bp, Homo sapiens
cctggctctgaagtccacatca

SEQ ID NO: 7734467 - DNA, 22 bp, Homo sapiens
cctggctctgaagtccacatca

SEQ ID NO: 7734468 - DNA, 22 bp, Homo sapiens
cctggctctagaggccactcct

SEQ ID NO: 7734469 - DNA, 22 bp, Homo sapiens
cctggctcgctgacctcagggg

SEQ ID NO: 7734470 - DNA, 22 bp, Homo sapiens
cctggccctggaatagggcagg

SEQ ID NO: 7734471 - DNA, 21 bp, Homo sapiens
cctggctccagaacttccggt

SEQ ID NO: 7734472 - DNA, 22 bp, Homo sapiens
cctggctccagctgcctgtcct

SEQ ID NO: 7734473 - DNA, 22 bp, Homo sapiens
cctggctcccccatcatagctg

SEQ ID NO: 7734474 - DNA, 22 bp, Homo sapiens
tgtcctggaaaaatggagagtt

SEQ ID NO: 7734475 - DNA, 22 bp, Homo sapiens
tgtctcaggcccaagccagtaa

SEQ ID NO: 7734476 - DNA, 22 bp, Homo sapiens
tgtctcagatacgccatcaagg

SEQ ID NO: 7734477 - DNA, 22 bp, Homo sapiens
tgtctctggctgcagcctgttc

SEQ ID NO: 7734478 - DNA, 22 bp, Homo sapiens
tgtctctggcccatgagcagag

SEQ ID NO: 7734479 - DNA, 22 bp, Homo sapiens
cctggccaggctctcagcactg

SEQ ID NO: 7734480 - DNA, 22 bp, Homo sapiens
cctggccagtttccaggccctg

SEQ ID NO: 7734481 - DNA, 22 bp, Homo sapiens
cctggccagccagggctggggt

SEQ ID NO: 7734482 - DNA, 22 bp, Homo sapiens
cctggccagcgccggctgctcg

SEQ ID NO: 7734483 - DNA, 22 bp, Homo sapiens
tgtccatggagaagctcagggc

SEQ ID NO: 7734484 - DNA, 22 bp, Homo sapiens
tgtcatggtagctgaaggatgt

SEQ ID NO: 7734485 - DNA, 22 bp, Homo sapiens
tgtattaacattaataaaatgg

SEQ ID NO: 7734486 - DNA, 22 bp, Homo sapiens
cctggagcacagcccagtccca

SEQ ID NO: 7734487 - DNA, 22 bp, Homo sapiens
cctggcacatagtaagtactag

SEQ ID NO: 7734488 - DNA, 22 bp, Homo sapiens
tggtccctagcacagctgtcct

SEQ ID NO: 7734489 - DNA, 22 bp, Homo sapiens
cctctgtgcctcgtgtcctctg

SEQ ID NO: 7734490 - DNA, 22 bp, Homo sapiens
cctggactcagaggtgctggtg

SEQ ID NO: 7734491 - DNA, 22 bp, Homo sapiens
tggtgctgccacctcctctgct

SEQ ID NO: 7734492 - DNA, 23 bp, Homo sapiens
tgtctggggcgccagaagagaga

SEQ ID NO: 7734493 - DNA, 23 bp, Homo sapiens
cctggctgacctgaaggtgtagt

SEQ ID NO: 7734494 - DNA, 22 bp, Homo sapiens
cctggctcttcgggagtttgtt

SEQ ID NO: 7734495 - DNA, 22 bp, Homo sapiens
cctggctgaacaaagtccctcc

SEQ ID NO: 7734496 - DNA, 22 bp, Homo sapiens
cctggctcttctgtgtcagccc

SEQ ID NO: 7734497 - DNA, 22 bp, Homo sapiens
tgtctttagaaagaagcagaca

SEQ ID NO: 7734498 - DNA, 22 bp, Homo sapiens
tgtctttacttagaagttcagg

SEQ ID NO: 7734499 - DNA, 22 bp, Homo sapiens
tgtgaggcctagacagcctggg

SEQ ID NO: 7734500 - DNA, 21 bp, Homo sapiens
cctggctgcacagttgctggt

SEQ ID NO: 7734501 - DNA, 22 bp, Homo sapiens
tgtgaggaacaggactagagca

SEQ ID NO: 7734502 - DNA, 22 bp, Homo sapiens
tgtgaggacattggaggactca

SEQ ID NO: 7734503 - DNA, 22 bp, Homo sapiens
cctggctgcattttgctggatg

SEQ ID NO: 7734504 - DNA, 22 bp, Homo sapiens
cctggctgctatagcagcatgt

SEQ ID NO: 7734505 - DNA, 22 bp, Homo sapiens
cctggctgctatagcagcatgt

SEQ ID NO: 7734506 - DNA, 22 bp, Homo sapiens
cctggctgtgcattgccggccc

SEQ ID NO: 7734507 - DNA, 21 bp, Homo sapiens
cctggcttcagggtgcactgg

SEQ ID NO: 7734508 - DNA, 22 bp, Homo sapiens
cctggctgtggcggtgctctca

SEQ ID NO: 7734509 - DNA, 22 bp, Homo sapiens
cctgggccaggcttgggaatgc

SEQ ID NO: 7734510 - DNA, 21 bp, Homo sapiens
cctgggccaaattccctggac

SEQ ID NO: 7734511 - DNA, 22 bp, Homo sapiens
cctgggcctcacccagctcttg

SEQ ID NO: 7734512 - DNA, 22 bp, Homo sapiens
tgtggggtgtggtccaggcatc

SEQ ID NO: 7734513 - DNA, 22 bp, Homo sapiens
tgtggctgttgaggaccccaag

SEQ ID NO: 7734514 - DNA, 22 bp, Homo sapiens
tgtggctgtgtccacctgctgc

SEQ ID NO: 7734515 - DNA, 22 bp, Homo sapiens
tgtggctgtggatgctttccag

SEQ ID NO: 7734516 - DNA, 22 bp, Homo sapiens
tgtggctgtggttttcataaat

SEQ ID NO: 7734517 - DNA, 22 bp, Homo sapiens
tgtggctggtctccgagcgtcg

SEQ ID NO: 7734518 - DNA, 18 bp, Homo sapiens
tgtggctggtccacactg

SEQ ID NO: 7734519 - DNA, 22 bp, Homo sapiens
tgtggctgtctgttctcctagg

SEQ ID NO: 7734520 - DNA, 22 bp, Homo sapiens
tgtggctgtgccgtcacacgtg

SEQ ID NO: 7734521 - DNA, 22 bp, Homo sapiens
tgtggctgctcctgggtggtca

SEQ ID NO: 7734522 - DNA, 22 bp, Homo sapiens
tgtggctgctcaggtgcagacc

SEQ ID NO: 7734523 - DNA, 22 bp, Homo sapiens
tgtggctggattgattttacct

SEQ ID NO: 7734524 - DNA, 15 bp, Homo sapiens
tgtggctggctcctg

SEQ ID NO: 7734525 - DNA, 22 bp, Homo sapiens
tgtggctgggaagaaggtaact

SEQ ID NO: 7734526 - DNA, 22 bp, Homo sapiens
tgtggctgggctaataggcaaa

SEQ ID NO: 7734527 - DNA, 22 bp, Homo sapiens
tgtggcagggatactgaggcag

SEQ ID NO: 7734528 - DNA, 21 bp, Homo sapiens
tgtggctgcctctggccctgg

SEQ ID NO: 7734529 - DNA, 22 bp, Homo sapiens
tgtggcaggcattctgaggctg

SEQ ID NO: 7734530 - DNA, 22 bp, Homo sapiens
tgtggcaggaagagcttctgag

SEQ ID NO: 7734531 - DNA, 22 bp, Homo sapiens
cctgggccttgacctcgtgggc

SEQ ID NO: 7734532 - DNA, 22 bp, Homo sapiens
cctgggccttgacctcgtgggc

SEQ ID NO: 7734533 - DNA, 20 bp, Homo sapiens
cctgggctcaaagcatcctc

SEQ ID NO: 7734534 - DNA, 22 bp, Homo sapiens
cctgggcttccacgagcagagg

SEQ ID NO: 7734535 - DNA, 22 bp, Homo sapiens
cctgggctcaagcgatcttgtc

SEQ ID NO: 7734536 - DNA, 22 bp, Homo sapiens
cctgggctttgctggcaaggcc

SEQ ID NO: 7734537 - DNA, 22 bp, Homo sapiens
cctggggaagtcacttctcttt

SEQ ID NO: 7734538 - DNA, 22 bp, Homo sapiens
cctgggctttggaacagtactt

SEQ ID NO: 7734539 - DNA, 22 bp, Homo sapiens
tgtgtgtcactgaaagaaatct

SEQ ID NO: 7734540 - DNA, 22 bp, Homo sapiens
cctgggcctggcgggtcggctc

SEQ ID NO: 7734541 - DNA, 23 bp, Homo sapiens
tgtgttctcacacagatgcagta

SEQ ID NO: 7734542 - DNA, 19 bp, Homo sapiens
tgtgttcattcatcagagg

SEQ ID NO: 7734543 - DNA, 22 bp, Homo sapiens
tgtgttcatgttgattcatagc

SEQ ID NO: 7734544 - DNA, 22 bp, Homo sapiens
cctgggtcccagccaggctttg

SEQ ID NO: 7734545 - DNA, 22 bp, Homo sapiens
tgtgttcaatgacttcatcttt

SEQ ID NO: 7734546 - DNA, 22 bp, Homo sapiens
tgtgttcagtatgacattcaca

SEQ ID NO: 7734547 - DNA, 22 bp, Homo sapiens
tgtgttcaccaaagtgtagaaa

SEQ ID NO: 7734548 - DNA, 22 bp, Homo sapiens
tgtgttcatgtcactggaatcc

SEQ ID NO: 7734549 - DNA, 22 bp, Homo sapiens
tgtgttcatgtatgtatacata

SEQ ID NO: 7734550 - DNA, 22 bp, Homo sapiens
tgtgttcatcatgatatcaggt

SEQ ID NO: 7734551 - DNA, 22 bp, Homo sapiens
cctgggtcccatcccagagtga

SEQ ID NO: 7734552 - DNA, 22 bp, Homo sapiens
cctgggtccctgagagatgatt

SEQ ID NO: 7734553 - DNA, 22 bp, Homo sapiens
cctgggtcctggcagcctcctg

SEQ ID NO: 7734554 - DNA, 22 bp, Homo sapiens
cctgggtctcctcctgctggct

SEQ ID NO: 7734555 - DNA, 22 bp, Homo sapiens
cctgggtctatagacttcaaga

SEQ ID NO: 7734556 - DNA, 22 bp, Homo sapiens
cctgggtcttggttcatgctct

SEQ ID NO: 7734557 - DNA, 22 bp, Homo sapiens
cctgggtcttcagtctgctggt

SEQ ID NO: 7734558 - DNA, 22 bp, Homo sapiens
cctgggtctggtcactaagtca

SEQ ID NO: 7734559 - DNA, 19 bp, Homo sapiens
cctgggtctgcagcattca

SEQ ID NO: 7734560 - DNA, 22 bp, Homo sapiens
cctgggtctgtattggtaggta

SEQ ID NO: 7734561 - DNA, 22 bp, Homo sapiens
gaaggccctggtattcttgagg

SEQ ID NO: 7734562 - DNA, 22 bp, Homo sapiens
gaaggagaggattgtgaggctg

SEQ ID NO: 7734563 - DNA, 22 bp, Homo sapiens
gaaggagagggtcaaggataat

SEQ ID NO: 7734564 - DNA, 22 bp, Homo sapiens
gaaggagagaaaggcaattctg

SEQ ID NO: 7734565 - DNA, 22 bp, Homo sapiens
gaaggagagagacatcgtccct

SEQ ID NO: 7734566 - DNA, 22 bp, Homo sapiens
gaaggagaccctgaagatgctg

SEQ ID NO: 7734567 - DNA, 22 bp, Homo sapiens
gaaggagaccctgaagatgctg

SEQ ID NO: 7734568 - DNA, 21 bp, Homo sapiens
gaaggagaaagcaagtgctgc

SEQ ID NO: 7734569 - DNA, 22 bp, Homo sapiens
gaaggagagagacatcgtccct

SEQ ID NO: 7734570 - DNA, 19 bp, Homo sapiens
gaaggagagctgagttagg

SEQ ID NO: 7734571 - DNA, 22 bp, Homo sapiens
gaaggaccctctggggtctcag

SEQ ID NO: 7734572 - DNA, 22 bp, Homo sapiens
gaaggaagtcattagtgcagac

SEQ ID NO: 7734573 - DNA, 22 bp, Homo sapiens
gaagttacatactgtcacttct

SEQ ID NO: 7734574 - DNA, 22 bp, Homo sapiens
gaagtgtctccgtttttaaagg

SEQ ID NO: 7734575 - DNA, 23 bp, Homo sapiens
gaagtgtctgagctgtatttttc

SEQ ID NO: 7734576 - DNA, 18 bp, Homo sapiens
gaagtgaagtgactcaat

SEQ ID NO: 7734577 - DNA, 22 bp, Homo sapiens
gaaggctctggggattgagata

SEQ ID NO: 7734578 - DNA, 22 bp, Homo sapiens
gacaggaagtctgaaggaggga

SEQ ID NO: 7734579 - DNA, 22 bp, Homo sapiens
gacagctgtggagaggcatgtg

SEQ ID NO: 7734580 - DNA, 22 bp, Homo sapiens
gacacagagataggcctgtgtt

SEQ ID NO: 7734581 - DNA, 22 bp, Homo sapiens
gaattctgggagagatctgaca

SEQ ID NO: 7734582 - DNA, 22 bp, Homo sapiens
gaagttctcagctaggtgatgt

SEQ ID NO: 7734583 - DNA, 22 bp, Homo sapiens
gaagttctcaaggatcacagaa

SEQ ID NO: 7734584 - DNA, 22 bp, Homo sapiens
gaattccactttggcttttggg

SEQ ID NO: 7734585 - DNA, 22 bp, Homo sapiens
gactttggtttgagcaagtcag

SEQ ID NO: 7734586 - DNA, 22 bp, Homo sapiens
gagacacaggtggttcctgtca

SEQ ID NO: 7734587 - DNA, 22 bp, Homo sapiens
gagacagagatcttgctgagtc

SEQ ID NO: 7734588 - DNA, 17 bp, Homo sapiens
gagagctgctgcttccg

SEQ ID NO: 7734589 - DNA, 22 bp, Homo sapiens
gagagctgcattctcagacaca

SEQ ID NO: 7734590 - DNA, 22 bp, Homo sapiens
gagaggtagaggctctgcttaa

SEQ ID NO: 7734591 - DNA, 22 bp, Homo sapiens
gagaggtacggaaagagcgtgg

SEQ ID NO: 7734592 - DNA, 22 bp, Homo sapiens
gagaggtacaccctttaaactt

SEQ ID NO: 7734593 - DNA, 22 bp, Homo sapiens
gagagtctaggaacctcatata

SEQ ID NO: 7734594 - DNA, 20 bp, Homo sapiens
gagagctggaaataaagtcc

SEQ ID NO: 7734595 - DNA, 18 bp, Homo sapiens
gacccagcagatgggctt

SEQ ID NO: 7734596 - DNA, 22 bp, Homo sapiens
gacaggaggcagagctcaggtg

SEQ ID NO: 7734597 - DNA, 22 bp, Homo sapiens
gactgtgacttctgaagcaata

SEQ ID NO: 7734598 - DNA, 22 bp, Homo sapiens
gactgtggcaggctcagcactg

SEQ ID NO: 7734599 - DNA, 22 bp, Homo sapiens
gacttctgaattcctatcaggt

SEQ ID NO: 7734600 - DNA, 22 bp, Homo sapiens
gactgtggtctgttctccaggt

SEQ ID NO: 7734601 - DNA, 22 bp, Homo sapiens
ctggctggtcctcggggacagc

SEQ ID NO: 7734602 - DNA, 22 bp, Homo sapiens
ctggctggttactatttctggt

SEQ ID NO: 7734603 - DNA, 22 bp, Homo sapiens
cttctctatctttggcacatca

SEQ ID NO: 7734604 - DNA, 22 bp, Homo sapiens
cttctcttcccagggacacagg

SEQ ID NO: 7734605 - DNA, 22 bp, Homo sapiens
cttctcttcctttgtcaactga

SEQ ID NO: 7734606 - DNA, 22 bp, Homo sapiens
cttctcttgggtgtggtgtctt

SEQ ID NO: 7734607 - DNA, 22 bp, Homo sapiens
cttctttcttttgatcacaggt

SEQ ID NO: 7734608 - DNA, 22 bp, Homo sapiens
cttctttgaaaaaggcagtcag

SEQ ID NO: 7734609 - DNA, 22 bp, Homo sapiens
cttggctggaactcctgagaaa

SEQ ID NO: 7734610 - DNA, 21 bp, Homo sapiens
ctttagtgaaaaggggctaac

SEQ ID NO: 7734611 - DNA, 22 bp, Homo sapiens
ctttagtgttgttgtgaggatt

SEQ ID NO: 7734612 - DNA, 22 bp, Homo sapiens
ctttagaatttgatataatcaa

SEQ ID NO: 7734613 - DNA, 20 bp, Homo sapiens
ctttagaagaacccaagcat

SEQ ID NO: 7734614 - DNA, 22 bp, Homo sapiens
ctttgtatctaaatatcttgaa

SEQ ID NO: 7734615 - DNA, 22 bp, Homo sapiens
gaaaacatccagagatagacct

SEQ ID NO: 7734616 - DNA, 22 bp, Homo sapiens
gaaaagggcaagagagagggca

SEQ ID NO: 7734617 - DNA, 22 bp, Homo sapiens
gaaaaggaaatttatagagatc

SEQ ID NO: 7734618 - DNA, 22 bp, Homo sapiens
ctttgttttactcagaggcatg

SEQ ID NO: 7734619 - DNA, 22 bp, Homo sapiens
ctttgtggctcctgcaggccat

SEQ ID NO: 7734620 - DNA, 22 bp, Homo sapiens
gaaagggagtgaagatggtata

SEQ ID NO: 7734621 - DNA, 21 bp, Homo sapiens
gaaaatacaatgagcttgacc

SEQ ID NO: 7734622 - DNA, 22 bp, Homo sapiens
gaaaatacaaatagccttgaaa

SEQ ID NO: 7734623 - DNA, 22 bp, Homo sapiens
gaaagtgcatgtgcccaccatt

SEQ ID NO: 7734624 - DNA, 22 bp, Homo sapiens
gaaagtgccagaataggaggcc

SEQ ID NO: 7734625 - DNA, 22 bp, Homo sapiens
gaaagtgcctcagtcctcttat

SEQ ID NO: 7734626 - DNA, 18 bp, Homo sapiens
gaaagtgcggggcagggg

SEQ ID NO: 7734627 - DNA, 22 bp, Homo sapiens
gaaagggagtggacaacaggca

SEQ ID NO: 7734628 - DNA, 22 bp, Homo sapiens
gaaagggagtggacaacaggca

SEQ ID NO: 7734629 - DNA, 22 bp, Homo sapiens
gaaagggcatgggcatgacaac

SEQ ID NO: 7734630 - DNA, 22 bp, Homo sapiens
gaaagtgctaggaagtgttaga

SEQ ID NO: 7734631 - DNA, 22 bp, Homo sapiens
gaaagtgctctctctatacaca

SEQ ID NO: 7734632 - DNA, 22 bp, Homo sapiens
gaaagtgcttagagtgtggtat

SEQ ID NO: 7734633 - DNA, 22 bp, Homo sapiens
gaaagtgcttttgagtgtgtgc

SEQ ID NO: 7734634 - DNA, 22 bp, Homo sapiens
gaaatacaaatgcctagatcct

SEQ ID NO: 7734635 - DNA, 22 bp, Homo sapiens
gaacagaattaccgaagatctg

SEQ ID NO: 7734636 - DNA, 22 bp, Homo sapiens
gaggcccagtcctgcaagcacg

SEQ ID NO: 7734637 - DNA, 22 bp, Homo sapiens
gaggcagctcttctgaatgggg

SEQ ID NO: 7734638 - DNA, 22 bp, Homo sapiens
gaggaggctgaacaatgccctg

SEQ ID NO: 7734639 - DNA, 23 bp, Homo sapiens
gaggagggtctgacaagtgtagc

SEQ ID NO: 7734640 - DNA, 22 bp, Homo sapiens
gaggaggtcgctgctgagcccc

SEQ ID NO: 7734641 - DNA, 22 bp, Homo sapiens
gaggaggtcccccgacatgcct

SEQ ID NO: 7734642 - DNA, 22 bp, Homo sapiens
gaggcagaggttgcagtgagct

SEQ ID NO: 7734643 - DNA, 22 bp, Homo sapiens
gagctgggagttatagcatgtt

SEQ ID NO: 7734644 - DNA, 22 bp, Homo sapiens
gagctgggacttggaatccaca

SEQ ID NO: 7734645 - DNA, 22 bp, Homo sapiens
gaggacagcttagggcttcctg

SEQ ID NO: 7734646 - DNA, 22 bp, Homo sapiens
gaggaaggtcccatcagaattt

SEQ ID NO: 7734647 - DNA, 22 bp, Homo sapiens
gaggaatgggtgtctcgtgatt

SEQ ID NO: 7734648 - DNA, 22 bp, Homo sapiens
gagagtctagtgcacctagttt

SEQ ID NO: 7734649 - DNA, 22 bp, Homo sapiens
gagagtggatggagctgcgaag

SEQ ID NO: 7734650 - DNA, 22 bp, Homo sapiens
gagagttctacctctgaaggcg

SEQ ID NO: 7734651 - DNA, 22 bp, Homo sapiens
gagagttccagtaagtggattc

SEQ ID NO: 7734652 - DNA, 22 bp, Homo sapiens
gaggggcagaggtagagaacaa

SEQ ID NO: 7734653 - DNA, 21 bp, Homo sapiens
gaggggcagctcttagcatta

SEQ ID NO: 7734654 - DNA, 22 bp, Homo sapiens
gaggggagtgtcctccgggccc

SEQ ID NO: 7734655 - DNA, 22 bp, Homo sapiens
gaggggcaatgagggaaagagt

SEQ ID NO: 7734656 - DNA, 22 bp, Homo sapiens
gagggcagagtctaatgatgca

SEQ ID NO: 7734657 - DNA, 22 bp, Homo sapiens
gaggggaaagtgtgaggctgcg

SEQ ID NO: 7734658 - DNA, 22 bp, Homo sapiens
gaggtccagggtggggcctgag

SEQ ID NO: 7734659 - DNA, 22 bp, Homo sapiens
gaggtccagccaagcggcaagg

SEQ ID NO: 7734660 - DNA, 22 bp, Homo sapiens
gaggtccactgaggcaacaggg

SEQ ID NO: 7734661 - DNA, 22 bp, Homo sapiens
gaggtcaggggagaggctgatg

SEQ ID NO: 7734662 - DNA, 22 bp, Homo sapiens
gaggtcaggcttgcagcagggt

SEQ ID NO: 7734663 - DNA, 22 bp, Homo sapiens
gaggtcaggctcaagctgggcc

SEQ ID NO: 7734664 - DNA, 22 bp, Homo sapiens
gaggggcctggcactgagctgg

SEQ ID NO: 7734665 - DNA, 22 bp, Homo sapiens
gagggttggtgcaaatgggatg

SEQ ID NO: 7734666 - DNA, 22 bp, Homo sapiens
gaggtaacaactgaaatgagaa

SEQ ID NO: 7734667 - DNA, 22 bp, Homo sapiens
gaggtatcttagagagtgtaga

SEQ ID NO: 7734668 - DNA, 23 bp, Homo sapiens
gaggtcaaggctgcagtgattgc

SEQ ID NO: 7734669 - DNA, 22 bp, Homo sapiens
gatgaggaaaccaaggctcagg

SEQ ID NO: 7734670 - DNA, 22 bp, Homo sapiens
gatgagaatgtttatcaaatgc

SEQ ID NO: 7734671 - DNA, 22 bp, Homo sapiens
gatgagaaatggacaggagtgg

SEQ ID NO: 7734672 - DNA, 22 bp, Homo sapiens
gatgagaaggctcagatccaaa

SEQ ID NO: 7734673 - DNA, 22 bp, Homo sapiens
gatgaagtcattatccttttgg

SEQ ID NO: 7734674 - DNA, 22 bp, Homo sapiens
gatgaagaggcactgacatatt

SEQ ID NO: 7734675 - DNA, 22 bp, Homo sapiens
gatgcaaagaggaccttcagta

SEQ ID NO: 7734676 - DNA, 22 bp, Homo sapiens
gatgcaaaccttacatggacct

SEQ ID NO: 7734677 - DNA, 22 bp, Homo sapiens
gatgcaaactgtgacatagagt

SEQ ID NO: 7734678 - DNA, 22 bp, Homo sapiens
gatgcaaagataaaacagacgc

SEQ ID NO: 7734679 - DNA, 22 bp, Homo sapiens
gatgcagggaacttagtgggct

SEQ ID NO: 7734680 - DNA, 22 bp, Homo sapiens
gatgcagggctggcaggagctt

SEQ ID NO: 7734681 - DNA, 22 bp, Homo sapiens
gatctggtttcatcatggactt

SEQ ID NO: 7734682 - DNA, 22 bp, Homo sapiens
gatctggtacaggcctgcagcc

SEQ ID NO: 7734683 - DNA, 22 bp, Homo sapiens
gatgaaatgctgagcctgagtt

SEQ ID NO: 7734684 - DNA, 22 bp, Homo sapiens
gatcaggaatattggaaagtac

SEQ ID NO: 7734685 - DNA, 22 bp, Homo sapiens
gataataagcacagcaggatgt

SEQ ID NO: 7734686 - DNA, 22 bp, Homo sapiens
gataccagacagggagggagaa

SEQ ID NO: 7734687 - DNA, 22 bp, Homo sapiens
gatactttccatccaaatgcat

SEQ ID NO: 7734688 - DNA, 22 bp, Homo sapiens
gatagcagctctggggtcagac

SEQ ID NO: 7734689 - DNA, 22 bp, Homo sapiens
gagtggggggtccgtctcagtg

SEQ ID NO: 7734690 - DNA, 22 bp, Homo sapiens
gagtggggggtccgtctcagtg

SEQ ID NO: 7734691 - DNA, 22 bp, Homo sapiens
gagtggggtctgggcatcagtc

SEQ ID NO: 7734692 - DNA, 22 bp, Homo sapiens
gagtgggtaccggagcaggtgc

SEQ ID NO: 7734693 - DNA, 22 bp, Homo sapiens
gagttaaaggcagttgaggaaa

SEQ ID NO: 7734694 - DNA, 22 bp, Homo sapiens
gagtgtggtgaacaggagcacc

SEQ ID NO: 7734695 - DNA, 22 bp, Homo sapiens
gagtgtgggcacgggggccttg

SEQ ID NO: 7734696 - DNA, 22 bp, Homo sapiens
gagtttaaataacacatttcca

SEQ ID NO: 7734697 - DNA, 22 bp, Homo sapiens
gagtttaaagcatacatatttt

SEQ ID NO: 7734698 - DNA, 22 bp, Homo sapiens
gagtttgtaaactattcactaa

SEQ ID NO: 7734699 - DNA, 21 bp, Homo sapiens
gataaaatgggccttggtcct

SEQ ID NO: 7734700 - DNA, 22 bp, Homo sapiens
gagtggagcaaaagaggtagat

SEQ ID NO: 7734701 - DNA, 22 bp, Homo sapiens
gagtgctgaatgcgagaacaga

SEQ ID NO: 7734702 - DNA, 22 bp, Homo sapiens
gagtctggactattctggtctt

SEQ ID NO: 7734703 - DNA, 22 bp, Homo sapiens
gagtctggccctgatgcatcat

SEQ ID NO: 7734704 - DNA, 22 bp, Homo sapiens
gagtcttctacgctcacacaaa

SEQ ID NO: 7734705 - DNA, 22 bp, Homo sapiens
gagtctggtgatggtcattgtc

SEQ ID NO: 7734706 - DNA, 22 bp, Homo sapiens
gagtctgtatgtcttccatgca

SEQ ID NO: 7734707 - DNA, 22 bp, Homo sapiens
gagtcctggcgtccaatttcct

SEQ ID NO: 7734708 - DNA, 22 bp, Homo sapiens
gagtcctgctttcaattctttt

SEQ ID NO: 7734709 - DNA, 22 bp, Homo sapiens
gatgtacaagattgtaggaatg

SEQ ID NO: 7734710 - DNA, 22 bp, Homo sapiens
gatgtacaagtaaaatatgtgt

SEQ ID NO: 7734711 - DNA, 22 bp, Homo sapiens
gatgtagacacttggaggctta

SEQ ID NO: 7734712 - DNA, 22 bp, Homo sapiens
gatgtacactcagaaaagtcat

SEQ ID NO: 7734713 - DNA, 22 bp, Homo sapiens
gattcaatgttgcagatggaat

SEQ ID NO: 7734714 - DNA, 22 bp, Homo sapiens
gatttaaagtagacctttgttt

SEQ ID NO: 7734715 - DNA, 22 bp, Homo sapiens
gatttacagatctaagggtcac

SEQ ID NO: 7734716 - DNA, 22 bp, Homo sapiens
gattgaatcatatgaaattgtg

SEQ ID NO: 7734717 - DNA, 22 bp, Homo sapiens
gcagaagctgggcagcgaggtg

SEQ ID NO: 7734718 - DNA, 22 bp, Homo sapiens
gcagaagctgggagaagggatt

SEQ ID NO: 7734719 - DNA, 22 bp, Homo sapiens
gcacccagtgggatgcttagca

SEQ ID NO: 7734720 - DNA, 22 bp, Homo sapiens
gcaaacataatatgaagacact

SEQ ID NO: 7734721 - DNA, 22 bp, Homo sapiens
gcaaacattcaggagtacagga

SEQ ID NO: 7734722 - DNA, 22 bp, Homo sapiens
gcaaacattccacagaaggaag

SEQ ID NO: 7734723 - DNA, 22 bp, Homo sapiens
gcaatgattgcattagaagatg

SEQ ID NO: 7734724 - DNA, 22 bp, Homo sapiens
gcaggagagccagcaggcttcc

SEQ ID NO: 7734725 - DNA, 22 bp, Homo sapiens
gcaggagaaatgaagattgggt

SEQ ID NO: 7734726 - DNA, 22 bp, Homo sapiens
gcaggagaacaaagcaagctgc

SEQ ID NO: 7734727 - DNA, 22 bp, Homo sapiens
gcagctgagcgtgaggaagagt

SEQ ID NO: 7734728 - DNA, 22 bp, Homo sapiens
gcagctgagagaagaacagggc

SEQ ID NO: 7734729 - DNA, 18 bp, Homo sapiens
gcagctgacactggagtt

SEQ ID NO: 7734730 - DNA, 22 bp, Homo sapiens
gcagctcccatcagggcacaga

SEQ ID NO: 7734731 - DNA, 22 bp, Homo sapiens
gcagctattgtctcctgggccc

SEQ ID NO: 7734732 - DNA, 20 bp, Homo sapiens
gcagggcaagggatatgaaa

SEQ ID NO: 7734733 - DNA, 21 bp, Homo sapiens
gcaggctggtcaaacctcagt

SEQ ID NO: 7734734 - DNA, 22 bp, Homo sapiens
gccacagacagagagtctagtg

SEQ ID NO: 7734735 - DNA, 22 bp, Homo sapiens
gccagatctgacatagtggaag

SEQ ID NO: 7734736 - DNA, 22 bp, Homo sapiens
gccacaggcacttaagggctgg

SEQ ID NO: 7734737 - DNA, 22 bp, Homo sapiens
gccagcaaagcaagttgtcagc

SEQ ID NO: 7734738 - DNA, 22 bp, Homo sapiens
gcagtggggcgctgggagttgg

SEQ ID NO: 7734739 - DNA, 22 bp, Homo sapiens
gcagtgggcctgaggaagggtg

SEQ ID NO: 7734740 - DNA, 22 bp, Homo sapiens
gccctctcttctgcagcctcca

SEQ ID NO: 7734741 - DNA, 22 bp, Homo sapiens
gcccttcacgatggtatcttag

SEQ ID NO: 7734742 - DNA, 22 bp, Homo sapiens
gcccttcatttatagttggaat

SEQ ID NO: 7734743 - DNA, 22 bp, Homo sapiens
gcccttcagttactccttgatg

SEQ ID NO: 7734744 - DNA, 22 bp, Homo sapiens
gcccaggctagcgtagagtgca

SEQ ID NO: 7734745 - DNA, 22 bp, Homo sapiens
gcctgtgtcatgtagtagcttc

SEQ ID NO: 7734746 - DNA, 23 bp, Homo sapiens
gcctggccaccccagggctgctt

SEQ ID NO: 7734747 - DNA, 17 bp, Homo sapiens
gcctggcccagcctggc

SEQ ID NO: 7734748 - DNA, 17 bp, Homo sapiens
gcctggcccagcctggc

SEQ ID NO: 7734749 - DNA, 23 bp, Homo sapiens
gcctggccaccccagggctgctt

SEQ ID NO: 7734750 - DNA, 22 bp, Homo sapiens
gcctggcctgaactaggaggtg

SEQ ID NO: 7734751 - DNA, 22 bp, Homo sapiens
gcctggcttttgcctcatgttc

SEQ ID NO: 7734752 - DNA, 22 bp, Homo sapiens
gcctggccgctccgagctccgc

SEQ ID NO: 7734753 - DNA, 22 bp, Homo sapiens
gcctgcctgctgtcatctgcct

SEQ ID NO: 7734754 - DNA, 22 bp, Homo sapiens
gcctgccttcggtgcgcagcgg

SEQ ID NO: 7734755 - DNA, 22 bp, Homo sapiens
gctggagctgcagcctgggcct

SEQ ID NO: 7734756 - DNA, 22 bp, Homo sapiens
gctggccagtgtcccagggatc

SEQ ID NO: 7734757 - DNA, 22 bp, Homo sapiens
gctggccccgagtgctacgctc

SEQ ID NO: 7734758 - DNA, 22 bp, Homo sapiens
gctggcccagggtcacctagga

SEQ ID NO: 7734759 - DNA, 22 bp, Homo sapiens
gctggcccagtgacccacagtg

SEQ ID NO: 7734760 - DNA, 22 bp, Homo sapiens
gctggagctgagttccctgggc

SEQ ID NO: 7734761 - DNA, 22 bp, Homo sapiens
gctgcctgctcacccggcctgg

SEQ ID NO: 7734762 - DNA, 22 bp, Homo sapiens
gctgcctgcttcatgtgggaga

SEQ ID NO: 7734763 - DNA, 22 bp, Homo sapiens
gctgcctgctcggctcctggga

SEQ ID NO: 7734764 - DNA, 22 bp, Homo sapiens
gctgcctgccttgcctggagga

SEQ ID NO: 7734765 - DNA, 22 bp, Homo sapiens
gctgaggcagtccacccttgtg

SEQ ID NO: 7734766 - DNA, 22 bp, Homo sapiens
gctgaggcaaaccaagaatgta

SEQ ID NO: 7734767 - DNA, 22 bp, Homo sapiens
gctgaggcaaatagttttaagt

SEQ ID NO: 7734768 - DNA, 22 bp, Homo sapiens
gctgaggcaagatttgaaccca

SEQ ID NO: 7734769 - DNA, 22 bp, Homo sapiens
gctgaggattgaagagttgcca

SEQ ID NO: 7734770 - DNA, 22 bp, Homo sapiens
gctcctcttatttcatcagggc

SEQ ID NO: 7734771 - DNA, 22 bp, Homo sapiens
gctcctctgtcaaatgagagtg

SEQ ID NO: 7734772 - DNA, 22 bp, Homo sapiens
gctcctggctctggccaaggga

SEQ ID NO: 7734773 - DNA, 22 bp, Homo sapiens
gctctgtgttccctccaggctc

SEQ ID NO: 7734774 - DNA, 22 bp, Homo sapiens
gctgagagtgtgagatcagatt

SEQ ID NO: 7734775 - DNA, 22 bp, Homo sapiens
ggagtaaggctcagaggaaatg

SEQ ID NO: 7734776 - DNA, 22 bp, Homo sapiens
ggagtagctgcattccgagcac

SEQ ID NO: 7734777 - DNA, 22 bp, Homo sapiens
ggaggtgggctaaggactctct

SEQ ID NO: 7734778 - DNA, 22 bp, Homo sapiens
ggaggtggaggttgcagtgagc

SEQ ID NO: 7734779 - DNA, 22 bp, Homo sapiens
ggaggtggaggttgcagtgagc

SEQ ID NO: 7734780 - DNA, 20 bp, Homo sapiens
ggagggtggaagaaagcaag

SEQ ID NO: 7734781 - DNA, 22 bp, Homo sapiens
ggaggggtggaaggagtgcctg

SEQ ID NO: 7734782 - DNA, 22 bp, Homo sapiens
ggaggggaggattaatgacaaa

SEQ ID NO: 7734783 - DNA, 22 bp, Homo sapiens
ggaggggagtctcccaaagccg

SEQ ID NO: 7734784 - DNA, 22 bp, Homo sapiens
ggagggggaaactttggctgcc

SEQ ID NO: 7734785 - DNA, 22 bp, Homo sapiens
ggagggggaattcagccccagc

SEQ ID NO: 7734786 - DNA, 22 bp, Homo sapiens
ggaggcggaggttgcagtgagc

SEQ ID NO: 7734787 - DNA, 22 bp, Homo sapiens
ggaggcggaggttgcagtgagt

SEQ ID NO: 7734788 - DNA, 22 bp, Homo sapiens
ggagggctgccaggtggagcgg

SEQ ID NO: 7734789 - DNA, 22 bp, Homo sapiens
ggagggctgccaggtggagcgg

SEQ ID NO: 7734790 - DNA, 22 bp, Homo sapiens
ggagggctgtagaggagacctg

SEQ ID NO: 7734791 - DNA, 18 bp, Homo sapiens
ggagggctttggggactg

SEQ ID NO: 7734792 - DNA, 21 bp, Homo sapiens
ggagggcagcccagactggct

SEQ ID NO: 7734793 - DNA, 22 bp, Homo sapiens
ggagggcacaggaccagaaatc

SEQ ID NO: 7734794 - DNA, 22 bp, Homo sapiens
ggagggagagtgaccctaccaa

SEQ ID NO: 7734795 - DNA, 22 bp, Homo sapiens
ggcacagagcccagcttcctag

SEQ ID NO: 7734796 - DNA, 22 bp, Homo sapiens
ggcacagagctttgtcccagtt

SEQ ID NO: 7734797 - DNA, 22 bp, Homo sapiens
ggcacagagttggcagagctgc

SEQ ID NO: 7734798 - DNA, 22 bp, Homo sapiens
ggcacagcactgtaggcctggg

SEQ ID NO: 7734799 - DNA, 22 bp, Homo sapiens
ggcacagcaccttttcacattg

SEQ ID NO: 7734800 - DNA, 22 bp, Homo sapiens
ggcacagcacagagcacatgta

SEQ ID NO: 7734801 - DNA, 23 bp, Homo sapiens
ggcacagatgctgagcatgtgca

SEQ ID NO: 7734802 - DNA, 22 bp, Homo sapiens
ggcacagcaagaagggaaatga

SEQ ID NO: 7734803 - DNA, 22 bp, Homo sapiens
ggcacagcacagtggacccagg

SEQ ID NO: 7734804 - DNA, 22 bp, Homo sapiens
ggcagagactgggttggcagag

SEQ ID NO: 7734805 - DNA, 19 bp, Homo sapiens
ggcagacacagttgacatg

SEQ ID NO: 7734806 - DNA, 22 bp, Homo sapiens
ggagtgggaacaatgacatggt

SEQ ID NO: 7734807 - DNA, 22 bp, Homo sapiens
ggagtgggcagcactgccctgt

SEQ ID NO: 7734808 - DNA, 22 bp, Homo sapiens
ggcaggcgtggtggcctcagaa

SEQ ID NO: 7734809 - DNA, 17 bp, Homo sapiens
ggcaggtgcggggccgc

SEQ ID NO: 7734810 - DNA, 22 bp, Homo sapiens
ggcaggtgcgcatgttgcatta

SEQ ID NO: 7734811 - DNA, 20 bp, Homo sapiens
ggcaggtgctcgcttggtct

SEQ ID NO: 7734812 - DNA, 22 bp, Homo sapiens
ggcaggtgctaagagaggtaaa

SEQ ID NO: 7734813 - DNA, 22 bp, Homo sapiens
ggcaggtgaggcatgtgcctgg

SEQ ID NO: 7734814 - DNA, 22 bp, Homo sapiens
ggcagctgctgcattacgttgt

SEQ ID NO: 7734815 - DNA, 22 bp, Homo sapiens
ggcagctggcctcctcgcccac

SEQ ID NO: 7734816 - DNA, 22 bp, Homo sapiens
ggcagctggcctcctcgcccac

SEQ ID NO: 7734817 - DNA, 22 bp, Homo sapiens
ggcagaggaagctggaagtggg

SEQ ID NO: 7734818 - DNA, 22 bp, Homo sapiens
ggcagctggggcagtgccctgt

SEQ ID NO: 7734819 - DNA, 22 bp, Homo sapiens
ggcagctggggcagtgccctgt

SEQ ID NO: 7734820 - DNA, 23 bp, Homo sapiens
ggcagctgggcagcactcatggg

SEQ ID NO: 7734821 - DNA, 22 bp, Homo sapiens
ggcagctgggttggccagaaac

SEQ ID NO: 7734822 - DNA, 22 bp, Homo sapiens
ggcagctgggttggccagaaac

SEQ ID NO: 7734823 - DNA, 22 bp, Homo sapiens
ggcagctggttctttccattaa

SEQ ID NO: 7734824 - DNA, 22 bp, Homo sapiens
ggcagctgtaagatgagtgaat

SEQ ID NO: 7734825 - DNA, 22 bp, Homo sapiens
ggcagctgtctctgagttagca

SEQ ID NO: 7734826 - DNA, 22 bp, Homo sapiens
ggcagctgtctctgagttagca

SEQ ID NO: 7734827 - DNA, 22 bp, Homo sapiens
ggcagctgtgaagtgcctcaca

SEQ ID NO: 7734828 - DNA, 22 bp, Homo sapiens
ggaagaaagcacacaaacttga

SEQ ID NO: 7734829 - DNA, 22 bp, Homo sapiens
ggaagaaatctggttaagagat

SEQ ID NO: 7734830 - DNA, 22 bp, Homo sapiens
ggaagggagtagttggaatgca

SEQ ID NO: 7734831 - DNA, 22 bp, Homo sapiens
ggaagggagtagttggaatgca

SEQ ID NO: 7734832 - DNA, 22 bp, Homo sapiens
ggaaggggtgtcgcccatggat

SEQ ID NO: 7734833 - DNA, 22 bp, Homo sapiens
ggaaggtcgagctgcatctggc

SEQ ID NO: 7734834 - DNA, 20 bp, Homo sapiens
ggaaaaatgcatgctcaaga

SEQ ID NO: 7734835 - DNA, 22 bp, Homo sapiens
ggaaagaatcaagtgatcctgt

SEQ ID NO: 7734836 - DNA, 22 bp, Homo sapiens
ggaaagagcccagcagtgcttg

SEQ ID NO: 7734837 - DNA, 21 bp, Homo sapiens
ggaaagaaggcaaggctcagg

SEQ ID NO: 7734838 - DNA, 22 bp, Homo sapiens
ggaaagccaggtgctctggtgt

SEQ ID NO: 7734839 - DNA, 22 bp, Homo sapiens
ggaaagagggacccagcttggt

SEQ ID NO: 7734840 - DNA, 20 bp, Homo sapiens
gcttctcagggcttctctga

SEQ ID NO: 7734841 - DNA, 20 bp, Homo sapiens
gcttctcagggcttctctga

SEQ ID NO: 7734842 - DNA, 22 bp, Homo sapiens
gcttctcaattctcaccctcca

SEQ ID NO: 7734843 - DNA, 22 bp, Homo sapiens
gctgggctccaggccagggtga

SEQ ID NO: 7734844 - DNA, 22 bp, Homo sapiens
gctgggctcatttgtgtgtctg

SEQ ID NO: 7734845 - DNA, 22 bp, Homo sapiens
gctgggctccaccctcaactgt

SEQ ID NO: 7734846 - DNA, 22 bp, Homo sapiens
gctgggccagagcagcagcact

SEQ ID NO: 7734847 - DNA, 22 bp, Homo sapiens
gctgggctcagacctagtgaac

SEQ ID NO: 7734848 - DNA, 21 bp, Homo sapiens
gctgggctccagtctgccgct

SEQ ID NO: 7734849 - DNA, 22 bp, Homo sapiens
gctgggctcgttcccacacgcg

SEQ ID NO: 7734850 - DNA, 22 bp, Homo sapiens
gctgggctctgtcatgccttcc

SEQ ID NO: 7734851 - DNA, 22 bp, Homo sapiens
gctgggctcttatcacctgtac

SEQ ID NO: 7734852 - DNA, 22 bp, Homo sapiens
gctgggctctttacccctgtac

SEQ ID NO: 7734853 - DNA, 22 bp, Homo sapiens
gctgggctgagaagttaagcaa

SEQ ID NO: 7734854 - DNA, 22 bp, Homo sapiens
gcttagtgtaggacctggaata

SEQ ID NO: 7734855 - DNA, 22 bp, Homo sapiens
gcttagtggtgtgcaaaggggt

SEQ ID NO: 7734856 - DNA, 16 bp, Homo sapiens
gcttagtgagagcaac

SEQ ID NO: 7734857 - DNA, 22 bp, Homo sapiens
gctgggctgcgtcggggaagcc

SEQ ID NO: 7734858 - DNA, 22 bp, Homo sapiens
gctgggctgcccaacctctgac

SEQ ID NO: 7734859 - DNA, 22 bp, Homo sapiens
gctgggctgagctagacttggc

SEQ ID NO: 7734860 - DNA, 23 bp, Homo sapiens
ggagaggggtgtgggcatcttta

SEQ ID NO: 7734861 - DNA, 22 bp, Homo sapiens
ggaagtagaagtaatgaaatca

SEQ ID NO: 7734862 - DNA, 22 bp, Homo sapiens
ggagaaggtggctcagcaaagg

SEQ ID NO: 7734863 - DNA, 22 bp, Homo sapiens
ggagaaggtggctcagcaaagg

SEQ ID NO: 7734864 - DNA, 22 bp, Homo sapiens
ggagaaggtggctcagcaaagg

SEQ ID NO: 7734865 - DNA, 22 bp, Homo sapiens
ggagacactggaaagtattaca

SEQ ID NO: 7734866 - DNA, 22 bp, Homo sapiens
ggagacagcaggaagaaatatc

SEQ ID NO: 7734867 - DNA, 22 bp, Homo sapiens
ggagacagggttgaaccacgca

SEQ ID NO: 7734868 - DNA, 21 bp, Homo sapiens
ggagaaggacaatgttgagta

SEQ ID NO: 7734869 - DNA, 22 bp, Homo sapiens
ggagaaggcacacccacctctg

SEQ ID NO: 7734870 - DNA, 22 bp, Homo sapiens
ggagaaggaatattggagtagg

SEQ ID NO: 7734871 - DNA, 22 bp, Homo sapiens
ggagaaggaagaaagctactat

SEQ ID NO: 7734872 - DNA, 22 bp, Homo sapiens
ggagaaggaagaaagctactat

SEQ ID NO: 7734873 - DNA, 22 bp, Homo sapiens
ggaggccagcctgaggctgagg

SEQ ID NO: 7734874 - DNA, 22 bp, Homo sapiens
ggaggagctgctgtgggggccc

SEQ ID NO: 7734875 - DNA, 22 bp, Homo sapiens
ggaggaggcaagtaccagatgc

SEQ ID NO: 7734876 - DNA, 22 bp, Homo sapiens
ggagctgatggtagaagaatga

SEQ ID NO: 7734877 - DNA, 22 bp, Homo sapiens
ggaggagcccactcaaagggga

SEQ ID NO: 7734878 - DNA, 22 bp, Homo sapiens
gggcctggtgcttctgactcct

SEQ ID NO: 7734879 - DNA, 22 bp, Homo sapiens
gggcggggggagctggaatgaa

SEQ ID NO: 7734880 - DNA, 22 bp, Homo sapiens
gggatctgagtaggcagaagct

SEQ ID NO: 7734881 - DNA, 22 bp, Homo sapiens
gggatctgagttgtcaggaagg

SEQ ID NO: 7734882 - DNA, 22 bp, Homo sapiens
gggatctgatgcactgctgaaa

SEQ ID NO: 7734883 - DNA, 21 bp, Homo sapiens
gggatctgaggcaagtctcct

SEQ ID NO: 7734884 - DNA, 22 bp, Homo sapiens
gggatctgacttgctggtgggt

SEQ ID NO: 7734885 - DNA, 22 bp, Homo sapiens
gggatggagggtagagcaagtg

SEQ ID NO: 7734886 - DNA, 22 bp, Homo sapiens
gggatggggagctggaaagggg

SEQ ID NO: 7734887 - DNA, 20 bp, Homo sapiens
gggaggccccagagtccagg

SEQ ID NO: 7734888 - DNA, 22 bp, Homo sapiens
gggaggagcttggagattcact

SEQ ID NO: 7734889 - DNA, 22 bp, Homo sapiens
gggggctagagagatgaaatat

SEQ ID NO: 7734890 - DNA, 22 bp, Homo sapiens
gggggctggaatatccatcaac

SEQ ID NO: 7734891 - DNA, 22 bp, Homo sapiens
gggtccagggacgtttctgcag

SEQ ID NO: 7734892 - DNA, 22 bp, Homo sapiens
gggggtgaggacaggagcactg

SEQ ID NO: 7734893 - DNA, 16 bp, Homo sapiens
gggggtgagagagagt

SEQ ID NO: 7734894 - DNA, 20 bp, Homo sapiens
ggggggcttcagggcctgtg

SEQ ID NO: 7734895 - DNA, 22 bp, Homo sapiens
gggtctctcatgcagttgctgt

SEQ ID NO: 7734896 - DNA, 22 bp, Homo sapiens
gggtctggacggctgcaggaag

SEQ ID NO: 7734897 - DNA, 22 bp, Homo sapiens
gggtctggagatccgggtgaag

SEQ ID NO: 7734898 - DNA, 22 bp, Homo sapiens
gggtctgggcaggcgcttcctc

SEQ ID NO: 7734899 - DNA, 22 bp, Homo sapiens
gggtctggcatgctgagatgga

SEQ ID NO: 7734900 - DNA, 22 bp, Homo sapiens
gggtctggcatgctgagatgga

SEQ ID NO: 7734901 - DNA, 22 bp, Homo sapiens
gggtctggagggcagcccttct

SEQ ID NO: 7734902 - DNA, 17 bp, Homo sapiens
gggtgggcactgctggc

SEQ ID NO: 7734903 - DNA, 22 bp, Homo sapiens
gggtgggcccagcccagagaag

SEQ ID NO: 7734904 - DNA, 22 bp, Homo sapiens
ggggacagtcgatctagtgatt

SEQ ID NO: 7734905 - DNA, 22 bp, Homo sapiens
gggctagcagattctacctaat

SEQ ID NO: 7734906 - DNA, 22 bp, Homo sapiens
gggctctgtgttctagctctcg

SEQ ID NO: 7734907 - DNA, 22 bp, Homo sapiens
gggctctgtggttgtgctttgt

SEQ ID NO: 7734908 - DNA, 22 bp, Homo sapiens
gggctgagaattcagctttcct

SEQ ID NO: 7734909 - DNA, 22 bp, Homo sapiens
ggccagaagttggaaaagagcc

SEQ ID NO: 7734910 - DNA, 22 bp, Homo sapiens
ggccacctgggatctcatcctg

SEQ ID NO: 7734911 - DNA, 22 bp, Homo sapiens
ggccacctgggatctcatcctg

SEQ ID NO: 7734912 - DNA, 22 bp, Homo sapiens
ggccacctggctgtgggggcag

SEQ ID NO: 7734913 - DNA, 22 bp, Homo sapiens
ggccacctggctgtgggggcag

SEQ ID NO: 7734914 - DNA, 22 bp, Homo sapiens
ggccacctctgccctactgagt

SEQ ID NO: 7734915 - DNA, 20 bp, Homo sapiens
ggccacctgcttcagacccc

SEQ ID NO: 7734916 - DNA, 22 bp, Homo sapiens
ggccaccttccagttgcctgca

SEQ ID NO: 7734917 - DNA, 22 bp, Homo sapiens
ggccaccttccagttgcctgca

SEQ ID NO: 7734918 - DNA, 22 bp, Homo sapiens
ggccacctgggttcgactgggc

SEQ ID NO: 7734919 - DNA, 22 bp, Homo sapiens
ggccaccttaagttaaggatat

SEQ ID NO: 7734920 - DNA, 22 bp, Homo sapiens
ggccaccttcctgtggtctctg

SEQ ID NO: 7734921 - DNA, 22 bp, Homo sapiens
ggccacctctgccctactgagt

SEQ ID NO: 7734922 - DNA, 22 bp, Homo sapiens
ggcaggtgcttgtcgaaggcct

SEQ ID NO: 7734923 - DNA, 22 bp, Homo sapiens
ggcaggtgctgggagcatctca

SEQ ID NO: 7734924 - DNA, 22 bp, Homo sapiens
ggcaggtgctctgtgggcctgg

SEQ ID NO: 7734925 - DNA, 22 bp, Homo sapiens
ggccagagagcagccaggattc

SEQ ID NO: 7734926 - DNA, 22 bp, Homo sapiens
ggccagaggccacagctgtgtc

SEQ ID NO: 7734927 - DNA, 22 bp, Homo sapiens
ggccagaggacctctcatagcc

SEQ ID NO: 7734928 - DNA, 18 bp, Homo sapiens
ggccagagggagggtccc

SEQ ID NO: 7734929 - DNA, 18 bp, Homo sapiens
ggccagagggagggtccc

SEQ ID NO: 7734930 - DNA, 17 bp, Homo sapiens
ggccagaggcggggctg

SEQ ID NO: 7734931 - DNA, 22 bp, Homo sapiens
ggccccagattctgggctgggt

SEQ ID NO: 7734932 - DNA, 22 bp, Homo sapiens
ggccccagattctgggctgggt

SEQ ID NO: 7734933 - DNA, 22 bp, Homo sapiens
ggcccctcagcatctgagtcag

SEQ ID NO: 7734934 - DNA, 19 bp, Homo sapiens
ggcccctctcacaggagtt

SEQ ID NO: 7734935 - DNA, 22 bp, Homo sapiens
ggcccctcttgtggcacatacg

SEQ ID NO: 7734936 - DNA, 22 bp, Homo sapiens
ggccccagttcactcctggccg

SEQ ID NO: 7734937 - DNA, 22 bp, Homo sapiens
ggccccagttcactcctggccg

SEQ ID NO: 7734938 - DNA, 22 bp, Homo sapiens
ggccttcacgtgacctggcgtg

SEQ ID NO: 7734939 - DNA, 19 bp, Homo sapiens
ggccttgctctgtggcagc

SEQ ID NO: 7734940 - DNA, 22 bp, Homo sapiens
ggccctcttttatccatcataa

SEQ ID NO: 7734941 - DNA, 22 bp, Homo sapiens
ggccctctgcctgtgctggcga

SEQ ID NO: 7734942 - DNA, 22 bp, Homo sapiens
ggccctctgctcacttcctatt

SEQ ID NO: 7734943 - DNA, 22 bp, Homo sapiens
ggcttccagctgggccttggag

SEQ ID NO: 7734944 - DNA, 17 bp, Homo sapiens
ggcttccaggtggctct

SEQ ID NO: 7734945 - DNA, 22 bp, Homo sapiens
ggctggctggatgaatggatta

SEQ ID NO: 7734946 - DNA, 22 bp, Homo sapiens
gggaacagagtgccagactgac

SEQ ID NO: 7734947 - DNA, 22 bp, Homo sapiens
gggaacagagtgccagactgac

SEQ ID NO: 7734948 - DNA, 22 bp, Homo sapiens
gggaagaagacatggtgaaggc

SEQ ID NO: 7734949 - DNA, 18 bp, Homo sapiens
gggaagaggatctggccc

SEQ ID NO: 7734950 - DNA, 23 bp, Homo sapiens
ggctggcccggggctgctcctga

SEQ ID NO: 7734951 - DNA, 22 bp, Homo sapiens
ggctggcctgtgtggccgccac

SEQ ID NO: 7734952 - DNA, 22 bp, Homo sapiens
ggctggctacattggaggaagg

SEQ ID NO: 7734953 - DNA, 23 bp, Homo sapiens
ggctcctggattcaaatcctgcc

SEQ ID NO: 7734954 - DNA, 23 bp, Homo sapiens
ggctcctggattcaaatcctgcc

SEQ ID NO: 7734955 - DNA, 22 bp, Homo sapiens
ggctcctggaggcaccactggt

SEQ ID NO: 7734956 - DNA, 20 bp, Homo sapiens
ggctccttctttcatggccc

SEQ ID NO: 7734957 - DNA, 22 bp, Homo sapiens
ggctccttatctctcctatgcc

SEQ ID NO: 7734958 - DNA, 22 bp, Homo sapiens
ggctccttcaaagcacctggct

SEQ ID NO: 7734959 - DNA, 22 bp, Homo sapiens
gtgtccattcactgcaacactt

SEQ ID NO: 7734960 - DNA, 22 bp, Homo sapiens
gtgtcctgagtgaggcctggcc

SEQ ID NO: 7734961 - DNA, 22 bp, Homo sapiens
gtgtcctgccaccctgggcttt

SEQ ID NO: 7734962 - DNA, 22 bp, Homo sapiens
gtgtcctgggctggtagagctg

SEQ ID NO: 7734963 - DNA, 18 bp, Homo sapiens
gtgtcctggctgcggcgc

SEQ ID NO: 7734964 - DNA, 22 bp, Homo sapiens
gtgtcctgcaggccaggaatgg

SEQ ID NO: 7734965 - DNA, 22 bp, Homo sapiens
gtgtctgagtttggaaagtcca

SEQ ID NO: 7734966 - DNA, 22 bp, Homo sapiens
gtgtgtcagagctcagagaagt

SEQ ID NO: 7734967 - DNA, 22 bp, Homo sapiens
gttctaatattttaaaagccaa

SEQ ID NO: 7734968 - DNA, 22 bp, Homo sapiens
gttctaataggagaaaagacag

SEQ ID NO: 7734969 - DNA, 21 bp, Homo sapiens
gttcaaatgggtagattcaca

SEQ ID NO: 7734970 - DNA, 22 bp, Homo sapiens
gttcaagaccagcctggccaac

SEQ ID NO: 7734971 - DNA, 22 bp, Homo sapiens
gttctctatcattagtgaattt

SEQ ID NO: 7734972 - DNA, 22 bp, Homo sapiens
gttctcagtggggagcagggtt

SEQ ID NO: 7734973 - DNA, 22 bp, Homo sapiens
gttctcagttcaggaaggacat

SEQ ID NO: 7734974 - DNA, 22 bp, Homo sapiens
gttgtcaggtaaaacagtatgg

SEQ ID NO: 7734975 - DNA, 22 bp, Homo sapiens
gttctgagtggcccaagccctg

SEQ ID NO: 7734976 - DNA, 20 bp, Homo sapiens
gtgggcagcaggcatactgg

SEQ ID NO: 7734977 - DNA, 19 bp, Homo sapiens
gtgggccaggcagaaggct

SEQ ID NO: 7734978 - DNA, 22 bp, Homo sapiens
gtgggccaggccggagtgcaga

SEQ ID NO: 7734979 - DNA, 22 bp, Homo sapiens
gtgggccagcttttctcctggg

SEQ ID NO: 7734980 - DNA, 22 bp, Homo sapiens
gtgggccacatcccagggctct

SEQ ID NO: 7734981 - DNA, 22 bp, Homo sapiens
gtgggccagttcctcacaggta

SEQ ID NO: 7734982 - DNA, 22 bp, Homo sapiens
gtggggagcagccttagcccct

SEQ ID NO: 7734983 - DNA, 22 bp, Homo sapiens
gtggggaggcctaagcaagttg

SEQ ID NO: 7734984 - DNA, 22 bp, Homo sapiens
gtggggaggcattcttctccct

SEQ ID NO: 7734985 - DNA, 22 bp, Homo sapiens
gtgggggctggaaatcttgcca

SEQ ID NO: 7734986 - DNA, 22 bp, Homo sapiens
gtgggggcagtgggcttcgagc

SEQ ID NO: 7734987 - DNA, 22 bp, Homo sapiens
gtgggggcaggcagtgctagga

SEQ ID NO: 7734988 - DNA, 22 bp, Homo sapiens
gtggtcctcataattcagtgag

SEQ ID NO: 7734989 - DNA, 22 bp, Homo sapiens
gtggtcctgcacccgcttggcc

SEQ ID NO: 7734990 - DNA, 22 bp, Homo sapiens
gtggtcctggcaaccatggtga

SEQ ID NO: 7734991 - DNA, 22 bp, Homo sapiens
gtggtgagttcaggctggggtg

SEQ ID NO: 7734992 - DNA, 22 bp, Homo sapiens
gtgtaaatcagcttgtgtaata

SEQ ID NO: 7734993 - DNA, 22 bp, Homo sapiens
gtgtcacaggcccagctcttca

SEQ ID NO: 7734994 - DNA, 22 bp, Homo sapiens
gtggggtgtccagcagcgagct

SEQ ID NO: 7734995 - DNA, 18 bp, Homo sapiens
gtggggtgttgtgaggat

SEQ ID NO: 7734996 - DNA, 22 bp, Homo sapiens
gtgggggctggctcgtcctgtg

SEQ ID NO: 7734997 - DNA, 22 bp, Homo sapiens
taaaacacctgtagtgtctgcc

SEQ ID NO: 7734998 - DNA, 22 bp, Homo sapiens
gtttttctagaaatctcctcct

SEQ ID NO: 7734999 - DNA, 22 bp, Homo sapiens
taaatcagggagtcatctgcga

SEQ ID NO: 7735000 - DNA, 22 bp, Homo sapiens
taaatcacccatctcctaatct

SEQ ID NO: 7735001 - DNA, 22 bp, Homo sapiens
taaatgaaagggtttaatttat

SEQ ID NO: 7735002 - DNA, 22 bp, Homo sapiens
taaatgagatgtacataactca

SEQ ID NO: 7735003 - DNA, 22 bp, Homo sapiens
taaatgagatttgttcttttgt

SEQ ID NO: 7735004 - DNA, 22 bp, Homo sapiens
taaatgataataatgctagtgt

SEQ ID NO: 7735005 - DNA, 22 bp, Homo sapiens
taaatgagtaatatagctgttt

SEQ ID NO: 7735006 - DNA, 22 bp, Homo sapiens
taaatgagtaatatagctgttt

SEQ ID NO: 7735007 - DNA, 22 bp, Homo sapiens
taacagaatagcagaaacagaa

SEQ ID NO: 7735008 - DNA, 22 bp, Homo sapiens
taacagagatagaaatgtaaag

SEQ ID NO: 7735009 - DNA, 22 bp, Homo sapiens
taagaaatttagttatagaatg

SEQ ID NO: 7735010 - DNA, 22 bp, Homo sapiens
gtggccagctgtcagcaccctt

SEQ ID NO: 7735011 - DNA, 22 bp, Homo sapiens
gtggcccaggcttggcgctggc

SEQ ID NO: 7735012 - DNA, 22 bp, Homo sapiens
gtggccccagggccctgtctgg

SEQ ID NO: 7735013 - DNA, 22 bp, Homo sapiens
gtggcccaggcaccctgatgac

SEQ ID NO: 7735014 - DNA, 22 bp, Homo sapiens
gtggccagaggtcccatgtgtc

SEQ ID NO: 7735015 - DNA, 22 bp, Homo sapiens
gtggccagaatcttgaggcctt

SEQ ID NO: 7735016 - DNA, 18 bp, Homo sapiens
gtggccagcctggtcttg

SEQ ID NO: 7735017 - DNA, 22 bp, Homo sapiens
gtggccagccagggtgctgatg

SEQ ID NO: 7735018 - DNA, 22 bp, Homo sapiens
gtggccagaggtcccatgtgtc

SEQ ID NO: 7735019 - DNA, 22 bp, Homo sapiens
gtggccagcaagtgctgcctct

SEQ ID NO: 7735020 - DNA, 22 bp, Homo sapiens
gtggctctccattgacatggaa

SEQ ID NO: 7735021 - DNA, 17 bp, Homo sapiens
gtggctgcacacacatg

SEQ ID NO: 7735022 - DNA, 22 bp, Homo sapiens
gtggctgcagagccagcaagct

SEQ ID NO: 7735023 - DNA, 22 bp, Homo sapiens
gtggcctggcgagctggcgcgg

SEQ ID NO: 7735024 - DNA, 22 bp, Homo sapiens
gtggcttcaccccagttgtctc

SEQ ID NO: 7735025 - DNA, 22 bp, Homo sapiens
gtggcttcacatggcatttggc

SEQ ID NO: 7735026 - DNA, 22 bp, Homo sapiens
gtggctgcagagggcacagcat

SEQ ID NO: 7735027 - DNA, 22 bp, Homo sapiens
gtggctgcagcggctgtggaga

SEQ ID NO: 7735028 - DNA, 22 bp, Homo sapiens
gtggctgcagcccagcggcacg

SEQ ID NO: 7735029 - DNA, 22 bp, Homo sapiens
gtggctgcagctctgaacggac

SEQ ID NO: 7735030 - DNA, 22 bp, Homo sapiens
gtggctgcatcggggtgaccag

SEQ ID NO: 7735031 - DNA, 22 bp, Homo sapiens
gtggctgctacagagctggagg

SEQ ID NO: 7735032 - DNA, 22 bp, Homo sapiens
gtggcttccatgtgcatctgac

SEQ ID NO: 7735033 - DNA, 22 bp, Homo sapiens
gtggcttcatcaactgtgctta

SEQ ID NO: 7735034 - DNA, 22 bp, Homo sapiens
gtggaatttttacctatgaatg

SEQ ID NO: 7735035 - DNA, 22 bp, Homo sapiens
gtggaggacaaaagaagccttt

SEQ ID NO: 7735036 - DNA, 22 bp, Homo sapiens
gtgcctggaactgggtaggctg

SEQ ID NO: 7735037 - DNA, 22 bp, Homo sapiens
gtgcctggaactgggtaggctg

SEQ ID NO: 7735038 - DNA, 20 bp, Homo sapiens
gtgcctggagaagaggctgt

SEQ ID NO: 7735039 - DNA, 22 bp, Homo sapiens
gtctgaggtcattagctctctt

SEQ ID NO: 7735040 - DNA, 22 bp, Homo sapiens
gtctgcagagggaaggcttcag

SEQ ID NO: 7735041 - DNA, 22 bp, Homo sapiens
gtctggcatatgcaaagtgcat

SEQ ID NO: 7735042 - DNA, 22 bp, Homo sapiens
gtctggcattcttcctggagaa

SEQ ID NO: 7735043 - DNA, 22 bp, Homo sapiens
gtctggccatttgcccattgtg

SEQ ID NO: 7735044 - DNA, 22 bp, Homo sapiens
gtctggccatttgcccattgtg

SEQ ID NO: 7735045 - DNA, 22 bp, Homo sapiens
gtctgggctcccagggtcggcg

SEQ ID NO: 7735046 - DNA, 22 bp, Homo sapiens
gtctgggcttcagagttagaga

SEQ ID NO: 7735047 - DNA, 22 bp, Homo sapiens
gtctgggcttagggacatggca

SEQ ID NO: 7735048 - DNA, 22 bp, Homo sapiens
gtctgggctcctggcaggcagc

SEQ ID NO: 7735049 - DNA, 17 bp, Homo sapiens
gtctgggctttagagac

SEQ ID NO: 7735050 - DNA, 22 bp, Homo sapiens
gtctgggcagcagcatttctta

SEQ ID NO: 7735051 - DNA, 22 bp, Homo sapiens
gtctgggcaggaatctgcattc

SEQ ID NO: 7735052 - DNA, 22 bp, Homo sapiens
gtctgggcatcagactgcgggc

SEQ ID NO: 7735053 - DNA, 22 bp, Homo sapiens
gtctgggccaggcgagccgagg

SEQ ID NO: 7735054 - DNA, 22 bp, Homo sapiens
gtctgggcacctggcctgggaa

SEQ ID NO: 7735055 - DNA, 22 bp, Homo sapiens
gtctgggcaagggagatggcgc

SEQ ID NO: 7735056 - DNA, 22 bp, Homo sapiens
gtctgagcaccctggcctgtca

SEQ ID NO: 7735057 - DNA, 22 bp, Homo sapiens
gtctgagggacagagtcctggc

SEQ ID NO: 7735058 - DNA, 22 bp, Homo sapiens
gtctgagactgggcacatacct

SEQ ID NO: 7735059 - DNA, 22 bp, Homo sapiens
gtctgaagccagtggtagtccg

SEQ ID NO: 7735060 - DNA, 19 bp, Homo sapiens
gtctctggatttcaggtcc

SEQ ID NO: 7735061 - DNA, 22 bp, Homo sapiens
gtccttcagcacctccctcggc

SEQ ID NO: 7735062 - DNA, 21 bp, Homo sapiens
gtccttcagcaagttagtggc

SEQ ID NO: 7735063 - DNA, 22 bp, Homo sapiens
gtccttcaagtaacctgggacc

SEQ ID NO: 7735064 - DNA, 22 bp, Homo sapiens
gtccttcaaggtccttggtgtg

SEQ ID NO: 7735065 - DNA, 22 bp, Homo sapiens
gtccttcatttcctgatctcta

SEQ ID NO: 7735066 - DNA, 22 bp, Homo sapiens
gtccttcagctttatctgaaca

SEQ ID NO: 7735067 - DNA, 22 bp, Homo sapiens
gtccttgcttgagacaggcagt

SEQ ID NO: 7735068 - DNA, 18 bp, Homo sapiens
gtccatggcctccaccca

SEQ ID NO: 7735069 - DNA, 22 bp, Homo sapiens
gtccattttattcagagacttt

SEQ ID NO: 7735070 - DNA, 22 bp, Homo sapiens
gtcctgtgtgagtgcaccacct

SEQ ID NO: 7735071 - DNA, 22 bp, Homo sapiens
gtcctgggtccccgcaggtcag

SEQ ID NO: 7735072 - DNA, 22 bp, Homo sapiens
gtcctgtgtcccagagaaagag

SEQ ID NO: 7735073 - DNA, 22 bp, Homo sapiens
gtcaggaagtggcattggagaa

SEQ ID NO: 7735074 - DNA, 22 bp, Homo sapiens
gtcaggaagcaaggttgggcat

SEQ ID NO: 7735075 - DNA, 20 bp, Homo sapiens
gtcaggattagtaaactctg

SEQ ID NO: 7735076 - DNA, 22 bp, Homo sapiens
gtcaggaaaaattgataatttt

SEQ ID NO: 7735077 - DNA, 18 bp, Homo sapiens
gtcagaggatggggaaat

SEQ ID NO: 7735078 - DNA, 22 bp, Homo sapiens
gtaaatataaatgctagctgcc

SEQ ID NO: 7735079 - DNA, 22 bp, Homo sapiens
gtaaataactggtaattggggt

SEQ ID NO: 7735080 - DNA, 22 bp, Homo sapiens
gtaaataactggtaattggggt

SEQ ID NO: 7735081 - DNA, 22 bp, Homo sapiens
gtaaatattaaaggctgctaga

SEQ ID NO: 7735082 - DNA, 22 bp, Homo sapiens
gtaaatattccctcggttccta

SEQ ID NO: 7735083 - DNA, 22 bp, Homo sapiens
gtacagtagtaaaagtgaatga

SEQ ID NO: 7735084 - DNA, 22 bp, Homo sapiens
gtatagaaggatctggtgaatt

SEQ ID NO: 7735085 - DNA, 22 bp, Homo sapiens
ggtgagggtaaatataggcaaa

SEQ ID NO: 7735086 - DNA, 22 bp, Homo sapiens
ggtgaggggagagtgaaagaaa

SEQ ID NO: 7735087 - DNA, 22 bp, Homo sapiens
ggtgagggtaaatataggcaaa

SEQ ID NO: 7735088 - DNA, 22 bp, Homo sapiens
ggtggcagttacaggggcaaat

SEQ ID NO: 7735089 - DNA, 22 bp, Homo sapiens
ggtggccataggaccagcctgg

SEQ ID NO: 7735090 - DNA, 22 bp, Homo sapiens
tctgaggccttgggacagaagt

SEQ ID NO: 7735091 - DNA, 22 bp, Homo sapiens
tctgaggccctgcaggcagtgt

SEQ ID NO: 7735092 - DNA, 17 bp, Homo sapiens
tctgaggcctctaggag

SEQ ID NO: 7735093 - DNA, 22 bp, Homo sapiens
tctgaggcctgaagcagcagag

SEQ ID NO: 7735094 - DNA, 22 bp, Homo sapiens
tctgaggccctaccctgagcct

SEQ ID NO: 7735095 - DNA, 22 bp, Homo sapiens
tctgagctttagctgggatttt

SEQ ID NO: 7735096 - DNA, 22 bp, Homo sapiens
tctgagggtgggagaaggagct

SEQ ID NO: 7735097 - DNA, 22 bp, Homo sapiens
tctgagagatacaaggaggcaa

SEQ ID NO: 7735098 - DNA, 22 bp, Homo sapiens
tctgagcccctagaactgagcg

SEQ ID NO: 7735099 - DNA, 22 bp, Homo sapiens
tctgagcccctagaactgagcg

SEQ ID NO: 7735100 - DNA, 22 bp, Homo sapiens
tctgagcccagtgagtctcgca

SEQ ID NO: 7735101 - DNA, 22 bp, Homo sapiens
tctgagccagacaagacagcca

SEQ ID NO: 7735102 - DNA, 22 bp, Homo sapiens
tctgagccaatttctgtgtcca

SEQ ID NO: 7735103 - DNA, 22 bp, Homo sapiens
tctgagctgtggccattcttcc

SEQ ID NO: 7735104 - DNA, 22 bp, Homo sapiens
tctgagcttctgcatttccaac

SEQ ID NO: 7735105 - DNA, 22 bp, Homo sapiens
tctgagctggagcccatcacct

SEQ ID NO: 7735106 - DNA, 22 bp, Homo sapiens
tctgagctgggcacagaaggcg

SEQ ID NO: 7735107 - DNA, 22 bp, Homo sapiens
tctgagctgcagagtggggtgg

SEQ ID NO: 7735108 - DNA, 22 bp, Homo sapiens
tctgagctctatctgtgggaat

SEQ ID NO: 7735109 - DNA, 22 bp, Homo sapiens
tctgagctacgatgcctgtcac

SEQ ID NO: 7735110 - DNA, 22 bp, Homo sapiens
tctgcctgagggagctgaggaa

SEQ ID NO: 7735111 - DNA, 22 bp, Homo sapiens
tctgcctgagggagctgaggaa

SEQ ID NO: 7735112 - DNA, 22 bp, Homo sapiens
tctgcccactgctctgctgccc

SEQ ID NO: 7735113 - DNA, 16 bp, Homo sapiens
tctgccagggacaggc

SEQ ID NO: 7735114 - DNA, 22 bp, Homo sapiens
tctgccaggcttggtgctagat

SEQ ID NO: 7735115 - DNA, 22 bp, Homo sapiens
tctgccaggtggggagaggcca

SEQ ID NO: 7735116 - DNA, 22 bp, Homo sapiens
tctgcaggcttggagtggcagc

SEQ ID NO: 7735117 - DNA, 22 bp, Homo sapiens
tctgcaggtagagctcaggaat

SEQ ID NO: 7735118 - DNA, 22 bp, Homo sapiens
tctgcaggatcagagccagagg

SEQ ID NO: 7735119 - DNA, 22 bp, Homo sapiens
tctggcaccactgagtctgcag

SEQ ID NO: 7735120 - DNA, 22 bp, Homo sapiens
tctggcatcactcgcaagagca

SEQ ID NO: 7735121 - DNA, 22 bp, Homo sapiens
tctggcccagcccctgaggtca

SEQ ID NO: 7735122 - DNA, 22 bp, Homo sapiens
tctggcccagcccctgatccca

SEQ ID NO: 7735123 - DNA, 22 bp, Homo sapiens
tctggagcaacagagcaggaca

SEQ ID NO: 7735124 - DNA, 21 bp, Homo sapiens
tctggagccctaagctgagaa

SEQ ID NO: 7735125 - DNA, 22 bp, Homo sapiens
tctggaggctctgagggtgagt

SEQ ID NO: 7735126 - DNA, 22 bp, Homo sapiens
tctggaggggtttagagggaca

SEQ ID NO: 7735127 - DNA, 22 bp, Homo sapiens
tctggatttgtggaaaatctgc

SEQ ID NO: 7735128 - DNA, 22 bp, Homo sapiens
tctggatctccctcatcctggg

SEQ ID NO: 7735129 - DNA, 22 bp, Homo sapiens
tctgctgttgagcacaagtgaa

SEQ ID NO: 7735130 - DNA, 18 bp, Homo sapiens
tctgctgctgcgtcctgc

SEQ ID NO: 7735131 - DNA, 22 bp, Homo sapiens
tctggagaaggaagagtctttg

SEQ ID NO: 7735132 - DNA, 22 bp, Homo sapiens
tctggctctgacactactgtta

SEQ ID NO: 7735133 - DNA, 22 bp, Homo sapiens
tctggctctttgggtgattgta

SEQ ID NO: 7735134 - DNA, 22 bp, Homo sapiens
tctggctcggatttgtctagca

SEQ ID NO: 7735135 - DNA, 22 bp, Homo sapiens
tctggctcctggctccactgcc

SEQ ID NO: 7735136 - DNA, 22 bp, Homo sapiens
tctggctctaactaggcatcag

SEQ ID NO: 7735137 - DNA, 22 bp, Homo sapiens
tctggccccggtcttcacagct

SEQ ID NO: 7735138 - DNA, 22 bp, Homo sapiens
tctggccccgcatgcactttat

SEQ ID NO: 7735139 - DNA, 22 bp, Homo sapiens
tctggcccctggtctctggtgt

SEQ ID NO: 7735140 - DNA, 22 bp, Homo sapiens
tctggccctatggcatgtacct

SEQ ID NO: 7735141 - DNA, 23 bp, Homo sapiens
tctggctccatccttggggatcc

SEQ ID NO: 7735142 - DNA, 22 bp, Homo sapiens
tctggctccactctgtgcatgc

SEQ ID NO: 7735143 - DNA, 22 bp, Homo sapiens
tctggctttctcagcatggcat

SEQ ID NO: 7735144 - DNA, 19 bp, Homo sapiens
tctgggcagggccagcacc

SEQ ID NO: 7735145 - DNA, 22 bp, Homo sapiens
tctgggcagcctcaggccaggg

SEQ ID NO: 7735146 - DNA, 22 bp, Homo sapiens
tctgggcagccatgtgcctggc

SEQ ID NO: 7735147 - DNA, 22 bp, Homo sapiens
tctgggcagcagcagctagtag

SEQ ID NO: 7735148 - DNA, 22 bp, Homo sapiens
tctgggataagaccacagattt

SEQ ID NO: 7735149 - DNA, 22 bp, Homo sapiens
tctgggcactgctgagcctgta

SEQ ID NO: 7735150 - DNA, 23 bp, Homo sapiens
tctgggctgagctcgagtgtaga

SEQ ID NO: 7735151 - DNA, 23 bp, Homo sapiens
tctgggctgagacttggaaggtc

SEQ ID NO: 7735152 - DNA, 22 bp, Homo sapiens
tctgggctgaaatgaaggcctt

SEQ ID NO: 7735153 - DNA, 22 bp, Homo sapiens
tctgggctgctgtgcagtgacc

SEQ ID NO: 7735154 - DNA, 21 bp, Homo sapiens
tctgggctgctgctgcccatc

SEQ ID NO: 7735155 - DNA, 22 bp, Homo sapiens
tctgggctgctatgaggcagag

SEQ ID NO: 7735156 - DNA, 22 bp, Homo sapiens
tctgggctcttagtgtaccctc

SEQ ID NO: 7735157 - DNA, 22 bp, Homo sapiens
tctgtctgccttgtgagggcac

SEQ ID NO: 7735158 - DNA, 22 bp, Homo sapiens
tctgtctgaggagtttttgacc

SEQ ID NO: 7735159 - DNA, 22 bp, Homo sapiens
tctgtctgagtggtgttagagt

SEQ ID NO: 7735160 - DNA, 22 bp, Homo sapiens
tctgtgcctttaagaagctcat

SEQ ID NO: 7735161 - DNA, 23 bp, Homo sapiens
tctgtgccagtttccatgtctgt

SEQ ID NO: 7735162 - DNA, 22 bp, Homo sapiens
tctgtgcactaacattcctggt

SEQ ID NO: 7735163 - DNA, 22 bp, Homo sapiens
tctgtgctgtctcagagaaagc

SEQ ID NO: 7735164 - DNA, 19 bp, Homo sapiens
tctgtgctgggaggcagca

SEQ ID NO: 7735165 - DNA, 22 bp, Homo sapiens
tctgtgctaggcagcctggccc

SEQ ID NO: 7735166 - DNA, 22 bp, Homo sapiens
tctgtgctagaggagttggcca

SEQ ID NO: 7735167 - DNA, 22 bp, Homo sapiens
tctgtggcttcctatttcttgg

SEQ ID NO: 7735168 - DNA, 22 bp, Homo sapiens
tctgtgtctggttgggccagta

SEQ ID NO: 7735169 - DNA, 22 bp, Homo sapiens
tctgttttgtaccagatacagc

SEQ ID NO: 7735170 - DNA, 22 bp, Homo sapiens
tcttaacaagctcctcagtgct

SEQ ID NO: 7735171 - DNA, 20 bp, Homo sapiens
tctgtgtgccatcacctaac

SEQ ID NO: 7735172 - DNA, 22 bp, Homo sapiens
tctgtgtttaaaagatatgtcc

SEQ ID NO: 7735173 - DNA, 22 bp, Homo sapiens
tctgttgcaatgtgcatggtga

SEQ ID NO: 7735174 - DNA, 22 bp, Homo sapiens
tctgttcttggtgcagctggga

SEQ ID NO: 7735175 - DNA, 22 bp, Homo sapiens
tctgttcttgtccccacttcag

SEQ ID NO: 7735176 - DNA, 22 bp, Homo sapiens
tctgtccagctctggggctcac

SEQ ID NO: 7735177 - DNA, 22 bp, Homo sapiens
tctgtccagaggtcctggagac

SEQ ID NO: 7735178 - DNA, 22 bp, Homo sapiens
tctgtctgactaccatgaggca

SEQ ID NO: 7735179 - DNA, 21 bp, Homo sapiens
tctgtactttgcttccatgct

SEQ ID NO: 7735180 - DNA, 22 bp, Homo sapiens
tctgtacttttattttggcact

SEQ ID NO: 7735181 - DNA, 22 bp, Homo sapiens
tctgtaggacagagaaatgggg

SEQ ID NO: 7735182 - DNA, 20 bp, Homo sapiens
tctgtaggcaagttagcagg

SEQ ID NO: 7735183 - DNA, 22 bp, Homo sapiens
tctgtagggtagtagtggagat

SEQ ID NO: 7735184 - DNA, 22 bp, Homo sapiens
tctgggtctttacccatggaat

SEQ ID NO: 7735185 - DNA, 22 bp, Homo sapiens
tctgggtctggctgctggtgca

SEQ ID NO: 7735186 - DNA, 22 bp, Homo sapiens
tctgggtctcagagtgaccatg

SEQ ID NO: 7735187 - DNA, 22 bp, Homo sapiens
tctgggtctatcccatgccttt

SEQ ID NO: 7735188 - DNA, 22 bp, Homo sapiens
tctgggtccgggactgtggatg

SEQ ID NO: 7735189 - DNA, 22 bp, Homo sapiens
tctgggtctatgatctcacttc

SEQ ID NO: 7735190 - DNA, 22 bp, Homo sapiens
tctgggtccccgaggaaggaga

SEQ ID NO: 7735191 - DNA, 22 bp, Homo sapiens
tctgggtcatgactcagcgtga

SEQ ID NO: 7735192 - DNA, 22 bp, Homo sapiens
tctgggtcactgtgggagggca

SEQ ID NO: 7735193 - DNA, 22 bp, Homo sapiens
tctggggtgcagcctggacata

SEQ ID NO: 7735194 - DNA, 22 bp, Homo sapiens
tctggggtgtgacctgagcatg

SEQ ID NO: 7735195 - DNA, 22 bp, Homo sapiens
tctgggggttaagtgaggacaa

SEQ ID NO: 7735196 - DNA, 22 bp, Homo sapiens
tctgggctggttgtgcttgctt

SEQ ID NO: 7735197 - DNA, 22 bp, Homo sapiens
tctgggctggtgctcatgaatt

SEQ ID NO: 7735198 - DNA, 22 bp, Homo sapiens
tctgggctgtctacaggttggc

SEQ ID NO: 7735199 - DNA, 15 bp, Homo sapiens
tctgggctgtgagca

SEQ ID NO: 7735200 - DNA, 22 bp, Homo sapiens
tctgggctgggagcgtgtggac

SEQ ID NO: 7735201 - DNA, 22 bp, Homo sapiens
tctgggctgggcttaggaaccc

SEQ ID NO: 7735202 - DNA, 22 bp, Homo sapiens
tctgggctggctttatgctgac

SEQ ID NO: 7735203 - DNA, 23 bp, Homo sapiens
tctgggctgcttaaggatcaagg

SEQ ID NO: 7735204 - DNA, 22 bp, Homo sapiens
tctgggctgcttcagccttcgc

SEQ ID NO: 7735205 - DNA, 22 bp, Homo sapiens
tctgggcttggattggctctgc

SEQ ID NO: 7735206 - DNA, 22 bp, Homo sapiens
tctgggcttgcctggttgtgca

SEQ ID NO: 7735207 - DNA, 20 bp, Homo sapiens
tctgggcttcccccagctcc

SEQ ID NO: 7735208 - DNA, 18 bp, Homo sapiens
tctgggcttcccgaggct

SEQ ID NO: 7735209 - DNA, 22 bp, Homo sapiens
tctgggctgtggttccactccg

SEQ ID NO: 7735210 - DNA, 22 bp, Homo sapiens
tctgggctgtgccaaagctctt

SEQ ID NO: 7735211 - DNA, 22 bp, Homo sapiens
tctgggctgtgggaattcaaca

SEQ ID NO: 7735212 - DNA, 17 bp, Homo sapiens
tctgggcttcagtggtc

SEQ ID NO: 7735213 - DNA, 22 bp, Homo sapiens
tctgggctttgtaatgggaggt

SEQ ID NO: 7735214 - DNA, 21 bp, Homo sapiens
tctgggctttcttataaggca

SEQ ID NO: 7735215 - DNA, 22 bp, Homo sapiens
tctgggctttagtttgttatct

SEQ ID NO: 7735216 - DNA, 22 bp, Homo sapiens
tctgggctttacactgtgctta

SEQ ID NO: 7735217 - DNA, 22 bp, Homo sapiens
tctgggcttgggtagaaatcac

SEQ ID NO: 7735218 - DNA, 22 bp, Homo sapiens
tctgggcttggttagggctgtt

SEQ ID NO: 7735219 - DNA, 22 bp, Homo sapiens
tctgggctttaagaactctgtt

SEQ ID NO: 7735220 - DNA, 22 bp, Homo sapiens
tctgggcttttccatgcctgtg

SEQ ID NO: 7735221 - DNA, 20 bp, Homo sapiens
tctggggatgaggtctagga

SEQ ID NO: 7735222 - DNA, 21 bp, Homo sapiens
tctgggggtgagcctagaaat

SEQ ID NO: 7735223 - DNA, 22 bp, Homo sapiens
tctgggggcgaccagggactgc

SEQ ID NO: 7735224 - DNA, 22 bp, Homo sapiens
tctgggggaggaggcatggccc

SEQ ID NO: 7735225 - DNA, 22 bp, Homo sapiens
tcttcaggaagggaaatcatcc

SEQ ID NO: 7735226 - DNA, 18 bp, Homo sapiens
tcttcatctcctgagctg

SEQ ID NO: 7735227 - DNA, 22 bp, Homo sapiens
tcttctttttgtcccacagaat

SEQ ID NO: 7735228 - DNA, 22 bp, Homo sapiens
tcttcttttatttcaagggtgt

SEQ ID NO: 7735229 - DNA, 22 bp, Homo sapiens
tcttctcagtttctctaggatg

SEQ ID NO: 7735230 - DNA, 19 bp, Homo sapiens
tctttagccagagctctgg

SEQ ID NO: 7735231 - DNA, 22 bp, Homo sapiens
tctttcctctgagctcctgtag

SEQ ID NO: 7735232 - DNA, 22 bp, Homo sapiens
tcttgctaaagaccaacacatt

SEQ ID NO: 7735233 - DNA, 22 bp, Homo sapiens
tcttgggcaatttctctagagg

SEQ ID NO: 7735234 - DNA, 22 bp, Homo sapiens
tcctggggtttagagggaagtg

SEQ ID NO: 7735235 - DNA, 22 bp, Homo sapiens
tcctggggtgtgttttgctgct

SEQ ID NO: 7735236 - DNA, 20 bp, Homo sapiens
tcctggggtaagccatggtc

SEQ ID NO: 7735237 - DNA, 22 bp, Homo sapiens
tcctggggctgcaaggcctgtc

SEQ ID NO: 7735238 - DNA, 22 bp, Homo sapiens
tcctggggctctgagcgagaca

SEQ ID NO: 7735239 - DNA, 22 bp, Homo sapiens
tcctggggccagcactggtgga

SEQ ID NO: 7735240 - DNA, 22 bp, Homo sapiens
tcctgtcttaatgatctcgtgc

SEQ ID NO: 7735241 - DNA, 19 bp, Homo sapiens
tcctgggctgcgtcttgcc

SEQ ID NO: 7735242 - DNA, 22 bp, Homo sapiens
tcctgggctgcagggaagagca

SEQ ID NO: 7735243 - DNA, 22 bp, Homo sapiens
tcctgggctgtgtgccactctg

SEQ ID NO: 7735244 - DNA, 22 bp, Homo sapiens
tcctgggccctccggatcaggt

SEQ ID NO: 7735245 - DNA, 22 bp, Homo sapiens
tcctgggcctgtactccatccg

SEQ ID NO: 7735246 - DNA, 22 bp, Homo sapiens
tcctgggcacaagtgagtctcc

SEQ ID NO: 7735247 - DNA, 22 bp, Homo sapiens
tcctggcttgtcacatctacgt

SEQ ID NO: 7735248 - DNA, 22 bp, Homo sapiens
tcctggcttccactcctctgtt

SEQ ID NO: 7735249 - DNA, 22 bp, Homo sapiens
tcctggctgccgtcgtcctgcg

SEQ ID NO: 7735250 - DNA, 22 bp, Homo sapiens
tcctggctctaagtcctgagtg

SEQ ID NO: 7735251 - DNA, 22 bp, Homo sapiens
tcctggcccactatgccagcat

SEQ ID NO: 7735252 - DNA, 22 bp, Homo sapiens
tcctggcccactatgccagcat

SEQ ID NO: 7735253 - DNA, 22 bp, Homo sapiens
tcctggcccactcctagcttct

SEQ ID NO: 7735254 - DNA, 22 bp, Homo sapiens
tcctggccctgtggcctgcagt

SEQ ID NO: 7735255 - DNA, 22 bp, Homo sapiens
tcctggccctctgcaaacgcca

SEQ ID NO: 7735256 - DNA, 21 bp, Homo sapiens
tcctggccagggcactaggca

SEQ ID NO: 7735257 - DNA, 22 bp, Homo sapiens
tcctggccagaggacaaagctg

SEQ ID NO: 7735258 - DNA, 22 bp, Homo sapiens
tcctggccaggatgacctaaca

SEQ ID NO: 7735259 - DNA, 18 bp, Homo sapiens
tcctggccacactacctt

SEQ ID NO: 7735260 - DNA, 22 bp, Homo sapiens
tcctggccacccgacagaagtc

SEQ ID NO: 7735261 - DNA, 22 bp, Homo sapiens
tcctggattaatagggagctgt

SEQ ID NO: 7735262 - DNA, 22 bp, Homo sapiens
tcctggatcagcgggggcaggc

SEQ ID NO: 7735263 - DNA, 22 bp, Homo sapiens
tcctggaggggacagcatgggc

SEQ ID NO: 7735264 - DNA, 22 bp, Homo sapiens
tccttcaagtgcagtacctgag

SEQ ID NO: 7735265 - DNA, 22 bp, Homo sapiens
tccttcagaacctgtgatggaa

SEQ ID NO: 7735266 - DNA, 22 bp, Homo sapiens
tccttcaatcacccagtgggga

SEQ ID NO: 7735267 - DNA, 23 bp, Homo sapiens
tccttcaagttaggaagtgaaca

SEQ ID NO: 7735268 - DNA, 21 bp, Homo sapiens
tccttgctattttcctcagct

SEQ ID NO: 7735269 - DNA, 22 bp, Homo sapiens
tcgcaccattgcactccagcca

SEQ ID NO: 7735270 - DNA, 22 bp, Homo sapiens
tcgcatttgggcaggagatgct

SEQ ID NO: 7735271 - DNA, 21 bp, Homo sapiens
tcgtgcagcagctgaggcttg

SEQ ID NO: 7735272 - DNA, 22 bp, Homo sapiens
tcctttggaactgactccgtta

SEQ ID NO: 7735273 - DNA, 22 bp, Homo sapiens
tccttgggaaacatcatgtaat

SEQ ID NO: 7735274 - DNA, 22 bp, Homo sapiens
tccttgggaaatcactagcact

SEQ ID NO: 7735275 - DNA, 22 bp, Homo sapiens
tctacctatttcttctattggt

SEQ ID NO: 7735276 - DNA, 22 bp, Homo sapiens
tctagagacaaaggaaggaggg

SEQ ID NO: 7735277 - DNA, 22 bp, Homo sapiens
tctaacattgtttttcacagat

SEQ ID NO: 7735278 - DNA, 22 bp, Homo sapiens
tctaattccattaaattgatgt

SEQ ID NO: 7735279 - DNA, 22 bp, Homo sapiens
tctaattttaggcatttgttca

SEQ ID NO: 7735280 - DNA, 22 bp, Homo sapiens
tctcacagcatcattgctcatg

SEQ ID NO: 7735281 - DNA, 22 bp, Homo sapiens
tctcacagcaggggccaggtct

SEQ ID NO: 7735282 - DNA, 22 bp, Homo sapiens
tctcaaggactttgggcactaa

SEQ ID NO: 7735283 - DNA, 22 bp, Homo sapiens
tctcaaatatttggagagagga

SEQ ID NO: 7735284 - DNA, 22 bp, Homo sapiens
tctatttaccaaatgtagttcc

SEQ ID NO: 7735285 - DNA, 22 bp, Homo sapiens
tctattcattcaatttagctct

SEQ ID NO: 7735286 - DNA, 22 bp, Homo sapiens
tctcagtccaaatgagaggttg

SEQ ID NO: 7735287 - DNA, 22 bp, Homo sapiens
tctcagtcagtttggactgtgt

SEQ ID NO: 7735288 - DNA, 22 bp, Homo sapiens
tctcagtcagccttgatgtccc

SEQ ID NO: 7735289 - DNA, 22 bp, Homo sapiens
tctcagtgacactcttcataca

SEQ ID NO: 7735290 - DNA, 23 bp, Homo sapiens
tctcagtgaatctcagaattcgc

SEQ ID NO: 7735291 - DNA, 22 bp, Homo sapiens
tctcagtgaagagtataacaaa

SEQ ID NO: 7735292 - DNA, 22 bp, Homo sapiens
tctcagtctttttggttactca

SEQ ID NO: 7735293 - DNA, 22 bp, Homo sapiens
tctcagtgcagcaaggaattta

SEQ ID NO: 7735294 - DNA, 22 bp, Homo sapiens
tctcagtgcagagaggctatct

SEQ ID NO: 7735295 - DNA, 23 bp, Homo sapiens
tctcagtgcacgcaccatgcctg

SEQ ID NO: 7735296 - DNA, 17 bp, Homo sapiens
tctcagtgactgatagc

SEQ ID NO: 7735297 - DNA, 22 bp, Homo sapiens
tctcagtgactgctgggtcccc

SEQ ID NO: 7735298 - DNA, 22 bp, Homo sapiens
tctcagtgatggcccatttgga

SEQ ID NO: 7735299 - DNA, 22 bp, Homo sapiens
tctcagtgagcttttctatgtt

SEQ ID NO: 7735300 - DNA, 22 bp, Homo sapiens
tctcatctattcacattaactg

SEQ ID NO: 7735301 - DNA, 22 bp, Homo sapiens
tctcatcattccttcaaagccc

SEQ ID NO: 7735302 - DNA, 22 bp, Homo sapiens
tctcagtggacgtgtctgtctt

SEQ ID NO: 7735303 - DNA, 23 bp, Homo sapiens
tctcagtgccgattgcatacaca

SEQ ID NO: 7735304 - DNA, 22 bp, Homo sapiens
tctcagtgcagcttgacagaga

SEQ ID NO: 7735305 - DNA, 19 bp, Homo sapiens
tctcagtgccgctgaccgc

SEQ ID NO: 7735306 - DNA, 22 bp, Homo sapiens
tctcagtgctatccatattcca

SEQ ID NO: 7735307 - DNA, 22 bp, Homo sapiens
tctcatcttcatatctgaaaga

SEQ ID NO: 7735308 - DNA, 22 bp, Homo sapiens
tctcatggagtcaggagcagaa

SEQ ID NO: 7735309 - DNA, 22 bp, Homo sapiens
tctccaagaaaagatctcagct

SEQ ID NO: 7735310 - DNA, 22 bp, Homo sapiens
tctcattggtatatacatgtgt

SEQ ID NO: 7735311 - DNA, 22 bp, Homo sapiens
tctccaaatagttatatttaga

SEQ ID NO: 7735312 - DNA, 19 bp, Homo sapiens
tctccaaaaccaatcacta

SEQ ID NO: 7735313 - DNA, 23 bp, Homo sapiens
tctcagaggattcctgggccttg

SEQ ID NO: 7735314 - DNA, 19 bp, Homo sapiens
tctcagagccctagaggcc

SEQ ID NO: 7735315 - DNA, 22 bp, Homo sapiens
tctcagagatctttctgcatgt

SEQ ID NO: 7735316 - DNA, 22 bp, Homo sapiens
tctcagagagatgaaacttcca

SEQ ID NO: 7735317 - DNA, 22 bp, Homo sapiens
tctcacatctgccctgtgctgg

SEQ ID NO: 7735318 - DNA, 22 bp, Homo sapiens
tctcacagtgcaggtctgtctc

SEQ ID NO: 7735319 - DNA, 22 bp, Homo sapiens
tctcacagtgagcctgaggtcg

SEQ ID NO: 7735320 - DNA, 22 bp, Homo sapiens
tctcacaggtgcacgtggctgt

SEQ ID NO: 7735321 - DNA, 22 bp, Homo sapiens
tctcagagggaaacatgagtga

SEQ ID NO: 7735322 - DNA, 22 bp, Homo sapiens
tctcagaggcccgacgttctcc

SEQ ID NO: 7735323 - DNA, 20 bp, Homo sapiens
tctcagcataagaacccttc

SEQ ID NO: 7735324 - DNA, 22 bp, Homo sapiens
tctcagcagccagatccagagc

SEQ ID NO: 7735325 - DNA, 22 bp, Homo sapiens
tctcagcaaggaaagaggcagg

SEQ ID NO: 7735326 - DNA, 22 bp, Homo sapiens
tctcagcaacgatccggagtaa

SEQ ID NO: 7735327 - DNA, 22 bp, Homo sapiens
tctcagcacgttgttttcattg

SEQ ID NO: 7735328 - DNA, 22 bp, Homo sapiens
tctcagagtttacggggctgaa

SEQ ID NO: 7735329 - DNA, 22 bp, Homo sapiens
tctcagagtttagagctgagcc

SEQ ID NO: 7735330 - DNA, 22 bp, Homo sapiens
tctcagagtttagagctgagcc

SEQ ID NO: 7735331 - DNA, 22 bp, Homo sapiens
tctcagctcttttttcacagaa

SEQ ID NO: 7735332 - DNA, 20 bp, Homo sapiens
tctcaggccccctccttgct

SEQ ID NO: 7735333 - DNA, 22 bp, Homo sapiens
tctcctctcttacctggtacaa

SEQ ID NO: 7735334 - DNA, 22 bp, Homo sapiens
tctcctctcctttcatgttgtt

SEQ ID NO: 7735335 - DNA, 22 bp, Homo sapiens
tctcctctatttctgtatgtat

SEQ ID NO: 7735336 - DNA, 22 bp, Homo sapiens
tctcctctactgggtctgcaga

SEQ ID NO: 7735337 - DNA, 22 bp, Homo sapiens
tctcctctgtgccacagcttgg

SEQ ID NO: 7735338 - DNA, 22 bp, Homo sapiens
tctcctctgcgcggcagtgccc

SEQ ID NO: 7735339 - DNA, 22 bp, Homo sapiens
tctcctggagcaggaaggtggg

SEQ ID NO: 7735340 - DNA, 22 bp, Homo sapiens
tctcgctctgtcgcccaggctg

SEQ ID NO: 7735341 - DNA, 22 bp, Homo sapiens
tctcctggtacccttcctagca

SEQ ID NO: 7735342 - DNA, 22 bp, Homo sapiens
tctccccaggggtatgggtatt

SEQ ID NO: 7735343 - DNA, 22 bp, Homo sapiens
tctccagggactgaggctggag

SEQ ID NO: 7735344 - DNA, 22 bp, Homo sapiens
tctctagttgaggactgagcag

SEQ ID NO: 7735345 - DNA, 22 bp, Homo sapiens
tctctcaacctcggcactattg

SEQ ID NO: 7735346 - DNA, 22 bp, Homo sapiens
tctctctactggggcactagga

SEQ ID NO: 7735347 - DNA, 22 bp, Homo sapiens
tctctgagctcaggagctgcag

SEQ ID NO: 7735348 - DNA, 22 bp, Homo sapiens
tctctgagggagatggcctgcc

SEQ ID NO: 7735349 - DNA, 22 bp, Homo sapiens
tctctgaagctgttgtagtctc

SEQ ID NO: 7735350 - DNA, 22 bp, Homo sapiens
tctctgggtaaagttctctcat

SEQ ID NO: 7735351 - DNA, 22 bp, Homo sapiens
tctctggggtagggcccaggac

SEQ ID NO: 7735352 - DNA, 22 bp, Homo sapiens
tctctgggtatggtaacgttgg

SEQ ID NO: 7735353 - DNA, 22 bp, Homo sapiens
tctctgggtattcactgccttc

SEQ ID NO: 7735354 - DNA, 22 bp, Homo sapiens
tctctggggcctttctacatca

SEQ ID NO: 7735355 - DNA, 22 bp, Homo sapiens
tctctgggggtagaactcaggc

SEQ ID NO: 7735356 - DNA, 22 bp, Homo sapiens
tctctggggatggacctgggag

SEQ ID NO: 7735357 - DNA, 22 bp, Homo sapiens
tctctgggttgagaactaggac

SEQ ID NO: 7735358 - DNA, 22 bp, Homo sapiens
tctctgggttctcactcagcac

SEQ ID NO: 7735359 - DNA, 16 bp, Homo sapiens
tctctgggttgcacag

SEQ ID NO: 7735360 - DNA, 22 bp, Homo sapiens
tctctgggttgagaactaggac

SEQ ID NO: 7735361 - DNA, 20 bp, Homo sapiens
tctctgggttctcactcagc

SEQ ID NO: 7735362 - DNA, 22 bp, Homo sapiens
tctctgggtctcagtttgtaca

SEQ ID NO: 7735363 - DNA, 22 bp, Homo sapiens
tctctgggtcctggcaagctca

SEQ ID NO: 7735364 - DNA, 22 bp, Homo sapiens
tctctgggtgatggcagggcac

SEQ ID NO: 7735365 - DNA, 23 bp, Homo sapiens
tctctgggtgggctgtgtctata

SEQ ID NO: 7735366 - DNA, 19 bp, Homo sapiens
tctctggggacactttcac

SEQ ID NO: 7735367 - DNA, 22 bp, Homo sapiens
tctctggggatgcttattcttg

SEQ ID NO: 7735368 - DNA, 22 bp, Homo sapiens
tctctgggctcaggagcccggc

SEQ ID NO: 7735369 - DNA, 22 bp, Homo sapiens
tctctggggaaaaggctgatac

SEQ ID NO: 7735370 - DNA, 22 bp, Homo sapiens
tctctgggcctgttttctcatc

SEQ ID NO: 7735371 - DNA, 22 bp, Homo sapiens
tctctgggcctccctttccaag

SEQ ID NO: 7735372 - DNA, 22 bp, Homo sapiens
tctctgggctaaaatcaaggtg

SEQ ID NO: 7735373 - DNA, 22 bp, Homo sapiens
tctctgggcctcagttttctca

SEQ ID NO: 7735374 - DNA, 21 bp, Homo sapiens
tctctgggccctcctgtgggg

SEQ ID NO: 7735375 - DNA, 22 bp, Homo sapiens
tctctgggcccagaccttcctt

SEQ ID NO: 7735376 - DNA, 22 bp, Homo sapiens
tctctgggatcgttttgggctc

SEQ ID NO: 7735377 - DNA, 22 bp, Homo sapiens
tctctgggaaatggagaatttt

SEQ ID NO: 7735378 - DNA, 22 bp, Homo sapiens
tctctgggatcaggtggcccag

SEQ ID NO: 7735379 - DNA, 19 bp, Homo sapiens
tctctggcttgtctgcctg

SEQ ID NO: 7735380 - DNA, 22 bp, Homo sapiens
tctctggcttaggttgagtgca

SEQ ID NO: 7735381 - DNA, 19 bp, Homo sapiens
tctctgcttctcttggcat

SEQ ID NO: 7735382 - DNA, 22 bp, Homo sapiens
tctctggaattggctgaggcaa

SEQ ID NO: 7735383 - DNA, 21 bp, Homo sapiens
tctctggagttagcagagaga

SEQ ID NO: 7735384 - DNA, 22 bp, Homo sapiens
tctctgctctgtgcctcagttt

SEQ ID NO: 7735385 - DNA, 22 bp, Homo sapiens
tctctggcagacacctccctga

SEQ ID NO: 7735386 - DNA, 22 bp, Homo sapiens
tctctggcactcccttatggct

SEQ ID NO: 7735387 - DNA, 22 bp, Homo sapiens
tctctggcacataataaggtct

SEQ ID NO: 7735388 - DNA, 20 bp, Homo sapiens
tctctggcaagaagctgcag

SEQ ID NO: 7735389 - DNA, 22 bp, Homo sapiens
tctctggcagggatatctggct

SEQ ID NO: 7735390 - DNA, 22 bp, Homo sapiens
tctctggcagcttgtgctgttg

SEQ ID NO: 7735391 - DNA, 22 bp, Homo sapiens
tctctggcagactggctgggct

SEQ ID NO: 7735392 - DNA, 22 bp, Homo sapiens
tctctggcagaggccctatccc

SEQ ID NO: 7735393 - DNA, 22 bp, Homo sapiens
tctctggctggcaccccaggga

SEQ ID NO: 7735394 - DNA, 22 bp, Homo sapiens
tctctggctcctgccgggtcca

SEQ ID NO: 7735395 - DNA, 22 bp, Homo sapiens
tctctggctgatattcctctgc

SEQ ID NO: 7735396 - DNA, 21 bp, Homo sapiens
tctctggcggtgtttggctcc

SEQ ID NO: 7735397 - DNA, 23 bp, Homo sapiens
tctctggcctttgatcaggttga

SEQ ID NO: 7735398 - DNA, 22 bp, Homo sapiens
tctctggccgagagtccctggg

SEQ ID NO: 7735399 - DNA, 19 bp, Homo sapiens
tctctggcatagactcaat

SEQ ID NO: 7735400 - DNA, 19 bp, Homo sapiens
tctctggcagttcagagca

SEQ ID NO: 7735401 - DNA, 20 bp, Homo sapiens
tctctggccagaaacaacag

SEQ ID NO: 7735402 - DNA, 22 bp, Homo sapiens
tctctggccctgttttctatct

SEQ ID NO: 7735403 - DNA, 22 bp, Homo sapiens
tctctggccccatggctgagct

SEQ ID NO: 7735404 - DNA, 22 bp, Homo sapiens
tctctgggtttttgtcctgtac

SEQ ID NO: 7735405 - DNA, 22 bp, Homo sapiens
tctctgtctcccgtgtgtccgg

SEQ ID NO: 7735406 - DNA, 22 bp, Homo sapiens
tctgaattttaactacacaaag

SEQ ID NO: 7735407 - DNA, 22 bp, Homo sapiens
tctgaaggttgagaagggctga

SEQ ID NO: 7735408 - DNA, 22 bp, Homo sapiens
tctgaaggtgctagagaaagct

SEQ ID NO: 7735409 - DNA, 18 bp, Homo sapiens
tctgaaggaatgattcca

SEQ ID NO: 7735410 - DNA, 22 bp, Homo sapiens
tctgaagctggaggaagctttg

SEQ ID NO: 7735411 - DNA, 22 bp, Homo sapiens
tctgaaggaaaagggtagatat

SEQ ID NO: 7735412 - DNA, 19 bp, Homo sapiens
tctgaagaattagagagca

SEQ ID NO: 7735413 - DNA, 22 bp, Homo sapiens
tctgaagagctttggaagtatg

SEQ ID NO: 7735414 - DNA, 22 bp, Homo sapiens
tctgaagcacagcaggaagggt

SEQ ID NO: 7735415 - DNA, 22 bp, Homo sapiens
tctgaagagtcttgcaagaaag

SEQ ID NO: 7735416 - DNA, 21 bp, Homo sapiens
tctctttgggaacattaatca

SEQ ID NO: 7735417 - DNA, 22 bp, Homo sapiens
tctctttgaccctttagctcca

SEQ ID NO: 7735418 - DNA, 22 bp, Homo sapiens
tctctttgcctgctgccatcca

SEQ ID NO: 7735419 - DNA, 22 bp, Homo sapiens
tctctttgtctgctcttagttg

SEQ ID NO: 7735420 - DNA, 22 bp, Homo sapiens
tctctttgtggccaggagagga

SEQ ID NO: 7735421 - DNA, 21 bp, Homo sapiens
tgcacagccataccctccttg

SEQ ID NO: 7735422 - DNA, 20 bp, Homo sapiens
tgcacagctgtgaataggat

SEQ ID NO: 7735423 - DNA, 22 bp, Homo sapiens
tgcacagctgcctcctctctgc

SEQ ID NO: 7735424 - DNA, 22 bp, Homo sapiens
tgcacagtgaccactgagcaag

SEQ ID NO: 7735425 - DNA, 23 bp, Homo sapiens
tgcagagggactgaagccagctt

SEQ ID NO: 7735426 - DNA, 22 bp, Homo sapiens
tgcagcaccacacctggctaat

SEQ ID NO: 7735427 - DNA, 23 bp, Homo sapiens
tgcagaggcatgatcactgctca

SEQ ID NO: 7735428 - DNA, 22 bp, Homo sapiens
tgcagaggagctggaaggctgg

SEQ ID NO: 7735429 - DNA, 22 bp, Homo sapiens
tgcagctcattggtgtcctggt

SEQ ID NO: 7735430 - DNA, 22 bp, Homo sapiens
tgcagctcatattagagagaag

SEQ ID NO: 7735431 - DNA, 22 bp, Homo sapiens
tgcagctcaggattctcagggc

SEQ ID NO: 7735432 - DNA, 22 bp, Homo sapiens
tgcagctcaggattctcagggc

SEQ ID NO: 7735433 - DNA, 23 bp, Homo sapiens
tgcagctcaaagatgggtaaatg

SEQ ID NO: 7735434 - DNA, 22 bp, Homo sapiens
tgcagctgaccagcaagtcctg

SEQ ID NO: 7735435 - DNA, 22 bp, Homo sapiens
tgcagctctgaacagtcatgaa

SEQ ID NO: 7735436 - DNA, 22 bp, Homo sapiens
tgcagctctgggcaagtgcctt

SEQ ID NO: 7735437 - DNA, 21 bp, Homo sapiens
tgcagctgacaccctttggga

SEQ ID NO: 7735438 - DNA, 22 bp, Homo sapiens
tgcagctggtatcccatggatt

SEQ ID NO: 7735439 - DNA, 22 bp, Homo sapiens
tgcagctgggtctgccctggct

SEQ ID NO: 7735440 - DNA, 22 bp, Homo sapiens
tgcagctgctggtggctgaaag

SEQ ID NO: 7735441 - DNA, 20 bp, Homo sapiens
tgcagctggtttcacaggga

SEQ ID NO: 7735442 - DNA, 22 bp, Homo sapiens
tgcagctgtaacagaggcctca

SEQ ID NO: 7735443 - DNA, 22 bp, Homo sapiens
tgcagctgtgaaagggaaccaa

SEQ ID NO: 7735444 - DNA, 22 bp, Homo sapiens
tgcagctgttacggaccctgtc

SEQ ID NO: 7735445 - DNA, 22 bp, Homo sapiens
tgcaggctcaccctggagctga

SEQ ID NO: 7735446 - DNA, 22 bp, Homo sapiens
tgatataagaagtagtatggat

SEQ ID NO: 7735447 - DNA, 22 bp, Homo sapiens
tgatagaaaatgctgtcaagct

SEQ ID NO: 7735448 - DNA, 22 bp, Homo sapiens
tgagttctgactgtgatgccag

SEQ ID NO: 7735449 - DNA, 22 bp, Homo sapiens
tgatctggaattccctgtggta

SEQ ID NO: 7735450 - DNA, 19 bp, Homo sapiens
tgatctggaaggaaccagg

SEQ ID NO: 7735451 - DNA, 22 bp, Homo sapiens
tgatctggtcctactgtgggca

SEQ ID NO: 7735452 - DNA, 17 bp, Homo sapiens
tgagttaagtttagatc

SEQ ID NO: 7735453 - DNA, 22 bp, Homo sapiens
tgagttactgcctagtaacttg

SEQ ID NO: 7735454 - DNA, 22 bp, Homo sapiens
tgagttcaagtccaagttgctg

SEQ ID NO: 7735455 - DNA, 23 bp, Homo sapiens
tgattgaaatgaggagtatttgt

SEQ ID NO: 7735456 - DNA, 22 bp, Homo sapiens
tgattgaattcaaatgcaatct

SEQ ID NO: 7735457 - DNA, 22 bp, Homo sapiens
tgatttaaaagaaacattgtct

SEQ ID NO: 7735458 - DNA, 22 bp, Homo sapiens
tgattcaataggaattgagtag

SEQ ID NO: 7735459 - DNA, 22 bp, Homo sapiens
tgattaatatcaccaccattgg

SEQ ID NO: 7735460 - DNA, 22 bp, Homo sapiens
tgatgtggccccacttagctgt

SEQ ID NO: 7735461 - DNA, 22 bp, Homo sapiens
tgattaaattaattaagatgag

SEQ ID NO: 7735462 - DNA, 23 bp, Homo sapiens
tgatggccgccctttgccctgtc

SEQ ID NO: 7735463 - DNA, 22 bp, Homo sapiens
tgcaaactattggtagagatgg

SEQ ID NO: 7735464 - DNA, 22 bp, Homo sapiens
tgcaaatggagcatgtataaga

SEQ ID NO: 7735465 - DNA, 22 bp, Homo sapiens
tgcaaatttctttagtacataa

SEQ ID NO: 7735466 - DNA, 21 bp, Homo sapiens
tgcaagaatcaggaagctgcc

SEQ ID NO: 7735467 - DNA, 22 bp, Homo sapiens
tgcaagggtagaagtgatggca

SEQ ID NO: 7735468 - DNA, 21 bp, Homo sapiens
tgcaatccagcctgggcgaca

SEQ ID NO: 7735469 - DNA, 22 bp, Homo sapiens
tgcacacagatggtacatgcat

SEQ ID NO: 7735470 - DNA, 22 bp, Homo sapiens
tgcacacacaggagtctcctcc

SEQ ID NO: 7735471 - DNA, 23 bp, Homo sapiens
tgcaggggaggcttaaagcaggt

SEQ ID NO: 7735472 - DNA, 22 bp, Homo sapiens
tgcaggtgattctgatgcagtt

SEQ ID NO: 7735473 - DNA, 22 bp, Homo sapiens
tgcaggtgcagcgatactgtga

SEQ ID NO: 7735474 - DNA, 22 bp, Homo sapiens
tgcaggtggacacgggagacgg

SEQ ID NO: 7735475 - DNA, 22 bp, Homo sapiens
tgcaggtggattcaatgtggga

SEQ ID NO: 7735476 - DNA, 22 bp, Homo sapiens
tgcaggtggcagcggggcacca

SEQ ID NO: 7735477 - DNA, 22 bp, Homo sapiens
tgcaggtgagtgcaggggctca

SEQ ID NO: 7735478 - DNA, 22 bp, Homo sapiens
tgcaggtgtctccagggcaggt

SEQ ID NO: 7735479 - DNA, 22 bp, Homo sapiens
tgcaggtgtagagttgggctcc

SEQ ID NO: 7735480 - DNA, 22 bp, Homo sapiens
tgcaggtgtgggcaggggagca

SEQ ID NO: 7735481 - DNA, 22 bp, Homo sapiens
tgcaggtgtctgggggcaacag

SEQ ID NO: 7735482 - DNA, 22 bp, Homo sapiens
tgcaggtgtctctgtctagcgt

SEQ ID NO: 7735483 - DNA, 23 bp, Homo sapiens
tgcaggtgtgcagagggctcttg

SEQ ID NO: 7735484 - DNA, 22 bp, Homo sapiens
tgcagtggcgccatctcagctc

SEQ ID NO: 7735485 - DNA, 22 bp, Homo sapiens
tgcagggaagcaagggtggctc

SEQ ID NO: 7735486 - DNA, 20 bp, Homo sapiens
tgcatggcgcacatctgtgg

SEQ ID NO: 7735487 - DNA, 22 bp, Homo sapiens
tgcatgtggacccctggtgcct

SEQ ID NO: 7735488 - DNA, 22 bp, Homo sapiens
tgcatgtgtcgggcctgtgcta

SEQ ID NO: 7735489 - DNA, 22 bp, Homo sapiens
tgcagttttggccattgaaggc

SEQ ID NO: 7735490 - DNA, 22 bp, Homo sapiens
tgcagttttgccaggcaatgga

SEQ ID NO: 7735491 - DNA, 22 bp, Homo sapiens
tgcatcagagtttgctgctgct

SEQ ID NO: 7735492 - DNA, 22 bp, Homo sapiens
tgcatctgattctcaggcagaa

SEQ ID NO: 7735493 - DNA, 22 bp, Homo sapiens
tgccaaattagagttcccaggc

SEQ ID NO: 7735494 - DNA, 22 bp, Homo sapiens
tgcattttacttacctgttagt

SEQ ID NO: 7735495 - DNA, 22 bp, Homo sapiens
tgcatttgagttgggagcaggc

SEQ ID NO: 7735496 - DNA, 22 bp, Homo sapiens
tgccacatggtgcatttcctag

SEQ ID NO: 7735497 - DNA, 22 bp, Homo sapiens
tgccaccaggagaaccagtgca

SEQ ID NO: 7735498 - DNA, 22 bp, Homo sapiens
tgccaccatctggctgtgttga

SEQ ID NO: 7735499 - DNA, 22 bp, Homo sapiens
tgccagccaggttctgaggcta

SEQ ID NO: 7735500 - DNA, 22 bp, Homo sapiens
tgccagccagggaagctcaccc

SEQ ID NO: 7735501 - DNA, 19 bp, Homo sapiens
tgccagagatactcccaga

SEQ ID NO: 7735502 - DNA, 22 bp, Homo sapiens
tgccgtggggctgaggctggag

SEQ ID NO: 7735503 - DNA, 22 bp, Homo sapiens
tgcctactagtactattttgtg

SEQ ID NO: 7735504 - DNA, 22 bp, Homo sapiens
tgcctacccatggttagacata

SEQ ID NO: 7735505 - DNA, 22 bp, Homo sapiens
tgccctgtgtgtgcaagcactg

SEQ ID NO: 7735506 - DNA, 22 bp, Homo sapiens
tgccctgttcctgcctccagct

SEQ ID NO: 7735507 - DNA, 22 bp, Homo sapiens
tgccctgcccatctaccctgtc

SEQ ID NO: 7735508 - DNA, 22 bp, Homo sapiens
tgccctcaagcaacagagagga

SEQ ID NO: 7735509 - DNA, 19 bp, Homo sapiens
tgccctgcacgctgtcctg

SEQ ID NO: 7735510 - DNA, 22 bp, Homo sapiens
tgcccctcttgagaagctcagc

SEQ ID NO: 7735511 - DNA, 22 bp, Homo sapiens
tgcccctctcctgtgatccaag

SEQ ID NO: 7735512 - DNA, 22 bp, Homo sapiens
tgcccctcttgctggccctgtc

SEQ ID NO: 7735513 - DNA, 22 bp, Homo sapiens
tgccctggcacacacacagctg

SEQ ID NO: 7735514 - DNA, 22 bp, Homo sapiens
tgccctggctctccactagttt

SEQ ID NO: 7735515 - DNA, 22 bp, Homo sapiens
tgccctggaaccatctacagtc

SEQ ID NO: 7735516 - DNA, 22 bp, Homo sapiens
tgccctggagtcagtggctatt

SEQ ID NO: 7735517 - DNA, 22 bp, Homo sapiens
tgccctgctgtgcctggagcca

SEQ ID NO: 7735518 - DNA, 22 bp, Homo sapiens
tgcctcaggcacctggcaggtt

SEQ ID NO: 7735519 - DNA, 22 bp, Homo sapiens
tgcctccctggcaagtctctcc

SEQ ID NO: 7735520 - DNA, 17 bp, Homo sapiens
tgcctgccagcattgga

SEQ ID NO: 7735521 - DNA, 22 bp, Homo sapiens
tgcctgccaatgatgcttgtgt

SEQ ID NO: 7735522 - DNA, 22 bp, Homo sapiens
tgcctgcccacgactacagcag

SEQ ID NO: 7735523 - DNA, 22 bp, Homo sapiens
tgcctgccaggcaacctgggag

SEQ ID NO: 7735524 - DNA, 22 bp, Homo sapiens
tgcctgcattttgtggctggct

SEQ ID NO: 7735525 - DNA, 22 bp, Homo sapiens
tgcctgcaagagttggggctac

SEQ ID NO: 7735526 - DNA, 22 bp, Homo sapiens
tgcctggcaccccagtctgcac

SEQ ID NO: 7735527 - DNA, 22 bp, Homo sapiens
tgcctggcaccccagtctgcac

SEQ ID NO: 7735528 - DNA, 22 bp, Homo sapiens
tgcctggcactcctggagctca

SEQ ID NO: 7735529 - DNA, 22 bp, Homo sapiens
tgcctggcatctagccctggga

SEQ ID NO: 7735530 - DNA, 19 bp, Homo sapiens
tgcctggcaccagctccac

SEQ ID NO: 7735531 - DNA, 22 bp, Homo sapiens
tgcctggcaagaggggctggct

SEQ ID NO: 7735532 - DNA, 22 bp, Homo sapiens
tgccagcctggcctgagtcttt

SEQ ID NO: 7735533 - DNA, 17 bp, Homo sapiens
tgccagcctgtcccagg

SEQ ID NO: 7735534 - DNA, 22 bp, Homo sapiens
tgccagcccaccttggggcctc

SEQ ID NO: 7735535 - DNA, 18 bp, Homo sapiens
tgccagccgactggcctg

SEQ ID NO: 7735536 - DNA, 22 bp, Homo sapiens
tgccaggcacgtgagagtggcc

SEQ ID NO: 7735537 - DNA, 22 bp, Homo sapiens
tgccaggcagtgtcagattgag

SEQ ID NO: 7735538 - DNA, 22 bp, Homo sapiens
tgccaggcccagctccagagct

SEQ ID NO: 7735539 - DNA, 22 bp, Homo sapiens
tgccaggccctcccacagatta

SEQ ID NO: 7735540 - DNA, 22 bp, Homo sapiens
tgccaggctaagtggaggactt

SEQ ID NO: 7735541 - DNA, 22 bp, Homo sapiens
tgccagggtcagctgcagctct

SEQ ID NO: 7735542 - DNA, 22 bp, Homo sapiens
tgccagggagccctgctgacca

SEQ ID NO: 7735543 - DNA, 22 bp, Homo sapiens
tgccaggctccggaacgacagt

SEQ ID NO: 7735544 - DNA, 22 bp, Homo sapiens
tgcccaggtttgagtgcccaag

SEQ ID NO: 7735545 - DNA, 22 bp, Homo sapiens
tgcccctctcctgtgatccaag

SEQ ID NO: 7735546 - DNA, 22 bp, Homo sapiens
tgcccctcgacgcaatgaaggg

SEQ ID NO: 7735547 - DNA, 22 bp, Homo sapiens
tgcccctcagggaacgggtatc

SEQ ID NO: 7735548 - DNA, 19 bp, Homo sapiens
tgcccaggcctcccaaaag

SEQ ID NO: 7735549 - DNA, 22 bp, Homo sapiens
tgaggcaggagttaatgtgctc

SEQ ID NO: 7735550 - DNA, 22 bp, Homo sapiens
tgaggcaggagttaatgtgctc

SEQ ID NO: 7735551 - DNA, 22 bp, Homo sapiens
tgaggcaggatgcttgcacagg

SEQ ID NO: 7735552 - DNA, 20 bp, Homo sapiens
tgaggcaggagaatggcatg

SEQ ID NO: 7735553 - DNA, 20 bp, Homo sapiens
tgaggcaggagaatggcatg

SEQ ID NO: 7735554 - DNA, 22 bp, Homo sapiens
tgaggcaggagaatggcgggaa

SEQ ID NO: 7735555 - DNA, 22 bp, Homo sapiens
tgaggccaagcctcctctgcca

SEQ ID NO: 7735556 - DNA, 22 bp, Homo sapiens
tgaggcagtgtgagataataaa

SEQ ID NO: 7735557 - DNA, 22 bp, Homo sapiens
tgaggcagggagagtggatatg

SEQ ID NO: 7735558 - DNA, 22 bp, Homo sapiens
tgaggcctgaagcctggagcct

SEQ ID NO: 7735559 - DNA, 22 bp, Homo sapiens
tgaggcctcataatgagatttc

SEQ ID NO: 7735560 - DNA, 19 bp, Homo sapiens
tgaggccaaggtcacagat

SEQ ID NO: 7735561 - DNA, 18 bp, Homo sapiens
tgaggccagagtgggcat

SEQ ID NO: 7735562 - DNA, 22 bp, Homo sapiens
tgaggccagccacagccaccct

SEQ ID NO: 7735563 - DNA, 22 bp, Homo sapiens
tgaggccagcttcagcagtgga

SEQ ID NO: 7735564 - DNA, 22 bp, Homo sapiens
tgaggcaggagaatcacatgaa

SEQ ID NO: 7735565 - DNA, 22 bp, Homo sapiens
tgaggcaggacttgcataaagt

SEQ ID NO: 7735566 - DNA, 22 bp, Homo sapiens
tgaggcaggactgagcgggatg

SEQ ID NO: 7735567 - DNA, 22 bp, Homo sapiens
tgaggcagcctgcattaaagag

SEQ ID NO: 7735568 - DNA, 22 bp, Homo sapiens
tgaggcaaagacaaagcagcat

SEQ ID NO: 7735569 - DNA, 22 bp, Homo sapiens
tgaggaggcccaggttggggct

SEQ ID NO: 7735570 - DNA, 23 bp, Homo sapiens
tgaggagcatagctgactgacag

SEQ ID NO: 7735571 - DNA, 22 bp, Homo sapiens
tgaggagcagggtggcttactc

SEQ ID NO: 7735572 - DNA, 22 bp, Homo sapiens
tgaggagcttctggaaagtgca

SEQ ID NO: 7735573 - DNA, 22 bp, Homo sapiens
tgaggagcgggcagggatgcag

SEQ ID NO: 7735574 - DNA, 22 bp, Homo sapiens
tgaggatggggagatggtgtct

SEQ ID NO: 7735575 - DNA, 22 bp, Homo sapiens
tgaggaagtggttgtatggttt

SEQ ID NO: 7735576 - DNA, 22 bp, Homo sapiens
tgaggaaagaaaggcatgcatg

SEQ ID NO: 7735577 - DNA, 22 bp, Homo sapiens
tgaggaagcaaaggcttgtgtg

SEQ ID NO: 7735578 - DNA, 22 bp, Homo sapiens
tgaggaaggaattgaggtttta

SEQ ID NO: 7735579 - DNA, 22 bp, Homo sapiens
tgagggaggccctttgagcaga

SEQ ID NO: 7735580 - DNA, 22 bp, Homo sapiens
tgagggaggcctccatctgcca

SEQ ID NO: 7735581 - DNA, 22 bp, Homo sapiens
tgagggagtgtggatacagtag

SEQ ID NO: 7735582 - DNA, 22 bp, Homo sapiens
tgaggttcagttcttggccaca

SEQ ID NO: 7735583 - DNA, 22 bp, Homo sapiens
tgagtctgggcatgttcacttt

SEQ ID NO: 7735584 - DNA, 22 bp, Homo sapiens
tgagtctgtatgtccagattta

SEQ ID NO: 7735585 - DNA, 22 bp, Homo sapiens
tgagtatcaattacatagttgt

SEQ ID NO: 7735586 - DNA, 22 bp, Homo sapiens
tgagggtctggaatctgggctt

SEQ ID NO: 7735587 - DNA, 22 bp, Homo sapiens
tgaggggcggcctgcagaggcc

SEQ ID NO: 7735588 - DNA, 22 bp, Homo sapiens
tgaggggcagagaggtgtccag

SEQ ID NO: 7735589 - DNA, 22 bp, Homo sapiens
tgaggggcgctggcaggttcct

SEQ ID NO: 7735590 - DNA, 22 bp, Homo sapiens
tgagccagagtggagtgtgcct

SEQ ID NO: 7735591 - DNA, 22 bp, Homo sapiens
tgagccacagtgagagctcctg

SEQ ID NO: 7735592 - DNA, 22 bp, Homo sapiens
tgagccaggcactgctcctgga

SEQ ID NO: 7735593 - DNA, 21 bp, Homo sapiens
tgagccaggctgacggctgtg

SEQ ID NO: 7735594 - DNA, 22 bp, Homo sapiens
tgagccaggcccagtggggtca

SEQ ID NO: 7735595 - DNA, 22 bp, Homo sapiens
tgagcacagctttcactagaaa

SEQ ID NO: 7735596 - DNA, 20 bp, Homo sapiens
tgagcaccaagaatcaagaa

SEQ ID NO: 7735597 - DNA, 22 bp, Homo sapiens
tgagcagaggagtgacgtaggt

SEQ ID NO: 7735598 - DNA, 22 bp, Homo sapiens
tgagcagagttgtttctcctga

SEQ ID NO: 7735599 - DNA, 22 bp, Homo sapiens
tgagcagcaggatcttctggta

SEQ ID NO: 7735600 - DNA, 22 bp, Homo sapiens
tgagcagcccttcctccggcca

SEQ ID NO: 7735601 - DNA, 22 bp, Homo sapiens
tgagcagcaactgtccatggca

SEQ ID NO: 7735602 - DNA, 22 bp, Homo sapiens
tgagctacacactaggcatggg

SEQ ID NO: 7735603 - DNA, 22 bp, Homo sapiens
tgagccaggtctcactcacctt

SEQ ID NO: 7735604 - DNA, 22 bp, Homo sapiens
tgagccccggagtttcaggctg

SEQ ID NO: 7735605 - DNA, 22 bp, Homo sapiens
tgagctggttcttgaggcatga

SEQ ID NO: 7735606 - DNA, 22 bp, Homo sapiens
tgagctggtcactccttctgaa

SEQ ID NO: 7735607 - DNA, 22 bp, Homo sapiens
tgagctgtagcagatgctgttg

SEQ ID NO: 7735608 - DNA, 22 bp, Homo sapiens
tgagctgtctgaatggtgagga

SEQ ID NO: 7735609 - DNA, 22 bp, Homo sapiens
tgagctgtggtggggtagagga

SEQ ID NO: 7735610 - DNA, 22 bp, Homo sapiens
tgagcttcaaagttggatctga

SEQ ID NO: 7735611 - DNA, 17 bp, Homo sapiens
tgagcttcaatcaggtg

SEQ ID NO: 7735612 - DNA, 22 bp, Homo sapiens
tgagctgtgtcctgggggcagt

SEQ ID NO: 7735613 - DNA, 22 bp, Homo sapiens
tgagcttccctcctgcactaca

SEQ ID NO: 7735614 - DNA, 22 bp, Homo sapiens
tgagcttctttatttggccaga

SEQ ID NO: 7735615 - DNA, 22 bp, Homo sapiens
tgagcttcctccctgcatccat

SEQ ID NO: 7735616 - DNA, 22 bp, Homo sapiens
tgaggaaacttacaaggcagaa

SEQ ID NO: 7735617 - DNA, 22 bp, Homo sapiens
tgagaagattgggcagagtgga

SEQ ID NO: 7735618 - DNA, 22 bp, Homo sapiens
tgagaaaggtatttcatgcact

SEQ ID NO: 7735619 - DNA, 20 bp, Homo sapiens
tgagaaagtagagactcagg

SEQ ID NO: 7735620 - DNA, 22 bp, Homo sapiens
tgagaaagacagacattcctaa

SEQ ID NO: 7735621 - DNA, 20 bp, Homo sapiens
tgagaagctcctgtctcctc

SEQ ID NO: 7735622 - DNA, 22 bp, Homo sapiens
tgagaattttttgtcatgcatt

SEQ ID NO: 7735623 - DNA, 23 bp, Homo sapiens
tgagacactcattcatggagtat

SEQ ID NO: 7735624 - DNA, 18 bp, Homo sapiens
tgagagcattcgaggcaa

SEQ ID NO: 7735625 - DNA, 22 bp, Homo sapiens
tgagagcagaggtgggcagcct

SEQ ID NO: 7735626 - DNA, 22 bp, Homo sapiens
tgagagacacactgtgcatgta

SEQ ID NO: 7735627 - DNA, 22 bp, Homo sapiens
tgagaggtaggaaatgaacaag

SEQ ID NO: 7735628 - DNA, 22 bp, Homo sapiens
tgagaggtaggaaatgaacaag

SEQ ID NO: 7735629 - DNA, 22 bp, Homo sapiens
tgagatgggtggggagctcagg

SEQ ID NO: 7735630 - DNA, 22 bp, Homo sapiens
tgagatgaataactcctgctaa

SEQ ID NO: 7735631 - DNA, 23 bp, Homo sapiens
tgaatcaattatgggattcaatg

SEQ ID NO: 7735632 - DNA, 22 bp, Homo sapiens
tgaatcaattgtcttaagacat

SEQ ID NO: 7735633 - DNA, 22 bp, Homo sapiens
tgaatcaatagttgcaagtatt

SEQ ID NO: 7735634 - DNA, 22 bp, Homo sapiens
tgaatcaatgaattgcacttca

SEQ ID NO: 7735635 - DNA, 22 bp, Homo sapiens
tgaatcaaagctgaagttttca

SEQ ID NO: 7735636 - DNA, 18 bp, Homo sapiens
tgaattagtttgtggttt

SEQ ID NO: 7735637 - DNA, 22 bp, Homo sapiens
tgaattcttaatgaaatctact

SEQ ID NO: 7735638 - DNA, 22 bp, Homo sapiens
tgaattcttttagaattcagtg

SEQ ID NO: 7735639 - DNA, 22 bp, Homo sapiens
tgaatttaccttgcctatattt

SEQ ID NO: 7735640 - DNA, 22 bp, Homo sapiens
tgaatttatcaaagattcttaa

SEQ ID NO: 7735641 - DNA, 21 bp, Homo sapiens
tgaatttcggtatggctataa

SEQ ID NO: 7735642 - DNA, 23 bp, Homo sapiens
tgaatttggaactcagagaatta

SEQ ID NO: 7735643 - DNA, 22 bp, Homo sapiens
tgaataagaattattataatga

SEQ ID NO: 7735644 - DNA, 22 bp, Homo sapiens
tgaataaactatgaggaggaat

SEQ ID NO: 7735645 - DNA, 22 bp, Homo sapiens
tgaagttttctggttgattaag

SEQ ID NO: 7735646 - DNA, 22 bp, Homo sapiens
tgaagttttacatcctctccaa

SEQ ID NO: 7735647 - DNA, 22 bp, Homo sapiens
tgaagtttaaggttagataagt

SEQ ID NO: 7735648 - DNA, 22 bp, Homo sapiens
tgaagtttcttgaatcttggag

SEQ ID NO: 7735649 - DNA, 22 bp, Homo sapiens
tgaaggccagcagagtgaaggc

SEQ ID NO: 7735650 - DNA, 22 bp, Homo sapiens
tgaaggcccagccacagaatgg

SEQ ID NO: 7735651 - DNA, 22 bp, Homo sapiens
tgaaggcctaacttccagtgct

SEQ ID NO: 7735652 - DNA, 23 bp, Homo sapiens
tgaaggccctggagccacgaggc

SEQ ID NO: 7735653 - DNA, 22 bp, Homo sapiens
tgaaggagatttttagggaggc

SEQ ID NO: 7735654 - DNA, 22 bp, Homo sapiens
tgaaggagctcaatgatgatgc

SEQ ID NO: 7735655 - DNA, 22 bp, Homo sapiens
tgaaggagctcaggagatagtc

SEQ ID NO: 7735656 - DNA, 22 bp, Homo sapiens
tgaaggagctcaggagatagtc

SEQ ID NO: 7735657 - DNA, 22 bp, Homo sapiens
tgaaggagggaagaaggctctg

SEQ ID NO: 7735658 - DNA, 19 bp, Homo sapiens
tgaaggagggggatggcca

SEQ ID NO: 7735659 - DNA, 22 bp, Homo sapiens
tgaaggaggaatgtggcctcca

SEQ ID NO: 7735660 - DNA, 22 bp, Homo sapiens
tgaaggagctgatgtaaggggt

SEQ ID NO: 7735661 - DNA, 19 bp, Homo sapiens
tgaaggagggggatggcca

SEQ ID NO: 7735662 - DNA, 22 bp, Homo sapiens
tgaagccactttccagaatcac

SEQ ID NO: 7735663 - DNA, 22 bp, Homo sapiens
tgacagtgacagccaaaggctt

SEQ ID NO: 7735664 - DNA, 22 bp, Homo sapiens
tgacagtgcatgtgacaaagga

SEQ ID NO: 7735665 - DNA, 22 bp, Homo sapiens
tgacacagttgtcgactctaca

SEQ ID NO: 7735666 - DNA, 21 bp, Homo sapiens
tgactaattgtgataaagtgc

SEQ ID NO: 7735667 - DNA, 22 bp, Homo sapiens
tgacttaagctgttctttagat

SEQ ID NO: 7735668 - DNA, 22 bp, Homo sapiens
tgacttcctgcactcaggtgat

SEQ ID NO: 7735669 - DNA, 22 bp, Homo sapiens
tgactgtgcctgttgaatgaat

SEQ ID NO: 7735670 - DNA, 22 bp, Homo sapiens
tgactggattgtcattacgacg

SEQ ID NO: 7735671 - DNA, 21 bp, Homo sapiens
tgactgaggcttcttcacaca

SEQ ID NO: 7735672 - DNA, 22 bp, Homo sapiens
tgacagtgcgggtacatcatag

SEQ ID NO: 7735673 - DNA, 22 bp, Homo sapiens
tgaaatcaattgcaatgtttat

SEQ ID NO: 7735674 - DNA, 17 bp, Homo sapiens
tgaaatcagcacccagg

SEQ ID NO: 7735675 - DNA, 22 bp, Homo sapiens
tgaaatcattgccaagtattga

SEQ ID NO: 7735676 - DNA, 22 bp, Homo sapiens
tgaaatcatgaacaaggtaggt

SEQ ID NO: 7735677 - DNA, 22 bp, Homo sapiens
tgaaatcatctgccaataagtt

SEQ ID NO: 7735678 - DNA, 22 bp, Homo sapiens
tgaaatcattggggttgaataa

SEQ ID NO: 7735679 - DNA, 22 bp, Homo sapiens
tgaaatgttaaacaagtggctc

SEQ ID NO: 7735680 - DNA, 22 bp, Homo sapiens
tgaaatgttgccatgaggtctc

SEQ ID NO: 7735681 - DNA, 22 bp, Homo sapiens
tgaacttagtgggaatatctct

SEQ ID NO: 7735682 - DNA, 22 bp, Homo sapiens
tgaagactcagaagctaagata

SEQ ID NO: 7735683 - DNA, 22 bp, Homo sapiens
tgaaagaactagcatcttcaag

SEQ ID NO: 7735684 - DNA, 22 bp, Homo sapiens
tgaaaatttccatcagttatat

SEQ ID NO: 7735685 - DNA, 22 bp, Homo sapiens
tctttgttattgctttatctat

SEQ ID NO: 7735686 - DNA, 20 bp, Homo sapiens
tctttgttaattttatctcc

SEQ ID NO: 7735687 - DNA, 22 bp, Homo sapiens
tctttgtttgtactgttagaat

SEQ ID NO: 7735688 - DNA, 22 bp, Homo sapiens
tctttgtttgcctttatcaaga

SEQ ID NO: 7735689 - DNA, 20 bp, Homo sapiens
tggcggggatgagggagtta

SEQ ID NO: 7735690 - DNA, 22 bp, Homo sapiens
tggcgtgccctccagacttggc

SEQ ID NO: 7735691 - DNA, 22 bp, Homo sapiens
tggctcagagccttgagagctg

SEQ ID NO: 7735692 - DNA, 22 bp, Homo sapiens
tggcctggtaccacatagattt

SEQ ID NO: 7735693 - DNA, 22 bp, Homo sapiens
tggctcctcttctgggtgtccc

SEQ ID NO: 7735694 - DNA, 22 bp, Homo sapiens
tggctccacaggccagggtgtg

SEQ ID NO: 7735695 - DNA, 22 bp, Homo sapiens
tggctctgtggtcttagcatgc

SEQ ID NO: 7735696 - DNA, 22 bp, Homo sapiens
tggctctgtggatgttctgacc

SEQ ID NO: 7735697 - DNA, 23 bp, Homo sapiens
tggctctgtggatccctcaggag

SEQ ID NO: 7735698 - DNA, 22 bp, Homo sapiens
tggctctgtgcttctagtatct

SEQ ID NO: 7735699 - DNA, 22 bp, Homo sapiens
tggctctggggacagtaagtcc

SEQ ID NO: 7735700 - DNA, 22 bp, Homo sapiens
tggctctgtcgccgtttggaat

SEQ ID NO: 7735701 - DNA, 22 bp, Homo sapiens
tggctctggattaatctaggaa

SEQ ID NO: 7735702 - DNA, 22 bp, Homo sapiens
tggctctgggaatctgttgctt

SEQ ID NO: 7735703 - DNA, 22 bp, Homo sapiens
tggctctgggaatgggaagatg

SEQ ID NO: 7735704 - DNA, 22 bp, Homo sapiens
tggctctgttgtgctgagccag

SEQ ID NO: 7735705 - DNA, 22 bp, Homo sapiens
tggctctgttgtgctgagccag

SEQ ID NO: 7735706 - DNA, 19 bp, Homo sapiens
tggctctgtttctctggag

SEQ ID NO: 7735707 - DNA, 22 bp, Homo sapiens
tggctctgttcgccatcaggag

SEQ ID NO: 7735708 - DNA, 21 bp, Homo sapiens
tggctctgctcagagcagtcc

SEQ ID NO: 7735709 - DNA, 22 bp, Homo sapiens
tggctctgcgtctgttcgtggg

SEQ ID NO: 7735710 - DNA, 22 bp, Homo sapiens
tggctctggagctcctgggccc

SEQ ID NO: 7735711 - DNA, 22 bp, Homo sapiens
tggctctgctgaacctagtgca

SEQ ID NO: 7735712 - DNA, 18 bp, Homo sapiens
tggctctgccactcaccg

SEQ ID NO: 7735713 - DNA, 18 bp, Homo sapiens
tggctctgcagccagatg

SEQ ID NO: 7735714 - DNA, 21 bp, Homo sapiens
tggctctgagcctcatggctg

SEQ ID NO: 7735715 - DNA, 22 bp, Homo sapiens
tggctctgagacacaggctctc

SEQ ID NO: 7735716 - DNA, 22 bp, Homo sapiens
tggctgagttcctggcacacgg

SEQ ID NO: 7735717 - DNA, 22 bp, Homo sapiens
tggctgagttacgaacagagca

SEQ ID NO: 7735718 - DNA, 22 bp, Homo sapiens
tggctgccatgacgcctgggga

SEQ ID NO: 7735719 - DNA, 22 bp, Homo sapiens
tggctgccaatggcttggaaag

SEQ ID NO: 7735720 - DNA, 18 bp, Homo sapiens
tggctgctggagtagggt

SEQ ID NO: 7735721 - DNA, 22 bp, Homo sapiens
tggctgctgagaaggcagctgt

SEQ ID NO: 7735722 - DNA, 22 bp, Homo sapiens
tggctgagcctttggggctttc

SEQ ID NO: 7735723 - DNA, 22 bp, Homo sapiens
tggctgagctgcagcgtggctt

SEQ ID NO: 7735724 - DNA, 22 bp, Homo sapiens
tggctgagctgcagcgtggctt

SEQ ID NO: 7735725 - DNA, 22 bp, Homo sapiens
tggctgaggagagggcggaagt

SEQ ID NO: 7735726 - DNA, 22 bp, Homo sapiens
tggctgaggctggagtgcagtg

SEQ ID NO: 7735727 - DNA, 22 bp, Homo sapiens
tggctgaggtctggggcttctg

SEQ ID NO: 7735728 - DNA, 22 bp, Homo sapiens
tgggaaagtgttgaggtgtctt

SEQ ID NO: 7735729 - DNA, 22 bp, Homo sapiens
tgggaagaggcgggaggctgtt

SEQ ID NO: 7735730 - DNA, 22 bp, Homo sapiens
tggcttcttgacttcttggctg

SEQ ID NO: 7735731 - DNA, 22 bp, Homo sapiens
tggcttcttgtctaatttgtta

SEQ ID NO: 7735732 - DNA, 22 bp, Homo sapiens
tggcttctgagtctcctgacat

SEQ ID NO: 7735733 - DNA, 19 bp, Homo sapiens
tggcttctgttttcatgtt

SEQ ID NO: 7735734 - DNA, 22 bp, Homo sapiens
tggcttctgggacttgtgagca

SEQ ID NO: 7735735 - DNA, 19 bp, Homo sapiens
tggcttcctgactctcatc

SEQ ID NO: 7735736 - DNA, 22 bp, Homo sapiens
tggcttcctaaactgatttcca

SEQ ID NO: 7735737 - DNA, 22 bp, Homo sapiens
tggcttctcagaatactctgga

SEQ ID NO: 7735738 - DNA, 22 bp, Homo sapiens
tggctggcgttggggccagtga

SEQ ID NO: 7735739 - DNA, 22 bp, Homo sapiens
tggctggcagtaggctagtggc

SEQ ID NO: 7735740 - DNA, 18 bp, Homo sapiens
tggctggcagtgggcagc

SEQ ID NO: 7735741 - DNA, 22 bp, Homo sapiens
tggctggcaaggctggagtcag

SEQ ID NO: 7735742 - DNA, 22 bp, Homo sapiens
tggctgtgggatatgtgactga

SEQ ID NO: 7735743 - DNA, 22 bp, Homo sapiens
tggctgtggactcagatggctc

SEQ ID NO: 7735744 - DNA, 22 bp, Homo sapiens
tggctgtgcggcctcgggcaga

SEQ ID NO: 7735745 - DNA, 22 bp, Homo sapiens
tggctgtgttaccacttcatgt

SEQ ID NO: 7735746 - DNA, 22 bp, Homo sapiens
tgggagaagcatggggtgcaga

SEQ ID NO: 7735747 - DNA, 22 bp, Homo sapiens
tgggagaagcagtgggacagta

SEQ ID NO: 7735748 - DNA, 22 bp, Homo sapiens
tgggagaaagaaccctgagtga

SEQ ID NO: 7735749 - DNA, 22 bp, Homo sapiens
tgggagaagcagcagccaagtg

SEQ ID NO: 7735750 - DNA, 22 bp, Homo sapiens
tgggagaacccagggtcaggct

SEQ ID NO: 7735751 - DNA, 22 bp, Homo sapiens
tgggagctggggttggacgtct

SEQ ID NO: 7735752 - DNA, 22 bp, Homo sapiens
tgggaaggtacacgggaaagag

SEQ ID NO: 7735753 - DNA, 22 bp, Homo sapiens
tgggaaggggagctggaaagga

SEQ ID NO: 7735754 - DNA, 22 bp, Homo sapiens
tgggaagggccgatggagcctc

SEQ ID NO: 7735755 - DNA, 22 bp, Homo sapiens
tgggaagatgaggtgccatggg

SEQ ID NO: 7735756 - DNA, 22 bp, Homo sapiens
tggcacagaaaaatgctccatt

SEQ ID NO: 7735757 - DNA, 22 bp, Homo sapiens
tggcacagacagcacagcaatg

SEQ ID NO: 7735758 - DNA, 22 bp, Homo sapiens
tggcaatgtaggcaagaacatt

SEQ ID NO: 7735759 - DNA, 17 bp, Homo sapiens
tggcacagaggtgctat

SEQ ID NO: 7735760 - DNA, 22 bp, Homo sapiens
tggcacagagggacccagcagc

SEQ ID NO: 7735761 - DNA, 22 bp, Homo sapiens
tggcacagtgctggatggtgct

SEQ ID NO: 7735762 - DNA, 22 bp, Homo sapiens
tggattcacaccattctcctgc

SEQ ID NO: 7735763 - DNA, 22 bp, Homo sapiens
tggatttgctaccttctgatat

SEQ ID NO: 7735764 - DNA, 22 bp, Homo sapiens
tggatttctccagctctccatt

SEQ ID NO: 7735765 - DNA, 22 bp, Homo sapiens
tggatttattaggttggtgaaa

SEQ ID NO: 7735766 - DNA, 22 bp, Homo sapiens
tggcagctctgttcaacatgag

SEQ ID NO: 7735767 - DNA, 22 bp, Homo sapiens
tggcagggtacaccttaacacc

SEQ ID NO: 7735768 - DNA, 22 bp, Homo sapiens
tggcagggtcttgctgtgttgc

SEQ ID NO: 7735769 - DNA, 18 bp, Homo sapiens
tggcaggtccagctgtgg

SEQ ID NO: 7735770 - DNA, 22 bp, Homo sapiens
tggcaggtgaagttgttaggga

SEQ ID NO: 7735771 - DNA, 23 bp, Homo sapiens
tggcatagtgaggggcacagaga

SEQ ID NO: 7735772 - DNA, 22 bp, Homo sapiens
tggcatgaagtcagcagctggg

SEQ ID NO: 7735773 - DNA, 19 bp, Homo sapiens
tggcatgatgatggatggg

SEQ ID NO: 7735774 - DNA, 19 bp, Homo sapiens
tggccacctctgctgttct

SEQ ID NO: 7735775 - DNA, 19 bp, Homo sapiens
tggccacctctgctgttct

SEQ ID NO: 7735776 - DNA, 20 bp, Homo sapiens
tggccacctgcgtcccagcc

SEQ ID NO: 7735777 - DNA, 22 bp, Homo sapiens
tggccaccttatggctattgga

SEQ ID NO: 7735778 - DNA, 22 bp, Homo sapiens
tggccaccttcccacttctgcc

SEQ ID NO: 7735779 - DNA, 22 bp, Homo sapiens
tggccaccttcccacttctgcc

SEQ ID NO: 7735780 - DNA, 22 bp, Homo sapiens
tggccaccttatggctattgga

SEQ ID NO: 7735781 - DNA, 22 bp, Homo sapiens
tggccacttggcatgtgtgcca

SEQ ID NO: 7735782 - DNA, 22 bp, Homo sapiens
tggccacccagctgacgccttc

SEQ ID NO: 7735783 - DNA, 22 bp, Homo sapiens
tggccacccccaatgtcagtag

SEQ ID NO: 7735784 - DNA, 22 bp, Homo sapiens
tggccacccccaatgtcagtag

SEQ ID NO: 7735785 - DNA, 22 bp, Homo sapiens
tggccacccctttctctgcact

SEQ ID NO: 7735786 - DNA, 22 bp, Homo sapiens
tggccaccaccaatacttgcct

SEQ ID NO: 7735787 - DNA, 22 bp, Homo sapiens
tggccacccaccctaatctttc

SEQ ID NO: 7735788 - DNA, 20 bp, Homo sapiens
tggccaccactgtatatcaa

SEQ ID NO: 7735789 - DNA, 22 bp, Homo sapiens
tggccacagtgtccagcagcag

SEQ ID NO: 7735790 - DNA, 22 bp, Homo sapiens
tggcatgtttaatgtactgtat

SEQ ID NO: 7735791 - DNA, 22 bp, Homo sapiens
tggccacacccacctagaggag

SEQ ID NO: 7735792 - DNA, 22 bp, Homo sapiens
tggccacactgcccccactggg

SEQ ID NO: 7735793 - DNA, 22 bp, Homo sapiens
tggccaggtgtgggttctcaga

SEQ ID NO: 7735794 - DNA, 22 bp, Homo sapiens
tggccagtagataggcaggcaa

SEQ ID NO: 7735795 - DNA, 22 bp, Homo sapiens
tggccaggggagttcccctcca

SEQ ID NO: 7735796 - DNA, 23 bp, Homo sapiens
tggccagggtactacacccaccc

SEQ ID NO: 7735797 - DNA, 22 bp, Homo sapiens
tggccaggctggtctggaacgc

SEQ ID NO: 7735798 - DNA, 22 bp, Homo sapiens
tggccagcccttcagccatgcc

SEQ ID NO: 7735799 - DNA, 22 bp, Homo sapiens
tggccagattcatgcatgtatc

SEQ ID NO: 7735800 - DNA, 22 bp, Homo sapiens
tggccaggccggggacagaact

SEQ ID NO: 7735801 - DNA, 23 bp, Homo sapiens
tggcctggagagaaaagatgagt

SEQ ID NO: 7735802 - DNA, 22 bp, Homo sapiens
tggcctggccacatccagcagg

SEQ ID NO: 7735803 - DNA, 22 bp, Homo sapiens
tggcctggaaaaatgcagatgg

SEQ ID NO: 7735804 - DNA, 22 bp, Homo sapiens
tggccctgggcagaggcaacat

SEQ ID NO: 7735805 - DNA, 22 bp, Homo sapiens
tggcccttgttcaaatatgtca

SEQ ID NO: 7735806 - DNA, 22 bp, Homo sapiens
tggccctttggtttatgactga

SEQ ID NO: 7735807 - DNA, 22 bp, Homo sapiens
tggccctgtgtcctgctgccag

SEQ ID NO: 7735808 - DNA, 23 bp, Homo sapiens
tggccctgaatctgtcctggagg

SEQ ID NO: 7735809 - DNA, 22 bp, Homo sapiens
tggccctgacaggtcctgggca

SEQ ID NO: 7735810 - DNA, 22 bp, Homo sapiens
tggccctgacaggtcctgggca

SEQ ID NO: 7735811 - DNA, 22 bp, Homo sapiens
tggcccagctcagggtgggcgg

SEQ ID NO: 7735812 - DNA, 22 bp, Homo sapiens
tggccagtttgctcaggcagtc

SEQ ID NO: 7735813 - DNA, 22 bp, Homo sapiens
tggccagtgattaatgacgctt

SEQ ID NO: 7735814 - DNA, 22 bp, Homo sapiens
tggccagtggggttgagcagga

SEQ ID NO: 7735815 - DNA, 22 bp, Homo sapiens
tggcccaggtctctctgagccc

SEQ ID NO: 7735816 - DNA, 22 bp, Homo sapiens
tggcccaggcgaggtgggcaga

SEQ ID NO: 7735817 - DNA, 22 bp, Homo sapiens
tggcccaggaggccagagggca

SEQ ID NO: 7735818 - DNA, 22 bp, Homo sapiens
tggagagctcctatttgctgtc

SEQ ID NO: 7735819 - DNA, 22 bp, Homo sapiens
tggagagcacagttcctgcttc

SEQ ID NO: 7735820 - DNA, 22 bp, Homo sapiens
tggagagaacagtgtctgaaag

SEQ ID NO: 7735821 - DNA, 22 bp, Homo sapiens
tggagaaagctgcatatggaaa

SEQ ID NO: 7735822 - DNA, 18 bp, Homo sapiens
tggagctgagtgctgtgc

SEQ ID NO: 7735823 - DNA, 18 bp, Homo sapiens
tggagctgagtgctgtgc

SEQ ID NO: 7735824 - DNA, 22 bp, Homo sapiens
tggagctgcctggcacctacag

SEQ ID NO: 7735825 - DNA, 22 bp, Homo sapiens
tggagctggaatttctgggcct

SEQ ID NO: 7735826 - DNA, 22 bp, Homo sapiens
tggagctggaagacagtgatat

SEQ ID NO: 7735827 - DNA, 22 bp, Homo sapiens
tggagctgaactttgaggccag

SEQ ID NO: 7735828 - DNA, 22 bp, Homo sapiens
tggagcctgttctgagaagccg

SEQ ID NO: 7735829 - DNA, 23 bp, Homo sapiens
tggagcctgggatacaatagatg

SEQ ID NO: 7735830 - DNA, 20 bp, Homo sapiens
tggaggcacctgtggagatc

SEQ ID NO: 7735831 - DNA, 22 bp, Homo sapiens
tggaggcagtaactgagcaaca

SEQ ID NO: 7735832 - DNA, 22 bp, Homo sapiens
tggagctgggagtcctgggctg

SEQ ID NO: 7735833 - DNA, 23 bp, Homo sapiens
tggagctgggctcagaccctggg

SEQ ID NO: 7735834 - DNA, 22 bp, Homo sapiens
tggagctggtaaacagtgacat

SEQ ID NO: 7735835 - DNA, 20 bp, Homo sapiens
tggagctgtaatcttgtctg

SEQ ID NO: 7735836 - DNA, 22 bp, Homo sapiens
tggagctgtagccaccaccctg

SEQ ID NO: 7735837 - DNA, 22 bp, Homo sapiens
tggagctgtcactcagaaccaa

SEQ ID NO: 7735838 - DNA, 19 bp, Homo sapiens
tggaggagaggaaaagtca

SEQ ID NO: 7735839 - DNA, 19 bp, Homo sapiens
tggaggagaggaaaagtca

SEQ ID NO: 7735840 - DNA, 22 bp, Homo sapiens
tggatatccttgttaactttct

SEQ ID NO: 7735841 - DNA, 22 bp, Homo sapiens
tggagtctgtgatgctctgggt

SEQ ID NO: 7735842 - DNA, 22 bp, Homo sapiens
tggagtggacttcatgaggcca

SEQ ID NO: 7735843 - DNA, 22 bp, Homo sapiens
tggagggcgcttagatggaggg

SEQ ID NO: 7735844 - DNA, 22 bp, Homo sapiens
tggagggctaagctgagggata

SEQ ID NO: 7735845 - DNA, 22 bp, Homo sapiens
tggagggatacaaagatgaaaa

SEQ ID NO: 7735846 - DNA, 20 bp, Homo sapiens
tggaccaccctcctctttgc

SEQ ID NO: 7735847 - DNA, 22 bp, Homo sapiens
tggacctgagcctggccctgcc

SEQ ID NO: 7735848 - DNA, 22 bp, Homo sapiens
tggacctgctggatgggcaggt

SEQ ID NO: 7735849 - DNA, 22 bp, Homo sapiens
tggacctggggtggcctcctct

SEQ ID NO: 7735850 - DNA, 22 bp, Homo sapiens
tggaccccagacaagccagggt

SEQ ID NO: 7735851 - DNA, 22 bp, Homo sapiens
tggaccccctcaaggcagagct

SEQ ID NO: 7735852 - DNA, 20 bp, Homo sapiens
tggacctgtctctttaggga

SEQ ID NO: 7735853 - DNA, 19 bp, Homo sapiens
tggacctgtgcccatggct

SEQ ID NO: 7735854 - DNA, 21 bp, Homo sapiens
tggactggtgagtttaggctg

SEQ ID NO: 7735855 - DNA, 22 bp, Homo sapiens
tggaattttgtattagctttga

SEQ ID NO: 7735856 - DNA, 22 bp, Homo sapiens
tggaaggaagccaaggaaggtt

SEQ ID NO: 7735857 - DNA, 22 bp, Homo sapiens
tggaaggaaaggtagcagagaa

SEQ ID NO: 7735858 - DNA, 22 bp, Homo sapiens
tggaaggaaaggtagcagagaa

SEQ ID NO: 7735859 - DNA, 17 bp, Homo sapiens
tggaagcttcatgttgg

SEQ ID NO: 7735860 - DNA, 22 bp, Homo sapiens
tggaagagaaaggagtggatct

SEQ ID NO: 7735861 - DNA, 22 bp, Homo sapiens
tggaaggaagccaaggaaggtt

SEQ ID NO: 7735862 - DNA, 22 bp, Homo sapiens
tggaaggagactgggaagtgtg

SEQ ID NO: 7735863 - DNA, 22 bp, Homo sapiens
tggaaggagctaaggacctggg

SEQ ID NO: 7735864 - DNA, 22 bp, Homo sapiens
tggaaggagactgggaagtgtg

SEQ ID NO: 7735865 - DNA, 22 bp, Homo sapiens
tggaagggggaagacagctctg

SEQ ID NO: 7735866 - DNA, 22 bp, Homo sapiens
tggaatcagttacatgtggttg

SEQ ID NO: 7735867 - DNA, 22 bp, Homo sapiens
tggaaatggatctgatgagtct

SEQ ID NO: 7735868 - DNA, 19 bp, Homo sapiens
tggaacaaactgcaatgac

SEQ ID NO: 7735869 - DNA, 22 bp, Homo sapiens
tggaacaacatgctggaaaatt

SEQ ID NO: 7735870 - DNA, 22 bp, Homo sapiens
tggaacaaattacaattaactt

SEQ ID NO: 7735871 - DNA, 22 bp, Homo sapiens
tggaaagtgagacatatttata

SEQ ID NO: 7735872 - DNA, 22 bp, Homo sapiens
tggaaacactcaagcttatatt

SEQ ID NO: 7735873 - DNA, 22 bp, Homo sapiens
tgctttatgtggctgatactca

SEQ ID NO: 7735874 - DNA, 22 bp, Homo sapiens
tgctttattaagagagaaattt

SEQ ID NO: 7735875 - DNA, 20 bp, Homo sapiens
tgctttgatggaaatacagc

SEQ ID NO: 7735876 - DNA, 20 bp, Homo sapiens
tgctctgggggtggagagac

SEQ ID NO: 7735877 - DNA, 22 bp, Homo sapiens
tgctgagcgcatccggcggccg

SEQ ID NO: 7735878 - DNA, 22 bp, Homo sapiens
tgctcctgtttcatcagctata

SEQ ID NO: 7735879 - DNA, 22 bp, Homo sapiens
tgctctgggattcagcagcctg

SEQ ID NO: 7735880 - DNA, 22 bp, Homo sapiens
tgctctggctgggatgagtgca

SEQ ID NO: 7735881 - DNA, 22 bp, Homo sapiens
tgctctggctggagcaatgact

SEQ ID NO: 7735882 - DNA, 22 bp, Homo sapiens
tgctcagagctccagctctcct

SEQ ID NO: 7735883 - DNA, 22 bp, Homo sapiens
tgcctggctctatcagtggtgg

SEQ ID NO: 7735884 - DNA, 22 bp, Homo sapiens
tgcctggctgaggtgacaggtt

SEQ ID NO: 7735885 - DNA, 21 bp, Homo sapiens
tgcctggcctttgcttttcct

SEQ ID NO: 7735886 - DNA, 20 bp, Homo sapiens
tgcctggcctttctctgccc

SEQ ID NO: 7735887 - DNA, 22 bp, Homo sapiens
tgcctggccctgacagccctgg

SEQ ID NO: 7735888 - DNA, 22 bp, Homo sapiens
tgcctggccctgacagccctgg

SEQ ID NO: 7735889 - DNA, 22 bp, Homo sapiens
tgcctggctgggctgctcatgg

SEQ ID NO: 7735890 - DNA, 19 bp, Homo sapiens
tgcctgtcagtagatctca

SEQ ID NO: 7735891 - DNA, 22 bp, Homo sapiens
tgcctgtctctgactgccatta

SEQ ID NO: 7735892 - DNA, 22 bp, Homo sapiens
tgcctgtcttggagtcctggcc

SEQ ID NO: 7735893 - DNA, 22 bp, Homo sapiens
tgccttgcaggttttaaataca

SEQ ID NO: 7735894 - DNA, 22 bp, Homo sapiens
tgcctgtgcccttcttggcatt

SEQ ID NO: 7735895 - DNA, 22 bp, Homo sapiens
tgccttgggagccagcatgcca

SEQ ID NO: 7735896 - DNA, 22 bp, Homo sapiens
tgctgctgaggctaaagtatag

SEQ ID NO: 7735897 - DNA, 20 bp, Homo sapiens
tgctgctgtgagcgtccctg

SEQ ID NO: 7735898 - DNA, 22 bp, Homo sapiens
tgctggaggagtttactgtggc

SEQ ID NO: 7735899 - DNA, 19 bp, Homo sapiens
tgctggagggtagtgagtc

SEQ ID NO: 7735900 - DNA, 22 bp, Homo sapiens
tgctggagtggcactgtgtggc

SEQ ID NO: 7735901 - DNA, 22 bp, Homo sapiens
tgctggcatttcaggactcacc

SEQ ID NO: 7735902 - DNA, 22 bp, Homo sapiens
tgctggctgggctgctggagac

SEQ ID NO: 7735903 - DNA, 22 bp, Homo sapiens
tgctggctgtatatgtgagagt

SEQ ID NO: 7735904 - DNA, 23 bp, Homo sapiens
tgctggcttccagctgctccctc

SEQ ID NO: 7735905 - DNA, 23 bp, Homo sapiens
tgctggttcaaaaaggaaggagg

SEQ ID NO: 7735906 - DNA, 23 bp, Homo sapiens
tgctggtgtttttgggaccaggg

SEQ ID NO: 7735907 - DNA, 22 bp, Homo sapiens
tgctggtggagaaagtggaggt

SEQ ID NO: 7735908 - DNA, 22 bp, Homo sapiens
tgctggtgattaaatcctgaag

SEQ ID NO: 7735909 - DNA, 22 bp, Homo sapiens
tgctggggcagaagagccaaga

SEQ ID NO: 7735910 - DNA, 20 bp, Homo sapiens
tgctggggacatacagggtg

SEQ ID NO: 7735911 - DNA, 23 bp, Homo sapiens
tgctggggtagtttgtggcacag

SEQ ID NO: 7735912 - DNA, 22 bp, Homo sapiens
tgctgggctagggtggagctct

SEQ ID NO: 7735913 - DNA, 22 bp, Homo sapiens
tgctgggccaaagcagggtttt

SEQ ID NO: 7735914 - DNA, 23 bp, Homo sapiens
tgcttctctgcttgacagttctg

SEQ ID NO: 7735915 - DNA, 21 bp, Homo sapiens
tgcttctctagatcaactact

SEQ ID NO: 7735916 - DNA, 22 bp, Homo sapiens
tgctgtgaggttgagaaggaag

SEQ ID NO: 7735917 - DNA, 17 bp, Homo sapiens
tgctgtctgcttcccta

SEQ ID NO: 7735918 - DNA, 22 bp, Homo sapiens
tgggatagtggccaggaccccc

SEQ ID NO: 7735919 - DNA, 22 bp, Homo sapiens
tgggatagtagctgagagacaa

SEQ ID NO: 7735920 - DNA, 22 bp, Homo sapiens
tgggcacagaatagatggccca

SEQ ID NO: 7735921 - DNA, 22 bp, Homo sapiens
tgggcacaaacatctgcctgtt

SEQ ID NO: 7735922 - DNA, 22 bp, Homo sapiens
tgggcacaggggaatggatgaa

SEQ ID NO: 7735923 - DNA, 22 bp, Homo sapiens
tgggcacaggggtaggaatgag

SEQ ID NO: 7735924 - DNA, 19 bp, Homo sapiens
tgggcagctccctctgtcc

SEQ ID NO: 7735925 - DNA, 22 bp, Homo sapiens
tgggccacagctcacacatcca

SEQ ID NO: 7735926 - DNA, 22 bp, Homo sapiens
tgggccacctgctctgtttcta

SEQ ID NO: 7735927 - DNA, 22 bp, Homo sapiens
tgggccacctgcttttttgcat

SEQ ID NO: 7735928 - DNA, 22 bp, Homo sapiens
tgggccacaagccatgggacca

SEQ ID NO: 7735929 - DNA, 22 bp, Homo sapiens
tgggccacacacagaagaatca

SEQ ID NO: 7735930 - DNA, 22 bp, Homo sapiens
tgggccacgggggtggagagct

SEQ ID NO: 7735931 - DNA, 22 bp, Homo sapiens
tgggccacgtcatctcccacaa

SEQ ID NO: 7735932 - DNA, 22 bp, Homo sapiens
tgggcagtgagaaaggtcaggt

SEQ ID NO: 7735933 - DNA, 22 bp, Homo sapiens
tgggcatgagtggacagagaag

SEQ ID NO: 7735934 - DNA, 17 bp, Homo sapiens
tgggccagtagaaggga

SEQ ID NO: 7735935 - DNA, 21 bp, Homo sapiens
tgggcctcaggcagctgtgac

SEQ ID NO: 7735936 - DNA, 22 bp, Homo sapiens
tgggcctcctccgacagccggg

SEQ ID NO: 7735937 - DNA, 22 bp, Homo sapiens
tgggcctcggggaagcccgtgt

SEQ ID NO: 7735938 - DNA, 22 bp, Homo sapiens
tgggcctgccccaggcttcagc

SEQ ID NO: 7735939 - DNA, 21 bp, Homo sapiens
tgggcctgattcccagggtca

SEQ ID NO: 7735940 - DNA, 18 bp, Homo sapiens
tgggcctgcatcctagtc

SEQ ID NO: 7735941 - DNA, 22 bp, Homo sapiens
tgggcctgggctggacagcctg

SEQ ID NO: 7735942 - DNA, 22 bp, Homo sapiens
tgggctctcacacatgttctga

SEQ ID NO: 7735943 - DNA, 22 bp, Homo sapiens
tgggctctgaagtcagtctgct

SEQ ID NO: 7735944 - DNA, 22 bp, Homo sapiens
tgggcctgtggcttggctctag

SEQ ID NO: 7735945 - DNA, 22 bp, Homo sapiens
tgggcgacagagcaagactccg

SEQ ID NO: 7735946 - DNA, 18 bp, Homo sapiens
tgggcttgaaagcaaggt

SEQ ID NO: 7735947 - DNA, 22 bp, Homo sapiens
tgggcttctggagtggggcaga

SEQ ID NO: 7735948 - DNA, 22 bp, Homo sapiens
tgggctttatcatgggtctggt

SEQ ID NO: 7735949 - DNA, 22 bp, Homo sapiens
tgggctttgagctcggtcacct

SEQ ID NO: 7735950 - DNA, 22 bp, Homo sapiens
tgggcttcataattggtcctag

SEQ ID NO: 7735951 - DNA, 19 bp, Homo sapiens
tgggcttccccagggcaga

SEQ ID NO: 7735952 - DNA, 22 bp, Homo sapiens
tgggcttcctggagcctgtgct

SEQ ID NO: 7735953 - DNA, 23 bp, Homo sapiens
tgggcttctgagaaagcacctaa

SEQ ID NO: 7735954 - DNA, 17 bp, Homo sapiens
tggggaagctcagattt

SEQ ID NO: 7735955 - DNA, 22 bp, Homo sapiens
tggggaaggcggagcttgcagc

SEQ ID NO: 7735956 - DNA, 22 bp, Homo sapiens
tggggacacagaggttcgttgg

SEQ ID NO: 7735957 - DNA, 22 bp, Homo sapiens
tggggacaggagacttacagct

SEQ ID NO: 7735958 - DNA, 22 bp, Homo sapiens
tggggacagggctcagcaattt

SEQ ID NO: 7735959 - DNA, 22 bp, Homo sapiens
tggggacattcatgcaggttgt

SEQ ID NO: 7735960 - DNA, 19 bp, Homo sapiens
tggggatgctgatgaccaa

SEQ ID NO: 7735961 - DNA, 22 bp, Homo sapiens
tggggctggcacagtctctatt

SEQ ID NO: 7735962 - DNA, 22 bp, Homo sapiens
tgggggagcgacagacataatt

SEQ ID NO: 7735963 - DNA, 22 bp, Homo sapiens
tgggggcacttcgaggtcgcct

SEQ ID NO: 7735964 - DNA, 22 bp, Homo sapiens
tgggggcacttcgaggtcgcct

SEQ ID NO: 7735965 - DNA, 22 bp, Homo sapiens
tgggggagctcagtccagccca

SEQ ID NO: 7735966 - DNA, 22 bp, Homo sapiens
tgggggctgagtaagatgagat

SEQ ID NO: 7735967 - DNA, 22 bp, Homo sapiens
tgggggcatggaccagcctggc

SEQ ID NO: 7735968 - DNA, 22 bp, Homo sapiens
tgggggcagccaggctgtcaag

SEQ ID NO: 7735969 - DNA, 22 bp, Homo sapiens
tggggcagcagacctttcttgg

SEQ ID NO: 7735970 - DNA, 19 bp, Homo sapiens
tggggcctcctgtccctgg

SEQ ID NO: 7735971 - DNA, 22 bp, Homo sapiens
tggggcctgaaaggttctcgcc

SEQ ID NO: 7735972 - DNA, 22 bp, Homo sapiens
tgggttctttcacttctcagtt

SEQ ID NO: 7735973 - DNA, 22 bp, Homo sapiens
tgggttctagagggaccagaac

SEQ ID NO: 7735974 - DNA, 21 bp, Homo sapiens
tgggtgggcagagtctcttca

SEQ ID NO: 7735975 - DNA, 16 bp, Homo sapiens
tgggtgggaggagcgg

SEQ ID NO: 7735976 - DNA, 22 bp, Homo sapiens
tgggtgggagcgccctgtctgg

SEQ ID NO: 7735977 - DNA, 22 bp, Homo sapiens
tgggtgctctgcgaccgtaggg

SEQ ID NO: 7735978 - DNA, 22 bp, Homo sapiens
tgggtgcttcgtcagctctgag

SEQ ID NO: 7735979 - DNA, 22 bp, Homo sapiens
tgggtgaggatgatgaggcagc

SEQ ID NO: 7735980 - DNA, 22 bp, Homo sapiens
tgggtcctaaatgcagtcacat

SEQ ID NO: 7735981 - DNA, 22 bp, Homo sapiens
tgggtcctcgtcttccaaggca

SEQ ID NO: 7735982 - DNA, 22 bp, Homo sapiens
tgggtcctgcactgcaagcacc

SEQ ID NO: 7735983 - DNA, 20 bp, Homo sapiens
tgggtcctgcttcttcctga

SEQ ID NO: 7735984 - DNA, 22 bp, Homo sapiens
tgggtcctggctttgtcagggt

SEQ ID NO: 7735985 - DNA, 22 bp, Homo sapiens
tgggtcctggaaggcgacaggt

SEQ ID NO: 7735986 - DNA, 20 bp, Homo sapiens
tgggtcctgcacattctcca

SEQ ID NO: 7735987 - DNA, 22 bp, Homo sapiens
tgggtcctctgagagggcagcg

SEQ ID NO: 7735988 - DNA, 22 bp, Homo sapiens
tgggtcctctggagcagcagca

SEQ ID NO: 7735989 - DNA, 22 bp, Homo sapiens
tgggtctgtagggctgtccaat

SEQ ID NO: 7735990 - DNA, 20 bp, Homo sapiens
tgggtctgcttggcttcagt

SEQ ID NO: 7735991 - DNA, 22 bp, Homo sapiens
tgggtccttcaaagctgggtct

SEQ ID NO: 7735992 - DNA, 22 bp, Homo sapiens
tgggtccttgccatcttggagt

SEQ ID NO: 7735993 - DNA, 22 bp, Homo sapiens
tgggtccttgctaacttctatg

SEQ ID NO: 7735994 - DNA, 22 bp, Homo sapiens
tgggtcctgtctccttgttctg

SEQ ID NO: 7735995 - DNA, 20 bp, Homo sapiens
tgggtcctgtgggagaagaa

SEQ ID NO: 7735996 - DNA, 22 bp, Homo sapiens
tgggtcctttttggacttcttc

SEQ ID NO: 7735997 - DNA, 22 bp, Homo sapiens
tgggtctccagttcagggcagg

SEQ ID NO: 7735998 - DNA, 22 bp, Homo sapiens
tgggtccttgctgattgctgag

SEQ ID NO: 7735999 - DNA, 22 bp, Homo sapiens
tgggtccttgctggcttcaaag

SEQ ID NO: 7736000 - DNA, 23 bp, Homo sapiens
tgggggtgcacgggccacatctt

SEQ ID NO: 7736001 - DNA, 22 bp, Homo sapiens
tgggggtgctgagaagacagga

SEQ ID NO: 7736002 - DNA, 22 bp, Homo sapiens
tggggtctggagttgcccatga

SEQ ID NO: 7736003 - DNA, 22 bp, Homo sapiens
tggggggcacttcagcacaatg

SEQ ID NO: 7736004 - DNA, 22 bp, Homo sapiens
tgtcccagcactttgggagtct

SEQ ID NO: 7736005 - DNA, 22 bp, Homo sapiens
tgtcccagtttatctgggactg

SEQ ID NO: 7736006 - DNA, 22 bp, Homo sapiens
tgtcccagggaaggcccagcac

SEQ ID NO: 7736007 - DNA, 22 bp, Homo sapiens
tgtccctgatccactggacccc

SEQ ID NO: 7736008 - DNA, 22 bp, Homo sapiens
tgtccctggtggaggctggcag

SEQ ID NO: 7736009 - DNA, 22 bp, Homo sapiens
tgtcctgggtccctgctagaag

SEQ ID NO: 7736010 - DNA, 22 bp, Homo sapiens
tgtcctgtgcactgtagcatgt

SEQ ID NO: 7736011 - DNA, 22 bp, Homo sapiens
tgtcctgtgacctggcaccaca

SEQ ID NO: 7736012 - DNA, 22 bp, Homo sapiens
tgtcctgtgattccagctcttc

SEQ ID NO: 7736013 - DNA, 22 bp, Homo sapiens
tgtcctgtaggaggcagaacaa

SEQ ID NO: 7736014 - DNA, 22 bp, Homo sapiens
tgtcctggggacaagaggccct

SEQ ID NO: 7736015 - DNA, 22 bp, Homo sapiens
tgtcctggggcgacttggggcc

SEQ ID NO: 7736016 - DNA, 22 bp, Homo sapiens
tgtcctgggtcaaatcctggtc

SEQ ID NO: 7736017 - DNA, 22 bp, Homo sapiens
tgtcctgggaatgggatgcagt

SEQ ID NO: 7736018 - DNA, 22 bp, Homo sapiens
tgtcctgggaggcggggtccag

SEQ ID NO: 7736019 - DNA, 22 bp, Homo sapiens
tgtccaatgccctttccacatg

SEQ ID NO: 7736020 - DNA, 22 bp, Homo sapiens
tgtcactttggggagagttttg

SEQ ID NO: 7736021 - DNA, 17 bp, Homo sapiens
tgtagcttctccttctc

SEQ ID NO: 7736022 - DNA, 19 bp, Homo sapiens
tgtagcagtttaaaacaac

SEQ ID NO: 7736023 - DNA, 22 bp, Homo sapiens
tgtagcagagtatctctgtttt

SEQ ID NO: 7736024 - DNA, 22 bp, Homo sapiens
tgtagcagtgtctaccacatta

SEQ ID NO: 7736025 - DNA, 22 bp, Homo sapiens
tgtagattttggagtctacaag

SEQ ID NO: 7736026 - DNA, 22 bp, Homo sapiens
tgtagaaaattggagcattcat

SEQ ID NO: 7736027 - DNA, 22 bp, Homo sapiens
tgtcacagtctcgtgagcatct

SEQ ID NO: 7736028 - DNA, 22 bp, Homo sapiens
tgtcaaactgtgacttctaatg

SEQ ID NO: 7736029 - DNA, 22 bp, Homo sapiens
tgtcaatgaagatatgaataat

SEQ ID NO: 7736030 - DNA, 22 bp, Homo sapiens
tgtaaaaggaaatcaaagcact

SEQ ID NO: 7736031 - DNA, 22 bp, Homo sapiens
tgtaaaagacatttctaagcaa

SEQ ID NO: 7736032 - DNA, 23 bp, Homo sapiens
tgtaaaagcatttgtcagcctgg

SEQ ID NO: 7736033 - DNA, 22 bp, Homo sapiens
tggtttctttccactctccacc

SEQ ID NO: 7736034 - DNA, 22 bp, Homo sapiens
tgtaaataatgcatgtaaatca

SEQ ID NO: 7736035 - DNA, 22 bp, Homo sapiens
tgtaaagagaatggtatatgga

SEQ ID NO: 7736036 - DNA, 23 bp, Homo sapiens
tggtggggtcttggagacagcac

SEQ ID NO: 7736037 - DNA, 23 bp, Homo sapiens
tggtggggtcttggagacagcac

SEQ ID NO: 7736038 - DNA, 22 bp, Homo sapiens
tggtggggtcatcgtcagatgc

SEQ ID NO: 7736039 - DNA, 22 bp, Homo sapiens
tggtttctgggtttgtctagga

SEQ ID NO: 7736040 - DNA, 22 bp, Homo sapiens
tggtttctgccctcagagctca

SEQ ID NO: 7736041 - DNA, 22 bp, Homo sapiens
tggtttctctgaactctacgac

SEQ ID NO: 7736042 - DNA, 22 bp, Homo sapiens
tggtttctcagactctttgcag

SEQ ID NO: 7736043 - DNA, 22 bp, Homo sapiens
tgtacagattgatcatggagag

SEQ ID NO: 7736044 - DNA, 23 bp, Homo sapiens
tgtaacttcttaaattcttcact

SEQ ID NO: 7736045 - DNA, 16 bp, Homo sapiens
tggtggggaggacagc

SEQ ID NO: 7736046 - DNA, 22 bp, Homo sapiens
tggtggcagctgggacagaggt

SEQ ID NO: 7736047 - DNA, 22 bp, Homo sapiens
tggtggcagcaggagggcccct

SEQ ID NO: 7736048 - DNA, 23 bp, Homo sapiens
tggtggcagaagtagcagatgac

SEQ ID NO: 7736049 - DNA, 22 bp, Homo sapiens
tggtggcacaagggagagaatc

SEQ ID NO: 7736050 - DNA, 22 bp, Homo sapiens
tggtggcaatgtcctggagaag

SEQ ID NO: 7736051 - DNA, 22 bp, Homo sapiens
tggtggcaaatcaggacacttc

SEQ ID NO: 7736052 - DNA, 22 bp, Homo sapiens
tggtcaggggcttctgagctgt

SEQ ID NO: 7736053 - DNA, 22 bp, Homo sapiens
tggtcaggctgctctgcggcgt

SEQ ID NO: 7736054 - DNA, 20 bp, Homo sapiens
tggtcctcacatgccatctt

SEQ ID NO: 7736055 - DNA, 22 bp, Homo sapiens
tggtcctgatcaccgctgggca

SEQ ID NO: 7736056 - DNA, 22 bp, Homo sapiens
tggtcctgcagtaatagacatc

SEQ ID NO: 7736057 - DNA, 22 bp, Homo sapiens
tggtcctgaggcttgtttccac

SEQ ID NO: 7736058 - DNA, 22 bp, Homo sapiens
tggtcctgagcaccagcctgac

SEQ ID NO: 7736059 - DNA, 22 bp, Homo sapiens
tggtcctgagaatcctgtcctc

SEQ ID NO: 7736060 - DNA, 22 bp, Homo sapiens
tggtcctgccccgtgcacagag

SEQ ID NO: 7736061 - DNA, 22 bp, Homo sapiens
tggtcctgcccacgcccatctg

SEQ ID NO: 7736062 - DNA, 23 bp, Homo sapiens
tggtcctgccaacggtgcccctc

SEQ ID NO: 7736063 - DNA, 22 bp, Homo sapiens
tggtcctgcttgctgcttaaga

SEQ ID NO: 7736064 - DNA, 22 bp, Homo sapiens
tggtcctgctacaggggattag

SEQ ID NO: 7736065 - DNA, 22 bp, Homo sapiens
tggtcctggaaggtcctgaggg

SEQ ID NO: 7736066 - DNA, 22 bp, Homo sapiens
tggtcctggagagtgttccata

SEQ ID NO: 7736067 - DNA, 22 bp, Homo sapiens
tggtcctggagatcaatatgca

SEQ ID NO: 7736068 - DNA, 22 bp, Homo sapiens
tggtcctggccttgaccccagg

SEQ ID NO: 7736069 - DNA, 22 bp, Homo sapiens
tggtcctgggcacagtatatgc

SEQ ID NO: 7736070 - DNA, 22 bp, Homo sapiens
tggtctctgtgctcgggcatgg

SEQ ID NO: 7736071 - DNA, 22 bp, Homo sapiens
tggtcctggtcatctgggctgg

SEQ ID NO: 7736072 - DNA, 22 bp, Homo sapiens
tggtcctggtagcggtgtgctt

SEQ ID NO: 7736073 - DNA, 22 bp, Homo sapiens
tggtcctggtgcaagtgcattt

SEQ ID NO: 7736074 - DNA, 22 bp, Homo sapiens
tggtcctggggatctgcagtga

SEQ ID NO: 7736075 - DNA, 22 bp, Homo sapiens
tggtcctggggtgcaggctgac

SEQ ID NO: 7736076 - DNA, 23 bp, Homo sapiens
tggtcctggttgaggtgggcccc

SEQ ID NO: 7736077 - DNA, 22 bp, Homo sapiens
tggtcctgtagcacttgattag

SEQ ID NO: 7736078 - DNA, 22 bp, Homo sapiens
tggtcctgtagctctctaagtt

SEQ ID NO: 7736079 - DNA, 20 bp, Homo sapiens
tggtcctgtcccacccactc

SEQ ID NO: 7736080 - DNA, 22 bp, Homo sapiens
tggtcctgtgttcttcctgcct

SEQ ID NO: 7736081 - DNA, 22 bp, Homo sapiens
tggtcctgtctcaaggagcctt

SEQ ID NO: 7736082 - DNA, 22 bp, Homo sapiens
tggtcctttaagtctttctctg

SEQ ID NO: 7736083 - DNA, 22 bp, Homo sapiens
tggtccttcttgaagagtgagt

SEQ ID NO: 7736084 - DNA, 21 bp, Homo sapiens
tggtccttctttactgcctcc

SEQ ID NO: 7736085 - DNA, 22 bp, Homo sapiens
tggtccttgctatagagtgata

SEQ ID NO: 7736086 - DNA, 22 bp, Homo sapiens
ttcaggaatcaaccaagtcatt

SEQ ID NO: 7736087 - DNA, 17 bp, Homo sapiens
ttccagcatgttactaa

SEQ ID NO: 7736088 - DNA, 22 bp, Homo sapiens
ttccagatgtttaagttctgct

SEQ ID NO: 7736089 - DNA, 22 bp, Homo sapiens
ttccagatatttttatgtggaa

SEQ ID NO: 7736090 - DNA, 22 bp, Homo sapiens
ttccaggaaaacagttggaagt

SEQ ID NO: 7736091 - DNA, 22 bp, Homo sapiens
ttcaggaaatgtctgcctacca

SEQ ID NO: 7736092 - DNA, 22 bp, Homo sapiens
ttcaggaaattggagtccttct

SEQ ID NO: 7736093 - DNA, 22 bp, Homo sapiens
ttcaggaagtgctgcctggtgt

SEQ ID NO: 7736094 - DNA, 19 bp, Homo sapiens
ttatgaatagcttcatcca

SEQ ID NO: 7736095 - DNA, 22 bp, Homo sapiens
ttagtgcaattcagagaacaat

SEQ ID NO: 7736096 - DNA, 22 bp, Homo sapiens
ttagtgcaaacctcagagacac

SEQ ID NO: 7736097 - DNA, 22 bp, Homo sapiens
ttagataatgtagagatatgag

SEQ ID NO: 7736098 - DNA, 22 bp, Homo sapiens
ttagataatgttattgtaattt

SEQ ID NO: 7736099 - DNA, 22 bp, Homo sapiens
ttagataacagtagaatatcaa

SEQ ID NO: 7736100 - DNA, 22 bp, Homo sapiens
ttagaaaggttttgctctgaaa

SEQ ID NO: 7736101 - DNA, 22 bp, Homo sapiens
ttagaaatcacctctgaagatc

SEQ ID NO: 7736102 - DNA, 22 bp, Homo sapiens
ttagaaatgtcacagatctgat

SEQ ID NO: 7736103 - DNA, 22 bp, Homo sapiens
ttagcagcaatggcatcaacta

SEQ ID NO: 7736104 - DNA, 22 bp, Homo sapiens
ttagggagctcagtcctcagat

SEQ ID NO: 7736105 - DNA, 22 bp, Homo sapiens
ttagtaaataaagtctactttc

SEQ ID NO: 7736106 - DNA, 22 bp, Homo sapiens
ttagggttacaccagcctcctg

SEQ ID NO: 7736107 - DNA, 22 bp, Homo sapiens
ttaataagtagtagttattgtt

SEQ ID NO: 7736108 - DNA, 22 bp, Homo sapiens
ttaaagcaggcatcattcctca

SEQ ID NO: 7736109 - DNA, 22 bp, Homo sapiens
ttaaagcactaaatgatgaggg

SEQ ID NO: 7736110 - DNA, 22 bp, Homo sapiens
ttaaagcagtttgtatacatgg

SEQ ID NO: 7736111 - DNA, 22 bp, Homo sapiens
ttaataaagtatgaattggaaa

SEQ ID NO: 7736112 - DNA, 22 bp, Homo sapiens
ttaaagcaaaaactaggatgga

SEQ ID NO: 7736113 - DNA, 22 bp, Homo sapiens
ttaaagcaaccatcaatttgga

SEQ ID NO: 7736114 - DNA, 22 bp, Homo sapiens
ttaaagcacctccttggatgtg

SEQ ID NO: 7736115 - DNA, 22 bp, Homo sapiens
ttaaagattctgaggctgatta

SEQ ID NO: 7736116 - DNA, 22 bp, Homo sapiens
ttaaagatgcagctttagagaa

SEQ ID NO: 7736117 - DNA, 22 bp, Homo sapiens
ttacaagacacagtgctgaagg

SEQ ID NO: 7736118 - DNA, 22 bp, Homo sapiens
ttacaacaaaggcacgtgcatg

SEQ ID NO: 7736119 - DNA, 22 bp, Homo sapiens
ttacaagattgatttgcttggc

SEQ ID NO: 7736120 - DNA, 22 bp, Homo sapiens
ttacaagattaattattggagt

SEQ ID NO: 7736121 - DNA, 22 bp, Homo sapiens
ttacaagatgggaaagggaagt

SEQ ID NO: 7736122 - DNA, 22 bp, Homo sapiens
ttacaagatatgtgagaactag

SEQ ID NO: 7736123 - DNA, 22 bp, Homo sapiens
ttacaagatctttgaaggcaag

SEQ ID NO: 7736124 - DNA, 22 bp, Homo sapiens
ttacaagacactgctgacacag

SEQ ID NO: 7736125 - DNA, 22 bp, Homo sapiens
ttacaagacagtgtggtaaata

SEQ ID NO: 7736126 - DNA, 22 bp, Homo sapiens
ttacaagataacggagaaagca

SEQ ID NO: 7736127 - DNA, 22 bp, Homo sapiens
ttacaagataacctgatgctgt

SEQ ID NO: 7736128 - DNA, 22 bp, Homo sapiens
ttacagcagtgggaaggagtca

SEQ ID NO: 7736129 - DNA, 22 bp, Homo sapiens
tgtgtgcatgttaatgagaaaa

SEQ ID NO: 7736130 - DNA, 22 bp, Homo sapiens
tgtgtacacaatgattgcagag

SEQ ID NO: 7736131 - DNA, 19 bp, Homo sapiens
tgtggctgagcactcctta

SEQ ID NO: 7736132 - DNA, 22 bp, Homo sapiens
tgtggctgatcaaagcgctcag

SEQ ID NO: 7736133 - DNA, 21 bp, Homo sapiens
tgtggctgacaccctttggga

SEQ ID NO: 7736134 - DNA, 23 bp, Homo sapiens
tgtggctgagaaattgacaactt

SEQ ID NO: 7736135 - DNA, 22 bp, Homo sapiens
tgtggctgactcctggtcccca

SEQ ID NO: 7736136 - DNA, 22 bp, Homo sapiens
tgtggaatgctcctaagtgaat

SEQ ID NO: 7736137 - DNA, 22 bp, Homo sapiens
tgtggccttgcagcctggaggt

SEQ ID NO: 7736138 - DNA, 22 bp, Homo sapiens
tgtggctgcagacactggagcc

SEQ ID NO: 7736139 - DNA, 22 bp, Homo sapiens
tgtggctgcaggcgatggagga

SEQ ID NO: 7736140 - DNA, 22 bp, Homo sapiens
tgtggctgcaaaggaaggctgc

SEQ ID NO: 7736141 - DNA, 22 bp, Homo sapiens
tgtgggaagatgttgcaggaga

SEQ ID NO: 7736142 - DNA, 22 bp, Homo sapiens
tgtggctgccaccctgaagccg

SEQ ID NO: 7736143 - DNA, 22 bp, Homo sapiens
ttaaaagacctgttgaggttag

SEQ ID NO: 7736144 - DNA, 22 bp, Homo sapiens
ttaaaagagacttcctttgttt

SEQ ID NO: 7736145 - DNA, 22 bp, Homo sapiens
ttaaaaaccatcttcctttcct

SEQ ID NO: 7736146 - DNA, 22 bp, Homo sapiens
tgttctttcagttagacacagt

SEQ ID NO: 7736147 - DNA, 22 bp, Homo sapiens
tgttaaatgtattatgtgttct

SEQ ID NO: 7736148 - DNA, 18 bp, Homo sapiens
tgttaaatgaagatttgc

SEQ ID NO: 7736149 - DNA, 22 bp, Homo sapiens
tgttaaatgagattggaatttg

SEQ ID NO: 7736150 - DNA, 22 bp, Homo sapiens
tgttaaattgattcacctttct

SEQ ID NO: 7736151 - DNA, 22 bp, Homo sapiens
tgtttaaatagaacatactgca

SEQ ID NO: 7736152 - DNA, 22 bp, Homo sapiens
tgtgcctggcattctgggcttc

SEQ ID NO: 7736153 - DNA, 22 bp, Homo sapiens
tgtgcctggagtccctgaggag

SEQ ID NO: 7736154 - DNA, 22 bp, Homo sapiens
tgtgcctgatggtcacgtggcc

SEQ ID NO: 7736155 - DNA, 22 bp, Homo sapiens
tgtgcctgtgacagcgacctgg

SEQ ID NO: 7736156 - DNA, 22 bp, Homo sapiens
tgtgcctgttcccactttgcct

SEQ ID NO: 7736157 - DNA, 22 bp, Homo sapiens
tgtgctgctctcagtgacagcc

SEQ ID NO: 7736158 - DNA, 22 bp, Homo sapiens
tgtgcacataaaacagtactag

SEQ ID NO: 7736159 - DNA, 22 bp, Homo sapiens
tgtgactgagctgcagagtgtc

SEQ ID NO: 7736160 - DNA, 22 bp, Homo sapiens
tgtgactggagtccagcccact

SEQ ID NO: 7736161 - DNA, 22 bp, Homo sapiens
tgtgaccataatttgtaaataa

SEQ ID NO: 7736162 - DNA, 23 bp, Homo sapiens
tgtgaattgaggacatcaaaagc

SEQ ID NO: 7736163 - DNA, 22 bp, Homo sapiens
tgtcttcaaatattgaaatcct

SEQ ID NO: 7736164 - DNA, 22 bp, Homo sapiens
tgtctgggagggacagggctac

SEQ ID NO: 7736165 - DNA, 23 bp, Homo sapiens
tgtctggctcatggtgggtctca

SEQ ID NO: 7736166 - DNA, 22 bp, Homo sapiens
tgtctggcatagttgctccctg

SEQ ID NO: 7736167 - DNA, 22 bp, Homo sapiens
tgtcttcaggagtaaatatcat

SEQ ID NO: 7736168 - DNA, 22 bp, Homo sapiens
tgtcttcagtaaaatacactat

SEQ ID NO: 7736169 - DNA, 21 bp, Homo sapiens
tgtcttcatatgagatggtgt

SEQ ID NO: 7736170 - DNA, 22 bp, Homo sapiens
tgtcttcatctccatgcacaga

SEQ ID NO: 7736171 - DNA, 22 bp, Homo sapiens
tgtctgaagcagccagtgctgt

SEQ ID NO: 7736172 - DNA, 22 bp, Homo sapiens
tgtctgaactgcactgaaagac

SEQ ID NO: 7736173 - DNA, 22 bp, Homo sapiens
tgtctgaacgaagtaggtccac

SEQ ID NO: 7736174 - DNA, 22 bp, Homo sapiens
tgtctgaacaaactctgcctcc

SEQ ID NO: 7736175 - DNA, 22 bp, Homo sapiens
tgtctgaattcaagaaattcaa

SEQ ID NO: 7736176 - DNA, 22 bp, Homo sapiens
tgtctgaatctcggtttcctca

SEQ ID NO: 7736177 - DNA, 22 bp, Homo sapiens
tgtctgaatcgcttcctagagg

SEQ ID NO: 7736178 - DNA, 22 bp, Homo sapiens
tgtctgaaggcaggtggagaac

SEQ ID NO: 7736179 - DNA, 22 bp, Homo sapiens
tgtctgaggaagtcagcccttt

SEQ ID NO: 7736180 - DNA, 22 bp, Homo sapiens
tgtctgaattttggaatcaagt

SEQ ID NO: 7736181 - DNA, 22 bp, Homo sapiens
tgtctgagtggtgcaaggctga

SEQ ID NO: 7736182 - DNA, 22 bp, Homo sapiens
tgtctgcagaagatggcatggg

SEQ ID NO: 7736183 - DNA, 19 bp, Homo sapiens
tgtctctgaaagatgagct

SEQ ID NO: 7736184 - DNA, 22 bp, Homo sapiens
tgtctctgaaatatgtggctcc

SEQ ID NO: 7736185 - DNA, 22 bp, Homo sapiens
tgtctctgctttccttgcaggg

SEQ ID NO: 7736186 - DNA, 20 bp, Homo sapiens
tgtctgaaaaggaagctatc

SEQ ID NO: 7736187 - DNA, 22 bp, Homo sapiens
tgtctgaaacttggtcctatgc

SEQ ID NO: 7736188 - DNA, 22 bp, Homo sapiens
tgtctgaaagaggacgagctgg

SEQ ID NO: 7736189 - DNA, 22 bp, Homo sapiens
tgtctgaaacttggtcctatgc

SEQ ID NO: 7736190 - DNA, 23 bp, Homo sapiens
agcaggcatctgtggcacaaggc

SEQ ID NO: 7736191 - DNA, 19 bp, Homo sapiens
agcaggcaggtggcccagg

SEQ ID NO: 7736192 - DNA, 22 bp, Homo sapiens
agcaggcatagagtagcactca

SEQ ID NO: 7736193 - DNA, 22 bp, Homo sapiens
agcagctgaccagtgagtcctg

SEQ ID NO: 7736194 - DNA, 17 bp, Homo sapiens
agcagctgaagcagcca

SEQ ID NO: 7736195 - DNA, 22 bp, Homo sapiens
agcagctcttaacaaagcatgg

SEQ ID NO: 7736196 - DNA, 22 bp, Homo sapiens
agcagctctgtttacctggagg

SEQ ID NO: 7736197 - DNA, 22 bp, Homo sapiens
agcagctcggccagtcaccagg

SEQ ID NO: 7736198 - DNA, 22 bp, Homo sapiens
agcagctctgagaggccagcac

SEQ ID NO: 7736199 - DNA, 22 bp, Homo sapiens
agcagctgagatggtaagattc

SEQ ID NO: 7736200 - DNA, 22 bp, Homo sapiens
acacagaacctcatagcctctc

SEQ ID NO: 7736201 - DNA, 22 bp, Homo sapiens
agcagcatacacatcatgttga

SEQ ID NO: 7736202 - DNA, 23 bp, Homo sapiens
acacagaagaagacccaaggaag

SEQ ID NO: 7736203 - DNA, 22 bp, Homo sapiens
acacacttgcagagaggaggga

SEQ ID NO: 7736204 - DNA, 22 bp, Homo sapiens
agcagcagattcagcaggaatg

SEQ ID NO: 7736205 - DNA, 22 bp, Homo sapiens
acacacagaaggaagccccact

SEQ ID NO: 7736206 - DNA, 22 bp, Homo sapiens
agatttgttgtgagcaggaata

SEQ ID NO: 7736207 - DNA, 22 bp, Homo sapiens
agatttgtatgtctaaatgtaa

SEQ ID NO: 7736208 - DNA, 22 bp, Homo sapiens
agcctgtctgtctccaaagctg

SEQ ID NO: 7736209 - DNA, 22 bp, Homo sapiens
agcctgtgtgctttggacaggg

SEQ ID NO: 7736210 - DNA, 22 bp, Homo sapiens
agccctgggtcccagtcctggc

SEQ ID NO: 7736211 - DNA, 22 bp, Homo sapiens
agccctggtagcctgctgccat

SEQ ID NO: 7736212 - DNA, 22 bp, Homo sapiens
agcatgaaaacatgaaacagca

SEQ ID NO: 7736213 - DNA, 22 bp, Homo sapiens
agcattccacactgaagtctgc

SEQ ID NO: 7736214 - DNA, 22 bp, Homo sapiens
agagatcagttaaaatcttttt

SEQ ID NO: 7736215 - DNA, 23 bp, Homo sapiens
agagagagtttgtgtcaggtacc

SEQ ID NO: 7736216 - DNA, 23 bp, Homo sapiens
agactgaggctgccagggtcaga

SEQ ID NO: 7736217 - DNA, 22 bp, Homo sapiens
agactgggccatttccccagct

SEQ ID NO: 7736218 - DNA, 22 bp, Homo sapiens
agactgggattctccctgatca

SEQ ID NO: 7736219 - DNA, 19 bp, Homo sapiens
agagaaagaattgagtcta

SEQ ID NO: 7736220 - DNA, 23 bp, Homo sapiens
agagaaagggataacacgttgaa

SEQ ID NO: 7736221 - DNA, 22 bp, Homo sapiens
agaatttaggatgcatgtgaat

SEQ ID NO: 7736222 - DNA, 22 bp, Homo sapiens
aatgtacactgaaagcctatca

SEQ ID NO: 7736223 - DNA, 22 bp, Homo sapiens
aatgaaaattggaccctagaac

SEQ ID NO: 7736224 - DNA, 22 bp, Homo sapiens
aatggagaccctaaggaagagg

SEQ ID NO: 7736225 - DNA, 21 bp, Homo sapiens
agaggcaggcattaagtacac

SEQ ID NO: 7736226 - DNA, 22 bp, Homo sapiens
agagcagctgtgacatggacag

SEQ ID NO: 7736227 - DNA, 22 bp, Homo sapiens
agagcagcttttcggaaccact

SEQ ID NO: 7736228 - DNA, 22 bp, Homo sapiens
agagcagctggggcagagacca

SEQ ID NO: 7736229 - DNA, 22 bp, Homo sapiens
agagcagctggctgcatctaga

SEQ ID NO: 7736230 - DNA, 22 bp, Homo sapiens
aattcacatatacattattcct

SEQ ID NO: 7736231 - DNA, 22 bp, Homo sapiens
aattcacatgttgaagtcctaa

SEQ ID NO: 7736232 - DNA, 22 bp, Homo sapiens
agagcagctgcattcagcacct

SEQ ID NO: 7736233 - DNA, 18 bp, Homo sapiens
agagcagcggcatcacac

SEQ ID NO: 7736234 - DNA, 22 bp, Homo sapiens
agagcagcgtttgtggaacact

SEQ ID NO: 7736235 - DNA, 22 bp, Homo sapiens
agagggccataggtgcatagtt

SEQ ID NO: 7736236 - DNA, 22 bp, Homo sapiens
agagggcataaaatagagcacg

SEQ ID NO: 7736237 - DNA, 21 bp, Homo sapiens
aattttgaaggaagattaagg

SEQ ID NO: 7736238 - DNA, 22 bp, Homo sapiens
aatttcaagtggcatctttgat

SEQ ID NO: 7736239 - DNA, 22 bp, Homo sapiens
agaggccaatagtaggtggcat

SEQ ID NO: 7736240 - DNA, 22 bp, Homo sapiens
agatctggaactgaggtttatt

SEQ ID NO: 7736241 - DNA, 22 bp, Homo sapiens
agatctggaaaatcacaggtgc

SEQ ID NO: 7736242 - DNA, 22 bp, Homo sapiens
agatctggttggagtcctgaca

SEQ ID NO: 7736243 - DNA, 22 bp, Homo sapiens
agatctggccctcagcttgatt

SEQ ID NO: 7736244 - DNA, 22 bp, Homo sapiens
agatctggttggagtcctgaca

SEQ ID NO: 7736245 - DNA, 22 bp, Homo sapiens
agatgttttggagacactaacc

SEQ ID NO: 7736246 - DNA, 22 bp, Homo sapiens
agatggtaatcacatttatctg

SEQ ID NO: 7736247 - DNA, 22 bp, Homo sapiens
agatctgaatctcatccgagga

SEQ ID NO: 7736248 - DNA, 21 bp, Homo sapiens
agagtctgcatttctgacaag

SEQ ID NO: 7736249 - DNA, 23 bp, Homo sapiens
agagtaatgtttttactgtattc

SEQ ID NO: 7736250 - DNA, 22 bp, Homo sapiens
agagtctgttacttgtccccta

SEQ ID NO: 7736251 - DNA, 22 bp, Homo sapiens
agataattatgtcaatttcttg

SEQ ID NO: 7736252 - DNA, 20 bp, Homo sapiens
agaggttcagtctggagaag

SEQ ID NO: 7736253 - DNA, 20 bp, Homo sapiens
acaggagatctgaggaaagg

SEQ ID NO: 7736254 - DNA, 21 bp, Homo sapiens
acagattttatatctctgctg

SEQ ID NO: 7736255 - DNA, 22 bp, Homo sapiens
acagattttggtatttgcaatg

SEQ ID NO: 7736256 - DNA, 22 bp, Homo sapiens
acagatttggcccagccaatgc

SEQ ID NO: 7736257 - DNA, 20 bp, Homo sapiens
acagatgaggaaaatgaagt

SEQ ID NO: 7736258 - DNA, 22 bp, Homo sapiens
acagatgaggaagagtcagcca

SEQ ID NO: 7736259 - DNA, 22 bp, Homo sapiens
acagatgaggaaacagggtcag

SEQ ID NO: 7736260 - DNA, 22 bp, Homo sapiens
acagatgaggaatttatttggt

SEQ ID NO: 7736261 - DNA, 22 bp, Homo sapiens
acaggtgtcctcacagggggtg

SEQ ID NO: 7736262 - DNA, 20 bp, Homo sapiens
acagtgcatggggggacagc

SEQ ID NO: 7736263 - DNA, 19 bp, Homo sapiens
acagtgcatgggacctggt

SEQ ID NO: 7736264 - DNA, 22 bp, Homo sapiens
acagtgcattattgctgaatgc

SEQ ID NO: 7736265 - DNA, 22 bp, Homo sapiens
acagtgcaggtctcaacaatta

SEQ ID NO: 7736266 - DNA, 22 bp, Homo sapiens
acagtgcataaaaacaactttt

SEQ ID NO: 7736267 - DNA, 22 bp, Homo sapiens
acagtgcagtgtgatgagtatt

SEQ ID NO: 7736268 - DNA, 18 bp, Homo sapiens
acagtggtttgatgtgct

SEQ ID NO: 7736269 - DNA, 20 bp, Homo sapiens
acagtgggtggggagcactg

SEQ ID NO: 7736270 - DNA, 22 bp, Homo sapiens
acaggtctgtgtgcacagtgct

SEQ ID NO: 7736271 - DNA, 22 bp, Homo sapiens
acaggtctggtctgggtgggac

SEQ ID NO: 7736272 - DNA, 22 bp, Homo sapiens
acaggtctccagagtgagagga

SEQ ID NO: 7736273 - DNA, 22 bp, Homo sapiens
acaggtctgcagtaactgggaa

SEQ ID NO: 7736274 - DNA, 22 bp, Homo sapiens
acaggtctactggcaagcagtg

SEQ ID NO: 7736275 - DNA, 21 bp, Homo sapiens
acaggctttagaaaatgactc

SEQ ID NO: 7736276 - DNA, 22 bp, Homo sapiens
acaggctgccacttgcatccaa

SEQ ID NO: 7736277 - DNA, 22 bp, Homo sapiens
acaggcttggggctcagacaga

SEQ ID NO: 7736278 - DNA, 22 bp, Homo sapiens
accacccagccagcttctccct

SEQ ID NO: 7736279 - DNA, 22 bp, Homo sapiens
accacccccttgggtgtggaag

SEQ ID NO: 7736280 - DNA, 22 bp, Homo sapiens
accacccccttgggtgtggaag

SEQ ID NO: 7736281 - DNA, 22 bp, Homo sapiens
accaccccagaatttttcaagg

SEQ ID NO: 7736282 - DNA, 22 bp, Homo sapiens
accaccccaaatgaacctctgt

SEQ ID NO: 7736283 - DNA, 22 bp, Homo sapiens
acattctgtcaacagtgagcag

SEQ ID NO: 7736284 - DNA, 22 bp, Homo sapiens
acattctgtgagtcatgtttta

SEQ ID NO: 7736285 - DNA, 22 bp, Homo sapiens
acattctgtttccccaaagaga

SEQ ID NO: 7736286 - DNA, 22 bp, Homo sapiens
acattttgcccttatttgctga

SEQ ID NO: 7736287 - DNA, 22 bp, Homo sapiens
aaggtttttttccagtatctct

SEQ ID NO: 7736288 - DNA, 22 bp, Homo sapiens
aaggtttttttccagtatctct

SEQ ID NO: 7736289 - DNA, 22 bp, Homo sapiens
acattcaaaaagcatctgtcac

SEQ ID NO: 7736290 - DNA, 22 bp, Homo sapiens
acattatccctggcacaactgc

SEQ ID NO: 7736291 - DNA, 23 bp, Homo sapiens
acattacttagccagagtctcag

SEQ ID NO: 7736292 - DNA, 22 bp, Homo sapiens
acattctgaaaaacagtgtttt

SEQ ID NO: 7736293 - DNA, 17 bp, Homo sapiens
acatgggctgagactcc

SEQ ID NO: 7736294 - DNA, 22 bp, Homo sapiens
aataaaatggtcagttttctca

SEQ ID NO: 7736295 - DNA, 22 bp, Homo sapiens
aataaagacaaacaggggagcc

SEQ ID NO: 7736296 - DNA, 22 bp, Homo sapiens
aataaatgtttgttggatgttt

SEQ ID NO: 7736297 - DNA, 22 bp, Homo sapiens
aataaatgaacaaagcaggttg

SEQ ID NO: 7736298 - DNA, 22 bp, Homo sapiens
actcagtggcactttggaattt

SEQ ID NO: 7736299 - DNA, 22 bp, Homo sapiens
actcagtgggcttgatgtcgaa

SEQ ID NO: 7736300 - DNA, 23 bp, Homo sapiens
actcagtgaagcaaacagatagt

SEQ ID NO: 7736301 - DNA, 22 bp, Homo sapiens
actcagtgaattttcatcaaat

SEQ ID NO: 7736302 - DNA, 23 bp, Homo sapiens
actcagtgagggccttgggctgc

SEQ ID NO: 7736303 - DNA, 22 bp, Homo sapiens
actcatgtcctaggagtaaagc

SEQ ID NO: 7736304 - DNA, 22 bp, Homo sapiens
aagtttgtggttatacttgatt

SEQ ID NO: 7736305 - DNA, 22 bp, Homo sapiens
aagtttggggagaatttcattt

SEQ ID NO: 7736306 - DNA, 22 bp, Homo sapiens
aagtaaatatctgtttatagca

SEQ ID NO: 7736307 - DNA, 21 bp, Homo sapiens
aagtaaatcagagaaataacc

SEQ ID NO: 7736308 - DNA, 22 bp, Homo sapiens
aagtgagtgaaaatgcagaata

SEQ ID NO: 7736309 - DNA, 22 bp, Homo sapiens
aagtgactatttgagtacatca

SEQ ID NO: 7736310 - DNA, 22 bp, Homo sapiens
aagtgaatttcattccaattct

SEQ ID NO: 7736311 - DNA, 22 bp, Homo sapiens
aatctttttcacaagaaagcac

SEQ ID NO: 7736312 - DNA, 22 bp, Homo sapiens
aatatgcagcatgatgaagtaa

SEQ ID NO: 7736313 - DNA, 22 bp, Homo sapiens
acttagtgccctggcccttaca

SEQ ID NO: 7736314 - DNA, 22 bp, Homo sapiens
acttataagagtgctatgggga

SEQ ID NO: 7736315 - DNA, 20 bp, Homo sapiens
acttagtgtagggttcctag

SEQ ID NO: 7736316 - DNA, 22 bp, Homo sapiens
acttagtggctatgtgacctta

SEQ ID NO: 7736317 - DNA, 19 bp, Homo sapiens
actgtgctcgggaaccact

SEQ ID NO: 7736318 - DNA, 22 bp, Homo sapiens
aatactttcctatataaggtgc

SEQ ID NO: 7736319 - DNA, 22 bp, Homo sapiens
aagagcctggctgctaggctca

SEQ ID NO: 7736320 - DNA, 22 bp, Homo sapiens
aagaggagaaaggctggctttg

SEQ ID NO: 7736321 - DNA, 22 bp, Homo sapiens
aagaggaagtctccatggagag

SEQ ID NO: 7736322 - DNA, 22 bp, Homo sapiens
aagaggaatgggtgtgtttatg

SEQ ID NO: 7736323 - DNA, 22 bp, Homo sapiens
aagaatggtggtggggccagca

SEQ ID NO: 7736324 - DNA, 22 bp, Homo sapiens
aagaaagggctattgttctcca

SEQ ID NO: 7736325 - DNA, 22 bp, Homo sapiens
aagaaaggtgtgtttgcagatg

SEQ ID NO: 7736326 - DNA, 22 bp, Homo sapiens
aagaagttaggtgtaacaatat

SEQ ID NO: 7736327 - DNA, 22 bp, Homo sapiens
aagaagttaataatggtgagaa

SEQ ID NO: 7736328 - DNA, 22 bp, Homo sapiens
aagaaagggagaaggatggtgt

SEQ ID NO: 7736329 - DNA, 22 bp, Homo sapiens
aagaaaggatatatgggaggta

SEQ ID NO: 7736330 - DNA, 22 bp, Homo sapiens
aactttggccacaagtaccctg

SEQ ID NO: 7736331 - DNA, 22 bp, Homo sapiens
aagaggagacttcagcaacttg

SEQ ID NO: 7736332 - DNA, 18 bp, Homo sapiens
aagaggaggagcaggttg

SEQ ID NO: 7736333 - DNA, 22 bp, Homo sapiens
aagcaaagagtttagtgggtga

SEQ ID NO: 7736334 - DNA, 22 bp, Homo sapiens
aagcagatgcgttggagcagtt

SEQ ID NO: 7736335 - DNA, 22 bp, Homo sapiens
aagcagatctgatagggccctg

SEQ ID NO: 7736336 - DNA, 22 bp, Homo sapiens
aagcagatattgtgggagtggg

SEQ ID NO: 7736337 - DNA, 22 bp, Homo sapiens
aagcagcagccatcccccaagg

SEQ ID NO: 7736338 - DNA, 22 bp, Homo sapiens
aacagtatcttttatcagaaat

SEQ ID NO: 7736339 - DNA, 22 bp, Homo sapiens
aactaatacattaatacatgtg

SEQ ID NO: 7736340 - DNA, 22 bp, Homo sapiens
aactatgttaataagtttcatt

SEQ ID NO: 7736341 - DNA, 22 bp, Homo sapiens
aaagcaattacaaaagggataa

SEQ ID NO: 7736342 - DNA, 22 bp, Homo sapiens
aaagcaatgtctctgcctggtt

SEQ ID NO: 7736343 - DNA, 22 bp, Homo sapiens
aaagcaatggcacatgatggta

SEQ ID NO: 7736344 - DNA, 22 bp, Homo sapiens
aaatggtcactggtgagtgtca

SEQ ID NO: 7736345 - DNA, 22 bp, Homo sapiens
aaagcacagggtgctagagagt

SEQ ID NO: 7736346 - DNA, 22 bp, Homo sapiens
aacagctttgtatacagtaact

SEQ ID NO: 7736347 - DNA, 22 bp, Homo sapiens
aacagctttgcttctggagaca

SEQ ID NO: 7736348 - DNA, 22 bp, Homo sapiens
aacagcttttttggtcagcatt

SEQ ID NO: 7736349 - DNA, 22 bp, Homo sapiens
aacagctttgtgctcagatttg

SEQ ID NO: 7736350 - DNA, 22 bp, Homo sapiens
aacagctttagaggataatagt

SEQ ID NO: 7736351 - DNA, 22 bp, Homo sapiens
aacagcttgctgcaccttaata

SEQ ID NO: 7736352 - DNA, 22 bp, Homo sapiens
aacagctttgagcagttctgta

SEQ ID NO: 7736353 - DNA, 22 bp, Homo sapiens
aaacacagggatatatattcca

SEQ ID NO: 7736354 - DNA, 22 bp, Homo sapiens
aaacttgagtcacttctcttcc

SEQ ID NO: 7736355 - DNA, 22 bp, Homo sapiens
aaagaaggacctggaggaggat

SEQ ID NO: 7736356 - DNA, 22 bp, Homo sapiens
aaagatgtcacaagatgtgatg

SEQ ID NO: 7736357 - DNA, 22 bp, Homo sapiens
aaagatgatctacaagttcatt

SEQ ID NO: 7736358 - DNA, 22 bp, Homo sapiens
aaagatctccccttcaaagagt

SEQ ID NO: 7736359 - DNA, 22 bp, Homo sapiens
aaaaagactagtcgagtgcagt

SEQ ID NO: 7736360 - DNA, 22 bp, Homo sapiens
aaaaagacttccaactcaggag

SEQ ID NO: 7736361 - DNA, 22 bp, Homo sapiens
aaaaagacagaggatgaggcag

SEQ ID NO: 7736362 - DNA, 22 bp, Homo sapiens
aaaaagatagcattgtgctcct

SEQ ID NO: 7736363 - DNA, 21 bp, Homo sapiens
aaaaatgaagttgttcaggaa

SEQ ID NO: 7736364 - DNA, 19 bp, Homo sapiens
aaaagtctattcaattaca

SEQ ID NO: 7736365 - DNA, 22 bp, Homo sapiens
aaaagtattttggatctcagat

SEQ ID NO: 7736366 - DNA, 22 bp, Homo sapiens
aaaaatgaattcttcagtggca

SEQ ID NO: 7736367 - DNA, 22 bp, Homo sapiens
aaaatagattctaggatgtctt

SEQ ID NO: 7736368 - DNA, 22 bp, Homo sapiens
aaaatagatgaaaggaagtctg

SEQ ID NO: 7736369 - DNA, 22 bp, Homo sapiens
aaatagaattggaagcagagtt

SEQ ID NO: 7736370 - DNA, 22 bp, Homo sapiens
aaatagaaaccaacaaggtcag

SEQ ID NO: 7736371 - DNA, 22 bp, Homo sapiens
aaatgctctggggataagactg

SEQ ID NO: 7736372 - DNA, 22 bp, Homo sapiens
aaatattattgcttaaggggag

SEQ ID NO: 7736373 - DNA, 21 bp, Homo sapiens
aaatccaaacactagtccaca

SEQ ID NO: 7736374 - DNA, 22 bp, Homo sapiens
aaatcatgtgcagagatcagga

SEQ ID NO: 7736375 - DNA, 22 bp, Homo sapiens
aaagtgctgggattacaagtgt

SEQ ID NO: 7736376 - DNA, 22 bp, Homo sapiens
aaagtgctgggattacaagcgt

SEQ ID NO: 7736377 - DNA, 22 bp, Homo sapiens
aaagtgctgagattacaagcgt

SEQ ID NO: 7736378 - DNA, 22 bp, Homo sapiens
aaagtgctaggattacaagcgt

SEQ ID NO: 7736379 - DNA, 22 bp, Homo sapiens
aaagtgctcggattacaggtat

SEQ ID NO: 7736380 - DNA, 22 bp, Homo sapiens
aaagtgctgaaattacaggtgt

SEQ ID NO: 7736381 - DNA, 22 bp, Homo sapiens
aaagtgctgaaattacaggggt

SEQ ID NO: 7736382 - DNA, 22 bp, Homo sapiens
aaagtgctgggattacaggctt

SEQ ID NO: 7736383 - DNA, 22 bp, Homo sapiens
aaagtgctgggattacaggcgt

SEQ ID NO: 7736384 - DNA, 22 bp, Homo sapiens
aaagtgctgggattacaggcct

SEQ ID NO: 7736385 - DNA, 22 bp, Homo sapiens
aaagtgctgggattacaggcat

SEQ ID NO: 7736386 - DNA, 22 bp, Homo sapiens
aaagtgctgggattacaggtgt

SEQ ID NO: 7736387 - DNA, 22 bp, Homo sapiens
aaacatagataatagatagatg

SEQ ID NO: 7736388 - DNA, 22 bp, Homo sapiens
aaagtgccacaactggacaacc

SEQ ID NO: 7736389 - DNA, 22 bp, Homo sapiens
aaagcaatgcttgtggaatgta

SEQ ID NO: 7736390 - DNA, 22 bp, Homo sapiens
aaaggaggaatggagagatgct

SEQ ID NO: 7736391 - DNA, 22 bp, Homo sapiens
aaaggcctctgtcctagtgcct

SEQ ID NO: 7736392 - DNA, 22 bp, Homo sapiens
aaagcaatagtaatggtaatag

SEQ ID NO: 7736393 - DNA, 22 bp, Homo sapiens
aaagcaatcagattcagatgtc

SEQ ID NO: 7736394 - DNA, 22 bp, Homo sapiens
aaagcaatgcccgttcattatc

SEQ ID NO: 7736395 - DNA, 22 bp, Homo sapiens
aaagcaataggttaggtcaaga

SEQ ID NO: 7736396 - DNA, 22 bp, Homo sapiens
aaagatgtcagtttgaaataac

SEQ ID NO: 7736397 - DNA, 18 bp, Homo sapiens
acagaggcagacatgtat

SEQ ID NO: 7736398 - DNA, 22 bp, Homo sapiens
acagaggaaggctgagctgccc

SEQ ID NO: 7736399 - DNA, 22 bp, Homo sapiens
acagatgaattttaattgtgtt

SEQ ID NO: 7736400 - DNA, 23 bp, Homo sapiens
acagatgaaagtgtggctcagag

SEQ ID NO: 7736401 - DNA, 22 bp, Homo sapiens
acagatgaatttatggatggaa

SEQ ID NO: 7736402 - DNA, 22 bp, Homo sapiens
acagatgaaaaagcttgtggat

SEQ ID NO: 7736403 - DNA, 22 bp, Homo sapiens
aagatttggtatcagaagacct

SEQ ID NO: 7736404 - DNA, 22 bp, Homo sapiens
aagatatagataaaactatgca

SEQ ID NO: 7736405 - DNA, 22 bp, Homo sapiens
aagagtctattggaactagaca

SEQ ID NO: 7736406 - DNA, 20 bp, Homo sapiens
aagagtctttactgagctaa

SEQ ID NO: 7736407 - DNA, 22 bp, Homo sapiens
aagagtttaccagtgctgcttc

SEQ ID NO: 7736408 - DNA, 22 bp, Homo sapiens
aagagtttaattttgtctagac

SEQ ID NO: 7736409 - DNA, 22 bp, Homo sapiens
aagagttctcagaaacgtgggt

SEQ ID NO: 7736410 - DNA, 23 bp, Homo sapiens
aagagtttagagtcttgcagagt

SEQ ID NO: 7736411 - DNA, 23 bp, Homo sapiens
acacctgtgctgtagtcactaca

SEQ ID NO: 7736412 - DNA, 22 bp, Homo sapiens
aagaggaggattgatgtgggag

SEQ ID NO: 7736413 - DNA, 22 bp, Homo sapiens
aagaggagtagatgtggttggt

SEQ ID NO: 7736414 - DNA, 23 bp, Homo sapiens
aagaggaggccctgctcccgtcc

SEQ ID NO: 7736415 - DNA, 22 bp, Homo sapiens
aagaggagggcagattcaaggc

SEQ ID NO: 7736416 - DNA, 22 bp, Homo sapiens
acacacagagtttatacaggca

SEQ ID NO: 7736417 - DNA, 19 bp, Homo sapiens
aagagggaaagtgctatgc

SEQ ID NO: 7736418 - DNA, 22 bp, Homo sapiens
aattcacaaaaccagattgctt

SEQ ID NO: 7736419 - DNA, 20 bp, Homo sapiens
aattagatgtttaatcaata

SEQ ID NO: 7736420 - DNA, 22 bp, Homo sapiens
aattagaagctgttagcaaaat

SEQ ID NO: 7736421 - DNA, 22 bp, Homo sapiens
aattagaatcttatttggggaa

SEQ ID NO: 7736422 - DNA, 22 bp, Homo sapiens
aattagaagggagttattgata

SEQ ID NO: 7736423 - DNA, 22 bp, Homo sapiens
aattcaatctaagaaatgatca

SEQ ID NO: 7736424 - DNA, 22 bp, Homo sapiens
aatgtcaaagtgctttgcaaac

SEQ ID NO: 7736425 - DNA, 22 bp, Homo sapiens
aatgtcaaacagagcagagcta

SEQ ID NO: 7736426 - DNA, 22 bp, Homo sapiens
aatgtcaaaatggaatgagact

SEQ ID NO: 7736427 - DNA, 22 bp, Homo sapiens
aatgtcaaaggctatacattca

SEQ ID NO: 7736428 - DNA, 22 bp, Homo sapiens
aactttctgaaaagcttgatca

SEQ ID NO: 7736429 - DNA, 22 bp, Homo sapiens
aatgttacgatcaacaacacat

SEQ ID NO: 7736430 - DNA, 22 bp, Homo sapiens
aatgttacagttttaattctga

SEQ ID NO: 7736431 - DNA, 22 bp, Homo sapiens
aatgtgaactttgtcatgtaac

SEQ ID NO: 7736432 - DNA, 22 bp, Homo sapiens
aatgtgaaaccgcacagaataa

SEQ ID NO: 7736433 - DNA, 22 bp, Homo sapiens
aaggagaaatggtagatgtgca

SEQ ID NO: 7736434 - DNA, 22 bp, Homo sapiens
aagctttggaagggcagggttg

SEQ ID NO: 7736435 - DNA, 22 bp, Homo sapiens
aaggggaagtagcaccagaggt

SEQ ID NO: 7736436 - DNA, 22 bp, Homo sapiens
aaggggagatgtcatgggccct

SEQ ID NO: 7736437 - DNA, 22 bp, Homo sapiens
aaggggagttagtgataaaacc

SEQ ID NO: 7736438 - DNA, 22 bp, Homo sapiens
aagggagcaaatggacagacgg

SEQ ID NO: 7736439 - DNA, 22 bp, Homo sapiens
aagggagccaagaaagcagggc

SEQ ID NO: 7736440 - DNA, 22 bp, Homo sapiens
aagggaggaggatttattgtac

SEQ ID NO: 7736441 - DNA, 22 bp, Homo sapiens
aagggagcttaggagatcaggc

SEQ ID NO: 7736442 - DNA, 22 bp, Homo sapiens
aagggagcttaggagatcaggc

SEQ ID NO: 7736443 - DNA, 22 bp, Homo sapiens
aagtatgtctttgggtattatt

SEQ ID NO: 7736444 - DNA, 22 bp, Homo sapiens
aagtattctggcagtcattcag

SEQ ID NO: 7736445 - DNA, 22 bp, Homo sapiens
aagtattctacaaagaaattga

SEQ ID NO: 7736446 - DNA, 22 bp, Homo sapiens
aagtattcataaggacatatgt

SEQ ID NO: 7736447 - DNA, 22 bp, Homo sapiens
aagtattatttaacaaatttgt

SEQ ID NO: 7736448 - DNA, 22 bp, Homo sapiens
aagtcaaagctttcagaggaaa

SEQ ID NO: 7736449 - DNA, 22 bp, Homo sapiens
aagttcttgctgtgtgtcagat

SEQ ID NO: 7736450 - DNA, 22 bp, Homo sapiens
aagttcttggaggatgaagagt

SEQ ID NO: 7736451 - DNA, 22 bp, Homo sapiens
aagttctttctggaaggtctgc

SEQ ID NO: 7736452 - DNA, 22 bp, Homo sapiens
aagttcttgataagtccactgt

SEQ ID NO: 7736453 - DNA, 23 bp, Homo sapiens
aagttcttttagatgtcttcgtg

SEQ ID NO: 7736454 - DNA, 22 bp, Homo sapiens
aagttgagatgtcataggagac

SEQ ID NO: 7736455 - DNA, 22 bp, Homo sapiens
aacactgtaacagcatcatttt

SEQ ID NO: 7736456 - DNA, 20 bp, Homo sapiens
aagttacattgtattgtacc

SEQ ID NO: 7736457 - DNA, 22 bp, Homo sapiens
aagtttgatgagtttctggagg

SEQ ID NO: 7736458 - DNA, 21 bp, Homo sapiens
aagtttgggattcagtttcca

SEQ ID NO: 7736459 - DNA, 22 bp, Homo sapiens
aataaaatggtcagttttctca

SEQ ID NO: 7736460 - DNA, 22 bp, Homo sapiens
aacagtttgagctttgaatttc

SEQ ID NO: 7736461 - DNA, 20 bp, Homo sapiens
aataaactactgagagatgt

SEQ ID NO: 7736462 - DNA, 22 bp, Homo sapiens
aataaactgctcaattgcatca

SEQ ID NO: 7736463 - DNA, 22 bp, Homo sapiens
aatcacatgtgctcaattttaa

SEQ ID NO: 7736464 - DNA, 22 bp, Homo sapiens
aacattgttttccctatatcca

SEQ ID NO: 7736465 - DNA, 22 bp, Homo sapiens
aaccaggaattgcagggctgca

SEQ ID NO: 7736466 - DNA, 22 bp, Homo sapiens
aactccagggggtcaatattta

SEQ ID NO: 7736467 - DNA, 20 bp, Homo sapiens
aactcctagcctcaagtgat

SEQ ID NO: 7736468 - DNA, 22 bp, Homo sapiens
aaccaggtgactcatggtgagc

SEQ ID NO: 7736469 - DNA, 22 bp, Homo sapiens
aactcagttacatattagaata

SEQ ID NO: 7736470 - DNA, 22 bp, Homo sapiens
cagagccttagttctcctagaa

SEQ ID NO: 7736471 - DNA, 22 bp, Homo sapiens
agccctggaagccacagtccta

SEQ ID NO: 7736472 - DNA, 22 bp, Homo sapiens
agcccccaaaagtgcttatgat

SEQ ID NO: 7736473 - DNA, 22 bp, Homo sapiens
agccctgggcagccaaggaagc

SEQ ID NO: 7736474 - DNA, 22 bp, Homo sapiens
agccctgggatacagtaaaagc

SEQ ID NO: 7736475 - DNA, 22 bp, Homo sapiens
agctcctgcttgacagaagagg

SEQ ID NO: 7736476 - DNA, 22 bp, Homo sapiens
agctcctggacgaacagggagt

SEQ ID NO: 7736477 - DNA, 22 bp, Homo sapiens
agctcctggctttcctctcacc

SEQ ID NO: 7736478 - DNA, 22 bp, Homo sapiens
agctcctggcaaggtcatggtg

SEQ ID NO: 7736479 - DNA, 22 bp, Homo sapiens
agctcctgtggcagctcttctg

SEQ ID NO: 7736480 - DNA, 22 bp, Homo sapiens
agctcctgtctcaagggagcct

SEQ ID NO: 7736481 - DNA, 18 bp, Homo sapiens
agcctgggctctgcctgg

SEQ ID NO: 7736482 - DNA, 22 bp, Homo sapiens
agctactctgcagtgcccatgg

SEQ ID NO: 7736483 - DNA, 22 bp, Homo sapiens
agctactcagagttccactcta

SEQ ID NO: 7736484 - DNA, 22 bp, Homo sapiens
agcctgggcaacaacacagcga

SEQ ID NO: 7736485 - DNA, 22 bp, Homo sapiens
cagatgtagtagctttattgca

SEQ ID NO: 7736486 - DNA, 22 bp, Homo sapiens
cagatgtgcatgatgggaaggg

SEQ ID NO: 7736487 - DNA, 22 bp, Homo sapiens
cagatgtaattactcaagtcaa

SEQ ID NO: 7736488 - DNA, 20 bp, Homo sapiens
cagcaactttggactgagtt

SEQ ID NO: 7736489 - DNA, 23 bp, Homo sapiens
agcagccctgggacctggcctgc

SEQ ID NO: 7736490 - DNA, 22 bp, Homo sapiens
agcagcagatcaaacaggcttg

SEQ ID NO: 7736491 - DNA, 22 bp, Homo sapiens
agcagcagaggtcagaaaggta

SEQ ID NO: 7736492 - DNA, 17 bp, Homo sapiens
agcagctggcacaggag

SEQ ID NO: 7736493 - DNA, 22 bp, Homo sapiens
agcagctcagaggcaccagggc

SEQ ID NO: 7736494 - DNA, 22 bp, Homo sapiens
agcagctcaaagcctgcaagga

SEQ ID NO: 7736495 - DNA, 22 bp, Homo sapiens
agcagctagacttcagaatctg

SEQ ID NO: 7736496 - DNA, 21 bp, Homo sapiens
agcagaggcagaatgtatgca

SEQ ID NO: 7736497 - DNA, 22 bp, Homo sapiens
agcagagcgcctgctcagaggg

SEQ ID NO: 7736498 - DNA, 22 bp, Homo sapiens
agcacctgcttgtgactaggga

SEQ ID NO: 7736499 - DNA, 22 bp, Homo sapiens
agcacctggagggctgggacct

SEQ ID NO: 7736500 - DNA, 22 bp, Homo sapiens
caccagagttgtccaaatgatt

SEQ ID NO: 7736501 - DNA, 22 bp, Homo sapiens
agcaggaactcagggagttctc

SEQ ID NO: 7736502 - DNA, 21 bp, Homo sapiens
agcagctgggcaacatggagg

SEQ ID NO: 7736503 - DNA, 22 bp, Homo sapiens
cacagcaagagctaaatgacca

SEQ ID NO: 7736504 - DNA, 22 bp, Homo sapiens
cacagcaatagctaactgatac

SEQ ID NO: 7736505 - DNA, 22 bp, Homo sapiens
cacagcagaaagtgtaggagga

SEQ ID NO: 7736506 - DNA, 22 bp, Homo sapiens
agcagggaggcggtgtgctggc

SEQ ID NO: 7736507 - DNA, 22 bp, Homo sapiens
agcagggagaccatctcttcct

SEQ ID NO: 7736508 - DNA, 22 bp, Homo sapiens
agcagggaggcccagggcactg

SEQ ID NO: 7736509 - DNA, 22 bp, Homo sapiens
agcattaagagagactgaactg

SEQ ID NO: 7736510 - DNA, 22 bp, Homo sapiens
agcattaagcctggctcagagg

SEQ ID NO: 7736511 - DNA, 22 bp, Homo sapiens
agcattaataagaaatggctcc

SEQ ID NO: 7736512 - DNA, 22 bp, Homo sapiens
cactgtggggtttggctggaac

SEQ ID NO: 7736513 - DNA, 23 bp, Homo sapiens
agcagtaacttcagaaacatcag

SEQ ID NO: 7736514 - DNA, 22 bp, Homo sapiens
agcagtgatgcatgacagccta

SEQ ID NO: 7736515 - DNA, 22 bp, Homo sapiens
agcatcagcagactctcagcta

SEQ ID NO: 7736516 - DNA, 22 bp, Homo sapiens
agagcccctggtggagtgagaa

SEQ ID NO: 7736517 - DNA, 22 bp, Homo sapiens
agagcccctcggtggaggggtc

SEQ ID NO: 7736518 - DNA, 22 bp, Homo sapiens
agagcagcacgttgtccccaca

SEQ ID NO: 7736519 - DNA, 22 bp, Homo sapiens
agagcacaggctctggagtcta

SEQ ID NO: 7736520 - DNA, 22 bp, Homo sapiens
agagctgaaaaagctgacccgg

SEQ ID NO: 7736521 - DNA, 22 bp, Homo sapiens
agagctggctgctgcggtgctt

SEQ ID NO: 7736522 - DNA, 22 bp, Homo sapiens
agagctggccagggatcactct

SEQ ID NO: 7736523 - DNA, 22 bp, Homo sapiens
agagctggagcagccccactgg

SEQ ID NO: 7736524 - DNA, 22 bp, Homo sapiens
agagctggacgtctgagcccta

SEQ ID NO: 7736525 - DNA, 22 bp, Homo sapiens
agagctggcagcagcttctcct

SEQ ID NO: 7736526 - DNA, 22 bp, Homo sapiens
agagctggatggtcaagatggc

SEQ ID NO: 7736527 - DNA, 22 bp, Homo sapiens
agactgtgagaagatggctgcg

SEQ ID NO: 7736528 - DNA, 21 bp, Homo sapiens
agacttctagaagtgagatag

SEQ ID NO: 7736529 - DNA, 23 bp, Homo sapiens
agagaatcatggaaactctttct

SEQ ID NO: 7736530 - DNA, 22 bp, Homo sapiens
agagaatctgggaagatgttaa

SEQ ID NO: 7736531 - DNA, 22 bp, Homo sapiens
agagaatctagaatgtttatac

SEQ ID NO: 7736532 - DNA, 22 bp, Homo sapiens
agagaagggtgtagcctgggcc

SEQ ID NO: 7736533 - DNA, 22 bp, Homo sapiens
agagaagggtgtagcctgggcc

SEQ ID NO: 7736534 - DNA, 22 bp, Homo sapiens
agagagcctgagtggcagctat

SEQ ID NO: 7736535 - DNA, 22 bp, Homo sapiens
agagaggcattcggtgatccca

SEQ ID NO: 7736536 - DNA, 22 bp, Homo sapiens
agagaggctgctggactatatg

SEQ ID NO: 7736537 - DNA, 21 bp, Homo sapiens
agagagggagatgaaacatcc

SEQ ID NO: 7736538 - DNA, 22 bp, Homo sapiens
agagagcattgaggaaatcttc

SEQ ID NO: 7736539 - DNA, 22 bp, Homo sapiens
agagagcatggcacagaggggt

SEQ ID NO: 7736540 - DNA, 22 bp, Homo sapiens
agagacaccgcgcatcatggct

SEQ ID NO: 7736541 - DNA, 20 bp, Homo sapiens
agagaattccctttggagat

SEQ ID NO: 7736542 - DNA, 22 bp, Homo sapiens
atgaagttctcaataatcatgt

SEQ ID NO: 7736543 - DNA, 22 bp, Homo sapiens
atgaagttctagtgagaaatgc

SEQ ID NO: 7736544 - DNA, 22 bp, Homo sapiens
atgaagttccagtatatgcagt

SEQ ID NO: 7736545 - DNA, 22 bp, Homo sapiens
agaatcaaggtgaagcccacag

SEQ ID NO: 7736546 - DNA, 22 bp, Homo sapiens
agaatcaactgaaaattggtga

SEQ ID NO: 7736547 - DNA, 22 bp, Homo sapiens
agaatcaattagattctatgag

SEQ ID NO: 7736548 - DNA, 22 bp, Homo sapiens
agaatcaaagagaaatactttg

SEQ ID NO: 7736549 - DNA, 22 bp, Homo sapiens
agacctggatgtgagggaagta

SEQ ID NO: 7736550 - DNA, 22 bp, Homo sapiens
agacctgggtgccctgtgcttt

SEQ ID NO: 7736551 - DNA, 22 bp, Homo sapiens
agacctggtgatagctgtccta

SEQ ID NO: 7736552 - DNA, 22 bp, Homo sapiens
atgccaaagcccaagttcatca

SEQ ID NO: 7736553 - DNA, 22 bp, Homo sapiens
atgccaaattctactttcagca

SEQ ID NO: 7736554 - DNA, 22 bp, Homo sapiens
agaggccaggctgcagagggat

SEQ ID NO: 7736555 - DNA, 22 bp, Homo sapiens
agaggctgcacttgctcatgat

SEQ ID NO: 7736556 - DNA, 22 bp, Homo sapiens
agaggccagcaaccacagtaaa

SEQ ID NO: 7736557 - DNA, 23 bp, Homo sapiens
agaggccagcctttggagacacc

SEQ ID NO: 7736558 - DNA, 23 bp, Homo sapiens
agaggcaggagtggcttgcccgg

SEQ ID NO: 7736559 - DNA, 22 bp, Homo sapiens
agagctggctgtgggtgacttt

SEQ ID NO: 7736560 - DNA, 20 bp, Homo sapiens
agagctgggaagctccctat

SEQ ID NO: 7736561 - DNA, 22 bp, Homo sapiens
agagctgggaccgtctggaagt

SEQ ID NO: 7736562 - DNA, 21 bp, Homo sapiens
agagctgggacttgcctgaga

SEQ ID NO: 7736563 - DNA, 22 bp, Homo sapiens
attacagtaacagctacaatgc

SEQ ID NO: 7736564 - DNA, 22 bp, Homo sapiens
agaggcaggaggttgacttgag

SEQ ID NO: 7736565 - DNA, 22 bp, Homo sapiens
agagtctgatatttgtaccaga

SEQ ID NO: 7736566 - DNA, 22 bp, Homo sapiens
agagtctgaggcagctgcagcc

SEQ ID NO: 7736567 - DNA, 22 bp, Homo sapiens
agagtctgaggaggaccaacag

SEQ ID NO: 7736568 - DNA, 22 bp, Homo sapiens
agagtgagggggcactgagacg

SEQ ID NO: 7736569 - DNA, 22 bp, Homo sapiens
agagtccaccctggggtcaggc

SEQ ID NO: 7736570 - DNA, 23 bp, Homo sapiens
agaggggagcatctgctggctga

SEQ ID NO: 7736571 - DNA, 22 bp, Homo sapiens
agatgtggccggctagggagag

SEQ ID NO: 7736572 - DNA, 22 bp, Homo sapiens
agatgtggatcctagggtagaa

SEQ ID NO: 7736573 - DNA, 22 bp, Homo sapiens
agatgtggccggctagggagag

SEQ ID NO: 7736574 - DNA, 22 bp, Homo sapiens
agatgtggcctttgggagatta

SEQ ID NO: 7736575 - DNA, 22 bp, Homo sapiens
attttagcaaatgcaagatgga

SEQ ID NO: 7736576 - DNA, 22 bp, Homo sapiens
attttagctgtccagtggattg

SEQ ID NO: 7736577 - DNA, 22 bp, Homo sapiens
agatgtgtttctagttcctgca

SEQ ID NO: 7736578 - DNA, 22 bp, Homo sapiens
caaaggcaggtgctgaatattc

SEQ ID NO: 7736579 - DNA, 22 bp, Homo sapiens
caaagcaaggctcagtttgaac

SEQ ID NO: 7736580 - DNA, 22 bp, Homo sapiens
caaagcaagggctgaagactcc

SEQ ID NO: 7736581 - DNA, 22 bp, Homo sapiens
caaagcaagggctgaagactcc

SEQ ID NO: 7736582 - DNA, 22 bp, Homo sapiens
caaagataatcacagaataccc

SEQ ID NO: 7736583 - DNA, 22 bp, Homo sapiens
caaagatgtcattggtaagaca

SEQ ID NO: 7736584 - DNA, 22 bp, Homo sapiens
caaagatgctgatgttggatca

SEQ ID NO: 7736585 - DNA, 22 bp, Homo sapiens
agatcaaatctgggatttctaa

SEQ ID NO: 7736586 - DNA, 22 bp, Homo sapiens
attggccatttgcatgtattat

SEQ ID NO: 7736587 - DNA, 22 bp, Homo sapiens
agatggagttgtagcagtgact

SEQ ID NO: 7736588 - DNA, 22 bp, Homo sapiens
agatggagaccttggatgaact

SEQ ID NO: 7736589 - DNA, 22 bp, Homo sapiens
agatggagaccttggatgaact

SEQ ID NO: 7736590 - DNA, 22 bp, Homo sapiens
agatggagtggagatgagtaaa

SEQ ID NO: 7736591 - DNA, 22 bp, Homo sapiens
agatggagttagtaccagagtc

SEQ ID NO: 7736592 - DNA, 17 bp, Homo sapiens
agatggcctctaagatt

SEQ ID NO: 7736593 - DNA, 22 bp, Homo sapiens
acccagagcacagatgcaacgt

SEQ ID NO: 7736594 - DNA, 22 bp, Homo sapiens
agggcctgagaccgtggcttga

SEQ ID NO: 7736595 - DNA, 22 bp, Homo sapiens
accccacagcatacaaaggcac

SEQ ID NO: 7736596 - DNA, 22 bp, Homo sapiens
accccagcgcatatggtctgcg

SEQ ID NO: 7736597 - DNA, 22 bp, Homo sapiens
accagggttgagtcagctgcgt

SEQ ID NO: 7736598 - DNA, 22 bp, Homo sapiens
accagtgtcttattgaccatct

SEQ ID NO: 7736599 - DNA, 23 bp, Homo sapiens
aggcttcctatcttagagctggg

SEQ ID NO: 7736600 - DNA, 22 bp, Homo sapiens
aggctccaggcaaaatttcgga

SEQ ID NO: 7736601 - DNA, 22 bp, Homo sapiens
aggctccacggtcactggctct

SEQ ID NO: 7736602 - DNA, 19 bp, Homo sapiens
acattgaattttcttcttt

SEQ ID NO: 7736603 - DNA, 22 bp, Homo sapiens
acattgaagctgtgaaatcaaa

SEQ ID NO: 7736604 - DNA, 22 bp, Homo sapiens
acattcttggactccactctag

SEQ ID NO: 7736605 - DNA, 22 bp, Homo sapiens
acattctagatatgttatattt

SEQ ID NO: 7736606 - DNA, 22 bp, Homo sapiens
aggccagcacgacagccgcagg

SEQ ID NO: 7736607 - DNA, 22 bp, Homo sapiens
aggcccagggctgctctctgaa

SEQ ID NO: 7736608 - DNA, 21 bp, Homo sapiens
aggcccagctttcctcttgct

SEQ ID NO: 7736609 - DNA, 22 bp, Homo sapiens
aggcccagcttgaagtgggaag

SEQ ID NO: 7736610 - DNA, 22 bp, Homo sapiens
aggcccagctgggccaggaaca

SEQ ID NO: 7736611 - DNA, 22 bp, Homo sapiens
aggccagcagcatgacggcatc

SEQ ID NO: 7736612 - DNA, 22 bp, Homo sapiens
aggccagccctcacctgtgttc

SEQ ID NO: 7736613 - DNA, 22 bp, Homo sapiens
aggccagccctgggctgagaga

SEQ ID NO: 7736614 - DNA, 22 bp, Homo sapiens
acatctttttggaaacggctga

SEQ ID NO: 7736615 - DNA, 22 bp, Homo sapiens
agctggttcactaagcataata

SEQ ID NO: 7736616 - DNA, 22 bp, Homo sapiens
agctgtgggagaatctctgggt

SEQ ID NO: 7736617 - DNA, 22 bp, Homo sapiens
agctgtgggatttgggtgtgcc

SEQ ID NO: 7736618 - DNA, 22 bp, Homo sapiens
agctgtgggcctgggagagctg

SEQ ID NO: 7736619 - DNA, 22 bp, Homo sapiens
agctgtggggcaggcagcgagg

SEQ ID NO: 7736620 - DNA, 19 bp, Homo sapiens
agctgtggggcctagcacc

SEQ ID NO: 7736621 - DNA, 22 bp, Homo sapiens
agcttcagcttgcagctgtgat

SEQ ID NO: 7736622 - DNA, 18 bp, Homo sapiens
aggaaagaaaggcaggtg

SEQ ID NO: 7736623 - DNA, 18 bp, Homo sapiens
aggaaagaaaggcaggtg

SEQ ID NO: 7736624 - DNA, 22 bp, Homo sapiens
aggaagagcattcacatggtag

SEQ ID NO: 7736625 - DNA, 22 bp, Homo sapiens
aggaaactaacttatctttata

SEQ ID NO: 7736626 - DNA, 22 bp, Homo sapiens
aggaaaaataaggcagcagggc

SEQ ID NO: 7736627 - DNA, 22 bp, Homo sapiens
aggaaagaaaggaggtgcattt

SEQ ID NO: 7736628 - DNA, 22 bp, Homo sapiens
agctgctgtcctaggcactgta

SEQ ID NO: 7736629 - DNA, 22 bp, Homo sapiens
agctgctgtcctaggcactgta

SEQ ID NO: 7736630 - DNA, 22 bp, Homo sapiens
agctgctggtttaagggatggg

SEQ ID NO: 7736631 - DNA, 22 bp, Homo sapiens
agctgctggggagggcagacac

SEQ ID NO: 7736632 - DNA, 22 bp, Homo sapiens
agctgctgtttcttgcacgtat

SEQ ID NO: 7736633 - DNA, 22 bp, Homo sapiens
agctgctgtggggctcggcctg

SEQ ID NO: 7736634 - DNA, 22 bp, Homo sapiens
acagccagtcatctcagcaggg

SEQ ID NO: 7736635 - DNA, 22 bp, Homo sapiens
acagccagggtctcaggaggcg

SEQ ID NO: 7736636 - DNA, 22 bp, Homo sapiens
acagccaggtaaaggcatggca

SEQ ID NO: 7736637 - DNA, 20 bp, Homo sapiens
acagccagaggaggcagaca

SEQ ID NO: 7736638 - DNA, 22 bp, Homo sapiens
agctccaggtgcaagtcatggt

SEQ ID NO: 7736639 - DNA, 22 bp, Homo sapiens
acagccagtgctccgtgaggac

SEQ ID NO: 7736640 - DNA, 22 bp, Homo sapiens
acagccagtgactggacaagct

SEQ ID NO: 7736641 - DNA, 22 bp, Homo sapiens
aggaaggagggcagatattaag

SEQ ID NO: 7736642 - DNA, 23 bp, Homo sapiens
aggaaggaggtcctaacagtatc

SEQ ID NO: 7736643 - DNA, 23 bp, Homo sapiens
aggaaggaggtcctaacagtatc

SEQ ID NO: 7736644 - DNA, 23 bp, Homo sapiens
aggaaggaggtcctaacagtatc

SEQ ID NO: 7736645 - DNA, 22 bp, Homo sapiens
aggagacatactataggaatat

SEQ ID NO: 7736646 - DNA, 22 bp, Homo sapiens
aggagacataactatgatgaga

SEQ ID NO: 7736647 - DNA, 22 bp, Homo sapiens
aggagccattttccaagggcga

SEQ ID NO: 7736648 - DNA, 22 bp, Homo sapiens
acagggtcttagagatcacctg

SEQ ID NO: 7736649 - DNA, 22 bp, Homo sapiens
acaggggctccgaaggtgaggg

SEQ ID NO: 7736650 - DNA, 22 bp, Homo sapiens
acaggggctccgaaggtgaggg

SEQ ID NO: 7736651 - DNA, 22 bp, Homo sapiens
aggcacagagaatgccctccat

SEQ ID NO: 7736652 - DNA, 22 bp, Homo sapiens
aggcaacaagggtagtcagtga

SEQ ID NO: 7736653 - DNA, 22 bp, Homo sapiens
aggcaacatgggccaggcagaa

SEQ ID NO: 7736654 - DNA, 22 bp, Homo sapiens
aggcaacataacacgaaagtct

SEQ ID NO: 7736655 - DNA, 22 bp, Homo sapiens
aggaggccgatttcagaggtcg

SEQ ID NO: 7736656 - DNA, 17 bp, Homo sapiens
aggagggaaatagcttg

SEQ ID NO: 7736657 - DNA, 22 bp, Homo sapiens
aggaggggcatagaaatgtaat

SEQ ID NO: 7736658 - DNA, 22 bp, Homo sapiens
aggagggagatgcccatcctgg

SEQ ID NO: 7736659 - DNA, 20 bp, Homo sapiens
aggagggacctggattggcg

SEQ ID NO: 7736660 - DNA, 22 bp, Homo sapiens
aggcaaatagatagtccataca

SEQ ID NO: 7736661 - DNA, 22 bp, Homo sapiens
actgcctgctcctggctccaca

SEQ ID NO: 7736662 - DNA, 22 bp, Homo sapiens
actgcctggcctggcctcactg

SEQ ID NO: 7736663 - DNA, 21 bp, Homo sapiens
actgcctggggtgctggccaa

SEQ ID NO: 7736664 - DNA, 23 bp, Homo sapiens
actgcctgctactatgcccacgg

SEQ ID NO: 7736665 - DNA, 22 bp, Homo sapiens
actgcctgccttccaggtactg

SEQ ID NO: 7736666 - DNA, 19 bp, Homo sapiens
actgcctgaggctcacagg

SEQ ID NO: 7736667 - DNA, 22 bp, Homo sapiens
actgggcctgtacagagaaaac

SEQ ID NO: 7736668 - DNA, 22 bp, Homo sapiens
actgggcctggattggcgtgtc

SEQ ID NO: 7736669 - DNA, 22 bp, Homo sapiens
actgggccagacactgattccc

SEQ ID NO: 7736670 - DNA, 22 bp, Homo sapiens
actgggccagatcagagcaact

SEQ ID NO: 7736671 - DNA, 22 bp, Homo sapiens
actctgactggagtgagagagg

SEQ ID NO: 7736672 - DNA, 21 bp, Homo sapiens
actgagagatgttggatcata

SEQ ID NO: 7736673 - DNA, 22 bp, Homo sapiens
actgcacttcaccctgggtgac

SEQ ID NO: 7736674 - DNA, 22 bp, Homo sapiens
actgcacttcaccctgggtgac

SEQ ID NO: 7736675 - DNA, 22 bp, Homo sapiens
agtgctgaacatagaatggaca

SEQ ID NO: 7736676 - DNA, 20 bp, Homo sapiens
agtgaatagagacattgccc

SEQ ID NO: 7736677 - DNA, 22 bp, Homo sapiens
actgcactcctgcctgggtaac

SEQ ID NO: 7736678 - DNA, 22 bp, Homo sapiens
actgcactccagcctgggtgat

SEQ ID NO: 7736679 - DNA, 22 bp, Homo sapiens
actgcactccagcctgggtgat

SEQ ID NO: 7736680 - DNA, 21 bp, Homo sapiens
actccctgcataagtgattta

SEQ ID NO: 7736681 - DNA, 22 bp, Homo sapiens
agtaataatagctgtaaagtgc

SEQ ID NO: 7736682 - DNA, 22 bp, Homo sapiens
agtaataatttatattagggag

SEQ ID NO: 7736683 - DNA, 21 bp, Homo sapiens
agtagtttagcacagggtttg

SEQ ID NO: 7736684 - DNA, 22 bp, Homo sapiens
acccttcatagaggagaagctg

SEQ ID NO: 7736685 - DNA, 22 bp, Homo sapiens
aggtgactggtttatctggcag

SEQ ID NO: 7736686 - DNA, 22 bp, Homo sapiens
actaaatatttgagaggtgtag

SEQ ID NO: 7736687 - DNA, 20 bp, Homo sapiens
atagatatcatctttagaag

SEQ ID NO: 7736688 - DNA, 22 bp, Homo sapiens
actttggacgccatgctgtttg

SEQ ID NO: 7736689 - DNA, 18 bp, Homo sapiens
ataaagtgctaataatgg

SEQ ID NO: 7736690 - DNA, 19 bp, Homo sapiens
ataaataaaaagtgggaga

SEQ ID NO: 7736691 - DNA, 22 bp, Homo sapiens
ataaagtggaggtagtattcat

SEQ ID NO: 7736692 - DNA, 22 bp, Homo sapiens
ataaagtttaaaagtcaatagt

SEQ ID NO: 7736693 - DNA, 22 bp, Homo sapiens
agtttttgagaatttactatgt

SEQ ID NO: 7736694 - DNA, 22 bp, Homo sapiens
actgggctagagtggaagctgg

SEQ ID NO: 7736695 - DNA, 21 bp, Homo sapiens
actgggctagcctgacttctg

SEQ ID NO: 7736696 - DNA, 22 bp, Homo sapiens
actgggctcaagtgattgtcct

SEQ ID NO: 7736697 - DNA, 22 bp, Homo sapiens
actgggccttgtgtgtctcatc

SEQ ID NO: 7736698 - DNA, 22 bp, Homo sapiens
actgggctaccccaccattacc

SEQ ID NO: 7736699 - DNA, 22 bp, Homo sapiens
actgggctccaaggacctggag

SEQ ID NO: 7736700 - DNA, 22 bp, Homo sapiens
actgggctccagatgtgatacg

SEQ ID NO: 7736701 - DNA, 22 bp, Homo sapiens
actgggctcataatgtcataga

SEQ ID NO: 7736702 - DNA, 22 bp, Homo sapiens
actgggctcccaggcttgtcat

SEQ ID NO: 7736703 - DNA, 22 bp, Homo sapiens
agaaatcatgtcttatttctat

SEQ ID NO: 7736704 - DNA, 22 bp, Homo sapiens
agaaaaagtcaaggaattggac

SEQ ID NO: 7736705 - DNA, 22 bp, Homo sapiens
atatttctccaaatgttttcaa

SEQ ID NO: 7736706 - DNA, 22 bp, Homo sapiens
agaaggcagatgggacggagca

SEQ ID NO: 7736707 - DNA, 22 bp, Homo sapiens
agaaggagtgtacaggtcatgc

SEQ ID NO: 7736708 - DNA, 22 bp, Homo sapiens
agaaggagtgtacaggtcatgc

SEQ ID NO: 7736709 - DNA, 22 bp, Homo sapiens
agaaggagtgtacaggtcatgc

SEQ ID NO: 7736710 - DNA, 22 bp, Homo sapiens
atctctggtccaaatgttacct

SEQ ID NO: 7736711 - DNA, 22 bp, Homo sapiens
atctctggttgttttgctccca

SEQ ID NO: 7736712 - DNA, 22 bp, Homo sapiens
atctctgggtccatagaagaga

SEQ ID NO: 7736713 - DNA, 22 bp, Homo sapiens
atctctgggctttgagtttgtt

SEQ ID NO: 7736714 - DNA, 22 bp, Homo sapiens
atctctggccttccttttccaa

SEQ ID NO: 7736715 - DNA, 22 bp, Homo sapiens
atctctggcccctggggtccga

SEQ ID NO: 7736716 - DNA, 22 bp, Homo sapiens
agaagccacaggaaagcagctt

SEQ ID NO: 7736717 - DNA, 22 bp, Homo sapiens
agaaatctatgttttggttaga

SEQ ID NO: 7736718 - DNA, 19 bp, Homo sapiens
agaaatctcgagatttgtt

SEQ ID NO: 7736719 - DNA, 19 bp, Homo sapiens
atcccaaggagctgggact

SEQ ID NO: 7736720 - DNA, 22 bp, Homo sapiens
atctctggcaatgcagcatcgt

SEQ ID NO: 7736721 - DNA, 22 bp, Homo sapiens
agaacagtgctgataaatcata

SEQ ID NO: 7736722 - DNA, 22 bp, Homo sapiens
aggagcagattggtaagatcat

SEQ ID NO: 7736723 - DNA, 22 bp, Homo sapiens
aggagctgggagaaggactaaa

SEQ ID NO: 7736724 - DNA, 22 bp, Homo sapiens
aggagctggcctagaaaggaga

SEQ ID NO: 7736725 - DNA, 20 bp, Homo sapiens
aggagatgatccagagtcag

SEQ ID NO: 7736726 - DNA, 22 bp, Homo sapiens
aggaattcaagaccagctgggc

SEQ ID NO: 7736727 - DNA, 22 bp, Homo sapiens
aggaattgagatcctaggtttt

SEQ ID NO: 7736728 - DNA, 22 bp, Homo sapiens
catcagaggtacttaatgaatg

SEQ ID NO: 7736729 - DNA, 23 bp, Homo sapiens
catcagaggttgccactccctgg

SEQ ID NO: 7736730 - DNA, 22 bp, Homo sapiens
catcagagtcagagctctttct

SEQ ID NO: 7736731 - DNA, 22 bp, Homo sapiens
aggaggctgggcacagtggcct

SEQ ID NO: 7736732 - DNA, 22 bp, Homo sapiens
cagttctgactttcataatgtc

SEQ ID NO: 7736733 - DNA, 22 bp, Homo sapiens
aggaggtgagcggtcatgtggt

SEQ ID NO: 7736734 - DNA, 22 bp, Homo sapiens
aggagggtggggtctgcctgtc

SEQ ID NO: 7736735 - DNA, 22 bp, Homo sapiens
aggaggctggttcaggccatat

SEQ ID NO: 7736736 - DNA, 22 bp, Homo sapiens
catcattgttagggactctaac

SEQ ID NO: 7736737 - DNA, 20 bp, Homo sapiens
aggcagctggccaggcaggt

SEQ ID NO: 7736738 - DNA, 20 bp, Homo sapiens
aggcagctgggaaatgaggg

SEQ ID NO: 7736739 - DNA, 22 bp, Homo sapiens
aggcagctgtgaggactggatt

SEQ ID NO: 7736740 - DNA, 22 bp, Homo sapiens
aggcagctggcagcacccaggg

SEQ ID NO: 7736741 - DNA, 22 bp, Homo sapiens
aggcagctttaactggtagtag

SEQ ID NO: 7736742 - DNA, 22 bp, Homo sapiens
aggcagcttaagccctggccca

SEQ ID NO: 7736743 - DNA, 22 bp, Homo sapiens
aggcagcttctgattagcagcg

SEQ ID NO: 7736744 - DNA, 22 bp, Homo sapiens
aggcagagctgatgttctgtga

SEQ ID NO: 7736745 - DNA, 22 bp, Homo sapiens
aggcagagctaggaagaattgt

SEQ ID NO: 7736746 - DNA, 22 bp, Homo sapiens
ccaaagcaagtcacatgatcaa

SEQ ID NO: 7736747 - DNA, 22 bp, Homo sapiens
aggcagagagcagtggccgtct

SEQ ID NO: 7736748 - DNA, 19 bp, Homo sapiens
aggcacaggttgtctggac

SEQ ID NO: 7736749 - DNA, 22 bp, Homo sapiens
aggatcctgtatggagaagctg

SEQ ID NO: 7736750 - DNA, 23 bp, Homo sapiens
aggatcctggtacaggagcagag

SEQ ID NO: 7736751 - DNA, 22 bp, Homo sapiens
aggagttatggcagaatcaaat

SEQ ID NO: 7736752 - DNA, 22 bp, Homo sapiens
catgtctgagtagagtgtgatt

SEQ ID NO: 7736753 - DNA, 22 bp, Homo sapiens
catgtgtgaatcttgtgatcat

SEQ ID NO: 7736754 - DNA, 22 bp, Homo sapiens
caggaaatgaaagctagctaat

SEQ ID NO: 7736755 - DNA, 22 bp, Homo sapiens
caggaaatgcgtagttgaactt

SEQ ID NO: 7736756 - DNA, 22 bp, Homo sapiens
caggaaatatctcctggcagag

SEQ ID NO: 7736757 - DNA, 23 bp, Homo sapiens
caggaaatcaattcttccagcat

SEQ ID NO: 7736758 - DNA, 22 bp, Homo sapiens
caggaaatcactctgattttgg

SEQ ID NO: 7736759 - DNA, 22 bp, Homo sapiens
caggaaatataggaaaaggaac

SEQ ID NO: 7736760 - DNA, 22 bp, Homo sapiens
caggaaatatctcaacacttta

SEQ ID NO: 7736761 - DNA, 22 bp, Homo sapiens
agctgggactcaactgtctggg

SEQ ID NO: 7736762 - DNA, 22 bp, Homo sapiens
agctggagattctggggacagt

SEQ ID NO: 7736763 - DNA, 22 bp, Homo sapiens
agctggagccagtgtgaggctt

SEQ ID NO: 7736764 - DNA, 22 bp, Homo sapiens
agctggagaaacctgggagggt

SEQ ID NO: 7736765 - DNA, 22 bp, Homo sapiens
agctggagagtttccaggaagg

SEQ ID NO: 7736766 - DNA, 22 bp, Homo sapiens
agctgggttcagaggcacatgg

SEQ ID NO: 7736767 - DNA, 22 bp, Homo sapiens
agctgggtgttcttgggcctaa

SEQ ID NO: 7736768 - DNA, 19 bp, Homo sapiens
agctggggcggtgtgtgtt

SEQ ID NO: 7736769 - DNA, 22 bp, Homo sapiens
agctgggtgcggtggctcatgc

SEQ ID NO: 7736770 - DNA, 22 bp, Homo sapiens
caggtcctggcatcaggcaggt

SEQ ID NO: 7736771 - DNA, 22 bp, Homo sapiens
aggaatgaactcgagtgatctg

SEQ ID NO: 7736772 - DNA, 22 bp, Homo sapiens
caggtcctggcatcaggcaggt

SEQ ID NO: 7736773 - DNA, 22 bp, Homo sapiens
caggtcctcgggggaggccggc

SEQ ID NO: 7736774 - DNA, 22 bp, Homo sapiens
caggtcctgcagggagagtaaa

SEQ ID NO: 7736775 - DNA, 22 bp, Homo sapiens
caggtcctgccttggttaccct

SEQ ID NO: 7736776 - DNA, 20 bp, Homo sapiens
aggaaggagaatctgagcaa

SEQ ID NO: 7736777 - DNA, 20 bp, Homo sapiens
aggaaggagaatctgagcaa

SEQ ID NO: 7736778 - DNA, 22 bp, Homo sapiens
aggaagggttctttgtgaaaga

SEQ ID NO: 7736779 - DNA, 22 bp, Homo sapiens
aggaagcaaaaggcagggtcta

SEQ ID NO: 7736780 - DNA, 22 bp, Homo sapiens
aggaagaggtgtgcaatggtgt

SEQ ID NO: 7736781 - DNA, 22 bp, Homo sapiens
agcttctccatctgcccagaga

SEQ ID NO: 7736782 - DNA, 22 bp, Homo sapiens
agcttctcaggagtctgaggca

SEQ ID NO: 7736783 - DNA, 22 bp, Homo sapiens
caggcttaggagtcagcctgct

SEQ ID NO: 7736784 - DNA, 22 bp, Homo sapiens
agcttctctctttgcactcaca

SEQ ID NO: 7736785 - DNA, 22 bp, Homo sapiens
agcttctctctttgcactcaca

SEQ ID NO: 7736786 - DNA, 22 bp, Homo sapiens
ccaggaaggtatgggaagaaaa

SEQ ID NO: 7736787 - DNA, 22 bp, Homo sapiens
ccaggaaggcaggcctccccgc

SEQ ID NO: 7736788 - DNA, 22 bp, Homo sapiens
ccagctggagctcgcagatagg

SEQ ID NO: 7736789 - DNA, 22 bp, Homo sapiens
ccagctggcaggagagtcaggg

SEQ ID NO: 7736790 - DNA, 22 bp, Homo sapiens
ccagctggagccaaggtggact

SEQ ID NO: 7736791 - DNA, 22 bp, Homo sapiens
ccagctggagccaaggtggact

SEQ ID NO: 7736792 - DNA, 22 bp, Homo sapiens
ccagctggaagagtgcagaact

SEQ ID NO: 7736793 - DNA, 22 bp, Homo sapiens
ccagctggaagagtgcagaact

SEQ ID NO: 7736794 - DNA, 22 bp, Homo sapiens
ccagctggaaacaaatagagtg

SEQ ID NO: 7736795 - DNA, 22 bp, Homo sapiens
ccagctcttttggctgagtgag

SEQ ID NO: 7736796 - DNA, 22 bp, Homo sapiens
ccagctccggtgtgcttatttc

SEQ ID NO: 7736797 - DNA, 22 bp, Homo sapiens
ccagctctgcttgcccagtcag

SEQ ID NO: 7736798 - DNA, 22 bp, Homo sapiens
aggccaccaccctatctcctgg

SEQ ID NO: 7736799 - DNA, 22 bp, Homo sapiens
aggcccagactcagcggggcgg

SEQ ID NO: 7736800 - DNA, 22 bp, Homo sapiens
ccagaccctgctctggggctct

SEQ ID NO: 7736801 - DNA, 22 bp, Homo sapiens
ccagactggggctccttgaggg

SEQ ID NO: 7736802 - DNA, 22 bp, Homo sapiens
aggccacagttgaggccagcaa

SEQ ID NO: 7736803 - DNA, 22 bp, Homo sapiens
ccagaaagaatgaactgaaccc

SEQ ID NO: 7736804 - DNA, 22 bp, Homo sapiens
ccagaaagttcagctgtgaatg

SEQ ID NO: 7736805 - DNA, 23 bp, Homo sapiens
ccagggctacgggcaccgtcctg

SEQ ID NO: 7736806 - DNA, 22 bp, Homo sapiens
ccagggcctgccacttagcaag

SEQ ID NO: 7736807 - DNA, 20 bp, Homo sapiens
ccagggctggctcctgggat

SEQ ID NO: 7736808 - DNA, 22 bp, Homo sapiens
aggctgaggatccctgtgttct

SEQ ID NO: 7736809 - DNA, 22 bp, Homo sapiens
aggctgagctgacctggtttgg

SEQ ID NO: 7736810 - DNA, 22 bp, Homo sapiens
ccaggtctggaaccaccagggc

SEQ ID NO: 7736811 - DNA, 22 bp, Homo sapiens
ccaggtctgcgggcggcaggca

SEQ ID NO: 7736812 - DNA, 22 bp, Homo sapiens
ccaggtctgcgggcggcaggca

SEQ ID NO: 7736813 - DNA, 22 bp, Homo sapiens
ccaggtctcgggtctgctcgtg

SEQ ID NO: 7736814 - DNA, 22 bp, Homo sapiens
ccaggctgggctacaagttgag

SEQ ID NO: 7736815 - DNA, 22 bp, Homo sapiens
ccaggctgctgttggtgtccgc

SEQ ID NO: 7736816 - DNA, 22 bp, Homo sapiens
aggctacatgttggggtggaag

SEQ ID NO: 7736817 - DNA, 22 bp, Homo sapiens
aggctacagatacagaggctac

SEQ ID NO: 7736818 - DNA, 19 bp, Homo sapiens
ccaggtctggggccagatt

SEQ ID NO: 7736819 - DNA, 22 bp, Homo sapiens
ccaggtctggcactggccagtc

SEQ ID NO: 7736820 - DNA, 22 bp, Homo sapiens
ccaggtctgtcttcttagctca

SEQ ID NO: 7736821 - DNA, 22 bp, Homo sapiens
ccaggtcttcactttactgaag

SEQ ID NO: 7736822 - DNA, 21 bp, Homo sapiens
ccaggtcttggtccttggact

SEQ ID NO: 7736823 - DNA, 22 bp, Homo sapiens
ccaggtcttggcccccggacct

SEQ ID NO: 7736824 - DNA, 22 bp, Homo sapiens
ccaggtcttgtttgacatcaat

SEQ ID NO: 7736825 - DNA, 22 bp, Homo sapiens
ccaggtctttgactaatatgct

SEQ ID NO: 7736826 - DNA, 22 bp, Homo sapiens
ccaggtctttggccttggcact

SEQ ID NO: 7736827 - DNA, 22 bp, Homo sapiens
aggggagagttaatgtgaatgt

SEQ ID NO: 7736828 - DNA, 22 bp, Homo sapiens
aggggaggtgtccccaaatctc

SEQ ID NO: 7736829 - DNA, 22 bp, Homo sapiens
aggggaggcagcgataaacctg

SEQ ID NO: 7736830 - DNA, 22 bp, Homo sapiens
aggggatggagctggaaggcag

SEQ ID NO: 7736831 - DNA, 22 bp, Homo sapiens
aggggatggagctggaaggcag

SEQ ID NO: 7736832 - DNA, 22 bp, Homo sapiens
agggtagggtaaatgatgcatc

SEQ ID NO: 7736833 - DNA, 22 bp, Homo sapiens
agggtagggccgtagggccatg

SEQ ID NO: 7736834 - DNA, 22 bp, Homo sapiens
agggtaggaactgagtggaagg

SEQ ID NO: 7736835 - DNA, 22 bp, Homo sapiens
agggtagggcccggagacagac

SEQ ID NO: 7736836 - DNA, 22 bp, Homo sapiens
agggctggcaagggattgaaat

SEQ ID NO: 7736837 - DNA, 22 bp, Homo sapiens
agggcctggaactgtgggcagg

SEQ ID NO: 7736838 - DNA, 22 bp, Homo sapiens
agggcctggaactggagaccac

SEQ ID NO: 7736839 - DNA, 23 bp, Homo sapiens
agggcctgatggctcccgctggc

SEQ ID NO: 7736840 - DNA, 22 bp, Homo sapiens
agggcctgcatcaggagcttgg

SEQ ID NO: 7736841 - DNA, 23 bp, Homo sapiens
cccaggctacaaattatgctctg

SEQ ID NO: 7736842 - DNA, 22 bp, Homo sapiens
cccaggctgatgttcagcgggt

SEQ ID NO: 7736843 - DNA, 22 bp, Homo sapiens
cccaggctgcatgagtccatgg

SEQ ID NO: 7736844 - DNA, 22 bp, Homo sapiens
cccaggctgtgcaaacttcaaa

SEQ ID NO: 7736845 - DNA, 18 bp, Homo sapiens
cccaggctttgtgggtct

SEQ ID NO: 7736846 - DNA, 22 bp, Homo sapiens
cccaggcttttctcttgcccca

SEQ ID NO: 7736847 - DNA, 22 bp, Homo sapiens
cccaggcttttaagttagacag

SEQ ID NO: 7736848 - DNA, 22 bp, Homo sapiens
ccctcccaggagtggccagaga

SEQ ID NO: 7736849 - DNA, 22 bp, Homo sapiens
ccctccatgagtgtgctgctgg

SEQ ID NO: 7736850 - DNA, 22 bp, Homo sapiens
ccctcccaagcactctgacata

SEQ ID NO: 7736851 - DNA, 22 bp, Homo sapiens
cccatgagattctgaatttggc

SEQ ID NO: 7736852 - DNA, 22 bp, Homo sapiens
cccatgctgagtggcctgagat

SEQ ID NO: 7736853 - DNA, 22 bp, Homo sapiens
cccatggagtgcctgagggcca

SEQ ID NO: 7736854 - DNA, 22 bp, Homo sapiens
ccctcacttcacgctctgcaga

SEQ ID NO: 7736855 - DNA, 22 bp, Homo sapiens
ccctcactgtccttgggccctt

SEQ ID NO: 7736856 - DNA, 22 bp, Homo sapiens
ccctaggggcaatgatggtgct

SEQ ID NO: 7736857 - DNA, 22 bp, Homo sapiens
agtgtgagaacggactaataaa

SEQ ID NO: 7736858 - DNA, 22 bp, Homo sapiens
agtgtgagatgattgaggagca

SEQ ID NO: 7736859 - DNA, 22 bp, Homo sapiens
agtgtcaactgtctacagggag

SEQ ID NO: 7736860 - DNA, 22 bp, Homo sapiens
agtgggtggcgcagaggaggaa

SEQ ID NO: 7736861 - DNA, 22 bp, Homo sapiens
ctctggagtgtctggccagggt

SEQ ID NO: 7736862 - DNA, 22 bp, Homo sapiens
ctctggagttctcatgaggaac

SEQ ID NO: 7736863 - DNA, 21 bp, Homo sapiens
ctctggagtttgaaggctggg

SEQ ID NO: 7736864 - DNA, 22 bp, Homo sapiens
agtggcctggagccccgcctgg

SEQ ID NO: 7736865 - DNA, 17 bp, Homo sapiens
agtgtggccctggttaa

SEQ ID NO: 7736866 - DNA, 22 bp, Homo sapiens
ctgagctgcggcaggcacctgg

SEQ ID NO: 7736867 - DNA, 22 bp, Homo sapiens
ctgagctgctttgcttttgggg

SEQ ID NO: 7736868 - DNA, 22 bp, Homo sapiens
ctgagctgacatcttcctcttt

SEQ ID NO: 7736869 - DNA, 22 bp, Homo sapiens
ctgagccaaggggacagtgaca

SEQ ID NO: 7736870 - DNA, 22 bp, Homo sapiens
ctgagccaccggcagggacatc

SEQ ID NO: 7736871 - DNA, 22 bp, Homo sapiens
ctgagccaccggcagggacatc

SEQ ID NO: 7736872 - DNA, 22 bp, Homo sapiens
ctgagccactgcttgttcagtg

SEQ ID NO: 7736873 - DNA, 22 bp, Homo sapiens
ctgagccagagggagtcgggtc

SEQ ID NO: 7736874 - DNA, 22 bp, Homo sapiens
ctgagcagccccaccagccatt

SEQ ID NO: 7736875 - DNA, 22 bp, Homo sapiens
ctgagccagggccacacatgga

SEQ ID NO: 7736876 - DNA, 22 bp, Homo sapiens
ctgagccagctggcatgtgcta

SEQ ID NO: 7736877 - DNA, 22 bp, Homo sapiens
ctgagccagctggcatgtgcta

SEQ ID NO: 7736878 - DNA, 22 bp, Homo sapiens
ctgagccagcgggctcactttt

SEQ ID NO: 7736879 - DNA, 20 bp, Homo sapiens
agtgagttatcagctacagt

SEQ ID NO: 7736880 - DNA, 22 bp, Homo sapiens
agtgaggggcagctgagtgggc

SEQ ID NO: 7736881 - DNA, 22 bp, Homo sapiens
agtgaggggcagctgagtgggc

SEQ ID NO: 7736882 - DNA, 22 bp, Homo sapiens
agtgaggggattcaggcaaggt

SEQ ID NO: 7736883 - DNA, 22 bp, Homo sapiens
agtcctgggtctggagaatgga

SEQ ID NO: 7736884 - DNA, 22 bp, Homo sapiens
agtctcagaaaagaagcatgga

SEQ ID NO: 7736885 - DNA, 22 bp, Homo sapiens
agtggcatcaaatcaaggtttg

SEQ ID NO: 7736886 - DNA, 20 bp, Homo sapiens
agtggcagggaaatggaaag

SEQ ID NO: 7736887 - DNA, 22 bp, Homo sapiens
agtgccatggaggaacagatgc

SEQ ID NO: 7736888 - DNA, 22 bp, Homo sapiens
agtgcctcttgtctacggtttt

SEQ ID NO: 7736889 - DNA, 22 bp, Homo sapiens
agtgcctggcacatggaaggtg

SEQ ID NO: 7736890 - DNA, 20 bp, Homo sapiens
aggtcctggttctctgggat

SEQ ID NO: 7736891 - DNA, 22 bp, Homo sapiens
cctgggctttgagggcaggatg

SEQ ID NO: 7736892 - DNA, 22 bp, Homo sapiens
cctgggggccaggaaggtgtga

SEQ ID NO: 7736893 - DNA, 22 bp, Homo sapiens
cctggggctctgcacagagcag

SEQ ID NO: 7736894 - DNA, 22 bp, Homo sapiens
cctggggctctgcacagagcag

SEQ ID NO: 7736895 - DNA, 22 bp, Homo sapiens
cctggggctttctttgtatcat

SEQ ID NO: 7736896 - DNA, 22 bp, Homo sapiens
aggtcctgggagttctagtgtg

SEQ ID NO: 7736897 - DNA, 20 bp, Homo sapiens
aggtcctgggactggcagag

SEQ ID NO: 7736898 - DNA, 22 bp, Homo sapiens
aggtcctgggagttctagtgtg

SEQ ID NO: 7736899 - DNA, 22 bp, Homo sapiens
aggtcctggtcttgagtcttaa

SEQ ID NO: 7736900 - DNA, 22 bp, Homo sapiens
aggtcctggtgaccatggagtt

SEQ ID NO: 7736901 - DNA, 20 bp, Homo sapiens
aggtcctggttctctgggat

SEQ ID NO: 7736902 - DNA, 22 bp, Homo sapiens
aggtcctggactgctcttgtta

SEQ ID NO: 7736903 - DNA, 20 bp, Homo sapiens
aggtcctgggactggcagag

SEQ ID NO: 7736904 - DNA, 22 bp, Homo sapiens
aggtcctgatgatctctgagag

SEQ ID NO: 7736905 - DNA, 23 bp, Homo sapiens
aggtcctggacatatgtgcatca

SEQ ID NO: 7736906 - DNA, 19 bp, Homo sapiens
aggtcctgatcagcaagga

SEQ ID NO: 7736907 - DNA, 22 bp, Homo sapiens
cctgggtcaccaggcccaggca

SEQ ID NO: 7736908 - DNA, 22 bp, Homo sapiens
cctgggtcactcaggcaggcgg

SEQ ID NO: 7736909 - DNA, 22 bp, Homo sapiens
cctgggtccaccctgtgaagta

SEQ ID NO: 7736910 - DNA, 22 bp, Homo sapiens
cctgggtccaattctggcttgt

SEQ ID NO: 7736911 - DNA, 22 bp, Homo sapiens
cctgtgggccctggacagagac

SEQ ID NO: 7736912 - DNA, 22 bp, Homo sapiens
aggtaaaatagatagtatttct

SEQ ID NO: 7736913 - DNA, 22 bp, Homo sapiens
agggttctgccagtgtcttgag

SEQ ID NO: 7736914 - DNA, 20 bp, Homo sapiens
agggttcccttgttcagcag

SEQ ID NO: 7736915 - DNA, 22 bp, Homo sapiens
ctattgaatagcccaaatcatt

SEQ ID NO: 7736916 - DNA, 22 bp, Homo sapiens
ctattgaaagtgtacaattcaa

SEQ ID NO: 7736917 - DNA, 22 bp, Homo sapiens
ctattgaattaactattaaagt

SEQ ID NO: 7736918 - DNA, 22 bp, Homo sapiens
ctattctagattacagtataaa

SEQ ID NO: 7736919 - DNA, 22 bp, Homo sapiens
agtcagcagtgaaagcacagcc

SEQ ID NO: 7736920 - DNA, 22 bp, Homo sapiens
agtcagcatctgcactgtgctg

SEQ ID NO: 7736921 - DNA, 22 bp, Homo sapiens
ctaggaaagacacagagagttt

SEQ ID NO: 7736922 - DNA, 22 bp, Homo sapiens
agtcacagaatgatggctccag

SEQ ID NO: 7736923 - DNA, 22 bp, Homo sapiens
ccttctcctgccttgggttcat

SEQ ID NO: 7736924 - DNA, 22 bp, Homo sapiens
agtaaataacagagaaaatggg

SEQ ID NO: 7736925 - DNA, 22 bp, Homo sapiens
agtaaatgaaagcaattttaga

SEQ ID NO: 7736926 - DNA, 22 bp, Homo sapiens
agtagggagaccggaggccgcc

SEQ ID NO: 7736927 - DNA, 22 bp, Homo sapiens
agtagcataaatagtggtagta

SEQ ID NO: 7736928 - DNA, 19 bp, Homo sapiens
agtagcagaaagtgcagtg

SEQ ID NO: 7736929 - DNA, 22 bp, Homo sapiens
agtagcagaaggtcttgaaggg

SEQ ID NO: 7736930 - DNA, 22 bp, Homo sapiens
agtagcagaaggtcttgaaggg

SEQ ID NO: 7736931 - DNA, 22 bp, Homo sapiens
ctggccagaagcacctttggcg

SEQ ID NO: 7736932 - DNA, 20 bp, Homo sapiens
ctggccagaacgcctacaca

SEQ ID NO: 7736933 - DNA, 23 bp, Homo sapiens
ctggcctccgacactggccaaga

SEQ ID NO: 7736934 - DNA, 22 bp, Homo sapiens
ctggccactgcgggcctctgcc

SEQ ID NO: 7736935 - DNA, 22 bp, Homo sapiens
ctggccactggtggtcataggc

SEQ ID NO: 7736936 - DNA, 22 bp, Homo sapiens
ctggccactggtggtcataggc

SEQ ID NO: 7736937 - DNA, 20 bp, Homo sapiens
atacacattcatagaaaaat

SEQ ID NO: 7736938 - DNA, 22 bp, Homo sapiens
atataaagaagtggaaaatgag

SEQ ID NO: 7736939 - DNA, 22 bp, Homo sapiens
atataaagagcttagtatagtg

SEQ ID NO: 7736940 - DNA, 22 bp, Homo sapiens
ctggctctttcctagctaggct

SEQ ID NO: 7736941 - DNA, 22 bp, Homo sapiens
atataaagtgtttagaaagctg

SEQ ID NO: 7736942 - DNA, 22 bp, Homo sapiens
atatacagttttacagggtttc

SEQ ID NO: 7736943 - DNA, 22 bp, Homo sapiens
ctgggagaggaacctcgagggt

SEQ ID NO: 7736944 - DNA, 22 bp, Homo sapiens
atatacaggtggtatgtgtaaa

SEQ ID NO: 7736945 - DNA, 22 bp, Homo sapiens
atatacaggtggtatgtgtaaa

SEQ ID NO: 7736946 - DNA, 22 bp, Homo sapiens
atatacagtatgtactgtggtt

SEQ ID NO: 7736947 - DNA, 22 bp, Homo sapiens
atatacagtatgtactgtggtt

SEQ ID NO: 7736948 - DNA, 22 bp, Homo sapiens
atatacagggagaaacagctta

SEQ ID NO: 7736949 - DNA, 22 bp, Homo sapiens
ctgcctgtgccaatgctccttt

SEQ ID NO: 7736950 - DNA, 22 bp, Homo sapiens
ctgcctgtgccaccgcctcatt

SEQ ID NO: 7736951 - DNA, 22 bp, Homo sapiens
ctgcctgtgatttttctctagt

SEQ ID NO: 7736952 - DNA, 21 bp, Homo sapiens
ctgctgtggcccccgacatgc

SEQ ID NO: 7736953 - DNA, 22 bp, Homo sapiens
ctgctgggggacacaggtccgg

SEQ ID NO: 7736954 - DNA, 22 bp, Homo sapiens
ctgctgtgcaggtgcctatgat

SEQ ID NO: 7736955 - DNA, 22 bp, Homo sapiens
ctgctgtgcagacagactctct

SEQ ID NO: 7736956 - DNA, 22 bp, Homo sapiens
ataaagatttctttttctctac

SEQ ID NO: 7736957 - DNA, 22 bp, Homo sapiens
agttcttcataaccttactgtg

SEQ ID NO: 7736958 - DNA, 22 bp, Homo sapiens
agttcttcataaccttactgtg

SEQ ID NO: 7736959 - DNA, 22 bp, Homo sapiens
ataaaagaagttttggtacttg

SEQ ID NO: 7736960 - DNA, 22 bp, Homo sapiens
agttctcagaattgcacctcaa

SEQ ID NO: 7736961 - DNA, 22 bp, Homo sapiens
agttctctttagctcatatggt

SEQ ID NO: 7736962 - DNA, 22 bp, Homo sapiens
agttctggtggtttggagatct

SEQ ID NO: 7736963 - DNA, 22 bp, Homo sapiens
agttctggcggctgtcggcact

SEQ ID NO: 7736964 - DNA, 22 bp, Homo sapiens
agttctgtggctgtgccctgta

SEQ ID NO: 7736965 - DNA, 22 bp, Homo sapiens
cttcaagttgtctgagggtggg

SEQ ID NO: 7736966 - DNA, 22 bp, Homo sapiens
cttcaagttgggcggcgggcag

SEQ ID NO: 7736967 - DNA, 22 bp, Homo sapiens
cttctgcaagagcatcagttgt

SEQ ID NO: 7736968 - DNA, 21 bp, Homo sapiens
atctcgggcttctcgcccagc

SEQ ID NO: 7736969 - DNA, 22 bp, Homo sapiens
atctgtgtatgtgaccttatct

SEQ ID NO: 7736970 - DNA, 22 bp, Homo sapiens
atctgtgtgttcaggaagtcct

SEQ ID NO: 7736971 - DNA, 22 bp, Homo sapiens
atcataagacccagccagtatt

SEQ ID NO: 7736972 - DNA, 22 bp, Homo sapiens
atcaggaaagagtggaactctg

SEQ ID NO: 7736973 - DNA, 22 bp, Homo sapiens
ctgtctcaagactgcaggcact

SEQ ID NO: 7736974 - DNA, 22 bp, Homo sapiens
atcagctgaaaaacaggcagca

SEQ ID NO: 7736975 - DNA, 22 bp, Homo sapiens
atcagctgatgaatggatgaat

SEQ ID NO: 7736976 - DNA, 22 bp, Homo sapiens
ctgtaatcccagctactcggga

SEQ ID NO: 7736977 - DNA, 22 bp, Homo sapiens
ctgtaatcccagctacctggga

SEQ ID NO: 7736978 - DNA, 22 bp, Homo sapiens
ctgggaggcggaggttgcagtg

SEQ ID NO: 7736979 - DNA, 22 bp, Homo sapiens
ctggggcatctgacagataaat

SEQ ID NO: 7736980 - DNA, 22 bp, Homo sapiens
ctgggggcaatggtcagagtgt

SEQ ID NO: 7736981 - DNA, 22 bp, Homo sapiens
ctgggggcaagcagacagctgt

SEQ ID NO: 7736982 - DNA, 22 bp, Homo sapiens
ctgggggcaagcagacagctgt

SEQ ID NO: 7736983 - DNA, 22 bp, Homo sapiens
ctgggggcaagcagacagctgt

SEQ ID NO: 7736984 - DNA, 22 bp, Homo sapiens
ctggtccctgcagtgtgctggg

SEQ ID NO: 7736985 - DNA, 22 bp, Homo sapiens
gcaggatgaaggcagaggctga

SEQ ID NO: 7736986 - DNA, 22 bp, Homo sapiens
gcaggatgggtgtagcccagca

SEQ ID NO: 7736987 - DNA, 22 bp, Homo sapiens
gcaggatggtggaaggcctgct

SEQ ID NO: 7736988 - DNA, 22 bp, Homo sapiens
gcaggctgtctaaagttagagt

SEQ ID NO: 7736989 - DNA, 22 bp, Homo sapiens
gcaggctgtgaggctcagatgg

SEQ ID NO: 7736990 - DNA, 22 bp, Homo sapiens
gcaggctgtggtatgttgggca

SEQ ID NO: 7736991 - DNA, 22 bp, Homo sapiens
gcagggaggaagagatgcttcc

SEQ ID NO: 7736992 - DNA, 22 bp, Homo sapiens
gcagggattgtgcagggggcta

SEQ ID NO: 7736993 - DNA, 22 bp, Homo sapiens
gccacagtgggctggggccaga

SEQ ID NO: 7736994 - DNA, 22 bp, Homo sapiens
gccacagtcaggacggggagag

SEQ ID NO: 7736995 - DNA, 22 bp, Homo sapiens
gccacagtcactgctgcagggg

SEQ ID NO: 7736996 - DNA, 22 bp, Homo sapiens
gcattcagggttcacggtcaac

SEQ ID NO: 7736997 - DNA, 22 bp, Homo sapiens
gccactgtcataccctggcaat

SEQ ID NO: 7736998 - DNA, 22 bp, Homo sapiens
gccactgtactccagcctgcga

SEQ ID NO: 7736999 - DNA, 22 bp, Homo sapiens
atttaaatgcttaagagggttt

SEQ ID NO: 7737000 - DNA, 21 bp, Homo sapiens
gcagtgcagcttggagggtag

SEQ ID NO: 7737001 - DNA, 22 bp, Homo sapiens
gcagtgcagtgggacagggcgc

SEQ ID NO: 7737002 - DNA, 22 bp, Homo sapiens
gcagtgcaggacaaatcagtgc

SEQ ID NO: 7737003 - DNA, 22 bp, Homo sapiens
gcagtgcaggaacatagcttct

SEQ ID NO: 7737004 - DNA, 18 bp, Homo sapiens
gcagtgcaggaagaagag

SEQ ID NO: 7737005 - DNA, 22 bp, Homo sapiens
gcagtgcattactcacatgttt

SEQ ID NO: 7737006 - DNA, 22 bp, Homo sapiens
gcagtgcatgtcggaactcatt

SEQ ID NO: 7737007 - DNA, 19 bp, Homo sapiens
gcagccaggtgctctacct

SEQ ID NO: 7737008 - DNA, 22 bp, Homo sapiens
gcagccaggggctgtgacctgt

SEQ ID NO: 7737009 - DNA, 22 bp, Homo sapiens
gcagccagggctaagctgggga

SEQ ID NO: 7737010 - DNA, 22 bp, Homo sapiens
gcagatgatgtagacagacagt

SEQ ID NO: 7737011 - DNA, 19 bp, Homo sapiens
gcagatgatgaggctggtc

SEQ ID NO: 7737012 - DNA, 22 bp, Homo sapiens
gcagaggctgggtgtcccagtc

SEQ ID NO: 7737013 - DNA, 22 bp, Homo sapiens
gcagaggctgtagggaaggttg

SEQ ID NO: 7737014 - DNA, 22 bp, Homo sapiens
gcagaggcctgaaggtggcggg

SEQ ID NO: 7737015 - DNA, 22 bp, Homo sapiens
gcagatgaagtttacaggaaac

SEQ ID NO: 7737016 - DNA, 20 bp, Homo sapiens
gcagatgagactcacagagg

SEQ ID NO: 7737017 - DNA, 22 bp, Homo sapiens
gcagaggggaagctgaggaatt

SEQ ID NO: 7737018 - DNA, 22 bp, Homo sapiens
gcagagttctcttccagctaac

SEQ ID NO: 7737019 - DNA, 22 bp, Homo sapiens
gcagaaggtcaaagcaagatgt

SEQ ID NO: 7737020 - DNA, 22 bp, Homo sapiens
gcagaagggaataaggagcttt

SEQ ID NO: 7737021 - DNA, 22 bp, Homo sapiens
gcagaggcctaggtggaaggcc

SEQ ID NO: 7737022 - DNA, 22 bp, Homo sapiens
gcaaatgtttttgagtgtttac

SEQ ID NO: 7737023 - DNA, 22 bp, Homo sapiens
gcaaaaaatgcttgttgcttag

SEQ ID NO: 7737024 - DNA, 22 bp, Homo sapiens
gcactggggtcatagcctccag

SEQ ID NO: 7737025 - DNA, 22 bp, Homo sapiens
gcacagaggatgaggcagctct

SEQ ID NO: 7737026 - DNA, 19 bp, Homo sapiens
gccctcctcactgagctct

SEQ ID NO: 7737027 - DNA, 22 bp, Homo sapiens
gcccagcccctgggtggacgtg

SEQ ID NO: 7737028 - DNA, 18 bp, Homo sapiens
gccagaggtactactgat

SEQ ID NO: 7737029 - DNA, 22 bp, Homo sapiens
atttacagtttagcatttcaag

SEQ ID NO: 7737030 - DNA, 22 bp, Homo sapiens
gcctgcctagaattgcagcttt

SEQ ID NO: 7737031 - DNA, 22 bp, Homo sapiens
attttctagatagatgatgcat

SEQ ID NO: 7737032 - DNA, 22 bp, Homo sapiens
attttgaaaccaagttatttcc

SEQ ID NO: 7737033 - DNA, 22 bp, Homo sapiens
attttgaaaagcatttgagtaa

SEQ ID NO: 7737034 - DNA, 22 bp, Homo sapiens
attttgaagggaattgaagttc

SEQ ID NO: 7737035 - DNA, 22 bp, Homo sapiens
atttgcctttcgaatcaacagg

SEQ ID NO: 7737036 - DNA, 22 bp, Homo sapiens
atttgccttggtgatttgtaaa

SEQ ID NO: 7737037 - DNA, 22 bp, Homo sapiens
atttgccttactgaagaaggag

SEQ ID NO: 7737038 - DNA, 22 bp, Homo sapiens
atttgccttgtgaattggatat

SEQ ID NO: 7737039 - DNA, 22 bp, Homo sapiens
atttgccttgtgatttgtaagt

SEQ ID NO: 7737040 - DNA, 22 bp, Homo sapiens
atttgcctgtaagacaaggcct

SEQ ID NO: 7737041 - DNA, 22 bp, Homo sapiens
atttgcctctgctttcaaggat

SEQ ID NO: 7737042 - DNA, 21 bp, Homo sapiens
gcctggctctcactggcctgg

SEQ ID NO: 7737043 - DNA, 22 bp, Homo sapiens
gcctggctcctaaggactggct

SEQ ID NO: 7737044 - DNA, 22 bp, Homo sapiens
gcgttggggaccccgaagctgg

SEQ ID NO: 7737045 - DNA, 22 bp, Homo sapiens
gctcagtgaaacatcaaatagt

SEQ ID NO: 7737046 - DNA, 22 bp, Homo sapiens
gctcagtctttgtggggtacgg

SEQ ID NO: 7737047 - DNA, 22 bp, Homo sapiens
gctctagaaagaaggatgtggg

SEQ ID NO: 7737048 - DNA, 22 bp, Homo sapiens
gctccaggctgctctgtcccat

SEQ ID NO: 7737049 - DNA, 22 bp, Homo sapiens
caaatctccttaaaggtaaaat

SEQ ID NO: 7737050 - DNA, 15 bp, Homo sapiens
gctctgggtatttga

SEQ ID NO: 7737051 - DNA, 22 bp, Homo sapiens
gctctgggtgaacttggagcaa

SEQ ID NO: 7737052 - DNA, 22 bp, Homo sapiens
gctctgggtgaagggtaccatt

SEQ ID NO: 7737053 - DNA, 22 bp, Homo sapiens
gctctgggtgaatggcagattg

SEQ ID NO: 7737054 - DNA, 20 bp, Homo sapiens
gctctgggtggtaaatgact

SEQ ID NO: 7737055 - DNA, 22 bp, Homo sapiens
gctctgggttctgatttatgag

SEQ ID NO: 7737056 - DNA, 22 bp, Homo sapiens
gctgagctgggacagtcctggg

SEQ ID NO: 7737057 - DNA, 22 bp, Homo sapiens
caaatgaagggagctgaagtct

SEQ ID NO: 7737058 - DNA, 22 bp, Homo sapiens
caaatgaaggtggtgggtcatt

SEQ ID NO: 7737059 - DNA, 22 bp, Homo sapiens
caaatgaagtccaaagggctta

SEQ ID NO: 7737060 - DNA, 22 bp, Homo sapiens
caaatgaagaaccttctcacct

SEQ ID NO: 7737061 - DNA, 22 bp, Homo sapiens
caaattcaaatttcatcagtgt

SEQ ID NO: 7737062 - DNA, 22 bp, Homo sapiens
caaatgaatagggagtgtgatg

SEQ ID NO: 7737063 - DNA, 22 bp, Homo sapiens
caaatgaatatttccatgggtt

SEQ ID NO: 7737064 - DNA, 17 bp, Homo sapiens
gaacttttattaaattc

SEQ ID NO: 7737065 - DNA, 22 bp, Homo sapiens
atgcaaatgcagccattgcaga

SEQ ID NO: 7737066 - DNA, 22 bp, Homo sapiens
atgcaaatgctagagaatgttg

SEQ ID NO: 7737067 - DNA, 22 bp, Homo sapiens
atgcaagtcttaatagtttagg

SEQ ID NO: 7737068 - DNA, 22 bp, Homo sapiens
atgcaatagtaattctagtctg

SEQ ID NO: 7737069 - DNA, 22 bp, Homo sapiens
atgcacaaacccacaattagtc

SEQ ID NO: 7737070 - DNA, 22 bp, Homo sapiens
atgcaatcatatggcatacagc

SEQ ID NO: 7737071 - DNA, 22 bp, Homo sapiens
gaaatgaactgattatcattgc

SEQ ID NO: 7737072 - DNA, 22 bp, Homo sapiens
atgaatcaagtgagaacagcat

SEQ ID NO: 7737073 - DNA, 22 bp, Homo sapiens
atgaatcaaagttcatttgatc

SEQ ID NO: 7737074 - DNA, 22 bp, Homo sapiens
atgaatatgagactgagagcct

SEQ ID NO: 7737075 - DNA, 22 bp, Homo sapiens
atgccctggggctacctctgag

SEQ ID NO: 7737076 - DNA, 23 bp, Homo sapiens
atgccctgtagaggctgctgacc

SEQ ID NO: 7737077 - DNA, 22 bp, Homo sapiens
atgccctgggagtgctgtacca

SEQ ID NO: 7737078 - DNA, 22 bp, Homo sapiens
atgccctgtgactctcctggac

SEQ ID NO: 7737079 - DNA, 23 bp, Homo sapiens
atgccctgtgcagaaatgtggaa

SEQ ID NO: 7737080 - DNA, 22 bp, Homo sapiens
atgccctgctgccatctggccg

SEQ ID NO: 7737081 - DNA, 22 bp, Homo sapiens
atgccctgctgctggggcagtg

SEQ ID NO: 7737082 - DNA, 22 bp, Homo sapiens
atgccctgctctcgggaaggga

SEQ ID NO: 7737083 - DNA, 22 bp, Homo sapiens
atgccctgcatcaagtgacact

SEQ ID NO: 7737084 - DNA, 22 bp, Homo sapiens
atgccctgccaagcaggctaaa

SEQ ID NO: 7737085 - DNA, 23 bp, Homo sapiens
gaatcagtggctaacaaggaaac

SEQ ID NO: 7737086 - DNA, 22 bp, Homo sapiens
gaccctgagcaaaagcagttct

SEQ ID NO: 7737087 - DNA, 22 bp, Homo sapiens
gaccctccactcactgctgtgt

SEQ ID NO: 7737088 - DNA, 17 bp, Homo sapiens
gactttggagtttcata

SEQ ID NO: 7737089 - DNA, 19 bp, Homo sapiens
gactttggaaatgctgttt

SEQ ID NO: 7737090 - DNA, 22 bp, Homo sapiens
gacagttaggacaactgacttc

SEQ ID NO: 7737091 - DNA, 22 bp, Homo sapiens
atgctttagttcaaaggactta

SEQ ID NO: 7737092 - DNA, 22 bp, Homo sapiens
atgtacaatctatcacaagaag

SEQ ID NO: 7737093 - DNA, 22 bp, Homo sapiens
atgtcacagtctgactcagtga

SEQ ID NO: 7737094 - DNA, 22 bp, Homo sapiens
atgtcacagcaggagtattctt

SEQ ID NO: 7737095 - DNA, 22 bp, Homo sapiens
atgtaagtattcaaaatatttc

SEQ ID NO: 7737096 - DNA, 22 bp, Homo sapiens
gagcttggggcatatggtgcta

SEQ ID NO: 7737097 - DNA, 22 bp, Homo sapiens
gagcttgggtgccatgctgagc

SEQ ID NO: 7737098 - DNA, 22 bp, Homo sapiens
gagcttggtgatgcctcctggt

SEQ ID NO: 7737099 - DNA, 22 bp, Homo sapiens
gagcttggctggacctcacgga

SEQ ID NO: 7737100 - DNA, 22 bp, Homo sapiens
gagctggggcggatactcagct

SEQ ID NO: 7737101 - DNA, 22 bp, Homo sapiens
gagcttggtgcacagtggttaa

SEQ ID NO: 7737102 - DNA, 22 bp, Homo sapiens
gagcttggtgctgcctgttgtc

SEQ ID NO: 7737103 - DNA, 22 bp, Homo sapiens
gagcttggtgttatttctgtgg

SEQ ID NO: 7737104 - DNA, 22 bp, Homo sapiens
gaggaaggaatgcagtgtatgc

SEQ ID NO: 7737105 - DNA, 22 bp, Homo sapiens
gaggaagccccattgaagccag

SEQ ID NO: 7737106 - DNA, 19 bp, Homo sapiens
gagcagctgcacccattga

SEQ ID NO: 7737107 - DNA, 22 bp, Homo sapiens
gagcagctgagctggaatgaga

SEQ ID NO: 7737108 - DNA, 22 bp, Homo sapiens
gagcagctctgggtgacccagt

SEQ ID NO: 7737109 - DNA, 22 bp, Homo sapiens
gagcagctctgtgcctggagac

SEQ ID NO: 7737110 - DNA, 22 bp, Homo sapiens
gagcagggcttgtcctcctcat

SEQ ID NO: 7737111 - DNA, 23 bp, Homo sapiens
gagctctgcactaggccctggga

SEQ ID NO: 7737112 - DNA, 22 bp, Homo sapiens
gagcctggggaccctcctgagt

SEQ ID NO: 7737113 - DNA, 22 bp, Homo sapiens
gagcctgggtccttccctggga

SEQ ID NO: 7737114 - DNA, 22 bp, Homo sapiens
gagcctgggtccttccctggga

SEQ ID NO: 7737115 - DNA, 22 bp, Homo sapiens
gagcctggggaccctcctgagt

SEQ ID NO: 7737116 - DNA, 22 bp, Homo sapiens
gagcctggcctcctgcctcagc

SEQ ID NO: 7737117 - DNA, 22 bp, Homo sapiens
gagaggtagcagtaagaacagg

SEQ ID NO: 7737118 - DNA, 22 bp, Homo sapiens
gagcagctcgagaaggaagcag

SEQ ID NO: 7737119 - DNA, 22 bp, Homo sapiens
gagcagctcaggcacttagcca

SEQ ID NO: 7737120 - DNA, 22 bp, Homo sapiens
gagcagctcagaggactagtgt

SEQ ID NO: 7737121 - DNA, 22 bp, Homo sapiens
gagcagctccagccgcatgact

SEQ ID NO: 7737122 - DNA, 22 bp, Homo sapiens
gagcagctaaaattctcatgca

SEQ ID NO: 7737123 - DNA, 22 bp, Homo sapiens
gagcagctaaaattctcatgca

SEQ ID NO: 7737124 - DNA, 22 bp, Homo sapiens
gagcagctagataaagcccttc

SEQ ID NO: 7737125 - DNA, 22 bp, Homo sapiens
gagcagctagataaagcccttc

SEQ ID NO: 7737126 - DNA, 22 bp, Homo sapiens
gagtccaggctgttgctcatct

SEQ ID NO: 7737127 - DNA, 22 bp, Homo sapiens
gatcctgtctgtggagtcagca

SEQ ID NO: 7737128 - DNA, 22 bp, Homo sapiens
gatcctgtctccgcaccgtgtt

SEQ ID NO: 7737129 - DNA, 22 bp, Homo sapiens
gatcctgttagaaatgtagact

SEQ ID NO: 7737130 - DNA, 22 bp, Homo sapiens
gatcctgttataatttggatgt

SEQ ID NO: 7737131 - DNA, 22 bp, Homo sapiens
gaggccacagtcctgaggcatc

SEQ ID NO: 7737132 - DNA, 22 bp, Homo sapiens
gaggcttctgtaaccctgtcct

SEQ ID NO: 7737133 - DNA, 22 bp, Homo sapiens
gaggcttcccgcccatgctgga

SEQ ID NO: 7737134 - DNA, 22 bp, Homo sapiens
gagggatgtgcctgaaggcagg

SEQ ID NO: 7737135 - DNA, 22 bp, Homo sapiens
gagggaagaaagaattgatgcg

SEQ ID NO: 7737136 - DNA, 22 bp, Homo sapiens
gaggttggtgaggggacacggt

SEQ ID NO: 7737137 - DNA, 22 bp, Homo sapiens
gaggttggggctgcagtgagct

SEQ ID NO: 7737138 - DNA, 23 bp, Homo sapiens
gaggtacagcaccagtgaatagg

SEQ ID NO: 7737139 - DNA, 22 bp, Homo sapiens
gaggtacagagtgttccaatgt

SEQ ID NO: 7737140 - DNA, 18 bp, Homo sapiens
gaggtagataagattttc

SEQ ID NO: 7737141 - DNA, 22 bp, Homo sapiens
gaggtacatgaggatacacagg

SEQ ID NO: 7737142 - DNA, 22 bp, Homo sapiens
ggtgtctgcttccctccagctg

SEQ ID NO: 7737143 - DNA, 22 bp, Homo sapiens
cagcactgctgctgtacacaca

SEQ ID NO: 7737144 - DNA, 22 bp, Homo sapiens
ggtggctggaggagctgatgga

SEQ ID NO: 7737145 - DNA, 18 bp, Homo sapiens
ggtggctggggacggaca

SEQ ID NO: 7737146 - DNA, 22 bp, Homo sapiens
ggtggctgggattagtagccca

SEQ ID NO: 7737147 - DNA, 22 bp, Homo sapiens
ggtggctggttttataagaggt

SEQ ID NO: 7737148 - DNA, 22 bp, Homo sapiens
ggtggctgtgagcattatgtga

SEQ ID NO: 7737149 - DNA, 22 bp, Homo sapiens
ggtggctgcttcctcaagagga

SEQ ID NO: 7737150 - DNA, 22 bp, Homo sapiens
ggtggctgcaccctggctaact

SEQ ID NO: 7737151 - DNA, 22 bp, Homo sapiens
cagatagcgtttgagagcataa

SEQ ID NO: 7737152 - DNA, 22 bp, Homo sapiens
cagatagcaatttgggcagggg

SEQ ID NO: 7737153 - DNA, 22 bp, Homo sapiens
cagatagcaaatgggtaagcta

SEQ ID NO: 7737154 - DNA, 22 bp, Homo sapiens
cagataaaggcttactagtagt

SEQ ID NO: 7737155 - DNA, 22 bp, Homo sapiens
ggggtgagatcaaggaagccct

SEQ ID NO: 7737156 - DNA, 22 bp, Homo sapiens
ggggtcctcggagcctgggtct

SEQ ID NO: 7737157 - DNA, 22 bp, Homo sapiens
ggggtcctggaggccagctgga

SEQ ID NO: 7737158 - DNA, 22 bp, Homo sapiens
cagaggctgccagccatgtgca

SEQ ID NO: 7737159 - DNA, 22 bp, Homo sapiens
cagaggcctttctacagtgata

SEQ ID NO: 7737160 - DNA, 22 bp, Homo sapiens
cagagcttctgacagctgctgc

SEQ ID NO: 7737161 - DNA, 22 bp, Homo sapiens
gggctctgcgctcagctccagc

SEQ ID NO: 7737162 - DNA, 22 bp, Homo sapiens
cagagctttgtgtcagggctgt

SEQ ID NO: 7737163 - DNA, 22 bp, Homo sapiens
gggggaggtgaatgcaataagg

SEQ ID NO: 7737164 - DNA, 22 bp, Homo sapiens
gggggcaggtctggaactttga

SEQ ID NO: 7737165 - DNA, 22 bp, Homo sapiens
gggggcagtaacctcaaagtgt

SEQ ID NO: 7737166 - DNA, 22 bp, Homo sapiens
cagaggaagcagacacatcttg

SEQ ID NO: 7737167 - DNA, 22 bp, Homo sapiens
cagaggaagctgggtgtggagt

SEQ ID NO: 7737168 - DNA, 22 bp, Homo sapiens
cagaggaagctgggtgtggagt

SEQ ID NO: 7737169 - DNA, 22 bp, Homo sapiens
cagaagcagattctaaagcaag

SEQ ID NO: 7737170 - DNA, 22 bp, Homo sapiens
cagaagcactaggaggaaacgt

SEQ ID NO: 7737171 - DNA, 18 bp, Homo sapiens
cagagcagaggtggagcg

SEQ ID NO: 7737172 - DNA, 22 bp, Homo sapiens
cagagcagcctccagggggagc

SEQ ID NO: 7737173 - DNA, 22 bp, Homo sapiens
gtgcctgggacttgctccggat

SEQ ID NO: 7737174 - DNA, 22 bp, Homo sapiens
gtgcctgggggtaatgtaggat

SEQ ID NO: 7737175 - DNA, 22 bp, Homo sapiens
cagctcccagaactgaccatgt

SEQ ID NO: 7737176 - DNA, 23 bp, Homo sapiens
cagctccagtgcactcaggtagc

SEQ ID NO: 7737177 - DNA, 22 bp, Homo sapiens
cagctccagctctgggcgcctc

SEQ ID NO: 7737178 - DNA, 22 bp, Homo sapiens
gtgctgaggtgggtgggcagcc

SEQ ID NO: 7737179 - DNA, 22 bp, Homo sapiens
cagctccagcccaggcagctcc

SEQ ID NO: 7737180 - DNA, 22 bp, Homo sapiens
cagctcctagatcggcgaagtg

SEQ ID NO: 7737181 - DNA, 22 bp, Homo sapiens
cagctcccctctgtggggcagt

SEQ ID NO: 7737182 - DNA, 22 bp, Homo sapiens
cagctcctctgttagccctggg

SEQ ID NO: 7737183 - DNA, 22 bp, Homo sapiens
cagctctgagactgaggctatg

SEQ ID NO: 7737184 - DNA, 22 bp, Homo sapiens
cagctctgaggaacactccttt

SEQ ID NO: 7737185 - DNA, 22 bp, Homo sapiens
gtcctgagatgtcacaaggttt

SEQ ID NO: 7737186 - DNA, 22 bp, Homo sapiens
gtcctgaggcaggatgggtttc

SEQ ID NO: 7737187 - DNA, 22 bp, Homo sapiens
gtcctgagccctcagcacagca

SEQ ID NO: 7737188 - DNA, 22 bp, Homo sapiens
gtcctgtggaaagctagccgct

SEQ ID NO: 7737189 - DNA, 22 bp, Homo sapiens
gtctctgggttaagcagtgcat

SEQ ID NO: 7737190 - DNA, 22 bp, Homo sapiens
gtctctgggtgtgtgatgccaa

SEQ ID NO: 7737191 - DNA, 22 bp, Homo sapiens
gtctctggctttatgctggttt

SEQ ID NO: 7737192 - DNA, 22 bp, Homo sapiens
gtctcagtgcccaatgccataa

SEQ ID NO: 7737193 - DNA, 22 bp, Homo sapiens
gtctcagtaagaaaggctcctg

SEQ ID NO: 7737194 - DNA, 22 bp, Homo sapiens
gtctcagttactctccctggta

SEQ ID NO: 7737195 - DNA, 22 bp, Homo sapiens
gtctcagtgtcacctccagctg

SEQ ID NO: 7737196 - DNA, 22 bp, Homo sapiens
gtctcagttgtatcacctggtt

SEQ ID NO: 7737197 - DNA, 22 bp, Homo sapiens
gtctcagtttgaagtgatgcca

SEQ ID NO: 7737198 - DNA, 22 bp, Homo sapiens
gtgaatggggcaggaaggatgg

SEQ ID NO: 7737199 - DNA, 22 bp, Homo sapiens
gtgaataatcacccttctggat

SEQ ID NO: 7737200 - DNA, 22 bp, Homo sapiens
gtgaagttgattgttatcgtca

SEQ ID NO: 7737201 - DNA, 22 bp, Homo sapiens
gtgaagttgattgttatcgtca

SEQ ID NO: 7737202 - DNA, 22 bp, Homo sapiens
gtgaagttttagtatatgtaga

SEQ ID NO: 7737203 - DNA, 22 bp, Homo sapiens
gtgaataactttctatgttaat

SEQ ID NO: 7737204 - DNA, 20 bp, Homo sapiens
gtgcagccaagctgagccgc

SEQ ID NO: 7737205 - DNA, 22 bp, Homo sapiens
ggcccagagtctgcaatggagt

SEQ ID NO: 7737206 - DNA, 21 bp, Homo sapiens
ggccccagcccatgggttctc

SEQ ID NO: 7737207 - DNA, 22 bp, Homo sapiens
ggccccaggcctttggtctggc

SEQ ID NO: 7737208 - DNA, 17 bp, Homo sapiens
ggcctgtgtggctgcag

SEQ ID NO: 7737209 - DNA, 23 bp, Homo sapiens
ggccactttgtgtcagtatgtgc

SEQ ID NO: 7737210 - DNA, 21 bp, Homo sapiens
cacatttgaacctcacagcaa

SEQ ID NO: 7737211 - DNA, 22 bp, Homo sapiens
ggcaggtgtgagctgtaaagga

SEQ ID NO: 7737212 - DNA, 22 bp, Homo sapiens
ggcaggtgtgagatcgaggcca

SEQ ID NO: 7737213 - DNA, 22 bp, Homo sapiens
ggcaggtgtggagtgttatttt

SEQ ID NO: 7737214 - DNA, 22 bp, Homo sapiens
ggcaggtgccttctgtgctagc

SEQ ID NO: 7737215 - DNA, 22 bp, Homo sapiens
ggcaggtgtttttatattaaag

SEQ ID NO: 7737216 - DNA, 22 bp, Homo sapiens
ggagtctgcggcagacactgta

SEQ ID NO: 7737217 - DNA, 22 bp, Homo sapiens
ggagtctgctcccagacatgat

SEQ ID NO: 7737218 - DNA, 22 bp, Homo sapiens
ggagtctggagtggggcccaag

SEQ ID NO: 7737219 - DNA, 22 bp, Homo sapiens
ggagtctgttttacatgcagga

SEQ ID NO: 7737220 - DNA, 22 bp, Homo sapiens
ggagtctgtcacctgtttctct

SEQ ID NO: 7737221 - DNA, 21 bp, Homo sapiens
ggagtctgtggatgctgtttc

SEQ ID NO: 7737222 - DNA, 22 bp, Homo sapiens
ggcaggaagtagcagtctgagc

SEQ ID NO: 7737223 - DNA, 22 bp, Homo sapiens
ggcagctgcaaatctgctctgt

SEQ ID NO: 7737224 - DNA, 22 bp, Homo sapiens
ggcagctgcaaatctgctctgt

SEQ ID NO: 7737225 - DNA, 22 bp, Homo sapiens
ggctgaggctcatgccatcttg

SEQ ID NO: 7737226 - DNA, 22 bp, Homo sapiens
ggctgcagattgtagtctgtta

SEQ ID NO: 7737227 - DNA, 22 bp, Homo sapiens
ggctgcggccgcgggtctgtgc

SEQ ID NO: 7737228 - DNA, 21 bp, Homo sapiens
cactgaggtcaggggtagggt

SEQ ID NO: 7737229 - DNA, 22 bp, Homo sapiens
cactgcaacctccacctcctgg

SEQ ID NO: 7737230 - DNA, 19 bp, Homo sapiens
ggctcctgtggctgcagcc

SEQ ID NO: 7737231 - DNA, 19 bp, Homo sapiens
ggctcctgtggctgcagcc

SEQ ID NO: 7737232 - DNA, 22 bp, Homo sapiens
ggctcctgtcccctcagctgct

SEQ ID NO: 7737233 - DNA, 22 bp, Homo sapiens
ggctgctgggtcatgatgcaga

SEQ ID NO: 7737234 - DNA, 22 bp, Homo sapiens
cagaaatggagcccaggaatct

SEQ ID NO: 7737235 - DNA, 22 bp, Homo sapiens
cagaaatgtactgacatgcagt

SEQ ID NO: 7737236 - DNA, 22 bp, Homo sapiens
ggcttctttttagtaaatgtca

SEQ ID NO: 7737237 - DNA, 20 bp, Homo sapiens
ggcttctttacatctgtgtt

SEQ ID NO: 7737238 - DNA, 22 bp, Homo sapiens
ggcttcttgtgtgtcaggctct

SEQ ID NO: 7737239 - DNA, 19 bp, Homo sapiens
gcttccagcactgcaggag

SEQ ID NO: 7737240 - DNA, 17 bp, Homo sapiens
ggaacaaatactatgca

SEQ ID NO: 7737241 - DNA, 20 bp, Homo sapiens
gcttccagaggaggccccgt

SEQ ID NO: 7737242 - DNA, 22 bp, Homo sapiens
gcttccacctactaaatgccac

SEQ ID NO: 7737243 - DNA, 22 bp, Homo sapiens
caagttcacttgtctacaaggg

SEQ ID NO: 7737244 - DNA, 22 bp, Homo sapiens
caagtcaatgattataagagtc

SEQ ID NO: 7737245 - DNA, 22 bp, Homo sapiens
caatgcaagcaagatggtcaca

SEQ ID NO: 7737246 - DNA, 22 bp, Homo sapiens
gctggccagtgtggtgaccacc

SEQ ID NO: 7737247 - DNA, 22 bp, Homo sapiens
gctggccatatattttgctgtt

SEQ ID NO: 7737248 - DNA, 22 bp, Homo sapiens
gctggccatggggagtgaggag

SEQ ID NO: 7737249 - DNA, 22 bp, Homo sapiens
gctggccatggggagtgaggag

SEQ ID NO: 7737250 - DNA, 22 bp, Homo sapiens
gctgggccttccgattctcaag

SEQ ID NO: 7737251 - DNA, 20 bp, Homo sapiens
gctgggctaccactggccct

SEQ ID NO: 7737252 - DNA, 22 bp, Homo sapiens
caaatttaggtaacagtctgta

SEQ ID NO: 7737253 - DNA, 16 bp, Homo sapiens
gctggagggaggggtt

SEQ ID NO: 7737254 - DNA, 22 bp, Homo sapiens
ggaggggatggtttgaccctgg

SEQ ID NO: 7737255 - DNA, 22 bp, Homo sapiens
cacaggagagctgggaggtgcc

SEQ ID NO: 7737256 - DNA, 22 bp, Homo sapiens
ggaggggatttagtagatgcta

SEQ ID NO: 7737257 - DNA, 22 bp, Homo sapiens
cacagcagtctttcactaaata

SEQ ID NO: 7737258 - DNA, 22 bp, Homo sapiens
cacagcaggtgcttaatgatta

SEQ ID NO: 7737259 - DNA, 22 bp, Homo sapiens
cacagccctgcgccccagtttg

SEQ ID NO: 7737260 - DNA, 22 bp, Homo sapiens
ggagcagccacgtctcagggca

SEQ ID NO: 7737261 - DNA, 22 bp, Homo sapiens
ggagcagccgcgtctcagggca

SEQ ID NO: 7737262 - DNA, 22 bp, Homo sapiens
ggaggagacagtaaaaagcacg

SEQ ID NO: 7737263 - DNA, 22 bp, Homo sapiens
ggagcagcttgcatgctcaggg

SEQ ID NO: 7737264 - DNA, 22 bp, Homo sapiens
ggagcagcttgcatgctcaggg

SEQ ID NO: 7737265 - DNA, 22 bp, Homo sapiens
ggagcagcttgcatgctcaggg

SEQ ID NO: 7737266 - DNA, 22 bp, Homo sapiens
ggaggagcacttgacggggtct

SEQ ID NO: 7737267 - DNA, 22 bp, Homo sapiens
ggaggagcacttctgagctcag

SEQ ID NO: 7737268 - DNA, 22 bp, Homo sapiens
ggaggagaccctgtgtcagttt

SEQ ID NO: 7737269 - DNA, 22 bp, Homo sapiens
ggaggagagaggttgcaaacac

SEQ ID NO: 7737270 - DNA, 22 bp, Homo sapiens
ggaggagacggagtgattagtg

SEQ ID NO: 7737271 - DNA, 22 bp, Homo sapiens
ggaggagattcccctctcactt

SEQ ID NO: 7737272 - DNA, 22 bp, Homo sapiens
ggaggagagaggttgcaaacac

SEQ ID NO: 7737273 - DNA, 22 bp, Homo sapiens
ggacagagggttgacagagtat

SEQ ID NO: 7737274 - DNA, 22 bp, Homo sapiens
ggacacaaaagtgaataaaata

SEQ ID NO: 7737275 - DNA, 22 bp, Homo sapiens
ggaaggggccttgagcaaactg

SEQ ID NO: 7737276 - DNA, 22 bp, Homo sapiens
ggaagagaaatgagtcaagact

SEQ ID NO: 7737277 - DNA, 22 bp, Homo sapiens
ggaagagagatcccatagatgt

SEQ ID NO: 7737278 - DNA, 22 bp, Homo sapiens
ggagataatccagggagggact

SEQ ID NO: 7737279 - DNA, 22 bp, Homo sapiens
ggagagtggattccagctgtat

SEQ ID NO: 7737280 - DNA, 22 bp, Homo sapiens
ggagagctgacatcatgatgtt

SEQ ID NO: 7737281 - DNA, 23 bp, Homo sapiens
catgtacagagtttgataaagtg

SEQ ID NO: 7737282 - DNA, 22 bp, Homo sapiens
catgtacaaggatgctcagagt

SEQ ID NO: 7737283 - DNA, 22 bp, Homo sapiens
tccaggctttggggcaggagcg

SEQ ID NO: 7737284 - DNA, 22 bp, Homo sapiens
tccaggctttttcatgctgtct

SEQ ID NO: 7737285 - DNA, 22 bp, Homo sapiens
tccagggcatgctcagactcag

SEQ ID NO: 7737286 - DNA, 22 bp, Homo sapiens
tccaggtcatcttggagagctg

SEQ ID NO: 7737287 - DNA, 22 bp, Homo sapiens
tccaggtcccagactgggcagc

SEQ ID NO: 7737288 - DNA, 18 bp, Homo sapiens
tccaggtcccaggggaag

SEQ ID NO: 7737289 - DNA, 22 bp, Homo sapiens
tccaggtcagacttctgtgccc

SEQ ID NO: 7737290 - DNA, 22 bp, Homo sapiens
tccagggcagtgactacagcgg

SEQ ID NO: 7737291 - DNA, 19 bp, Homo sapiens
catggtgaaaccccgtctc

SEQ ID NO: 7737292 - DNA, 22 bp, Homo sapiens
catgctgggtaaaggtggtgaa

SEQ ID NO: 7737293 - DNA, 22 bp, Homo sapiens
catgctggtcagccagtggatg

SEQ ID NO: 7737294 - DNA, 22 bp, Homo sapiens
tccaagcactgttaattaaact

SEQ ID NO: 7737295 - DNA, 22 bp, Homo sapiens
tcagtgtgtacactgagcattt

SEQ ID NO: 7737296 - DNA, 23 bp, Homo sapiens
tcagtgtgcaagaatggagaagc

SEQ ID NO: 7737297 - DNA, 22 bp, Homo sapiens
tcagtgtgcacatggtagcagt

SEQ ID NO: 7737298 - DNA, 22 bp, Homo sapiens
tcagtgtcttgacctgggtgtg

SEQ ID NO: 7737299 - DNA, 22 bp, Homo sapiens
tcagtgtgaggggctgggtcct

SEQ ID NO: 7737300 - DNA, 22 bp, Homo sapiens
tcagtgtcttctctttcctacc

SEQ ID NO: 7737301 - DNA, 22 bp, Homo sapiens
catcagagtggtggcctggtgt

SEQ ID NO: 7737302 - DNA, 20 bp, Homo sapiens
tcatcagataggttagtaca

SEQ ID NO: 7737303 - DNA, 19 bp, Homo sapiens
tcagtgtgtgggaggtggt

SEQ ID NO: 7737304 - DNA, 22 bp, Homo sapiens
tcataagctagctgcaccatat

SEQ ID NO: 7737305 - DNA, 21 bp, Homo sapiens
catcacattactcaaagtcct

SEQ ID NO: 7737306 - DNA, 22 bp, Homo sapiens
catcacattagtctcaagagaa

SEQ ID NO: 7737307 - DNA, 22 bp, Homo sapiens
tcaggctgcctatcagactgtg

SEQ ID NO: 7737308 - DNA, 22 bp, Homo sapiens
catcaagagtcttactatcagt

SEQ ID NO: 7737309 - DNA, 22 bp, Homo sapiens
catcaaagggcctgtggtgcag

SEQ ID NO: 7737310 - DNA, 22 bp, Homo sapiens
catcaaagcttttttctgtgtt

SEQ ID NO: 7737311 - DNA, 22 bp, Homo sapiens
catcaaagttgatatccaatta

SEQ ID NO: 7737312 - DNA, 22 bp, Homo sapiens
ccagagccagagaggtgcctgc

SEQ ID NO: 7737313 - DNA, 22 bp, Homo sapiens
tctctgggataaactgggccag

SEQ ID NO: 7737314 - DNA, 20 bp, Homo sapiens
ccagcaccctctcagctgaa

SEQ ID NO: 7737315 - DNA, 22 bp, Homo sapiens
ccagattcatagaaactcatag

SEQ ID NO: 7737316 - DNA, 22 bp, Homo sapiens
tctcagtgtgttgagaggtctg

SEQ ID NO: 7737317 - DNA, 22 bp, Homo sapiens
tctcagtggtgttttgagtcca

SEQ ID NO: 7737318 - DNA, 22 bp, Homo sapiens
tctcagtgtggtgcttaggata

SEQ ID NO: 7737319 - DNA, 22 bp, Homo sapiens
tctcagtgggaagggcacagtt

SEQ ID NO: 7737320 - DNA, 22 bp, Homo sapiens
tctcagtgggttaaaagagaag

SEQ ID NO: 7737321 - DNA, 22 bp, Homo sapiens
tctcagtggtggcattccagac

SEQ ID NO: 7737322 - DNA, 22 bp, Homo sapiens
tctcagtggcttcctcactttt

SEQ ID NO: 7737323 - DNA, 22 bp, Homo sapiens
tctcagtgtttaaaaagatttc

SEQ ID NO: 7737324 - DNA, 22 bp, Homo sapiens
tctcagtgttgttctgcagatg

SEQ ID NO: 7737325 - DNA, 22 bp, Homo sapiens
tctcagtgtgttttctctcaga

SEQ ID NO: 7737326 - DNA, 22 bp, Homo sapiens
tctcagtgttatctatctgcct

SEQ ID NO: 7737327 - DNA, 22 bp, Homo sapiens
tctcagtggatctcagaatttt

SEQ ID NO: 7737328 - DNA, 22 bp, Homo sapiens
tctataatcctatttcaactgc

SEQ ID NO: 7737329 - DNA, 22 bp, Homo sapiens
tctcagagaagtgatgagcaat

SEQ ID NO: 7737330 - DNA, 17 bp, Homo sapiens
tcctgtttatcattgat

SEQ ID NO: 7737331 - DNA, 22 bp, Homo sapiens
tcctgtttatctgtgtgactcg

SEQ ID NO: 7737332 - DNA, 22 bp, Homo sapiens
ccaccccaaatgaagacctctc

SEQ ID NO: 7737333 - DNA, 22 bp, Homo sapiens
ccaccccaaatgaagacctctc

SEQ ID NO: 7737334 - DNA, 19 bp, Homo sapiens
ccacccctttgctgggccc

SEQ ID NO: 7737335 - DNA, 19 bp, Homo sapiens
tcctgcccaccagccaggg

SEQ ID NO: 7737336 - DNA, 22 bp, Homo sapiens
ccaaattaaatcatacagacag

SEQ ID NO: 7737337 - DNA, 22 bp, Homo sapiens
tcctgaggtggattgagcagag

SEQ ID NO: 7737338 - DNA, 22 bp, Homo sapiens
tcctgaggtggattgagcagag

SEQ ID NO: 7737339 - DNA, 22 bp, Homo sapiens
tcctgaggtgctcagccaggaa

SEQ ID NO: 7737340 - DNA, 22 bp, Homo sapiens
tcctgaggtatatgctttgcag

SEQ ID NO: 7737341 - DNA, 23 bp, Homo sapiens
tcctgagggtttcccagccttgg

SEQ ID NO: 7737342 - DNA, 22 bp, Homo sapiens
tcctggccttatccccaaactg

SEQ ID NO: 7737343 - DNA, 22 bp, Homo sapiens
tcctggctagttttgctgaaat

SEQ ID NO: 7737344 - DNA, 22 bp, Homo sapiens
tcctggccttgctcctgatgcc

SEQ ID NO: 7737345 - DNA, 22 bp, Homo sapiens
tccaggtccctggggagatttt

SEQ ID NO: 7737346 - DNA, 22 bp, Homo sapiens
tccaggtcctactggcccatag

SEQ ID NO: 7737347 - DNA, 22 bp, Homo sapiens
catttcacgcacactcattact

SEQ ID NO: 7737348 - DNA, 22 bp, Homo sapiens
catttgtcatcactgagctgcc

SEQ ID NO: 7737349 - DNA, 22 bp, Homo sapiens
tcctgaggctcactttgaatgt

SEQ ID NO: 7737350 - DNA, 22 bp, Homo sapiens
tcctgagggcgattcagcaggt

SEQ ID NO: 7737351 - DNA, 22 bp, Homo sapiens
tcctgagggcattttggtgact

SEQ ID NO: 7737352 - DNA, 22 bp, Homo sapiens
tcctgagggactggttcctcgc

SEQ ID NO: 7737353 - DNA, 22 bp, Homo sapiens
tagacattggccattcctgtgg

SEQ ID NO: 7737354 - DNA, 22 bp, Homo sapiens
tagacattatgtattaagttct

SEQ ID NO: 7737355 - DNA, 22 bp, Homo sapiens
tagacatttggcatggttttca

SEQ ID NO: 7737356 - DNA, 22 bp, Homo sapiens
tagacatttggagttttatgac

SEQ ID NO: 7737357 - DNA, 22 bp, Homo sapiens
tagacattaggtaggttcatgg

SEQ ID NO: 7737358 - DNA, 22 bp, Homo sapiens
tagaaatgtaggcttcctgaca

SEQ ID NO: 7737359 - DNA, 22 bp, Homo sapiens
tagaaatgtgataatagcttaa

SEQ ID NO: 7737360 - DNA, 22 bp, Homo sapiens
caggctgagggttaggccttag

SEQ ID NO: 7737361 - DNA, 22 bp, Homo sapiens
caggctgaggcagtagggtttg

SEQ ID NO: 7737362 - DNA, 22 bp, Homo sapiens
caggctgatagggtccaaagtt

SEQ ID NO: 7737363 - DNA, 22 bp, Homo sapiens
caggctgatcagggctgggatg

SEQ ID NO: 7737364 - DNA, 22 bp, Homo sapiens
caggctgattaggcctcgtcca

SEQ ID NO: 7737365 - DNA, 22 bp, Homo sapiens
tagcatcagccacaccttgtac

SEQ ID NO: 7737366 - DNA, 22 bp, Homo sapiens
tagcatcatgatcagaactgtt

SEQ ID NO: 7737367 - DNA, 18 bp, Homo sapiens
tagcagcactggccgctt

SEQ ID NO: 7737368 - DNA, 22 bp, Homo sapiens
tagcagttaatctgagccaaga

SEQ ID NO: 7737369 - DNA, 22 bp, Homo sapiens
cagggatgctgcttaggcagtt

SEQ ID NO: 7737370 - DNA, 22 bp, Homo sapiens
cagggatgagcagatggagcaa

SEQ ID NO: 7737371 - DNA, 22 bp, Homo sapiens
tagcagcaatttcagaagtttg

SEQ ID NO: 7737372 - DNA, 22 bp, Homo sapiens
tagcagcacagaaagcctggag

SEQ ID NO: 7737373 - DNA, 22 bp, Homo sapiens
tagcagcaagaatgggatgtgt

SEQ ID NO: 7737374 - DNA, 22 bp, Homo sapiens
tagcagcaattcaggtgtgatg

SEQ ID NO: 7737375 - DNA, 22 bp, Homo sapiens
cagggatggcctggcgggccac

SEQ ID NO: 7737376 - DNA, 22 bp, Homo sapiens
cagggatgaccagagggatgtg

SEQ ID NO: 7737377 - DNA, 22 bp, Homo sapiens
cagggagggacaattgtcacct

SEQ ID NO: 7737378 - DNA, 22 bp, Homo sapiens
cagggaggctgtcttatgcctg

SEQ ID NO: 7737379 - DNA, 22 bp, Homo sapiens
cagggagggaggaaaatttgct

SEQ ID NO: 7737380 - DNA, 23 bp, Homo sapiens
cagggaggagatactgtgtatct

SEQ ID NO: 7737381 - DNA, 22 bp, Homo sapiens
cagggaggatgggctgttttgc

SEQ ID NO: 7737382 - DNA, 22 bp, Homo sapiens
caggccccattcctcttgggac

SEQ ID NO: 7737383 - DNA, 22 bp, Homo sapiens
tacacagggaaaggtctcagag

SEQ ID NO: 7737384 - DNA, 22 bp, Homo sapiens
gtggagcaggactagctgagaa

SEQ ID NO: 7737385 - DNA, 22 bp, Homo sapiens
cagctctgcctctggggctgag

SEQ ID NO: 7737386 - DNA, 22 bp, Homo sapiens
caggctcaaggctgacttccat

SEQ ID NO: 7737387 - DNA, 22 bp, Homo sapiens
caggctcccgaaatcacccatg

SEQ ID NO: 7737388 - DNA, 22 bp, Homo sapiens
tacagtttcccagcagatgcaa

SEQ ID NO: 7737389 - DNA, 20 bp, Homo sapiens
caggctccgcaggactaggg

SEQ ID NO: 7737390 - DNA, 17 bp, Homo sapiens
caggctccttccagatt

SEQ ID NO: 7737391 - DNA, 22 bp, Homo sapiens
caggctccttatcttacaactt

SEQ ID NO: 7737392 - DNA, 22 bp, Homo sapiens
caggctccttcccagggatggt

SEQ ID NO: 7737393 - DNA, 22 bp, Homo sapiens
caggctccctaagtcagcagcc

SEQ ID NO: 7737394 - DNA, 22 bp, Homo sapiens
caggctcccgctccactgggca

SEQ ID NO: 7737395 - DNA, 22 bp, Homo sapiens
caggctccctgggcagtggcag

SEQ ID NO: 7737396 - DNA, 22 bp, Homo sapiens
tacagcctcgaactcctgcatt

SEQ ID NO: 7737397 - DNA, 22 bp, Homo sapiens
caggcctgtgagttgaggcccc

SEQ ID NO: 7737398 - DNA, 22 bp, Homo sapiens
cagggccaagctgcagcatctg

SEQ ID NO: 7737399 - DNA, 22 bp, Homo sapiens
tagtaatcagaggtaaacttta

SEQ ID NO: 7737400 - DNA, 22 bp, Homo sapiens
tagtaagttctcgcattgttat

SEQ ID NO: 7737401 - DNA, 22 bp, Homo sapiens
tagtaagtagctaatatttact

SEQ ID NO: 7737402 - DNA, 22 bp, Homo sapiens
tagtaaatctcagaaaaagatc

SEQ ID NO: 7737403 - DNA, 22 bp, Homo sapiens
tagtgattttcatattacatta

SEQ ID NO: 7737404 - DNA, 22 bp, Homo sapiens
tagtgattgctgatattccatt

SEQ ID NO: 7737405 - DNA, 22 bp, Homo sapiens
cagggctggatcctccagactc

SEQ ID NO: 7737406 - DNA, 22 bp, Homo sapiens
cagggctgctggccgtgccctc

SEQ ID NO: 7737407 - DNA, 22 bp, Homo sapiens
tagtacagaaaacctcagggtc

SEQ ID NO: 7737408 - DNA, 22 bp, Homo sapiens
tagtgttccagaagcaaacaag

SEQ ID NO: 7737409 - DNA, 22 bp, Homo sapiens
tatatacaaggtaggtttaggt

SEQ ID NO: 7737410 - DNA, 22 bp, Homo sapiens
tatataattttctgccatatcc

SEQ ID NO: 7737411 - DNA, 22 bp, Homo sapiens
tatgcaaatcattagatttcct

SEQ ID NO: 7737412 - DNA, 22 bp, Homo sapiens
tatgtacatggagagcaattga

SEQ ID NO: 7737413 - DNA, 22 bp, Homo sapiens
tatgtacatgatttcatttgct

SEQ ID NO: 7737414 - DNA, 22 bp, Homo sapiens
tatgtacatcttgagcaatgaa

SEQ ID NO: 7737415 - DNA, 22 bp, Homo sapiens
cagtactgcttgtgggagcaga

SEQ ID NO: 7737416 - DNA, 22 bp, Homo sapiens
tatgtacatcgttgaattcaaa

SEQ ID NO: 7737417 - DNA, 22 bp, Homo sapiens
cagtgcaggtttagggctgggg

SEQ ID NO: 7737418 - DNA, 22 bp, Homo sapiens
cagtgcagtcaaggaagaacca

SEQ ID NO: 7737419 - DNA, 22 bp, Homo sapiens
cagtgcagttggtggcaggggt

SEQ ID NO: 7737420 - DNA, 22 bp, Homo sapiens
cagtgcaggtggcagaggacag

SEQ ID NO: 7737421 - DNA, 22 bp, Homo sapiens
cagtgcagaggccagggaggat

SEQ ID NO: 7737422 - DNA, 22 bp, Homo sapiens
tcacactgtgaagagacaagca

SEQ ID NO: 7737423 - DNA, 22 bp, Homo sapiens
cagtgctgttgtaagctcattg

SEQ ID NO: 7737424 - DNA, 19 bp, Homo sapiens
tcacattcagccttgctga

SEQ ID NO: 7737425 - DNA, 22 bp, Homo sapiens
tcacattctagaatgttatcgt

SEQ ID NO: 7737426 - DNA, 19 bp, Homo sapiens
tcaaatgccaatgtcacag

SEQ ID NO: 7737427 - DNA, 22 bp, Homo sapiens
cagtctggcacagcacactgaa

SEQ ID NO: 7737428 - DNA, 22 bp, Homo sapiens
cagtctggctcagcacaaaggg

SEQ ID NO: 7737429 - DNA, 22 bp, Homo sapiens
cagtctggaggtcagctggctt

SEQ ID NO: 7737430 - DNA, 22 bp, Homo sapiens
tattccaacttcactattgtct

SEQ ID NO: 7737431 - DNA, 22 bp, Homo sapiens
tcaaagcatcagtcaatttagg

SEQ ID NO: 7737432 - DNA, 22 bp, Homo sapiens
tcaaagcagcacattcgcaagc

SEQ ID NO: 7737433 - DNA, 22 bp, Homo sapiens
tcaaagcatggttttgaaagac

SEQ ID NO: 7737434 - DNA, 22 bp, Homo sapiens
tcaaagcctgtggatagtttgg

SEQ ID NO: 7737435 - DNA, 22 bp, Homo sapiens
tcaaagcacacttagtggtaga

SEQ ID NO: 7737436 - DNA, 22 bp, Homo sapiens
tcaaagcaatttcaccagtgcc

SEQ ID NO: 7737437 - DNA, 20 bp, Homo sapiens
tcaaagcactgcctgtcatc

SEQ ID NO: 7737438 - DNA, 22 bp, Homo sapiens
tcaaagcagcacattcgcaagc

SEQ ID NO: 7737439 - DNA, 22 bp, Homo sapiens
tcaaagcactggggaaagcctg

SEQ ID NO: 7737440 - DNA, 21 bp, Homo sapiens
tcaaagcacatatttgcacat

SEQ ID NO: 7737441 - DNA, 22 bp, Homo sapiens
tgagcagtaacagctcacaggg

SEQ ID NO: 7737442 - DNA, 22 bp, Homo sapiens
ccagtccacgtcaagaagaggt

SEQ ID NO: 7737443 - DNA, 20 bp, Homo sapiens
ccagtccacctgagacatgt

SEQ ID NO: 7737444 - DNA, 22 bp, Homo sapiens
ccagtgcataatcaatacagcc

SEQ ID NO: 7737445 - DNA, 22 bp, Homo sapiens
ccagtgcattgccgtgtctagg

SEQ ID NO: 7737446 - DNA, 22 bp, Homo sapiens
tgagccagttcttcagatccat

SEQ ID NO: 7737447 - DNA, 22 bp, Homo sapiens
ccagtgcagtccccctgaactg

SEQ ID NO: 7737448 - DNA, 22 bp, Homo sapiens
ccagtgcaggtgagcaccaggt

SEQ ID NO: 7737449 - DNA, 22 bp, Homo sapiens
tgagtctgatttttctagcatt

SEQ ID NO: 7737450 - DNA, 22 bp, Homo sapiens
tgagtctgctcctggtagcaga

SEQ ID NO: 7737451 - DNA, 22 bp, Homo sapiens
tgagttctttccgttaggtatg

SEQ ID NO: 7737452 - DNA, 22 bp, Homo sapiens
ccatccctcctccaccagctag

SEQ ID NO: 7737453 - DNA, 22 bp, Homo sapiens
ccatccctgccattatagccca

SEQ ID NO: 7737454 - DNA, 22 bp, Homo sapiens
ccatcagtgaaggagacagatt

SEQ ID NO: 7737455 - DNA, 22 bp, Homo sapiens
ccatcacagtccccatcgtgat

SEQ ID NO: 7737456 - DNA, 21 bp, Homo sapiens
tgcaatatatatttgcctgaa

SEQ ID NO: 7737457 - DNA, 22 bp, Homo sapiens
tgataaatccatgtaaatggta

SEQ ID NO: 7737458 - DNA, 22 bp, Homo sapiens
tgcacagatctggtggcaagga

SEQ ID NO: 7737459 - DNA, 22 bp, Homo sapiens
tgcactccaggctgggtgacag

SEQ ID NO: 7737460 - DNA, 22 bp, Homo sapiens
tgcaggcctatggtggggcccc

SEQ ID NO: 7737461 - DNA, 22 bp, Homo sapiens
tgcaggcccagtgtagaggctc

SEQ ID NO: 7737462 - DNA, 22 bp, Homo sapiens
tgcagctgattaaagggcagac

SEQ ID NO: 7737463 - DNA, 22 bp, Homo sapiens
tgcagctgcctagggctggctt

SEQ ID NO: 7737464 - DNA, 23 bp, Homo sapiens
tgcagctgcctctggcgggccgg

SEQ ID NO: 7737465 - DNA, 22 bp, Homo sapiens
ccagggagggtcctgtggcttc

SEQ ID NO: 7737466 - DNA, 22 bp, Homo sapiens
tgaaatgagataatttaagtgc

SEQ ID NO: 7737467 - DNA, 22 bp, Homo sapiens
ccagggctccattgctcatcct

SEQ ID NO: 7737468 - DNA, 22 bp, Homo sapiens
ccaggcctgattgggaatcttg

SEQ ID NO: 7737469 - DNA, 19 bp, Homo sapiens
ccaggcctctggggcctgt

SEQ ID NO: 7737470 - DNA, 23 bp, Homo sapiens
ccaggcctctcagagggtgtgcc

SEQ ID NO: 7737471 - DNA, 22 bp, Homo sapiens
ccaggcctctggctgcttagtc

SEQ ID NO: 7737472 - DNA, 22 bp, Homo sapiens
tcttttcttgcattattgcact

SEQ ID NO: 7737473 - DNA, 21 bp, Homo sapiens
ccaggctgggagggcagttcc

SEQ ID NO: 7737474 - DNA, 22 bp, Homo sapiens
ccaggcttcctaatgtgtgcag

SEQ ID NO: 7737475 - DNA, 22 bp, Homo sapiens
tgaaatgacagtcttaagctct

SEQ ID NO: 7737476 - DNA, 22 bp, Homo sapiens
ccaggcctcctgtgagtggacc

SEQ ID NO: 7737477 - DNA, 19 bp, Homo sapiens
ccaggcctcctgggaggtc

SEQ ID NO: 7737478 - DNA, 22 bp, Homo sapiens
ccaggcctcccttttccagcca

SEQ ID NO: 7737479 - DNA, 22 bp, Homo sapiens
tcttctggatgagagcggaggc

SEQ ID NO: 7737480 - DNA, 21 bp, Homo sapiens
ccaggcagagctgtgagttct

SEQ ID NO: 7737481 - DNA, 21 bp, Homo sapiens
tctgtggcggactctaggccc

SEQ ID NO: 7737482 - DNA, 22 bp, Homo sapiens
tctgttcttcctacattcacat

SEQ ID NO: 7737483 - DNA, 22 bp, Homo sapiens
tctggggagtgcctaagtggaa

SEQ ID NO: 7737484 - DNA, 22 bp, Homo sapiens
tctgggctctgtcagcacctct

SEQ ID NO: 7737485 - DNA, 22 bp, Homo sapiens
tctgggcttttgcactggccat

SEQ ID NO: 7737486 - DNA, 22 bp, Homo sapiens
tctgggcctgtctcagagctgg

SEQ ID NO: 7737487 - DNA, 22 bp, Homo sapiens
tctgggctctgggaattaggga

SEQ ID NO: 7737488 - DNA, 22 bp, Homo sapiens
tctgggctctgcgaagcccttc

SEQ ID NO: 7737489 - DNA, 22 bp, Homo sapiens
tctgggctcacgagtctggaca

SEQ ID NO: 7737490 - DNA, 22 bp, Homo sapiens
tctgggctatatggtctctgct

SEQ ID NO: 7737491 - DNA, 22 bp, Homo sapiens
ccagcaccttgatcttggagtt

SEQ ID NO: 7737492 - DNA, 22 bp, Homo sapiens
tctgggccctgagatgttcttc

SEQ ID NO: 7737493 - DNA, 22 bp, Homo sapiens
cctgccctgtgtttggggacta

SEQ ID NO: 7737494 - DNA, 22 bp, Homo sapiens
cctgccctgtcactggctaggg

SEQ ID NO: 7737495 - DNA, 22 bp, Homo sapiens
cctgccctgtcactggctaggg

SEQ ID NO: 7737496 - DNA, 22 bp, Homo sapiens
cctgcccttctttccccagcat

SEQ ID NO: 7737497 - DNA, 22 bp, Homo sapiens
cctgcctatgagacgttttgcc

SEQ ID NO: 7737498 - DNA, 22 bp, Homo sapiens
tggttacccagtcgctggagtt

SEQ ID NO: 7737499 - DNA, 22 bp, Homo sapiens
tgggtgggagcaccctgtctgg

SEQ ID NO: 7737500 - DNA, 22 bp, Homo sapiens
tgggtccacaaacatcagatat

SEQ ID NO: 7737501 - DNA, 22 bp, Homo sapiens
tgggtggcacttctggggtcca

SEQ ID NO: 7737502 - DNA, 22 bp, Homo sapiens
tgggcctggacaaggccactag

SEQ ID NO: 7737503 - DNA, 23 bp, Homo sapiens
tgggcctggcctcccagtccagc

SEQ ID NO: 7737504 - DNA, 22 bp, Homo sapiens
tgggctccgttgcctggggcag

SEQ ID NO: 7737505 - DNA, 22 bp, Homo sapiens
tgggctccggcggcctcaggct

SEQ ID NO: 7737506 - DNA, 22 bp, Homo sapiens
tgggctccagcacctgtgctct

SEQ ID NO: 7737507 - DNA, 22 bp, Homo sapiens
tgggctcatggcccagcactgg

SEQ ID NO: 7737508 - DNA, 22 bp, Homo sapiens
cctgaggtcatggtccagtgtt

SEQ ID NO: 7737509 - DNA, 22 bp, Homo sapiens
cctgagttagttgctgtgtctc

SEQ ID NO: 7737510 - DNA, 22 bp, Homo sapiens
tggggagcacggtagggaaatg

SEQ ID NO: 7737511 - DNA, 22 bp, Homo sapiens
tggggagagttacaaggaatct

SEQ ID NO: 7737512 - DNA, 22 bp, Homo sapiens
cctgcagctgtaggagaaggcg

SEQ ID NO: 7737513 - DNA, 22 bp, Homo sapiens
cctgcaggctgcaggccagttc

SEQ ID NO: 7737514 - DNA, 22 bp, Homo sapiens
cctgcagggaatcgaggcagaa

SEQ ID NO: 7737515 - DNA, 22 bp, Homo sapiens
cctccagggcccctctcactgg

SEQ ID NO: 7737516 - DNA, 22 bp, Homo sapiens
cctccagtcacctggatgagaa

SEQ ID NO: 7737517 - DNA, 22 bp, Homo sapiens
cctcccaccgtatctcagtggc

SEQ ID NO: 7737518 - DNA, 22 bp, Homo sapiens
tgggagagaattctggtgactg

SEQ ID NO: 7737519 - DNA, 23 bp, Homo sapiens
tgggatagaatttcatggctgct

SEQ ID NO: 7737520 - DNA, 21 bp, Homo sapiens
tgggatagaaatatggctgct

SEQ ID NO: 7737521 - DNA, 22 bp, Homo sapiens
tggcttctttccactgtcctgt

SEQ ID NO: 7737522 - DNA, 22 bp, Homo sapiens
ccctgggagaagttgagggctg

SEQ ID NO: 7737523 - DNA, 22 bp, Homo sapiens
tggcaggctgagttggcctggt

SEQ ID NO: 7737524 - DNA, 19 bp, Homo sapiens
tggcagggagagtttgaag

SEQ ID NO: 7737525 - DNA, 19 bp, Homo sapiens
tggcagggagagtttgaag

SEQ ID NO: 7737526 - DNA, 22 bp, Homo sapiens
tggcagggaatacagatgttta

SEQ ID NO: 7737527 - DNA, 22 bp, Homo sapiens
ccctttagcccctgcagagact

SEQ ID NO: 7737528 - DNA, 22 bp, Homo sapiens
cccttggaaggtagctggcagt

SEQ ID NO: 7737529 - DNA, 22 bp, Homo sapiens
ccctggaggttgaggctgcagt

SEQ ID NO: 7737530 - DNA, 22 bp, Homo sapiens
tggcactttacacccatttggc

SEQ ID NO: 7737531 - DNA, 22 bp, Homo sapiens
tggagaattctatgttgagggg

SEQ ID NO: 7737532 - DNA, 22 bp, Homo sapiens
ccctccctgaagaagttactct

SEQ ID NO: 7737533 - DNA, 22 bp, Homo sapiens
ccctcctcaactctggcttcca

SEQ ID NO: 7737534 - DNA, 16 bp, Homo sapiens
tggaggcatctggccc

SEQ ID NO: 7737535 - DNA, 22 bp, Homo sapiens
tggaggcatttgatgttcataa

SEQ ID NO: 7737536 - DNA, 22 bp, Homo sapiens
tgctaggaatacacagagcaat

SEQ ID NO: 7737537 - DNA, 22 bp, Homo sapiens
tgctaggagaggcagcacagcg

SEQ ID NO: 7737538 - DNA, 22 bp, Homo sapiens
tgcaggtgccatcgctgctcat

SEQ ID NO: 7737539 - DNA, 22 bp, Homo sapiens
tgcaggtgctccgggggtgccc

SEQ ID NO: 7737540 - DNA, 22 bp, Homo sapiens
tgctacacttaaatcagtcacc

SEQ ID NO: 7737541 - DNA, 22 bp, Homo sapiens
tgcaggtgctgtgtcaagagag

SEQ ID NO: 7737542 - DNA, 22 bp, Homo sapiens
tgctctggacgctgagtggttt

SEQ ID NO: 7737543 - DNA, 22 bp, Homo sapiens
tgctctggaaataaatgattta

SEQ ID NO: 7737544 - DNA, 22 bp, Homo sapiens
tgctctgaaggggaagggatgg

SEQ ID NO: 7737545 - DNA, 19 bp, Homo sapiens
cccagtccttgtcctgggc

SEQ ID NO: 7737546 - DNA, 22 bp, Homo sapiens
cccagtccagaccatgacctca

SEQ ID NO: 7737547 - DNA, 22 bp, Homo sapiens
cccaggtctcctgcttcccagg

SEQ ID NO: 7737548 - DNA, 22 bp, Homo sapiens
tgcttgggaatgtggagtcaga

SEQ ID NO: 7737549 - DNA, 22 bp, Homo sapiens
tgcttgggcggccagcatggcg

SEQ ID NO: 7737550 - DNA, 21 bp, Homo sapiens
tgcttgggggcttcaggagct

SEQ ID NO: 7737551 - DNA, 22 bp, Homo sapiens
ccctccctatgtagatgatgtt

SEQ ID NO: 7737552 - DNA, 22 bp, Homo sapiens
tgcttcctatccacacaatgcc

SEQ ID NO: 7737553 - DNA, 22 bp, Homo sapiens
tgcttcctgctaaggctgcctg

SEQ ID NO: 7737554 - DNA, 20 bp, Homo sapiens
tgcttcctggccactgcggg

SEQ ID NO: 7737555 - DNA, 22 bp, Homo sapiens
tgcttccttgagctctccaatc

SEQ ID NO: 7737556 - DNA, 22 bp, Homo sapiens
gaggagcccagcaccatcactt

SEQ ID NO: 7737557 - DNA, 22 bp, Homo sapiens
gaggcagcttagggtactgact

SEQ ID NO: 7737558 - DNA, 22 bp, Homo sapiens
gaggcaggcagattgcttgagg

SEQ ID NO: 7737559 - DNA, 22 bp, Homo sapiens
gaggcaggaggattgcttgagc

SEQ ID NO: 7737560 - DNA, 22 bp, Homo sapiens
gaggagaggccatcgttgttat

SEQ ID NO: 7737561 - DNA, 22 bp, Homo sapiens
gaggagagatggtagattgggt

SEQ ID NO: 7737562 - DNA, 22 bp, Homo sapiens
gaggagaggggctcccaagagc

SEQ ID NO: 7737563 - DNA, 22 bp, Homo sapiens
gaggagcaagaaatagtgccca

SEQ ID NO: 7737564 - DNA, 22 bp, Homo sapiens
gaggagcacatgaggctgaggg

SEQ ID NO: 7737565 - DNA, 20 bp, Homo sapiens
gaggagccaccttgagctgg

SEQ ID NO: 7737566 - DNA, 22 bp, Homo sapiens
gaggctcagagaagtcatggta

SEQ ID NO: 7737567 - DNA, 22 bp, Homo sapiens
gaggctcacctagggagcactg

SEQ ID NO: 7737568 - DNA, 22 bp, Homo sapiens
gaggcagttcctgagtgacaag

SEQ ID NO: 7737569 - DNA, 19 bp, Homo sapiens
gaggcagtagtcaaagctt

SEQ ID NO: 7737570 - DNA, 22 bp, Homo sapiens
gaggcagtggtctgatgcaagg

SEQ ID NO: 7737571 - DNA, 22 bp, Homo sapiens
gaggcagggtgttgattacaga

SEQ ID NO: 7737572 - DNA, 22 bp, Homo sapiens
gaggctgaacaggttctcatga

SEQ ID NO: 7737573 - DNA, 22 bp, Homo sapiens
gaggctcagagaggtccacata

SEQ ID NO: 7737574 - DNA, 22 bp, Homo sapiens
gaggctgagagtttgttctact

SEQ ID NO: 7737575 - DNA, 22 bp, Homo sapiens
gaggctgagactctgaattttt

SEQ ID NO: 7737576 - DNA, 22 bp, Homo sapiens
gaggctgacggcaccatcttct

SEQ ID NO: 7737577 - DNA, 22 bp, Homo sapiens
gaggctgaatggccagaagcca

SEQ ID NO: 7737578 - DNA, 22 bp, Homo sapiens
gaggctgaagtgtacatgggtg

SEQ ID NO: 7737579 - DNA, 20 bp, Homo sapiens
gaggctgaagtgtttttgct

SEQ ID NO: 7737580 - DNA, 22 bp, Homo sapiens
gagggctgctgccagatatgcc

SEQ ID NO: 7737581 - DNA, 22 bp, Homo sapiens
gagggctgctggaaaaatgcag

SEQ ID NO: 7737582 - DNA, 22 bp, Homo sapiens
gagggctgcaatgagacagaga

SEQ ID NO: 7737583 - DNA, 22 bp, Homo sapiens
gagggagtaacgtactacagtg

SEQ ID NO: 7737584 - DNA, 22 bp, Homo sapiens
gagggaggtgatactgaacgta

SEQ ID NO: 7737585 - DNA, 22 bp, Homo sapiens
gaggctgagtagctttgtgctc

SEQ ID NO: 7737586 - DNA, 22 bp, Homo sapiens
gaggctgatgctgcctcacaga

SEQ ID NO: 7737587 - DNA, 22 bp, Homo sapiens
gaggctgattcggggaacagca

SEQ ID NO: 7737588 - DNA, 22 bp, Homo sapiens
gaggctgaggcaggaggatcac

SEQ ID NO: 7737589 - DNA, 22 bp, Homo sapiens
gaggctgaggcggatggatcac

SEQ ID NO: 7737590 - DNA, 22 bp, Homo sapiens
gaggctgagggttagagagtca

SEQ ID NO: 7737591 - DNA, 22 bp, Homo sapiens
gaggctgaggttgcagtgagcc

SEQ ID NO: 7737592 - DNA, 22 bp, Homo sapiens
gaggctgaggttgcagtgagct

SEQ ID NO: 7737593 - DNA, 22 bp, Homo sapiens
gagggagggccaggtcccaacc

SEQ ID NO: 7737594 - DNA, 22 bp, Homo sapiens
gagggaggggagctccaccctc

SEQ ID NO: 7737595 - DNA, 22 bp, Homo sapiens
gagggagggactagcattctct

SEQ ID NO: 7737596 - DNA, 22 bp, Homo sapiens
gagggagggaaagtttaacact

SEQ ID NO: 7737597 - DNA, 22 bp, Homo sapiens
gagggaggcatcatgaatccag

SEQ ID NO: 7737598 - DNA, 22 bp, Homo sapiens
gagcccaggaagtggaggctga

SEQ ID NO: 7737599 - DNA, 22 bp, Homo sapiens
gagcccagcttgcacatggagc

SEQ ID NO: 7737600 - DNA, 22 bp, Homo sapiens
gagcccagctctacctcagact

SEQ ID NO: 7737601 - DNA, 22 bp, Homo sapiens
gagcatcactgtcctctccccg

SEQ ID NO: 7737602 - DNA, 22 bp, Homo sapiens
gagcagttgggctctaggaagt

SEQ ID NO: 7737603 - DNA, 22 bp, Homo sapiens
gagaggggcccaagccacatag

SEQ ID NO: 7737604 - DNA, 22 bp, Homo sapiens
gagaggggcgcgcagctcgcga

SEQ ID NO: 7737605 - DNA, 22 bp, Homo sapiens
gagaggtaatttgaagtgcaaa

SEQ ID NO: 7737606 - DNA, 22 bp, Homo sapiens
gaggaaagaaccccagtcaata

SEQ ID NO: 7737607 - DNA, 22 bp, Homo sapiens
gaggaaatcattccagaaaagg

SEQ ID NO: 7737608 - DNA, 23 bp, Homo sapiens
gaggaaagaatatagatgcaatc

SEQ ID NO: 7737609 - DNA, 23 bp, Homo sapiens
gaggaaagaatatagatgcaatc

SEQ ID NO: 7737610 - DNA, 22 bp, Homo sapiens
gaggaacttatgatattctact

SEQ ID NO: 7737611 - DNA, 22 bp, Homo sapiens
gaggaagaaagcataggtgggg

SEQ ID NO: 7737612 - DNA, 22 bp, Homo sapiens
gaggaacatgaggtgacctggg

SEQ ID NO: 7737613 - DNA, 18 bp, Homo sapiens
gaggaacattcacctcct

SEQ ID NO: 7737614 - DNA, 22 bp, Homo sapiens
gaggaaatggttgttcaggtgg

SEQ ID NO: 7737615 - DNA, 21 bp, Homo sapiens
gaggaaatgctctggtgttca

SEQ ID NO: 7737616 - DNA, 22 bp, Homo sapiens
gaggagagatggtagattgggt

SEQ ID NO: 7737617 - DNA, 22 bp, Homo sapiens
gaggaagaagcaaaccagctaa

SEQ ID NO: 7737618 - DNA, 22 bp, Homo sapiens
gagctgagtatgaaggatgtga

SEQ ID NO: 7737619 - DNA, 18 bp, Homo sapiens
gaagggagctggaatgca

SEQ ID NO: 7737620 - DNA, 18 bp, Homo sapiens
gaagggagctggaatgca

SEQ ID NO: 7737621 - DNA, 22 bp, Homo sapiens
gaaggggaaagttgagcaaata

SEQ ID NO: 7737622 - DNA, 19 bp, Homo sapiens
gaaggggaaggtgggtacc

SEQ ID NO: 7737623 - DNA, 22 bp, Homo sapiens
gaaggggactggcagctgcaga

SEQ ID NO: 7737624 - DNA, 22 bp, Homo sapiens
gaaggtagctgctgagatgaca

SEQ ID NO: 7737625 - DNA, 22 bp, Homo sapiens
gaaggtccagcgtggccaagtc

SEQ ID NO: 7737626 - DNA, 22 bp, Homo sapiens
gaatctcaaattaagaatttta

SEQ ID NO: 7737627 - DNA, 22 bp, Homo sapiens
gaatctcaggaagatctctgca

SEQ ID NO: 7737628 - DNA, 22 bp, Homo sapiens
gaatctcattctaactagtagg

SEQ ID NO: 7737629 - DNA, 22 bp, Homo sapiens
gaatctcagtggaagcaggaag

SEQ ID NO: 7737630 - DNA, 17 bp, Homo sapiens
gaaaggaggcaacactg

SEQ ID NO: 7737631 - DNA, 22 bp, Homo sapiens
gaaaggagggaaacagagcggt

SEQ ID NO: 7737632 - DNA, 22 bp, Homo sapiens
gaaggcccagcttgaatgctgc

SEQ ID NO: 7737633 - DNA, 22 bp, Homo sapiens
gaagggagaaggttgggtgacg

SEQ ID NO: 7737634 - DNA, 22 bp, Homo sapiens
gaagggagaaggttgggtgacg

SEQ ID NO: 7737635 - DNA, 22 bp, Homo sapiens
gaaggcaggtttttcaaaactg

SEQ ID NO: 7737636 - DNA, 22 bp, Homo sapiens
gaaggagagggtcaaggataat

SEQ ID NO: 7737637 - DNA, 20 bp, Homo sapiens
gaagccagaggggaaaggag

SEQ ID NO: 7737638 - DNA, 22 bp, Homo sapiens
gaaggagctaccaagactgaat

SEQ ID NO: 7737639 - DNA, 22 bp, Homo sapiens
gaaggagctaccaagactgaat

SEQ ID NO: 7737640 - DNA, 16 bp, Homo sapiens
gaaggagattcagaaa

SEQ ID NO: 7737641 - DNA, 22 bp, Homo sapiens
gaaggagctaccaagactgaat

SEQ ID NO: 7737642 - DNA, 22 bp, Homo sapiens
gacagaggagaagatgctgtgg

SEQ ID NO: 7737643 - DNA, 22 bp, Homo sapiens
gagactgggggcttggcctttt

SEQ ID NO: 7737644 - DNA, 22 bp, Homo sapiens
gagactggtgtttgctgggctg

SEQ ID NO: 7737645 - DNA, 22 bp, Homo sapiens
gagagggcaaacttgtagctaa

SEQ ID NO: 7737646 - DNA, 18 bp, Homo sapiens
gagagggatccctcagga

SEQ ID NO: 7737647 - DNA, 22 bp, Homo sapiens
gagagggccgggggccagctcc

SEQ ID NO: 7737648 - DNA, 22 bp, Homo sapiens
gactgcaaccttagactagaaa

SEQ ID NO: 7737649 - DNA, 22 bp, Homo sapiens
gagaaagattgtccttcagggg

SEQ ID NO: 7737650 - DNA, 22 bp, Homo sapiens
ctggtcactggtctcatccagc

SEQ ID NO: 7737651 - DNA, 22 bp, Homo sapiens
ctggtctggctacccagcgaat

SEQ ID NO: 7737652 - DNA, 19 bp, Homo sapiens
ctggtctgtcatgctcccc

SEQ ID NO: 7737653 - DNA, 19 bp, Homo sapiens
ctggtctgctgcttccagg

SEQ ID NO: 7737654 - DNA, 22 bp, Homo sapiens
ctggtctgcaaggccatataga

SEQ ID NO: 7737655 - DNA, 22 bp, Homo sapiens
ctgggcttgagttcctgctcgt

SEQ ID NO: 7737656 - DNA, 22 bp, Homo sapiens
ctgggcttaggacctggtgcgg

SEQ ID NO: 7737657 - DNA, 22 bp, Homo sapiens
ctgggcttgtgttagctgacaa

SEQ ID NO: 7737658 - DNA, 21 bp, Homo sapiens
ctgggctttctctcaaagaca

SEQ ID NO: 7737659 - DNA, 22 bp, Homo sapiens
ctgggcttttgagtcacaaggg

SEQ ID NO: 7737660 - DNA, 22 bp, Homo sapiens
ctggggaaggcggtgactgcgc

SEQ ID NO: 7737661 - DNA, 22 bp, Homo sapiens
ctgtaaaactgcttaagtatgc

SEQ ID NO: 7737662 - DNA, 22 bp, Homo sapiens
ctgtataacatcttttgtttcc

SEQ ID NO: 7737663 - DNA, 22 bp, Homo sapiens
ctgtctgaatcctaagcttcct

SEQ ID NO: 7737664 - DNA, 22 bp, Homo sapiens
ctgtctctgttgcctgtaggtg

SEQ ID NO: 7737665 - DNA, 22 bp, Homo sapiens
ctgtcagcttctcctggccaga

SEQ ID NO: 7737666 - DNA, 22 bp, Homo sapiens
ctgtcagagatggggagtcaga

SEQ ID NO: 7737667 - DNA, 22 bp, Homo sapiens
ctgtgctgattcagcacaggcc

SEQ ID NO: 7737668 - DNA, 22 bp, Homo sapiens
ctgtgctgaacaattctgcatt

SEQ ID NO: 7737669 - DNA, 17 bp, Homo sapiens
ctgtctgctgcttcctc

SEQ ID NO: 7737670 - DNA, 22 bp, Homo sapiens
ctgggcaaattgtgccagctat

SEQ ID NO: 7737671 - DNA, 22 bp, Homo sapiens
ctgggcactgcagcaggcatca

SEQ ID NO: 7737672 - DNA, 22 bp, Homo sapiens
ctgggagattgctagagatgca

SEQ ID NO: 7737673 - DNA, 22 bp, Homo sapiens
ctgggcagcacatcatcgtatc

SEQ ID NO: 7737674 - DNA, 22 bp, Homo sapiens
ctgggccttgccttgcccacag

SEQ ID NO: 7737675 - DNA, 22 bp, Homo sapiens
ctgggccttcattgctctccca

SEQ ID NO: 7737676 - DNA, 22 bp, Homo sapiens
ctgggcctgtgactcccatcct

SEQ ID NO: 7737677 - DNA, 22 bp, Homo sapiens
ctgggcctcctctgcccaagct

SEQ ID NO: 7737678 - DNA, 22 bp, Homo sapiens
ctgggcctggtgtggcacctgc

SEQ ID NO: 7737679 - DNA, 17 bp, Homo sapiens
ctgggcctcccctgtcc

SEQ ID NO: 7737680 - DNA, 22 bp, Homo sapiens
ctgggctagaaggaccaggatg

SEQ ID NO: 7737681 - DNA, 22 bp, Homo sapiens
ctgggcttagcagctcctggtc

SEQ ID NO: 7737682 - DNA, 22 bp, Homo sapiens
ctgggcttagcagctcctggtc

SEQ ID NO: 7737683 - DNA, 22 bp, Homo sapiens
ctgggctcaaatcctatctcca

SEQ ID NO: 7737684 - DNA, 22 bp, Homo sapiens
ctgggagatatgaggatctgga

SEQ ID NO: 7737685 - DNA, 22 bp, Homo sapiens
ctgctgtgcacccaggaaggct

SEQ ID NO: 7737686 - DNA, 22 bp, Homo sapiens
ctgctgtgttcctcctgcatct

SEQ ID NO: 7737687 - DNA, 22 bp, Homo sapiens
cttctattcactggtcacagtt

SEQ ID NO: 7737688 - DNA, 22 bp, Homo sapiens
cttataaagtccatctgaacaa

SEQ ID NO: 7737689 - DNA, 22 bp, Homo sapiens
ctgtttgttggctattgacagt

SEQ ID NO: 7737690 - DNA, 22 bp, Homo sapiens
cttacaagaccaaagaaaggat

SEQ ID NO: 7737691 - DNA, 22 bp, Homo sapiens
cttacagtacttctaatatgat

SEQ ID NO: 7737692 - DNA, 22 bp, Homo sapiens
cttacagtgatcaacacaaaga

SEQ ID NO: 7737693 - DNA, 19 bp, Homo sapiens
cttctggccctgagccacc

SEQ ID NO: 7737694 - DNA, 22 bp, Homo sapiens
cttctggcgttggaggtctgag

SEQ ID NO: 7737695 - DNA, 22 bp, Homo sapiens
cttgttttggctagtatgatgt

SEQ ID NO: 7737696 - DNA, 22 bp, Homo sapiens
ctttacaaatagggagggagtg

SEQ ID NO: 7737697 - DNA, 22 bp, Homo sapiens
ctttgaaaacacacgaatagac

SEQ ID NO: 7737698 - DNA, 21 bp, Homo sapiens
cttttacattcagtcatgatg

SEQ ID NO: 7737699 - DNA, 22 bp, Homo sapiens
cttttcctcaggaggagacgcg

SEQ ID NO: 7737700 - DNA, 22 bp, Homo sapiens
cttttctagagccgcagcccta

SEQ ID NO: 7737701 - DNA, 22 bp, Homo sapiens
gaaaattattgaaaatggctct

SEQ ID NO: 7737702 - DNA, 22 bp, Homo sapiens
gaaaatacttcagtgttctggc

SEQ ID NO: 7737703 - DNA, 22 bp, Homo sapiens
gaaagataatcaattactcctt

SEQ ID NO: 7737704 - DNA, 22 bp, Homo sapiens
gaaacagcacgtttggagagat

SEQ ID NO: 7737705 - DNA, 22 bp, Homo sapiens
ctctgctgtctcagatgggcca

SEQ ID NO: 7737706 - DNA, 22 bp, Homo sapiens
ctctgctggccatgaagagaga

SEQ ID NO: 7737707 - DNA, 22 bp, Homo sapiens
tttgaataaacggttaatgttc

SEQ ID NO: 7737708 - DNA, 19 bp, Homo sapiens
ctctggagcagacactgga

SEQ ID NO: 7737709 - DNA, 22 bp, Homo sapiens
ctctggagggaggctgagctgg

SEQ ID NO: 7737710 - DNA, 22 bp, Homo sapiens
ctctggagggaggctgagctgg

SEQ ID NO: 7737711 - DNA, 22 bp, Homo sapiens
ctctggaggcctaaggaagtgg

SEQ ID NO: 7737712 - DNA, 22 bp, Homo sapiens
ctctggaggcctaaggaagtgg

SEQ ID NO: 7737713 - DNA, 22 bp, Homo sapiens
ctctggaggccgttggccctta

SEQ ID NO: 7737714 - DNA, 22 bp, Homo sapiens
ctctggaggtggaggttgcagt

SEQ ID NO: 7737715 - DNA, 22 bp, Homo sapiens
ctctggagtaagagctatgaaa

SEQ ID NO: 7737716 - DNA, 22 bp, Homo sapiens
tttctgcacatttctaaagttg

SEQ ID NO: 7737717 - DNA, 22 bp, Homo sapiens
tttctgcaaacttccacgtctc

SEQ ID NO: 7737718 - DNA, 22 bp, Homo sapiens
ctctgaggtcctacagtgaccc

SEQ ID NO: 7737719 - DNA, 22 bp, Homo sapiens
tttctgcaggtattgcataagt

SEQ ID NO: 7737720 - DNA, 19 bp, Homo sapiens
tttctgcagcccagcagca

SEQ ID NO: 7737721 - DNA, 22 bp, Homo sapiens
tttctgtttagcataaagtggc

SEQ ID NO: 7737722 - DNA, 22 bp, Homo sapiens
ctctgagctgaaacatgagcat

SEQ ID NO: 7737723 - DNA, 22 bp, Homo sapiens
ctctctggcccatcctgttgcc

SEQ ID NO: 7737724 - DNA, 22 bp, Homo sapiens
ctctctggcacttcattgctgt

SEQ ID NO: 7737725 - DNA, 22 bp, Homo sapiens
ctctctggatatttgtatgctg

SEQ ID NO: 7737726 - DNA, 22 bp, Homo sapiens
ctctgaggctccatgcaggctt

SEQ ID NO: 7737727 - DNA, 22 bp, Homo sapiens
ctctgagggctcgagggacgcg

SEQ ID NO: 7737728 - DNA, 22 bp, Homo sapiens
ctctgagggtctaaggagtcac

SEQ ID NO: 7737729 - DNA, 22 bp, Homo sapiens
ctctctggacttgagtatcagc

SEQ ID NO: 7737730 - DNA, 22 bp, Homo sapiens
ctctctggacctcaactatttt

SEQ ID NO: 7737731 - DNA, 20 bp, Homo sapiens
ctctctggaaggtgggagcc

SEQ ID NO: 7737732 - DNA, 22 bp, Homo sapiens
ctctctggaattaaagcccaat

SEQ ID NO: 7737733 - DNA, 22 bp, Homo sapiens
ctctactccaaaaggctacaat

SEQ ID NO: 7737734 - DNA, 22 bp, Homo sapiens
ctctagagtacgggctggcatg

SEQ ID NO: 7737735 - DNA, 22 bp, Homo sapiens
ctctaggctgcccaggagctga

SEQ ID NO: 7737736 - DNA, 22 bp, Homo sapiens
ctcctcagctgggaggagtccc

SEQ ID NO: 7737737 - DNA, 23 bp, Homo sapiens
ctccctggagtttctggaagatg

SEQ ID NO: 7737738 - DNA, 22 bp, Homo sapiens
ctccctggcacagcgagaggtt

SEQ ID NO: 7737739 - DNA, 22 bp, Homo sapiens
ctccctggctttgtcctgaggc

SEQ ID NO: 7737740 - DNA, 22 bp, Homo sapiens
ctccctctgtcttgtccagaaa

SEQ ID NO: 7737741 - DNA, 22 bp, Homo sapiens
ctccctggaggtgagctggcac

SEQ ID NO: 7737742 - DNA, 22 bp, Homo sapiens
ctcaggctctgtactccctttg

SEQ ID NO: 7737743 - DNA, 22 bp, Homo sapiens
ctcaggctccagacttccgtcc

SEQ ID NO: 7737744 - DNA, 22 bp, Homo sapiens
ctccccaagccttggcttctcc

SEQ ID NO: 7737745 - DNA, 22 bp, Homo sapiens
ttgtttcagcccagatctttac

SEQ ID NO: 7737746 - DNA, 22 bp, Homo sapiens
ctcctgtcaataggctcctggc

SEQ ID NO: 7737747 - DNA, 22 bp, Homo sapiens
ctcctgtcagaagcatcctgag

SEQ ID NO: 7737748 - DNA, 22 bp, Homo sapiens
ctctaaatccaaataagtgtcc

SEQ ID NO: 7737749 - DNA, 22 bp, Homo sapiens
ctctaaatccacggtatagttg

SEQ ID NO: 7737750 - DNA, 22 bp, Homo sapiens
tttatatgtttgtacaattaag

SEQ ID NO: 7737751 - DNA, 20 bp, Homo sapiens
ctcctcagttccatgggagg

SEQ ID NO: 7737752 - DNA, 22 bp, Homo sapiens
ctgctcggcgcgcatggctgcc

SEQ ID NO: 7737753 - DNA, 22 bp, Homo sapiens
ctgcctctgttgggcatggtct

SEQ ID NO: 7737754 - DNA, 22 bp, Homo sapiens
ctgcctgcactgcctggctcca

SEQ ID NO: 7737755 - DNA, 21 bp, Homo sapiens
ctgagggccgcagctgggctc

SEQ ID NO: 7737756 - DNA, 22 bp, Homo sapiens
ctgagggctggagctgaggcct

SEQ ID NO: 7737757 - DNA, 22 bp, Homo sapiens
ctgccctgcctggccagtgtgg

SEQ ID NO: 7737758 - DNA, 22 bp, Homo sapiens
ctgcccctggtgatggacgcca

SEQ ID NO: 7737759 - DNA, 22 bp, Homo sapiens
ctgccctgagggcctgtgtgtt

SEQ ID NO: 7737760 - DNA, 22 bp, Homo sapiens
ctgccctggccactgtgcccag

SEQ ID NO: 7737761 - DNA, 22 bp, Homo sapiens
ctgccctgggatggtctgtgcg

SEQ ID NO: 7737762 - DNA, 22 bp, Homo sapiens
ctgcctctggttttggtccctg

SEQ ID NO: 7737763 - DNA, 22 bp, Homo sapiens
ctgagcacctgttataggttag

SEQ ID NO: 7737764 - DNA, 22 bp, Homo sapiens
ctgagcacagaaataagatatt

SEQ ID NO: 7737765 - DNA, 22 bp, Homo sapiens
ctgagctgggctctcttgaggg

SEQ ID NO: 7737766 - DNA, 22 bp, Homo sapiens
ctgagctgggagtagagactct

SEQ ID NO: 7737767 - DNA, 22 bp, Homo sapiens
ctgagaggtaagcagcgcagtg

SEQ ID NO: 7737768 - DNA, 22 bp, Homo sapiens
ctgaataattttatagttgctg

SEQ ID NO: 7737769 - DNA, 22 bp, Homo sapiens
ctgaataatattccattatgag

SEQ ID NO: 7737770 - DNA, 22 bp, Homo sapiens
ctgaggacattgatgaggcaat

SEQ ID NO: 7737771 - DNA, 22 bp, Homo sapiens
ctgagctgtttaatcccagata

SEQ ID NO: 7737772 - DNA, 22 bp, Homo sapiens
ctgagctgttactctgtcctcg

SEQ ID NO: 7737773 - DNA, 22 bp, Homo sapiens
ctgagctgttactctgtcctcg

SEQ ID NO: 7737774 - DNA, 22 bp, Homo sapiens
ctgagggatgggctgggccgcc

SEQ ID NO: 7737775 - DNA, 18 bp, Homo sapiens
ctgagggcaacagaggct

SEQ ID NO: 7737776 - DNA, 18 bp, Homo sapiens
ctgaggctggcaggagcc

SEQ ID NO: 7737777 - DNA, 22 bp, Homo sapiens
ctgaggctgggcatggggtcca

SEQ ID NO: 7737778 - DNA, 22 bp, Homo sapiens
ctgagggagaagtcacgggcag

SEQ ID NO: 7737779 - DNA, 19 bp, Homo sapiens
ttttcctgcctcattgttt

SEQ ID NO: 7737780 - DNA, 22 bp, Homo sapiens
ttttctcaggtgcttatctaag

SEQ ID NO: 7737781 - DNA, 22 bp, Homo sapiens
ttttcctgggctttctgtgtaa

SEQ ID NO: 7737782 - DNA, 22 bp, Homo sapiens
tttttctcttctgtaaagtggt

SEQ ID NO: 7737783 - DNA, 22 bp, Homo sapiens
tttttctctaagtagtcccaaa

SEQ ID NO: 7737784 - DNA, 22 bp, Homo sapiens
ttcctctgaaatggcttggaaa

SEQ ID NO: 7737785 - DNA, 21 bp, Homo sapiens
ttcctctgcaactgatgctca

SEQ ID NO: 7737786 - DNA, 22 bp, Homo sapiens
ttcctctggaggctctaggaga

SEQ ID NO: 7737787 - DNA, 22 bp, Homo sapiens
cgtctggcttctccacggtaaa

SEQ ID NO: 7737788 - DNA, 22 bp, Homo sapiens
ttccagaaaaaaatgtatatct

SEQ ID NO: 7737789 - DNA, 22 bp, Homo sapiens
ttctacatcacttaacatgcta

SEQ ID NO: 7737790 - DNA, 22 bp, Homo sapiens
ctacattcaacagcagagtttt

SEQ ID NO: 7737791 - DNA, 22 bp, Homo sapiens
ctaaatgcctttcctacctaac

SEQ ID NO: 7737792 - DNA, 22 bp, Homo sapiens
ttctcagtttcatagctgagca

SEQ ID NO: 7737793 - DNA, 19 bp, Homo sapiens
ttctcagttcaggagaaga

SEQ ID NO: 7737794 - DNA, 22 bp, Homo sapiens
ttctcagtatgtgacgaggacc

SEQ ID NO: 7737795 - DNA, 23 bp, Homo sapiens
ttctcagtcctgcccagggaggc

SEQ ID NO: 7737796 - DNA, 22 bp, Homo sapiens
ctacattctgggaaatcagatg

SEQ ID NO: 7737797 - DNA, 18 bp, Homo sapiens
ctacattcataggaaagg

SEQ ID NO: 7737798 - DNA, 22 bp, Homo sapiens
ttctcatgaaactcgcttcctc

SEQ ID NO: 7737799 - DNA, 22 bp, Homo sapiens
ctagtgaacgtggtactatgga

SEQ ID NO: 7737800 - DNA, 22 bp, Homo sapiens
ctagttctgccattcagtgtca

SEQ ID NO: 7737801 - DNA, 22 bp, Homo sapiens
ctcagcatcatggtatctgggg

SEQ ID NO: 7737802 - DNA, 22 bp, Homo sapiens
ctcagcattcaatgtccagtcc

SEQ ID NO: 7737803 - DNA, 22 bp, Homo sapiens
ctcaggccaggtttctcccaca

SEQ ID NO: 7737804 - DNA, 22 bp, Homo sapiens
ctcaggccattcttccagctgc

SEQ ID NO: 7737805 - DNA, 22 bp, Homo sapiens
ttgcaaaagcaattgcagtttt

SEQ ID NO: 7737806 - DNA, 22 bp, Homo sapiens
ttgctgagcagtgtttaattgt

SEQ ID NO: 7737807 - DNA, 22 bp, Homo sapiens
ttgcacagtggtttagagcctg

SEQ ID NO: 7737808 - DNA, 22 bp, Homo sapiens
ttgcacagatgagggtgatgct

SEQ ID NO: 7737809 - DNA, 23 bp, Homo sapiens
ttgcacagtttcggaaactgagg

SEQ ID NO: 7737810 - DNA, 22 bp, Homo sapiens
ctcaggcctgagtggcagtccc

SEQ ID NO: 7737811 - DNA, 22 bp, Homo sapiens
ctcaggccttgaagtcttttct

SEQ ID NO: 7737812 - DNA, 22 bp, Homo sapiens
ttgcacagagtggatattcagt

SEQ ID NO: 7737813 - DNA, 18 bp, Homo sapiens
ctcaggcctttccctgtg

SEQ ID NO: 7737814 - DNA, 22 bp, Homo sapiens
ttcttcattcccttacttccga

SEQ ID NO: 7737815 - DNA, 22 bp, Homo sapiens
ttgaagttgcacattataattt

SEQ ID NO: 7737816 - DNA, 22 bp, Homo sapiens
ttgaagttctaagccccagtac

SEQ ID NO: 7737817 - DNA, 22 bp, Homo sapiens
ttgaagttctgcatttctaata

SEQ ID NO: 7737818 - DNA, 22 bp, Homo sapiens
ttgaataatatgcttcgttctc

SEQ ID NO: 7737819 - DNA, 22 bp, Homo sapiens
ttgaataatgtgtatgttgtta

SEQ ID NO: 7737820 - DNA, 22 bp, Homo sapiens
ttgaatcattacaatagataag

SEQ ID NO: 7737821 - DNA, 22 bp, Homo sapiens
ctataaatctacccagcattgg

SEQ ID NO: 7737822 - DNA, 22 bp, Homo sapiens
ccttgggcttgggcatagcttt

SEQ ID NO: 7737823 - DNA, 22 bp, Homo sapiens
ccttggtgatctgggctggaag

SEQ ID NO: 7737824 - DNA, 22 bp, Homo sapiens
ttaccatagaaacttccttttt

SEQ ID NO: 7737825 - DNA, 22 bp, Homo sapiens
ttacagaactgtcttgaaattt

SEQ ID NO: 7737826 - DNA, 21 bp, Homo sapiens
ccttctccacagggtctccgg

SEQ ID NO: 7737827 - DNA, 22 bp, Homo sapiens
ttattcaccgcaggtgcttccc

SEQ ID NO: 7737828 - DNA, 22 bp, Homo sapiens
cgcaccactgaattccagcctg

SEQ ID NO: 7737829 - DNA, 22 bp, Homo sapiens
cctttggctgcatagggaaggg

SEQ ID NO: 7737830 - DNA, 22 bp, Homo sapiens
cctttggccgctttatggagga

SEQ ID NO: 7737831 - DNA, 22 bp, Homo sapiens
tggttccagttttcaatagagc

SEQ ID NO: 7737832 - DNA, 22 bp, Homo sapiens
tggttccaatcgcactggctca

SEQ ID NO: 7737833 - DNA, 22 bp, Homo sapiens
tggttccactaacctgagagcc

SEQ ID NO: 7737834 - DNA, 22 bp, Homo sapiens
tggttcataatttgcactactg

SEQ ID NO: 7737835 - DNA, 22 bp, Homo sapiens
tggttccaagatggctgccaca

SEQ ID NO: 7737836 - DNA, 17 bp, Homo sapiens
tggttccaaccatacgc

SEQ ID NO: 7737837 - DNA, 22 bp, Homo sapiens
tggttcatagcctcacaggata

SEQ ID NO: 7737838 - DNA, 22 bp, Homo sapiens
cctggggagaagagcttccccc

SEQ ID NO: 7737839 - DNA, 22 bp, Homo sapiens
cctggggagccgcctgagcccc

SEQ ID NO: 7737840 - DNA, 23 bp, Homo sapiens
cctggggagctgtatccagagtg

SEQ ID NO: 7737841 - DNA, 23 bp, Homo sapiens
cctggggcacttgagtcctcatc

SEQ ID NO: 7737842 - DNA, 22 bp, Homo sapiens
cctggggccccgagccagaagc

SEQ ID NO: 7737843 - DNA, 20 bp, Homo sapiens
tgtttctgacggtaggagag

SEQ ID NO: 7737844 - DNA, 19 bp, Homo sapiens
tgtttcttcctccatctga

SEQ ID NO: 7737845 - DNA, 22 bp, Homo sapiens
tgttttcatcacagaatgtaac

SEQ ID NO: 7737846 - DNA, 22 bp, Homo sapiens
cctgtggctgccccgctgttgg

SEQ ID NO: 7737847 - DNA, 22 bp, Homo sapiens
cctgtggcgggggccagtgcct

SEQ ID NO: 7737848 - DNA, 22 bp, Homo sapiens
cctgtggcgggggccagtgcct

SEQ ID NO: 7737849 - DNA, 22 bp, Homo sapiens
ttacaatagttccttcttttgt

SEQ ID NO: 7737850 - DNA, 22 bp, Homo sapiens
ttacaatagttccttcttttgt

SEQ ID NO: 7737851 - DNA, 22 bp, Homo sapiens
ttaaaatgaatattgattagca

SEQ ID NO: 7737852 - DNA, 22 bp, Homo sapiens
gcaagacctatctagttgctgt

SEQ ID NO: 7737853 - DNA, 22 bp, Homo sapiens
gagggtcccgagccctgtcaga

SEQ ID NO: 7737854 - DNA, 22 bp, Homo sapiens
gagggtccccatgcagagctca

SEQ ID NO: 7737855 - DNA, 22 bp, Homo sapiens
gagggtccctgctcagggccag

SEQ ID NO: 7737856 - DNA, 22 bp, Homo sapiens
gcacagccagcatctgagggat

SEQ ID NO: 7737857 - DNA, 22 bp, Homo sapiens
gcacagccctgagcgcatgtct

SEQ ID NO: 7737858 - DNA, 22 bp, Homo sapiens
gcacagccggaccgaggaaaag

SEQ ID NO: 7737859 - DNA, 22 bp, Homo sapiens
gcacagccctggtcggggcccc

SEQ ID NO: 7737860 - DNA, 22 bp, Homo sapiens
gcacagccttgccctgtgccct

SEQ ID NO: 7737861 - DNA, 22 bp, Homo sapiens
gcacagcctgtccctgtcctgg

SEQ ID NO: 7737862 - DNA, 22 bp, Homo sapiens
gcacagccacgtaatgtggtca

SEQ ID NO: 7737863 - DNA, 22 bp, Homo sapiens
gcacagccactgagtgagaacc

SEQ ID NO: 7737864 - DNA, 22 bp, Homo sapiens
gcactgagtctgtcatgctgca

SEQ ID NO: 7737865 - DNA, 22 bp, Homo sapiens
gcactgccatcaatgcatgaca

SEQ ID NO: 7737866 - DNA, 17 bp, Homo sapiens
gcactgagccacagttt

SEQ ID NO: 7737867 - DNA, 22 bp, Homo sapiens
gcactgagcaccagccacagat

SEQ ID NO: 7737868 - DNA, 22 bp, Homo sapiens
gcactgggctccaggaaggagg

SEQ ID NO: 7737869 - DNA, 22 bp, Homo sapiens
gcagaggagcaagctggacacc

SEQ ID NO: 7737870 - DNA, 22 bp, Homo sapiens
gcagaggacacaggagggcaag

SEQ ID NO: 7737871 - DNA, 22 bp, Homo sapiens
gcaggctgagttgggaaaccaa

SEQ ID NO: 7737872 - DNA, 22 bp, Homo sapiens
gcaggctgagtattaccctagt

SEQ ID NO: 7737873 - DNA, 22 bp, Homo sapiens
gcaggctgagagtccaagaagg

SEQ ID NO: 7737874 - DNA, 22 bp, Homo sapiens
gcagctggcccctttccttgtt

SEQ ID NO: 7737875 - DNA, 22 bp, Homo sapiens
gcagcatcaggttcactgcgtg

SEQ ID NO: 7737876 - DNA, 22 bp, Homo sapiens
gcagcatcaatccatgcttctc

SEQ ID NO: 7737877 - DNA, 22 bp, Homo sapiens
gcagcatccccaggcagcaggg

SEQ ID NO: 7737878 - DNA, 22 bp, Homo sapiens
gcagcatcctgggccacagtcc

SEQ ID NO: 7737879 - DNA, 22 bp, Homo sapiens
gcagcatccttggcctccaccc

SEQ ID NO: 7737880 - DNA, 22 bp, Homo sapiens
gcagcatctgtacatagacgct

SEQ ID NO: 7737881 - DNA, 22 bp, Homo sapiens
gcagcatctagggcactggcct

SEQ ID NO: 7737882 - DNA, 22 bp, Homo sapiens
gcagcatacagggagagtactc

SEQ ID NO: 7737883 - DNA, 20 bp, Homo sapiens
gcagctgcccccagtccctg

SEQ ID NO: 7737884 - DNA, 22 bp, Homo sapiens
gcagctgccgtgagctcacgcc

SEQ ID NO: 7737885 - DNA, 22 bp, Homo sapiens
gcagcaggagagtaatagcggt

SEQ ID NO: 7737886 - DNA, 22 bp, Homo sapiens
gcagcagctcagttctgggagg

SEQ ID NO: 7737887 - DNA, 22 bp, Homo sapiens
gcagcagctgacagtgggtgcc

SEQ ID NO: 7737888 - DNA, 22 bp, Homo sapiens
gcagcagctctgaatgggcccc

SEQ ID NO: 7737889 - DNA, 23 bp, Homo sapiens
gcagaggagcaagctggacacca

SEQ ID NO: 7737890 - DNA, 22 bp, Homo sapiens
gcccatccatggggtcatggcc

SEQ ID NO: 7737891 - DNA, 22 bp, Homo sapiens
gcctagagaaaaagcctctgca

SEQ ID NO: 7737892 - DNA, 22 bp, Homo sapiens
gccaggagttcagatgcatgtt

SEQ ID NO: 7737893 - DNA, 22 bp, Homo sapiens
gccaggttctggggaggtacaa

SEQ ID NO: 7737894 - DNA, 22 bp, Homo sapiens
gccagagcttcccccgagtgtg

SEQ ID NO: 7737895 - DNA, 22 bp, Homo sapiens
gccagagctgagacacgagtcc

SEQ ID NO: 7737896 - DNA, 22 bp, Homo sapiens
gccagagctgagtgaggttctt

SEQ ID NO: 7737897 - DNA, 22 bp, Homo sapiens
gccagcccagctccaggggaaa

SEQ ID NO: 7737898 - DNA, 22 bp, Homo sapiens
gccagagccacttttgggtgat

SEQ ID NO: 7737899 - DNA, 22 bp, Homo sapiens
gcatttgtgtggcggaaggatt

SEQ ID NO: 7737900 - DNA, 22 bp, Homo sapiens
gcagggctattggaaggagatg

SEQ ID NO: 7737901 - DNA, 22 bp, Homo sapiens
gcatttggaacttggttgagat

SEQ ID NO: 7737902 - DNA, 22 bp, Homo sapiens
gcctggggtctctgactcacag

SEQ ID NO: 7737903 - DNA, 22 bp, Homo sapiens
gcctggctgtctggcaaggttc

SEQ ID NO: 7737904 - DNA, 22 bp, Homo sapiens
gcctggctgggcaccaggggag

SEQ ID NO: 7737905 - DNA, 21 bp, Homo sapiens
gcctggcttcacaggcactga

SEQ ID NO: 7737906 - DNA, 21 bp, Homo sapiens
gcctggctagaagctcctagc

SEQ ID NO: 7737907 - DNA, 22 bp, Homo sapiens
gcctggctgctggttctgagga

SEQ ID NO: 7737908 - DNA, 22 bp, Homo sapiens
gcctggctgctagccagaggca

SEQ ID NO: 7737909 - DNA, 22 bp, Homo sapiens
gcgccccatctacagtactttt

SEQ ID NO: 7737910 - DNA, 19 bp, Homo sapiens
gctcaacagctcgggtcct

SEQ ID NO: 7737911 - DNA, 22 bp, Homo sapiens
gctcaagccttctgcccacctc

SEQ ID NO: 7737912 - DNA, 22 bp, Homo sapiens
gctcacagtctgctgagtgcag

SEQ ID NO: 7737913 - DNA, 22 bp, Homo sapiens
gctgccagttccttcttactcc

SEQ ID NO: 7737914 - DNA, 22 bp, Homo sapiens
gctgcagggggtgggcgtctcc

SEQ ID NO: 7737915 - DNA, 22 bp, Homo sapiens
gctgcaggttgggcaacagagt

SEQ ID NO: 7737916 - DNA, 22 bp, Homo sapiens
gctgcaggatgaggctctgctc

SEQ ID NO: 7737917 - DNA, 22 bp, Homo sapiens
gctcctggtctggagcttcaag

SEQ ID NO: 7737918 - DNA, 22 bp, Homo sapiens
gctcctgttttcttccagaaat

SEQ ID NO: 7737919 - DNA, 22 bp, Homo sapiens
gctccttcaggtggtagctgtt

SEQ ID NO: 7737920 - DNA, 22 bp, Homo sapiens
gctctcagatgctccagcagcc

SEQ ID NO: 7737921 - DNA, 22 bp, Homo sapiens
gctcctggtgctgtagagattt

SEQ ID NO: 7737922 - DNA, 22 bp, Homo sapiens
gctctgctccctcaaatgacat

SEQ ID NO: 7737923 - DNA, 22 bp, Homo sapiens
gctctgctgcttactagatggt

SEQ ID NO: 7737924 - DNA, 23 bp, Homo sapiens
gctctggcagcttgtgtcagcac

SEQ ID NO: 7737925 - DNA, 22 bp, Homo sapiens
gctctggcactggcgcgggatg

SEQ ID NO: 7737926 - DNA, 22 bp, Homo sapiens
gctctggcagctgatattagga

SEQ ID NO: 7737927 - DNA, 21 bp, Homo sapiens
gctctggcctactgttccctc

SEQ ID NO: 7737928 - DNA, 22 bp, Homo sapiens
gctctggcccaaaccctttcta

SEQ ID NO: 7737929 - DNA, 22 bp, Homo sapiens
gctctggccagaccctcagtgg

SEQ ID NO: 7737930 - DNA, 22 bp, Homo sapiens
gctctggctactccaccctgtt

SEQ ID NO: 7737931 - DNA, 22 bp, Homo sapiens
gctctggctactgtggctaccg

SEQ ID NO: 7737932 - DNA, 22 bp, Homo sapiens
gctgtgagtgagctgcctaggc

SEQ ID NO: 7737933 - DNA, 21 bp, Homo sapiens
gctgggtcagcaggtcctctg

SEQ ID NO: 7737934 - DNA, 22 bp, Homo sapiens
gctgggtcagaatctccctgtg

SEQ ID NO: 7737935 - DNA, 18 bp, Homo sapiens
gctggggttgagctctcc

SEQ ID NO: 7737936 - DNA, 22 bp, Homo sapiens
gctgggtccatggtcctcgggt

SEQ ID NO: 7737937 - DNA, 22 bp, Homo sapiens
gctgggtcccaagcctggggag

SEQ ID NO: 7737938 - DNA, 20 bp, Homo sapiens
gctgggggtgtgctgagtga

SEQ ID NO: 7737939 - DNA, 22 bp, Homo sapiens
gctgggttttcttccgggccta

SEQ ID NO: 7737940 - DNA, 22 bp, Homo sapiens
gctgggttttcttccgggccta

SEQ ID NO: 7737941 - DNA, 22 bp, Homo sapiens
gctgggttttcttccgggccta

SEQ ID NO: 7737942 - DNA, 22 bp, Homo sapiens
gctgggtctctccctggtcctg

SEQ ID NO: 7737943 - DNA, 22 bp, Homo sapiens
gctgggtcctatgctggtagag

SEQ ID NO: 7737944 - DNA, 22 bp, Homo sapiens
gctgggtctggatgctcaggtg

SEQ ID NO: 7737945 - DNA, 22 bp, Homo sapiens
gctgggtctggctgtgagccgg

SEQ ID NO: 7737946 - DNA, 22 bp, Homo sapiens
gctggctcccagaggccccagc

SEQ ID NO: 7737947 - DNA, 22 bp, Homo sapiens
gctggctctacatttgaggtca

SEQ ID NO: 7737948 - DNA, 22 bp, Homo sapiens
gctggctctgatgggctccagg

SEQ ID NO: 7737949 - DNA, 22 bp, Homo sapiens
gctggctctgcacccaggcctc

SEQ ID NO: 7737950 - DNA, 22 bp, Homo sapiens
gctggctctgccccacctgttc

SEQ ID NO: 7737951 - DNA, 22 bp, Homo sapiens
ggacctggcaatttgcatctct

SEQ ID NO: 7737952 - DNA, 22 bp, Homo sapiens
ggaccttcctggctcctggggt

SEQ ID NO: 7737953 - DNA, 22 bp, Homo sapiens
ggacggggagctggaaagggga

SEQ ID NO: 7737954 - DNA, 22 bp, Homo sapiens
ggagaggacatggctcccacag

SEQ ID NO: 7737955 - DNA, 22 bp, Homo sapiens
ggagaggagattgtggcatttt

SEQ ID NO: 7737956 - DNA, 22 bp, Homo sapiens
ggagaggaaatgccagcacttc

SEQ ID NO: 7737957 - DNA, 22 bp, Homo sapiens
ggagaggcttccagagtcgtgc

SEQ ID NO: 7737958 - DNA, 19 bp, Homo sapiens
ggagaggctggagggatgc

SEQ ID NO: 7737959 - DNA, 22 bp, Homo sapiens
ggagaggagctattgggggctc

SEQ ID NO: 7737960 - DNA, 22 bp, Homo sapiens
ggagaggatgttttagtaactt

SEQ ID NO: 7737961 - DNA, 22 bp, Homo sapiens
ggacagagccctggtggcctaa

SEQ ID NO: 7737962 - DNA, 22 bp, Homo sapiens
ggaaggaaattggggcagttgt

SEQ ID NO: 7737963 - DNA, 22 bp, Homo sapiens
ggaaggaagtaaatgatgctat

SEQ ID NO: 7737964 - DNA, 22 bp, Homo sapiens
gcttcctcaccttctcttgcat

SEQ ID NO: 7737965 - DNA, 22 bp, Homo sapiens
gcttcctccctgctgctcacta

SEQ ID NO: 7737966 - DNA, 22 bp, Homo sapiens
ggaaatcatgggagagttggaa

SEQ ID NO: 7737967 - DNA, 19 bp, Homo sapiens
ggcctggatttagggctcc

SEQ ID NO: 7737968 - DNA, 21 bp, Homo sapiens
ggcctaggggcagatggtgct

SEQ ID NO: 7737969 - DNA, 22 bp, Homo sapiens
ggcctagttttttctggtaggt

SEQ ID NO: 7737970 - DNA, 22 bp, Homo sapiens
ggcctagttttttctggtaggt

SEQ ID NO: 7737971 - DNA, 22 bp, Homo sapiens
ggcatcagggtaggaaggtatc

SEQ ID NO: 7737972 - DNA, 22 bp, Homo sapiens
ggcatccaaataccaagatgta

SEQ ID NO: 7737973 - DNA, 22 bp, Homo sapiens
ggcaggtgagagctctttgaaa

SEQ ID NO: 7737974 - DNA, 18 bp, Homo sapiens
ggcaggagcaagaatagg

SEQ ID NO: 7737975 - DNA, 22 bp, Homo sapiens
ggagcaagaggtggtgaaaaat

SEQ ID NO: 7737976 - DNA, 22 bp, Homo sapiens
ggagcaaatgccaagtgggagg

SEQ ID NO: 7737977 - DNA, 22 bp, Homo sapiens
ggatgaggaagattactgagaa

SEQ ID NO: 7737978 - DNA, 22 bp, Homo sapiens
ggatctggggctctgctgctca

SEQ ID NO: 7737979 - DNA, 22 bp, Homo sapiens
ggatctgttttgcctctgaggg

SEQ ID NO: 7737980 - DNA, 22 bp, Homo sapiens
ggatctggggtagagcagtggg

SEQ ID NO: 7737981 - DNA, 22 bp, Homo sapiens
ggattctgccttgttgcttcaa

SEQ ID NO: 7737982 - DNA, 19 bp, Homo sapiens
ggattctgcagttttcaca

SEQ ID NO: 7737983 - DNA, 22 bp, Homo sapiens
ggatggcaggacaaggacccag

SEQ ID NO: 7737984 - DNA, 22 bp, Homo sapiens
ggatggaggttctcagatgctc

SEQ ID NO: 7737985 - DNA, 23 bp, Homo sapiens
ggatggagccactttgaaaccac

SEQ ID NO: 7737986 - DNA, 19 bp, Homo sapiens
ggatgagggtcaggcatag

SEQ ID NO: 7737987 - DNA, 22 bp, Homo sapiens
ggatgaggtagatgaacaaggg

SEQ ID NO: 7737988 - DNA, 23 bp, Homo sapiens
ggatggacgtgatgccttagcca

SEQ ID NO: 7737989 - DNA, 22 bp, Homo sapiens
ggcagctgttggctctctagga

SEQ ID NO: 7737990 - DNA, 22 bp, Homo sapiens
ggcagctgttggctctctagga

SEQ ID NO: 7737991 - DNA, 22 bp, Homo sapiens
ggcagctgtttgtcctcctgtt

SEQ ID NO: 7737992 - DNA, 17 bp, Homo sapiens
ggcagctgtgtgcatgc

SEQ ID NO: 7737993 - DNA, 22 bp, Homo sapiens
ggcagccagagggcagctggat

SEQ ID NO: 7737994 - DNA, 22 bp, Homo sapiens
ggcagaagataggacagggaat

SEQ ID NO: 7737995 - DNA, 22 bp, Homo sapiens
ggcagaaggcaattagagactg

SEQ ID NO: 7737996 - DNA, 22 bp, Homo sapiens
gggagctgagctggaagagaat

SEQ ID NO: 7737997 - DNA, 22 bp, Homo sapiens
ggctttatattgtttgagcaga

SEQ ID NO: 7737998 - DNA, 22 bp, Homo sapiens
ggctttatagggtagaggatca

SEQ ID NO: 7737999 - DNA, 22 bp, Homo sapiens
ggctttatgcagggatagaaat

SEQ ID NO: 7738000 - DNA, 22 bp, Homo sapiens
ggctttatgcacagcagatggt

SEQ ID NO: 7738001 - DNA, 22 bp, Homo sapiens
ggctttatcaaatgagaccctg

SEQ ID NO: 7738002 - DNA, 22 bp, Homo sapiens
ggctttatttcactgtaccata

SEQ ID NO: 7738003 - DNA, 22 bp, Homo sapiens
ggctttattatgtggccatgtg

SEQ ID NO: 7738004 - DNA, 22 bp, Homo sapiens
ggctttatttgcagccattgtt

SEQ ID NO: 7738005 - DNA, 21 bp, Homo sapiens
ggctttatgctcacccagcct

SEQ ID NO: 7738006 - DNA, 22 bp, Homo sapiens
ggctttatgtttttcatgtggt

SEQ ID NO: 7738007 - DNA, 22 bp, Homo sapiens
ggctttattaactcatccgtaa

SEQ ID NO: 7738008 - DNA, 22 bp, Homo sapiens
ggctttattaagcagggtaagt

SEQ ID NO: 7738009 - DNA, 22 bp, Homo sapiens
gggaaggctgcctgagggatgg

SEQ ID NO: 7738010 - DNA, 22 bp, Homo sapiens
ggctttattttgcatgaatgct

SEQ ID NO: 7738011 - DNA, 22 bp, Homo sapiens
gggcacagtctgcagcccccca

SEQ ID NO: 7738012 - DNA, 22 bp, Homo sapiens
gggcacagtctaaagttgggcc

SEQ ID NO: 7738013 - DNA, 22 bp, Homo sapiens
gggcactgctggaggctccctg

SEQ ID NO: 7738014 - DNA, 19 bp, Homo sapiens
gggcagtggcactagggag

SEQ ID NO: 7738015 - DNA, 22 bp, Homo sapiens
gggcagtcacagtgctggagca

SEQ ID NO: 7738016 - DNA, 22 bp, Homo sapiens
gggcaggttattggagtaggga

SEQ ID NO: 7738017 - DNA, 23 bp, Homo sapiens
gggcaggtttttataggcttcag

SEQ ID NO: 7738018 - DNA, 22 bp, Homo sapiens
gggagggacacaaagagttccc

SEQ ID NO: 7738019 - DNA, 22 bp, Homo sapiens
gggagggatctgctaggcaatg

SEQ ID NO: 7738020 - DNA, 22 bp, Homo sapiens
gggagggaggtgatgcttggct

SEQ ID NO: 7738021 - DNA, 22 bp, Homo sapiens
gggcacaggagaaggatctggc

SEQ ID NO: 7738022 - DNA, 22 bp, Homo sapiens
gggcacaggagaaggatctggc

SEQ ID NO: 7738023 - DNA, 22 bp, Homo sapiens
gggcacagtactccaatcaact

SEQ ID NO: 7738024 - DNA, 19 bp, Homo sapiens
ggctggagaaaggaatcag

SEQ ID NO: 7738025 - DNA, 22 bp, Homo sapiens
ggctgtgagcaggcagaatgct

SEQ ID NO: 7738026 - DNA, 22 bp, Homo sapiens
ggctgaggggcccagaggaaca

SEQ ID NO: 7738027 - DNA, 22 bp, Homo sapiens
ggctgagggtatagctgtccca

SEQ ID NO: 7738028 - DNA, 22 bp, Homo sapiens
ggctgaggggcccagaggaaca

SEQ ID NO: 7738029 - DNA, 22 bp, Homo sapiens
ggctgagggccagggctagtct

SEQ ID NO: 7738030 - DNA, 22 bp, Homo sapiens
ggctgagggttaagatcagaca

SEQ ID NO: 7738031 - DNA, 22 bp, Homo sapiens
ggctggaagtccaagatcaagg

SEQ ID NO: 7738032 - DNA, 22 bp, Homo sapiens
ggctggaaggtagaagatgagg

SEQ ID NO: 7738033 - DNA, 22 bp, Homo sapiens
ggctggaagtccaagatcaaga

SEQ ID NO: 7738034 - DNA, 23 bp, Homo sapiens
ggctggaagaaaacagaattgtt

SEQ ID NO: 7738035 - DNA, 22 bp, Homo sapiens
ggctggaaaagacaaagctatt

SEQ ID NO: 7738036 - DNA, 22 bp, Homo sapiens
ggctgctgtttcagagactgtt

SEQ ID NO: 7738037 - DNA, 22 bp, Homo sapiens
ggctgctggggacgtgggagag

SEQ ID NO: 7738038 - DNA, 17 bp, Homo sapiens
ggctctgggtgtcacat

SEQ ID NO: 7738039 - DNA, 22 bp, Homo sapiens
ggctctgggtgtgaccttgggt

SEQ ID NO: 7738040 - DNA, 22 bp, Homo sapiens
ggctctggtgtgaagcagcctc

SEQ ID NO: 7738041 - DNA, 22 bp, Homo sapiens
ggctctgtggctggccatgatg

SEQ ID NO: 7738042 - DNA, 22 bp, Homo sapiens
ggctctggggcctcctcccttg

SEQ ID NO: 7738043 - DNA, 22 bp, Homo sapiens
ggctctggggaagctctcttca

SEQ ID NO: 7738044 - DNA, 22 bp, Homo sapiens
ggctctgggtctgtggggagcg

SEQ ID NO: 7738045 - DNA, 22 bp, Homo sapiens
ggctctggggggaagtctgttg

SEQ ID NO: 7738046 - DNA, 22 bp, Homo sapiens
ggctccctgttctattccctgg

SEQ ID NO: 7738047 - DNA, 22 bp, Homo sapiens
ggctagaagtcagaggtcaaga

SEQ ID NO: 7738048 - DNA, 22 bp, Homo sapiens
ggctagaataattgacttcatt

SEQ ID NO: 7738049 - DNA, 22 bp, Homo sapiens
ggcgtttcaccatgttgaccag

SEQ ID NO: 7738050 - DNA, 22 bp, Homo sapiens
ggctccagggagtggagagaag

SEQ ID NO: 7738051 - DNA, 22 bp, Homo sapiens
ggctccctggccctggggacac

SEQ ID NO: 7738052 - DNA, 22 bp, Homo sapiens
ggctccctggaaatcccgaggc

SEQ ID NO: 7738053 - DNA, 22 bp, Homo sapiens
ggctccctgcctgtcctcagtc

SEQ ID NO: 7738054 - DNA, 22 bp, Homo sapiens
ggctccctagggagagtgggag

SEQ ID NO: 7738055 - DNA, 22 bp, Homo sapiens
ggggatggattccgggtccctg

SEQ ID NO: 7738056 - DNA, 22 bp, Homo sapiens
gggctgggattgcttgctgtga

SEQ ID NO: 7738057 - DNA, 22 bp, Homo sapiens
gggctgggatggcttgaagatt

SEQ ID NO: 7738058 - DNA, 22 bp, Homo sapiens
gggctggctgattttcctctct

SEQ ID NO: 7738059 - DNA, 22 bp, Homo sapiens
gggggacaggatgaatatctgt

SEQ ID NO: 7738060 - DNA, 22 bp, Homo sapiens
ggggctgttgaagttagttgag

SEQ ID NO: 7738061 - DNA, 22 bp, Homo sapiens
ggggcagctcccgagggcagga

SEQ ID NO: 7738062 - DNA, 22 bp, Homo sapiens
gggtatgatagggaggtgaaat

SEQ ID NO: 7738063 - DNA, 22 bp, Homo sapiens
gggtatgagatataggtgaata

SEQ ID NO: 7738064 - DNA, 22 bp, Homo sapiens
gggggctaccgtctctggagct

SEQ ID NO: 7738065 - DNA, 22 bp, Homo sapiens
gggcctccgtgtgctggtgctc

SEQ ID NO: 7738066 - DNA, 22 bp, Homo sapiens
gggcatgcctgagcctgccact

SEQ ID NO: 7738067 - DNA, 21 bp, Homo sapiens
gggcctggctgcgcaggacgg

SEQ ID NO: 7738068 - DNA, 21 bp, Homo sapiens
gggcctggctgcgcaggacgg

SEQ ID NO: 7738069 - DNA, 22 bp, Homo sapiens
gggcctgggaacttgcatttag

SEQ ID NO: 7738070 - DNA, 22 bp, Homo sapiens
gggcctggggacaccaccatga

SEQ ID NO: 7738071 - DNA, 22 bp, Homo sapiens
gggctccagtttggccaggaag

SEQ ID NO: 7738072 - DNA, 22 bp, Homo sapiens
gggctccatcacaggctccatc

SEQ ID NO: 7738073 - DNA, 22 bp, Homo sapiens
gggctccagagtccatgttctt

SEQ ID NO: 7738074 - DNA, 22 bp, Homo sapiens
gggctggctaagacttttctgt

SEQ ID NO: 7738075 - DNA, 22 bp, Homo sapiens
gggctctgaatcccaggtctgc

SEQ ID NO: 7738076 - DNA, 22 bp, Homo sapiens
ggtcaggggctgctctacagag

SEQ ID NO: 7738077 - DNA, 22 bp, Homo sapiens
ggtccaggtatgtggtgtgaat

SEQ ID NO: 7738078 - DNA, 22 bp, Homo sapiens
ggtccagggggtagatatgtga

SEQ ID NO: 7738079 - DNA, 22 bp, Homo sapiens
ggtcagcatctggttgagggca

SEQ ID NO: 7738080 - DNA, 22 bp, Homo sapiens
ggtagcagggctgtgagtcaga

SEQ ID NO: 7738081 - DNA, 20 bp, Homo sapiens
ggtagcagctgctgtcatcc

SEQ ID NO: 7738082 - DNA, 22 bp, Homo sapiens
ggtgcctgtatttggggcacag

SEQ ID NO: 7738083 - DNA, 22 bp, Homo sapiens
ggtggctgaagcagtcttcggg

SEQ ID NO: 7738084 - DNA, 22 bp, Homo sapiens
ggtggctgaatcaaatcaggcc

SEQ ID NO: 7738085 - DNA, 22 bp, Homo sapiens
ggtggctgcaatggctaacttc

SEQ ID NO: 7738086 - DNA, 22 bp, Homo sapiens
ggtgggagagcttgctttgatg

SEQ ID NO: 7738087 - DNA, 22 bp, Homo sapiens
ggtgggagagctctgtctccag

SEQ ID NO: 7738088 - DNA, 22 bp, Homo sapiens
ggtgggaggcaggctgctccca

SEQ ID NO: 7738089 - DNA, 22 bp, Homo sapiens
ggtctggcctggcattctatgg

SEQ ID NO: 7738090 - DNA, 17 bp, Homo sapiens
ggtctggggccattggc

SEQ ID NO: 7738091 - DNA, 22 bp, Homo sapiens
ggtgaataagctgaacacttgg

SEQ ID NO: 7738092 - DNA, 22 bp, Homo sapiens
gtgctgggattacaggtgtgag

SEQ ID NO: 7738093 - DNA, 22 bp, Homo sapiens
gtgctgggccctgagaccaggg

SEQ ID NO: 7738094 - DNA, 22 bp, Homo sapiens
gtgctggggagataggaagaga

SEQ ID NO: 7738095 - DNA, 22 bp, Homo sapiens
gtgctgggtgctgcagacaggt

SEQ ID NO: 7738096 - DNA, 20 bp, Homo sapiens
gtgccctgtgggctattttc

SEQ ID NO: 7738097 - DNA, 21 bp, Homo sapiens
gtgccctgttcccacatgccc

SEQ ID NO: 7738098 - DNA, 22 bp, Homo sapiens
gtgccctgatcgctaggctccc

SEQ ID NO: 7738099 - DNA, 22 bp, Homo sapiens
gtgccctgatgcaattgtctca

SEQ ID NO: 7738100 - DNA, 22 bp, Homo sapiens
gtgcacagaaacatacaatgtg

SEQ ID NO: 7738101 - DNA, 22 bp, Homo sapiens
gtgccctgagcttatgcattct

SEQ ID NO: 7738102 - DNA, 22 bp, Homo sapiens
gtgccctgacacacctggtgtg

SEQ ID NO: 7738103 - DNA, 22 bp, Homo sapiens
gtctggggtactttcatctgat

SEQ ID NO: 7738104 - DNA, 22 bp, Homo sapiens
gtgatcctataaagtgagcaca

SEQ ID NO: 7738105 - DNA, 22 bp, Homo sapiens
gtgaggtggtacaatattaact

SEQ ID NO: 7738106 - DNA, 22 bp, Homo sapiens
gtgataaaatagaaacagtggt

SEQ ID NO: 7738107 - DNA, 22 bp, Homo sapiens
gtcagtaggaacctagggtcaa

SEQ ID NO: 7738108 - DNA, 22 bp, Homo sapiens
gtcagtgcttgaagggcagaga

SEQ ID NO: 7738109 - DNA, 22 bp, Homo sapiens
gtcattcagagatgcaggtaga

SEQ ID NO: 7738110 - DNA, 22 bp, Homo sapiens
gtcattcaactgcacattaggt

SEQ ID NO: 7738111 - DNA, 22 bp, Homo sapiens
gtccctggatctgggacagctg

SEQ ID NO: 7738112 - DNA, 22 bp, Homo sapiens
gtcctcagagtgggcaggtcct

SEQ ID NO: 7738113 - DNA, 22 bp, Homo sapiens
gtcctcagggagtcccagtcat

SEQ ID NO: 7738114 - DNA, 22 bp, Homo sapiens
gtcctcagggaatgtggcgggt

SEQ ID NO: 7738115 - DNA, 21 bp, Homo sapiens
gtcctcagctgatgggagctg

SEQ ID NO: 7738116 - DNA, 22 bp, Homo sapiens
gtcctcagtcagtttggtgggg

SEQ ID NO: 7738117 - DNA, 22 bp, Homo sapiens
gtaaattatttcaagatcatct

SEQ ID NO: 7738118 - DNA, 22 bp, Homo sapiens
gtaatctcagctacttgggagg

SEQ ID NO: 7738119 - DNA, 22 bp, Homo sapiens
gtcaacatttactgccctggcc

SEQ ID NO: 7738120 - DNA, 22 bp, Homo sapiens
gtcaacttatctctttatctgt

SEQ ID NO: 7738121 - DNA, 22 bp, Homo sapiens
gtcaataattttatggagagaa

SEQ ID NO: 7738122 - DNA, 22 bp, Homo sapiens
gtcaataattgatagatattgg

SEQ ID NO: 7738123 - DNA, 22 bp, Homo sapiens
gtagcttccagaaagtgtcttt

SEQ ID NO: 7738124 - DNA, 22 bp, Homo sapiens
gtagctgatcctgaggacaggg

SEQ ID NO: 7738125 - DNA, 22 bp, Homo sapiens
gtagcttcaagtactctccctg

SEQ ID NO: 7738126 - DNA, 22 bp, Homo sapiens
gtagaggacatttgacatgatg

SEQ ID NO: 7738127 - DNA, 22 bp, Homo sapiens
gtagaggggtgattctgtgaga

SEQ ID NO: 7738128 - DNA, 22 bp, Homo sapiens
gtagattccagtggtctgtgtc

SEQ ID NO: 7738129 - DNA, 22 bp, Homo sapiens
taggttcaagttcaggctctat

SEQ ID NO: 7738130 - DNA, 22 bp, Homo sapiens
taggttcacacatcttccagat

SEQ ID NO: 7738131 - DNA, 22 bp, Homo sapiens
taggttcactgtcttgaggagc

SEQ ID NO: 7738132 - DNA, 22 bp, Homo sapiens
taggttcagcttccactgccta

SEQ ID NO: 7738133 - DNA, 22 bp, Homo sapiens
taggttcagagaactgaaaata

SEQ ID NO: 7738134 - DNA, 22 bp, Homo sapiens
taggttcacttagctgtgggaa

SEQ ID NO: 7738135 - DNA, 22 bp, Homo sapiens
taggttcagctttcatcctgaa

SEQ ID NO: 7738136 - DNA, 22 bp, Homo sapiens
taggttcaggagatattgcaca

SEQ ID NO: 7738137 - DNA, 22 bp, Homo sapiens
taggttcagtgtcttgttctgc

SEQ ID NO: 7738138 - DNA, 22 bp, Homo sapiens
taggttcatattctagaatcat

SEQ ID NO: 7738139 - DNA, 22 bp, Homo sapiens
taggttctctattgcccccaaa

SEQ ID NO: 7738140 - DNA, 22 bp, Homo sapiens
taggttcatgaaattttcagga

SEQ ID NO: 7738141 - DNA, 22 bp, Homo sapiens
taggctgagcttgtagatcgta

SEQ ID NO: 7738142 - DNA, 22 bp, Homo sapiens
taggctgagctaagagagctta

SEQ ID NO: 7738143 - DNA, 22 bp, Homo sapiens
taggctgacttgtttcataaag

SEQ ID NO: 7738144 - DNA, 22 bp, Homo sapiens
taggctgaggttgatgccaggg

SEQ ID NO: 7738145 - DNA, 22 bp, Homo sapiens
tagtagcaggaatctgaaggta

SEQ ID NO: 7738146 - DNA, 22 bp, Homo sapiens
tagtagcaaaactcatctcttt

SEQ ID NO: 7738147 - DNA, 22 bp, Homo sapiens
tagtcctgaccttgccaccagc

SEQ ID NO: 7738148 - DNA, 22 bp, Homo sapiens
taggacagagttccctgatggc

SEQ ID NO: 7738149 - DNA, 22 bp, Homo sapiens
taggacaggatcatgatgctgg

SEQ ID NO: 7738150 - DNA, 22 bp, Homo sapiens
taggctgaaaggagaggtgaag

SEQ ID NO: 7738151 - DNA, 22 bp, Homo sapiens
taggaaggaggccatcttggcg

SEQ ID NO: 7738152 - DNA, 22 bp, Homo sapiens
taggaaggtgtttttaaggagc

SEQ ID NO: 7738153 - DNA, 20 bp, Homo sapiens
taggaaatatgtttttaccc

SEQ ID NO: 7738154 - DNA, 22 bp, Homo sapiens
taggaaatgaatgcaggctccc

SEQ ID NO: 7738155 - DNA, 22 bp, Homo sapiens
taggaaatatttgaacatagga

SEQ ID NO: 7738156 - DNA, 19 bp, Homo sapiens
tagcccagagcctggctac

SEQ ID NO: 7738157 - DNA, 22 bp, Homo sapiens
taggaagcctaaattaagtggt

SEQ ID NO: 7738158 - DNA, 18 bp, Homo sapiens
taggaagcttaatgtttt

SEQ ID NO: 7738159 - DNA, 22 bp, Homo sapiens
taggaagctctttgttttgtga

SEQ ID NO: 7738160 - DNA, 22 bp, Homo sapiens
taggaaatgctgtcttattgta

SEQ ID NO: 7738161 - DNA, 22 bp, Homo sapiens
tagatgttaagcttctagaagg

SEQ ID NO: 7738162 - DNA, 22 bp, Homo sapiens
tagatgttttaactcttggtta

SEQ ID NO: 7738163 - DNA, 22 bp, Homo sapiens
tagatttgtttccttctctcca

SEQ ID NO: 7738164 - DNA, 22 bp, Homo sapiens
tagatgttttgatatttgctga

SEQ ID NO: 7738165 - DNA, 22 bp, Homo sapiens
tagaagtggcaacactcagaaa

SEQ ID NO: 7738166 - DNA, 18 bp, Homo sapiens
tagaagtgtgctatacaa

SEQ ID NO: 7738167 - DNA, 22 bp, Homo sapiens
tagaagttcatgcgaattattt

SEQ ID NO: 7738168 - DNA, 22 bp, Homo sapiens
tagaatcattgagaataacagg

SEQ ID NO: 7738169 - DNA, 22 bp, Homo sapiens
tagaagttgctcaataaatgtt

SEQ ID NO: 7738170 - DNA, 22 bp, Homo sapiens
tagaagtttcaaaagacttcat

SEQ ID NO: 7738171 - DNA, 22 bp, Homo sapiens
tagagcagtgttgtccatcaga

SEQ ID NO: 7738172 - DNA, 22 bp, Homo sapiens
tagagcagtgggtaccatggca

SEQ ID NO: 7738173 - DNA, 23 bp, Homo sapiens
tagagcagtagatcaccatggga

SEQ ID NO: 7738174 - DNA, 23 bp, Homo sapiens
tagagcagggaaatctgtcagag

SEQ ID NO: 7738175 - DNA, 22 bp, Homo sapiens
tagagcagccttcagagcagtt

SEQ ID NO: 7738176 - DNA, 22 bp, Homo sapiens
tagagcagatagtgaaacagaa

SEQ ID NO: 7738177 - DNA, 22 bp, Homo sapiens
tagagcagaacttgttaacacc

SEQ ID NO: 7738178 - DNA, 22 bp, Homo sapiens
tagatgattttcagtcaaagca

SEQ ID NO: 7738179 - DNA, 22 bp, Homo sapiens
tagatgatggaaaaaagcaata

SEQ ID NO: 7738180 - DNA, 17 bp, Homo sapiens
tatcaagaagtctggcc

SEQ ID NO: 7738181 - DNA, 22 bp, Homo sapiens
tatctagatatttggataaatg

SEQ ID NO: 7738182 - DNA, 22 bp, Homo sapiens
tatcaaagttgtcctgtgaagt

SEQ ID NO: 7738183 - DNA, 22 bp, Homo sapiens
tatctttgcaaatatctctaag

SEQ ID NO: 7738184 - DNA, 22 bp, Homo sapiens
tatagaagagacatgtgcatag

SEQ ID NO: 7738185 - DNA, 22 bp, Homo sapiens
tatagaagtaagcattgtgatg

SEQ ID NO: 7738186 - DNA, 22 bp, Homo sapiens
tatacagatatctaagatgtaa

SEQ ID NO: 7738187 - DNA, 21 bp, Homo sapiens
tatacagaggggaacaggaga

SEQ ID NO: 7738188 - DNA, 22 bp, Homo sapiens
tagttaatgctaattaacaaat

SEQ ID NO: 7738189 - DNA, 22 bp, Homo sapiens
tatttcacataccacagagtgt

SEQ ID NO: 7738190 - DNA, 22 bp, Homo sapiens
tatgttcatgcttatgcagaat

SEQ ID NO: 7738191 - DNA, 22 bp, Homo sapiens
tattcacatgtacatatgctca

SEQ ID NO: 7738192 - DNA, 22 bp, Homo sapiens
tattcaagattgaactggcaga

SEQ ID NO: 7738193 - DNA, 22 bp, Homo sapiens
tacataattaatctttaagttc

SEQ ID NO: 7738194 - DNA, 22 bp, Homo sapiens
tacagcttgacccataatgtct

SEQ ID NO: 7738195 - DNA, 22 bp, Homo sapiens
tacagcttcagtgtgccccagt

SEQ ID NO: 7738196 - DNA, 22 bp, Homo sapiens
tacagcttgatgagagcgcgag

SEQ ID NO: 7738197 - DNA, 18 bp, Homo sapiens
tacagcttgagttgactg

SEQ ID NO: 7738198 - DNA, 22 bp, Homo sapiens
tacagcttttcatatttgtgtt

SEQ ID NO: 7738199 - DNA, 22 bp, Homo sapiens
tacagctttgggaaggccccat

SEQ ID NO: 7738200 - DNA, 22 bp, Homo sapiens
tacagctttatacccatcaaaa

SEQ ID NO: 7738201 - DNA, 22 bp, Homo sapiens
tacagctttagcaaattaccta

SEQ ID NO: 7738202 - DNA, 22 bp, Homo sapiens
tacagcttgatgtttgtgtgtt

SEQ ID NO: 7738203 - DNA, 22 bp, Homo sapiens
tacagcttatccagcttgatag

SEQ ID NO: 7738204 - DNA, 22 bp, Homo sapiens
tacagcttaaaagatgcattta

SEQ ID NO: 7738205 - DNA, 22 bp, Homo sapiens
tacagcactgtgcatagtggtt

SEQ ID NO: 7738206 - DNA, 22 bp, Homo sapiens
tacagcttttgcagctgttttg

SEQ ID NO: 7738207 - DNA, 22 bp, Homo sapiens
tactaaatgattaagcaggaat

SEQ ID NO: 7738208 - DNA, 22 bp, Homo sapiens
tacgaatcctgtggatgaatgt

SEQ ID NO: 7738209 - DNA, 22 bp, Homo sapiens
tacttcattcctttgtaaaatg

SEQ ID NO: 7738210 - DNA, 20 bp, Homo sapiens
tactgggtctgggtcctgga

SEQ ID NO: 7738211 - DNA, 22 bp, Homo sapiens
taagttacacttaacttactag

SEQ ID NO: 7738212 - DNA, 22 bp, Homo sapiens
taataaatgaaagtgctggcat

SEQ ID NO: 7738213 - DNA, 22 bp, Homo sapiens
taataaatgaaagtgctggcat

SEQ ID NO: 7738214 - DNA, 22 bp, Homo sapiens
taagtttgtgtctctgttactt

SEQ ID NO: 7738215 - DNA, 22 bp, Homo sapiens
taagtttggggaaaatgttaag

SEQ ID NO: 7738216 - DNA, 22 bp, Homo sapiens
taagttctcaatacattgtagc

SEQ ID NO: 7738217 - DNA, 22 bp, Homo sapiens
taatgagatcatatcttctgag

SEQ ID NO: 7738218 - DNA, 22 bp, Homo sapiens
taatgagactcaattgtgtgtg

SEQ ID NO: 7738219 - DNA, 23 bp, Homo sapiens
taatgagaagctttgtttcctga

SEQ ID NO: 7738220 - DNA, 22 bp, Homo sapiens
taatgagaattctttttgggta

SEQ ID NO: 7738221 - DNA, 22 bp, Homo sapiens
tacaatgctgtgcatgtaatgg

SEQ ID NO: 7738222 - DNA, 22 bp, Homo sapiens
taatttttccacgtacactggg

SEQ ID NO: 7738223 - DNA, 22 bp, Homo sapiens
taattttgtattgccattgtag

SEQ ID NO: 7738224 - DNA, 22 bp, Homo sapiens
taattttgctgtgaccattgaa

SEQ ID NO: 7738225 - DNA, 22 bp, Homo sapiens
taattttgtcacagtgacatgc

SEQ ID NO: 7738226 - DNA, 22 bp, Homo sapiens
taattttgtccccctgcacata

SEQ ID NO: 7738227 - DNA, 22 bp, Homo sapiens
gtttctcaagcttgaatgcaca

SEQ ID NO: 7738228 - DNA, 22 bp, Homo sapiens
gtttctaattggaactttgagg

SEQ ID NO: 7738229 - DNA, 22 bp, Homo sapiens
gtttctaagcacatgtgagtgt

SEQ ID NO: 7738230 - DNA, 22 bp, Homo sapiens
gtttctaagggagagctgccag

SEQ ID NO: 7738231 - DNA, 22 bp, Homo sapiens
gtttctaaatgttctgagtttt

SEQ ID NO: 7738232 - DNA, 22 bp, Homo sapiens
gtttctaagcacatgtgagtgt

SEQ ID NO: 7738233 - DNA, 22 bp, Homo sapiens
gtttctgtaagactgaattgac

SEQ ID NO: 7738234 - DNA, 22 bp, Homo sapiens
gtttctcagtttggtctgcaga

SEQ ID NO: 7738235 - DNA, 22 bp, Homo sapiens
gtgtgttcagcaagaggtaagg

SEQ ID NO: 7738236 - DNA, 22 bp, Homo sapiens
gttataaatacctaataggatt

SEQ ID NO: 7738237 - DNA, 22 bp, Homo sapiens
gttcatttttccctaatgagta

SEQ ID NO: 7738238 - DNA, 22 bp, Homo sapiens
gttttattggaacacagccatg

SEQ ID NO: 7738239 - DNA, 22 bp, Homo sapiens
gttttatttccatgagagaccg

SEQ ID NO: 7738240 - DNA, 22 bp, Homo sapiens
taaacagctactgtgtcaaagg

SEQ ID NO: 7738241 - DNA, 22 bp, Homo sapiens
taaacagagagtgcagttatag

SEQ ID NO: 7738242 - DNA, 22 bp, Homo sapiens
taaacagcctcccctttcactc

SEQ ID NO: 7738243 - DNA, 22 bp, Homo sapiens
taaacagcctaaaactttcttt

SEQ ID NO: 7738244 - DNA, 16 bp, Homo sapiens
taaacagcagacagtt

SEQ ID NO: 7738245 - DNA, 22 bp, Homo sapiens
gttttcagccaggagcacattt

SEQ ID NO: 7738246 - DNA, 22 bp, Homo sapiens
taaagttcttagaacaaggcct

SEQ ID NO: 7738247 - DNA, 22 bp, Homo sapiens
taaagttataaattacctgtca

SEQ ID NO: 7738248 - DNA, 22 bp, Homo sapiens
taagatggttgtagatggactg

SEQ ID NO: 7738249 - DNA, 22 bp, Homo sapiens
taagatgggggaaagaaatagt

SEQ ID NO: 7738250 - DNA, 22 bp, Homo sapiens
taagatagaactctgaggctac

SEQ ID NO: 7738251 - DNA, 22 bp, Homo sapiens
taagagttactggtttagaacc

SEQ ID NO: 7738252 - DNA, 22 bp, Homo sapiens
taagataaggaacattctgtga

SEQ ID NO: 7738253 - DNA, 22 bp, Homo sapiens
tcctcctcacgctgttgcttgt

SEQ ID NO: 7738254 - DNA, 21 bp, Homo sapiens
tcctcctccactaggctagcc

SEQ ID NO: 7738255 - DNA, 23 bp, Homo sapiens
tcctcagtatataaaggcagatg

SEQ ID NO: 7738256 - DNA, 22 bp, Homo sapiens
tcctcagtcacggtagcacatt

SEQ ID NO: 7738257 - DNA, 22 bp, Homo sapiens
tcctcagtcagctccgttcttg

SEQ ID NO: 7738258 - DNA, 22 bp, Homo sapiens
tcctcagtattgtggagcagat

SEQ ID NO: 7738259 - DNA, 22 bp, Homo sapiens
tcctcagtctctaaggcctcag

SEQ ID NO: 7738260 - DNA, 22 bp, Homo sapiens
tcctcagtcgtttgagccaaaa

SEQ ID NO: 7738261 - DNA, 22 bp, Homo sapiens
tcctcagttttctagtatggca

SEQ ID NO: 7738262 - DNA, 22 bp, Homo sapiens
tcctcagttataaataggaaac

SEQ ID NO: 7738263 - DNA, 22 bp, Homo sapiens
tcctcagtggggcattcattat

SEQ ID NO: 7738264 - DNA, 22 bp, Homo sapiens
tcctcagtgctagccaactgcc

SEQ ID NO: 7738265 - DNA, 22 bp, Homo sapiens
tcctcagtctctcaaatgaggc

SEQ ID NO: 7738266 - DNA, 19 bp, Homo sapiens
tcctcagtgacaacctcag

SEQ ID NO: 7738267 - DNA, 22 bp, Homo sapiens
tcccttcatcagtgagcaagcc

SEQ ID NO: 7738268 - DNA, 22 bp, Homo sapiens
tcccttcacagatgcgatgttt

SEQ ID NO: 7738269 - DNA, 22 bp, Homo sapiens
tcccttcaagatttggggaaat

SEQ ID NO: 7738270 - DNA, 22 bp, Homo sapiens
tccctgtgggatgaggactctg

SEQ ID NO: 7738271 - DNA, 22 bp, Homo sapiens
tccctgtgtccatgccaggagg

SEQ ID NO: 7738272 - DNA, 22 bp, Homo sapiens
tccctggggatgttggcctgcc

SEQ ID NO: 7738273 - DNA, 22 bp, Homo sapiens
tccagggacagcgctggagcta

SEQ ID NO: 7738274 - DNA, 22 bp, Homo sapiens
tccagggagatactggctgcca

SEQ ID NO: 7738275 - DNA, 22 bp, Homo sapiens
tccagtccagggaatggctgat

SEQ ID NO: 7738276 - DNA, 18 bp, Homo sapiens
tccagtcccaaggccagc

SEQ ID NO: 7738277 - DNA, 18 bp, Homo sapiens
tccagtcccagctctgcc

SEQ ID NO: 7738278 - DNA, 22 bp, Homo sapiens
tccagtcctagaaactggagag

SEQ ID NO: 7738279 - DNA, 22 bp, Homo sapiens
tccagtcctatctgcccttgga

SEQ ID NO: 7738280 - DNA, 22 bp, Homo sapiens
tcccagctactctagaggctga

SEQ ID NO: 7738281 - DNA, 22 bp, Homo sapiens
tcccacatgtgaatcctcaggt

SEQ ID NO: 7738282 - DNA, 22 bp, Homo sapiens
tcccagagaaagtcaaggtctt

SEQ ID NO: 7738283 - DNA, 19 bp, Homo sapiens
tcccagagtctagaggttg

SEQ ID NO: 7738284 - DNA, 22 bp, Homo sapiens
tcccagagtgtgggcatcaagg

SEQ ID NO: 7738285 - DNA, 20 bp, Homo sapiens
tccaggaatggtagaggact

SEQ ID NO: 7738286 - DNA, 22 bp, Homo sapiens
tccaggaatagatcagagattt

SEQ ID NO: 7738287 - DNA, 22 bp, Homo sapiens
tccagccctgcttcctgcctca

SEQ ID NO: 7738288 - DNA, 22 bp, Homo sapiens
tccagcccgactgggcctgccg

SEQ ID NO: 7738289 - DNA, 20 bp, Homo sapiens
tccagcccaggtcctgcctg

SEQ ID NO: 7738290 - DNA, 22 bp, Homo sapiens
tccagccccggcttccttacag

SEQ ID NO: 7738291 - DNA, 22 bp, Homo sapiens
tcatggcttgcagatggccacc

SEQ ID NO: 7738292 - DNA, 22 bp, Homo sapiens
tccacagaccagtatctgcagc

SEQ ID NO: 7738293 - DNA, 22 bp, Homo sapiens
tccacgtgagcttcgtgtgcag

SEQ ID NO: 7738294 - DNA, 22 bp, Homo sapiens
tccacccctgggaatgtcaata

SEQ ID NO: 7738295 - DNA, 22 bp, Homo sapiens
tccacccccagacagctggtga

SEQ ID NO: 7738296 - DNA, 23 bp, Homo sapiens
tccaccccagctgaggcttagcc

SEQ ID NO: 7738297 - DNA, 19 bp, Homo sapiens
tccaccccagccagctctg

SEQ ID NO: 7738298 - DNA, 22 bp, Homo sapiens
tcagggctgccgggcagaccgt

SEQ ID NO: 7738299 - DNA, 22 bp, Homo sapiens
tcaggtctgtactattgtcttg

SEQ ID NO: 7738300 - DNA, 22 bp, Homo sapiens
tcaggtctgggcacatggtaca

SEQ ID NO: 7738301 - DNA, 22 bp, Homo sapiens
tcaggtctgatgcctcatccat

SEQ ID NO: 7738302 - DNA, 22 bp, Homo sapiens
tcaggtcttttgtctcctagaa

SEQ ID NO: 7738303 - DNA, 22 bp, Homo sapiens
tcaggtcttttgtctcctagaa

SEQ ID NO: 7738304 - DNA, 22 bp, Homo sapiens
tcaggtcttgagccatcaggat

SEQ ID NO: 7738305 - DNA, 22 bp, Homo sapiens
tcaggtctatagaagaggaggg

SEQ ID NO: 7738306 - DNA, 22 bp, Homo sapiens
tcaggtctatactatgagaggc

SEQ ID NO: 7738307 - DNA, 22 bp, Homo sapiens
tcagtgcatcacagaactttgt

SEQ ID NO: 7738308 - DNA, 22 bp, Homo sapiens
tcagtgcatggacagatttaga

SEQ ID NO: 7738309 - DNA, 22 bp, Homo sapiens
tcagtgcattcatgggtggctg

SEQ ID NO: 7738310 - DNA, 22 bp, Homo sapiens
tcagtgcattaataatatcagt

SEQ ID NO: 7738311 - DNA, 22 bp, Homo sapiens
tcagtgcagtgaaaggtttact

SEQ ID NO: 7738312 - DNA, 22 bp, Homo sapiens
tcaggctgaggtcatctgcatc

SEQ ID NO: 7738313 - DNA, 22 bp, Homo sapiens
tcaggcctttcttcagagcttc

SEQ ID NO: 7738314 - DNA, 22 bp, Homo sapiens
tcataaagatactaagtgagtt

SEQ ID NO: 7738315 - DNA, 22 bp, Homo sapiens
tcataaaatgctcctgatattg

SEQ ID NO: 7738316 - DNA, 22 bp, Homo sapiens
tcagtgcttatattctgagcct

SEQ ID NO: 7738317 - DNA, 22 bp, Homo sapiens
tcagtgcttgacagctctggga

SEQ ID NO: 7738318 - DNA, 22 bp, Homo sapiens
tcagtgcttgcctctggaggag

SEQ ID NO: 7738319 - DNA, 22 bp, Homo sapiens
tcagtgcttttgagaagctcct

SEQ ID NO: 7738320 - DNA, 22 bp, Homo sapiens
tcagtggaactgtctgggtgag

SEQ ID NO: 7738321 - DNA, 22 bp, Homo sapiens
tcaggaaatggacatctttgct

SEQ ID NO: 7738322 - DNA, 22 bp, Homo sapiens
tcaggaaagtgttctcagagga

SEQ ID NO: 7738323 - DNA, 22 bp, Homo sapiens
tcaggaaatacaagtgacatca

SEQ ID NO: 7738324 - DNA, 22 bp, Homo sapiens
tcaggaaagcctagaagagaac

SEQ ID NO: 7738325 - DNA, 22 bp, Homo sapiens
tcaggccttgtcctgacctcct

SEQ ID NO: 7738326 - DNA, 22 bp, Homo sapiens
tcagaggcttgaagcccaagcc

SEQ ID NO: 7738327 - DNA, 22 bp, Homo sapiens
tcagaggcttctggccagtctg

SEQ ID NO: 7738328 - DNA, 22 bp, Homo sapiens
tcagaggcttccttcctcggag

SEQ ID NO: 7738329 - DNA, 20 bp, Homo sapiens
tcagaggctgccagctgggg

SEQ ID NO: 7738330 - DNA, 21 bp, Homo sapiens
tcagaggctgggggaatgccc

SEQ ID NO: 7738331 - DNA, 22 bp, Homo sapiens
tcagccagtatttgagtgctca

SEQ ID NO: 7738332 - DNA, 22 bp, Homo sapiens
tcagcttggacagcttggttga

SEQ ID NO: 7738333 - DNA, 22 bp, Homo sapiens
tcacatgccctacctaatctta

SEQ ID NO: 7738334 - DNA, 22 bp, Homo sapiens
tcacctgggagggctgtggtag

SEQ ID NO: 7738335 - DNA, 21 bp, Homo sapiens
tcacctggcttctgacctggc

SEQ ID NO: 7738336 - DNA, 22 bp, Homo sapiens
tcacctcttttttaacaggctt

SEQ ID NO: 7738337 - DNA, 22 bp, Homo sapiens
tcacctaattgaagtcaggagt

SEQ ID NO: 7738338 - DNA, 22 bp, Homo sapiens
tcactgggagagctgacaagga

SEQ ID NO: 7738339 - DNA, 22 bp, Homo sapiens
tcactgggagatgtgggaaggg

SEQ ID NO: 7738340 - DNA, 22 bp, Homo sapiens
tcagaggctacagtctgggagt

SEQ ID NO: 7738341 - DNA, 22 bp, Homo sapiens
tcagaggcctgaaagaatttgg

SEQ ID NO: 7738342 - DNA, 21 bp, Homo sapiens
tcagaggcactgagagcaatg

SEQ ID NO: 7738343 - DNA, 22 bp, Homo sapiens
tcagaggcatcattcatagtta

SEQ ID NO: 7738344 - DNA, 18 bp, Homo sapiens
tcagagagaatagtaatt

SEQ ID NO: 7738345 - DNA, 22 bp, Homo sapiens
tcagagaggattttaataagtg

SEQ ID NO: 7738346 - DNA, 22 bp, Homo sapiens
tcagaggacagcagctaaataa

SEQ ID NO: 7738347 - DNA, 22 bp, Homo sapiens
tcagaagcagatatttcaaaat

SEQ ID NO: 7738348 - DNA, 22 bp, Homo sapiens
tcagaacctgcaagtctaacct

SEQ ID NO: 7738349 - DNA, 22 bp, Homo sapiens
tcagaaccagcccagcagatga

SEQ ID NO: 7738350 - DNA, 23 bp, Homo sapiens
tcacacagctggtcaggtacaga

SEQ ID NO: 7738351 - DNA, 22 bp, Homo sapiens
tcaattcaattgaacagttact

SEQ ID NO: 7738352 - DNA, 22 bp, Homo sapiens
tcaattcagtccaacagtaatt

SEQ ID NO: 7738353 - DNA, 22 bp, Homo sapiens
tcaattctagtggagagagttt

SEQ ID NO: 7738354 - DNA, 19 bp, Homo sapiens
tcaatgcatgaaatcagcc

SEQ ID NO: 7738355 - DNA, 22 bp, Homo sapiens
tcaatgcatgtgacaaagagta

SEQ ID NO: 7738356 - DNA, 22 bp, Homo sapiens
tcaatgcaatcattggacaagt

SEQ ID NO: 7738357 - DNA, 22 bp, Homo sapiens
tcaaacctgctgtcttgttcat

SEQ ID NO: 7738358 - DNA, 22 bp, Homo sapiens
tcacagcagggtaacaggaaga

SEQ ID NO: 7738359 - DNA, 17 bp, Homo sapiens
tcacatcacacaagcaa

SEQ ID NO: 7738360 - DNA, 22 bp, Homo sapiens
tcacagcctggacagttgcctg

SEQ ID NO: 7738361 - DNA, 22 bp, Homo sapiens
tcacagcctggtcactctgccc

SEQ ID NO: 7738362 - DNA, 22 bp, Homo sapiens
tcacagaatagcactgtaagcg

SEQ ID NO: 7738363 - DNA, 22 bp, Homo sapiens
tcacagaataaattgagaagac

SEQ ID NO: 7738364 - DNA, 18 bp, Homo sapiens
tcacagaatattgagtgg

SEQ ID NO: 7738365 - DNA, 20 bp, Homo sapiens
tcacagaatgcctgaagaag

SEQ ID NO: 7738366 - DNA, 22 bp, Homo sapiens
tcacagaatctctgataagtct

SEQ ID NO: 7738367 - DNA, 22 bp, Homo sapiens
tcacagaattgacatgggaatc

SEQ ID NO: 7738368 - DNA, 22 bp, Homo sapiens
tcacagaatttttgcttccagt

SEQ ID NO: 7738369 - DNA, 22 bp, Homo sapiens
tcacagaatgtctagcataatt

SEQ ID NO: 7738370 - DNA, 22 bp, Homo sapiens
tcacagaatgtcagagttgggg

SEQ ID NO: 7738371 - DNA, 21 bp, Homo sapiens
tcacagagccacagaattggt

SEQ ID NO: 7738372 - DNA, 22 bp, Homo sapiens
tcacagcaaaagtgtgcagagc

SEQ ID NO: 7738373 - DNA, 22 bp, Homo sapiens
tcacagagaggttaagcagttg

SEQ ID NO: 7738374 - DNA, 18 bp, Homo sapiens
ttctctggtggatgttat

SEQ ID NO: 7738375 - DNA, 22 bp, Homo sapiens
ttctccagtttctcccttcagt

SEQ ID NO: 7738376 - DNA, 22 bp, Homo sapiens
ttctcttcccactttctgtatt

SEQ ID NO: 7738377 - DNA, 22 bp, Homo sapiens
ttctctggtttgctgtttctga

SEQ ID NO: 7738378 - DNA, 22 bp, Homo sapiens
ttctgagctgcaacactaacat

SEQ ID NO: 7738379 - DNA, 20 bp, Homo sapiens
ttctggaggctacaagtctg

SEQ ID NO: 7738380 - DNA, 22 bp, Homo sapiens
ttctgcagcatgaggctggagc

SEQ ID NO: 7738381 - DNA, 22 bp, Homo sapiens
ttccctctcacttaaagcttgg

SEQ ID NO: 7738382 - DNA, 22 bp, Homo sapiens
ttccctctccaggagccctgag

SEQ ID NO: 7738383 - DNA, 20 bp, Homo sapiens
ttcgctgggagtggccaggc

SEQ ID NO: 7738384 - DNA, 22 bp, Homo sapiens
ttccctcttttccaacagttgt

SEQ ID NO: 7738385 - DNA, 22 bp, Homo sapiens
ttccctctgcgcattgaatttc

SEQ ID NO: 7738386 - DNA, 22 bp, Homo sapiens
ttccctctttcactgtgatttt

SEQ ID NO: 7738387 - DNA, 22 bp, Homo sapiens
ttctaaagactcatggaagtgg

SEQ ID NO: 7738388 - DNA, 22 bp, Homo sapiens
ttcgttttctaggaccaacaga

SEQ ID NO: 7738389 - DNA, 22 bp, Homo sapiens
ttctaaagtgcaatctgacaga

SEQ ID NO: 7738390 - DNA, 22 bp, Homo sapiens
ttctaaattttggaagatgcag

SEQ ID NO: 7738391 - DNA, 21 bp, Homo sapiens
ttctccaggcaaccatttcag

SEQ ID NO: 7738392 - DNA, 22 bp, Homo sapiens
ttctcaaagaaagctgtcatta

SEQ ID NO: 7738393 - DNA, 22 bp, Homo sapiens
ttctcaagaacatatgtagggt

SEQ ID NO: 7738394 - DNA, 22 bp, Homo sapiens
ttctcaaggacaaaatgacatg

SEQ ID NO: 7738395 - DNA, 22 bp, Homo sapiens
ttctcacactttccactgaggt

SEQ ID NO: 7738396 - DNA, 22 bp, Homo sapiens
ttcttcctcagcagggctgcct

SEQ ID NO: 7738397 - DNA, 22 bp, Homo sapiens
ttctgggcacacaggccctggt

SEQ ID NO: 7738398 - DNA, 22 bp, Homo sapiens
ttgaaacagtagctcatagacc

SEQ ID NO: 7738399 - DNA, 22 bp, Homo sapiens
ttataattctggcataggctgt

SEQ ID NO: 7738400 - DNA, 22 bp, Homo sapiens
ttatacaggagattccttactt

SEQ ID NO: 7738401 - DNA, 22 bp, Homo sapiens
ttatacagggagtttccctgca

SEQ ID NO: 7738402 - DNA, 22 bp, Homo sapiens
ttatacagtttatacttagaat

SEQ ID NO: 7738403 - DNA, 22 bp, Homo sapiens
ttattaaaatgcggatttggct

SEQ ID NO: 7738404 - DNA, 22 bp, Homo sapiens
ttatttactggatggccttggg

SEQ ID NO: 7738405 - DNA, 22 bp, Homo sapiens
ttatttacaactcttctcttcc

SEQ ID NO: 7738406 - DNA, 22 bp, Homo sapiens
ttatttactggatggccttggg

SEQ ID NO: 7738407 - DNA, 22 bp, Homo sapiens
ttcaaggagattggagtctact

SEQ ID NO: 7738408 - DNA, 22 bp, Homo sapiens
ttccatgaagggcagcctctca

SEQ ID NO: 7738409 - DNA, 22 bp, Homo sapiens
ttcccagagataagacgtctta

SEQ ID NO: 7738410 - DNA, 22 bp, Homo sapiens
ttcccagagaaggatgaaaaag

SEQ ID NO: 7738411 - DNA, 22 bp, Homo sapiens
ttcccagaggagatttgcttat

SEQ ID NO: 7738412 - DNA, 19 bp, Homo sapiens
ttcccagagccatgagtga

SEQ ID NO: 7738413 - DNA, 22 bp, Homo sapiens
ttcccagactccacactgaggc

SEQ ID NO: 7738414 - DNA, 22 bp, Homo sapiens
ttcccagacctgtaggatcaga

SEQ ID NO: 7738415 - DNA, 22 bp, Homo sapiens
ttccaagagctttaattgttga

SEQ ID NO: 7738416 - DNA, 17 bp, Homo sapiens
ttccaaggagcatttga

SEQ ID NO: 7738417 - DNA, 21 bp, Homo sapiens
ttcatcagccagaaatcaagc

SEQ ID NO: 7738418 - DNA, 22 bp, Homo sapiens
ttccaagtgcccatatttcatc

SEQ ID NO: 7738419 - DNA, 22 bp, Homo sapiens
ttccataatcaccttattcttt

SEQ ID NO: 7738420 - DNA, 22 bp, Homo sapiens
ttcatactcactccaataactg

SEQ ID NO: 7738421 - DNA, 17 bp, Homo sapiens
ttcaatgattaatgcat

SEQ ID NO: 7738422 - DNA, 22 bp, Homo sapiens
ttcaatcattgcaaagtaatgg

SEQ ID NO: 7738423 - DNA, 22 bp, Homo sapiens
ttcaatcatttttacatagtcc

SEQ ID NO: 7738424 - DNA, 22 bp, Homo sapiens
ttcaatcattagaatctcaggc

SEQ ID NO: 7738425 - DNA, 22 bp, Homo sapiens
ttgtggaagccctatgagagac

SEQ ID NO: 7738426 - DNA, 22 bp, Homo sapiens
ttgtgagtagtgccgcaataaa

SEQ ID NO: 7738427 - DNA, 22 bp, Homo sapiens
ttgtagaacatgcagcacaatg

SEQ ID NO: 7738428 - DNA, 22 bp, Homo sapiens
ttgtagaatcattatttctagt

SEQ ID NO: 7738429 - DNA, 22 bp, Homo sapiens
ttgtagaacatgcagcacaatg

SEQ ID NO: 7738430 - DNA, 22 bp, Homo sapiens
ttgtagaaaattagatgcatgg

SEQ ID NO: 7738431 - DNA, 22 bp, Homo sapiens
ttgtactttggggaaatgttga

SEQ ID NO: 7738432 - DNA, 22 bp, Homo sapiens
ttgggggcatattgagtagtgg

SEQ ID NO: 7738433 - DNA, 22 bp, Homo sapiens
ttgggggcagagggagcatctg

SEQ ID NO: 7738434 - DNA, 22 bp, Homo sapiens
ttggggggttgaggagtagata

SEQ ID NO: 7738435 - DNA, 22 bp, Homo sapiens
ttgtataagaagttggcagata

SEQ ID NO: 7738436 - DNA, 22 bp, Homo sapiens
ttggcttctttagtcagtttgg

SEQ ID NO: 7738437 - DNA, 22 bp, Homo sapiens
ttggcttcctgcacttgagttt

SEQ ID NO: 7738438 - DNA, 22 bp, Homo sapiens
ttggcttctgatgtattcctga

SEQ ID NO: 7738439 - DNA, 22 bp, Homo sapiens
ttggcttccaggggcttttaca

SEQ ID NO: 7738440 - DNA, 22 bp, Homo sapiens
ttggcttcaatgtcagagacag

SEQ ID NO: 7738441 - DNA, 22 bp, Homo sapiens
ttgggctggcagaggtggtctt

SEQ ID NO: 7738442 - DNA, 22 bp, Homo sapiens
ttgggctggcccttgtctctgg

SEQ ID NO: 7738443 - DNA, 22 bp, Homo sapiens
ttgggctcaggagtttgagacc

SEQ ID NO: 7738444 - DNA, 22 bp, Homo sapiens
ttggctgctggtctttggatat

SEQ ID NO: 7738445 - DNA, 22 bp, Homo sapiens
ttggcctttgtcatcaagatca

SEQ ID NO: 7738446 - DNA, 21 bp, Homo sapiens
ttggcctttgtctcagacact

SEQ ID NO: 7738447 - DNA, 22 bp, Homo sapiens
ttggccttgtacatcatattaa

SEQ ID NO: 7738448 - DNA, 22 bp, Homo sapiens
ttggccttctggtgttcatttt

SEQ ID NO: 7738449 - DNA, 22 bp, Homo sapiens
ttggccctttatgggatgggca

SEQ ID NO: 7738450 - DNA, 22 bp, Homo sapiens
ttgccaggagacaaagtgggcc

SEQ ID NO: 7738451 - DNA, 22 bp, Homo sapiens
ttgccaggagacatctggagcc

SEQ ID NO: 7738452 - DNA, 22 bp, Homo sapiens
ttgccaggcttgtttctaggct

SEQ ID NO: 7738453 - DNA, 22 bp, Homo sapiens
ttgccaggctctggttccagcc

SEQ ID NO: 7738454 - DNA, 22 bp, Homo sapiens
ttgccagggtcaggatgagatc

SEQ ID NO: 7738455 - DNA, 22 bp, Homo sapiens
ttgccaggggacatctggagcc

SEQ ID NO: 7738456 - DNA, 22 bp, Homo sapiens
ttgccagggctttggtggcatc

SEQ ID NO: 7738457 - DNA, 22 bp, Homo sapiens
ttgccagggccagtgggggtgt

SEQ ID NO: 7738458 - DNA, 22 bp, Homo sapiens
ttgccagggaacagggagaggc

SEQ ID NO: 7738459 - DNA, 22 bp, Homo sapiens
ttgagtcagtaattccatttct

SEQ ID NO: 7738460 - DNA, 22 bp, Homo sapiens
ttgcatttcccattgagtaatg

SEQ ID NO: 7738461 - DNA, 22 bp, Homo sapiens
ttgcttcctctagtttcttgaa

SEQ ID NO: 7738462 - DNA, 22 bp, Homo sapiens
ttggaattcagcttgcttataa

SEQ ID NO: 7738463 - DNA, 20 bp, Homo sapiens
ttggatgtgcatggccgtgc

SEQ ID NO: 7738464 - DNA, 22 bp, Homo sapiens
ttgctttattcacatctatatt

SEQ ID NO: 7738465 - DNA, 22 bp, Homo sapiens
ttgctttatgtgtatgacttga

SEQ ID NO: 7738466 - DNA, 22 bp, Homo sapiens
ttgctttacaaaaattgatggt

SEQ ID NO: 7738467 - DNA, 22 bp, Homo sapiens
tttcaaggctagttttaattag

SEQ ID NO: 7738468 - DNA, 22 bp, Homo sapiens
tttcaaggtgcaggagggtttt

SEQ ID NO: 7738469 - DNA, 17 bp, Homo sapiens
tttcaaggttacgttcc

SEQ ID NO: 7738470 - DNA, 22 bp, Homo sapiens
tttcaaggatgttatataaatg

SEQ ID NO: 7738471 - DNA, 23 bp, Homo sapiens
tttatttatttaggctgagggat

SEQ ID NO: 7738472 - DNA, 22 bp, Homo sapiens
tttatttatccttctggattgc

SEQ ID NO: 7738473 - DNA, 22 bp, Homo sapiens
tttatttatccttctggattgc

SEQ ID NO: 7738474 - DNA, 21 bp, Homo sapiens
tttatttatataggacacatg

SEQ ID NO: 7738475 - DNA, 22 bp, Homo sapiens
tttatttataagccacttgctg

SEQ ID NO: 7738476 - DNA, 22 bp, Homo sapiens
tttcacaggagttgtaccattt

SEQ ID NO: 7738477 - DNA, 22 bp, Homo sapiens
tttcacaggggcaacctccatg

SEQ ID NO: 7738478 - DNA, 22 bp, Homo sapiens
tttcgagggccttaagtattcc

SEQ ID NO: 7738479 - DNA, 22 bp, Homo sapiens
tttctaagaaagtaatggttat

SEQ ID NO: 7738480 - DNA, 22 bp, Homo sapiens
tttctaagaaagtaatggttat

SEQ ID NO: 7738481 - DNA, 22 bp, Homo sapiens
tttctaagaatattgctcttaa

SEQ ID NO: 7738482 - DNA, 22 bp, Homo sapiens
tttctaagacatttgtcatctt

SEQ ID NO: 7738483 - DNA, 22 bp, Homo sapiens
tttctaagatgtggtttcaagg

SEQ ID NO: 7738484 - DNA, 22 bp, Homo sapiens
tttctaagatgtggtttcaagg

SEQ ID NO: 7738485 - DNA, 19 bp, Homo sapiens
tttctaagctaaatgcttc

SEQ ID NO: 7738486 - DNA, 19 bp, Homo sapiens
tttctaagctaaatgcttc

SEQ ID NO: 7738487 - DNA, 22 bp, Homo sapiens
tttctaaggctaggtcttaagg

SEQ ID NO: 7738488 - DNA, 22 bp, Homo sapiens
tttctaaggctaggtcttaagg

SEQ ID NO: 7738489 - DNA, 22 bp, Homo sapiens
tttctaaggtgaggtagaaaat

SEQ ID NO: 7738490 - DNA, 22 bp, Homo sapiens
tttctaaggtgaggtagaaaat

SEQ ID NO: 7738491 - DNA, 21 bp, Homo sapiens
tttctaaggaggaagaaaaga

SEQ ID NO: 7738492 - DNA, 22 bp, Homo sapiens
tttccaggtgcatagaaaacag

SEQ ID NO: 7738493 - DNA, 22 bp, Homo sapiens
tttccaggtatcaagcttcagg

SEQ ID NO: 7738494 - DNA, 22 bp, Homo sapiens
tttccaggcagaggagttgtga

SEQ ID NO: 7738495 - DNA, 22 bp, Homo sapiens
tttccaggagaaagagagcctt

SEQ ID NO: 7738496 - DNA, 22 bp, Homo sapiens
tttccaggaagtaaggataatc

SEQ ID NO: 7738497 - DNA, 22 bp, Homo sapiens
tttcataatactgtacatgaaa

SEQ ID NO: 7738498 - DNA, 22 bp, Homo sapiens
tttcatattgtccagtcagcgc

SEQ ID NO: 7738499 - DNA, 22 bp, Homo sapiens
tttacagctagacatacctgag

SEQ ID NO: 7738500 - DNA, 19 bp, Homo sapiens
tttacaagttctttgtatg

SEQ ID NO: 7738501 - DNA, 22 bp, Homo sapiens
tttacaagtctgttgatcccaa

SEQ ID NO: 7738502 - DNA, 22 bp, Homo sapiens
tttacaagtcagggactgttct

SEQ ID NO: 7738503 - DNA, 22 bp, Homo sapiens
tttacaagtttacagaatgatg

SEQ ID NO: 7738504 - DNA, 22 bp, Homo sapiens
tttaaattatagttaatgtctg

SEQ ID NO: 7738505 - DNA, 22 bp, Homo sapiens
tttaaattatagttaatgtctg

SEQ ID NO: 7738506 - DNA, 22 bp, Homo sapiens
tttaacagatgtgaaattttca

SEQ ID NO: 7738507 - DNA, 23 bp, Homo sapiens
tttaactttccaataattcattg

SEQ ID NO: 7738508 - DNA, 22 bp, Homo sapiens
tttaacttagaagagatatcct

SEQ ID NO: 7738509 - DNA, 22 bp, Homo sapiens
tttaggatattaatgttcagag

SEQ ID NO: 7738510 - DNA, 22 bp, Homo sapiens
tttaggagtcaaatgttttagg

SEQ ID NO: 7738511 - DNA, 22 bp, Homo sapiens
tttattgggcctggaggatcta

SEQ ID NO: 7738512 - DNA, 22 bp, Homo sapiens
ttttgtaagaaactgccaagcc

SEQ ID NO: 7738513 - DNA, 22 bp, Homo sapiens
ttttgtctaagaactttgcaaa

SEQ ID NO: 7738514 - DNA, 22 bp, Homo sapiens
tttgtgcaggtataggcggaga

SEQ ID NO: 7738515 - DNA, 19 bp, Homo sapiens
tttgtctctgaataatatt

SEQ ID NO: 7738516 - DNA, 18 bp, Homo sapiens
tttgtcctgtggcagctg

SEQ ID NO: 7738517 - DNA, 22 bp, Homo sapiens
tttgtgtaccttgtacatttgt

SEQ ID NO: 7738518 - DNA, 22 bp, Homo sapiens
tttctaggacatgataggatat

SEQ ID NO: 7738519 - DNA, 22 bp, Homo sapiens
tttgaaatgtatcagtataggt

SEQ ID NO: 7738520 - DNA, 22 bp, Homo sapiens
tttctattgatctaataaacat

SEQ ID NO: 7738521 - DNA, 23 bp, Homo sapiens
tttggcatgttaacttcacttac

SEQ ID NO: 7738522 - DNA, 22 bp, Homo sapiens
tttggcatagctctttgttcct

SEQ ID NO: 7738523 - DNA, 22 bp, Homo sapiens
tttggccttagtccagaagaag

SEQ ID NO: 7738524 - DNA, 22 bp, Homo sapiens
tttggcctcatgaatttcttgc

SEQ ID NO: 7738525 - DNA, 22 bp, Homo sapiens
tttggcctcatgaatttcttgc

SEQ ID NO: 7738526 - DNA, 22 bp, Homo sapiens
tttggccatgctcaagggtata

SEQ ID NO: 7738527 - DNA, 22 bp, Homo sapiens
tttggcttaacttacatgatat

SEQ ID NO: 7738528 - DNA, 22 bp, Homo sapiens
agccatgggagactgtgggaga

SEQ ID NO: 7738529 - DNA, 22 bp, Homo sapiens
agccattttggtaatgataaca

SEQ ID NO: 7738530 - DNA, 22 bp, Homo sapiens
agccattttcctgaaatataac

SEQ ID NO: 7738531 - DNA, 23 bp, Homo sapiens
acagaggtccaaacagtataagc

SEQ ID NO: 7738532 - DNA, 22 bp, Homo sapiens
agcccctctgtggctctgcctc

SEQ ID NO: 7738533 - DNA, 22 bp, Homo sapiens
agcccctctccgccctgagtcg

SEQ ID NO: 7738534 - DNA, 22 bp, Homo sapiens
agcccctccagtggcataaaat

SEQ ID NO: 7738535 - DNA, 22 bp, Homo sapiens
agcccctctgtagctaatagta

SEQ ID NO: 7738536 - DNA, 17 bp, Homo sapiens
agcccctcagcgtcacc

SEQ ID NO: 7738537 - DNA, 23 bp, Homo sapiens
agcccctcatatctgctttctct

SEQ ID NO: 7738538 - DNA, 23 bp, Homo sapiens
agcccctcatggtgtctagacag

SEQ ID NO: 7738539 - DNA, 22 bp, Homo sapiens
acagcaatctgagagacatagt

SEQ ID NO: 7738540 - DNA, 17 bp, Homo sapiens
agcctgctgatctcaca

SEQ ID NO: 7738541 - DNA, 22 bp, Homo sapiens
acagcaggcacacaaggataga

SEQ ID NO: 7738542 - DNA, 22 bp, Homo sapiens
agctctgggggaaagtctgctc

SEQ ID NO: 7738543 - DNA, 19 bp, Homo sapiens
agctcctgttcagcagctc

SEQ ID NO: 7738544 - DNA, 22 bp, Homo sapiens
agctcctgttctgagagcagga

SEQ ID NO: 7738545 - DNA, 22 bp, Homo sapiens
agctccttgaagggctctggga

SEQ ID NO: 7738546 - DNA, 22 bp, Homo sapiens
acagaaattgctaatagctcat

SEQ ID NO: 7738547 - DNA, 22 bp, Homo sapiens
acactgtgagctgaagggctgc

SEQ ID NO: 7738548 - DNA, 22 bp, Homo sapiens
agcagcagtacatataagacta

SEQ ID NO: 7738549 - DNA, 22 bp, Homo sapiens
acacaggaagtcagcactgatg

SEQ ID NO: 7738550 - DNA, 21 bp, Homo sapiens
acacaggagtttcttctttct

SEQ ID NO: 7738551 - DNA, 22 bp, Homo sapiens
acaatttgaggctactcaattg

SEQ ID NO: 7738552 - DNA, 22 bp, Homo sapiens
agaggccccatgggatggcggt

SEQ ID NO: 7738553 - DNA, 22 bp, Homo sapiens
agaggccccaggtgagcatgcc

SEQ ID NO: 7738554 - DNA, 22 bp, Homo sapiens
aattttctggtgtgtaatgaag

SEQ ID NO: 7738555 - DNA, 20 bp, Homo sapiens
agaggccagttaggagtcta

SEQ ID NO: 7738556 - DNA, 22 bp, Homo sapiens
agagctggggccagagtcaagg

SEQ ID NO: 7738557 - DNA, 22 bp, Homo sapiens
agagctggggccagagtcaagg

SEQ ID NO: 7738558 - DNA, 22 bp, Homo sapiens
agagctggggccagagtcaagg

SEQ ID NO: 7738559 - DNA, 22 bp, Homo sapiens
agagctggggccagagtcaagg

SEQ ID NO: 7738560 - DNA, 22 bp, Homo sapiens
agagctgggtgaagtgccatca

SEQ ID NO: 7738561 - DNA, 22 bp, Homo sapiens
aattttctaaggtgatgatctg

SEQ ID NO: 7738562 - DNA, 22 bp, Homo sapiens
acaagttctgggaattaggaca

SEQ ID NO: 7738563 - DNA, 22 bp, Homo sapiens
acaattccacatggcatgcagg

SEQ ID NO: 7738564 - DNA, 22 bp, Homo sapiens
agatggggctcagtgtggaggc

SEQ ID NO: 7738565 - DNA, 22 bp, Homo sapiens
agatggggctgaaagttccaat

SEQ ID NO: 7738566 - DNA, 22 bp, Homo sapiens
agatggggtttcatcatgttgg

SEQ ID NO: 7738567 - DNA, 22 bp, Homo sapiens
agatggggtttcatcatgttgg

SEQ ID NO: 7738568 - DNA, 22 bp, Homo sapiens
aatgtcaattaccagaacagaa

SEQ ID NO: 7738569 - DNA, 22 bp, Homo sapiens
agacagggtcttgatcagagct

SEQ ID NO: 7738570 - DNA, 22 bp, Homo sapiens
aatgtctacattctgaattcgt

SEQ ID NO: 7738571 - DNA, 22 bp, Homo sapiens
aatgtctatttgctacaaagcc

SEQ ID NO: 7738572 - DNA, 22 bp, Homo sapiens
aatgtctacaccgtatgttgtt

SEQ ID NO: 7738573 - DNA, 22 bp, Homo sapiens
aatgtctgctctactcaggagg

SEQ ID NO: 7738574 - DNA, 22 bp, Homo sapiens
aatgcaaacttcttgttacttg

SEQ ID NO: 7738575 - DNA, 22 bp, Homo sapiens
aatgcaaagcaagcagagattt

SEQ ID NO: 7738576 - DNA, 22 bp, Homo sapiens
aatgcaaacagcccagaatcca

SEQ ID NO: 7738577 - DNA, 22 bp, Homo sapiens
aatgcaaagctctttaatcctt

SEQ ID NO: 7738578 - DNA, 22 bp, Homo sapiens
aatgcaaattctagggccctat

SEQ ID NO: 7738579 - DNA, 22 bp, Homo sapiens
aatgcaaattatcaggcttctc

SEQ ID NO: 7738580 - DNA, 23 bp, Homo sapiens
agaagggtccttggcagcgacag

SEQ ID NO: 7738581 - DNA, 23 bp, Homo sapiens
agaagggtccttggcagcgacag

SEQ ID NO: 7738582 - DNA, 22 bp, Homo sapiens
agaagggttcaggaatatgtta

SEQ ID NO: 7738583 - DNA, 22 bp, Homo sapiens
agaagggtgtatacatttcctg

SEQ ID NO: 7738584 - DNA, 21 bp, Homo sapiens
agaagggattgtggtaaagat

SEQ ID NO: 7738585 - DNA, 22 bp, Homo sapiens
agaagggtagttgtaagagtga

SEQ ID NO: 7738586 - DNA, 22 bp, Homo sapiens
agaagggtagggacttatccaa

SEQ ID NO: 7738587 - DNA, 22 bp, Homo sapiens
agacagagatactatgttgtca

SEQ ID NO: 7738588 - DNA, 21 bp, Homo sapiens
agacagagtgcagtctacata

SEQ ID NO: 7738589 - DNA, 22 bp, Homo sapiens
agagctgggacttggactcaat

SEQ ID NO: 7738590 - DNA, 22 bp, Homo sapiens
agagctgggacttggactcaat

SEQ ID NO: 7738591 - DNA, 22 bp, Homo sapiens
agagctgggacttggactcaat

SEQ ID NO: 7738592 - DNA, 22 bp, Homo sapiens
aatttacagttgctgatggtac

SEQ ID NO: 7738593 - DNA, 20 bp, Homo sapiens
aatttactcacagaatgaat

SEQ ID NO: 7738594 - DNA, 20 bp, Homo sapiens
aattagcttaagtcaatcag

SEQ ID NO: 7738595 - DNA, 22 bp, Homo sapiens
accccagggctgccagcctcct

SEQ ID NO: 7738596 - DNA, 22 bp, Homo sapiens
accccaggtccaggttacagag

SEQ ID NO: 7738597 - DNA, 22 bp, Homo sapiens
aagtacttctagatggataatc

SEQ ID NO: 7738598 - DNA, 22 bp, Homo sapiens
accatccaaactgctttctgtg

SEQ ID NO: 7738599 - DNA, 22 bp, Homo sapiens
accatgttggccaagctggtct

SEQ ID NO: 7738600 - DNA, 22 bp, Homo sapiens
aagggctgagaagtggggctgg

SEQ ID NO: 7738601 - DNA, 22 bp, Homo sapiens
aaggtagattctggatcgaagg

SEQ ID NO: 7738602 - DNA, 18 bp, Homo sapiens
aaggtctgtctggtaggt

SEQ ID NO: 7738603 - DNA, 22 bp, Homo sapiens
aaggtctgtggccacctctggg

SEQ ID NO: 7738604 - DNA, 22 bp, Homo sapiens
aaggctgaaagaccttgaacct

SEQ ID NO: 7738605 - DNA, 22 bp, Homo sapiens
aaggctgaggagggcctgcagg

SEQ ID NO: 7738606 - DNA, 22 bp, Homo sapiens
aaggctgaggcagtgaggcaga

SEQ ID NO: 7738607 - DNA, 22 bp, Homo sapiens
aaggctgaggctggagaattac

SEQ ID NO: 7738608 - DNA, 16 bp, Homo sapiens
aaggctgattttccct

SEQ ID NO: 7738609 - DNA, 22 bp, Homo sapiens
aaggctgagggctgtacctggc

SEQ ID NO: 7738610 - DNA, 22 bp, Homo sapiens
aaggctgaggtagggcctaaaa

SEQ ID NO: 7738611 - DNA, 22 bp, Homo sapiens
aaggctgagtaaaacagagaac

SEQ ID NO: 7738612 - DNA, 22 bp, Homo sapiens
aaggctgattagactgatagct

SEQ ID NO: 7738613 - DNA, 22 bp, Homo sapiens
aaggctggtttccttgatgttt

SEQ ID NO: 7738614 - DNA, 22 bp, Homo sapiens
aaggaaatacaacatgtattca

SEQ ID NO: 7738615 - DNA, 22 bp, Homo sapiens
aaggaaaggatgagcatgcatt

SEQ ID NO: 7738616 - DNA, 22 bp, Homo sapiens
aaggaaaggatgagcatgcatt

SEQ ID NO: 7738617 - DNA, 22 bp, Homo sapiens
aaggaaatgaggttgatggatg

SEQ ID NO: 7738618 - DNA, 22 bp, Homo sapiens
aaggaaatgtgcctgacactgc

SEQ ID NO: 7738619 - DNA, 22 bp, Homo sapiens
aaggaaattaggttattttgct

SEQ ID NO: 7738620 - DNA, 22 bp, Homo sapiens
aaggaaatctttgtaacatctt

SEQ ID NO: 7738621 - DNA, 22 bp, Homo sapiens
aaggcaggtattgatgccacag

SEQ ID NO: 7738622 - DNA, 22 bp, Homo sapiens
aaggcaggatgggaaaagattt

SEQ ID NO: 7738623 - DNA, 22 bp, Homo sapiens
aaggcagcttcaccacagcatt

SEQ ID NO: 7738624 - DNA, 22 bp, Homo sapiens
aaggcagccgtgtgactgcatg

SEQ ID NO: 7738625 - DNA, 22 bp, Homo sapiens
actgcctgtttggcatggcccc

SEQ ID NO: 7738626 - DNA, 22 bp, Homo sapiens
actgcctgtttggcatggcccc

SEQ ID NO: 7738627 - DNA, 22 bp, Homo sapiens
aataagatcttaaaggttatat

SEQ ID NO: 7738628 - DNA, 22 bp, Homo sapiens
aataatgttatgtcattcttct

SEQ ID NO: 7738629 - DNA, 22 bp, Homo sapiens
aataagatcctgaagatatgtt

SEQ ID NO: 7738630 - DNA, 22 bp, Homo sapiens
aataagatcctgaagatatgtt

SEQ ID NO: 7738631 - DNA, 21 bp, Homo sapiens
aagtggagaagaaaagctgga

SEQ ID NO: 7738632 - DNA, 23 bp, Homo sapiens
aagttagtttcaataaagcaatt

SEQ ID NO: 7738633 - DNA, 22 bp, Homo sapiens
aagttagtggataaacagcaaa

SEQ ID NO: 7738634 - DNA, 18 bp, Homo sapiens
actccccacaggctctgt

SEQ ID NO: 7738635 - DNA, 22 bp, Homo sapiens
acttgaatttagtttttcctaa

SEQ ID NO: 7738636 - DNA, 22 bp, Homo sapiens
aatatatgactccactgcatga

SEQ ID NO: 7738637 - DNA, 22 bp, Homo sapiens
acttgaaaagctcagcagtagt

SEQ ID NO: 7738638 - DNA, 22 bp, Homo sapiens
aatccagcacatggacacagtc

SEQ ID NO: 7738639 - DNA, 22 bp, Homo sapiens
aatcctgaggcaaagagatgag

SEQ ID NO: 7738640 - DNA, 22 bp, Homo sapiens
aatcaaagaatgggctagttgg

SEQ ID NO: 7738641 - DNA, 21 bp, Homo sapiens
aatcaagagtactggtgtggc

SEQ ID NO: 7738642 - DNA, 22 bp, Homo sapiens
aatcaagagctgactatatttt

SEQ ID NO: 7738643 - DNA, 22 bp, Homo sapiens
aatcaagaggcgatggatggaa

SEQ ID NO: 7738644 - DNA, 21 bp, Homo sapiens
agaagggattgtggtaaagat

SEQ ID NO: 7738645 - DNA, 18 bp, Homo sapiens
agaaggagctatgggcag

SEQ ID NO: 7738646 - DNA, 22 bp, Homo sapiens
agaagggaactcagagatgatt

SEQ ID NO: 7738647 - DNA, 22 bp, Homo sapiens
aatgagaaccttgaaaggaact

SEQ ID NO: 7738648 - DNA, 22 bp, Homo sapiens
aatgagaaaacacagaggaggt

SEQ ID NO: 7738649 - DNA, 22 bp, Homo sapiens
aatgagaactgggagttggtgg

SEQ ID NO: 7738650 - DNA, 22 bp, Homo sapiens
aatgagaagcctaggtgtactg

SEQ ID NO: 7738651 - DNA, 22 bp, Homo sapiens
aatgagaatgtaagtgaagaga

SEQ ID NO: 7738652 - DNA, 22 bp, Homo sapiens
aatgacctcagagcacccagaa

SEQ ID NO: 7738653 - DNA, 22 bp, Homo sapiens
aaatagcttctaagccttttga

SEQ ID NO: 7738654 - DNA, 22 bp, Homo sapiens
aaatagcagctttgacagcaca

SEQ ID NO: 7738655 - DNA, 22 bp, Homo sapiens
aaatactgtagataatagagtt

SEQ ID NO: 7738656 - DNA, 22 bp, Homo sapiens
aaatagatttcctagcattgga

SEQ ID NO: 7738657 - DNA, 22 bp, Homo sapiens
aaatagattgctgaggcattac

SEQ ID NO: 7738658 - DNA, 22 bp, Homo sapiens
aaataacttggtttcatcagag

SEQ ID NO: 7738659 - DNA, 22 bp, Homo sapiens
aaataagtgtgggccagtcaaa

SEQ ID NO: 7738660 - DNA, 22 bp, Homo sapiens
aaagtgttgaagaaaatgttca

SEQ ID NO: 7738661 - DNA, 22 bp, Homo sapiens
aaagttttatatgctgcagcga

SEQ ID NO: 7738662 - DNA, 22 bp, Homo sapiens
aaagtgtttacattgctataag

SEQ ID NO: 7738663 - DNA, 22 bp, Homo sapiens
aaatgtattgcataggatattt

SEQ ID NO: 7738664 - DNA, 18 bp, Homo sapiens
aaatgtactgtccatggc

SEQ ID NO: 7738665 - DNA, 22 bp, Homo sapiens
aagcatgggaatcccacagggt

SEQ ID NO: 7738666 - DNA, 22 bp, Homo sapiens
aagcatgggaggcctggaggag

SEQ ID NO: 7738667 - DNA, 22 bp, Homo sapiens
aagcacagagaggtaaagtaac

SEQ ID NO: 7738668 - DNA, 22 bp, Homo sapiens
aaattttgtattctagttctag

SEQ ID NO: 7738669 - DNA, 21 bp, Homo sapiens
aaattttcttggctgtagtgt

SEQ ID NO: 7738670 - DNA, 22 bp, Homo sapiens
aaagatcaatagataaagctac

SEQ ID NO: 7738671 - DNA, 22 bp, Homo sapiens
aaagctgccaaggagaatacta

SEQ ID NO: 7738672 - DNA, 22 bp, Homo sapiens
aaagctgctttaaacatctatg

SEQ ID NO: 7738673 - DNA, 22 bp, Homo sapiens
aaagctgcccttgtgaaacaag

SEQ ID NO: 7738674 - DNA, 22 bp, Homo sapiens
aaaggttttcatcacagcaaga

SEQ ID NO: 7738675 - DNA, 22 bp, Homo sapiens
aactaaatctggcatttagagc

SEQ ID NO: 7738676 - DNA, 22 bp, Homo sapiens
aaaggtttatttaatcagggag

SEQ ID NO: 7738677 - DNA, 22 bp, Homo sapiens
aaaggaagattgagcttttcca

SEQ ID NO: 7738678 - DNA, 22 bp, Homo sapiens
aaagtatgattggggattattt

SEQ ID NO: 7738679 - DNA, 22 bp, Homo sapiens
aaagtagaggcattgatcaggt

SEQ ID NO: 7738680 - DNA, 22 bp, Homo sapiens
aaagtagctttgtaggtacagt

SEQ ID NO: 7738681 - DNA, 22 bp, Homo sapiens
aaagtatgttgtggcttttaaa

SEQ ID NO: 7738682 - DNA, 22 bp, Homo sapiens
aaagtattcaaaaatatttggt

SEQ ID NO: 7738683 - DNA, 22 bp, Homo sapiens
aaagtattcttgactgtttttc

SEQ ID NO: 7738684 - DNA, 22 bp, Homo sapiens
aaagtatttttgacaggcatta

SEQ ID NO: 7738685 - DNA, 22 bp, Homo sapiens
aaagtatttgtgatttttacca

SEQ ID NO: 7738686 - DNA, 22 bp, Homo sapiens
aaagtgctgtgattacaggcat

SEQ ID NO: 7738687 - DNA, 22 bp, Homo sapiens
aaagtgctggtattacaggtgt

SEQ ID NO: 7738688 - DNA, 22 bp, Homo sapiens
aaaaatctatgactgcttctcc

SEQ ID NO: 7738689 - DNA, 22 bp, Homo sapiens
aaaatgacattccagtgatatt

SEQ ID NO: 7738690 - DNA, 22 bp, Homo sapiens
aaaaaagattgatggtggatgc

SEQ ID NO: 7738691 - DNA, 22 bp, Homo sapiens
aaaaaattatcatagttcctga

SEQ ID NO: 7738692 - DNA, 22 bp, Homo sapiens
aaaaacctcaattacttttgca

SEQ ID NO: 7738693 - DNA, 22 bp, Homo sapiens
aaaatcttgtgacttaggaagg

SEQ ID NO: 7738694 - DNA, 22 bp, Homo sapiens
aaaatcttgactgtttttagaa

SEQ ID NO: 7738695 - DNA, 22 bp, Homo sapiens
aaaatctaagtagcgagtaagg

SEQ ID NO: 7738696 - DNA, 22 bp, Homo sapiens
aaagactaaccagttgtcaaaa

SEQ ID NO: 7738697 - DNA, 22 bp, Homo sapiens
aaaatcctctaattctagaata

SEQ ID NO: 7738698 - DNA, 22 bp, Homo sapiens
aaactcaaagtcagatcagaga

SEQ ID NO: 7738699 - DNA, 22 bp, Homo sapiens
aaactcaagtctatgaacaagg

SEQ ID NO: 7738700 - DNA, 22 bp, Homo sapiens
aaaagtatagggtttggagtca

SEQ ID NO: 7738701 - DNA, 22 bp, Homo sapiens
aaaagtatttatggctatgtaa

SEQ ID NO: 7738702 - DNA, 22 bp, Homo sapiens
aaagacatggaactagagatgg

SEQ ID NO: 7738703 - DNA, 22 bp, Homo sapiens
aaaagtattggccaccatttct

SEQ ID NO: 7738704 - DNA, 22 bp, Homo sapiens
aaaagtatggtggtccttttta

SEQ ID NO: 7738705 - DNA, 22 bp, Homo sapiens
aaaagtatccacagctcaggag

SEQ ID NO: 7738706 - DNA, 22 bp, Homo sapiens
aaacaatgtagattaccattta

SEQ ID NO: 7738707 - DNA, 22 bp, Homo sapiens
aaacagcttgtaaggtgtaatt

SEQ ID NO: 7738708 - DNA, 22 bp, Homo sapiens
aaaggtatcatgtccatacagt

SEQ ID NO: 7738709 - DNA, 22 bp, Homo sapiens
aaacctttgcctggaagggagt

SEQ ID NO: 7738710 - DNA, 22 bp, Homo sapiens
aaagttcatggtgttatagaaa

SEQ ID NO: 7738711 - DNA, 22 bp, Homo sapiens
aaattacagatcaccaatgcat

SEQ ID NO: 7738712 - DNA, 22 bp, Homo sapiens
aaattacagccttgggtagctt

SEQ ID NO: 7738713 - DNA, 22 bp, Homo sapiens
aaattagaccagggctcctgga

SEQ ID NO: 7738714 - DNA, 22 bp, Homo sapiens
aaattagaagtgctcaggaata

SEQ ID NO: 7738715 - DNA, 22 bp, Homo sapiens
aaagaatgtctgaacagctggc

SEQ ID NO: 7738716 - DNA, 22 bp, Homo sapiens
aaagaatagcctttgtccaaat

SEQ ID NO: 7738717 - DNA, 21 bp, Homo sapiens
aaactgaccttgcctgagaca

SEQ ID NO: 7738718 - DNA, 22 bp, Homo sapiens
aagatgttgactcctttgatgt

SEQ ID NO: 7738719 - DNA, 22 bp, Homo sapiens
aagatgttctattttcactttt

SEQ ID NO: 7738720 - DNA, 22 bp, Homo sapiens
aagatgttattgtcttccttgc

SEQ ID NO: 7738721 - DNA, 22 bp, Homo sapiens
aagaggcctcacctcactgccc

SEQ ID NO: 7738722 - DNA, 22 bp, Homo sapiens
aagaggccttggtctgacctga

SEQ ID NO: 7738723 - DNA, 22 bp, Homo sapiens
aagcacagtgccaagttctatt

SEQ ID NO: 7738724 - DNA, 18 bp, Homo sapiens
acagacaaaatggaaatg

SEQ ID NO: 7738725 - DNA, 22 bp, Homo sapiens
aagcagcattgtaaccaatgcc

SEQ ID NO: 7738726 - DNA, 22 bp, Homo sapiens
aagcagcatgattgtaatacta

SEQ ID NO: 7738727 - DNA, 22 bp, Homo sapiens
aagcagcatgtgggttatcggg

SEQ ID NO: 7738728 - DNA, 22 bp, Homo sapiens
aagcagctgatttcacagctca

SEQ ID NO: 7738729 - DNA, 22 bp, Homo sapiens
aagcagctgaaggattcagggt

SEQ ID NO: 7738730 - DNA, 22 bp, Homo sapiens
aagcagctgatttcacagctca

SEQ ID NO: 7738731 - DNA, 22 bp, Homo sapiens
acagaggtttccattgaggttt

SEQ ID NO: 7738732 - DNA, 22 bp, Homo sapiens
acagagtaggtgctcagtaaat

SEQ ID NO: 7738733 - DNA, 17 bp, Homo sapiens
aagcatttaatttgcta

SEQ ID NO: 7738734 - DNA, 22 bp, Homo sapiens
aagcatttggcatgaaactctt

SEQ ID NO: 7738735 - DNA, 22 bp, Homo sapiens
aagcatttcaggtagagatatt

SEQ ID NO: 7738736 - DNA, 22 bp, Homo sapiens
acaaagcacgagtgccatggac

SEQ ID NO: 7738737 - DNA, 22 bp, Homo sapiens
acaaagataagtcagaaagtca

SEQ ID NO: 7738738 - DNA, 22 bp, Homo sapiens
aagacatcagtgatgacatttg

SEQ ID NO: 7738739 - DNA, 22 bp, Homo sapiens
aagagatgatggcagccagagg

SEQ ID NO: 7738740 - DNA, 22 bp, Homo sapiens
aagagatgtggaatcatttaca

SEQ ID NO: 7738741 - DNA, 22 bp, Homo sapiens
aagagatgctttacatcggatg

SEQ ID NO: 7738742 - DNA, 17 bp, Homo sapiens
aagagaggctgagctgg

SEQ ID NO: 7738743 - DNA, 22 bp, Homo sapiens
aagagagtcagtctgagcacca

SEQ ID NO: 7738744 - DNA, 22 bp, Homo sapiens
aagaggaactgggggctgagtc

SEQ ID NO: 7738745 - DNA, 22 bp, Homo sapiens
aagaggaaatgattgactatat

SEQ ID NO: 7738746 - DNA, 22 bp, Homo sapiens
aagagctggctcttgcagcagc

SEQ ID NO: 7738747 - DNA, 22 bp, Homo sapiens
aatagtgcttacattatcatga

SEQ ID NO: 7738748 - DNA, 22 bp, Homo sapiens
aatagtttgaatttatcagatg

SEQ ID NO: 7738749 - DNA, 22 bp, Homo sapiens
aacaggaattgcaggcagatct

SEQ ID NO: 7738750 - DNA, 22 bp, Homo sapiens
aactacatagaaattagtattt

SEQ ID NO: 7738751 - DNA, 22 bp, Homo sapiens
aatccaatcctactcagaaagt

SEQ ID NO: 7738752 - DNA, 22 bp, Homo sapiens
aaatgttcccaatatgaagctg

SEQ ID NO: 7738753 - DNA, 22 bp, Homo sapiens
aaatgttccattattgtgtaat

SEQ ID NO: 7738754 - DNA, 22 bp, Homo sapiens
aaatgttctaaattacatgtga

SEQ ID NO: 7738755 - DNA, 22 bp, Homo sapiens
aaatgttccgggtaaggagaaa

SEQ ID NO: 7738756 - DNA, 22 bp, Homo sapiens
aaatgtgctaaagtattaacat

SEQ ID NO: 7738757 - DNA, 22 bp, Homo sapiens
aacaaagtcgttgcctagaaga

SEQ ID NO: 7738758 - DNA, 22 bp, Homo sapiens
aacagcataccaatgtacatat

SEQ ID NO: 7738759 - DNA, 22 bp, Homo sapiens
aacagcatatttcatatattga

SEQ ID NO: 7738760 - DNA, 22 bp, Homo sapiens
aaggtcctgtagccacagagcc

SEQ ID NO: 7738761 - DNA, 22 bp, Homo sapiens
aaggtccttttgcagtgtgatc

SEQ ID NO: 7738762 - DNA, 22 bp, Homo sapiens
aaggtctgagttttgccaggcc

SEQ ID NO: 7738763 - DNA, 22 bp, Homo sapiens
aaggtctggatgatgggtgtgc

SEQ ID NO: 7738764 - DNA, 22 bp, Homo sapiens
aacagcttgaggaatatcatca

SEQ ID NO: 7738765 - DNA, 22 bp, Homo sapiens
aacaaatgataccagttctcaa

SEQ ID NO: 7738766 - DNA, 22 bp, Homo sapiens
aacaccttctccttgcaggcca

SEQ ID NO: 7738767 - DNA, 22 bp, Homo sapiens
cacctctttgatttgaggcaag

SEQ ID NO: 7738768 - DNA, 22 bp, Homo sapiens
cactgctgatttcataggcagg

SEQ ID NO: 7738769 - DNA, 22 bp, Homo sapiens
agcaggggtctctgctaatgaa

SEQ ID NO: 7738770 - DNA, 22 bp, Homo sapiens
agcagctgatggggaaggagtt

SEQ ID NO: 7738771 - DNA, 22 bp, Homo sapiens
agcagctgcagggagggtctgc

SEQ ID NO: 7738772 - DNA, 22 bp, Homo sapiens
agcagctgcagagggctccccc

SEQ ID NO: 7738773 - DNA, 17 bp, Homo sapiens
agcaggcacgtcagcac

SEQ ID NO: 7738774 - DNA, 22 bp, Homo sapiens
agcaggcacgctccctgcgcga

SEQ ID NO: 7738775 - DNA, 22 bp, Homo sapiens
agcaggcaccagggctcgtcct

SEQ ID NO: 7738776 - DNA, 21 bp, Homo sapiens
agcaggcaaaggtgaagtctt

SEQ ID NO: 7738777 - DNA, 22 bp, Homo sapiens
agcaggcaggaaggcagcactg

SEQ ID NO: 7738778 - DNA, 22 bp, Homo sapiens
agcaggcagctgggggagttga

SEQ ID NO: 7738779 - DNA, 22 bp, Homo sapiens
agcagctccctcctcagccacc

SEQ ID NO: 7738780 - DNA, 22 bp, Homo sapiens
agcagctcctctaggaacggat

SEQ ID NO: 7738781 - DNA, 22 bp, Homo sapiens
cacaaggaggtcctgaggaagc

SEQ ID NO: 7738782 - DNA, 22 bp, Homo sapiens
agcagcaggcttaaggaaaagt

SEQ ID NO: 7738783 - DNA, 22 bp, Homo sapiens
agcagcagggacaaaggaacag

SEQ ID NO: 7738784 - DNA, 22 bp, Homo sapiens
caacagctgatctttgatgaag

SEQ ID NO: 7738785 - DNA, 22 bp, Homo sapiens
caacagctcagacacgggacct

SEQ ID NO: 7738786 - DNA, 22 bp, Homo sapiens
caacagctggaggcttggcccg

SEQ ID NO: 7738787 - DNA, 23 bp, Homo sapiens
caacagctgttagatatgggctt

SEQ ID NO: 7738788 - DNA, 22 bp, Homo sapiens
caacagctttagaaacactttc

SEQ ID NO: 7738789 - DNA, 22 bp, Homo sapiens
caagacttcaccgctctgtgct

SEQ ID NO: 7738790 - DNA, 22 bp, Homo sapiens
caagacttagagcatcttgaaa

SEQ ID NO: 7738791 - DNA, 22 bp, Homo sapiens
caagacctcaaaatgagagggg

SEQ ID NO: 7738792 - DNA, 22 bp, Homo sapiens
caaatagattgttcaatcctga

SEQ ID NO: 7738793 - DNA, 20 bp, Homo sapiens
agcacattaaacatactcct

SEQ ID NO: 7738794 - DNA, 22 bp, Homo sapiens
caaatagacttcaatctcttga

SEQ ID NO: 7738795 - DNA, 22 bp, Homo sapiens
agcaaagcaccatatggcagtt

SEQ ID NO: 7738796 - DNA, 18 bp, Homo sapiens
agcaaagcaagagatcac

SEQ ID NO: 7738797 - DNA, 20 bp, Homo sapiens
agcaaagcctttagagtttg

SEQ ID NO: 7738798 - DNA, 22 bp, Homo sapiens
agcaaagccgagacagccagtg

SEQ ID NO: 7738799 - DNA, 21 bp, Homo sapiens
agcacagctttaagccatgtg

SEQ ID NO: 7738800 - DNA, 22 bp, Homo sapiens
caaaataccacgacttgtttta

SEQ ID NO: 7738801 - DNA, 22 bp, Homo sapiens
agcaaagacagggacgaccaag

SEQ ID NO: 7738802 - DNA, 22 bp, Homo sapiens
cagaggtattttgataaacgcc

SEQ ID NO: 7738803 - DNA, 22 bp, Homo sapiens
cagaggtattgcaaaagcctag

SEQ ID NO: 7738804 - DNA, 22 bp, Homo sapiens
cagagggatcatcttcctgaag

SEQ ID NO: 7738805 - DNA, 22 bp, Homo sapiens
agcctctgtagaaagcagtgtg

SEQ ID NO: 7738806 - DNA, 22 bp, Homo sapiens
agcctctgcacgggcacgggtg

SEQ ID NO: 7738807 - DNA, 22 bp, Homo sapiens
agcctctgcttatgcaaaggta

SEQ ID NO: 7738808 - DNA, 22 bp, Homo sapiens
cagcagctgaggcgctggcgtg

SEQ ID NO: 7738809 - DNA, 22 bp, Homo sapiens
cagcagctcactcaggtggctc

SEQ ID NO: 7738810 - DNA, 22 bp, Homo sapiens
cagcagctcactgaataatgac

SEQ ID NO: 7738811 - DNA, 22 bp, Homo sapiens
cagcagcattgctctggattcc

SEQ ID NO: 7738812 - DNA, 22 bp, Homo sapiens
agcctgagagccaagctgtgca

SEQ ID NO: 7738813 - DNA, 22 bp, Homo sapiens
cagcagctccaaagaatagcca

SEQ ID NO: 7738814 - DNA, 22 bp, Homo sapiens
cagcagctcccatccgctgagc

SEQ ID NO: 7738815 - DNA, 22 bp, Homo sapiens
cagcagctgactccaagagagc

SEQ ID NO: 7738816 - DNA, 22 bp, Homo sapiens
cagcagctcctctgcggctatg

SEQ ID NO: 7738817 - DNA, 22 bp, Homo sapiens
cagcagctcaggctccttccca

SEQ ID NO: 7738818 - DNA, 22 bp, Homo sapiens
cagcagctcaggctgcttccca

SEQ ID NO: 7738819 - DNA, 22 bp, Homo sapiens
cagcagctcagtctctcagtag

SEQ ID NO: 7738820 - DNA, 22 bp, Homo sapiens
cagctcaggctctccatgctcc

SEQ ID NO: 7738821 - DNA, 22 bp, Homo sapiens
agctcagagataatcaagagac

SEQ ID NO: 7738822 - DNA, 22 bp, Homo sapiens
cagctctgacacagtacaaaat

SEQ ID NO: 7738823 - DNA, 22 bp, Homo sapiens
agctcctgatacatgcaggaat

SEQ ID NO: 7738824 - DNA, 22 bp, Homo sapiens
cagccctgcacgctgcctccgc

SEQ ID NO: 7738825 - DNA, 22 bp, Homo sapiens
cagccctgcagagggcgctcct

SEQ ID NO: 7738826 - DNA, 22 bp, Homo sapiens
cagccctgagcaaggcttttaa

SEQ ID NO: 7738827 - DNA, 16 bp, Homo sapiens
cagccctgaggaagaa

SEQ ID NO: 7738828 - DNA, 23 bp, Homo sapiens
cagccctgaaatcgaggtgacac

SEQ ID NO: 7738829 - DNA, 22 bp, Homo sapiens
cagcatcaacattctcagctct

SEQ ID NO: 7738830 - DNA, 22 bp, Homo sapiens
cagagaaaaaatcctgctctca

SEQ ID NO: 7738831 - DNA, 22 bp, Homo sapiens
cagagggaccagaacatactgt

SEQ ID NO: 7738832 - DNA, 22 bp, Homo sapiens
agccacccattcccgagcccta

SEQ ID NO: 7738833 - DNA, 22 bp, Homo sapiens
agaccatgggctcctgggacat

SEQ ID NO: 7738834 - DNA, 22 bp, Homo sapiens
agagaagagcaatgataaattt

SEQ ID NO: 7738835 - DNA, 21 bp, Homo sapiens
agagaagaggactttctcaca

SEQ ID NO: 7738836 - DNA, 21 bp, Homo sapiens
agagaagaggactttctcaca

SEQ ID NO: 7738837 - DNA, 22 bp, Homo sapiens
atggcctctagctgagaccaat

SEQ ID NO: 7738838 - DNA, 22 bp, Homo sapiens
agagagttgtaccacactcata

SEQ ID NO: 7738839 - DNA, 22 bp, Homo sapiens
agagagttgaggaagcaacact

SEQ ID NO: 7738840 - DNA, 22 bp, Homo sapiens
agagaagagtcttgtcaaatta

SEQ ID NO: 7738841 - DNA, 22 bp, Homo sapiens
agagaagattcttatatgtctt

SEQ ID NO: 7738842 - DNA, 22 bp, Homo sapiens
agagaaggaaagctgacatggg

SEQ ID NO: 7738843 - DNA, 19 bp, Homo sapiens
agagaccacagagctgcct

SEQ ID NO: 7738844 - DNA, 22 bp, Homo sapiens
agagatggagagcactggggct

SEQ ID NO: 7738845 - DNA, 22 bp, Homo sapiens
atggggggatgaaggagtccaa

SEQ ID NO: 7738846 - DNA, 22 bp, Homo sapiens
atgggggcggctgaagcccagg

SEQ ID NO: 7738847 - DNA, 22 bp, Homo sapiens
agagatggccttaggtgggaat

SEQ ID NO: 7738848 - DNA, 22 bp, Homo sapiens
atgggggcctgaacaggcaaaa

SEQ ID NO: 7738849 - DNA, 22 bp, Homo sapiens
atgtcaaacacaacaccagtgg

SEQ ID NO: 7738850 - DNA, 22 bp, Homo sapiens
atgtgggccgtgcgggtgtcct

SEQ ID NO: 7738851 - DNA, 22 bp, Homo sapiens
atgaaattgatcttgaactttt

SEQ ID NO: 7738852 - DNA, 23 bp, Homo sapiens
atgaaagttcttaaaatgtcatg

SEQ ID NO: 7738853 - DNA, 22 bp, Homo sapiens
atgaaattttaattatacctct

SEQ ID NO: 7738854 - DNA, 22 bp, Homo sapiens
agaagtatttggctaaaagaca

SEQ ID NO: 7738855 - DNA, 22 bp, Homo sapiens
agaaggctggccctgggtggcc

SEQ ID NO: 7738856 - DNA, 22 bp, Homo sapiens
agaagtattctgcatgtactga

SEQ ID NO: 7738857 - DNA, 22 bp, Homo sapiens
agaagttaccacatacttctct

SEQ ID NO: 7738858 - DNA, 19 bp, Homo sapiens
agaagttagacattgcaat

SEQ ID NO: 7738859 - DNA, 22 bp, Homo sapiens
agaagttaattcctgaaattct

SEQ ID NO: 7738860 - DNA, 20 bp, Homo sapiens
agaagtggctgcagacacta

SEQ ID NO: 7738861 - DNA, 22 bp, Homo sapiens
agaagtttgaaattaggagaaa

SEQ ID NO: 7738862 - DNA, 22 bp, Homo sapiens
agaagtttggtcctataaactc

SEQ ID NO: 7738863 - DNA, 22 bp, Homo sapiens
agacagctgcctccaccacagc

SEQ ID NO: 7738864 - DNA, 21 bp, Homo sapiens
agacagcagatagtcgaaagg

SEQ ID NO: 7738865 - DNA, 21 bp, Homo sapiens
agacagctttaaagacacagg

SEQ ID NO: 7738866 - DNA, 22 bp, Homo sapiens
agacagaccatggctattcaga

SEQ ID NO: 7738867 - DNA, 22 bp, Homo sapiens
agaggcctgtgtgctccagtgg

SEQ ID NO: 7738868 - DNA, 22 bp, Homo sapiens
agaggctcagaggcctggtcct

SEQ ID NO: 7738869 - DNA, 22 bp, Homo sapiens
agaggcaggaagagctgatttt

SEQ ID NO: 7738870 - DNA, 17 bp, Homo sapiens
agaggcagatacttgga

SEQ ID NO: 7738871 - DNA, 22 bp, Homo sapiens
attccagttagtggcagcttat

SEQ ID NO: 7738872 - DNA, 17 bp, Homo sapiens
agagggaaaatgcggtt

SEQ ID NO: 7738873 - DNA, 22 bp, Homo sapiens
agaggagctgggaggccctcgt

SEQ ID NO: 7738874 - DNA, 22 bp, Homo sapiens
agaggagcttttggaaaaggcc

SEQ ID NO: 7738875 - DNA, 22 bp, Homo sapiens
agaggaggctctgggatcgtcc

SEQ ID NO: 7738876 - DNA, 22 bp, Homo sapiens
agagctgttcagcagccaggtt

SEQ ID NO: 7738877 - DNA, 22 bp, Homo sapiens
agagctggtttactcaggaatt

SEQ ID NO: 7738878 - DNA, 22 bp, Homo sapiens
agagctgtgctttgcaccacgt

SEQ ID NO: 7738879 - DNA, 21 bp, Homo sapiens
agagctgggacttgcctgaga

SEQ ID NO: 7738880 - DNA, 22 bp, Homo sapiens
agaggtattaggtaattcagta

SEQ ID NO: 7738881 - DNA, 22 bp, Homo sapiens
agaggtattagatttgcatagg

SEQ ID NO: 7738882 - DNA, 22 bp, Homo sapiens
agagttctgtctgccacacgaa

SEQ ID NO: 7738883 - DNA, 22 bp, Homo sapiens
agagttctgctcttctcagtga

SEQ ID NO: 7738884 - DNA, 22 bp, Homo sapiens
agagtttacagaaataagctgt

SEQ ID NO: 7738885 - DNA, 22 bp, Homo sapiens
agagtttcttgtgagcactgac

SEQ ID NO: 7738886 - DNA, 22 bp, Homo sapiens
agagttggccaaaaggggcatt

SEQ ID NO: 7738887 - DNA, 22 bp, Homo sapiens
atttcacatctatctcagattt

SEQ ID NO: 7738888 - DNA, 22 bp, Homo sapiens
atttcacagctgtcagtgttac

SEQ ID NO: 7738889 - DNA, 22 bp, Homo sapiens
atttcacagcgtggttgactgc

SEQ ID NO: 7738890 - DNA, 22 bp, Homo sapiens
atttcacaaagaacagatgcag

SEQ ID NO: 7738891 - DNA, 22 bp, Homo sapiens
atttcacaaagaacagatgcag

SEQ ID NO: 7738892 - DNA, 22 bp, Homo sapiens
agataaaatggttcaaaggcta

SEQ ID NO: 7738893 - DNA, 22 bp, Homo sapiens
agagtttgtatttttcagtgaa

SEQ ID NO: 7738894 - DNA, 22 bp, Homo sapiens
agagtttggtgaagcaatttga

SEQ ID NO: 7738895 - DNA, 22 bp, Homo sapiens
agataaaatgattttctggatc

SEQ ID NO: 7738896 - DNA, 22 bp, Homo sapiens
atttccagcagcatatttgtct

SEQ ID NO: 7738897 - DNA, 22 bp, Homo sapiens
agatacattgttctaagcattg

SEQ ID NO: 7738898 - DNA, 22 bp, Homo sapiens
atttgtttatcgtcgattgtag

SEQ ID NO: 7738899 - DNA, 20 bp, Homo sapiens
atttgtttctactctctgac

SEQ ID NO: 7738900 - DNA, 22 bp, Homo sapiens
atttgtttcagggccttggtat

SEQ ID NO: 7738901 - DNA, 22 bp, Homo sapiens
caaaagtaattgcggtttttgc

SEQ ID NO: 7738902 - DNA, 22 bp, Homo sapiens
caaaagtaattgcagtttttgc

SEQ ID NO: 7738903 - DNA, 22 bp, Homo sapiens
caaaagtaccttgtgtgctttg

SEQ ID NO: 7738904 - DNA, 22 bp, Homo sapiens
caaaagtaattgtggtttttgc

SEQ ID NO: 7738905 - DNA, 22 bp, Homo sapiens
caaaagtaattatggtttttgc

SEQ ID NO: 7738906 - DNA, 22 bp, Homo sapiens
caaaagtaatggcggtttttac

SEQ ID NO: 7738907 - DNA, 22 bp, Homo sapiens
aggtctctgagtactgctggac

SEQ ID NO: 7738908 - DNA, 22 bp, Homo sapiens
aggtcctgtcttatctctgtaa

SEQ ID NO: 7738909 - DNA, 22 bp, Homo sapiens
aggtcctgtcttatctctgtaa

SEQ ID NO: 7738910 - DNA, 22 bp, Homo sapiens
aggtcctgtctatcaccctcgc

SEQ ID NO: 7738911 - DNA, 22 bp, Homo sapiens
aggtcctgtggtttgggtaaaa

SEQ ID NO: 7738912 - DNA, 20 bp, Homo sapiens
aggtcctgttccttgtctcc

SEQ ID NO: 7738913 - DNA, 22 bp, Homo sapiens
aggtcctgtgtccaggggcctg

SEQ ID NO: 7738914 - DNA, 22 bp, Homo sapiens
aggtcctgtttcttccctgggg

SEQ ID NO: 7738915 - DNA, 22 bp, Homo sapiens
acctcttaatattgcaccttct

SEQ ID NO: 7738916 - DNA, 22 bp, Homo sapiens
acctgaggcctccccagcagac

SEQ ID NO: 7738917 - DNA, 22 bp, Homo sapiens
acctgaggctgttagtctaggt

SEQ ID NO: 7738918 - DNA, 22 bp, Homo sapiens
acctgagggagattaggcctga

SEQ ID NO: 7738919 - DNA, 22 bp, Homo sapiens
acctgagggcccaaacttggta

SEQ ID NO: 7738920 - DNA, 20 bp, Homo sapiens
acctgaggtccctatggtct

SEQ ID NO: 7738921 - DNA, 22 bp, Homo sapiens
acctgaggactggatggtagaa

SEQ ID NO: 7738922 - DNA, 22 bp, Homo sapiens
acctgaggaagggcgagaagct

SEQ ID NO: 7738923 - DNA, 22 bp, Homo sapiens
acctgagcctagggaggttgag

SEQ ID NO: 7738924 - DNA, 21 bp, Homo sapiens
acctgagctccacctcctgcc

SEQ ID NO: 7738925 - DNA, 22 bp, Homo sapiens
acctgagcatgccaggagagtg

SEQ ID NO: 7738926 - DNA, 22 bp, Homo sapiens
actaggaagtggcaaaactgga

SEQ ID NO: 7738927 - DNA, 22 bp, Homo sapiens
actaggaaggcatatgggcaga

SEQ ID NO: 7738928 - DNA, 22 bp, Homo sapiens
actaggaattcaagtagacaga

SEQ ID NO: 7738929 - DNA, 22 bp, Homo sapiens
actaggaacggggtttgcactc

SEQ ID NO: 7738930 - DNA, 22 bp, Homo sapiens
agtatttgtggatttgtattgg

SEQ ID NO: 7738931 - DNA, 22 bp, Homo sapiens
acgcctgtaatcccagcacttt

SEQ ID NO: 7738932 - DNA, 22 bp, Homo sapiens
acggcttcttgactgtgggttg

SEQ ID NO: 7738933 - DNA, 22 bp, Homo sapiens
aggttcttggtgtccagatttc

SEQ ID NO: 7738934 - DNA, 22 bp, Homo sapiens
aggttcttttggccaacctcat

SEQ ID NO: 7738935 - DNA, 22 bp, Homo sapiens
agtgtacatcagaacatatcaa

SEQ ID NO: 7738936 - DNA, 20 bp, Homo sapiens
agtgtacagacactagaaat

SEQ ID NO: 7738937 - DNA, 22 bp, Homo sapiens
actgcacttcagcctgggtgtc

SEQ ID NO: 7738938 - DNA, 22 bp, Homo sapiens
actgcacttcagcctgggtgtc

SEQ ID NO: 7738939 - DNA, 22 bp, Homo sapiens
agtggcagtggctgggcagagc

SEQ ID NO: 7738940 - DNA, 22 bp, Homo sapiens
actgcacttcagcctgggtgac

SEQ ID NO: 7738941 - DNA, 22 bp, Homo sapiens
actgcacttcagcctgggtgac

SEQ ID NO: 7738942 - DNA, 22 bp, Homo sapiens
actcctgtgggcatggcacccc

SEQ ID NO: 7738943 - DNA, 22 bp, Homo sapiens
agtctgtctaatattattcagg

SEQ ID NO: 7738944 - DNA, 23 bp, Homo sapiens
actcgtggaattctctgcgatcg

SEQ ID NO: 7738945 - DNA, 22 bp, Homo sapiens
agtgcatgcgcttgggaggggt

SEQ ID NO: 7738946 - DNA, 20 bp, Homo sapiens
agtgcatggagggagagggc

SEQ ID NO: 7738947 - DNA, 22 bp, Homo sapiens
agtgcacaccttagtacaaagt

SEQ ID NO: 7738948 - DNA, 22 bp, Homo sapiens
atatttataagcaagcaggact

SEQ ID NO: 7738949 - DNA, 22 bp, Homo sapiens
actttcctagacttcagtgaca

SEQ ID NO: 7738950 - DNA, 22 bp, Homo sapiens
actttctattcccacagagata

SEQ ID NO: 7738951 - DNA, 22 bp, Homo sapiens
atatggaagttacctgacttca

SEQ ID NO: 7738952 - DNA, 18 bp, Homo sapiens
atatggaatgcctggcta

SEQ ID NO: 7738953 - DNA, 22 bp, Homo sapiens
atatggaaatagcaatatggtt

SEQ ID NO: 7738954 - DNA, 22 bp, Homo sapiens
atatggaactattctgtgtaga

SEQ ID NO: 7738955 - DNA, 18 bp, Homo sapiens
atcctgggagcagacagc

SEQ ID NO: 7738956 - DNA, 22 bp, Homo sapiens
atctaaagtgtttcatgaaaga

SEQ ID NO: 7738957 - DNA, 22 bp, Homo sapiens
atctaaagtgtcataagtagct

SEQ ID NO: 7738958 - DNA, 23 bp, Homo sapiens
atctaaagtgttaaatagctggg

SEQ ID NO: 7738959 - DNA, 22 bp, Homo sapiens
atctaattttcactcatttgct

SEQ ID NO: 7738960 - DNA, 23 bp, Homo sapiens
agaaagtttgtgccttgtgacac

SEQ ID NO: 7738961 - DNA, 22 bp, Homo sapiens
agaaagggtcactgaaagagga

SEQ ID NO: 7738962 - DNA, 22 bp, Homo sapiens
agaaagggttctctgaggtgct

SEQ ID NO: 7738963 - DNA, 22 bp, Homo sapiens
atacagggacatccagtttttc

SEQ ID NO: 7738964 - DNA, 22 bp, Homo sapiens
atacagcagtgaataagataaa

SEQ ID NO: 7738965 - DNA, 22 bp, Homo sapiens
ataaaatttgctactgttaaat

SEQ ID NO: 7738966 - DNA, 22 bp, Homo sapiens
ataatcttgtatttcctaaagt

SEQ ID NO: 7738967 - DNA, 22 bp, Homo sapiens
accctcatgaagctggcctgga

SEQ ID NO: 7738968 - DNA, 22 bp, Homo sapiens
agggggctcctccggtgcttcc

SEQ ID NO: 7738969 - DNA, 22 bp, Homo sapiens
agggggctcagtgactgaagtg

SEQ ID NO: 7738970 - DNA, 22 bp, Homo sapiens
agggggctcagcaggctctgga

SEQ ID NO: 7738971 - DNA, 22 bp, Homo sapiens
agggggctcagcatggatggag

SEQ ID NO: 7738972 - DNA, 22 bp, Homo sapiens
agggggagtttcagttagaaag

SEQ ID NO: 7738973 - DNA, 22 bp, Homo sapiens
agggcagcacaaggcatggact

SEQ ID NO: 7738974 - DNA, 21 bp, Homo sapiens
agggcagattagctgtaagag

SEQ ID NO: 7738975 - DNA, 18 bp, Homo sapiens
agggagagaccgcgggtc

SEQ ID NO: 7738976 - DNA, 22 bp, Homo sapiens
agggagagaagttatacaagat

SEQ ID NO: 7738977 - DNA, 22 bp, Homo sapiens
acatgtttaagtttaatgaaaa

SEQ ID NO: 7738978 - DNA, 22 bp, Homo sapiens
aggccaggcctttctccattcc

SEQ ID NO: 7738979 - DNA, 22 bp, Homo sapiens
acatttctttctattcagtagc

SEQ ID NO: 7738980 - DNA, 22 bp, Homo sapiens
aggcctgaggaccttctggagg

SEQ ID NO: 7738981 - DNA, 22 bp, Homo sapiens
acatttctaatttaatgtaaca

SEQ ID NO: 7738982 - DNA, 22 bp, Homo sapiens
acagctgggtgtcccacttctg

SEQ ID NO: 7738983 - DNA, 22 bp, Homo sapiens
acagctggtgaatgttctctgt

SEQ ID NO: 7738984 - DNA, 22 bp, Homo sapiens
agctgaagggaggatatgtaca

SEQ ID NO: 7738985 - DNA, 22 bp, Homo sapiens
agctggtgtcctcctggagctg

SEQ ID NO: 7738986 - DNA, 22 bp, Homo sapiens
acaggagaaatctggtcaaaag

SEQ ID NO: 7738987 - DNA, 22 bp, Homo sapiens
aggaagaatgtttacatatcaa

SEQ ID NO: 7738988 - DNA, 21 bp, Homo sapiens
aggaagaaaggttggaggttg

SEQ ID NO: 7738989 - DNA, 19 bp, Homo sapiens
acaggggcctttccagggt

SEQ ID NO: 7738990 - DNA, 19 bp, Homo sapiens
acaggggctagcggaagca

SEQ ID NO: 7738991 - DNA, 22 bp, Homo sapiens
acagggagatgggtgaaagcgg

SEQ ID NO: 7738992 - DNA, 22 bp, Homo sapiens
aggagcagaccgtagtcctgca

SEQ ID NO: 7738993 - DNA, 20 bp, Homo sapiens
acaggttcattctgtgtgac

SEQ ID NO: 7738994 - DNA, 22 bp, Homo sapiens
acagtctgcctctcagagcagc

SEQ ID NO: 7738995 - DNA, 22 bp, Homo sapiens
acagtcaatcagaacagcatgt

SEQ ID NO: 7738996 - DNA, 22 bp, Homo sapiens
acagtttgaataatttagatag

SEQ ID NO: 7738997 - DNA, 22 bp, Homo sapiens
acagtttgcactgttcatcaaa

SEQ ID NO: 7738998 - DNA, 22 bp, Homo sapiens
aggatgagattgctgtgttgta

SEQ ID NO: 7738999 - DNA, 22 bp, Homo sapiens
aggatgagagatacatggagca

SEQ ID NO: 7739000 - DNA, 22 bp, Homo sapiens
aggatgaggctggcaggtcttg

SEQ ID NO: 7739001 - DNA, 22 bp, Homo sapiens
aggcagctgaccacagtatgat

SEQ ID NO: 7739002 - DNA, 22 bp, Homo sapiens
aggcagctgaggtctggcgccc

SEQ ID NO: 7739003 - DNA, 22 bp, Homo sapiens
acatattgagctctaaaagtac

SEQ ID NO: 7739004 - DNA, 22 bp, Homo sapiens
acatagaaggaagagtagtagg

SEQ ID NO: 7739005 - DNA, 17 bp, Homo sapiens
aggcagctcagaacatc

SEQ ID NO: 7739006 - DNA, 22 bp, Homo sapiens
cccagggcttttctcactagac

SEQ ID NO: 7739007 - DNA, 22 bp, Homo sapiens
cccagggccctggacagctaca

SEQ ID NO: 7739008 - DNA, 22 bp, Homo sapiens
cccaggatggggctgcagttat

SEQ ID NO: 7739009 - DNA, 22 bp, Homo sapiens
agggaaatctttcaacacttca

SEQ ID NO: 7739010 - DNA, 22 bp, Homo sapiens
agggaacagtgaaaggcatcag

SEQ ID NO: 7739011 - DNA, 18 bp, Homo sapiens
aggcttcttggctcagtc

SEQ ID NO: 7739012 - DNA, 22 bp, Homo sapiens
aggcttcttgagccccacaggc

SEQ ID NO: 7739013 - DNA, 22 bp, Homo sapiens
aggcttctagggttggcagcgg

SEQ ID NO: 7739014 - DNA, 22 bp, Homo sapiens
aggcttctacgtggtcccaggg

SEQ ID NO: 7739015 - DNA, 19 bp, Homo sapiens
aggcttctaccctgtccag

SEQ ID NO: 7739016 - DNA, 22 bp, Homo sapiens
aggcttctgataccatgagaga

SEQ ID NO: 7739017 - DNA, 22 bp, Homo sapiens
aggcttctggggcaccgagcga

SEQ ID NO: 7739018 - DNA, 22 bp, Homo sapiens
ccctctgctcaggtgcataggc

SEQ ID NO: 7739019 - DNA, 22 bp, Homo sapiens
ccctctgcctgcgccctggtgt

SEQ ID NO: 7739020 - DNA, 22 bp, Homo sapiens
ccctctctcggttgctgtggtt

SEQ ID NO: 7739021 - DNA, 22 bp, Homo sapiens
ccctctctgctgcatagaggaa

SEQ ID NO: 7739022 - DNA, 20 bp, Homo sapiens
ccctctgcacatggctgtgg

SEQ ID NO: 7739023 - DNA, 22 bp, Homo sapiens
agggagtggttaagaaggtgca

SEQ ID NO: 7739024 - DNA, 22 bp, Homo sapiens
agggagaagagaacaaagccct

SEQ ID NO: 7739025 - DNA, 22 bp, Homo sapiens
agggagaagagaacaaagccct

SEQ ID NO: 7739026 - DNA, 22 bp, Homo sapiens
agggagaacagttgcagcagac

SEQ ID NO: 7739027 - DNA, 22 bp, Homo sapiens
agggagaaaattggatgcacaa

SEQ ID NO: 7739028 - DNA, 22 bp, Homo sapiens
agggatcacggtggacttggat

SEQ ID NO: 7739029 - DNA, 22 bp, Homo sapiens
agggatgactcttggctgattc

SEQ ID NO: 7739030 - DNA, 22 bp, Homo sapiens
agggatcagcagagggtgtggt

SEQ ID NO: 7739031 - DNA, 22 bp, Homo sapiens
agggatgatggaaagaagcagg

SEQ ID NO: 7739032 - DNA, 22 bp, Homo sapiens
cctgaggcaaggacttggtggc

SEQ ID NO: 7739033 - DNA, 22 bp, Homo sapiens
cctgaggcaaggacttggtggc

SEQ ID NO: 7739034 - DNA, 22 bp, Homo sapiens
aggggctgggacagagccaagc

SEQ ID NO: 7739035 - DNA, 21 bp, Homo sapiens
aggggacagagtagctccagg

SEQ ID NO: 7739036 - DNA, 22 bp, Homo sapiens
aggggagagaacataaggaagt

SEQ ID NO: 7739037 - DNA, 22 bp, Homo sapiens
aggggagaaaaatgccttctgt

SEQ ID NO: 7739038 - DNA, 22 bp, Homo sapiens
aggggagaatttcaactcaggt

SEQ ID NO: 7739039 - DNA, 22 bp, Homo sapiens
cctgagctttaaaagccatgta

SEQ ID NO: 7739040 - DNA, 22 bp, Homo sapiens
cctgaggacacacgctgcagga

SEQ ID NO: 7739041 - DNA, 22 bp, Homo sapiens
cctgaggacagtgtgaccatgg

SEQ ID NO: 7739042 - DNA, 22 bp, Homo sapiens
cctctgggagactgctactgag

SEQ ID NO: 7739043 - DNA, 16 bp, Homo sapiens
cctctgggatgtttgc

SEQ ID NO: 7739044 - DNA, 22 bp, Homo sapiens
cctctgggcaggtagcagcagc

SEQ ID NO: 7739045 - DNA, 22 bp, Homo sapiens
cctctgggccagcctggaccct

SEQ ID NO: 7739046 - DNA, 22 bp, Homo sapiens
cctctgggcctggaagggcagt

SEQ ID NO: 7739047 - DNA, 22 bp, Homo sapiens
cctctgggcggagatctgctgc

SEQ ID NO: 7739048 - DNA, 16 bp, Homo sapiens
cctctgggcctgcaag

SEQ ID NO: 7739049 - DNA, 21 bp, Homo sapiens
cctctggcttgtgctgtgccc

SEQ ID NO: 7739050 - DNA, 21 bp, Homo sapiens
cctctggcttgtgctgtgccc

SEQ ID NO: 7739051 - DNA, 22 bp, Homo sapiens
cctctggcttactgttgggttt

SEQ ID NO: 7739052 - DNA, 22 bp, Homo sapiens
cctctgggaagccagtcctgct

SEQ ID NO: 7739053 - DNA, 22 bp, Homo sapiens
cctctggcttactgttgggttt

SEQ ID NO: 7739054 - DNA, 22 bp, Homo sapiens
agggctcctatgatgctctgcc

SEQ ID NO: 7739055 - DNA, 22 bp, Homo sapiens
cctcctctgtgcagctgtgggt

SEQ ID NO: 7739056 - DNA, 22 bp, Homo sapiens
aggctccaccctacagagctcc

SEQ ID NO: 7739057 - DNA, 22 bp, Homo sapiens
aggctccaccagtcaggtgcat

SEQ ID NO: 7739058 - DNA, 22 bp, Homo sapiens
aggctccaccagtcaggtgcat

SEQ ID NO: 7739059 - DNA, 23 bp, Homo sapiens
aggctccacatgggcactttgca

SEQ ID NO: 7739060 - DNA, 22 bp, Homo sapiens
aggctccaccccgccagacctt

SEQ ID NO: 7739061 - DNA, 22 bp, Homo sapiens
aggctccaaattaccaagctct

SEQ ID NO: 7739062 - DNA, 22 bp, Homo sapiens
aggctcagttctgtggtgagcc

SEQ ID NO: 7739063 - DNA, 22 bp, Homo sapiens
aggctccgtccagtctcaggcc

SEQ ID NO: 7739064 - DNA, 22 bp, Homo sapiens
cccagagatgtcctgagtgata

SEQ ID NO: 7739065 - DNA, 22 bp, Homo sapiens
aggctctgtgatccacaatgag

SEQ ID NO: 7739066 - DNA, 22 bp, Homo sapiens
ccagccctgccagagagagctg

SEQ ID NO: 7739067 - DNA, 19 bp, Homo sapiens
ccagctggcctgggacctc

SEQ ID NO: 7739068 - DNA, 21 bp, Homo sapiens
aggcccagagtcttgggggga

SEQ ID NO: 7739069 - DNA, 22 bp, Homo sapiens
aggcccagcccgtcctcgtgct

SEQ ID NO: 7739070 - DNA, 19 bp, Homo sapiens
aggcccagcgctgggggct

SEQ ID NO: 7739071 - DNA, 22 bp, Homo sapiens
aggccagagaggggaccagcct

SEQ ID NO: 7739072 - DNA, 22 bp, Homo sapiens
aggcaggggagctggaagggta

SEQ ID NO: 7739073 - DNA, 22 bp, Homo sapiens
aggcaggggagctggaagggta

SEQ ID NO: 7739074 - DNA, 22 bp, Homo sapiens
caggccagaggctgttgttgcg

SEQ ID NO: 7739075 - DNA, 22 bp, Homo sapiens
agctgctgcaagtggtgctaac

SEQ ID NO: 7739076 - DNA, 19 bp, Homo sapiens
agctgctggcccagggacc

SEQ ID NO: 7739077 - DNA, 22 bp, Homo sapiens
caggaggagggtacaccatcag

SEQ ID NO: 7739078 - DNA, 22 bp, Homo sapiens
caggaggacatactggctcaca

SEQ ID NO: 7739079 - DNA, 22 bp, Homo sapiens
caggaggagcattagcgtctca

SEQ ID NO: 7739080 - DNA, 22 bp, Homo sapiens
caggaaggcccacctgtcctgt

SEQ ID NO: 7739081 - DNA, 22 bp, Homo sapiens
caggaaggcccacctgtcctgt

SEQ ID NO: 7739082 - DNA, 22 bp, Homo sapiens
caggaaggcgcggctgtgcctg

SEQ ID NO: 7739083 - DNA, 22 bp, Homo sapiens
caggaaggcgcggctgtgcctg

SEQ ID NO: 7739084 - DNA, 22 bp, Homo sapiens
caggaaggggctcactctggcc

SEQ ID NO: 7739085 - DNA, 22 bp, Homo sapiens
agctgccacagagcctggccag

SEQ ID NO: 7739086 - DNA, 22 bp, Homo sapiens
cagctctggttcctgggcccag

SEQ ID NO: 7739087 - DNA, 22 bp, Homo sapiens
cagctctggtccagggagggca

SEQ ID NO: 7739088 - DNA, 22 bp, Homo sapiens
cagctctgggtgacaggagggc

SEQ ID NO: 7739089 - DNA, 22 bp, Homo sapiens
cagctctgggtaggaggaatct

SEQ ID NO: 7739090 - DNA, 22 bp, Homo sapiens
cagctctggggcagagtgacta

SEQ ID NO: 7739091 - DNA, 20 bp, Homo sapiens
cagctctgggcaggtcgagg

SEQ ID NO: 7739092 - DNA, 22 bp, Homo sapiens
caggctccactgtaggcagctc

SEQ ID NO: 7739093 - DNA, 18 bp, Homo sapiens
agctggggcctctggtcc

SEQ ID NO: 7739094 - DNA, 22 bp, Homo sapiens
caggctcactgtaaggtcagct

SEQ ID NO: 7739095 - DNA, 22 bp, Homo sapiens
caggcctggttgagccctgaga

SEQ ID NO: 7739096 - DNA, 22 bp, Homo sapiens
agctgtggagtagggggttgga

SEQ ID NO: 7739097 - DNA, 22 bp, Homo sapiens
agctgtggaagactgtcagggt

SEQ ID NO: 7739098 - DNA, 19 bp, Homo sapiens
agctgtggatgtgggattt

SEQ ID NO: 7739099 - DNA, 22 bp, Homo sapiens
caggctgagctctggcctgggc

SEQ ID NO: 7739100 - DNA, 22 bp, Homo sapiens
cagggatgggatggagtcagtt

SEQ ID NO: 7739101 - DNA, 22 bp, Homo sapiens
cagggatgggatggagtcagtt

SEQ ID NO: 7739102 - DNA, 22 bp, Homo sapiens
cagggagctggctggctgtgcc

SEQ ID NO: 7739103 - DNA, 22 bp, Homo sapiens
caggctggagtgcagtggtgcc

SEQ ID NO: 7739104 - DNA, 22 bp, Homo sapiens
caggctggagtgcagttgtgca

SEQ ID NO: 7739105 - DNA, 22 bp, Homo sapiens
caggtcctttagtgtccagaac

SEQ ID NO: 7739106 - DNA, 22 bp, Homo sapiens
caggtgagctctatctagggag

SEQ ID NO: 7739107 - DNA, 20 bp, Homo sapiens
caggtgagcagatctgggtg

SEQ ID NO: 7739108 - DNA, 22 bp, Homo sapiens
cagggcttgcaggagaaagttt

SEQ ID NO: 7739109 - DNA, 22 bp, Homo sapiens
cagggcctcgaagcctctgggc

SEQ ID NO: 7739110 - DNA, 22 bp, Homo sapiens
cagggatgtctctggaagggag

SEQ ID NO: 7739111 - DNA, 22 bp, Homo sapiens
cagtggcctgagccaggcttcc

SEQ ID NO: 7739112 - DNA, 17 bp, Homo sapiens
cagtggcctatggcttt

SEQ ID NO: 7739113 - DNA, 22 bp, Homo sapiens
aggagaaggaagtgcatcacta

SEQ ID NO: 7739114 - DNA, 19 bp, Homo sapiens
aggagaagtagcagaaatt

SEQ ID NO: 7739115 - DNA, 22 bp, Homo sapiens
aggacatgtgcctccagggcag

SEQ ID NO: 7739116 - DNA, 22 bp, Homo sapiens
aggagggagcttaagccaggca

SEQ ID NO: 7739117 - DNA, 17 bp, Homo sapiens
cagtggtctgaggtatg

SEQ ID NO: 7739118 - DNA, 22 bp, Homo sapiens
cagttctgagctttcccagaag

SEQ ID NO: 7739119 - DNA, 22 bp, Homo sapiens
cagttctggaggctccacatct

SEQ ID NO: 7739120 - DNA, 22 bp, Homo sapiens
cagtggcctttcctgctgctca

SEQ ID NO: 7739121 - DNA, 23 bp, Homo sapiens
cagtggtcagaacgtgggagggt

SEQ ID NO: 7739122 - DNA, 22 bp, Homo sapiens
cagtggtccctgaggttgctgg

SEQ ID NO: 7739123 - DNA, 22 bp, Homo sapiens
catggcagaaacctgagctgct

SEQ ID NO: 7739124 - DNA, 22 bp, Homo sapiens
aggagggatagaaaaatacttg

SEQ ID NO: 7739125 - DNA, 22 bp, Homo sapiens
aggagggatagaaaaatacttg

SEQ ID NO: 7739126 - DNA, 20 bp, Homo sapiens
aggaggggatagaatcaaag

SEQ ID NO: 7739127 - DNA, 16 bp, Homo sapiens
aggaggggaattagga

SEQ ID NO: 7739128 - DNA, 22 bp, Homo sapiens
catgtcagggaagagagtcagt

SEQ ID NO: 7739129 - DNA, 22 bp, Homo sapiens
catgggggtctggacaacaggc

SEQ ID NO: 7739130 - DNA, 22 bp, Homo sapiens
aggatttaatcagttggcattt

SEQ ID NO: 7739131 - DNA, 22 bp, Homo sapiens
cattaaaatatctcatggtgtt

SEQ ID NO: 7739132 - DNA, 22 bp, Homo sapiens
cattaaatcttccagacctcac

SEQ ID NO: 7739133 - DNA, 22 bp, Homo sapiens
ccaagtgatacacccgcctcgg

SEQ ID NO: 7739134 - DNA, 23 bp, Homo sapiens
aggttcaggagatggaggaacaa

SEQ ID NO: 7739135 - DNA, 22 bp, Homo sapiens
aggttcaggctgcacacctgag

SEQ ID NO: 7739136 - DNA, 22 bp, Homo sapiens
aggttcaggcacttgcccaaca

SEQ ID NO: 7739137 - DNA, 17 bp, Homo sapiens
aggttcaggttacattc

SEQ ID NO: 7739138 - DNA, 22 bp, Homo sapiens
aggttcagtaaatgttagttga

SEQ ID NO: 7739139 - DNA, 22 bp, Homo sapiens
aggttcagtctttggacccctc

SEQ ID NO: 7739140 - DNA, 22 bp, Homo sapiens
aggttcagtgcctggaacaggg

SEQ ID NO: 7739141 - DNA, 22 bp, Homo sapiens
aggttcagacgcataataggca

SEQ ID NO: 7739142 - DNA, 22 bp, Homo sapiens
aggttcagagttgttgatgttt

SEQ ID NO: 7739143 - DNA, 22 bp, Homo sapiens
aggttcagatgacttttatgct

SEQ ID NO: 7739144 - DNA, 23 bp, Homo sapiens
aggttcagctttcttactctggg

SEQ ID NO: 7739145 - DNA, 22 bp, Homo sapiens
aggttcacacacacaaaaagat

SEQ ID NO: 7739146 - DNA, 22 bp, Homo sapiens
aggttccaagaaatcatcagtg

SEQ ID NO: 7739147 - DNA, 22 bp, Homo sapiens
aggttacagtcatctcagaatc

SEQ ID NO: 7739148 - DNA, 23 bp, Homo sapiens
aggttacagttgttaagttgcaa

SEQ ID NO: 7739149 - DNA, 22 bp, Homo sapiens
aggtttctcctttaaagcatgg

SEQ ID NO: 7739150 - DNA, 22 bp, Homo sapiens
aggtttctatgctgtttatctt

SEQ ID NO: 7739151 - DNA, 19 bp, Homo sapiens
aggtttctaactattcaag

SEQ ID NO: 7739152 - DNA, 21 bp, Homo sapiens
aggtttctcttttatggaggg

SEQ ID NO: 7739153 - DNA, 22 bp, Homo sapiens
cggtcaggtgcagcgttggcac

SEQ ID NO: 7739154 - DNA, 22 bp, Homo sapiens
cggtcaggtgcagcgttggcac

SEQ ID NO: 7739155 - DNA, 22 bp, Homo sapiens
cgcggtggcggcctccagcgcc

SEQ ID NO: 7739156 - DNA, 22 bp, Homo sapiens
cgtggccagtttcaagctacca

SEQ ID NO: 7739157 - DNA, 17 bp, Homo sapiens
cgtggctgagccataga

SEQ ID NO: 7739158 - DNA, 22 bp, Homo sapiens
cgtggctggggaggtcagccag

SEQ ID NO: 7739159 - DNA, 22 bp, Homo sapiens
cgtggctggggcgactccacgg

SEQ ID NO: 7739160 - DNA, 22 bp, Homo sapiens
agtcagttgcaaacatcaggca

SEQ ID NO: 7739161 - DNA, 22 bp, Homo sapiens
agtcagttaacctcacagcatc

SEQ ID NO: 7739162 - DNA, 22 bp, Homo sapiens
agtcagtgtagaaagcccaggc

SEQ ID NO: 7739163 - DNA, 22 bp, Homo sapiens
agtcagacataattctaacatt

SEQ ID NO: 7739164 - DNA, 22 bp, Homo sapiens
cctggagcaggagctgcagagg

SEQ ID NO: 7739165 - DNA, 21 bp, Homo sapiens
cctggactaaaaccaggccac

SEQ ID NO: 7739166 - DNA, 22 bp, Homo sapiens
aggggcttatgtttctccaggc

SEQ ID NO: 7739167 - DNA, 22 bp, Homo sapiens
cctggccagcagccccttcctc

SEQ ID NO: 7739168 - DNA, 22 bp, Homo sapiens
cctggctcagaccccagttctg

SEQ ID NO: 7739169 - DNA, 22 bp, Homo sapiens
cctggctcagaccccagttctg

SEQ ID NO: 7739170 - DNA, 22 bp, Homo sapiens
cctggctcagcagctctttctc

SEQ ID NO: 7739171 - DNA, 17 bp, Homo sapiens
aggtataaaatggtagc

SEQ ID NO: 7739172 - DNA, 22 bp, Homo sapiens
cctggctcattatgtgccccca

SEQ ID NO: 7739173 - DNA, 22 bp, Homo sapiens
aggtatctggtaagaggcagac

SEQ ID NO: 7739174 - DNA, 22 bp, Homo sapiens
aggtatcaacagcagagtctga

SEQ ID NO: 7739175 - DNA, 22 bp, Homo sapiens
aggtataagtctcatttctgtt

SEQ ID NO: 7739176 - DNA, 22 bp, Homo sapiens
aggtgaggtttgggaggtgtca

SEQ ID NO: 7739177 - DNA, 21 bp, Homo sapiens
aggtggagtgcttagcatcca

SEQ ID NO: 7739178 - DNA, 22 bp, Homo sapiens
aggtggagatcagggactaagg

SEQ ID NO: 7739179 - DNA, 22 bp, Homo sapiens
aggtctggagtgggatctgaga

SEQ ID NO: 7739180 - DNA, 22 bp, Homo sapiens
aggtctggctcttctccacaga

SEQ ID NO: 7739181 - DNA, 22 bp, Homo sapiens
aggtctggaggcggagtcagga

SEQ ID NO: 7739182 - DNA, 22 bp, Homo sapiens
aggtctgggcaccactggctgc

SEQ ID NO: 7739183 - DNA, 22 bp, Homo sapiens
aggtctggtatttttctatact

SEQ ID NO: 7739184 - DNA, 22 bp, Homo sapiens
aggtctggtgggctttagattg

SEQ ID NO: 7739185 - DNA, 22 bp, Homo sapiens
aggtctggtgttgggcctgaaa

SEQ ID NO: 7739186 - DNA, 22 bp, Homo sapiens
aggtctggtgttgatgaattcc

SEQ ID NO: 7739187 - DNA, 22 bp, Homo sapiens
aggtctgtctggccccatgaat

SEQ ID NO: 7739188 - DNA, 18 bp, Homo sapiens
aggtctgtggtcaccagg

SEQ ID NO: 7739189 - DNA, 22 bp, Homo sapiens
aggtctgagtatggcctgagaa

SEQ ID NO: 7739190 - DNA, 18 bp, Homo sapiens
aggtctgaggaagagcct

SEQ ID NO: 7739191 - DNA, 20 bp, Homo sapiens
aggtctgattccagaatcag

SEQ ID NO: 7739192 - DNA, 23 bp, Homo sapiens
aggtctggacccttggcccctgc

SEQ ID NO: 7739193 - DNA, 22 bp, Homo sapiens
aggtcctgtccttggtctctga

SEQ ID NO: 7739194 - DNA, 22 bp, Homo sapiens
aggtcctgtccttggtctctga

SEQ ID NO: 7739195 - DNA, 22 bp, Homo sapiens
aggtctcttgctgtctctgggc

SEQ ID NO: 7739196 - DNA, 22 bp, Homo sapiens
aggtctgactctttgccacata

SEQ ID NO: 7739197 - DNA, 22 bp, Homo sapiens
ctcctctcaggctggatggcgc

SEQ ID NO: 7739198 - DNA, 22 bp, Homo sapiens
ctcctctcaaaagtaggttgac

SEQ ID NO: 7739199 - DNA, 22 bp, Homo sapiens
ctcctcccacggtctcaggaag

SEQ ID NO: 7739200 - DNA, 22 bp, Homo sapiens
ctccagttggccccagttggtt

SEQ ID NO: 7739201 - DNA, 22 bp, Homo sapiens
ctccagtggtgatggggaagaa

SEQ ID NO: 7739202 - DNA, 22 bp, Homo sapiens
ctccagtgtctcagagcagatg

SEQ ID NO: 7739203 - DNA, 20 bp, Homo sapiens
ctccagtgttcaggggagtg

SEQ ID NO: 7739204 - DNA, 22 bp, Homo sapiens
ctccagtgcttctagaaaatac

SEQ ID NO: 7739205 - DNA, 22 bp, Homo sapiens
agtgcagaggctgggaaatgct

SEQ ID NO: 7739206 - DNA, 22 bp, Homo sapiens
agtgcagagacctggtcaggca

SEQ ID NO: 7739207 - DNA, 22 bp, Homo sapiens
agtgactggtgtgaagttaaat

SEQ ID NO: 7739208 - DNA, 22 bp, Homo sapiens
agtgactggttttgacaggaat

SEQ ID NO: 7739209 - DNA, 22 bp, Homo sapiens
agtgaccatctaacgcctgtga

SEQ ID NO: 7739210 - DNA, 22 bp, Homo sapiens
agtctgaaccagatggcaaggt

SEQ ID NO: 7739211 - DNA, 22 bp, Homo sapiens
agtctgaagactcatgtctgaa

SEQ ID NO: 7739212 - DNA, 22 bp, Homo sapiens
agtctgaagatattcttgcagg

SEQ ID NO: 7739213 - DNA, 22 bp, Homo sapiens
agtctgaagtagtctttagtgt

SEQ ID NO: 7739214 - DNA, 22 bp, Homo sapiens
agtctgaaggcaatctgctgac

SEQ ID NO: 7739215 - DNA, 23 bp, Homo sapiens
agtctgaattgagatgtgctgtg

SEQ ID NO: 7739216 - DNA, 22 bp, Homo sapiens
ctcaggcaaggcccgcattctc

SEQ ID NO: 7739217 - DNA, 22 bp, Homo sapiens
agtctgtgtatattcactgccc

SEQ ID NO: 7739218 - DNA, 22 bp, Homo sapiens
agtctggaatttggcctgagca

SEQ ID NO: 7739219 - DNA, 22 bp, Homo sapiens
agtctgtgaaaagataggaagt

SEQ ID NO: 7739220 - DNA, 22 bp, Homo sapiens
ctgaagccacgatagcttccta

SEQ ID NO: 7739221 - DNA, 21 bp, Homo sapiens
agtgtgtgtggaatgagaata

SEQ ID NO: 7739222 - DNA, 21 bp, Homo sapiens
agtgtgtgataggcaggaaga

SEQ ID NO: 7739223 - DNA, 22 bp, Homo sapiens
agtgtgggggctttggtgtcac

SEQ ID NO: 7739224 - DNA, 22 bp, Homo sapiens
agtggggaggtccaggccaccc

SEQ ID NO: 7739225 - DNA, 22 bp, Homo sapiens
agtggggacaatgagagcaggt

SEQ ID NO: 7739226 - DNA, 22 bp, Homo sapiens
agtgtctgatgcacagttgtcc

SEQ ID NO: 7739227 - DNA, 22 bp, Homo sapiens
ctctctggtacatagagtttgg

SEQ ID NO: 7739228 - DNA, 18 bp, Homo sapiens
ctctctgggtgaggacaa

SEQ ID NO: 7739229 - DNA, 22 bp, Homo sapiens
ctctctgggtcctcttttatag

SEQ ID NO: 7739230 - DNA, 22 bp, Homo sapiens
ctctctgggtcctcttttatag

SEQ ID NO: 7739231 - DNA, 22 bp, Homo sapiens
ctctctggggttccagacgtgg

SEQ ID NO: 7739232 - DNA, 22 bp, Homo sapiens
ctctctgggaatattttattct

SEQ ID NO: 7739233 - DNA, 22 bp, Homo sapiens
ctctctggcttggcacggagat

SEQ ID NO: 7739234 - DNA, 22 bp, Homo sapiens
ctctctgggaatattttattct

SEQ ID NO: 7739235 - DNA, 22 bp, Homo sapiens
ctctctgggggccatgccaaga

SEQ ID NO: 7739236 - DNA, 22 bp, Homo sapiens
ctctctgggcccagttggcacc

SEQ ID NO: 7739237 - DNA, 22 bp, Homo sapiens
agtggcagccgagcaggagatg

SEQ ID NO: 7739238 - DNA, 22 bp, Homo sapiens
ctctctggtcccagattccaga

SEQ ID NO: 7739239 - DNA, 22 bp, Homo sapiens
agtggcaggaaagtggaagaga

SEQ ID NO: 7739240 - DNA, 22 bp, Homo sapiens
agtggctgaatatattttacta

SEQ ID NO: 7739241 - DNA, 22 bp, Homo sapiens
agtggctgaagcatcaaaggca

SEQ ID NO: 7739242 - DNA, 23 bp, Homo sapiens
agtggctggacagactttcctgg

SEQ ID NO: 7739243 - DNA, 22 bp, Homo sapiens
agtggctgacaactgggttaac

SEQ ID NO: 7739244 - DNA, 22 bp, Homo sapiens
agtggctggcataggaacagac

SEQ ID NO: 7739245 - DNA, 22 bp, Homo sapiens
agtggctggagccccaggctgg

SEQ ID NO: 7739246 - DNA, 22 bp, Homo sapiens
agtggctggacgacaagggtga

SEQ ID NO: 7739247 - DNA, 22 bp, Homo sapiens
agtggctgtactattttttcat

SEQ ID NO: 7739248 - DNA, 22 bp, Homo sapiens
agtggctggtctaaggtcacag

SEQ ID NO: 7739249 - DNA, 22 bp, Homo sapiens
agtggctgtatcagtcaaccct

SEQ ID NO: 7739250 - DNA, 22 bp, Homo sapiens
agtggctgtaggctatgagaga

SEQ ID NO: 7739251 - DNA, 19 bp, Homo sapiens
agtggctgggcagaagcaa

SEQ ID NO: 7739252 - DNA, 22 bp, Homo sapiens
agtggctggtagttactgagca

SEQ ID NO: 7739253 - DNA, 21 bp, Homo sapiens
agtggctgtcaagggggcctt

SEQ ID NO: 7739254 - DNA, 22 bp, Homo sapiens
agtggctgtcttccaaaatctg

SEQ ID NO: 7739255 - DNA, 22 bp, Homo sapiens
agtggctgtcctggctctaact

SEQ ID NO: 7739256 - DNA, 22 bp, Homo sapiens
ataataaaccaggatgggtctg

SEQ ID NO: 7739257 - DNA, 22 bp, Homo sapiens
ctgccctgtggctctgagtcat

SEQ ID NO: 7739258 - DNA, 22 bp, Homo sapiens
ataataaaccaggatgggtctg

SEQ ID NO: 7739259 - DNA, 22 bp, Homo sapiens
ataataaaccaggatgggtctg

SEQ ID NO: 7739260 - DNA, 22 bp, Homo sapiens
ctgccctgtatcttctcccaat

SEQ ID NO: 7739261 - DNA, 22 bp, Homo sapiens
ctgccctgtagctgttctagca

SEQ ID NO: 7739262 - DNA, 22 bp, Homo sapiens
ctgccctcccagttggtccgtg

SEQ ID NO: 7739263 - DNA, 22 bp, Homo sapiens
ctgcccgctgctagagaggccg

SEQ ID NO: 7739264 - DNA, 22 bp, Homo sapiens
agttttcagtaaatattagtga

SEQ ID NO: 7739265 - DNA, 22 bp, Homo sapiens
agttttctcacatcaaaaatga

SEQ ID NO: 7739266 - DNA, 21 bp, Homo sapiens
agttttctgagttataaaata

SEQ ID NO: 7739267 - DNA, 22 bp, Homo sapiens
agttttctctgtgttctgctta

SEQ ID NO: 7739268 - DNA, 22 bp, Homo sapiens
agttttctgttctacaatttga

SEQ ID NO: 7739269 - DNA, 22 bp, Homo sapiens
agttttctttcgcaaaggtaca

SEQ ID NO: 7739270 - DNA, 22 bp, Homo sapiens
agtttctctttgacaccaaaat

SEQ ID NO: 7739271 - DNA, 22 bp, Homo sapiens
agtttcagtgttgacagatggt

SEQ ID NO: 7739272 - DNA, 18 bp, Homo sapiens
agtttcagggcaggaaac

SEQ ID NO: 7739273 - DNA, 22 bp, Homo sapiens
agtttcacatagctcagtgctc

SEQ ID NO: 7739274 - DNA, 22 bp, Homo sapiens
agtttcagaatttatgcagaca

SEQ ID NO: 7739275 - DNA, 22 bp, Homo sapiens
agtttctcttaatctagtatct

SEQ ID NO: 7739276 - DNA, 22 bp, Homo sapiens
agtttctctcagtatagaatag

SEQ ID NO: 7739277 - DNA, 22 bp, Homo sapiens
agtttctctagagtctttgaaa

SEQ ID NO: 7739278 - DNA, 20 bp, Homo sapiens
agtttgtgtgtctatgcgct

SEQ ID NO: 7739279 - DNA, 22 bp, Homo sapiens
agtgttcagtgattgtcaaccg

SEQ ID NO: 7739280 - DNA, 22 bp, Homo sapiens
agtgttcaggatctgaggccag

SEQ ID NO: 7739281 - DNA, 22 bp, Homo sapiens
agtgttcactctgtggagccca

SEQ ID NO: 7739282 - DNA, 23 bp, Homo sapiens
agtgttcagcatgtagtaaatac

SEQ ID NO: 7739283 - DNA, 20 bp, Homo sapiens
agtgttccggaagactggca

SEQ ID NO: 7739284 - DNA, 22 bp, Homo sapiens
agtgttcatttattcattcact

SEQ ID NO: 7739285 - DNA, 22 bp, Homo sapiens
agtttcacagagggttagacgc

SEQ ID NO: 7739286 - DNA, 22 bp, Homo sapiens
ctggagcttattgggagcagaa

SEQ ID NO: 7739287 - DNA, 22 bp, Homo sapiens
atagaaaacagatgtccttaaa

SEQ ID NO: 7739288 - DNA, 22 bp, Homo sapiens
atagaaatggcagctggtgcta

SEQ ID NO: 7739289 - DNA, 19 bp, Homo sapiens
atagaaagggttaaagaca

SEQ ID NO: 7739290 - DNA, 22 bp, Homo sapiens
atagacatggtcttttgtcatt

SEQ ID NO: 7739291 - DNA, 22 bp, Homo sapiens
atagacatatggctttgtttct

SEQ ID NO: 7739292 - DNA, 22 bp, Homo sapiens
ctggagctggcttccttccact

SEQ ID NO: 7739293 - DNA, 22 bp, Homo sapiens
ataattatctcagacacttgtt

SEQ ID NO: 7739294 - DNA, 22 bp, Homo sapiens
ataatcagaattcatgaaagat

SEQ ID NO: 7739295 - DNA, 22 bp, Homo sapiens
atacagaagaactatagccact

SEQ ID NO: 7739296 - DNA, 22 bp, Homo sapiens
atcaggaacgttcatggactgt

SEQ ID NO: 7739297 - DNA, 22 bp, Homo sapiens
atcaggaagaattggatgctac

SEQ ID NO: 7739298 - DNA, 22 bp, Homo sapiens
atcaggaagatctagcgaatgt

SEQ ID NO: 7739299 - DNA, 22 bp, Homo sapiens
atcattcagcctaagcaagtac

SEQ ID NO: 7739300 - DNA, 22 bp, Homo sapiens
atcattcagtctctgggacagt

SEQ ID NO: 7739301 - DNA, 22 bp, Homo sapiens
atcattcaaatgatttggaggt

SEQ ID NO: 7739302 - DNA, 22 bp, Homo sapiens
ctgtttatctctaacctgttta

SEQ ID NO: 7739303 - DNA, 22 bp, Homo sapiens
cttcagagagtccagggactgc

SEQ ID NO: 7739304 - DNA, 22 bp, Homo sapiens
cttcagcaactttggaatgttt

SEQ ID NO: 7739305 - DNA, 23 bp, Homo sapiens
cttcatcaaaagttaacactagt

SEQ ID NO: 7739306 - DNA, 22 bp, Homo sapiens
cttcatctttctgagcctcagt

SEQ ID NO: 7739307 - DNA, 22 bp, Homo sapiens
ctggggaggatgctacgacctg

SEQ ID NO: 7739308 - DNA, 23 bp, Homo sapiens
ctgggctgtcctgaggtcacctc

SEQ ID NO: 7739309 - DNA, 22 bp, Homo sapiens
ctggtgggaagatggaaaacat

SEQ ID NO: 7739310 - DNA, 22 bp, Homo sapiens
ctggtcctctccagcaggcatt

SEQ ID NO: 7739311 - DNA, 22 bp, Homo sapiens
ctggggcatcatccattctttc

SEQ ID NO: 7739312 - DNA, 22 bp, Homo sapiens
ctgtatctgtgttggatgagtt

SEQ ID NO: 7739313 - DNA, 22 bp, Homo sapiens
atattttccgaacttgaggtag

SEQ ID NO: 7739314 - DNA, 17 bp, Homo sapiens
ctgggcctctgcccttt

SEQ ID NO: 7739315 - DNA, 22 bp, Homo sapiens
ctgggccatgggccagcgaggc

SEQ ID NO: 7739316 - DNA, 22 bp, Homo sapiens
ctgggccatctctctgcaagtg

SEQ ID NO: 7739317 - DNA, 20 bp, Homo sapiens
ctgggccatccttttacaat

SEQ ID NO: 7739318 - DNA, 22 bp, Homo sapiens
ctgggccatctcctttgtgtgg

SEQ ID NO: 7739319 - DNA, 22 bp, Homo sapiens
ctgggccagttatgtctcatct

SEQ ID NO: 7739320 - DNA, 22 bp, Homo sapiens
ctgggcagttcgctttcgtttt

SEQ ID NO: 7739321 - DNA, 22 bp, Homo sapiens
ctgggcctggcgttccaggctg

SEQ ID NO: 7739322 - DNA, 22 bp, Homo sapiens
ctgggcctggacgggcagatct

SEQ ID NO: 7739323 - DNA, 22 bp, Homo sapiens
ctgggcctgccaccatcttagg

SEQ ID NO: 7739324 - DNA, 23 bp, Homo sapiens
atatcacacccagtacagtctcc

SEQ ID NO: 7739325 - DNA, 22 bp, Homo sapiens
atagtatttccagaaatagtct

SEQ ID NO: 7739326 - DNA, 22 bp, Homo sapiens
gcagggcagtgtgtctgtgggg

SEQ ID NO: 7739327 - DNA, 22 bp, Homo sapiens
attcttttaagccccagggatt

SEQ ID NO: 7739328 - DNA, 22 bp, Homo sapiens
attctgatgcctgggtactgcc

SEQ ID NO: 7739329 - DNA, 22 bp, Homo sapiens
gcagtaagaaagtcaagcagtt

SEQ ID NO: 7739330 - DNA, 22 bp, Homo sapiens
attctctttgtataacatcttg

SEQ ID NO: 7739331 - DNA, 22 bp, Homo sapiens
attctgagaggcacaatgtgga

SEQ ID NO: 7739332 - DNA, 22 bp, Homo sapiens
attctgagtacaacaagatgtt

SEQ ID NO: 7739333 - DNA, 21 bp, Homo sapiens
attctgagttgtcagtcttca

SEQ ID NO: 7739334 - DNA, 22 bp, Homo sapiens
attctgagttagagtcagccag

SEQ ID NO: 7739335 - DNA, 22 bp, Homo sapiens
gcaggcaggagcccaactgcct

SEQ ID NO: 7739336 - DNA, 22 bp, Homo sapiens
attcacaacaaaaggatatgag

SEQ ID NO: 7739337 - DNA, 22 bp, Homo sapiens
attccaaagacagaagcagctg

SEQ ID NO: 7739338 - DNA, 22 bp, Homo sapiens
attccacacagtaatactcaat

SEQ ID NO: 7739339 - DNA, 22 bp, Homo sapiens
attccaaaggttaatgcccatt

SEQ ID NO: 7739340 - DNA, 22 bp, Homo sapiens
attccaaaggctggcctggagg

SEQ ID NO: 7739341 - DNA, 22 bp, Homo sapiens
attccaaagcctgaataatgga

SEQ ID NO: 7739342 - DNA, 22 bp, Homo sapiens
attccaaagcacatcagaacta

SEQ ID NO: 7739343 - DNA, 22 bp, Homo sapiens
attccacataggccttcatgac

SEQ ID NO: 7739344 - DNA, 22 bp, Homo sapiens
attatctatgtagaatgatttt

SEQ ID NO: 7739345 - DNA, 22 bp, Homo sapiens
gcaccatgacagtgaggagaac

SEQ ID NO: 7739346 - DNA, 22 bp, Homo sapiens
attcaagtccagcttctctaca

SEQ ID NO: 7739347 - DNA, 22 bp, Homo sapiens
attataggcttgagccaccgtg

SEQ ID NO: 7739348 - DNA, 22 bp, Homo sapiens
gcacacagctagattaccattc

SEQ ID NO: 7739349 - DNA, 18 bp, Homo sapiens
gattctgattctggaggc

SEQ ID NO: 7739350 - DNA, 22 bp, Homo sapiens
gattctgagctggtgttttacg

SEQ ID NO: 7739351 - DNA, 22 bp, Homo sapiens
gatgtgaggtggtaaacaggga

SEQ ID NO: 7739352 - DNA, 22 bp, Homo sapiens
gatgtgagtggtagctgggatt

SEQ ID NO: 7739353 - DNA, 22 bp, Homo sapiens
gatgtggatgatcttagatggt

SEQ ID NO: 7739354 - DNA, 22 bp, Homo sapiens
attgtacataaaatgtatgtct

SEQ ID NO: 7739355 - DNA, 22 bp, Homo sapiens
attgtacatatgatgtatgtaa

SEQ ID NO: 7739356 - DNA, 19 bp, Homo sapiens
attgtacattgagtttggc

SEQ ID NO: 7739357 - DNA, 22 bp, Homo sapiens
atttagtttaggaaaagtaggt

SEQ ID NO: 7739358 - DNA, 22 bp, Homo sapiens
gccagctgcttctccagaattt

SEQ ID NO: 7739359 - DNA, 22 bp, Homo sapiens
gccatcatatcccctgtgacct

SEQ ID NO: 7739360 - DNA, 19 bp, Homo sapiens
gccatcccaagcattttgg

SEQ ID NO: 7739361 - DNA, 20 bp, Homo sapiens
gccatccagcctcccaggag

SEQ ID NO: 7739362 - DNA, 22 bp, Homo sapiens
gcccagtctcttctggccctgt

SEQ ID NO: 7739363 - DNA, 22 bp, Homo sapiens
atttcaaggctacagaaacctt

SEQ ID NO: 7739364 - DNA, 19 bp, Homo sapiens
atttcaagaggtttattgg

SEQ ID NO: 7739365 - DNA, 22 bp, Homo sapiens
gccctgtgagtcatgcggcaga

SEQ ID NO: 7739366 - DNA, 22 bp, Homo sapiens
atttcttcaggtcagaaataga

SEQ ID NO: 7739367 - DNA, 22 bp, Homo sapiens
attttcctcaagcctctggaag

SEQ ID NO: 7739368 - DNA, 22 bp, Homo sapiens
gcctgtgcttaactgacgtgag

SEQ ID NO: 7739369 - DNA, 22 bp, Homo sapiens
gcctgtgctgttccctctgcca

SEQ ID NO: 7739370 - DNA, 22 bp, Homo sapiens
attttcatgactaccttaaata

SEQ ID NO: 7739371 - DNA, 22 bp, Homo sapiens
attttccaaaataattgttact

SEQ ID NO: 7739372 - DNA, 22 bp, Homo sapiens
attttgataatcatgttagaga

SEQ ID NO: 7739373 - DNA, 22 bp, Homo sapiens
attttgctgtggtacattagga

SEQ ID NO: 7739374 - DNA, 22 bp, Homo sapiens
caaaagatacttgcatctaact

SEQ ID NO: 7739375 - DNA, 20 bp, Homo sapiens
caaaagcaatgaagttatga

SEQ ID NO: 7739376 - DNA, 22 bp, Homo sapiens
gctccccagcttagccctggct

SEQ ID NO: 7739377 - DNA, 22 bp, Homo sapiens
gctctgctgggtgggcagttat

SEQ ID NO: 7739378 - DNA, 22 bp, Homo sapiens
gaagctaaaccacagctaagaa

SEQ ID NO: 7739379 - DNA, 22 bp, Homo sapiens
gaagccttgaactgcaaacccc

SEQ ID NO: 7739380 - DNA, 22 bp, Homo sapiens
gaaggaggtctgatacaatatg

SEQ ID NO: 7739381 - DNA, 22 bp, Homo sapiens
gaaggaggctccccaaagtctg

SEQ ID NO: 7739382 - DNA, 23 bp, Homo sapiens
atgatgtttttggtagtcaaatg

SEQ ID NO: 7739383 - DNA, 22 bp, Homo sapiens
gaagagcatatgaagagcatat

SEQ ID NO: 7739384 - DNA, 22 bp, Homo sapiens
gaagagatgacaaaggagcatg

SEQ ID NO: 7739385 - DNA, 22 bp, Homo sapiens
atgagctgggccatccagtgat

SEQ ID NO: 7739386 - DNA, 22 bp, Homo sapiens
gaagagagagccctggggtccg

SEQ ID NO: 7739387 - DNA, 22 bp, Homo sapiens
gaagtagaaagcctcgtaaata

SEQ ID NO: 7739388 - DNA, 22 bp, Homo sapiens
gaagtatttctgagttgcccag

SEQ ID NO: 7739389 - DNA, 22 bp, Homo sapiens
gaagtattatagcatattagcc

SEQ ID NO: 7739390 - DNA, 22 bp, Homo sapiens
gaagtattactctgaatgtatt

SEQ ID NO: 7739391 - DNA, 22 bp, Homo sapiens
gaatttcaagcagtgcaatgtt

SEQ ID NO: 7739392 - DNA, 22 bp, Homo sapiens
gaatttcagaggtaacatcatc

SEQ ID NO: 7739393 - DNA, 22 bp, Homo sapiens
gacagcttgcctggtactgcaa

SEQ ID NO: 7739394 - DNA, 22 bp, Homo sapiens
gacagcttcttgggccgggcct

SEQ ID NO: 7739395 - DNA, 22 bp, Homo sapiens
gacagcttctatgtgacgagca

SEQ ID NO: 7739396 - DNA, 22 bp, Homo sapiens
gacagcttctagaggaattggt

SEQ ID NO: 7739397 - DNA, 22 bp, Homo sapiens
gacagcttctagaaatggtcac

SEQ ID NO: 7739398 - DNA, 20 bp, Homo sapiens
gacagcttggggtgtcacct

SEQ ID NO: 7739399 - DNA, 22 bp, Homo sapiens
gacagcttagtgaaaatgtaaa

SEQ ID NO: 7739400 - DNA, 22 bp, Homo sapiens
gacagcttcgaggaggtgagct

SEQ ID NO: 7739401 - DNA, 22 bp, Homo sapiens
gacagcttaggaagtttctatt

SEQ ID NO: 7739402 - DNA, 22 bp, Homo sapiens
gacagcttagtgaaaatgtaaa

SEQ ID NO: 7739403 - DNA, 22 bp, Homo sapiens
gaatttgtgctcaggaagatta

SEQ ID NO: 7739404 - DNA, 22 bp, Homo sapiens
gaatttgtcccttgatataaaa

SEQ ID NO: 7739405 - DNA, 22 bp, Homo sapiens
cttctccctggcttctgcacac

SEQ ID NO: 7739406 - DNA, 22 bp, Homo sapiens
atctttgctattgtaaatcacg

SEQ ID NO: 7739407 - DNA, 22 bp, Homo sapiens
atctttgcccagagactcagcc

SEQ ID NO: 7739408 - DNA, 22 bp, Homo sapiens
ctttgcttgacactgtgattgt

SEQ ID NO: 7739409 - DNA, 22 bp, Homo sapiens
ctttggaaaaatacctggcata

SEQ ID NO: 7739410 - DNA, 22 bp, Homo sapiens
ctttggctcatggttttatcca

SEQ ID NO: 7739411 - DNA, 22 bp, Homo sapiens
ctttgcctcctagagcacgttc

SEQ ID NO: 7739412 - DNA, 20 bp, Homo sapiens
ctttgcctattctctgcctg

SEQ ID NO: 7739413 - DNA, 22 bp, Homo sapiens
ctttgggatttcatgagagcta

SEQ ID NO: 7739414 - DNA, 22 bp, Homo sapiens
atgagaaagagttgtatctaga

SEQ ID NO: 7739415 - DNA, 22 bp, Homo sapiens
atgagacatgacttcaggcctt

SEQ ID NO: 7739416 - DNA, 22 bp, Homo sapiens
atgagagactgtgtgttgggag

SEQ ID NO: 7739417 - DNA, 22 bp, Homo sapiens
atgagaggtttcgtcagaggaa

SEQ ID NO: 7739418 - DNA, 22 bp, Homo sapiens
atgagcagatgctcctgcctct

SEQ ID NO: 7739419 - DNA, 22 bp, Homo sapiens
gagccccttctgcagtcaggtt

SEQ ID NO: 7739420 - DNA, 22 bp, Homo sapiens
atgggcagagctggtgggaggc

SEQ ID NO: 7739421 - DNA, 22 bp, Homo sapiens
gagcacagctggaggtagcatt

SEQ ID NO: 7739422 - DNA, 22 bp, Homo sapiens
gagcacaggctttggtggacac

SEQ ID NO: 7739423 - DNA, 22 bp, Homo sapiens
atggctgcagagacctgaagaa

SEQ ID NO: 7739424 - DNA, 22 bp, Homo sapiens
atggctgcagtccgtgccctgg

SEQ ID NO: 7739425 - DNA, 22 bp, Homo sapiens
atggctgcagccggccctgcgc

SEQ ID NO: 7739426 - DNA, 22 bp, Homo sapiens
atggagggtgtcagagagcgaa

SEQ ID NO: 7739427 - DNA, 22 bp, Homo sapiens
atggatctaccttcaggctctg

SEQ ID NO: 7739428 - DNA, 22 bp, Homo sapiens
atgctggtggttgatggcagga

SEQ ID NO: 7739429 - DNA, 22 bp, Homo sapiens
atgctggtctgcagagttggga

SEQ ID NO: 7739430 - DNA, 22 bp, Homo sapiens
atgctggtctcattgggttagg

SEQ ID NO: 7739431 - DNA, 22 bp, Homo sapiens
gagaaggggtgatgtgggtaat

SEQ ID NO: 7739432 - DNA, 22 bp, Homo sapiens
gaggttctgggggtctgcctgg

SEQ ID NO: 7739433 - DNA, 22 bp, Homo sapiens
gaggttccccattgtactggct

SEQ ID NO: 7739434 - DNA, 22 bp, Homo sapiens
gaggttcattcagctctgtcac

SEQ ID NO: 7739435 - DNA, 22 bp, Homo sapiens
gaggttcagtcctgctctgtca

SEQ ID NO: 7739436 - DNA, 22 bp, Homo sapiens
atgtggccagtcatgtagtaac

SEQ ID NO: 7739437 - DNA, 22 bp, Homo sapiens
atgtgctgagtgtgtatataca

SEQ ID NO: 7739438 - DNA, 22 bp, Homo sapiens
atgtgctgtaatccattgaagg

SEQ ID NO: 7739439 - DNA, 22 bp, Homo sapiens
atgtcagagcttccacaatagt

SEQ ID NO: 7739440 - DNA, 22 bp, Homo sapiens
atgtatcagataaagcatgtgg

SEQ ID NO: 7739441 - DNA, 22 bp, Homo sapiens
gaggcacagagtaggtgcacac

SEQ ID NO: 7739442 - DNA, 22 bp, Homo sapiens
gaggcacagagccctaggagct

SEQ ID NO: 7739443 - DNA, 22 bp, Homo sapiens
gaggaggggcacttgtctccta

SEQ ID NO: 7739444 - DNA, 22 bp, Homo sapiens
gaggcacagtgtttggtcagtg

SEQ ID NO: 7739445 - DNA, 22 bp, Homo sapiens
gaggagggcctggtgtcccttc

SEQ ID NO: 7739446 - DNA, 22 bp, Homo sapiens
gaggagctgtcaccgtgactca

SEQ ID NO: 7739447 - DNA, 22 bp, Homo sapiens
cagcagcagccccaggaaggtt

SEQ ID NO: 7739448 - DNA, 22 bp, Homo sapiens
cagcaaaggtagaagcacagga

SEQ ID NO: 7739449 - DNA, 22 bp, Homo sapiens
cagattcttcattcattctaca

SEQ ID NO: 7739450 - DNA, 22 bp, Homo sapiens
gtaggcagtctctcaggtgatc

SEQ ID NO: 7739451 - DNA, 22 bp, Homo sapiens
gtaggcagtggttggaagagaa

SEQ ID NO: 7739452 - DNA, 22 bp, Homo sapiens
gtaggcagataggagtgcagcc

SEQ ID NO: 7739453 - DNA, 22 bp, Homo sapiens
gtaggcaggtggaggagtgaag

SEQ ID NO: 7739454 - DNA, 22 bp, Homo sapiens
gtaggcagggctgtggggagaa

SEQ ID NO: 7739455 - DNA, 22 bp, Homo sapiens
cagccagctgtcccaagtgcct

SEQ ID NO: 7739456 - DNA, 22 bp, Homo sapiens
cagccagctggtgcggcagagc

SEQ ID NO: 7739457 - DNA, 22 bp, Homo sapiens
gtcagatctttggggatgctgt

SEQ ID NO: 7739458 - DNA, 22 bp, Homo sapiens
gtcagatctttggggatgctgt

SEQ ID NO: 7739459 - DNA, 22 bp, Homo sapiens
cagcatcctttgctggtttccc

SEQ ID NO: 7739460 - DNA, 22 bp, Homo sapiens
gtcagcagtgtcagctctgggg

SEQ ID NO: 7739461 - DNA, 22 bp, Homo sapiens
gtcagattaatagcaataataa

SEQ ID NO: 7739462 - DNA, 22 bp, Homo sapiens
gtcagcagggtccccttgagtg

SEQ ID NO: 7739463 - DNA, 17 bp, Homo sapiens
gtcagcagcttgcttgt

SEQ ID NO: 7739464 - DNA, 22 bp, Homo sapiens
cagccctcctaccctgccaggc

SEQ ID NO: 7739465 - DNA, 22 bp, Homo sapiens
gtgagcagaataagggttgaga

SEQ ID NO: 7739466 - DNA, 22 bp, Homo sapiens
gtcctgtgacctgcatcctgag

SEQ ID NO: 7739467 - DNA, 22 bp, Homo sapiens
gtcctgtgagattcatgctcaa

SEQ ID NO: 7739468 - DNA, 22 bp, Homo sapiens
gtgagagatgctttcttaacgc

SEQ ID NO: 7739469 - DNA, 22 bp, Homo sapiens
gtgagagctgctccagatctct

SEQ ID NO: 7739470 - DNA, 22 bp, Homo sapiens
cagccctgtccctgagggacct

SEQ ID NO: 7739471 - DNA, 22 bp, Homo sapiens
cagccctggcccaggtgcctta

SEQ ID NO: 7739472 - DNA, 22 bp, Homo sapiens
cagccctgtccagcagagggtg

SEQ ID NO: 7739473 - DNA, 22 bp, Homo sapiens
cagccctgtccaatgtctgctc

SEQ ID NO: 7739474 - DNA, 18 bp, Homo sapiens
gggtcctgtgggagacag

SEQ ID NO: 7739475 - DNA, 21 bp, Homo sapiens
gggtcctgggatgggatccag

SEQ ID NO: 7739476 - DNA, 22 bp, Homo sapiens
gggtcctgcgtgggcccaggac

SEQ ID NO: 7739477 - DNA, 22 bp, Homo sapiens
gggtcctggaatctgcatttta

SEQ ID NO: 7739478 - DNA, 22 bp, Homo sapiens
gggtgggatctgtggagcctca

SEQ ID NO: 7739479 - DNA, 18 bp, Homo sapiens
gggtcctgtgggagacag

SEQ ID NO: 7739480 - DNA, 18 bp, Homo sapiens
gggtcctgttcttggaag

SEQ ID NO: 7739481 - DNA, 20 bp, Homo sapiens
gggtcctgacttggtctcct

SEQ ID NO: 7739482 - DNA, 18 bp, Homo sapiens
gggttcacctgcctttgg

SEQ ID NO: 7739483 - DNA, 22 bp, Homo sapiens
gggttcagactaaagctatgca

SEQ ID NO: 7739484 - DNA, 22 bp, Homo sapiens
gggttccagtctgaaactacag

SEQ ID NO: 7739485 - DNA, 22 bp, Homo sapiens
gggttccaatgatgagcaagag

SEQ ID NO: 7739486 - DNA, 22 bp, Homo sapiens
gggttcttatagtatcagagct

SEQ ID NO: 7739487 - DNA, 22 bp, Homo sapiens
gggttccaaacatagtcttcct

SEQ ID NO: 7739488 - DNA, 22 bp, Homo sapiens
gggttcaggttggcctgagcac

SEQ ID NO: 7739489 - DNA, 22 bp, Homo sapiens
gggttcagagtcaggtgtgata

SEQ ID NO: 7739490 - DNA, 22 bp, Homo sapiens
ggtcctgaggggagctgaaggt

SEQ ID NO: 7739491 - DNA, 22 bp, Homo sapiens
cagatgttgttcctgcctgtag

SEQ ID NO: 7739492 - DNA, 19 bp, Homo sapiens
cagatgttttcagttcatt

SEQ ID NO: 7739493 - DNA, 22 bp, Homo sapiens
ggtcctggcagctctgtgtcca

SEQ ID NO: 7739494 - DNA, 22 bp, Homo sapiens
ggtcctggaagtgtaagtggca

SEQ ID NO: 7739495 - DNA, 22 bp, Homo sapiens
cagatgagcatgggcacaagca

SEQ ID NO: 7739496 - DNA, 22 bp, Homo sapiens
cagatgaggcaacctcattgct

SEQ ID NO: 7739497 - DNA, 23 bp, Homo sapiens
cagatgaggttggcagcatggtc

SEQ ID NO: 7739498 - DNA, 18 bp, Homo sapiens
cagatgagatgcaatctc

SEQ ID NO: 7739499 - DNA, 22 bp, Homo sapiens
cagatgagagtggccagggttc

SEQ ID NO: 7739500 - DNA, 19 bp, Homo sapiens
cagatgagaaaagtgaggt

SEQ ID NO: 7739501 - DNA, 22 bp, Homo sapiens
cagatgaataaatgatgaggta

SEQ ID NO: 7739502 - DNA, 22 bp, Homo sapiens
ggtcaacagaggtaatggtaac

SEQ ID NO: 7739503 - DNA, 22 bp, Homo sapiens
ggggcagatggaacagagcaca

SEQ ID NO: 7739504 - DNA, 22 bp, Homo sapiens
ggggccttggatctgtgccccg

SEQ ID NO: 7739505 - DNA, 22 bp, Homo sapiens
gggctgtgaggtgagaacttac

SEQ ID NO: 7739506 - DNA, 22 bp, Homo sapiens
gggctgtggagccgcgagggct

SEQ ID NO: 7739507 - DNA, 22 bp, Homo sapiens
cagagccagcccactgttcccg

SEQ ID NO: 7739508 - DNA, 22 bp, Homo sapiens
gggatctgggacaacaggtggt

SEQ ID NO: 7739509 - DNA, 22 bp, Homo sapiens
gggatctggaattttggtatgt

SEQ ID NO: 7739510 - DNA, 23 bp, Homo sapiens
gggatctgtaaacctggagaacc

SEQ ID NO: 7739511 - DNA, 23 bp, Homo sapiens
gggatctgtaagttgaagacaaa

SEQ ID NO: 7739512 - DNA, 22 bp, Homo sapiens
gggatctgtgttgcgatggatt

SEQ ID NO: 7739513 - DNA, 22 bp, Homo sapiens
gggatgaattgagtcagaaggg

SEQ ID NO: 7739514 - DNA, 22 bp, Homo sapiens
cagagacaacctggtagagaaa

SEQ ID NO: 7739515 - DNA, 22 bp, Homo sapiens
cagagacaccccagaaaataag

SEQ ID NO: 7739516 - DNA, 22 bp, Homo sapiens
gggatctgctccagagggaaaa

SEQ ID NO: 7739517 - DNA, 22 bp, Homo sapiens
gggatctgatttaggatgggag

SEQ ID NO: 7739518 - DNA, 22 bp, Homo sapiens
cagagcagacgttgagattaag

SEQ ID NO: 7739519 - DNA, 22 bp, Homo sapiens
gggcaggtacaagatgcttctt

SEQ ID NO: 7739520 - DNA, 22 bp, Homo sapiens
gggaggcagtgctggaggctgg

SEQ ID NO: 7739521 - DNA, 22 bp, Homo sapiens
cagaaacacttgtagagaagtt

SEQ ID NO: 7739522 - DNA, 22 bp, Homo sapiens
cagaatttaagtggattattct

SEQ ID NO: 7739523 - DNA, 22 bp, Homo sapiens
cactgcactccagcctgggaga

SEQ ID NO: 7739524 - DNA, 21 bp, Homo sapiens
cactccacttagaacagggtt

SEQ ID NO: 7739525 - DNA, 21 bp, Homo sapiens
cactccacttagaacagggtt

SEQ ID NO: 7739526 - DNA, 22 bp, Homo sapiens
cactgcactccagcctgggtga

SEQ ID NO: 7739527 - DNA, 22 bp, Homo sapiens
cactgcactccagcctgggtca

SEQ ID NO: 7739528 - DNA, 22 bp, Homo sapiens
cactgggcaattctgagcctaa

SEQ ID NO: 7739529 - DNA, 20 bp, Homo sapiens
ggctctggaatctggtgggc

SEQ ID NO: 7739530 - DNA, 22 bp, Homo sapiens
ggctctggaaagtgtccttgat

SEQ ID NO: 7739531 - DNA, 22 bp, Homo sapiens
cacagggctttgatggctgagt

SEQ ID NO: 7739532 - DNA, 22 bp, Homo sapiens
cacaggggcaaactgtagggga

SEQ ID NO: 7739533 - DNA, 18 bp, Homo sapiens
cacaggcaggtgataggt

SEQ ID NO: 7739534 - DNA, 22 bp, Homo sapiens
cacagtcctgccagagggcctt

SEQ ID NO: 7739535 - DNA, 22 bp, Homo sapiens
ggcaagtcaggaagttgacatt

SEQ ID NO: 7739536 - DNA, 22 bp, Homo sapiens
cacatgcaccagaaatcaacat

SEQ ID NO: 7739537 - DNA, 22 bp, Homo sapiens
ggcagaggtgacagtgtctttt

SEQ ID NO: 7739538 - DNA, 22 bp, Homo sapiens
caccagcttctcattgcgggtc

SEQ ID NO: 7739539 - DNA, 22 bp, Homo sapiens
caccagcttgggctgtggaaat

SEQ ID NO: 7739540 - DNA, 22 bp, Homo sapiens
gctggctctttttgccgggctc

SEQ ID NO: 7739541 - DNA, 22 bp, Homo sapiens
gctggcccagggtcacctagga

SEQ ID NO: 7739542 - DNA, 20 bp, Homo sapiens
gctgggctttgactgacaca

SEQ ID NO: 7739543 - DNA, 22 bp, Homo sapiens
gctgggcttgtggccagctggg

SEQ ID NO: 7739544 - DNA, 22 bp, Homo sapiens
gctggggagcaagagtagtgag

SEQ ID NO: 7739545 - DNA, 22 bp, Homo sapiens
gctgggctcaccaggccactag

SEQ ID NO: 7739546 - DNA, 17 bp, Homo sapiens
gctctggcacaggattg

SEQ ID NO: 7739547 - DNA, 22 bp, Homo sapiens
caaagtcagccagctagtaggt

SEQ ID NO: 7739548 - DNA, 22 bp, Homo sapiens
caaagtcatggggatgcaggtc

SEQ ID NO: 7739549 - DNA, 22 bp, Homo sapiens
caaagtgctaggattacaggcc

SEQ ID NO: 7739550 - DNA, 22 bp, Homo sapiens
caaagtgcagaaggaactgggt

SEQ ID NO: 7739551 - DNA, 22 bp, Homo sapiens
caaagtgcctgtaccactttgc

SEQ ID NO: 7739552 - DNA, 22 bp, Homo sapiens
caaagtgctaggattacaggcg

SEQ ID NO: 7739553 - DNA, 22 bp, Homo sapiens
caaagtgctaggattataggtg

SEQ ID NO: 7739554 - DNA, 22 bp, Homo sapiens
caaagtgctggaattacaggtg

SEQ ID NO: 7739555 - DNA, 22 bp, Homo sapiens
ggagagcagggaggctgctctg

SEQ ID NO: 7739556 - DNA, 22 bp, Homo sapiens
ggagaaggtgctggtcactgtg

SEQ ID NO: 7739557 - DNA, 22 bp, Homo sapiens
ggagaaggtgctggtcactgtg

SEQ ID NO: 7739558 - DNA, 22 bp, Homo sapiens
ggagaagggtatgtgtggcgga

SEQ ID NO: 7739559 - DNA, 22 bp, Homo sapiens
ggagaagggacagactcagctt

SEQ ID NO: 7739560 - DNA, 22 bp, Homo sapiens
ggagaagggccaattccatgta

SEQ ID NO: 7739561 - DNA, 22 bp, Homo sapiens
ggagaagggcatggtagtttta

SEQ ID NO: 7739562 - DNA, 22 bp, Homo sapiens
ggagaagggaactgagtttttg

SEQ ID NO: 7739563 - DNA, 22 bp, Homo sapiens
ggagaaggcgaagtcattcttt

SEQ ID NO: 7739564 - DNA, 22 bp, Homo sapiens
ggactgggtaggagcccagggc

SEQ ID NO: 7739565 - DNA, 23 bp, Homo sapiens
ggaagctcacgtagtcctgcact

SEQ ID NO: 7739566 - DNA, 22 bp, Homo sapiens
caaggctgtctccagcttccaa

SEQ ID NO: 7739567 - DNA, 22 bp, Homo sapiens
caatagcaggtctacagagaga

SEQ ID NO: 7739568 - DNA, 22 bp, Homo sapiens
caattgaacagatgagttaaat

SEQ ID NO: 7739569 - DNA, 22 bp, Homo sapiens
caatcacaaagagacaagtgtc

SEQ ID NO: 7739570 - DNA, 22 bp, Homo sapiens
cctggagggaccctggccctgt

SEQ ID NO: 7739571 - DNA, 22 bp, Homo sapiens
cctggagcttttccatcctgga

SEQ ID NO: 7739572 - DNA, 22 bp, Homo sapiens
cctggaggagcgctgaccagct

SEQ ID NO: 7739573 - DNA, 22 bp, Homo sapiens
cctggagggcgccgcacagtcc

SEQ ID NO: 7739574 - DNA, 22 bp, Homo sapiens
cctggagcactctccctggctg

SEQ ID NO: 7739575 - DNA, 22 bp, Homo sapiens
tggtctgggcaaatccttctga

SEQ ID NO: 7739576 - DNA, 20 bp, Homo sapiens
tggtctggagccagtgagga

SEQ ID NO: 7739577 - DNA, 22 bp, Homo sapiens
tggtctggggaccgagggttac

SEQ ID NO: 7739578 - DNA, 17 bp, Homo sapiens
tggtctggaagaactga

SEQ ID NO: 7739579 - DNA, 22 bp, Homo sapiens
tggtctgaggaacaccagcact

SEQ ID NO: 7739580 - DNA, 22 bp, Homo sapiens
tggtctcttcttccaagatggc

SEQ ID NO: 7739581 - DNA, 22 bp, Homo sapiens
cctgaggccctggctgtgctga

SEQ ID NO: 7739582 - DNA, 22 bp, Homo sapiens
cctgaggccctggctgtgctga

SEQ ID NO: 7739583 - DNA, 22 bp, Homo sapiens
cctgaggctccacctccagaga

SEQ ID NO: 7739584 - DNA, 22 bp, Homo sapiens
cctgaggctcgcgcgcccctgg

SEQ ID NO: 7739585 - DNA, 22 bp, Homo sapiens
cctgaggctggcccttccatcc

SEQ ID NO: 7739586 - DNA, 22 bp, Homo sapiens
cctgaggcttgggagttccgcc

SEQ ID NO: 7739587 - DNA, 22 bp, Homo sapiens
cctgaggcttaatctgtcccaa

SEQ ID NO: 7739588 - DNA, 22 bp, Homo sapiens
cctgccaggagctggtgctgca

SEQ ID NO: 7739589 - DNA, 22 bp, Homo sapiens
cctgatgtccataatcctgtaa

SEQ ID NO: 7739590 - DNA, 22 bp, Homo sapiens
cctctttgactatagtagttaa

SEQ ID NO: 7739591 - DNA, 22 bp, Homo sapiens
cctctttgacaagtacctgccc

SEQ ID NO: 7739592 - DNA, 22 bp, Homo sapiens
cctctttgagattcagttttcc

SEQ ID NO: 7739593 - DNA, 22 bp, Homo sapiens
cctctttgactctcaggtcttt

SEQ ID NO: 7739594 - DNA, 22 bp, Homo sapiens
cctctttgttcaggctgctggc

SEQ ID NO: 7739595 - DNA, 22 bp, Homo sapiens
cctctttgtgcctgcaggctgc

SEQ ID NO: 7739596 - DNA, 21 bp, Homo sapiens
tgggccagatctgagtttcta

SEQ ID NO: 7739597 - DNA, 22 bp, Homo sapiens
tgggccagaggcatggagctat

SEQ ID NO: 7739598 - DNA, 22 bp, Homo sapiens
cctctggccagagaaaggccag

SEQ ID NO: 7739599 - DNA, 22 bp, Homo sapiens
cctctggccatcccccattaag

SEQ ID NO: 7739600 - DNA, 22 bp, Homo sapiens
cctctggccacatgggacatag

SEQ ID NO: 7739601 - DNA, 22 bp, Homo sapiens
cctctggccattctttgatgga

SEQ ID NO: 7739602 - DNA, 22 bp, Homo sapiens
cctctggccattctttgatgga

SEQ ID NO: 7739603 - DNA, 22 bp, Homo sapiens
cctctggcctaggccgggagag

SEQ ID NO: 7739604 - DNA, 23 bp, Homo sapiens
tgggccactatagaaatctctca

SEQ ID NO: 7739605 - DNA, 22 bp, Homo sapiens
tgggccactcttccctgggtct

SEQ ID NO: 7739606 - DNA, 22 bp, Homo sapiens
tgggccactgctccaagtagct

SEQ ID NO: 7739607 - DNA, 22 bp, Homo sapiens
tgggccactgctgcggaaggcg

SEQ ID NO: 7739608 - DNA, 22 bp, Homo sapiens
cctctggctcacagcaccaact

SEQ ID NO: 7739609 - DNA, 16 bp, Homo sapiens
cctctggcaattagat

SEQ ID NO: 7739610 - DNA, 22 bp, Homo sapiens
cctctggcaagtgatttatcat

SEQ ID NO: 7739611 - DNA, 22 bp, Homo sapiens
cctctggcagccagccagttgt

SEQ ID NO: 7739612 - DNA, 22 bp, Homo sapiens
cctctggcatagcaagtggcct

SEQ ID NO: 7739613 - DNA, 22 bp, Homo sapiens
cctctggcatagcaagtggcct

SEQ ID NO: 7739614 - DNA, 22 bp, Homo sapiens
cctctggcaacttcacagccca

SEQ ID NO: 7739615 - DNA, 21 bp, Homo sapiens
tggctctgaaagagtgctgca

SEQ ID NO: 7739616 - DNA, 21 bp, Homo sapiens
tgggagagcgttgctgtcctc

SEQ ID NO: 7739617 - DNA, 22 bp, Homo sapiens
tggctctgaccaggtagaggag

SEQ ID NO: 7739618 - DNA, 22 bp, Homo sapiens
ccctgctcttagtgcctgtgtg

SEQ ID NO: 7739619 - DNA, 22 bp, Homo sapiens
tggaggtacataatgagagggt

SEQ ID NO: 7739620 - DNA, 22 bp, Homo sapiens
tgcctgcctaggaagctgtgaa

SEQ ID NO: 7739621 - DNA, 22 bp, Homo sapiens
tgcctgcctctggagcccatcc

SEQ ID NO: 7739622 - DNA, 22 bp, Homo sapiens
tgcctgccttgctgctggacag

SEQ ID NO: 7739623 - DNA, 22 bp, Homo sapiens
tgctttatttataaaatagcaa

SEQ ID NO: 7739624 - DNA, 21 bp, Homo sapiens
tggaaggctgctctgccaggg

SEQ ID NO: 7739625 - DNA, 22 bp, Homo sapiens
tggaaggcttggaatacttcca

SEQ ID NO: 7739626 - DNA, 17 bp, Homo sapiens
tggaaggcttcaatatt

SEQ ID NO: 7739627 - DNA, 20 bp, Homo sapiens
tggaaggcatctgcattatt

SEQ ID NO: 7739628 - DNA, 17 bp, Homo sapiens
cccgttctcttcgctgg

SEQ ID NO: 7739629 - DNA, 22 bp, Homo sapiens
cctcacccagtcacctaggtgg

SEQ ID NO: 7739630 - DNA, 22 bp, Homo sapiens
ccgggcctcgggacaccgggta

SEQ ID NO: 7739631 - DNA, 22 bp, Homo sapiens
ccggctactcgggaggctgacg

SEQ ID NO: 7739632 - DNA, 22 bp, Homo sapiens
ccggtcccaggtgccccggtga

SEQ ID NO: 7739633 - DNA, 22 bp, Homo sapiens
ccgtggtcacctgagctccttg

SEQ ID NO: 7739634 - DNA, 22 bp, Homo sapiens
ccctgtggcaggaggaggagca

SEQ ID NO: 7739635 - DNA, 22 bp, Homo sapiens
cctcagctgcttccctggagcc

SEQ ID NO: 7739636 - DNA, 22 bp, Homo sapiens
tggcctcagatttcaggggtgg

SEQ ID NO: 7739637 - DNA, 22 bp, Homo sapiens
tggcctcaccactagctgggtg

SEQ ID NO: 7739638 - DNA, 22 bp, Homo sapiens
tggcctcagattattgcacagt

SEQ ID NO: 7739639 - DNA, 22 bp, Homo sapiens
tggcctcaaccgtcctaagcac

SEQ ID NO: 7739640 - DNA, 22 bp, Homo sapiens
tggcctcaagtctgagggcctt

SEQ ID NO: 7739641 - DNA, 22 bp, Homo sapiens
cctcactcttgtcctggcaggt

SEQ ID NO: 7739642 - DNA, 22 bp, Homo sapiens
cctcactcttgtcctggcaggt

SEQ ID NO: 7739643 - DNA, 22 bp, Homo sapiens
cctcactctgcaccctgcagca

SEQ ID NO: 7739644 - DNA, 22 bp, Homo sapiens
cctccctctgttagagctgtct

SEQ ID NO: 7739645 - DNA, 22 bp, Homo sapiens
cctcccgtatatgtcctgggct

SEQ ID NO: 7739646 - DNA, 22 bp, Homo sapiens
cccaggactcggcactctcctt

SEQ ID NO: 7739647 - DNA, 22 bp, Homo sapiens
cccaggactaatgagctctacg

SEQ ID NO: 7739648 - DNA, 22 bp, Homo sapiens
cccaggaccatccttctgtgcc

SEQ ID NO: 7739649 - DNA, 22 bp, Homo sapiens
cccaggactctgacacccccaa

SEQ ID NO: 7739650 - DNA, 22 bp, Homo sapiens
cccaggactcttcactgcagcc

SEQ ID NO: 7739651 - DNA, 22 bp, Homo sapiens
tgcagtggaagaggtggagatc

SEQ ID NO: 7739652 - DNA, 22 bp, Homo sapiens
tgcagtggaaagactcagactt

SEQ ID NO: 7739653 - DNA, 18 bp, Homo sapiens
tgcagcatgttcccataa

SEQ ID NO: 7739654 - DNA, 22 bp, Homo sapiens
tgcagcattatgtagctgtttt

SEQ ID NO: 7739655 - DNA, 22 bp, Homo sapiens
tgcagcattgcaaagcagtctt

SEQ ID NO: 7739656 - DNA, 22 bp, Homo sapiens
tgcagcatttgctgaagcagga

SEQ ID NO: 7739657 - DNA, 22 bp, Homo sapiens
cccagcccacggtcctgggtgg

SEQ ID NO: 7739658 - DNA, 22 bp, Homo sapiens
cccagcccagcgttcgaggggt

SEQ ID NO: 7739659 - DNA, 22 bp, Homo sapiens
tgccctcattataagaggctca

SEQ ID NO: 7739660 - DNA, 22 bp, Homo sapiens
tgccctctcaagttgagtcaga

SEQ ID NO: 7739661 - DNA, 22 bp, Homo sapiens
tgccctcttaggtctgcgcagc

SEQ ID NO: 7739662 - DNA, 22 bp, Homo sapiens
tgccctctttctgtacagctcc

SEQ ID NO: 7739663 - DNA, 23 bp, Homo sapiens
tgcctcagtggaatgtgagggtg

SEQ ID NO: 7739664 - DNA, 22 bp, Homo sapiens
tgccctggttacactggagtcc

SEQ ID NO: 7739665 - DNA, 22 bp, Homo sapiens
tgaggcagtattttagtgactt

SEQ ID NO: 7739666 - DNA, 22 bp, Homo sapiens
tgaggcagtcaccccctcctgc

SEQ ID NO: 7739667 - DNA, 18 bp, Homo sapiens
tgaggcagtcagtgatgg

SEQ ID NO: 7739668 - DNA, 22 bp, Homo sapiens
tgatgaattagtaacaaatgag

SEQ ID NO: 7739669 - DNA, 22 bp, Homo sapiens
cccaagagatcgcatgtagttg

SEQ ID NO: 7739670 - DNA, 22 bp, Homo sapiens
tgattcaactttcataacaaaa

SEQ ID NO: 7739671 - DNA, 22 bp, Homo sapiens
ccatggccaggaaagccaaggt

SEQ ID NO: 7739672 - DNA, 21 bp, Homo sapiens
cccaccccataaggcagaacc

SEQ ID NO: 7739673 - DNA, 22 bp, Homo sapiens
cccacatttttgagtcttcatc

SEQ ID NO: 7739674 - DNA, 22 bp, Homo sapiens
tgcagcagtcagtcaggcctgg

SEQ ID NO: 7739675 - DNA, 22 bp, Homo sapiens
cccagagatcttgtcctttcca

SEQ ID NO: 7739676 - DNA, 22 bp, Homo sapiens
cccagagaattccacatagagg

SEQ ID NO: 7739677 - DNA, 22 bp, Homo sapiens
cccagagaatctttcagaaagg

SEQ ID NO: 7739678 - DNA, 22 bp, Homo sapiens
cccagagaagtgaagtgacttg

SEQ ID NO: 7739679 - DNA, 22 bp, Homo sapiens
ccaggtctatcaagttgggctc

SEQ ID NO: 7739680 - DNA, 22 bp, Homo sapiens
tgagaggtgaggcatgaggcat

SEQ ID NO: 7739681 - DNA, 19 bp, Homo sapiens
tgagactgggtgcagtact

SEQ ID NO: 7739682 - DNA, 22 bp, Homo sapiens
tgagctgggctgggctgagctg

SEQ ID NO: 7739683 - DNA, 22 bp, Homo sapiens
tgagctgggctgggctgagctg

SEQ ID NO: 7739684 - DNA, 22 bp, Homo sapiens
tgaggaagttgtttctcttcta

SEQ ID NO: 7739685 - DNA, 22 bp, Homo sapiens
tgaggaatgctgagcagaggaa

SEQ ID NO: 7739686 - DNA, 22 bp, Homo sapiens
tgagcagaaaagaatgctgagc

SEQ ID NO: 7739687 - DNA, 22 bp, Homo sapiens
tgagcagacttgatgaggcagc

SEQ ID NO: 7739688 - DNA, 22 bp, Homo sapiens
tgagctgggaagagcagccaga

SEQ ID NO: 7739689 - DNA, 19 bp, Homo sapiens
tgagctggctgagcctctc

SEQ ID NO: 7739690 - DNA, 22 bp, Homo sapiens
tgagctggcacttttcctggga

SEQ ID NO: 7739691 - DNA, 19 bp, Homo sapiens
tgagctggctgagcctctc

SEQ ID NO: 7739692 - DNA, 22 bp, Homo sapiens
tgagctggcaggggctcaggga

SEQ ID NO: 7739693 - DNA, 22 bp, Homo sapiens
ccagggaaaatcaacttctact

SEQ ID NO: 7739694 - DNA, 22 bp, Homo sapiens
ccaggctttgtaccaggctttc

SEQ ID NO: 7739695 - DNA, 22 bp, Homo sapiens
ccaggcttttagctgcatggca

SEQ ID NO: 7739696 - DNA, 21 bp, Homo sapiens
tgaaggagaggaccgagtgct

SEQ ID NO: 7739697 - DNA, 22 bp, Homo sapiens
tgaaggagaattaataggcatt

SEQ ID NO: 7739698 - DNA, 21 bp, Homo sapiens
tgaaggagaggaccgagtgct

SEQ ID NO: 7739699 - DNA, 22 bp, Homo sapiens
ccagggtctctgctgcctgaga

SEQ ID NO: 7739700 - DNA, 22 bp, Homo sapiens
tgaccccactgtgctcagaggt

SEQ ID NO: 7739701 - DNA, 19 bp, Homo sapiens
tgaccccacgctccagagc

SEQ ID NO: 7739702 - DNA, 22 bp, Homo sapiens
ccaggcgtggcttcagcagccc

SEQ ID NO: 7739703 - DNA, 22 bp, Homo sapiens
ccagcccttgctgaagggtggc

SEQ ID NO: 7739704 - DNA, 22 bp, Homo sapiens
ccagcccttgagatggaaggga

SEQ ID NO: 7739705 - DNA, 22 bp, Homo sapiens
tcttgtcctaagagctggattc

SEQ ID NO: 7739706 - DNA, 22 bp, Homo sapiens
ccaggctccgcatagaccccac

SEQ ID NO: 7739707 - DNA, 22 bp, Homo sapiens
ccaggctgcagtcaaggggcat

SEQ ID NO: 7739708 - DNA, 22 bp, Homo sapiens
ccaggctgagcatgattggagc

SEQ ID NO: 7739709 - DNA, 22 bp, Homo sapiens
ccaggctgctcacaagctgccc

SEQ ID NO: 7739710 - DNA, 22 bp, Homo sapiens
tgaaggagaaatggaaagtggg

SEQ ID NO: 7739711 - DNA, 22 bp, Homo sapiens
tctcaaatttatacagagttca

SEQ ID NO: 7739712 - DNA, 22 bp, Homo sapiens
tctcaaatttgttagataaaat

SEQ ID NO: 7739713 - DNA, 22 bp, Homo sapiens
tctcaagcttgttggtatgttt

SEQ ID NO: 7739714 - DNA, 19 bp, Homo sapiens
ccactttgcttctctgggt

SEQ ID NO: 7739715 - DNA, 22 bp, Homo sapiens
ccactttgaaccactgaggtgg

SEQ ID NO: 7739716 - DNA, 19 bp, Homo sapiens
tctccagctttgggctttt

SEQ ID NO: 7739717 - DNA, 22 bp, Homo sapiens
ccacatttcttcacttgtccca

SEQ ID NO: 7739718 - DNA, 22 bp, Homo sapiens
tcctgactccaggtcctgtgtg

SEQ ID NO: 7739719 - DNA, 22 bp, Homo sapiens
tcctctctgcactggccctgcc

SEQ ID NO: 7739720 - DNA, 22 bp, Homo sapiens
tcctgaagtatgggtatggagt

SEQ ID NO: 7739721 - DNA, 21 bp, Homo sapiens
tcctctgcagtgaggtggcct

SEQ ID NO: 7739722 - DNA, 22 bp, Homo sapiens
tcggagctgtagatgaaaccct

SEQ ID NO: 7739723 - DNA, 22 bp, Homo sapiens
tcgctgtgaaaaccttggacaa

SEQ ID NO: 7739724 - DNA, 22 bp, Homo sapiens
ccaccagcttcagcagccgcgg

SEQ ID NO: 7739725 - DNA, 22 bp, Homo sapiens
ccagcccttagataaacctggc

SEQ ID NO: 7739726 - DNA, 22 bp, Homo sapiens
ccagccctgcctctcagggccc

SEQ ID NO: 7739727 - DNA, 22 bp, Homo sapiens
tctgagagtctctgaggcagat

SEQ ID NO: 7739728 - DNA, 19 bp, Homo sapiens
tctgaagtccagggcatac

SEQ ID NO: 7739729 - DNA, 22 bp, Homo sapiens
ccagcatccatgctccctcggg

SEQ ID NO: 7739730 - DNA, 22 bp, Homo sapiens
ccagcatctaacgctcctggga

SEQ ID NO: 7739731 - DNA, 22 bp, Homo sapiens
ccagcatcagcacccaaggagc

SEQ ID NO: 7739732 - DNA, 22 bp, Homo sapiens
tctctgagttttaaggatgatg

SEQ ID NO: 7739733 - DNA, 23 bp, Homo sapiens
tctctgcatgtcctgagcacatc

SEQ ID NO: 7739734 - DNA, 23 bp, Homo sapiens
tctcctggctgcactgtggccac

SEQ ID NO: 7739735 - DNA, 22 bp, Homo sapiens
tctctgggagttgagcagcagc

SEQ ID NO: 7739736 - DNA, 21 bp, Homo sapiens
tctctgggaggacttgtgaga

SEQ ID NO: 7739737 - DNA, 22 bp, Homo sapiens
tctctgggagcaattgtttgct

SEQ ID NO: 7739738 - DNA, 22 bp, Homo sapiens
tctctgggagccaggatgacac

SEQ ID NO: 7739739 - DNA, 22 bp, Homo sapiens
tctctgggaattttttggacat

SEQ ID NO: 7739740 - DNA, 22 bp, Homo sapiens
tctctgggacactgggtcagtt

SEQ ID NO: 7739741 - DNA, 22 bp, Homo sapiens
tctctgggaattcacaagccct

SEQ ID NO: 7739742 - DNA, 22 bp, Homo sapiens
tctctgggaattcacaagccct

SEQ ID NO: 7739743 - DNA, 22 bp, Homo sapiens
tctctgggaatgggcctgggta

SEQ ID NO: 7739744 - DNA, 22 bp, Homo sapiens
ccagcagctttattggctctcc

SEQ ID NO: 7739745 - DNA, 22 bp, Homo sapiens
ccagcagagggtcttggccatt

SEQ ID NO: 7739746 - DNA, 20 bp, Homo sapiens
catttgggatcatgaggttt

SEQ ID NO: 7739747 - DNA, 22 bp, Homo sapiens
catttggaccaaaatagccaac

SEQ ID NO: 7739748 - DNA, 22 bp, Homo sapiens
tcccaggaggtgcttcctagga

SEQ ID NO: 7739749 - DNA, 22 bp, Homo sapiens
cattgaaatatggaaactgatg

SEQ ID NO: 7739750 - DNA, 22 bp, Homo sapiens
cattgcaacttcaaactcctgg

SEQ ID NO: 7739751 - DNA, 22 bp, Homo sapiens
cattcacaatggattgcttcaa

SEQ ID NO: 7739752 - DNA, 22 bp, Homo sapiens
cattcacaaaaccacatgccat

SEQ ID NO: 7739753 - DNA, 22 bp, Homo sapiens
tcccagagcctctgccactctg

SEQ ID NO: 7739754 - DNA, 22 bp, Homo sapiens
tcccagagctgataagccttta

SEQ ID NO: 7739755 - DNA, 22 bp, Homo sapiens
tcccagagctctggaggttgga

SEQ ID NO: 7739756 - DNA, 22 bp, Homo sapiens
tcccagagctctgacaccagct

SEQ ID NO: 7739757 - DNA, 22 bp, Homo sapiens
tccaggctcccctgcgtgctcc

SEQ ID NO: 7739758 - DNA, 19 bp, Homo sapiens
tccagactgtccaggctat

SEQ ID NO: 7739759 - DNA, 22 bp, Homo sapiens
tccacattatgtttctcctttc

SEQ ID NO: 7739760 - DNA, 21 bp, Homo sapiens
tccaagccttcaacacattca

SEQ ID NO: 7739761 - DNA, 22 bp, Homo sapiens
tcattccatttccagctctgaa

SEQ ID NO: 7739762 - DNA, 20 bp, Homo sapiens
tcattccaaatagttcagca

SEQ ID NO: 7739763 - DNA, 22 bp, Homo sapiens
catctttgttctgtaaactttt

SEQ ID NO: 7739764 - DNA, 22 bp, Homo sapiens
tcagactgctgtccctgcctgg

SEQ ID NO: 7739765 - DNA, 22 bp, Homo sapiens
cagtgtctccagatgctccaat

SEQ ID NO: 7739766 - DNA, 22 bp, Homo sapiens
cagttaaacgggccatgtgagt

SEQ ID NO: 7739767 - DNA, 22 bp, Homo sapiens
cagttaccagatcgcaggaggt

SEQ ID NO: 7739768 - DNA, 22 bp, Homo sapiens
cagtttaggtcatccttgcttt

SEQ ID NO: 7739769 - DNA, 21 bp, Homo sapiens
tcaggaaacacctcttaagga

SEQ ID NO: 7739770 - DNA, 22 bp, Homo sapiens
cagtgagagagaacgcattcat

SEQ ID NO: 7739771 - DNA, 21 bp, Homo sapiens
tcacagactggtcagtgaggc

SEQ ID NO: 7739772 - DNA, 20 bp, Homo sapiens
tcacaggagggaaggcaggt

SEQ ID NO: 7739773 - DNA, 22 bp, Homo sapiens
tatttcttgttccctccaagtt

SEQ ID NO: 7739774 - DNA, 22 bp, Homo sapiens
caggtttctagttctaagaata

SEQ ID NO: 7739775 - DNA, 22 bp, Homo sapiens
caggttctggagatgcagagat

SEQ ID NO: 7739776 - DNA, 22 bp, Homo sapiens
caggttctcagaaggcagtcac

SEQ ID NO: 7739777 - DNA, 22 bp, Homo sapiens
caggttcagcaggaggcatccc

SEQ ID NO: 7739778 - DNA, 22 bp, Homo sapiens
tagataaattagaaagtttact

SEQ ID NO: 7739779 - DNA, 19 bp, Homo sapiens
tagataaggcatttaatct

SEQ ID NO: 7739780 - DNA, 22 bp, Homo sapiens
tagcattccttgtggcttctga

SEQ ID NO: 7739781 - DNA, 22 bp, Homo sapiens
tagagctggaatttgcagcaag

SEQ ID NO: 7739782 - DNA, 22 bp, Homo sapiens
tagataaaagggcaaagggcat

SEQ ID NO: 7739783 - DNA, 22 bp, Homo sapiens
tagataaattagaaagtttact

SEQ ID NO: 7739784 - DNA, 19 bp, Homo sapiens
tagaggagaagggaagtgg

SEQ ID NO: 7739785 - DNA, 22 bp, Homo sapiens
caggctgggctggtgttagagt

SEQ ID NO: 7739786 - DNA, 22 bp, Homo sapiens
caggctgggctccggagataaa

SEQ ID NO: 7739787 - DNA, 22 bp, Homo sapiens
tagaatcaagcagtagagcaga

SEQ ID NO: 7739788 - DNA, 21 bp, Homo sapiens
tagaatcactaataagatgta

SEQ ID NO: 7739789 - DNA, 22 bp, Homo sapiens
caggctggagtgagtgtagtgg

SEQ ID NO: 7739790 - DNA, 22 bp, Homo sapiens
gtgaggggccaagagtagggca

SEQ ID NO: 7739791 - DNA, 22 bp, Homo sapiens
gtgagggcaaattagaatcaaa

SEQ ID NO: 7739792 - DNA, 22 bp, Homo sapiens
gtgaggggtggctgagcagttt

SEQ ID NO: 7739793 - DNA, 22 bp, Homo sapiens
tagctcctggctgcagggcctc

SEQ ID NO: 7739794 - DNA, 22 bp, Homo sapiens
taggaacacacatgtgtagctg

SEQ ID NO: 7739795 - DNA, 22 bp, Homo sapiens
taggaaattttactggtctggg

SEQ ID NO: 7739796 - DNA, 22 bp, Homo sapiens
taggaaattggaaactcttcac

SEQ ID NO: 7739797 - DNA, 22 bp, Homo sapiens
taggaaattagaacttggaaac

SEQ ID NO: 7739798 - DNA, 22 bp, Homo sapiens
taggaaattgacacctgcttga

SEQ ID NO: 7739799 - DNA, 22 bp, Homo sapiens
cagggcctgcttccttcttgtt

SEQ ID NO: 7739800 - DNA, 22 bp, Homo sapiens
taggagcctgctctgcagggac

SEQ ID NO: 7739801 - DNA, 22 bp, Homo sapiens
taggagaggtgaatggcacact

SEQ ID NO: 7739802 - DNA, 22 bp, Homo sapiens
taggagagctgaactattgtct

SEQ ID NO: 7739803 - DNA, 22 bp, Homo sapiens
tatcatcttgttgtcatgcagc

SEQ ID NO: 7739804 - DNA, 22 bp, Homo sapiens
tatcatctgcaaagcacatcta

SEQ ID NO: 7739805 - DNA, 22 bp, Homo sapiens
tagggtcctcatctgtaaatga

SEQ ID NO: 7739806 - DNA, 22 bp, Homo sapiens
tagggtcctgcctacagagaca

SEQ ID NO: 7739807 - DNA, 22 bp, Homo sapiens
tagggtcccagataggagccag

SEQ ID NO: 7739808 - DNA, 22 bp, Homo sapiens
tagggtccatatggatgaatgg

SEQ ID NO: 7739809 - DNA, 22 bp, Homo sapiens
tagggtccaagccttataatta

SEQ ID NO: 7739810 - DNA, 22 bp, Homo sapiens
tagggccagataggcttcttga

SEQ ID NO: 7739811 - DNA, 22 bp, Homo sapiens
cagggctttttattagctgcct

SEQ ID NO: 7739812 - DNA, 22 bp, Homo sapiens
cagggctttgtgtgcctgggga

SEQ ID NO: 7739813 - DNA, 22 bp, Homo sapiens
cagggctttcctgagaagtgat

SEQ ID NO: 7739814 - DNA, 22 bp, Homo sapiens
cagggctttcctgagaagtgat

SEQ ID NO: 7739815 - DNA, 22 bp, Homo sapiens
cagggcttggttggaaccaccc

SEQ ID NO: 7739816 - DNA, 22 bp, Homo sapiens
cagggcttggatctgtggtcag

SEQ ID NO: 7739817 - DNA, 22 bp, Homo sapiens
caggggaagatgccaagggaga

SEQ ID NO: 7739818 - DNA, 22 bp, Homo sapiens
taggtagggaccaccttgggga

SEQ ID NO: 7739819 - DNA, 22 bp, Homo sapiens
ctgctgtgagtttggaggtcta

SEQ ID NO: 7739820 - DNA, 22 bp, Homo sapiens
ctgctgtctagtatcttaaaaa

SEQ ID NO: 7739821 - DNA, 22 bp, Homo sapiens
ctgctgtgagtggttcttgcct

SEQ ID NO: 7739822 - DNA, 22 bp, Homo sapiens
ctgcctgtggtctgtgatctaa

SEQ ID NO: 7739823 - DNA, 22 bp, Homo sapiens
ctgcctgtggtctgtgatctaa

SEQ ID NO: 7739824 - DNA, 22 bp, Homo sapiens
ctgcctgtttcctcttgctccc

SEQ ID NO: 7739825 - DNA, 22 bp, Homo sapiens
ctgctctgtggtccatgagaca

SEQ ID NO: 7739826 - DNA, 22 bp, Homo sapiens
ctgctctgtatatgagcaggaa

SEQ ID NO: 7739827 - DNA, 22 bp, Homo sapiens
ctgctctgtttcttagctgggt

SEQ ID NO: 7739828 - DNA, 21 bp, Homo sapiens
ctgctctgacagtgaggccag

SEQ ID NO: 7739829 - DNA, 22 bp, Homo sapiens
ctgctgggtctatgcaagtgga

SEQ ID NO: 7739830 - DNA, 22 bp, Homo sapiens
ctgctggtaccagtggccgtca

SEQ ID NO: 7739831 - DNA, 22 bp, Homo sapiens
ctgctggttagtcttagtggga

SEQ ID NO: 7739832 - DNA, 22 bp, Homo sapiens
ctgctggtgcagagtggggctg

SEQ ID NO: 7739833 - DNA, 22 bp, Homo sapiens
ctgctggtgatgtctgggcatg

SEQ ID NO: 7739834 - DNA, 21 bp, Homo sapiens
ctgcccatttgtgatgtcccc

SEQ ID NO: 7739835 - DNA, 22 bp, Homo sapiens
ctgcccaggggagtgctgtcgg

SEQ ID NO: 7739836 - DNA, 22 bp, Homo sapiens
ctgcccccaggctgcatggctg

SEQ ID NO: 7739837 - DNA, 21 bp, Homo sapiens
ctgcaggatgctgaagccagg

SEQ ID NO: 7739838 - DNA, 22 bp, Homo sapiens
ctgcagctgtctctactgggca

SEQ ID NO: 7739839 - DNA, 22 bp, Homo sapiens
ctgaggccgttggtgggcctta

SEQ ID NO: 7739840 - DNA, 22 bp, Homo sapiens
ctgagccaaaaagcagagcttg

SEQ ID NO: 7739841 - DNA, 22 bp, Homo sapiens
ctgagccaaaaagcagagcttg

SEQ ID NO: 7739842 - DNA, 22 bp, Homo sapiens
ctgagccaaaaagcagagcttg

SEQ ID NO: 7739843 - DNA, 22 bp, Homo sapiens
ctgaggctgcccagggccaggt

SEQ ID NO: 7739844 - DNA, 22 bp, Homo sapiens
ctgaggctgaagagggcctacg

SEQ ID NO: 7739845 - DNA, 22 bp, Homo sapiens
ctcttcctacagtctgctatgc

SEQ ID NO: 7739846 - DNA, 22 bp, Homo sapiens
ctcttcctctcatgcggtcata

SEQ ID NO: 7739847 - DNA, 22 bp, Homo sapiens
ctcttccttaagactataaaga

SEQ ID NO: 7739848 - DNA, 22 bp, Homo sapiens
ctgagcagcgtggggagctggc

SEQ ID NO: 7739849 - DNA, 22 bp, Homo sapiens
ctgagcagaagggtgcacgtgc

SEQ ID NO: 7739850 - DNA, 19 bp, Homo sapiens
ctgagcagcggcagcactt

SEQ ID NO: 7739851 - DNA, 19 bp, Homo sapiens
ctgagcagcggcagcactt

SEQ ID NO: 7739852 - DNA, 22 bp, Homo sapiens
ctgagcagtagagggtctcttt

SEQ ID NO: 7739853 - DNA, 22 bp, Homo sapiens
ctgagcagtgctttgcagtggg

SEQ ID NO: 7739854 - DNA, 22 bp, Homo sapiens
ctgagcagtggttcttgagcgc

SEQ ID NO: 7739855 - DNA, 22 bp, Homo sapiens
ctctgggtgtgacagcacctgg

SEQ ID NO: 7739856 - DNA, 22 bp, Homo sapiens
ctctgggtctccctgaggctaa

SEQ ID NO: 7739857 - DNA, 22 bp, Homo sapiens
ctctgggtctataatgcagctg

SEQ ID NO: 7739858 - DNA, 22 bp, Homo sapiens
ctctgggtctacctgtggccag

SEQ ID NO: 7739859 - DNA, 20 bp, Homo sapiens
ctctgggtcgagacagactt

SEQ ID NO: 7739860 - DNA, 22 bp, Homo sapiens
ctctgggtcctggggctacaag

SEQ ID NO: 7739861 - DNA, 22 bp, Homo sapiens
ctctgggtgggcagcagatgga

SEQ ID NO: 7739862 - DNA, 22 bp, Homo sapiens
ctctgggtgtcttaggagctca

SEQ ID NO: 7739863 - DNA, 22 bp, Homo sapiens
ctctgggtggtctcactgagtg

SEQ ID NO: 7739864 - DNA, 22 bp, Homo sapiens
tttggaattccatttctgcatt

SEQ ID NO: 7739865 - DNA, 19 bp, Homo sapiens
ctctgggctgcatcttggt

SEQ ID NO: 7739866 - DNA, 20 bp, Homo sapiens
ctctgggctgcaccctcgcc

SEQ ID NO: 7739867 - DNA, 22 bp, Homo sapiens
tttggaattatgcttaaagttt

SEQ ID NO: 7739868 - DNA, 22 bp, Homo sapiens
tttggaatggtaccttcagttg

SEQ ID NO: 7739869 - DNA, 22 bp, Homo sapiens
tttggaatggaatagagattgc

SEQ ID NO: 7739870 - DNA, 22 bp, Homo sapiens
tttggaatgtagtttaatcatc

SEQ ID NO: 7739871 - DNA, 22 bp, Homo sapiens
tttggaatgaaacagcagagcc

SEQ ID NO: 7739872 - DNA, 22 bp, Homo sapiens
ctctgtgcttatgctccatggg

SEQ ID NO: 7739873 - DNA, 22 bp, Homo sapiens
ttttgcctagggttgacccgtt

SEQ ID NO: 7739874 - DNA, 22 bp, Homo sapiens
ttttgcctgagagtgaaaataa

SEQ ID NO: 7739875 - DNA, 22 bp, Homo sapiens
ttttgcctgagatccgagtctg

SEQ ID NO: 7739876 - DNA, 22 bp, Homo sapiens
ttttgcctgcactgtatatata

SEQ ID NO: 7739877 - DNA, 22 bp, Homo sapiens
ttttgcctgtgaatactatctt

SEQ ID NO: 7739878 - DNA, 22 bp, Homo sapiens
ctctggcctgcttcctcaggta

SEQ ID NO: 7739879 - DNA, 22 bp, Homo sapiens
ctctggccccagtggccccttg

SEQ ID NO: 7739880 - DNA, 22 bp, Homo sapiens
ctctggcacactccttccaggt

SEQ ID NO: 7739881 - DNA, 22 bp, Homo sapiens
ctctggagtgggtggccgggag

SEQ ID NO: 7739882 - DNA, 22 bp, Homo sapiens
tttgacttctgggcattttggt

SEQ ID NO: 7739883 - DNA, 22 bp, Homo sapiens
ctccaggatgttagacgtccag

SEQ ID NO: 7739884 - DNA, 22 bp, Homo sapiens
ctccaggaggttgctgcttcct

SEQ ID NO: 7739885 - DNA, 22 bp, Homo sapiens
ctccttcatgtcatgtgtccgg

SEQ ID NO: 7739886 - DNA, 22 bp, Homo sapiens
ctccttcagctgaatccctgct

SEQ ID NO: 7739887 - DNA, 22 bp, Homo sapiens
tttcagaatagcaaagcaagct

SEQ ID NO: 7739888 - DNA, 22 bp, Homo sapiens
tttcagaaccaagagagacatc

SEQ ID NO: 7739889 - DNA, 22 bp, Homo sapiens
tttctacagaagatacactgct

SEQ ID NO: 7739890 - DNA, 22 bp, Homo sapiens
ctctctggtttcagcgaagggg

SEQ ID NO: 7739891 - DNA, 19 bp, Homo sapiens
ctctctggcggtgtctgcg

SEQ ID NO: 7739892 - DNA, 18 bp, Homo sapiens
ctctctggtctggatccc

SEQ ID NO: 7739893 - DNA, 22 bp, Homo sapiens
tttctcaaatactgttccagga

SEQ ID NO: 7739894 - DNA, 22 bp, Homo sapiens
ttctgaagctcccttttgtagt

SEQ ID NO: 7739895 - DNA, 23 bp, Homo sapiens
ttctggaagatttacttgagaca

SEQ ID NO: 7739896 - DNA, 23 bp, Homo sapiens
ttctggatgttctagtctgagag

SEQ ID NO: 7739897 - DNA, 22 bp, Homo sapiens
ctagagctgttctgtgcactca

SEQ ID NO: 7739898 - DNA, 22 bp, Homo sapiens
ctagagcagattgcagagtagg

SEQ ID NO: 7739899 - DNA, 22 bp, Homo sapiens
ctagagggatgttaggatagca

SEQ ID NO: 7739900 - DNA, 22 bp, Homo sapiens
ctagataaggtggcttggaatt

SEQ ID NO: 7739901 - DNA, 22 bp, Homo sapiens
ctagataaggatttctcaactt

SEQ ID NO: 7739902 - DNA, 22 bp, Homo sapiens
ctcagagagttaagtgaattac

SEQ ID NO: 7739903 - DNA, 22 bp, Homo sapiens
ttctttctctactagcagagct

SEQ ID NO: 7739904 - DNA, 22 bp, Homo sapiens
ctatacagagcatccttaactt

SEQ ID NO: 7739905 - DNA, 22 bp, Homo sapiens
ttctggctgaaagtttatttga

SEQ ID NO: 7739906 - DNA, 22 bp, Homo sapiens
ttctggcatgagagatgggggt

SEQ ID NO: 7739907 - DNA, 22 bp, Homo sapiens
ttctggcatctgggggaggcct

SEQ ID NO: 7739908 - DNA, 22 bp, Homo sapiens
ctcacccctgtaattccagcac

SEQ ID NO: 7739909 - DNA, 19 bp, Homo sapiens
ctcacctggaggtgctgat

SEQ ID NO: 7739910 - DNA, 22 bp, Homo sapiens
ctatacagtgactagaagtaat

SEQ ID NO: 7739911 - DNA, 22 bp, Homo sapiens
ctatacagcagcttactagtta

SEQ ID NO: 7739912 - DNA, 19 bp, Homo sapiens
ctatacagcctctgaggaa

SEQ ID NO: 7739913 - DNA, 22 bp, Homo sapiens
ctatacagtaaccacagtgatt

SEQ ID NO: 7739914 - DNA, 22 bp, Homo sapiens
ttggctctgatggggatcagga

SEQ ID NO: 7739915 - DNA, 22 bp, Homo sapiens
ttggctctggaactatttctga

SEQ ID NO: 7739916 - DNA, 22 bp, Homo sapiens
ctccaggactcaggcccctggg

SEQ ID NO: 7739917 - DNA, 22 bp, Homo sapiens
ctccaggacccagtggctccag

SEQ ID NO: 7739918 - DNA, 22 bp, Homo sapiens
ctccaggacactaacccaggct

SEQ ID NO: 7739919 - DNA, 22 bp, Homo sapiens
ctcagtctgtcttgtctgtgtt

SEQ ID NO: 7739920 - DNA, 22 bp, Homo sapiens
ctcagtctcttgggctgtgaag

SEQ ID NO: 7739921 - DNA, 22 bp, Homo sapiens
ctcagtccttatttgcctctac

SEQ ID NO: 7739922 - DNA, 22 bp, Homo sapiens
ctcagtccgtcccgctaggtgc

SEQ ID NO: 7739923 - DNA, 22 bp, Homo sapiens
ctcagtgcagctaggcatgaga

SEQ ID NO: 7739924 - DNA, 22 bp, Homo sapiens
ttggaaggagcctaaaagagac

SEQ ID NO: 7739925 - DNA, 20 bp, Homo sapiens
ttggaaggtggagaagagga

SEQ ID NO: 7739926 - DNA, 22 bp, Homo sapiens
ctcaggtcttagttctgtcatc

SEQ ID NO: 7739927 - DNA, 22 bp, Homo sapiens
ctcagggagtagcacatgtgga

SEQ ID NO: 7739928 - DNA, 22 bp, Homo sapiens
ctcaggaaccgcggcagcagcc

SEQ ID NO: 7739929 - DNA, 22 bp, Homo sapiens
ctcaggaaaatattgaagaagt

SEQ ID NO: 7739930 - DNA, 22 bp, Homo sapiens
ctcaggaaggaagcagggagcc

SEQ ID NO: 7739931 - DNA, 22 bp, Homo sapiens
ctcaggaaccgcggcagcagcc

SEQ ID NO: 7739932 - DNA, 22 bp, Homo sapiens
cgaaatcagcatcttgaggcaa

SEQ ID NO: 7739933 - DNA, 22 bp, Homo sapiens
ttattgcaaaggaagagcttga

SEQ ID NO: 7739934 - DNA, 22 bp, Homo sapiens
ccttttgctctcccatccagaa

SEQ ID NO: 7739935 - DNA, 22 bp, Homo sapiens
ccttttggccaggtcagtgcag

SEQ ID NO: 7739936 - DNA, 22 bp, Homo sapiens
cgctccttgagcgtgtcggcct

SEQ ID NO: 7739937 - DNA, 21 bp, Homo sapiens
cgtgactgggtccgtctggct

SEQ ID NO: 7739938 - DNA, 22 bp, Homo sapiens
cgtggctggtggacctgagggc

SEQ ID NO: 7739939 - DNA, 22 bp, Homo sapiens
ttcaaatcctagccctgtggcc

SEQ ID NO: 7739940 - DNA, 22 bp, Homo sapiens
cggcacagccgggcaaggctgg

SEQ ID NO: 7739941 - DNA, 22 bp, Homo sapiens
ttaaattatttctagtgaggtg

SEQ ID NO: 7739942 - DNA, 21 bp, Homo sapiens
tgtcagagcttgtaggacatt

SEQ ID NO: 7739943 - DNA, 22 bp, Homo sapiens
tgtcagcacatctgtaatcaca

SEQ ID NO: 7739944 - DNA, 22 bp, Homo sapiens
ttaaattattgagggattgtca

SEQ ID NO: 7739945 - DNA, 22 bp, Homo sapiens
ttaaattagtcaagcttctctg

SEQ ID NO: 7739946 - DNA, 22 bp, Homo sapiens
tgtcagcaggacattaaaagct

SEQ ID NO: 7739947 - DNA, 22 bp, Homo sapiens
tgtcagcagtatctctatctca

SEQ ID NO: 7739948 - DNA, 22 bp, Homo sapiens
ttacagttgttctatcagcatg

SEQ ID NO: 7739949 - DNA, 22 bp, Homo sapiens
ccttaaagaataagtcttatct

SEQ ID NO: 7739950 - DNA, 22 bp, Homo sapiens
ccttagtgtgcctgaggcagat

SEQ ID NO: 7739951 - DNA, 22 bp, Homo sapiens
ccttagtgaaacagaggcaatt

SEQ ID NO: 7739952 - DNA, 17 bp, Homo sapiens
ccttagggcagtgtggt

SEQ ID NO: 7739953 - DNA, 20 bp, Homo sapiens
ccttcagaacttacatagta

SEQ ID NO: 7739954 - DNA, 22 bp, Homo sapiens
ccttcaagttcctggtccctgg

SEQ ID NO: 7739955 - DNA, 22 bp, Homo sapiens
ccttcaaggcaaggagggctgg

SEQ ID NO: 7739956 - DNA, 22 bp, Homo sapiens
ttacagtttatccaggaagagc

SEQ ID NO: 7739957 - DNA, 22 bp, Homo sapiens
ttataaagattgttatgtatct

SEQ ID NO: 7739958 - DNA, 22 bp, Homo sapiens
ttataaaggtttgtgcatattt

SEQ ID NO: 7739959 - DNA, 22 bp, Homo sapiens
ttagttttcccatctttatggt

SEQ ID NO: 7739960 - DNA, 22 bp, Homo sapiens
gagggacagctaaagagaaatt

SEQ ID NO: 7739961 - DNA, 22 bp, Homo sapiens
gaggcctggtttgcatgagaat

SEQ ID NO: 7739962 - DNA, 22 bp, Homo sapiens
gaggtgcctggcgatgtctctg

SEQ ID NO: 7739963 - DNA, 22 bp, Homo sapiens
gaggtggaaggcaggaacaaat

SEQ ID NO: 7739964 - DNA, 22 bp, Homo sapiens
gaggttggtgaggggacacggt

SEQ ID NO: 7739965 - DNA, 22 bp, Homo sapiens
gaggttggtgaggggacacggt

SEQ ID NO: 7739966 - DNA, 22 bp, Homo sapiens
gaggtttcactgtgttgtccag

SEQ ID NO: 7739967 - DNA, 22 bp, Homo sapiens
gaggtttcttatcaagaaagct

SEQ ID NO: 7739968 - DNA, 22 bp, Homo sapiens
gaggtgggagggcagtccctaa

SEQ ID NO: 7739969 - DNA, 22 bp, Homo sapiens
gagtaaggctgctgatggagtg

SEQ ID NO: 7739970 - DNA, 22 bp, Homo sapiens
gagggtcctggctaagtctgac

SEQ ID NO: 7739971 - DNA, 22 bp, Homo sapiens
gagggctgataacaggaataca

SEQ ID NO: 7739972 - DNA, 22 bp, Homo sapiens
gagggtgggctcctatctgggt

SEQ ID NO: 7739973 - DNA, 22 bp, Homo sapiens
gagggtggggaatagactgcta

SEQ ID NO: 7739974 - DNA, 22 bp, Homo sapiens
gaggtcctgtctgagaatggag

SEQ ID NO: 7739975 - DNA, 22 bp, Homo sapiens
gaggtcctctgtgtccgcgggc

SEQ ID NO: 7739976 - DNA, 22 bp, Homo sapiens
gaggtctgggatggggcctgaa

SEQ ID NO: 7739977 - DNA, 22 bp, Homo sapiens
gaggtctgggcttgggcctggt

SEQ ID NO: 7739978 - DNA, 22 bp, Homo sapiens
gaggtctggaccaagtcgcccc

SEQ ID NO: 7739979 - DNA, 22 bp, Homo sapiens
gagctgggcacacgccacttga

SEQ ID NO: 7739980 - DNA, 22 bp, Homo sapiens
gagctggtcagtttcaggagag

SEQ ID NO: 7739981 - DNA, 22 bp, Homo sapiens
gagctggtcagtttcagggcca

SEQ ID NO: 7739982 - DNA, 22 bp, Homo sapiens
gagctggtgatcagctggagga

SEQ ID NO: 7739983 - DNA, 22 bp, Homo sapiens
gagctggtcgaaatgggctgac

SEQ ID NO: 7739984 - DNA, 22 bp, Homo sapiens
gagctgtggaaggcagggacca

SEQ ID NO: 7739985 - DNA, 20 bp, Homo sapiens
gagctgtgctctcaggagcc

SEQ ID NO: 7739986 - DNA, 22 bp, Homo sapiens
gagctgtgccaatctgtctggg

SEQ ID NO: 7739987 - DNA, 22 bp, Homo sapiens
gagctgtgattggtgtctcact

SEQ ID NO: 7739988 - DNA, 22 bp, Homo sapiens
gaggacaggagactcactgttt

SEQ ID NO: 7739989 - DNA, 17 bp, Homo sapiens
gaggacagggaagtagg

SEQ ID NO: 7739990 - DNA, 22 bp, Homo sapiens
gagctggtgtgtgcccgagcac

SEQ ID NO: 7739991 - DNA, 22 bp, Homo sapiens
gagctggttctgtccagggaat

SEQ ID NO: 7739992 - DNA, 22 bp, Homo sapiens
gagctgtgacacgcagcccagg

SEQ ID NO: 7739993 - DNA, 22 bp, Homo sapiens
gagctcagagcctatagttggt

SEQ ID NO: 7739994 - DNA, 19 bp, Homo sapiens
gagcaggccacacatgtgt

SEQ ID NO: 7739995 - DNA, 22 bp, Homo sapiens
gaggagagaagctaacggtgct

SEQ ID NO: 7739996 - DNA, 22 bp, Homo sapiens
gaggagagaacattcctccata

SEQ ID NO: 7739997 - DNA, 22 bp, Homo sapiens
gaggcatgcagagctggagcag

SEQ ID NO: 7739998 - DNA, 21 bp, Homo sapiens
gaggccactaataggggcaga

SEQ ID NO: 7739999 - DNA, 23 bp, Homo sapiens
gagagcccattggcaggggtacc

SEQ ID NO: 7740000 - DNA, 22 bp, Homo sapiens
gagagcaggctctcgggggcca

SEQ ID NO: 7740001 - DNA, 22 bp, Homo sapiens
gagagcaggaggcagcgggacg

SEQ ID NO: 7740002 - DNA, 22 bp, Homo sapiens
gagaggaggtggctatgacagc

SEQ ID NO: 7740003 - DNA, 22 bp, Homo sapiens
gagaacaggctctggagtcaga

SEQ ID NO: 7740004 - DNA, 22 bp, Homo sapiens
gagaaagggaacttacagagtg

SEQ ID NO: 7740005 - DNA, 22 bp, Homo sapiens
gagagaagaaagccatggtcct

SEQ ID NO: 7740006 - DNA, 22 bp, Homo sapiens
gagaaggaagttgagccagcat

SEQ ID NO: 7740007 - DNA, 22 bp, Homo sapiens
gagagaagggacttctacactt

SEQ ID NO: 7740008 - DNA, 22 bp, Homo sapiens
gagagaatgtacatgctagggg

SEQ ID NO: 7740009 - DNA, 22 bp, Homo sapiens
gagcacagaatcttcccatgca

SEQ ID NO: 7740010 - DNA, 22 bp, Homo sapiens
gagcaagactcactgcatcttg

SEQ ID NO: 7740011 - DNA, 22 bp, Homo sapiens
gagaggagtccctatcacagtt

SEQ ID NO: 7740012 - DNA, 22 bp, Homo sapiens
gagaggcaggaatcctgggtga

SEQ ID NO: 7740013 - DNA, 22 bp, Homo sapiens
gagcagcttgcgctgtcttcac

SEQ ID NO: 7740014 - DNA, 22 bp, Homo sapiens
gagcagagcttctcaaagtaaa

SEQ ID NO: 7740015 - DNA, 19 bp, Homo sapiens
gagcagcttcctatctggt

SEQ ID NO: 7740016 - DNA, 22 bp, Homo sapiens
gacctgagattttgaggctcat

SEQ ID NO: 7740017 - DNA, 22 bp, Homo sapiens
gacatgcattaagacacactga

SEQ ID NO: 7740018 - DNA, 22 bp, Homo sapiens
gaccttcttgctgtgtcctaac

SEQ ID NO: 7740019 - DNA, 22 bp, Homo sapiens
gaccttcagtgtgtttctcaca

SEQ ID NO: 7740020 - DNA, 22 bp, Homo sapiens
gacctggggtaagcttggcaac

SEQ ID NO: 7740021 - DNA, 22 bp, Homo sapiens
gacctggctttgggccccggca

SEQ ID NO: 7740022 - DNA, 22 bp, Homo sapiens
gacctggcctgcacagccctta

SEQ ID NO: 7740023 - DNA, 19 bp, Homo sapiens
gaatgggaatgggaaagct

SEQ ID NO: 7740024 - DNA, 22 bp, Homo sapiens
gaattacagccagaagaatgaa

SEQ ID NO: 7740025 - DNA, 22 bp, Homo sapiens
gaatttacaagttgaataacaa

SEQ ID NO: 7740026 - DNA, 22 bp, Homo sapiens
gaatttacaagttgaataacaa

SEQ ID NO: 7740027 - DNA, 22 bp, Homo sapiens
ctttccttaataagcaggtata

SEQ ID NO: 7740028 - DNA, 22 bp, Homo sapiens
ctttctaattctcccatagtct

SEQ ID NO: 7740029 - DNA, 22 bp, Homo sapiens
cttcttcccagcttccctcacc

SEQ ID NO: 7740030 - DNA, 22 bp, Homo sapiens
cttcttccagttataagagctt

SEQ ID NO: 7740031 - DNA, 22 bp, Homo sapiens
cttcttcctgctgcagcctcca

SEQ ID NO: 7740032 - DNA, 22 bp, Homo sapiens
cttccagggtccaggaagagcc

SEQ ID NO: 7740033 - DNA, 22 bp, Homo sapiens
cttccaggacaccagggtagta

SEQ ID NO: 7740034 - DNA, 22 bp, Homo sapiens
cttcacagtctttatttcctcc

SEQ ID NO: 7740035 - DNA, 22 bp, Homo sapiens
cttcacaggcaagtctgttttt

SEQ ID NO: 7740036 - DNA, 22 bp, Homo sapiens
cttcacagtcaccctgctgtgt

SEQ ID NO: 7740037 - DNA, 22 bp, Homo sapiens
cttcacagtataggtccctgag

SEQ ID NO: 7740038 - DNA, 22 bp, Homo sapiens
cttcacagcatgagctttggag

SEQ ID NO: 7740039 - DNA, 22 bp, Homo sapiens
cttcacagccaacatgggcaca

SEQ ID NO: 7740040 - DNA, 22 bp, Homo sapiens
cttcccttctgtgcagggcaga

SEQ ID NO: 7740041 - DNA, 22 bp, Homo sapiens
cttccaggtccttcttgagaag

SEQ ID NO: 7740042 - DNA, 22 bp, Homo sapiens
cttccccaagtagagaggggag

SEQ ID NO: 7740043 - DNA, 22 bp, Homo sapiens
gaaatgttgtcctgtctcttga

SEQ ID NO: 7740044 - DNA, 22 bp, Homo sapiens
gaagaagacatggaacaatagt

SEQ ID NO: 7740045 - DNA, 22 bp, Homo sapiens
gaaatattgggactcagagctt

SEQ ID NO: 7740046 - DNA, 22 bp, Homo sapiens
gaaatattgtactggagatgtt

SEQ ID NO: 7740047 - DNA, 22 bp, Homo sapiens
gaaatacagaaagggctgaatg

SEQ ID NO: 7740048 - DNA, 22 bp, Homo sapiens
gaaatattacagtggaggggat

SEQ ID NO: 7740049 - DNA, 22 bp, Homo sapiens
gaaatattcttgtcttgttttc

SEQ ID NO: 7740050 - DNA, 22 bp, Homo sapiens
cttttggcctcaaaggaaagaa

SEQ ID NO: 7740051 - DNA, 22 bp, Homo sapiens
ctttggaggtcatagccaagag

SEQ ID NO: 7740052 - DNA, 22 bp, Homo sapiens
gaaacagctttaagtgatactg

SEQ ID NO: 7740053 - DNA, 22 bp, Homo sapiens
gaaacagcccctgtgtgaagca

SEQ ID NO: 7740054 - DNA, 22 bp, Homo sapiens
gaaacagctagaaagccattgg

SEQ ID NO: 7740055 - DNA, 22 bp, Homo sapiens
ctggggggctactgacagagga

SEQ ID NO: 7740056 - DNA, 22 bp, Homo sapiens
ctggggggctactgacagagga

SEQ ID NO: 7740057 - DNA, 22 bp, Homo sapiens
ctgggggtcttgaaagggagag

SEQ ID NO: 7740058 - DNA, 22 bp, Homo sapiens
ctgggctctagaaaggaaagaa

SEQ ID NO: 7740059 - DNA, 22 bp, Homo sapiens
ctggggctgtaggaggacttat

SEQ ID NO: 7740060 - DNA, 22 bp, Homo sapiens
ctgggggccttacggaactcca

SEQ ID NO: 7740061 - DNA, 22 bp, Homo sapiens
ctgggggccttacggaactcca

SEQ ID NO: 7740062 - DNA, 22 bp, Homo sapiens
ctgggggcagcaagaagccatg

SEQ ID NO: 7740063 - DNA, 22 bp, Homo sapiens
ctgggggcagcaagaagccatg

SEQ ID NO: 7740064 - DNA, 22 bp, Homo sapiens
ctgggggcagcaagaagccatg

SEQ ID NO: 7740065 - DNA, 22 bp, Homo sapiens
ctgggctctaagggagcaccgt

SEQ ID NO: 7740066 - DNA, 20 bp, Homo sapiens
ctgggctcggtggccctggc

SEQ ID NO: 7740067 - DNA, 18 bp, Homo sapiens
ctgggctcgagagatcct

SEQ ID NO: 7740068 - DNA, 22 bp, Homo sapiens
ctgggctccctcatgtgtctgc

SEQ ID NO: 7740069 - DNA, 22 bp, Homo sapiens
ctgggctcctaaccatccaggt

SEQ ID NO: 7740070 - DNA, 22 bp, Homo sapiens
ctgggttccatgtagccaagag

SEQ ID NO: 7740071 - DNA, 22 bp, Homo sapiens
ctgggttctatttttggcttca

SEQ ID NO: 7740072 - DNA, 22 bp, Homo sapiens
ctgggttctctgcttagggcct

SEQ ID NO: 7740073 - DNA, 22 bp, Homo sapiens
ctggtcacctccttcccagcta

SEQ ID NO: 7740074 - DNA, 22 bp, Homo sapiens
ctggtcaccaggtagcattgta

SEQ ID NO: 7740075 - DNA, 22 bp, Homo sapiens
ctgggccagatccagcctcaca

SEQ ID NO: 7740076 - DNA, 22 bp, Homo sapiens
ctgggccaggaccagggttgaa

SEQ ID NO: 7740077 - DNA, 19 bp, Homo sapiens
ctgggagttcactgctgcc

SEQ ID NO: 7740078 - DNA, 22 bp, Homo sapiens
ctgggatccacgggctcccaag

SEQ ID NO: 7740079 - DNA, 22 bp, Homo sapiens
ctggagctcagcccaggttcca

SEQ ID NO: 7740080 - DNA, 22 bp, Homo sapiens
ctggagctccagggtctcctct

SEQ ID NO: 7740081 - DNA, 22 bp, Homo sapiens
ctgggcctcacacccaccaaat

SEQ ID NO: 7740082 - DNA, 22 bp, Homo sapiens
ctgggcctcatccccagagttt

SEQ ID NO: 7740083 - DNA, 22 bp, Homo sapiens
ctgggcctagcaacagaggagt

SEQ ID NO: 7740084 - DNA, 22 bp, Homo sapiens
ctgggccctatggaagaaaggg

SEQ ID NO: 7740085 - DNA, 22 bp, Homo sapiens
ctgggcccaggcggctctcgga

SEQ ID NO: 7740086 - DNA, 22 bp, Homo sapiens
ctgggcctccacgggccatcac

SEQ ID NO: 7740087 - DNA, 22 bp, Homo sapiens
ctgggctcagcaggccaaggcc

SEQ ID NO: 7740088 - DNA, 22 bp, Homo sapiens
ctgggctcaaatcctggccctg

SEQ ID NO: 7740089 - DNA, 22 bp, Homo sapiens
ctgggctccactcccacagtgt

SEQ ID NO: 7740090 - DNA, 22 bp, Homo sapiens
ctgggctccactacttgctaac

SEQ ID NO: 7740091 - DNA, 22 bp, Homo sapiens
ctgggctcagtgtctcactcct

SEQ ID NO: 7740092 - DNA, 22 bp, Homo sapiens
ctgggctcagcccatgctgtcc

SEQ ID NO: 7740093 - DNA, 22 bp, Homo sapiens
ctgtgaggccctgggtgctgga

SEQ ID NO: 7740094 - DNA, 22 bp, Homo sapiens
ctgtgaggcgggtggagtggag

SEQ ID NO: 7740095 - DNA, 22 bp, Homo sapiens
ctgtgactgggtgacagtcctc

SEQ ID NO: 7740096 - DNA, 22 bp, Homo sapiens
ctgtccctcatcacctctgggt

SEQ ID NO: 7740097 - DNA, 19 bp, Homo sapiens
ctgtccctcccaggtatga

SEQ ID NO: 7740098 - DNA, 22 bp, Homo sapiens
ctgtgaatgctagtaagagtgc

SEQ ID NO: 7740099 - DNA, 22 bp, Homo sapiens
ctgtgaattgaatatgactatg

SEQ ID NO: 7740100 - DNA, 22 bp, Homo sapiens
ctgtggcttctgggtcagttca

SEQ ID NO: 7740101 - DNA, 22 bp, Homo sapiens
ctgtgggcctagtctggcctag

SEQ ID NO: 7740102 - DNA, 22 bp, Homo sapiens
ctgtgggcatttgagtgtgggt

SEQ ID NO: 7740103 - DNA, 22 bp, Homo sapiens
ctgtgggcgcctgtcagcctca

SEQ ID NO: 7740104 - DNA, 22 bp, Homo sapiens
ctgtgggctcccagcttctctc

SEQ ID NO: 7740105 - DNA, 22 bp, Homo sapiens
ctgtggcagggaagaggccatg

SEQ ID NO: 7740106 - DNA, 20 bp, Homo sapiens
ctgtggcatctgtcatggtg

SEQ ID NO: 7740107 - DNA, 22 bp, Homo sapiens
ctgtggcaagtctgcctgtcac

SEQ ID NO: 7740108 - DNA, 22 bp, Homo sapiens
ctgtggggaagatagaaccgac

SEQ ID NO: 7740109 - DNA, 18 bp, Homo sapiens
ctgtgggctggtgcatga

SEQ ID NO: 7740110 - DNA, 22 bp, Homo sapiens
ctgtgggctgaaagtgctcccg

SEQ ID NO: 7740111 - DNA, 22 bp, Homo sapiens
ctgtggtgagcaactgactgaa

SEQ ID NO: 7740112 - DNA, 22 bp, Homo sapiens
gcacagaagagctttggaatga

SEQ ID NO: 7740113 - DNA, 22 bp, Homo sapiens
gcacagaacttctcttagtagg

SEQ ID NO: 7740114 - DNA, 22 bp, Homo sapiens
gcacagaaccagacatgaggca

SEQ ID NO: 7740115 - DNA, 22 bp, Homo sapiens
gcacagaaccctatctttcgga

SEQ ID NO: 7740116 - DNA, 22 bp, Homo sapiens
gcacagaaccagacatgaggca

SEQ ID NO: 7740117 - DNA, 22 bp, Homo sapiens
gcacagaataacactctgggct

SEQ ID NO: 7740118 - DNA, 22 bp, Homo sapiens
gcacagaataacactctgggct

SEQ ID NO: 7740119 - DNA, 22 bp, Homo sapiens
gcacagaagtaaaatacaagtc

SEQ ID NO: 7740120 - DNA, 22 bp, Homo sapiens
gagtaggaatgttctgccatct

SEQ ID NO: 7740121 - DNA, 23 bp, Homo sapiens
gcagaggtttttcagtatggttt

SEQ ID NO: 7740122 - DNA, 21 bp, Homo sapiens
gcagcaaatgacaacagtgag

SEQ ID NO: 7740123 - DNA, 23 bp, Homo sapiens
gcagccatgttcccgtctcagct

SEQ ID NO: 7740124 - DNA, 23 bp, Homo sapiens
gcagccatgttcccgtctcagct

SEQ ID NO: 7740125 - DNA, 17 bp, Homo sapiens
gcagccagtgcagcagg

SEQ ID NO: 7740126 - DNA, 22 bp, Homo sapiens
gcagctggctctgggaaaaact

SEQ ID NO: 7740127 - DNA, 22 bp, Homo sapiens
gcagctggttaatgggagaatt

SEQ ID NO: 7740128 - DNA, 22 bp, Homo sapiens
gcagcagcaggcgctcggccgt

SEQ ID NO: 7740129 - DNA, 22 bp, Homo sapiens
gcagcagaagtagaagtacagg

SEQ ID NO: 7740130 - DNA, 22 bp, Homo sapiens
gcagcaaggatgaagcacttgg

SEQ ID NO: 7740131 - DNA, 22 bp, Homo sapiens
gcagcagcccagggctctcaga

SEQ ID NO: 7740132 - DNA, 22 bp, Homo sapiens
gcagccagcccctctgacctct

SEQ ID NO: 7740133 - DNA, 22 bp, Homo sapiens
gcaggtgatgtgatgtgagcat

SEQ ID NO: 7740134 - DNA, 22 bp, Homo sapiens
gcaggtcttgaaggtgtgattt

SEQ ID NO: 7740135 - DNA, 22 bp, Homo sapiens
gcaggtctggcatagagcctgc

SEQ ID NO: 7740136 - DNA, 22 bp, Homo sapiens
gcaggtctgttgattacagtca

SEQ ID NO: 7740137 - DNA, 22 bp, Homo sapiens
gcaggtctggagggcactgggg

SEQ ID NO: 7740138 - DNA, 22 bp, Homo sapiens
gcaggtctcaatctgagcaggc

SEQ ID NO: 7740139 - DNA, 22 bp, Homo sapiens
gcaggtctatcaggctgcaggt

SEQ ID NO: 7740140 - DNA, 22 bp, Homo sapiens
gcaggtagtgatcgagggtgac

SEQ ID NO: 7740141 - DNA, 22 bp, Homo sapiens
gcaggtctagaagctgcctctg

SEQ ID NO: 7740142 - DNA, 22 bp, Homo sapiens
gcagggcagctcactgtggttc

SEQ ID NO: 7740143 - DNA, 18 bp, Homo sapiens
gcctccctggctacactt

SEQ ID NO: 7740144 - DNA, 22 bp, Homo sapiens
gcctgagggctcctagcaggct

SEQ ID NO: 7740145 - DNA, 22 bp, Homo sapiens
gccccttcgtggaagtgcattc

SEQ ID NO: 7740146 - DNA, 22 bp, Homo sapiens
gccccttccatcatgtgaggac

SEQ ID NO: 7740147 - DNA, 22 bp, Homo sapiens
gccccttccatcatgtgaggac

SEQ ID NO: 7740148 - DNA, 22 bp, Homo sapiens
gcccctctccttgtgcacctgc

SEQ ID NO: 7740149 - DNA, 22 bp, Homo sapiens
gcccctccgggcgcgtcatagc

SEQ ID NO: 7740150 - DNA, 22 bp, Homo sapiens
gccctgcttctggcatgcagaa

SEQ ID NO: 7740151 - DNA, 22 bp, Homo sapiens
gcctcagtaaccttaggggata

SEQ ID NO: 7740152 - DNA, 20 bp, Homo sapiens
gcctcagtcacatggcctac

SEQ ID NO: 7740153 - DNA, 22 bp, Homo sapiens
gcctcagtgatatgtgggacaa

SEQ ID NO: 7740154 - DNA, 22 bp, Homo sapiens
gcctcagtctcccgagtagctg

SEQ ID NO: 7740155 - DNA, 22 bp, Homo sapiens
gcctcatgagggatctgccctc

SEQ ID NO: 7740156 - DNA, 18 bp, Homo sapiens
gcctcagtttcctcacct

SEQ ID NO: 7740157 - DNA, 22 bp, Homo sapiens
gcctcagtttatacacctgtaa

SEQ ID NO: 7740158 - DNA, 22 bp, Homo sapiens
gcctcagtggctttaggagttc

SEQ ID NO: 7740159 - DNA, 22 bp, Homo sapiens
gcctcagtgtcctcctccatgt

SEQ ID NO: 7740160 - DNA, 22 bp, Homo sapiens
gcctcagttgatctgtgtgagc

SEQ ID NO: 7740161 - DNA, 22 bp, Homo sapiens
gccctgctccaggagaataccc

SEQ ID NO: 7740162 - DNA, 17 bp, Homo sapiens
gccctgcctgctgccct

SEQ ID NO: 7740163 - DNA, 22 bp, Homo sapiens
gccctgctgctggcagaggcgc

SEQ ID NO: 7740164 - DNA, 22 bp, Homo sapiens
gccctgctgtcttcagagtata

SEQ ID NO: 7740165 - DNA, 23 bp, Homo sapiens
gccagctttggtctgtctcctag

SEQ ID NO: 7740166 - DNA, 22 bp, Homo sapiens
gccaggaacacaatgccaagct

SEQ ID NO: 7740167 - DNA, 18 bp, Homo sapiens
gccaggaagaggaatgtg

SEQ ID NO: 7740168 - DNA, 22 bp, Homo sapiens
gccaggaatgcataaatgacct

SEQ ID NO: 7740169 - DNA, 22 bp, Homo sapiens
gccaggctaagaaaggtgtgat

SEQ ID NO: 7740170 - DNA, 23 bp, Homo sapiens
gccaggctccggtctgtggccac

SEQ ID NO: 7740171 - DNA, 19 bp, Homo sapiens
gcataaaatgtcaatgtgt

SEQ ID NO: 7740172 - DNA, 22 bp, Homo sapiens
gcagttttattatgatggaaat

SEQ ID NO: 7740173 - DNA, 22 bp, Homo sapiens
gccacctcccaggacgaggctg

SEQ ID NO: 7740174 - DNA, 22 bp, Homo sapiens
gccacctgtttcgcttgcccag

SEQ ID NO: 7740175 - DNA, 22 bp, Homo sapiens
gccacctgtttcagatgtggtt

SEQ ID NO: 7740176 - DNA, 22 bp, Homo sapiens
gccacctgtgtgggcctttgtg

SEQ ID NO: 7740177 - DNA, 22 bp, Homo sapiens
gccacctgtaagccattaggcc

SEQ ID NO: 7740178 - DNA, 22 bp, Homo sapiens
gccacctggtggcatcttctgg

SEQ ID NO: 7740179 - DNA, 22 bp, Homo sapiens
gccacctggactcagagccagg

SEQ ID NO: 7740180 - DNA, 22 bp, Homo sapiens
gccacctgcgggccgtggtgga

SEQ ID NO: 7740181 - DNA, 22 bp, Homo sapiens
gccacctggacagctgtgccct

SEQ ID NO: 7740182 - DNA, 22 bp, Homo sapiens
gccacctgccaacttgctggaa

SEQ ID NO: 7740183 - DNA, 22 bp, Homo sapiens
gctggccaaagtgtacctggag

SEQ ID NO: 7740184 - DNA, 22 bp, Homo sapiens
gctggccacactgctgatggag

SEQ ID NO: 7740185 - DNA, 22 bp, Homo sapiens
gctggccacagatccccaggga

SEQ ID NO: 7740186 - DNA, 22 bp, Homo sapiens
gctggccacagatccccaggga

SEQ ID NO: 7740187 - DNA, 19 bp, Homo sapiens
gctggccacgccccagttg

SEQ ID NO: 7740188 - DNA, 19 bp, Homo sapiens
gctggccacgccccagttg

SEQ ID NO: 7740189 - DNA, 22 bp, Homo sapiens
gctggccaggaagagtctcaga

SEQ ID NO: 7740190 - DNA, 22 bp, Homo sapiens
gctgtcagtgaggtgagacatg

SEQ ID NO: 7740191 - DNA, 23 bp, Homo sapiens
gctgtcctcctgggcccagcagc

SEQ ID NO: 7740192 - DNA, 22 bp, Homo sapiens
gctgtctgctgggtcgctcagg

SEQ ID NO: 7740193 - DNA, 22 bp, Homo sapiens
gctgtctgctgtgcactgagca

SEQ ID NO: 7740194 - DNA, 22 bp, Homo sapiens
gctgtctgggatgtcactgctg

SEQ ID NO: 7740195 - DNA, 22 bp, Homo sapiens
gctgtctgggaggcctccactt

SEQ ID NO: 7740196 - DNA, 22 bp, Homo sapiens
gctgtctgtcttcacatctcgc

SEQ ID NO: 7740197 - DNA, 22 bp, Homo sapiens
gctgtctgtggtgtcagctgac

SEQ ID NO: 7740198 - DNA, 23 bp, Homo sapiens
gctgtctgtcatctctgcgggag

SEQ ID NO: 7740199 - DNA, 19 bp, Homo sapiens
gctgtgtgaccttgggcaa

SEQ ID NO: 7740200 - DNA, 22 bp, Homo sapiens
ggacaggatgctgaagatgaag

SEQ ID NO: 7740201 - DNA, 22 bp, Homo sapiens
ggacaggcccggggagcctgga

SEQ ID NO: 7740202 - DNA, 22 bp, Homo sapiens
ggagaaaattgatgaagttggc

SEQ ID NO: 7740203 - DNA, 22 bp, Homo sapiens
ggagaaagctgtagtggaatgt

SEQ ID NO: 7740204 - DNA, 22 bp, Homo sapiens
ggactgggaatcagggagatgc

SEQ ID NO: 7740205 - DNA, 19 bp, Homo sapiens
ggaaggcagaggggctgtg

SEQ ID NO: 7740206 - DNA, 22 bp, Homo sapiens
ggaaggagtctttaacacccat

SEQ ID NO: 7740207 - DNA, 22 bp, Homo sapiens
ggaaggatctggctgaaatcca

SEQ ID NO: 7740208 - DNA, 18 bp, Homo sapiens
ggaaggagtggaccccag

SEQ ID NO: 7740209 - DNA, 22 bp, Homo sapiens
ggaaggaggggcaaagcagttc

SEQ ID NO: 7740210 - DNA, 22 bp, Homo sapiens
ggaaggagccatatcatatcca

SEQ ID NO: 7740211 - DNA, 22 bp, Homo sapiens
ggaaggaggatgctctggcctt

SEQ ID NO: 7740212 - DNA, 22 bp, Homo sapiens
ggaaggagggcggcaatgatga

SEQ ID NO: 7740213 - DNA, 22 bp, Homo sapiens
ggaaggagggcggcaatgatga

SEQ ID NO: 7740214 - DNA, 22 bp, Homo sapiens
ggaaaaatagagtatactttaa

SEQ ID NO: 7740215 - DNA, 22 bp, Homo sapiens
ggaaggagcatttgccagttta

SEQ ID NO: 7740216 - DNA, 22 bp, Homo sapiens
ggaaggagcatttgccagttta

SEQ ID NO: 7740217 - DNA, 19 bp, Homo sapiens
ggaaggagagaaatgcatg

SEQ ID NO: 7740218 - DNA, 22 bp, Homo sapiens
ggaaggcagtgaaggggctgat

SEQ ID NO: 7740219 - DNA, 22 bp, Homo sapiens
ggaaggcagaggtgtcgtgggg

SEQ ID NO: 7740220 - DNA, 22 bp, Homo sapiens
ggaagggaaaattcattcggct

SEQ ID NO: 7740221 - DNA, 22 bp, Homo sapiens
ggaagggaatccatctggttag

SEQ ID NO: 7740222 - DNA, 22 bp, Homo sapiens
ggagcctggcccggcccttggc

SEQ ID NO: 7740223 - DNA, 22 bp, Homo sapiens
ggagccccaattgagcagtacg

SEQ ID NO: 7740224 - DNA, 22 bp, Homo sapiens
ggagctggccgcctatgtgcag

SEQ ID NO: 7740225 - DNA, 22 bp, Homo sapiens
ggagcctgggcctcctgccctt

SEQ ID NO: 7740226 - DNA, 22 bp, Homo sapiens
ggagctgggaattggatcatct

SEQ ID NO: 7740227 - DNA, 22 bp, Homo sapiens
ggagctgggaccctgtcatctg

SEQ ID NO: 7740228 - DNA, 22 bp, Homo sapiens
ggagctggggttggcatcttcc

SEQ ID NO: 7740229 - DNA, 21 bp, Homo sapiens
ggagctggggagctggcccca

SEQ ID NO: 7740230 - DNA, 22 bp, Homo sapiens
ggagctggtcagccttgagcat

SEQ ID NO: 7740231 - DNA, 22 bp, Homo sapiens
gctgctggaacaaatcacccca

SEQ ID NO: 7740232 - DNA, 22 bp, Homo sapiens
gctgctgcttgaaggctcggag

SEQ ID NO: 7740233 - DNA, 22 bp, Homo sapiens
gctgctgggggaacagttaaaa

SEQ ID NO: 7740234 - DNA, 22 bp, Homo sapiens
gctgctggggtcacatggtaag

SEQ ID NO: 7740235 - DNA, 22 bp, Homo sapiens
gctgctgggcaccccctgagct

SEQ ID NO: 7740236 - DNA, 22 bp, Homo sapiens
gctgctggtcctcagagctcat

SEQ ID NO: 7740237 - DNA, 22 bp, Homo sapiens
gctgctggggtggagaaacgct

SEQ ID NO: 7740238 - DNA, 22 bp, Homo sapiens
gctgctgtcagcaggccttgtt

SEQ ID NO: 7740239 - DNA, 22 bp, Homo sapiens
gctggagcttgagaggacaggg

SEQ ID NO: 7740240 - DNA, 22 bp, Homo sapiens
gctggaggggtaataggatggg

SEQ ID NO: 7740241 - DNA, 22 bp, Homo sapiens
gctggaggtggtgagaaaaggt

SEQ ID NO: 7740242 - DNA, 22 bp, Homo sapiens
gctggaggtagggaggtcctgt

SEQ ID NO: 7740243 - DNA, 22 bp, Homo sapiens
gctgcaggctctgcaggaattg

SEQ ID NO: 7740244 - DNA, 21 bp, Homo sapiens
gctgcagggcccagggcaccc

SEQ ID NO: 7740245 - DNA, 22 bp, Homo sapiens
gctgagtgaggtccagagcttg

SEQ ID NO: 7740246 - DNA, 22 bp, Homo sapiens
gctctctgaggtgctggcagag

SEQ ID NO: 7740247 - DNA, 22 bp, Homo sapiens
gctccctcccaccagcctgcag

SEQ ID NO: 7740248 - DNA, 22 bp, Homo sapiens
gctccctccatgaggcagaccg

SEQ ID NO: 7740249 - DNA, 22 bp, Homo sapiens
gctccccattgatctgcaggct

SEQ ID NO: 7740250 - DNA, 22 bp, Homo sapiens
gctctggggttggaaagtgatc

SEQ ID NO: 7740251 - DNA, 22 bp, Homo sapiens
gctctgggtagccactgcctgg

SEQ ID NO: 7740252 - DNA, 22 bp, Homo sapiens
gctctctgccatatgaggatac

SEQ ID NO: 7740253 - DNA, 22 bp, Homo sapiens
gctaggaatcggacccaggaag

SEQ ID NO: 7740254 - DNA, 22 bp, Homo sapiens
gctaggaagctggggagaagtc

SEQ ID NO: 7740255 - DNA, 22 bp, Homo sapiens
gctaggaagaagggtgcttgaa

SEQ ID NO: 7740256 - DNA, 22 bp, Homo sapiens
gctaggaaaggaagaactttga

SEQ ID NO: 7740257 - DNA, 22 bp, Homo sapiens
gctcagtgtggtcctcagatgt

SEQ ID NO: 7740258 - DNA, 18 bp, Homo sapiens
gctcagtgtgttaacact

SEQ ID NO: 7740259 - DNA, 22 bp, Homo sapiens
gctcagtggtattcggaaactg

SEQ ID NO: 7740260 - DNA, 22 bp, Homo sapiens
gctcagtgtgcacgagtactct

SEQ ID NO: 7740261 - DNA, 22 bp, Homo sapiens
gctcagtgtgttcaagggctca

SEQ ID NO: 7740262 - DNA, 22 bp, Homo sapiens
gctcagtgttcatctgtatgca

SEQ ID NO: 7740263 - DNA, 22 bp, Homo sapiens
gctcagtgtttctggtagaaaa

SEQ ID NO: 7740264 - DNA, 22 bp, Homo sapiens
gctcagtgagatattgactcca

SEQ ID NO: 7740265 - DNA, 22 bp, Homo sapiens
gctcagtgaagggtgccaagta

SEQ ID NO: 7740266 - DNA, 22 bp, Homo sapiens
gctcagtgaatttttgcccatg

SEQ ID NO: 7740267 - DNA, 19 bp, Homo sapiens
gctcagtgatgccagacca

SEQ ID NO: 7740268 - DNA, 22 bp, Homo sapiens
gctcagtgcagcctttctgtat

SEQ ID NO: 7740269 - DNA, 20 bp, Homo sapiens
gctcagtggagaaatgcacc

SEQ ID NO: 7740270 - DNA, 22 bp, Homo sapiens
gctcagtgcatcattccaggct

SEQ ID NO: 7740271 - DNA, 22 bp, Homo sapiens
gctagtccacagccatccaggc

SEQ ID NO: 7740272 - DNA, 21 bp, Homo sapiens
gggctcagtggaaaagagtgt

SEQ ID NO: 7740273 - DNA, 22 bp, Homo sapiens
gggctctggacccaggcaagag

SEQ ID NO: 7740274 - DNA, 22 bp, Homo sapiens
gggctccaaaatctatgtcttc

SEQ ID NO: 7740275 - DNA, 22 bp, Homo sapiens
gggctccaactacatcagcctt

SEQ ID NO: 7740276 - DNA, 22 bp, Homo sapiens
gggccccttgctgctctgctgg

SEQ ID NO: 7740277 - DNA, 22 bp, Homo sapiens
gggccccttgtatctctggctc

SEQ ID NO: 7740278 - DNA, 22 bp, Homo sapiens
gggcccctgggaattctgtgat

SEQ ID NO: 7740279 - DNA, 22 bp, Homo sapiens
gggcaggtgtgcagagctgttg

SEQ ID NO: 7740280 - DNA, 22 bp, Homo sapiens
gggctatagcactatgtatggg

SEQ ID NO: 7740281 - DNA, 22 bp, Homo sapiens
gggccggagctgggtcccgcgc

SEQ ID NO: 7740282 - DNA, 22 bp, Homo sapiens
gggcaggtctgggtcagcctga

SEQ ID NO: 7740283 - DNA, 19 bp, Homo sapiens
gggatcagcccagggctct

SEQ ID NO: 7740284 - DNA, 22 bp, Homo sapiens
gggagctgaatggcaatggaga

SEQ ID NO: 7740285 - DNA, 22 bp, Homo sapiens
gggagtcagagaggtaatggga

SEQ ID NO: 7740286 - DNA, 22 bp, Homo sapiens
gggagtaaactatggtgaggat

SEQ ID NO: 7740287 - DNA, 22 bp, Homo sapiens
gggagtggagagcaatggatga

SEQ ID NO: 7740288 - DNA, 17 bp, Homo sapiens
ggctggaggggacccgg

SEQ ID NO: 7740289 - DNA, 19 bp, Homo sapiens
ggctggagtggccatctgt

SEQ ID NO: 7740290 - DNA, 17 bp, Homo sapiens
ggctggagcagctcccc

SEQ ID NO: 7740291 - DNA, 17 bp, Homo sapiens
ggctggagcagctcccc

SEQ ID NO: 7740292 - DNA, 22 bp, Homo sapiens
ggctgtggccagcggggctgag

SEQ ID NO: 7740293 - DNA, 22 bp, Homo sapiens
ggctggccagggccctcgctgg

SEQ ID NO: 7740294 - DNA, 22 bp, Homo sapiens
gggaaggcaggattctctggtg

SEQ ID NO: 7740295 - DNA, 22 bp, Homo sapiens
gggaaggcaggcctctgttgga

SEQ ID NO: 7740296 - DNA, 22 bp, Homo sapiens
gggaaggcaccatggtgttcca

SEQ ID NO: 7740297 - DNA, 22 bp, Homo sapiens
gggaaggcatacctgagggaga

SEQ ID NO: 7740298 - DNA, 22 bp, Homo sapiens
gggaaggcagtgggaggaactg

SEQ ID NO: 7740299 - DNA, 22 bp, Homo sapiens
gggaaggcagtgtctggttgaa

SEQ ID NO: 7740300 - DNA, 22 bp, Homo sapiens
gggaagagtaactagcccatgt

SEQ ID NO: 7740301 - DNA, 22 bp, Homo sapiens
ggcctctgccccagccacacct

SEQ ID NO: 7740302 - DNA, 22 bp, Homo sapiens
ggctcagattccgagtggccct

SEQ ID NO: 7740303 - DNA, 22 bp, Homo sapiens
ggctctctccttggctttcaga

SEQ ID NO: 7740304 - DNA, 22 bp, Homo sapiens
ggctctctgaggaaacccttcc

SEQ ID NO: 7740305 - DNA, 22 bp, Homo sapiens
ggccagagttgatggcatcttg

SEQ ID NO: 7740306 - DNA, 22 bp, Homo sapiens
ggccacctctgccctaccgagt

SEQ ID NO: 7740307 - DNA, 22 bp, Homo sapiens
ggccacctccgtgaaggaatga

SEQ ID NO: 7740308 - DNA, 19 bp, Homo sapiens
ggccacctctcttcccagg

SEQ ID NO: 7740309 - DNA, 22 bp, Homo sapiens
ggccaccagtcctctggcaggg

SEQ ID NO: 7740310 - DNA, 22 bp, Homo sapiens
ggccacctaggagccacagtga

SEQ ID NO: 7740311 - DNA, 22 bp, Homo sapiens
ggccaccaaagtcctgtggctt

SEQ ID NO: 7740312 - DNA, 22 bp, Homo sapiens
ggccacatgtggctgctcgtat

SEQ ID NO: 7740313 - DNA, 22 bp, Homo sapiens
ggccacagtgggaaatcctggg

SEQ ID NO: 7740314 - DNA, 22 bp, Homo sapiens
ggccacagtgggaaatcctggg

SEQ ID NO: 7740315 - DNA, 20 bp, Homo sapiens
ggccacagggtgctggtgga

SEQ ID NO: 7740316 - DNA, 22 bp, Homo sapiens
ggccacagtctctggaaggatg

SEQ ID NO: 7740317 - DNA, 22 bp, Homo sapiens
ggccacagagggcgggatgctg

SEQ ID NO: 7740318 - DNA, 17 bp, Homo sapiens
ggccacagagcttgggg

SEQ ID NO: 7740319 - DNA, 22 bp, Homo sapiens
ggcccaggctggagtgcggtgg

SEQ ID NO: 7740320 - DNA, 22 bp, Homo sapiens
ggcccagtctggggccctgtga

SEQ ID NO: 7740321 - DNA, 20 bp, Homo sapiens
ggcccagtgaaccaggacgg

SEQ ID NO: 7740322 - DNA, 22 bp, Homo sapiens
ggcccagtgtgggtggatgttg

SEQ ID NO: 7740323 - DNA, 22 bp, Homo sapiens
ggcccagtgttgccagacctga

SEQ ID NO: 7740324 - DNA, 22 bp, Homo sapiens
ggcccatctcttgctctgggtt

SEQ ID NO: 7740325 - DNA, 22 bp, Homo sapiens
ggcccagtgtaccccaggcagt

SEQ ID NO: 7740326 - DNA, 18 bp, Homo sapiens
ggcagggaaaagataggg

SEQ ID NO: 7740327 - DNA, 22 bp, Homo sapiens
ggcaggggtcctggtgttgact

SEQ ID NO: 7740328 - DNA, 22 bp, Homo sapiens
ggcagggaagctggcatcacgg

SEQ ID NO: 7740329 - DNA, 22 bp, Homo sapiens
ggcagggaaacagctgatccca

SEQ ID NO: 7740330 - DNA, 22 bp, Homo sapiens
ggcagtgactggggacccccaa

SEQ ID NO: 7740331 - DNA, 19 bp, Homo sapiens
ggcaccttggtcttggact

SEQ ID NO: 7740332 - DNA, 19 bp, Homo sapiens
ggcacctttctgctgtgtc

SEQ ID NO: 7740333 - DNA, 19 bp, Homo sapiens
ggcaccttggctatgcctg

SEQ ID NO: 7740334 - DNA, 18 bp, Homo sapiens
ggcacctctcttgcctta

SEQ ID NO: 7740335 - DNA, 22 bp, Homo sapiens
ggaggcagaacttcccgtcagt

SEQ ID NO: 7740336 - DNA, 22 bp, Homo sapiens
gtcctggaatcctagaacagtg

SEQ ID NO: 7740337 - DNA, 22 bp, Homo sapiens
gtcagaggaggctgagtaggaa

SEQ ID NO: 7740338 - DNA, 20 bp, Homo sapiens
gtcagaggaccctagagcga

SEQ ID NO: 7740339 - DNA, 22 bp, Homo sapiens
gtcagaggaatggatgagtgat

SEQ ID NO: 7740340 - DNA, 22 bp, Homo sapiens
gtcagaggaatggatgagtgat

SEQ ID NO: 7740341 - DNA, 22 bp, Homo sapiens
gtccagctccagggaggcaggc

SEQ ID NO: 7740342 - DNA, 22 bp, Homo sapiens
gtccagctgcagctgggcagaa

SEQ ID NO: 7740343 - DNA, 22 bp, Homo sapiens
gtaggcagaccagtggatgggt

SEQ ID NO: 7740344 - DNA, 22 bp, Homo sapiens
gtatacagatacttagacgtgc

SEQ ID NO: 7740345 - DNA, 22 bp, Homo sapiens
gtagttctttctcaatgttcaa

SEQ ID NO: 7740346 - DNA, 22 bp, Homo sapiens
gtgctggcacccctctccagtt

SEQ ID NO: 7740347 - DNA, 22 bp, Homo sapiens
gtgctggccctgtcctcgagct

SEQ ID NO: 7740348 - DNA, 22 bp, Homo sapiens
gtgcagggcagccgaatgggct

SEQ ID NO: 7740349 - DNA, 17 bp, Homo sapiens
gtgcagggatgaaggat

SEQ ID NO: 7740350 - DNA, 22 bp, Homo sapiens
gtgcagggtagcgacggcagga

SEQ ID NO: 7740351 - DNA, 22 bp, Homo sapiens
gtgcagcaaagtttgagatata

SEQ ID NO: 7740352 - DNA, 22 bp, Homo sapiens
gtgaggatacttaagagaacac

SEQ ID NO: 7740353 - DNA, 22 bp, Homo sapiens
gtgcagggagcccagaaggtcc

SEQ ID NO: 7740354 - DNA, 22 bp, Homo sapiens
gtctccagggctgctggcgcct

SEQ ID NO: 7740355 - DNA, 22 bp, Homo sapiens
gtgagcagttgtgagccccaaa

SEQ ID NO: 7740356 - DNA, 22 bp, Homo sapiens
gggtgaggcccatttgaggcca

SEQ ID NO: 7740357 - DNA, 22 bp, Homo sapiens
gggtgctgggaggctgacatct

SEQ ID NO: 7740358 - DNA, 22 bp, Homo sapiens
gggtgcagcagagctcctctgt

SEQ ID NO: 7740359 - DNA, 22 bp, Homo sapiens
gggtggagccagttgactctgt

SEQ ID NO: 7740360 - DNA, 22 bp, Homo sapiens
ggggtgagtgctcagccccgga

SEQ ID NO: 7740361 - DNA, 22 bp, Homo sapiens
ggggcccctgtggcttgatgcc

SEQ ID NO: 7740362 - DNA, 22 bp, Homo sapiens
ggggtgggagtgccatccttga

SEQ ID NO: 7740363 - DNA, 19 bp, Homo sapiens
ggggtggctggggctccag

SEQ ID NO: 7740364 - DNA, 22 bp, Homo sapiens
ggggccactggcaggaccttgg

SEQ ID NO: 7740365 - DNA, 22 bp, Homo sapiens
ggggagaattacatggcgtgga

SEQ ID NO: 7740366 - DNA, 19 bp, Homo sapiens
ggggagaactagagacagc

SEQ ID NO: 7740367 - DNA, 22 bp, Homo sapiens
ggggaggaagctggaacacggg

SEQ ID NO: 7740368 - DNA, 22 bp, Homo sapiens
ggttcacatattgagagtattc

SEQ ID NO: 7740369 - DNA, 22 bp, Homo sapiens
ggttcacactttcatgatttca

SEQ ID NO: 7740370 - DNA, 22 bp, Homo sapiens
ggttggggcgagctggaggccc

SEQ ID NO: 7740371 - DNA, 22 bp, Homo sapiens
ggtggagagctggatgagaggt

SEQ ID NO: 7740372 - DNA, 22 bp, Homo sapiens
ggtggcagagacataggacata

SEQ ID NO: 7740373 - DNA, 22 bp, Homo sapiens
ggtaaaaatcacaaatacttta

SEQ ID NO: 7740374 - DNA, 23 bp, Homo sapiens
ggtccctgacagcgggcaagttg

SEQ ID NO: 7740375 - DNA, 18 bp, Homo sapiens
ggtgagggagctggaagc

SEQ ID NO: 7740376 - DNA, 21 bp, Homo sapiens
tcctgcagggcagcagagtgg

SEQ ID NO: 7740377 - DNA, 22 bp, Homo sapiens
tcctcagtaaggatcgtcagct

SEQ ID NO: 7740378 - DNA, 22 bp, Homo sapiens
tcctcagtaaggcatggctttg

SEQ ID NO: 7740379 - DNA, 22 bp, Homo sapiens
tcctctggggcgtggtcctgga

SEQ ID NO: 7740380 - DNA, 22 bp, Homo sapiens
tcctgaggctaaagtgcagtgg

SEQ ID NO: 7740381 - DNA, 22 bp, Homo sapiens
tcctgaggctaaagtgcagtgg

SEQ ID NO: 7740382 - DNA, 22 bp, Homo sapiens
tcctgagtgagagctgggaggt

SEQ ID NO: 7740383 - DNA, 22 bp, Homo sapiens
tcctgaggccctgttagggtct

SEQ ID NO: 7740384 - DNA, 22 bp, Homo sapiens
tcctgaggcctctgtgatgtga

SEQ ID NO: 7740385 - DNA, 22 bp, Homo sapiens
tcctgaggatggttgaagtgca

SEQ ID NO: 7740386 - DNA, 22 bp, Homo sapiens
tcctgagctgacacttggggag

SEQ ID NO: 7740387 - DNA, 22 bp, Homo sapiens
tcctgaggaaagttcatgaatg

SEQ ID NO: 7740388 - DNA, 22 bp, Homo sapiens
tcctgaggactaacaggaagga

SEQ ID NO: 7740389 - DNA, 22 bp, Homo sapiens
tcctgaggactaacaggaagga

SEQ ID NO: 7740390 - DNA, 22 bp, Homo sapiens
tcctgaggaccctgtcaggggc

SEQ ID NO: 7740391 - DNA, 22 bp, Homo sapiens
tcctgagccctggggtcagtgt

SEQ ID NO: 7740392 - DNA, 22 bp, Homo sapiens
tcctgagccctgtaggaccctg

SEQ ID NO: 7740393 - DNA, 22 bp, Homo sapiens
tcctcagcatggaatctggact

SEQ ID NO: 7740394 - DNA, 22 bp, Homo sapiens
tccctgggactcagacatggaa

SEQ ID NO: 7740395 - DNA, 22 bp, Homo sapiens
tccccttggcttggtcaagagg

SEQ ID NO: 7740396 - DNA, 22 bp, Homo sapiens
tccctctgtgttgggcatgcct

SEQ ID NO: 7740397 - DNA, 22 bp, Homo sapiens
tccctgaaacatctctgtggat

SEQ ID NO: 7740398 - DNA, 22 bp, Homo sapiens
tccctctgctagtgcttgagct

SEQ ID NO: 7740399 - DNA, 22 bp, Homo sapiens
tccagggctgttactttacata

SEQ ID NO: 7740400 - DNA, 22 bp, Homo sapiens
tccagggaaggtgtgaggctgg

SEQ ID NO: 7740401 - DNA, 22 bp, Homo sapiens
tccaggtctggcctgctaggca

SEQ ID NO: 7740402 - DNA, 22 bp, Homo sapiens
tccaggtcttcctattccaggt

SEQ ID NO: 7740403 - DNA, 22 bp, Homo sapiens
tccaggtctggttggacaggtt

SEQ ID NO: 7740404 - DNA, 21 bp, Homo sapiens
tccaggctggaaggggcgttg

SEQ ID NO: 7740405 - DNA, 22 bp, Homo sapiens
tccaggctggacatgaggcggg

SEQ ID NO: 7740406 - DNA, 22 bp, Homo sapiens
tccaggctaattttgcattgtt

SEQ ID NO: 7740407 - DNA, 22 bp, Homo sapiens
tcccagccttccttgtggtgaa

SEQ ID NO: 7740408 - DNA, 22 bp, Homo sapiens
tcccagccggtgcctgggtccc

SEQ ID NO: 7740409 - DNA, 22 bp, Homo sapiens
tcccagaggctccagtctctat

SEQ ID NO: 7740410 - DNA, 22 bp, Homo sapiens
tcccagaggttgagtcacttat

SEQ ID NO: 7740411 - DNA, 22 bp, Homo sapiens
tcccagagtattagcaattgct

SEQ ID NO: 7740412 - DNA, 22 bp, Homo sapiens
tcccaaagtattagcatttcaa

SEQ ID NO: 7740413 - DNA, 22 bp, Homo sapiens
tcccaaatataatgcaagagac

SEQ ID NO: 7740414 - DNA, 19 bp, Homo sapiens
tcccaagatttctgtatca

SEQ ID NO: 7740415 - DNA, 22 bp, Homo sapiens
tcccaagagctctgggataagg

SEQ ID NO: 7740416 - DNA, 22 bp, Homo sapiens
tcccagagatttcctctccttc

SEQ ID NO: 7740417 - DNA, 22 bp, Homo sapiens
tcccagagacagagcctcctcc

SEQ ID NO: 7740418 - DNA, 22 bp, Homo sapiens
tcccagagacatcatttctccg

SEQ ID NO: 7740419 - DNA, 22 bp, Homo sapiens
tcccagagcagtactccaggag

SEQ ID NO: 7740420 - DNA, 22 bp, Homo sapiens
tcccagagcagatgtgctaaag

SEQ ID NO: 7740421 - DNA, 22 bp, Homo sapiens
tcccagagccaagctatggatg

SEQ ID NO: 7740422 - DNA, 22 bp, Homo sapiens
tcagctggagatccttgttgtg

SEQ ID NO: 7740423 - DNA, 22 bp, Homo sapiens
tcagctggaagatggtgcagaa

SEQ ID NO: 7740424 - DNA, 22 bp, Homo sapiens
tcaggaagggtggtccacaggg

SEQ ID NO: 7740425 - DNA, 22 bp, Homo sapiens
tcaggaagggctcagtctgtgc

SEQ ID NO: 7740426 - DNA, 22 bp, Homo sapiens
tcagcatttcagaagtggcata

SEQ ID NO: 7740427 - DNA, 22 bp, Homo sapiens
tcagcatcaggttgtctgaatt

SEQ ID NO: 7740428 - DNA, 19 bp, Homo sapiens
tcagcatcaatttggtcct

SEQ ID NO: 7740429 - DNA, 22 bp, Homo sapiens
tcagccagccagctacaggctt

SEQ ID NO: 7740430 - DNA, 22 bp, Homo sapiens
tcagcaaaggcaattcattatt

SEQ ID NO: 7740431 - DNA, 22 bp, Homo sapiens
tcacagtgatgacgtgggagca

SEQ ID NO: 7740432 - DNA, 22 bp, Homo sapiens
tcagaacagaagaaggaacacg

SEQ ID NO: 7740433 - DNA, 22 bp, Homo sapiens
tcagaaagctatatggtgtgtc

SEQ ID NO: 7740434 - DNA, 22 bp, Homo sapiens
tcagaatatgctaatgacattt

SEQ ID NO: 7740435 - DNA, 22 bp, Homo sapiens
tcactgcaacctccacctcctg

SEQ ID NO: 7740436 - DNA, 22 bp, Homo sapiens
tcactgcaacctccacctcctg

SEQ ID NO: 7740437 - DNA, 22 bp, Homo sapiens
tcactgcaacctccacctcccg

SEQ ID NO: 7740438 - DNA, 22 bp, Homo sapiens
tcactgcaacctccacctcccg

SEQ ID NO: 7740439 - DNA, 17 bp, Homo sapiens
tcaggctgggtgcagtg

SEQ ID NO: 7740440 - DNA, 22 bp, Homo sapiens
tcagggctcaccagcctctgcc

SEQ ID NO: 7740441 - DNA, 22 bp, Homo sapiens
tcagggctgcagaagaggcagg

SEQ ID NO: 7740442 - DNA, 22 bp, Homo sapiens
tcataaattgattatgtgcttt

SEQ ID NO: 7740443 - DNA, 22 bp, Homo sapiens
tcataaattagctgtctttgaa

SEQ ID NO: 7740444 - DNA, 22 bp, Homo sapiens
tcataaatgcagtgtcataaat

SEQ ID NO: 7740445 - DNA, 22 bp, Homo sapiens
tcatgcagaggaaggctagttt

SEQ ID NO: 7740446 - DNA, 23 bp, Homo sapiens
tcataaatattagcacagtagga

SEQ ID NO: 7740447 - DNA, 22 bp, Homo sapiens
tcagtgtttcctgtggtacagc

SEQ ID NO: 7740448 - DNA, 22 bp, Homo sapiens
tcagtcctcctctcatagagag

SEQ ID NO: 7740449 - DNA, 18 bp, Homo sapiens
tcagtcctccatagagct

SEQ ID NO: 7740450 - DNA, 22 bp, Homo sapiens
tcagtcctccacacaggcaccc

SEQ ID NO: 7740451 - DNA, 22 bp, Homo sapiens
tcagtcctcacttggttctaag

SEQ ID NO: 7740452 - DNA, 22 bp, Homo sapiens
tcagtcctctctgggtttctta

SEQ ID NO: 7740453 - DNA, 22 bp, Homo sapiens
tcagtcctgatgacaggcccaa

SEQ ID NO: 7740454 - DNA, 23 bp, Homo sapiens
tcagtcctgtaggggctccaggt

SEQ ID NO: 7740455 - DNA, 21 bp, Homo sapiens
tcagtcctgttagcctttggg

SEQ ID NO: 7740456 - DNA, 22 bp, Homo sapiens
tcatttccctcctacaaagagg

SEQ ID NO: 7740457 - DNA, 21 bp, Homo sapiens
tcatttctctatgtatttcac

SEQ ID NO: 7740458 - DNA, 22 bp, Homo sapiens
tcatttcttaactagagtgaac

SEQ ID NO: 7740459 - DNA, 22 bp, Homo sapiens
tcatttggagccttcctgtttt

SEQ ID NO: 7740460 - DNA, 22 bp, Homo sapiens
tcatttctgagccttccatgat

SEQ ID NO: 7740461 - DNA, 22 bp, Homo sapiens
tcatttacacttcacaaatgga

SEQ ID NO: 7740462 - DNA, 22 bp, Homo sapiens
tcatttacatagaaacaatata

SEQ ID NO: 7740463 - DNA, 18 bp, Homo sapiens
tccaaaatcatgtatttt

SEQ ID NO: 7740464 - DNA, 22 bp, Homo sapiens
tccaagtcttccttcccaaacc

SEQ ID NO: 7740465 - DNA, 22 bp, Homo sapiens
tccaattttacgtctgtataaa

SEQ ID NO: 7740466 - DNA, 22 bp, Homo sapiens
tccaatttgtttgatgatggaa

SEQ ID NO: 7740467 - DNA, 19 bp, Homo sapiens
tccaatttctattcatgtt

SEQ ID NO: 7740468 - DNA, 22 bp, Homo sapiens
tccaatttgaaatggtatatgt

SEQ ID NO: 7740469 - DNA, 20 bp, Homo sapiens
tccaatttaagaatttagag

SEQ ID NO: 7740470 - DNA, 22 bp, Homo sapiens
tccaatgttcctgctttcagct

SEQ ID NO: 7740471 - DNA, 22 bp, Homo sapiens
tccaagttgatgtttcttaaat

SEQ ID NO: 7740472 - DNA, 22 bp, Homo sapiens
tagggcagagtccaggatgggc

SEQ ID NO: 7740473 - DNA, 22 bp, Homo sapiens
tagggcttcaggtgtgaggcag

SEQ ID NO: 7740474 - DNA, 22 bp, Homo sapiens
taggcagcgcttggctgtgctt

SEQ ID NO: 7740475 - DNA, 19 bp, Homo sapiens
tagtctctgatgaggcttt

SEQ ID NO: 7740476 - DNA, 22 bp, Homo sapiens
taggggcagaagcggcggtcca

SEQ ID NO: 7740477 - DNA, 22 bp, Homo sapiens
tagttcttggttcttagttctt

SEQ ID NO: 7740478 - DNA, 22 bp, Homo sapiens
tagttctactcaaagtgtgatc

SEQ ID NO: 7740479 - DNA, 22 bp, Homo sapiens
tagcagctgcatcattttacag

SEQ ID NO: 7740480 - DNA, 22 bp, Homo sapiens
tagcagctggggctattcatca

SEQ ID NO: 7740481 - DNA, 19 bp, Homo sapiens
tagcagctgccaaaggaga

SEQ ID NO: 7740482 - DNA, 22 bp, Homo sapiens
tagcagctgtggaggggctgtg

SEQ ID NO: 7740483 - DNA, 22 bp, Homo sapiens
tagcagcttaagtaattagaat

SEQ ID NO: 7740484 - DNA, 22 bp, Homo sapiens
tagcagctgtgagtaaaagcca

SEQ ID NO: 7740485 - DNA, 22 bp, Homo sapiens
tagcagctgtcagtttcacata

SEQ ID NO: 7740486 - DNA, 22 bp, Homo sapiens
tagcagcttccagagagggcag

SEQ ID NO: 7740487 - DNA, 22 bp, Homo sapiens
tagctgcttctcacatgggcaa

SEQ ID NO: 7740488 - DNA, 22 bp, Homo sapiens
tagcagctctgattctgggccc

SEQ ID NO: 7740489 - DNA, 22 bp, Homo sapiens
tagcagctctttactaaccagt

SEQ ID NO: 7740490 - DNA, 22 bp, Homo sapiens
tagcagctcctaaacagtggtg

SEQ ID NO: 7740491 - DNA, 22 bp, Homo sapiens
tagcaaagggaaagaagggcct

SEQ ID NO: 7740492 - DNA, 22 bp, Homo sapiens
tagcaaaggccttggacacgct

SEQ ID NO: 7740493 - DNA, 23 bp, Homo sapiens
tagcaaagttgtttgggaaattt

SEQ ID NO: 7740494 - DNA, 22 bp, Homo sapiens
tagatctgatacaattcatctg

SEQ ID NO: 7740495 - DNA, 22 bp, Homo sapiens
tagatctgatacaattcatctg

SEQ ID NO: 7740496 - DNA, 22 bp, Homo sapiens
tagaaatgggttacatttagag

SEQ ID NO: 7740497 - DNA, 22 bp, Homo sapiens
tagaaatggggaagtagttagg

SEQ ID NO: 7740498 - DNA, 22 bp, Homo sapiens
tagaagataagacaagtgctgc

SEQ ID NO: 7740499 - DNA, 22 bp, Homo sapiens
tagaagattctaaagtggagag

SEQ ID NO: 7740500 - DNA, 22 bp, Homo sapiens
tagagtctagtgtatacaaagt

SEQ ID NO: 7740501 - DNA, 22 bp, Homo sapiens
tagagacaccagtaccattctg

SEQ ID NO: 7740502 - DNA, 22 bp, Homo sapiens
tagagaatggccttgaagtagt

SEQ ID NO: 7740503 - DNA, 22 bp, Homo sapiens
tagagaggtttgaattggctgc

SEQ ID NO: 7740504 - DNA, 22 bp, Homo sapiens
tatccaaagtggcatattatag

SEQ ID NO: 7740505 - DNA, 22 bp, Homo sapiens
tatgaatataccacaatttagg

SEQ ID NO: 7740506 - DNA, 22 bp, Homo sapiens
tatgaatgctccagtaactttc

SEQ ID NO: 7740507 - DNA, 22 bp, Homo sapiens
tatgaaatttctagttctgctt

SEQ ID NO: 7740508 - DNA, 22 bp, Homo sapiens
tatgaaattgccatttttatgg

SEQ ID NO: 7740509 - DNA, 22 bp, Homo sapiens
tataaagagtctcaaagaagtt

SEQ ID NO: 7740510 - DNA, 22 bp, Homo sapiens
tataaagagtctcaaagaagtt

SEQ ID NO: 7740511 - DNA, 22 bp, Homo sapiens
tataaagaaggcacagcaagac

SEQ ID NO: 7740512 - DNA, 22 bp, Homo sapiens
tataaagaaatgatttccagaa

SEQ ID NO: 7740513 - DNA, 22 bp, Homo sapiens
tatcagcaccgcggacagcatc

SEQ ID NO: 7740514 - DNA, 22 bp, Homo sapiens
tatgtactacactagaacattt

SEQ ID NO: 7740515 - DNA, 22 bp, Homo sapiens
tatgtacatacatgtgcatacg

SEQ ID NO: 7740516 - DNA, 22 bp, Homo sapiens
tattaattcttgccaattctcc

SEQ ID NO: 7740517 - DNA, 21 bp, Homo sapiens
tattaatatgtctaagctgat

SEQ ID NO: 7740518 - DNA, 22 bp, Homo sapiens
tatttgcaggcttttgtcatgg

SEQ ID NO: 7740519 - DNA, 22 bp, Homo sapiens
tattttctggggagagtgaacc

SEQ ID NO: 7740520 - DNA, 22 bp, Homo sapiens
tattacaagaaagggcatgaat

SEQ ID NO: 7740521 - DNA, 22 bp, Homo sapiens
tattacaaattataatgggaga

SEQ ID NO: 7740522 - DNA, 22 bp, Homo sapiens
tcaaatacatggtcaatcaact

SEQ ID NO: 7740523 - DNA, 22 bp, Homo sapiens
tcaaatcagcaagcagcttccc

SEQ ID NO: 7740524 - DNA, 22 bp, Homo sapiens
tcaaatcaccaaactcactggc

SEQ ID NO: 7740525 - DNA, 22 bp, Homo sapiens
tcaaatcccagctcagcctctc

SEQ ID NO: 7740526 - DNA, 22 bp, Homo sapiens
tcaaaaataagatattctggac

SEQ ID NO: 7740527 - DNA, 22 bp, Homo sapiens
tattttgcaaacctgagtttga

SEQ ID NO: 7740528 - DNA, 20 bp, Homo sapiens
tcaaagcaaagggagatgat

SEQ ID NO: 7740529 - DNA, 19 bp, Homo sapiens
tcaaagcaagcatgttctg

SEQ ID NO: 7740530 - DNA, 19 bp, Homo sapiens
tcaaagcaagcatgttctg

SEQ ID NO: 7740531 - DNA, 20 bp, Homo sapiens
tcaaagcaaagggagatgat

SEQ ID NO: 7740532 - DNA, 22 bp, Homo sapiens
tcaaagagctattcagttgtgg

SEQ ID NO: 7740533 - DNA, 22 bp, Homo sapiens
tcaaaaatggtctttgagctgc

SEQ ID NO: 7740534 - DNA, 22 bp, Homo sapiens
tactcctgctgatcctgccagc

SEQ ID NO: 7740535 - DNA, 22 bp, Homo sapiens
tacttaatgccactgaattgta

SEQ ID NO: 7740536 - DNA, 22 bp, Homo sapiens
taccagcctgaccctgtctgac

SEQ ID NO: 7740537 - DNA, 22 bp, Homo sapiens
taccagcctctgttgggggtgg

SEQ ID NO: 7740538 - DNA, 22 bp, Homo sapiens
taccagccttttaacatgggcc

SEQ ID NO: 7740539 - DNA, 22 bp, Homo sapiens
taccagcctcagttgtgagccc

SEQ ID NO: 7740540 - DNA, 22 bp, Homo sapiens
tacagtgcatagaggcatgata

SEQ ID NO: 7740541 - DNA, 22 bp, Homo sapiens
tacagttaaaaagttcaatggt

SEQ ID NO: 7740542 - DNA, 22 bp, Homo sapiens
tacatgtatgtttatcttgaga

SEQ ID NO: 7740543 - DNA, 19 bp, Homo sapiens
taccaaattgcattatggc

SEQ ID NO: 7740544 - DNA, 22 bp, Homo sapiens
taccaaatgtaatcattctaat

SEQ ID NO: 7740545 - DNA, 22 bp, Homo sapiens
taaggagagaatttagaggttt

SEQ ID NO: 7740546 - DNA, 22 bp, Homo sapiens
tacaagaaactacatgaatgca

SEQ ID NO: 7740547 - DNA, 22 bp, Homo sapiens
tacaagaaagtccagtgggttt

SEQ ID NO: 7740548 - DNA, 22 bp, Homo sapiens
tacaagagacaccagggaggct

SEQ ID NO: 7740549 - DNA, 22 bp, Homo sapiens
tacagaattagattattagaga

SEQ ID NO: 7740550 - DNA, 22 bp, Homo sapiens
tacagaattagattattagaga

SEQ ID NO: 7740551 - DNA, 20 bp, Homo sapiens
tacagaatgcaataaaatgg

SEQ ID NO: 7740552 - DNA, 22 bp, Homo sapiens
taaaagatatcttagggatttg

SEQ ID NO: 7740553 - DNA, 21 bp, Homo sapiens
taaaagatgacaagacagctc

SEQ ID NO: 7740554 - DNA, 22 bp, Homo sapiens
taaaagacatataactgtagga

SEQ ID NO: 7740555 - DNA, 22 bp, Homo sapiens
taaaagaccctctagagtccca

SEQ ID NO: 7740556 - DNA, 22 bp, Homo sapiens
taaagacataggatcagggaga

SEQ ID NO: 7740557 - DNA, 22 bp, Homo sapiens
taaaagattttataggaacaag

SEQ ID NO: 7740558 - DNA, 22 bp, Homo sapiens
taaaagattttataggaacaag

SEQ ID NO: 7740559 - DNA, 22 bp, Homo sapiens
taaaagtatactttcaaaggag

SEQ ID NO: 7740560 - DNA, 22 bp, Homo sapiens
taaaagtaggaatgaaacgcat

SEQ ID NO: 7740561 - DNA, 22 bp, Homo sapiens
taaatgcagttagtacttgcca

SEQ ID NO: 7740562 - DNA, 22 bp, Homo sapiens
taaatgcaagggaaaggcaaga

SEQ ID NO: 7740563 - DNA, 22 bp, Homo sapiens
taaatgatttatgtatgtgaaa

SEQ ID NO: 7740564 - DNA, 22 bp, Homo sapiens
taaagcaatttgagcaagttct

SEQ ID NO: 7740565 - DNA, 22 bp, Homo sapiens
taaagcaattactcagtggctt

SEQ ID NO: 7740566 - DNA, 22 bp, Homo sapiens
taaagcaatgaaagttttgcag

SEQ ID NO: 7740567 - DNA, 22 bp, Homo sapiens
taaagcaaggcaaattgttggt

SEQ ID NO: 7740568 - DNA, 22 bp, Homo sapiens
taaagcaaggaatagagtagtc

SEQ ID NO: 7740569 - DNA, 22 bp, Homo sapiens
taaagcaagacacacccatagc

SEQ ID NO: 7740570 - DNA, 22 bp, Homo sapiens
taaagatggagatgacctagga

SEQ ID NO: 7740571 - DNA, 22 bp, Homo sapiens
taaagatgcccacattgcaggt

SEQ ID NO: 7740572 - DNA, 22 bp, Homo sapiens
taaagatgctatagtgaaggag

SEQ ID NO: 7740573 - DNA, 23 bp, Homo sapiens
taaagcaaagtcaagtgcactcc

SEQ ID NO: 7740574 - DNA, 22 bp, Homo sapiens
taaagcaaaaatgaactgccat

SEQ ID NO: 7740575 - DNA, 22 bp, Homo sapiens
taagacttcattagtaatatgg

SEQ ID NO: 7740576 - DNA, 22 bp, Homo sapiens
taacagctctgtgtggctgtaa

SEQ ID NO: 7740577 - DNA, 22 bp, Homo sapiens
taacagctggcgttataggaat

SEQ ID NO: 7740578 - DNA, 22 bp, Homo sapiens
gttatcttagggtacaaaggac

SEQ ID NO: 7740579 - DNA, 22 bp, Homo sapiens
gtgttcatggatgtcaatttga

SEQ ID NO: 7740580 - DNA, 22 bp, Homo sapiens
gtgttcttttgcttcacagaaa

SEQ ID NO: 7740581 - DNA, 22 bp, Homo sapiens
gtgctggctggacatggagcac

SEQ ID NO: 7740582 - DNA, 21 bp, Homo sapiens
gtgctgggacacagccaggct

SEQ ID NO: 7740583 - DNA, 22 bp, Homo sapiens
gtgttattagagcattaatttt

SEQ ID NO: 7740584 - DNA, 22 bp, Homo sapiens
gtttcacagatggggagacacg

SEQ ID NO: 7740585 - DNA, 22 bp, Homo sapiens
gttcttcctcattgctttgaag

SEQ ID NO: 7740586 - DNA, 22 bp, Homo sapiens
ttgtcagccagctcgcactctt

SEQ ID NO: 7740587 - DNA, 22 bp, Homo sapiens
ttgtcctgtttagggataagga

SEQ ID NO: 7740588 - DNA, 22 bp, Homo sapiens
ttgtaacaggtactaaataact

SEQ ID NO: 7740589 - DNA, 22 bp, Homo sapiens
ttgtaaactggatagacctatt

SEQ ID NO: 7740590 - DNA, 22 bp, Homo sapiens
ttgtaaagttcttaggaagctc

SEQ ID NO: 7740591 - DNA, 22 bp, Homo sapiens
ttgtacagggaagtaatacaag

SEQ ID NO: 7740592 - DNA, 18 bp, Homo sapiens
ttggacctgtgtcagggc

SEQ ID NO: 7740593 - DNA, 22 bp, Homo sapiens
ttggcagcattccagccaagca

SEQ ID NO: 7740594 - DNA, 22 bp, Homo sapiens
ttggaggactagttaagagacc

SEQ ID NO: 7740595 - DNA, 22 bp, Homo sapiens
ttggccagtggaaagaggagga

SEQ ID NO: 7740596 - DNA, 22 bp, Homo sapiens
ttgggccaaggcagatctccaa

SEQ ID NO: 7740597 - DNA, 22 bp, Homo sapiens
ttgggccaaatagctatttact

SEQ ID NO: 7740598 - DNA, 22 bp, Homo sapiens
ttgggccaaagatgtccttgtt

SEQ ID NO: 7740599 - DNA, 22 bp, Homo sapiens
ttgggccactttagtttcctta

SEQ ID NO: 7740600 - DNA, 22 bp, Homo sapiens
ttgcaattgctatggagagcgt

SEQ ID NO: 7740601 - DNA, 22 bp, Homo sapiens
ttgcaattgctatggagagcgt

SEQ ID NO: 7740602 - DNA, 21 bp, Homo sapiens
ttgcacagaaaaccatagaga

SEQ ID NO: 7740603 - DNA, 22 bp, Homo sapiens
ttgcagctgtgagctttacacg

SEQ ID NO: 7740604 - DNA, 22 bp, Homo sapiens
ttgcagctgcagtaaatgttca

SEQ ID NO: 7740605 - DNA, 22 bp, Homo sapiens
ttgcagcttagtgatgttatct

SEQ ID NO: 7740606 - DNA, 22 bp, Homo sapiens
ttgcagctgttgcaaagtctct

SEQ ID NO: 7740607 - DNA, 22 bp, Homo sapiens
ttgcagcttcaagcaggttgac

SEQ ID NO: 7740608 - DNA, 22 bp, Homo sapiens
ttgcagctgaggaaattgaagc

SEQ ID NO: 7740609 - DNA, 22 bp, Homo sapiens
ttgcagcttctaccactgtttc

SEQ ID NO: 7740610 - DNA, 22 bp, Homo sapiens
ttgcagcttcttgcatcagaaa

SEQ ID NO: 7740611 - DNA, 21 bp, Homo sapiens
ttgctgttttcccaatgcagt

SEQ ID NO: 7740612 - DNA, 22 bp, Homo sapiens
ttggaattgtgaactaagtgat

SEQ ID NO: 7740613 - DNA, 22 bp, Homo sapiens
ttggaattcctgttgtttcgtc

SEQ ID NO: 7740614 - DNA, 22 bp, Homo sapiens
ttggaattgaggatttacatag

SEQ ID NO: 7740615 - DNA, 21 bp, Homo sapiens
ttggaatttgggagctatgtg

SEQ ID NO: 7740616 - DNA, 22 bp, Homo sapiens
ttggaaatacagcagttacttt

SEQ ID NO: 7740617 - DNA, 22 bp, Homo sapiens
ttggaaatgcaaatatattgaa

SEQ ID NO: 7740618 - DNA, 22 bp, Homo sapiens
ttggaaatgatttctattatta

SEQ ID NO: 7740619 - DNA, 22 bp, Homo sapiens
ttggaaatggctgtagttatga

SEQ ID NO: 7740620 - DNA, 22 bp, Homo sapiens
tttacagtgtcttgttgactgt

SEQ ID NO: 7740621 - DNA, 22 bp, Homo sapiens
tttacagtgagagcttagtgag

SEQ ID NO: 7740622 - DNA, 22 bp, Homo sapiens
tttacagtgagagcttagtgag

SEQ ID NO: 7740623 - DNA, 20 bp, Homo sapiens
tttacattttgaaacagtga

SEQ ID NO: 7740624 - DNA, 22 bp, Homo sapiens
tttagagttgagtattcattgg

SEQ ID NO: 7740625 - DNA, 22 bp, Homo sapiens
tttagagaccctctgctatttt

SEQ ID NO: 7740626 - DNA, 22 bp, Homo sapiens
tttatcaaacaaattatccagc

SEQ ID NO: 7740627 - DNA, 22 bp, Homo sapiens
tttagcaattattaagggttga

SEQ ID NO: 7740628 - DNA, 22 bp, Homo sapiens
tttaaactaacagtacacgttg

SEQ ID NO: 7740629 - DNA, 22 bp, Homo sapiens
tttacagtaaggtggatggtac

SEQ ID NO: 7740630 - DNA, 22 bp, Homo sapiens
tttacagtctatgttgaattaa

SEQ ID NO: 7740631 - DNA, 22 bp, Homo sapiens
tttacagtctatgttgaattaa

SEQ ID NO: 7740632 - DNA, 22 bp, Homo sapiens
tttacagtctgtctagcaatgt

SEQ ID NO: 7740633 - DNA, 22 bp, Homo sapiens
tttcaacatcacctagcagttc

SEQ ID NO: 7740634 - DNA, 22 bp, Homo sapiens
tttcacactagtcagaatacca

SEQ ID NO: 7740635 - DNA, 22 bp, Homo sapiens
tttcacactgcagcatcagaga

SEQ ID NO: 7740636 - DNA, 22 bp, Homo sapiens
tttcacacaacgtgaatatact

SEQ ID NO: 7740637 - DNA, 22 bp, Homo sapiens
tttcattcattatacagtagag

SEQ ID NO: 7740638 - DNA, 22 bp, Homo sapiens
tttcatggctaggactagagtg

SEQ ID NO: 7740639 - DNA, 22 bp, Homo sapiens
tttcacagatgttttggagtct

SEQ ID NO: 7740640 - DNA, 22 bp, Homo sapiens
ttcctgcatggattgaggctat

SEQ ID NO: 7740641 - DNA, 22 bp, Homo sapiens
ttcctgagaaatttgtacctgg

SEQ ID NO: 7740642 - DNA, 22 bp, Homo sapiens
ttccagttctggctttgccact

SEQ ID NO: 7740643 - DNA, 22 bp, Homo sapiens
ttcctgagtcgccgagtctatg

SEQ ID NO: 7740644 - DNA, 23 bp, Homo sapiens
ttcctgagtgctggagagagtgc

SEQ ID NO: 7740645 - DNA, 22 bp, Homo sapiens
ttcctgagtcccgggtaaagat

SEQ ID NO: 7740646 - DNA, 22 bp, Homo sapiens
ttcctgagcaccagacactgca

SEQ ID NO: 7740647 - DNA, 22 bp, Homo sapiens
ttcctgagcttttaacctagtc

SEQ ID NO: 7740648 - DNA, 22 bp, Homo sapiens
ttccttggagttaagaccctgg

SEQ ID NO: 7740649 - DNA, 22 bp, Homo sapiens
ttccttggatacaagtaacttt

SEQ ID NO: 7740650 - DNA, 22 bp, Homo sapiens
ttccttcttccagaggctgccc

SEQ ID NO: 7740651 - DNA, 18 bp, Homo sapiens
ttccttctgatgtatatg

SEQ ID NO: 7740652 - DNA, 22 bp, Homo sapiens
ttcctggggtactggagaaaat

SEQ ID NO: 7740653 - DNA, 22 bp, Homo sapiens
ttcctggtttgcctggaatcca

SEQ ID NO: 7740654 - DNA, 22 bp, Homo sapiens
ttcctggtagtaagacatctgg

SEQ ID NO: 7740655 - DNA, 22 bp, Homo sapiens
ttctcaggtcaccagggtgcca

SEQ ID NO: 7740656 - DNA, 22 bp, Homo sapiens
ttctcagggtctggatggcctg

SEQ ID NO: 7740657 - DNA, 22 bp, Homo sapiens
ttctcaggcccctgcctggact

SEQ ID NO: 7740658 - DNA, 22 bp, Homo sapiens
ttctcaggcctttgggatggga

SEQ ID NO: 7740659 - DNA, 22 bp, Homo sapiens
ttccttggtacagagtagcttt

SEQ ID NO: 7740660 - DNA, 22 bp, Homo sapiens
ttctctgcagcttaggcccagt

SEQ ID NO: 7740661 - DNA, 22 bp, Homo sapiens
ttctctggaaggctctacggga

SEQ ID NO: 7740662 - DNA, 22 bp, Homo sapiens
ttctctggaactgaaacaagat

SEQ ID NO: 7740663 - DNA, 22 bp, Homo sapiens
ttctctaatacattttgacaaa

SEQ ID NO: 7740664 - DNA, 22 bp, Homo sapiens
ttctctcagttaaactttgtga

SEQ ID NO: 7740665 - DNA, 22 bp, Homo sapiens
ttcttcaaccatctacataaac

SEQ ID NO: 7740666 - DNA, 22 bp, Homo sapiens
ttgaatttagattgtatgttga

SEQ ID NO: 7740667 - DNA, 23 bp, Homo sapiens
ttgaatttctcttgcaatattta

SEQ ID NO: 7740668 - DNA, 22 bp, Homo sapiens
ttgaaattttaggccttgcaat

SEQ ID NO: 7740669 - DNA, 22 bp, Homo sapiens
ttcttactacatttgcaggcta

SEQ ID NO: 7740670 - DNA, 22 bp, Homo sapiens
ttctgtgttctgtgcaatgagc

SEQ ID NO: 7740671 - DNA, 22 bp, Homo sapiens
ttctgtgtgggtagctcctgtt

SEQ ID NO: 7740672 - DNA, 22 bp, Homo sapiens
ttctgtgtgtctcagcaagctg

SEQ ID NO: 7740673 - DNA, 22 bp, Homo sapiens
ttctggaatactaagttccttt

SEQ ID NO: 7740674 - DNA, 22 bp, Homo sapiens
ttctggaagtggaatttttgta

SEQ ID NO: 7740675 - DNA, 21 bp, Homo sapiens
ttctctggtcaagcacacata

SEQ ID NO: 7740676 - DNA, 22 bp, Homo sapiens
ttctctgggatctggcaaaagg

SEQ ID NO: 7740677 - DNA, 22 bp, Homo sapiens
ttctctgggcttttcggatccg

SEQ ID NO: 7740678 - DNA, 22 bp, Homo sapiens
ttctctggggactgtctctatt

SEQ ID NO: 7740679 - DNA, 19 bp, Homo sapiens
ttctctggactagatgctg

SEQ ID NO: 7740680 - DNA, 22 bp, Homo sapiens
ttctctgggacaggaacagttt

SEQ ID NO: 7740681 - DNA, 22 bp, Homo sapiens
ttctctggacagtgaagagagg

SEQ ID NO: 7740682 - DNA, 16 bp, Homo sapiens
ttctctggggttgtgc

SEQ ID NO: 7740683 - DNA, 22 bp, Homo sapiens
ttctctgggttaggggaactat

SEQ ID NO: 7740684 - DNA, 22 bp, Homo sapiens
ttctctggtaaacacatgcgta

SEQ ID NO: 7740685 - DNA, 22 bp, Homo sapiens
ttctctggggttcagtatctct

SEQ ID NO: 7740686 - DNA, 22 bp, Homo sapiens
ttctctggggacttggttggag

SEQ ID NO: 7740687 - DNA, 22 bp, Homo sapiens
ttctggagccccaagatctgta

SEQ ID NO: 7740688 - DNA, 22 bp, Homo sapiens
ttctggagaggaacagaaaggt

SEQ ID NO: 7740689 - DNA, 22 bp, Homo sapiens
ttctggagattgagaaggcatt

SEQ ID NO: 7740690 - DNA, 22 bp, Homo sapiens
ttctggagacccagcaacaggg

SEQ ID NO: 7740691 - DNA, 22 bp, Homo sapiens
ttctggaattcttgcagccact

SEQ ID NO: 7740692 - DNA, 22 bp, Homo sapiens
ttagccttagaagcttagcaaa

SEQ ID NO: 7740693 - DNA, 22 bp, Homo sapiens
ttattaataaagtggcatagcc

SEQ ID NO: 7740694 - DNA, 22 bp, Homo sapiens
ttattaatgagtacaagttatt

SEQ ID NO: 7740695 - DNA, 22 bp, Homo sapiens
ttcaaaccttcacttgcagagt

SEQ ID NO: 7740696 - DNA, 22 bp, Homo sapiens
ttcaaacctatctaagaaatag

SEQ ID NO: 7740697 - DNA, 22 bp, Homo sapiens
ttcaaactcttgctctgctagt

SEQ ID NO: 7740698 - DNA, 19 bp, Homo sapiens
ttccaggtgctgtggggag

SEQ ID NO: 7740699 - DNA, 22 bp, Homo sapiens
ttccaggaacactctgtgtccc

SEQ ID NO: 7740700 - DNA, 22 bp, Homo sapiens
ttcagtgtgcttcaggacgtta

SEQ ID NO: 7740701 - DNA, 22 bp, Homo sapiens
ttcagtgtggcccatgaagagg

SEQ ID NO: 7740702 - DNA, 22 bp, Homo sapiens
ttcagtgtggtgcacagttttg

SEQ ID NO: 7740703 - DNA, 22 bp, Homo sapiens
ttcagtgttaaattcaaagagt

SEQ ID NO: 7740704 - DNA, 22 bp, Homo sapiens
ttcagtgttaatcttgggagaa

SEQ ID NO: 7740705 - DNA, 22 bp, Homo sapiens
ttcagtgttcttttctgttagc

SEQ ID NO: 7740706 - DNA, 22 bp, Homo sapiens
ttcagtgtttgtagagataact

SEQ ID NO: 7740707 - DNA, 22 bp, Homo sapiens
ttcatttaatcagaatctctaa

SEQ ID NO: 7740708 - DNA, 22 bp, Homo sapiens
ttcagcaccctctgaggcatcc

SEQ ID NO: 7740709 - DNA, 22 bp, Homo sapiens
ttcagcacctggaatagcacct

SEQ ID NO: 7740710 - DNA, 22 bp, Homo sapiens
ttcagcacagttcaagatggta

SEQ ID NO: 7740711 - DNA, 22 bp, Homo sapiens
ttcagcactggacagcgagtct

SEQ ID NO: 7740712 - DNA, 22 bp, Homo sapiens
ttcagcactttgttttgctcat

SEQ ID NO: 7740713 - DNA, 22 bp, Homo sapiens
ttcagtgtgcctaagtcagttg

SEQ ID NO: 7740714 - DNA, 22 bp, Homo sapiens
ttcagtgtgaagcttctgaaag

SEQ ID NO: 7740715 - DNA, 22 bp, Homo sapiens
ttcagtgtccctagtagaagtt

SEQ ID NO: 7740716 - DNA, 22 bp, Homo sapiens
ttcagagagtccagtatgcagt

SEQ ID NO: 7740717 - DNA, 22 bp, Homo sapiens
ttcagagacagcaaccaggaca

SEQ ID NO: 7740718 - DNA, 22 bp, Homo sapiens
ttcagagatggaaggcagaatg

SEQ ID NO: 7740719 - DNA, 22 bp, Homo sapiens
ttcagagaacttcatggaagag

SEQ ID NO: 7740720 - DNA, 22 bp, Homo sapiens
ttcagagaagcaaaggcagatt

SEQ ID NO: 7740721 - DNA, 20 bp, Homo sapiens
ttcaaagaccctcaggtcca

SEQ ID NO: 7740722 - DNA, 22 bp, Homo sapiens
ttcaaagcagagggtcaataca

SEQ ID NO: 7740723 - DNA, 22 bp, Homo sapiens
ttcaaagcaagacacaattcct

SEQ ID NO: 7740724 - DNA, 23 bp, Homo sapiens
ttcaaagcttaagctctttccac

SEQ ID NO: 7740725 - DNA, 22 bp, Homo sapiens
ttcacagatgtattggaactcc

SEQ ID NO: 7740726 - DNA, 22 bp, Homo sapiens
ttcacagatgagaaaattgagg

SEQ ID NO: 7740727 - DNA, 20 bp, Homo sapiens
ttcacagaggactcaggtca

SEQ ID NO: 7740728 - DNA, 22 bp, Homo sapiens
tttgtgtttgtacaatgcacta

SEQ ID NO: 7740729 - DNA, 22 bp, Homo sapiens
tttgtaaaaggaggaagcatgg

SEQ ID NO: 7740730 - DNA, 22 bp, Homo sapiens
tttgtaaagtctgttctgagtt

SEQ ID NO: 7740731 - DNA, 22 bp, Homo sapiens
tttgtaaaggcctgaatttcag

SEQ ID NO: 7740732 - DNA, 22 bp, Homo sapiens
tttgtaaatagcagtactcatg

SEQ ID NO: 7740733 - DNA, 22 bp, Homo sapiens
ttttaattcaaagtgaatagtg

SEQ ID NO: 7740734 - DNA, 22 bp, Homo sapiens
ttttcttactgtctgtgatcct

SEQ ID NO: 7740735 - DNA, 22 bp, Homo sapiens
ttttcttatagagcttaaagtt

SEQ ID NO: 7740736 - DNA, 22 bp, Homo sapiens
ttttcttaggtgctccaagtag

SEQ ID NO: 7740737 - DNA, 22 bp, Homo sapiens
ttttcttatgtgcagctatatg

SEQ ID NO: 7740738 - DNA, 20 bp, Homo sapiens
ttttctgtgccaagaaaact

SEQ ID NO: 7740739 - DNA, 22 bp, Homo sapiens
ttttcacattgtcccagcacta

SEQ ID NO: 7740740 - DNA, 22 bp, Homo sapiens
ttttatgtgtgaaatgctgtct

SEQ ID NO: 7740741 - DNA, 22 bp, Homo sapiens
tttctttgagtctcagtttgct

SEQ ID NO: 7740742 - DNA, 22 bp, Homo sapiens
tttctttgttgttatcacatca

SEQ ID NO: 7740743 - DNA, 22 bp, Homo sapiens
tttcttttgaatagtgtgtggt

SEQ ID NO: 7740744 - DNA, 22 bp, Homo sapiens
tttggaaactgcctcagctctt

SEQ ID NO: 7740745 - DNA, 22 bp, Homo sapiens
tttggaaaatattgaactggtt

SEQ ID NO: 7740746 - DNA, 22 bp, Homo sapiens
tttggaaaatattgaactggtt

SEQ ID NO: 7740747 - DNA, 22 bp, Homo sapiens
tttggtctctgtgcatcctcct

SEQ ID NO: 7740748 - DNA, 22 bp, Homo sapiens
tttgctttcttgattcagatta

SEQ ID NO: 7740749 - DNA, 22 bp, Homo sapiens
tttgatagttgattaaattcca

SEQ ID NO: 7740750 - DNA, 22 bp, Homo sapiens
tttgataattaaaaattgtagt

SEQ ID NO: 7740751 - DNA, 22 bp, Homo sapiens
tttttagagtgttaccagtata

SEQ ID NO: 7740752 - DNA, 22 bp, Homo sapiens
ttttgtttgtgtccactgcagt

SEQ ID NO: 7740753 - DNA, 22 bp, Homo sapiens
ttttgtttaaaatcctggatgg

SEQ ID NO: 7740754 - DNA, 22 bp, Homo sapiens
aagcttgggaaccacggtaatc

SEQ ID NO: 7740755 - DNA, 22 bp, Homo sapiens
aagcttggaagtcttcctttca

SEQ ID NO: 7740756 - DNA, 21 bp, Homo sapiens
aagcttggctgatgttattgg

SEQ ID NO: 7740757 - DNA, 22 bp, Homo sapiens
aaggaaggttcatagtcaaaga

SEQ ID NO: 7740758 - DNA, 22 bp, Homo sapiens
aaggaaggttcatagtcaaaga

SEQ ID NO: 7740759 - DNA, 22 bp, Homo sapiens
aaggaaggtactcagtgattct

SEQ ID NO: 7740760 - DNA, 22 bp, Homo sapiens
aaggaaggttcatagtcaaaga

SEQ ID NO: 7740761 - DNA, 22 bp, Homo sapiens
aaggaaggaattgatcatgcgc

SEQ ID NO: 7740762 - DNA, 22 bp, Homo sapiens
aaggaagggaaatagtgatgtc

SEQ ID NO: 7740763 - DNA, 22 bp, Homo sapiens
aaggaagggaaatagtgatgtc

SEQ ID NO: 7740764 - DNA, 22 bp, Homo sapiens
aaggatttttggaatgagatgg

SEQ ID NO: 7740765 - DNA, 22 bp, Homo sapiens
aaggcaaaagaggtgtcatcac

SEQ ID NO: 7740766 - DNA, 22 bp, Homo sapiens
aaggatgaacattaatacatca

SEQ ID NO: 7740767 - DNA, 22 bp, Homo sapiens
aaggatgattggtaatgacact

SEQ ID NO: 7740768 - DNA, 22 bp, Homo sapiens
aaggaggcctggcagatgaaga

SEQ ID NO: 7740769 - DNA, 22 bp, Homo sapiens
acatctagactcttgccctctt

SEQ ID NO: 7740770 - DNA, 22 bp, Homo sapiens
aaggccagagcgtgtcctgcct

SEQ ID NO: 7740771 - DNA, 22 bp, Homo sapiens
aaggccagattcactttacaat

SEQ ID NO: 7740772 - DNA, 22 bp, Homo sapiens
aagggctggatctctctgagca

SEQ ID NO: 7740773 - DNA, 22 bp, Homo sapiens
aagggatgcaggaaagaaggtt

SEQ ID NO: 7740774 - DNA, 22 bp, Homo sapiens
aagggaggtaaagctatttaaa

SEQ ID NO: 7740775 - DNA, 22 bp, Homo sapiens
aagggaggggatgtaagcctgg

SEQ ID NO: 7740776 - DNA, 20 bp, Homo sapiens
aagggagaataatgattgta

SEQ ID NO: 7740777 - DNA, 23 bp, Homo sapiens
aagggtccatagctatcattaca

SEQ ID NO: 7740778 - DNA, 22 bp, Homo sapiens
aagggtccagcacctcggctcc

SEQ ID NO: 7740779 - DNA, 22 bp, Homo sapiens
aagggtccaaggctttgcgttt

SEQ ID NO: 7740780 - DNA, 22 bp, Homo sapiens
aaggggaagagaccgcagagtc

SEQ ID NO: 7740781 - DNA, 22 bp, Homo sapiens
acctctgcaaccctggaatggg

SEQ ID NO: 7740782 - DNA, 20 bp, Homo sapiens
acctagtacaatctgtttct

SEQ ID NO: 7740783 - DNA, 22 bp, Homo sapiens
aagtccataggtttcatgaggg

SEQ ID NO: 7740784 - DNA, 22 bp, Homo sapiens
aagtgtgttgactgaattgggg

SEQ ID NO: 7740785 - DNA, 22 bp, Homo sapiens
actctgggaatcctcaccttcc

SEQ ID NO: 7740786 - DNA, 22 bp, Homo sapiens
actctggcttgaggaccaggtc

SEQ ID NO: 7740787 - DNA, 18 bp, Homo sapiens
actctgggacctgttatt

SEQ ID NO: 7740788 - DNA, 22 bp, Homo sapiens
aagttcaagtagtgttacatgg

SEQ ID NO: 7740789 - DNA, 22 bp, Homo sapiens
actctttgtctgttgccgctta

SEQ ID NO: 7740790 - DNA, 20 bp, Homo sapiens
aagttttctccaaatacagt

SEQ ID NO: 7740791 - DNA, 22 bp, Homo sapiens
actgcactccagcctgggtgac

SEQ ID NO: 7740792 - DNA, 22 bp, Homo sapiens
aataaaatgaactggtagagtt

SEQ ID NO: 7740793 - DNA, 22 bp, Homo sapiens
aataaaatgaactggtagagtt

SEQ ID NO: 7740794 - DNA, 22 bp, Homo sapiens
aagttttgaaatactgaagtgt

SEQ ID NO: 7740795 - DNA, 22 bp, Homo sapiens
aataagttgcctgttgaatcat

SEQ ID NO: 7740796 - DNA, 22 bp, Homo sapiens
aataatacatgagattaatgtt

SEQ ID NO: 7740797 - DNA, 21 bp, Homo sapiens
aatgcattaacataaagctga

SEQ ID NO: 7740798 - DNA, 22 bp, Homo sapiens
aatgcattagctacatatgtct

SEQ ID NO: 7740799 - DNA, 22 bp, Homo sapiens
aatgcacaaaggtgtctattgc

SEQ ID NO: 7740800 - DNA, 22 bp, Homo sapiens
aatgcattttattatatgtgac

SEQ ID NO: 7740801 - DNA, 22 bp, Homo sapiens
aatgaagaaatggacatcttta

SEQ ID NO: 7740802 - DNA, 22 bp, Homo sapiens
aatgaagtgttatttagtttca

SEQ ID NO: 7740803 - DNA, 22 bp, Homo sapiens
aatgaagttctattcattttct

SEQ ID NO: 7740804 - DNA, 22 bp, Homo sapiens
aatctaaggacttagcattgct

SEQ ID NO: 7740805 - DNA, 22 bp, Homo sapiens
aatctaagccaccagtagtttc

SEQ ID NO: 7740806 - DNA, 22 bp, Homo sapiens
aatctacatagagatcaaatga

SEQ ID NO: 7740807 - DNA, 22 bp, Homo sapiens
agaaagggagcgtggatcaatt

SEQ ID NO: 7740808 - DNA, 22 bp, Homo sapiens
agaaagggagagccagcacacg

SEQ ID NO: 7740809 - DNA, 22 bp, Homo sapiens
agaaagggaactggcaaagcca

SEQ ID NO: 7740810 - DNA, 22 bp, Homo sapiens
agaaagggaactggcaaagcca

SEQ ID NO: 7740811 - DNA, 22 bp, Homo sapiens
aatcaagagttgtgtaatattt

SEQ ID NO: 7740812 - DNA, 22 bp, Homo sapiens
aatcaatgttagtcatgaattt

SEQ ID NO: 7740813 - DNA, 22 bp, Homo sapiens
aatcaagagttgtgtaatattt

SEQ ID NO: 7740814 - DNA, 17 bp, Homo sapiens
acagaggcaggagtgga

SEQ ID NO: 7740815 - DNA, 22 bp, Homo sapiens
acagaggtcacctttgtatctt

SEQ ID NO: 7740816 - DNA, 22 bp, Homo sapiens
acagaggtaggacatgagatat

SEQ ID NO: 7740817 - DNA, 22 bp, Homo sapiens
acagagggtttctaaggatttg

SEQ ID NO: 7740818 - DNA, 19 bp, Homo sapiens
acagagggcaactgagaaa

SEQ ID NO: 7740819 - DNA, 22 bp, Homo sapiens
acagaggctgcgcttgggaacg

SEQ ID NO: 7740820 - DNA, 22 bp, Homo sapiens
acagaggctgatcttcaagccc

SEQ ID NO: 7740821 - DNA, 23 bp, Homo sapiens
acagaggcttaaatgagtggcag

SEQ ID NO: 7740822 - DNA, 22 bp, Homo sapiens
acagaggcctcgtaggtacaac

SEQ ID NO: 7740823 - DNA, 22 bp, Homo sapiens
acagaggcctcggcctgcccag

SEQ ID NO: 7740824 - DNA, 22 bp, Homo sapiens
acagaggccccgtgggagagcc

SEQ ID NO: 7740825 - DNA, 21 bp, Homo sapiens
agcgtcaatatcgtcaacagg

SEQ ID NO: 7740826 - DNA, 22 bp, Homo sapiens
agcgtgaattagttggtacaca

SEQ ID NO: 7740827 - DNA, 22 bp, Homo sapiens
acagaggtcatggagagttctc

SEQ ID NO: 7740828 - DNA, 21 bp, Homo sapiens
agctgaggtaaggcaagagag

SEQ ID NO: 7740829 - DNA, 22 bp, Homo sapiens
agcagggaatagcggaaagaat

SEQ ID NO: 7740830 - DNA, 22 bp, Homo sapiens
agcagggactacgtgaaagtga

SEQ ID NO: 7740831 - DNA, 19 bp, Homo sapiens
agcaggccacagggccagc

SEQ ID NO: 7740832 - DNA, 22 bp, Homo sapiens
acaccatggttcccaaactgtg

SEQ ID NO: 7740833 - DNA, 22 bp, Homo sapiens
aattacaaatgtagactctcat

SEQ ID NO: 7740834 - DNA, 23 bp, Homo sapiens
aattacaaccaagaactggaagg

SEQ ID NO: 7740835 - DNA, 22 bp, Homo sapiens
agagcacagaagttatatgtta

SEQ ID NO: 7740836 - DNA, 22 bp, Homo sapiens
agagctggaagctgctcttaga

SEQ ID NO: 7740837 - DNA, 22 bp, Homo sapiens
agagctggaagctgctcttaga

SEQ ID NO: 7740838 - DNA, 22 bp, Homo sapiens
agaggatgattttaaggacact

SEQ ID NO: 7740839 - DNA, 22 bp, Homo sapiens
agagctgggtggtggtgactca

SEQ ID NO: 7740840 - DNA, 22 bp, Homo sapiens
aattccaagagcttcctaagtg

SEQ ID NO: 7740841 - DNA, 22 bp, Homo sapiens
aattccaacagacaaagttaga

SEQ ID NO: 7740842 - DNA, 22 bp, Homo sapiens
aattccacagatgtctatctgt

SEQ ID NO: 7740843 - DNA, 22 bp, Homo sapiens
agaggaagtaatcaggacctgc

SEQ ID NO: 7740844 - DNA, 22 bp, Homo sapiens
agaggaatctgtctagacacaa

SEQ ID NO: 7740845 - DNA, 21 bp, Homo sapiens
agaggaagtgattggtctggc

SEQ ID NO: 7740846 - DNA, 22 bp, Homo sapiens
agaggaataaatttctgtagtg

SEQ ID NO: 7740847 - DNA, 22 bp, Homo sapiens
agagaaatgattcctgggcaga

SEQ ID NO: 7740848 - DNA, 22 bp, Homo sapiens
agagaaggcatagaacttgagt

SEQ ID NO: 7740849 - DNA, 22 bp, Homo sapiens
agagaagggcctgtatgtaatc

SEQ ID NO: 7740850 - DNA, 22 bp, Homo sapiens
agagaaggggtaaagagtcctg

SEQ ID NO: 7740851 - DNA, 22 bp, Homo sapiens
agacatggagaaggagccagtg

SEQ ID NO: 7740852 - DNA, 22 bp, Homo sapiens
agatgctgctccacaggccagg

SEQ ID NO: 7740853 - DNA, 22 bp, Homo sapiens
agatgcagagtttgctgtggac

SEQ ID NO: 7740854 - DNA, 21 bp, Homo sapiens
agatgcagttatgagatgcag

SEQ ID NO: 7740855 - DNA, 22 bp, Homo sapiens
agatgcagatttggattcagga

SEQ ID NO: 7740856 - DNA, 21 bp, Homo sapiens
agatgcagtttgcaggtgggt

SEQ ID NO: 7740857 - DNA, 22 bp, Homo sapiens
acaaagtgctgacattacaggc

SEQ ID NO: 7740858 - DNA, 22 bp, Homo sapiens
agagttcagttgtagccatatt

SEQ ID NO: 7740859 - DNA, 22 bp, Homo sapiens
aatttcttgggagctcagagaa

SEQ ID NO: 7740860 - DNA, 22 bp, Homo sapiens
aatttctccaagaatgcttaga

SEQ ID NO: 7740861 - DNA, 22 bp, Homo sapiens
aatttctcatggattcagttat

SEQ ID NO: 7740862 - DNA, 22 bp, Homo sapiens
aatttctcggttttgatattgt

SEQ ID NO: 7740863 - DNA, 22 bp, Homo sapiens
aatttgattcagcaaatgttca

SEQ ID NO: 7740864 - DNA, 18 bp, Homo sapiens
aatttctttgacaactta

SEQ ID NO: 7740865 - DNA, 22 bp, Homo sapiens
aatttgtacaaaatgtttataa

SEQ ID NO: 7740866 - DNA, 22 bp, Homo sapiens
agagttcacactcagtgcaccc

SEQ ID NO: 7740867 - DNA, 21 bp, Homo sapiens
agagttactgtcatcctaggt

SEQ ID NO: 7740868 - DNA, 22 bp, Homo sapiens
agcacagaaagtattgactgaa

SEQ ID NO: 7740869 - DNA, 22 bp, Homo sapiens
agcacagaatggcttggaagcc

SEQ ID NO: 7740870 - DNA, 22 bp, Homo sapiens
agcacagaatgaggtggaagtg

SEQ ID NO: 7740871 - DNA, 22 bp, Homo sapiens
agcacaaatataaaaatgtctg

SEQ ID NO: 7740872 - DNA, 22 bp, Homo sapiens
agcaaagctgattaagagcaca

SEQ ID NO: 7740873 - DNA, 22 bp, Homo sapiens
agcaaagctgattaagagcaca

SEQ ID NO: 7740874 - DNA, 22 bp, Homo sapiens
agcaaagcttccataaagcagc

SEQ ID NO: 7740875 - DNA, 22 bp, Homo sapiens
acacagaagatctcttaatgct

SEQ ID NO: 7740876 - DNA, 22 bp, Homo sapiens
acacagaagctttttctattcc

SEQ ID NO: 7740877 - DNA, 22 bp, Homo sapiens
aagagtttccagttgtggctca

SEQ ID NO: 7740878 - DNA, 22 bp, Homo sapiens
aagataatattcattaactaga

SEQ ID NO: 7740879 - DNA, 22 bp, Homo sapiens
aagataatgtgtctgtctttgc

SEQ ID NO: 7740880 - DNA, 22 bp, Homo sapiens
acacagctagtgagtggcagag

SEQ ID NO: 7740881 - DNA, 17 bp, Homo sapiens
acacagccaggttctcc

SEQ ID NO: 7740882 - DNA, 22 bp, Homo sapiens
acaatgtcacctctcatgtttt

SEQ ID NO: 7740883 - DNA, 22 bp, Homo sapiens
acaatgtctcatattcgtgttc

SEQ ID NO: 7740884 - DNA, 20 bp, Homo sapiens
acaatatgtagatgaatagc

SEQ ID NO: 7740885 - DNA, 22 bp, Homo sapiens
acaaaagtgtaggaattcctta

SEQ ID NO: 7740886 - DNA, 22 bp, Homo sapiens
acaaaagtgagtgtgtctcaga

SEQ ID NO: 7740887 - DNA, 22 bp, Homo sapiens
aatgtacaataagacaaagagg

SEQ ID NO: 7740888 - DNA, 22 bp, Homo sapiens
aagaagatggttaactttcagt

SEQ ID NO: 7740889 - DNA, 20 bp, Homo sapiens
acagagatcagctgatgggc

SEQ ID NO: 7740890 - DNA, 22 bp, Homo sapiens
acagagatgggaacattcaggt

SEQ ID NO: 7740891 - DNA, 22 bp, Homo sapiens
acagagatggcttttcagaggc

SEQ ID NO: 7740892 - DNA, 22 bp, Homo sapiens
acacatataccactgtaaatga

SEQ ID NO: 7740893 - DNA, 23 bp, Homo sapiens
acagaaagttctgctggacagag

SEQ ID NO: 7740894 - DNA, 22 bp, Homo sapiens
aagcataaaacgttacaacatg

SEQ ID NO: 7740895 - DNA, 22 bp, Homo sapiens
acagccaggcccagcacgcagg

SEQ ID NO: 7740896 - DNA, 22 bp, Homo sapiens
acagccaggagccatgggcagg

SEQ ID NO: 7740897 - DNA, 22 bp, Homo sapiens
acagccaggaattctggagaag

SEQ ID NO: 7740898 - DNA, 21 bp, Homo sapiens
acagccaggaacatgaggggc

SEQ ID NO: 7740899 - DNA, 22 bp, Homo sapiens
aatacagtaattttgatgagtt

SEQ ID NO: 7740900 - DNA, 22 bp, Homo sapiens
aatatctgtggccatacaattt

SEQ ID NO: 7740901 - DNA, 22 bp, Homo sapiens
aataatgtacatacatatttcg

SEQ ID NO: 7740902 - DNA, 22 bp, Homo sapiens
aataagaattgccagatttgaa

SEQ ID NO: 7740903 - DNA, 21 bp, Homo sapiens
aacagttctctttgaaggtgt

SEQ ID NO: 7740904 - DNA, 22 bp, Homo sapiens
aagttacagttattatttaaaa

SEQ ID NO: 7740905 - DNA, 22 bp, Homo sapiens
aagttacagttacagaatggag

SEQ ID NO: 7740906 - DNA, 22 bp, Homo sapiens
aatgaaatgaagatatgatcag

SEQ ID NO: 7740907 - DNA, 22 bp, Homo sapiens
aatctcactcaaagaattctct

SEQ ID NO: 7740908 - DNA, 20 bp, Homo sapiens
aatctcagtatcctatgcaa

SEQ ID NO: 7740909 - DNA, 17 bp, Homo sapiens
aatctcagtggcttaag

SEQ ID NO: 7740910 - DNA, 22 bp, Homo sapiens
aatgaaatagttggctgtagag

SEQ ID NO: 7740911 - DNA, 22 bp, Homo sapiens
aatgaaatagttggctgtagag

SEQ ID NO: 7740912 - DNA, 22 bp, Homo sapiens
aatgaaatctgctgggtaaaga

SEQ ID NO: 7740913 - DNA, 22 bp, Homo sapiens
aatgtacaaaagtcagccaact

SEQ ID NO: 7740914 - DNA, 21 bp, Homo sapiens
aacttgtatttctccttattc

SEQ ID NO: 7740915 - DNA, 22 bp, Homo sapiens
aagtccagtgatactggcagga

SEQ ID NO: 7740916 - DNA, 21 bp, Homo sapiens
aaggtctgtaaagtgacagga

SEQ ID NO: 7740917 - DNA, 22 bp, Homo sapiens
aaggtctgtattagagtttcat

SEQ ID NO: 7740918 - DNA, 22 bp, Homo sapiens
aagtgcctgggcaacatagcaa

SEQ ID NO: 7740919 - DNA, 22 bp, Homo sapiens
aagtctttttgaatctataact

SEQ ID NO: 7740920 - DNA, 22 bp, Homo sapiens
aagtcttttgctaagagtaatg

SEQ ID NO: 7740921 - DNA, 22 bp, Homo sapiens
aacagtgctgattattttacct

SEQ ID NO: 7740922 - DNA, 22 bp, Homo sapiens
aacagtaaagacagaatttatc

SEQ ID NO: 7740923 - DNA, 22 bp, Homo sapiens
aacagtgcttcattcacacatt

SEQ ID NO: 7740924 - DNA, 22 bp, Homo sapiens
aaggagtctgggccattcagag

SEQ ID NO: 7740925 - DNA, 16 bp, Homo sapiens
aaggagggaagagaat

SEQ ID NO: 7740926 - DNA, 22 bp, Homo sapiens
aaggagaagtctgttgagattg

SEQ ID NO: 7740927 - DNA, 22 bp, Homo sapiens
aaggagaagggtaatcaacaca

SEQ ID NO: 7740928 - DNA, 22 bp, Homo sapiens
aaggctgaattcaagggtaggc

SEQ ID NO: 7740929 - DNA, 22 bp, Homo sapiens
aaggctgaccagtttacacttt

SEQ ID NO: 7740930 - DNA, 21 bp, Homo sapiens
aaggctgagacaactcaggag

SEQ ID NO: 7740931 - DNA, 22 bp, Homo sapiens
aaggctgactcaacagggggcc

SEQ ID NO: 7740932 - DNA, 22 bp, Homo sapiens
aaggctgacgtttgtgtttatt

SEQ ID NO: 7740933 - DNA, 22 bp, Homo sapiens
aaggctgagacagcacaggtcc

SEQ ID NO: 7740934 - DNA, 22 bp, Homo sapiens
aaggctgagagtcacagtccta

SEQ ID NO: 7740935 - DNA, 22 bp, Homo sapiens
aagggaggccagaggttttgca

SEQ ID NO: 7740936 - DNA, 23 bp, Homo sapiens
aaaacagcttcctccagtggctc

SEQ ID NO: 7740937 - DNA, 22 bp, Homo sapiens
aaaagcaattgcgggttttgcc

SEQ ID NO: 7740938 - DNA, 22 bp, Homo sapiens
aaaagcaattgcagttcttgcc

SEQ ID NO: 7740939 - DNA, 22 bp, Homo sapiens
aaaagcaagttgcctaggttga

SEQ ID NO: 7740940 - DNA, 22 bp, Homo sapiens
aaaagcatctcaaaggagcttc

SEQ ID NO: 7740941 - DNA, 22 bp, Homo sapiens
aaaagcatctcaaaggagcttc

SEQ ID NO: 7740942 - DNA, 22 bp, Homo sapiens
aaaagatgaaatggtgtcttgg

SEQ ID NO: 7740943 - DNA, 22 bp, Homo sapiens
aaaagattgttagggagaatgt

SEQ ID NO: 7740944 - DNA, 22 bp, Homo sapiens
aaaagagtgtttcaactttggc

SEQ ID NO: 7740945 - DNA, 22 bp, Homo sapiens
aaaagcaagaggctggattaaa

SEQ ID NO: 7740946 - DNA, 22 bp, Homo sapiens
aaaagcaaggcagtctgtctga

SEQ ID NO: 7740947 - DNA, 22 bp, Homo sapiens
aaaatactgtggagtgttgaaa

SEQ ID NO: 7740948 - DNA, 22 bp, Homo sapiens
aaaatgagacacatgtgactcc

SEQ ID NO: 7740949 - DNA, 22 bp, Homo sapiens
aaaagctttgttaataggtttg

SEQ ID NO: 7740950 - DNA, 22 bp, Homo sapiens
aaaagtattttgagcactttat

SEQ ID NO: 7740951 - DNA, 22 bp, Homo sapiens
aaaatgaggaacggatcatggc

SEQ ID NO: 7740952 - DNA, 22 bp, Homo sapiens
aaaatgagccatgaaccaacca

SEQ ID NO: 7740953 - DNA, 22 bp, Homo sapiens
aaaatgagccatgaaccaacca

SEQ ID NO: 7740954 - DNA, 22 bp, Homo sapiens
aaaatgatatcctgacttttat

SEQ ID NO: 7740955 - DNA, 22 bp, Homo sapiens
aaagcagccggttccctggtct

SEQ ID NO: 7740956 - DNA, 22 bp, Homo sapiens
aaatacagagttgcttaaaagc

SEQ ID NO: 7740957 - DNA, 21 bp, Homo sapiens
aaatacagatgcaaatctgtt

SEQ ID NO: 7740958 - DNA, 22 bp, Homo sapiens
aaatacagattccagggtctta

SEQ ID NO: 7740959 - DNA, 19 bp, Homo sapiens
aaagttttattctcatttg

SEQ ID NO: 7740960 - DNA, 22 bp, Homo sapiens
aaagttttctgccttcattaga

SEQ ID NO: 7740961 - DNA, 19 bp, Homo sapiens
aaagttttattctcatttg

SEQ ID NO: 7740962 - DNA, 22 bp, Homo sapiens
aaagtttttaagcaagaccctt

SEQ ID NO: 7740963 - DNA, 22 bp, Homo sapiens
aaagttccttttatagacatga

SEQ ID NO: 7740964 - DNA, 22 bp, Homo sapiens
aaaggagaaaacatacaggact

SEQ ID NO: 7740965 - DNA, 22 bp, Homo sapiens
aaaggagacagtcttacctgga

SEQ ID NO: 7740966 - DNA, 22 bp, Homo sapiens
aaaggagacttcagatctcctt

SEQ ID NO: 7740967 - DNA, 22 bp, Homo sapiens
aaaggagagtaggttactccat

SEQ ID NO: 7740968 - DNA, 22 bp, Homo sapiens
aaaggagagtgagtcagatgcc

SEQ ID NO: 7740969 - DNA, 22 bp, Homo sapiens
aaaggagataaagggcccttca

SEQ ID NO: 7740970 - DNA, 22 bp, Homo sapiens
aacatgagcattcttgtgcttg

SEQ ID NO: 7740971 - DNA, 22 bp, Homo sapiens
aaaggctctaacaaggagagag

SEQ ID NO: 7740972 - DNA, 22 bp, Homo sapiens
aaaggctcacgcagttagtgat

SEQ ID NO: 7740973 - DNA, 22 bp, Homo sapiens
aaagtctgaaagataagagtga

SEQ ID NO: 7740974 - DNA, 20 bp, Homo sapiens
aaagtcttatggttaatttt

SEQ ID NO: 7740975 - DNA, 22 bp, Homo sapiens
aaagtctttattttgtatcttt

SEQ ID NO: 7740976 - DNA, 22 bp, Homo sapiens
aaagtcctttttgccatgcaag

SEQ ID NO: 7740977 - DNA, 22 bp, Homo sapiens
aaagtcctgtttgaaggacctg

SEQ ID NO: 7740978 - DNA, 22 bp, Homo sapiens
aaagtcctagcgatccacagaa

SEQ ID NO: 7740979 - DNA, 22 bp, Homo sapiens
aaagtcctagcgatccacagaa

SEQ ID NO: 7740980 - DNA, 22 bp, Homo sapiens
aaagttacacatctagtaagtg

SEQ ID NO: 7740981 - DNA, 19 bp, Homo sapiens
aaagttctgactgtagagc

SEQ ID NO: 7740982 - DNA, 22 bp, Homo sapiens
aaagcagtgcaccttaattgat

SEQ ID NO: 7740983 - DNA, 22 bp, Homo sapiens
aaagcagtagttttcaaatagt

SEQ ID NO: 7740984 - DNA, 22 bp, Homo sapiens
aaattccagaaactcagtatat

SEQ ID NO: 7740985 - DNA, 22 bp, Homo sapiens
aaattccattaggaaacttcca

SEQ ID NO: 7740986 - DNA, 22 bp, Homo sapiens
aaagacatgacacattggagag

SEQ ID NO: 7740987 - DNA, 22 bp, Homo sapiens
aaagcatagaattagagttagg

SEQ ID NO: 7740988 - DNA, 22 bp, Homo sapiens
aaagccaaatgaaagatggttc

SEQ ID NO: 7740989 - DNA, 22 bp, Homo sapiens
aaagcattattctgtggaaaaa

SEQ ID NO: 7740990 - DNA, 22 bp, Homo sapiens
aaagcattactagactggattt

SEQ ID NO: 7740991 - DNA, 22 bp, Homo sapiens
aaagcatttcatgtctagaaag

SEQ ID NO: 7740992 - DNA, 20 bp, Homo sapiens
aaagcatttacttgtgattg

SEQ ID NO: 7740993 - DNA, 22 bp, Homo sapiens
aaaggaggccacatggctagga

SEQ ID NO: 7740994 - DNA, 22 bp, Homo sapiens
aaaggattaaataaatgtgctg

SEQ ID NO: 7740995 - DNA, 22 bp, Homo sapiens
aacatgaagttttctatagtga

SEQ ID NO: 7740996 - DNA, 22 bp, Homo sapiens
aaaggcagagtgctcagctggc

SEQ ID NO: 7740997 - DNA, 22 bp, Homo sapiens
aagagtttctttattaaccttt

SEQ ID NO: 7740998 - DNA, 22 bp, Homo sapiens
aagagtttctgggtcaaggatt

SEQ ID NO: 7740999 - DNA, 22 bp, Homo sapiens
aagagtttctgattcagtaggt

SEQ ID NO: 7741000 - DNA, 22 bp, Homo sapiens
aagagtttccatgctctgtgct

SEQ ID NO: 7741001 - DNA, 22 bp, Homo sapiens
aagagtttttggagtgtgagtt

SEQ ID NO: 7741002 - DNA, 22 bp, Homo sapiens
aagagtttgacctgtgccatcc

SEQ ID NO: 7741003 - DNA, 22 bp, Homo sapiens
aagagtttgggcaagtcataaa

SEQ ID NO: 7741004 - DNA, 22 bp, Homo sapiens
aagagtttgtcagatctgcacg

SEQ ID NO: 7741005 - DNA, 22 bp, Homo sapiens
aagagtttgtcagatctgcacg

SEQ ID NO: 7741006 - DNA, 22 bp, Homo sapiens
aagagttttctataatcttggc

SEQ ID NO: 7741007 - DNA, 22 bp, Homo sapiens
aagagagaccatgggggacagg

SEQ ID NO: 7741008 - DNA, 22 bp, Homo sapiens
aaatacatacactgtacgtggc

SEQ ID NO: 7741009 - DNA, 22 bp, Homo sapiens
aagaagctgtagggattaactc

SEQ ID NO: 7741010 - DNA, 22 bp, Homo sapiens
aaatcaaaagacatgtgtttta

SEQ ID NO: 7741011 - DNA, 23 bp, Homo sapiens
aaatattcttttttagtaagtgc

SEQ ID NO: 7741012 - DNA, 22 bp, Homo sapiens
aaatcactaagttatagtgtgg

SEQ ID NO: 7741013 - DNA, 22 bp, Homo sapiens
aaatcagaaaatatggagagga

SEQ ID NO: 7741014 - DNA, 22 bp, Homo sapiens
aaatgaaatgagtgcctggagg

SEQ ID NO: 7741015 - DNA, 22 bp, Homo sapiens
aaatgatgattaaaatgaggta

SEQ ID NO: 7741016 - DNA, 22 bp, Homo sapiens
aaatgagtttgcctctagatag

SEQ ID NO: 7741017 - DNA, 22 bp, Homo sapiens
aaatgagtagcgatgcacatta

SEQ ID NO: 7741018 - DNA, 23 bp, Homo sapiens
aaatgactaaatgttcttataga

SEQ ID NO: 7741019 - DNA, 22 bp, Homo sapiens
aaatgaggttaatacagtgctt

SEQ ID NO: 7741020 - DNA, 22 bp, Homo sapiens
aaatgcttgcaacatcccaggt

SEQ ID NO: 7741021 - DNA, 20 bp, Homo sapiens
aaatgctgtaatgtttggga

SEQ ID NO: 7741022 - DNA, 22 bp, Homo sapiens
aaatgatgttataagaccagga

SEQ ID NO: 7741023 - DNA, 22 bp, Homo sapiens
aaatgattgtcaaagttctgtt

SEQ ID NO: 7741024 - DNA, 22 bp, Homo sapiens
aaatgcaaggattttgttaggc

SEQ ID NO: 7741025 - DNA, 22 bp, Homo sapiens
aaatgcaaggccatgtgaagga

SEQ ID NO: 7741026 - DNA, 22 bp, Homo sapiens
caaggaaggagagatgatgggt

SEQ ID NO: 7741027 - DNA, 22 bp, Homo sapiens
caaggaaggagagatgatgggt

SEQ ID NO: 7741028 - DNA, 22 bp, Homo sapiens
caaggaagttttaggagaggaa

SEQ ID NO: 7741029 - DNA, 22 bp, Homo sapiens
caagggagttactgagggcggg

SEQ ID NO: 7741030 - DNA, 22 bp, Homo sapiens
caagtcctcaaagggctctgct

SEQ ID NO: 7741031 - DNA, 22 bp, Homo sapiens
caagtcctcgcttctagctgtg

SEQ ID NO: 7741032 - DNA, 22 bp, Homo sapiens
caagtccttagatggttctttg

SEQ ID NO: 7741033 - DNA, 22 bp, Homo sapiens
caagtccttttcttggctcagg

SEQ ID NO: 7741034 - DNA, 22 bp, Homo sapiens
caagtccttttcttggctcagg

SEQ ID NO: 7741035 - DNA, 22 bp, Homo sapiens
caattacatttattgagcattc

SEQ ID NO: 7741036 - DNA, 20 bp, Homo sapiens
cacagaacaaattgcaggac

SEQ ID NO: 7741037 - DNA, 22 bp, Homo sapiens
cacaggaaatgattctgcagca

SEQ ID NO: 7741038 - DNA, 22 bp, Homo sapiens
agcaggcaggcccagcggctgg

SEQ ID NO: 7741039 - DNA, 20 bp, Homo sapiens
cacaggaaagctactcagtt

SEQ ID NO: 7741040 - DNA, 20 bp, Homo sapiens
cacaggaaagctactcagtt

SEQ ID NO: 7741041 - DNA, 22 bp, Homo sapiens
cacaggaaagtcagccagaaga

SEQ ID NO: 7741042 - DNA, 22 bp, Homo sapiens
cacagctggggaagctgaggcc

SEQ ID NO: 7741043 - DNA, 22 bp, Homo sapiens
cacagaaaaaggcttgaaaatc

SEQ ID NO: 7741044 - DNA, 22 bp, Homo sapiens
caattcaaatgcatagttcaca

SEQ ID NO: 7741045 - DNA, 22 bp, Homo sapiens
caattcaatggcaaagtattgt

SEQ ID NO: 7741046 - DNA, 22 bp, Homo sapiens
caattcaagttgagtacagctt

SEQ ID NO: 7741047 - DNA, 22 bp, Homo sapiens
cacacagacagctctctgaaga

SEQ ID NO: 7741048 - DNA, 22 bp, Homo sapiens
cactgcactccagcccgggcaa

SEQ ID NO: 7741049 - DNA, 22 bp, Homo sapiens
cactgcactccatcctgggaaa

SEQ ID NO: 7741050 - DNA, 22 bp, Homo sapiens
cactgcactccagcccgggcaa

SEQ ID NO: 7741051 - DNA, 22 bp, Homo sapiens
cactgcacttcagcctgggtga

SEQ ID NO: 7741052 - DNA, 21 bp, Homo sapiens
agcattcaaaagatgccataa

SEQ ID NO: 7741053 - DNA, 22 bp, Homo sapiens
agccaaagtggtatatagggaa

SEQ ID NO: 7741054 - DNA, 22 bp, Homo sapiens
agccaaagatcagtgtgcaagt

SEQ ID NO: 7741055 - DNA, 20 bp, Homo sapiens
agccaaaggagaacagtgct

SEQ ID NO: 7741056 - DNA, 22 bp, Homo sapiens
cagcatgggttccgggggcctg

SEQ ID NO: 7741057 - DNA, 22 bp, Homo sapiens
cagcactgcttcgcagccaggg

SEQ ID NO: 7741058 - DNA, 22 bp, Homo sapiens
cagcactgtgataactgagcca

SEQ ID NO: 7741059 - DNA, 22 bp, Homo sapiens
cagccctggtgaggttggctat

SEQ ID NO: 7741060 - DNA, 22 bp, Homo sapiens
cagccatcagtaaagacagctt

SEQ ID NO: 7741061 - DNA, 22 bp, Homo sapiens
cagccagctggcactgtgagta

SEQ ID NO: 7741062 - DNA, 22 bp, Homo sapiens
cagccagctggcactgtgagta

SEQ ID NO: 7741063 - DNA, 22 bp, Homo sapiens
cagcctctgagccttggcagat

SEQ ID NO: 7741064 - DNA, 22 bp, Homo sapiens
cagccttcgacagttggagtag

SEQ ID NO: 7741065 - DNA, 22 bp, Homo sapiens
cagcgctgtgggaacagggcta

SEQ ID NO: 7741066 - DNA, 22 bp, Homo sapiens
agctctggaataatgatgtgat

SEQ ID NO: 7741067 - DNA, 22 bp, Homo sapiens
cagctggatccctgcagaactt

SEQ ID NO: 7741068 - DNA, 22 bp, Homo sapiens
agcctgagctgcctgccgcctc

SEQ ID NO: 7741069 - DNA, 22 bp, Homo sapiens
cagatgaagatcatagaatagt

SEQ ID NO: 7741070 - DNA, 22 bp, Homo sapiens
cagatgaactgtgactgaaaat

SEQ ID NO: 7741071 - DNA, 19 bp, Homo sapiens
agcctggagggctggtcac

SEQ ID NO: 7741072 - DNA, 22 bp, Homo sapiens
cagatccttaggacaaccatcc

SEQ ID NO: 7741073 - DNA, 22 bp, Homo sapiens
agcctaggtctgggtctagcag

SEQ ID NO: 7741074 - DNA, 22 bp, Homo sapiens
agccggccatgtggtcttgtgc

SEQ ID NO: 7741075 - DNA, 22 bp, Homo sapiens
agcctagggggtcctgggccac

SEQ ID NO: 7741076 - DNA, 22 bp, Homo sapiens
agccctgggctgtagataagca

SEQ ID NO: 7741077 - DNA, 22 bp, Homo sapiens
agccctgggctgtagataagca

SEQ ID NO: 7741078 - DNA, 18 bp, Homo sapiens
cagaggagagacattcag

SEQ ID NO: 7741079 - DNA, 22 bp, Homo sapiens
cagagcttcctgctgggcttct

SEQ ID NO: 7741080 - DNA, 22 bp, Homo sapiens
cagagccaggcctgccctcttt

SEQ ID NO: 7741081 - DNA, 18 bp, Homo sapiens
cagagcagtatgaatgtt

SEQ ID NO: 7741082 - DNA, 22 bp, Homo sapiens
cagagcagtctggagatccagc

SEQ ID NO: 7741083 - DNA, 22 bp, Homo sapiens
cagagctgtcatttgccagtga

SEQ ID NO: 7741084 - DNA, 22 bp, Homo sapiens
agagaagacttacagccacagt

SEQ ID NO: 7741085 - DNA, 22 bp, Homo sapiens
atgggccaggcttgggatgaca

SEQ ID NO: 7741086 - DNA, 22 bp, Homo sapiens
atgggccacacacgattgggtg

SEQ ID NO: 7741087 - DNA, 22 bp, Homo sapiens
atgggccaagtaaacattctca

SEQ ID NO: 7741088 - DNA, 23 bp, Homo sapiens
atgggccaagcaagacccatgac

SEQ ID NO: 7741089 - DNA, 22 bp, Homo sapiens
atgtagtttggggctagattta

SEQ ID NO: 7741090 - DNA, 18 bp, Homo sapiens
agagatgggagttggaaa

SEQ ID NO: 7741091 - DNA, 20 bp, Homo sapiens
agagatggggtatcaccgta

SEQ ID NO: 7741092 - DNA, 22 bp, Homo sapiens
agagactgtaatgagaggtaca

SEQ ID NO: 7741093 - DNA, 22 bp, Homo sapiens
agagactggagttacgagttca

SEQ ID NO: 7741094 - DNA, 19 bp, Homo sapiens
agagactgccaccagctgt

SEQ ID NO: 7741095 - DNA, 22 bp, Homo sapiens
agagactggagatgggcagtgt

SEQ ID NO: 7741096 - DNA, 22 bp, Homo sapiens
agagactgcaatgagtggtagg

SEQ ID NO: 7741097 - DNA, 22 bp, Homo sapiens
agagactgcaaatcataagaat

SEQ ID NO: 7741098 - DNA, 21 bp, Homo sapiens
agagactgtcactgcagtacc

SEQ ID NO: 7741099 - DNA, 22 bp, Homo sapiens
agagactgtacgtggcaagtat

SEQ ID NO: 7741100 - DNA, 22 bp, Homo sapiens
agagactgtcacataacagagg

SEQ ID NO: 7741101 - DNA, 22 bp, Homo sapiens
agagattacagcagggtccagc

SEQ ID NO: 7741102 - DNA, 22 bp, Homo sapiens
atgttctacagatggaaagggg

SEQ ID NO: 7741103 - DNA, 22 bp, Homo sapiens
agagctagaaggaagcatttct

SEQ ID NO: 7741104 - DNA, 22 bp, Homo sapiens
atgttcaaactttttacacacc

SEQ ID NO: 7741105 - DNA, 22 bp, Homo sapiens
agagctctgcagctggcctcag

SEQ ID NO: 7741106 - DNA, 22 bp, Homo sapiens
attaaatactgcaggctaagca

SEQ ID NO: 7741107 - DNA, 22 bp, Homo sapiens
attaagtgactaaagtaatgct

SEQ ID NO: 7741108 - DNA, 22 bp, Homo sapiens
agacataagcgagcatcacagg

SEQ ID NO: 7741109 - DNA, 22 bp, Homo sapiens
atgcaaatgtcaccacttctaa

SEQ ID NO: 7741110 - DNA, 22 bp, Homo sapiens
atgcaaattaacatatagtaga

SEQ ID NO: 7741111 - DNA, 22 bp, Homo sapiens
atgaggataccgcagggggcag

SEQ ID NO: 7741112 - DNA, 22 bp, Homo sapiens
atgaggagtcaaggagtcggag

SEQ ID NO: 7741113 - DNA, 22 bp, Homo sapiens
atgaggatgggaagggagccaa

SEQ ID NO: 7741114 - DNA, 22 bp, Homo sapiens
atgaggatgttagtggactgga

SEQ ID NO: 7741115 - DNA, 23 bp, Homo sapiens
atctgggcatctggagtggtcct

SEQ ID NO: 7741116 - DNA, 22 bp, Homo sapiens
atctgggcatggaggaaagaga

SEQ ID NO: 7741117 - DNA, 22 bp, Homo sapiens
atctgggccaatcctagtacca

SEQ ID NO: 7741118 - DNA, 22 bp, Homo sapiens
atctgggccagccccaagagac

SEQ ID NO: 7741119 - DNA, 22 bp, Homo sapiens
atctgggcctgttccctcacct

SEQ ID NO: 7741120 - DNA, 20 bp, Homo sapiens
atctgggcatcaattttgtg

SEQ ID NO: 7741121 - DNA, 22 bp, Homo sapiens
atctgggcagggcagcaaggcg

SEQ ID NO: 7741122 - DNA, 22 bp, Homo sapiens
atctgggtcacagtggcatcta

SEQ ID NO: 7741123 - DNA, 22 bp, Homo sapiens
atctgggcgtataggtgcaagt

SEQ ID NO: 7741124 - DNA, 22 bp, Homo sapiens
atctgggctcgaatcctagctc

SEQ ID NO: 7741125 - DNA, 22 bp, Homo sapiens
atgaccagtttccccactgtcc

SEQ ID NO: 7741126 - DNA, 23 bp, Homo sapiens
atcttagcatagacttgagtccc

SEQ ID NO: 7741127 - DNA, 22 bp, Homo sapiens
atttacaggacagcttggcatt

SEQ ID NO: 7741128 - DNA, 23 bp, Homo sapiens
atttacagctgtgtgagcaagtt

SEQ ID NO: 7741129 - DNA, 22 bp, Homo sapiens
atttacagccttgaaaacagca

SEQ ID NO: 7741130 - DNA, 22 bp, Homo sapiens
atttgaatgcaggtagctgagt

SEQ ID NO: 7741131 - DNA, 22 bp, Homo sapiens
agatgacagccaaggagatgaa

SEQ ID NO: 7741132 - DNA, 22 bp, Homo sapiens
agatgacagctacgggatgaaa

SEQ ID NO: 7741133 - DNA, 22 bp, Homo sapiens
agatgagaatttttagagtgct

SEQ ID NO: 7741134 - DNA, 22 bp, Homo sapiens
attttgtggcagatgcagaacc

SEQ ID NO: 7741135 - DNA, 22 bp, Homo sapiens
attttgtgaaccctcaagcaat

SEQ ID NO: 7741136 - DNA, 22 bp, Homo sapiens
agcaaggggcagtgaaagtgtg

SEQ ID NO: 7741137 - DNA, 22 bp, Homo sapiens
caaacatttgacttctctcagg

SEQ ID NO: 7741138 - DNA, 22 bp, Homo sapiens
agcaatcagcttctttgtgttt

SEQ ID NO: 7741139 - DNA, 22 bp, Homo sapiens
caaagtgctgggattagtgctg

SEQ ID NO: 7741140 - DNA, 22 bp, Homo sapiens
caaagtgctgggattataggca

SEQ ID NO: 7741141 - DNA, 22 bp, Homo sapiens
caaagtgctgggattacaggtg

SEQ ID NO: 7741142 - DNA, 22 bp, Homo sapiens
agcaatgctaccgggtgattcg

SEQ ID NO: 7741143 - DNA, 22 bp, Homo sapiens
agaggccctgggctggtgtgct

SEQ ID NO: 7741144 - DNA, 22 bp, Homo sapiens
agaggccctggctagagcagct

SEQ ID NO: 7741145 - DNA, 19 bp, Homo sapiens
agaggcctcagcagctggc

SEQ ID NO: 7741146 - DNA, 22 bp, Homo sapiens
agaggcctaaccaagatgtcct

SEQ ID NO: 7741147 - DNA, 22 bp, Homo sapiens
attcaaaagaccatgcagactc

SEQ ID NO: 7741148 - DNA, 22 bp, Homo sapiens
agaggcctctagggcccctcag

SEQ ID NO: 7741149 - DNA, 22 bp, Homo sapiens
agaggccctctctgctcagtct

SEQ ID NO: 7741150 - DNA, 22 bp, Homo sapiens
agaggccctctctgctcagtct

SEQ ID NO: 7741151 - DNA, 22 bp, Homo sapiens
attaataaaataccactttgtt

SEQ ID NO: 7741152 - DNA, 22 bp, Homo sapiens
agagcttcactggagagcacat

SEQ ID NO: 7741153 - DNA, 22 bp, Homo sapiens
attctacaatcatgtagatcct

SEQ ID NO: 7741154 - DNA, 22 bp, Homo sapiens
attgaaaaatgactattgctta

SEQ ID NO: 7741155 - DNA, 22 bp, Homo sapiens
attctaagcacgctgaagtctt

SEQ ID NO: 7741156 - DNA, 22 bp, Homo sapiens
attctaaagcttgtggagctta

SEQ ID NO: 7741157 - DNA, 20 bp, Homo sapiens
attctaaagctctgctcttt

SEQ ID NO: 7741158 - DNA, 22 bp, Homo sapiens
attgtatacaagcttaattgtt

SEQ ID NO: 7741159 - DNA, 22 bp, Homo sapiens
attgaaaatataattctaggag

SEQ ID NO: 7741160 - DNA, 22 bp, Homo sapiens
atttacagacgtggattagtgc

SEQ ID NO: 7741161 - DNA, 20 bp, Homo sapiens
aggttcctttgtggagaatt

SEQ ID NO: 7741162 - DNA, 22 bp, Homo sapiens
aggttcttgactctaccttcca

SEQ ID NO: 7741163 - DNA, 22 bp, Homo sapiens
aggttcttggtgagcatttggt

SEQ ID NO: 7741164 - DNA, 22 bp, Homo sapiens
actcacagtccctgtaggagtg

SEQ ID NO: 7741165 - DNA, 21 bp, Homo sapiens
aggttccagcagccagagaat

SEQ ID NO: 7741166 - DNA, 20 bp, Homo sapiens
aggttccagccacaaccagc

SEQ ID NO: 7741167 - DNA, 22 bp, Homo sapiens
aggttccaggtctgggttatgt

SEQ ID NO: 7741168 - DNA, 22 bp, Homo sapiens
aggttccagggattaggatgtg

SEQ ID NO: 7741169 - DNA, 22 bp, Homo sapiens
aggttccatcacctgcagtgga

SEQ ID NO: 7741170 - DNA, 22 bp, Homo sapiens
aggttccaggttcgaatcccat

SEQ ID NO: 7741171 - DNA, 22 bp, Homo sapiens
aggttcctcttcctctggcctg

SEQ ID NO: 7741172 - DNA, 22 bp, Homo sapiens
agggtcctaagcctcagataag

SEQ ID NO: 7741173 - DNA, 18 bp, Homo sapiens
agggtcagtgtcactggc

SEQ ID NO: 7741174 - DNA, 22 bp, Homo sapiens
agtaacttaggagatacatggg

SEQ ID NO: 7741175 - DNA, 22 bp, Homo sapiens
agtcagtggatttaccatgcgt

SEQ ID NO: 7741176 - DNA, 22 bp, Homo sapiens
agtcagtgggcttggcacagaa

SEQ ID NO: 7741177 - DNA, 23 bp, Homo sapiens
agtcagtgcgggatggtcagggg

SEQ ID NO: 7741178 - DNA, 22 bp, Homo sapiens
agtcagtgacttttgctgagag

SEQ ID NO: 7741179 - DNA, 22 bp, Homo sapiens
agtaataatagctgtaaagtgc

SEQ ID NO: 7741180 - DNA, 22 bp, Homo sapiens
agtaataatagctgtaaagtgc

SEQ ID NO: 7741181 - DNA, 22 bp, Homo sapiens
actctgggagaggacaaacaaa

SEQ ID NO: 7741182 - DNA, 22 bp, Homo sapiens
actctgggatcttgaaaagagt

SEQ ID NO: 7741183 - DNA, 22 bp, Homo sapiens
actctgggattgtttctggtat

SEQ ID NO: 7741184 - DNA, 22 bp, Homo sapiens
actctgggatgagaaaagggtt

SEQ ID NO: 7741185 - DNA, 22 bp, Homo sapiens
actctgggcccaccctcagagt

SEQ ID NO: 7741186 - DNA, 22 bp, Homo sapiens
agtccaggagttgggtgacatt

SEQ ID NO: 7741187 - DNA, 21 bp, Homo sapiens
agtccaggaggaggccaggtt

SEQ ID NO: 7741188 - DNA, 22 bp, Homo sapiens
actctgggccccaggtggagct

SEQ ID NO: 7741189 - DNA, 22 bp, Homo sapiens
actctgggctttgatttgttac

SEQ ID NO: 7741190 - DNA, 22 bp, Homo sapiens
actctgggctgttaggagctgt

SEQ ID NO: 7741191 - DNA, 22 bp, Homo sapiens
actctggggcgctactccaact

SEQ ID NO: 7741192 - DNA, 20 bp, Homo sapiens
actctggggctcattagggg

SEQ ID NO: 7741193 - DNA, 22 bp, Homo sapiens
actctggggtgatgtctctgag

SEQ ID NO: 7741194 - DNA, 22 bp, Homo sapiens
actctgggtcctgccattcact

SEQ ID NO: 7741195 - DNA, 22 bp, Homo sapiens
actctgggttctttcacttgac

SEQ ID NO: 7741196 - DNA, 22 bp, Homo sapiens
agtcctggtgacactcctcttc

SEQ ID NO: 7741197 - DNA, 22 bp, Homo sapiens
agtcctgggttctggtgttttg

SEQ ID NO: 7741198 - DNA, 22 bp, Homo sapiens
agtggctggaattgcaggtgcg

SEQ ID NO: 7741199 - DNA, 22 bp, Homo sapiens
agtggcagagccaagtagagcc

SEQ ID NO: 7741200 - DNA, 22 bp, Homo sapiens
agtgagagtattaatgtgaact

SEQ ID NO: 7741201 - DNA, 22 bp, Homo sapiens
agtgaatgtccccgcgggtcag

SEQ ID NO: 7741202 - DNA, 17 bp, Homo sapiens
agtgaggagattggaag

SEQ ID NO: 7741203 - DNA, 19 bp, Homo sapiens
agtgtgtactgaaagcact

SEQ ID NO: 7741204 - DNA, 17 bp, Homo sapiens
agtgtgtgaaatggtgg

SEQ ID NO: 7741205 - DNA, 23 bp, Homo sapiens
actgggctgaaattaaaggtgtc

SEQ ID NO: 7741206 - DNA, 23 bp, Homo sapiens
actgggctgaaatttttcatggc

SEQ ID NO: 7741207 - DNA, 22 bp, Homo sapiens
agtgtgtaagggatcaaagagt

SEQ ID NO: 7741208 - DNA, 22 bp, Homo sapiens
agtgtctgtgatgaggtcagga

SEQ ID NO: 7741209 - DNA, 22 bp, Homo sapiens
agtgtctggtgagggctctctc

SEQ ID NO: 7741210 - DNA, 22 bp, Homo sapiens
agtgggggccaacgagggcagc

SEQ ID NO: 7741211 - DNA, 22 bp, Homo sapiens
actgggctgcctggttcttcta

SEQ ID NO: 7741212 - DNA, 22 bp, Homo sapiens
actggggcagtgggcagtggtt

SEQ ID NO: 7741213 - DNA, 23 bp, Homo sapiens
actgggtctatctccagagaaga

SEQ ID NO: 7741214 - DNA, 22 bp, Homo sapiens
actggggcctcctccatgctct

SEQ ID NO: 7741215 - DNA, 22 bp, Homo sapiens
ataggagatcaatatgcaattt

SEQ ID NO: 7741216 - DNA, 22 bp, Homo sapiens
atagaatagcatagaaaattga

SEQ ID NO: 7741217 - DNA, 22 bp, Homo sapiens
actttagatattcctctgtaca

SEQ ID NO: 7741218 - DNA, 22 bp, Homo sapiens
atagaaatgtattttggactag

SEQ ID NO: 7741219 - DNA, 22 bp, Homo sapiens
atagaagatagcttttgtttct

SEQ ID NO: 7741220 - DNA, 22 bp, Homo sapiens
agttcagaggcaggagaaggct

SEQ ID NO: 7741221 - DNA, 22 bp, Homo sapiens
agttcactttctgtagtggaag

SEQ ID NO: 7741222 - DNA, 22 bp, Homo sapiens
agttcactctttatgagaaagt

SEQ ID NO: 7741223 - DNA, 22 bp, Homo sapiens
agttcactatagaagacagtgt

SEQ ID NO: 7741224 - DNA, 22 bp, Homo sapiens
ataacagacttagagttacaag

SEQ ID NO: 7741225 - DNA, 22 bp, Homo sapiens
ataaattctctgatgtatagta

SEQ ID NO: 7741226 - DNA, 19 bp, Homo sapiens
ataaataaaaagtgggaga

SEQ ID NO: 7741227 - DNA, 22 bp, Homo sapiens
agaaatcttggagtctgtggta

SEQ ID NO: 7741228 - DNA, 22 bp, Homo sapiens
agaaatctttcctgaagtgttt

SEQ ID NO: 7741229 - DNA, 22 bp, Homo sapiens
atcaatgcttgccaaatggaag

SEQ ID NO: 7741230 - DNA, 22 bp, Homo sapiens
agaaatgcagtctcgtcaaaag

SEQ ID NO: 7741231 - DNA, 22 bp, Homo sapiens
agaaatgcagtttcaagacaaa

SEQ ID NO: 7741232 - DNA, 22 bp, Homo sapiens
atcaagagtattgacaagacca

SEQ ID NO: 7741233 - DNA, 22 bp, Homo sapiens
atcaatgctctgtacccagaat

SEQ ID NO: 7741234 - DNA, 22 bp, Homo sapiens
atcaatatcagatcagacagga

SEQ ID NO: 7741235 - DNA, 22 bp, Homo sapiens
agaaaagggcaggagggataca

SEQ ID NO: 7741236 - DNA, 22 bp, Homo sapiens
agaaagaggatgcagatctcat

SEQ ID NO: 7741237 - DNA, 22 bp, Homo sapiens
atattaattatttacacatgag

SEQ ID NO: 7741238 - DNA, 22 bp, Homo sapiens
atattaatgggatttagtcagg

SEQ ID NO: 7741239 - DNA, 22 bp, Homo sapiens
atattaatgagcaagtaagtga

SEQ ID NO: 7741240 - DNA, 22 bp, Homo sapiens
agaagctgcgtttatttaaatc

SEQ ID NO: 7741241 - DNA, 22 bp, Homo sapiens
agaagctgacagatgcagcagg

SEQ ID NO: 7741242 - DNA, 22 bp, Homo sapiens
agaagcagggcagggaaaagca

SEQ ID NO: 7741243 - DNA, 20 bp, Homo sapiens
agaagcattcaaagaaaact

SEQ ID NO: 7741244 - DNA, 22 bp, Homo sapiens
agaaatgtaattgcaactgtct

SEQ ID NO: 7741245 - DNA, 22 bp, Homo sapiens
agggcacaggctccgggtccag

SEQ ID NO: 7741246 - DNA, 22 bp, Homo sapiens
agggcacatctgctgggaatgg

SEQ ID NO: 7741247 - DNA, 22 bp, Homo sapiens
agggaggagtcctcaaagtcat

SEQ ID NO: 7741248 - DNA, 22 bp, Homo sapiens
agggagctgactggctgccatt

SEQ ID NO: 7741249 - DNA, 22 bp, Homo sapiens
agggccagcactcctggcagga

SEQ ID NO: 7741250 - DNA, 22 bp, Homo sapiens
agggctcaatggtgggcatgta

SEQ ID NO: 7741251 - DNA, 22 bp, Homo sapiens
aggggtgtgcatcctggaggat

SEQ ID NO: 7741252 - DNA, 22 bp, Homo sapiens
aggggttggatttggcctagag

SEQ ID NO: 7741253 - DNA, 22 bp, Homo sapiens
aggggccattgttctgcccgct

SEQ ID NO: 7741254 - DNA, 22 bp, Homo sapiens
acctcagttcaattcagttaga

SEQ ID NO: 7741255 - DNA, 22 bp, Homo sapiens
agggctcagaacaatgagtgta

SEQ ID NO: 7741256 - DNA, 22 bp, Homo sapiens
aggggagcatctgtgatggtta

SEQ ID NO: 7741257 - DNA, 22 bp, Homo sapiens
aggggagcaaggccgtggtgta

SEQ ID NO: 7741258 - DNA, 22 bp, Homo sapiens
agggctttgatggcattctcat

SEQ ID NO: 7741259 - DNA, 22 bp, Homo sapiens
agggctttgatggcattctcat

SEQ ID NO: 7741260 - DNA, 22 bp, Homo sapiens
agggctttgagaatagtggaac

SEQ ID NO: 7741261 - DNA, 22 bp, Homo sapiens
agggctttctttgtaaaagaag

SEQ ID NO: 7741262 - DNA, 22 bp, Homo sapiens
aggggagcgacattccgtgccg

SEQ ID NO: 7741263 - DNA, 22 bp, Homo sapiens
aggggagccgaggggcatctgt

SEQ ID NO: 7741264 - DNA, 22 bp, Homo sapiens
aggggagccgaggggcatctgt

SEQ ID NO: 7741265 - DNA, 22 bp, Homo sapiens
aggggagcttgcctggtcaccc

SEQ ID NO: 7741266 - DNA, 22 bp, Homo sapiens
accactgcccatggtgaaaact

SEQ ID NO: 7741267 - DNA, 22 bp, Homo sapiens
acatttctcaggtaagtcattt

SEQ ID NO: 7741268 - DNA, 22 bp, Homo sapiens
acatgtaaaaggaacatgcatg

SEQ ID NO: 7741269 - DNA, 22 bp, Homo sapiens
aggctccagtctcctctggcag

SEQ ID NO: 7741270 - DNA, 22 bp, Homo sapiens
aggctcaggtctcaggtctggc

SEQ ID NO: 7741271 - DNA, 22 bp, Homo sapiens
acatgttttgtgccttgactag

SEQ ID NO: 7741272 - DNA, 22 bp, Homo sapiens
aggctctgacccatgggaccca

SEQ ID NO: 7741273 - DNA, 22 bp, Homo sapiens
aggcacagcacacctggccccc

SEQ ID NO: 7741274 - DNA, 22 bp, Homo sapiens
acagtgcagggtgggaagaagg

SEQ ID NO: 7741275 - DNA, 22 bp, Homo sapiens
acagtgcagggcgggaagaagg

SEQ ID NO: 7741276 - DNA, 22 bp, Homo sapiens
aggacaggtgtagtgggctctg

SEQ ID NO: 7741277 - DNA, 22 bp, Homo sapiens
aggaaaggggtaggtgtggacg

SEQ ID NO: 7741278 - DNA, 22 bp, Homo sapiens
aggaaaggttcagtgattgaaa

SEQ ID NO: 7741279 - DNA, 22 bp, Homo sapiens
acagcattcaataaataataac

SEQ ID NO: 7741280 - DNA, 22 bp, Homo sapiens
acagcattccctttggctgctt

SEQ ID NO: 7741281 - DNA, 22 bp, Homo sapiens
acagcatttaaagaaaatgaac

SEQ ID NO: 7741282 - DNA, 22 bp, Homo sapiens
acagcattgctccatctcaaga

SEQ ID NO: 7741283 - DNA, 22 bp, Homo sapiens
acagccagaagtcagggtggga

SEQ ID NO: 7741284 - DNA, 22 bp, Homo sapiens
agcttcttgaccaagcctgtaa

SEQ ID NO: 7741285 - DNA, 22 bp, Homo sapiens
agcttccacatctgtcttcagt

SEQ ID NO: 7741286 - DNA, 21 bp, Homo sapiens
agcttccagagcacattccat

SEQ ID NO: 7741287 - DNA, 22 bp, Homo sapiens
agcttctttaattcagcatgat

SEQ ID NO: 7741288 - DNA, 22 bp, Homo sapiens
aggggaatgggtagactgttga

SEQ ID NO: 7741289 - DNA, 22 bp, Homo sapiens
aggggctcctttgtgctgcgtc

SEQ ID NO: 7741290 - DNA, 22 bp, Homo sapiens
cctgagtctgtgttttcctaag

SEQ ID NO: 7741291 - DNA, 22 bp, Homo sapiens
aggggtgaaagagggccctcaa

SEQ ID NO: 7741292 - DNA, 22 bp, Homo sapiens
agggggtgggaagtctagaatc

SEQ ID NO: 7741293 - DNA, 22 bp, Homo sapiens
agggggtgcccagatgaaggat

SEQ ID NO: 7741294 - DNA, 22 bp, Homo sapiens
agggggtgcatttgtgaatgaa

SEQ ID NO: 7741295 - DNA, 22 bp, Homo sapiens
agggggtgatcaaggtgcggcg

SEQ ID NO: 7741296 - DNA, 22 bp, Homo sapiens
agggggtgatcaaggtgcggcg

SEQ ID NO: 7741297 - DNA, 22 bp, Homo sapiens
agggggctgccaaggaatgtaa

SEQ ID NO: 7741298 - DNA, 22 bp, Homo sapiens
cctctgtgtcagggaagagact

SEQ ID NO: 7741299 - DNA, 22 bp, Homo sapiens
agggctttgatgtccatgagga

SEQ ID NO: 7741300 - DNA, 19 bp, Homo sapiens
agggctttgtgtgctgctc

SEQ ID NO: 7741301 - DNA, 22 bp, Homo sapiens
agggctttgtggcagtcactat

SEQ ID NO: 7741302 - DNA, 22 bp, Homo sapiens
agggctttggccccctgctgca

SEQ ID NO: 7741303 - DNA, 22 bp, Homo sapiens
agggctttggccccctgctgca

SEQ ID NO: 7741304 - DNA, 22 bp, Homo sapiens
agggctttgcaatgcacagtgg

SEQ ID NO: 7741305 - DNA, 22 bp, Homo sapiens
agggcttttgcaatccaagtct

SEQ ID NO: 7741306 - DNA, 22 bp, Homo sapiens
agggcttttgagcgcacgtctg

SEQ ID NO: 7741307 - DNA, 22 bp, Homo sapiens
agggctttgtttaggtgaccac

SEQ ID NO: 7741308 - DNA, 22 bp, Homo sapiens
agggcctgtgaattctccctgc

SEQ ID NO: 7741309 - DNA, 22 bp, Homo sapiens
agggcctgtccgctcccgcccg

SEQ ID NO: 7741310 - DNA, 22 bp, Homo sapiens
cctaagtattttcagtgttaac

SEQ ID NO: 7741311 - DNA, 22 bp, Homo sapiens
cctaatttgattttaaatagcc

SEQ ID NO: 7741312 - DNA, 22 bp, Homo sapiens
cctaagtaagttgactttcaga

SEQ ID NO: 7741313 - DNA, 22 bp, Homo sapiens
ccctggcactagcgacggccat

SEQ ID NO: 7741314 - DNA, 22 bp, Homo sapiens
agggcctggcttcactttctca

SEQ ID NO: 7741315 - DNA, 22 bp, Homo sapiens
agggagctgactggctgccatt

SEQ ID NO: 7741316 - DNA, 22 bp, Homo sapiens
agggaaaggctgatgctgtggg

SEQ ID NO: 7741317 - DNA, 22 bp, Homo sapiens
agggaaataatctattctgagg

SEQ ID NO: 7741318 - DNA, 22 bp, Homo sapiens
ccctgaggatgtctccttcctg

SEQ ID NO: 7741319 - DNA, 22 bp, Homo sapiens
ccctgaggcacaggccacgtat

SEQ ID NO: 7741320 - DNA, 22 bp, Homo sapiens
ccctgaggggcttactttgccc

SEQ ID NO: 7741321 - DNA, 22 bp, Homo sapiens
agggccaccagagcagggcagt

SEQ ID NO: 7741322 - DNA, 22 bp, Homo sapiens
agggccacagtggggcctgaga

SEQ ID NO: 7741323 - DNA, 22 bp, Homo sapiens
agggccacagtaatgctgagta

SEQ ID NO: 7741324 - DNA, 22 bp, Homo sapiens
agggccactggctgacggctgc

SEQ ID NO: 7741325 - DNA, 22 bp, Homo sapiens
ccctgaggagagcgcttcccga

SEQ ID NO: 7741326 - DNA, 20 bp, Homo sapiens
ccccttcatctacagcctga

SEQ ID NO: 7741327 - DNA, 22 bp, Homo sapiens
agggatggtggaggttgcaagt

SEQ ID NO: 7741328 - DNA, 22 bp, Homo sapiens
agggcagactaggatggaagtg

SEQ ID NO: 7741329 - DNA, 22 bp, Homo sapiens
agggcagaagtacagacactta

SEQ ID NO: 7741330 - DNA, 22 bp, Homo sapiens
cccctgctggcctgctggtttc

SEQ ID NO: 7741331 - DNA, 22 bp, Homo sapiens
cccagaggtgacatcccattct

SEQ ID NO: 7741332 - DNA, 22 bp, Homo sapiens
cccacctctcagagagccttgc

SEQ ID NO: 7741333 - DNA, 22 bp, Homo sapiens
cccaagttaatttgtagctgaa

SEQ ID NO: 7741334 - DNA, 22 bp, Homo sapiens
cccaagttaaaattcagtgctc

SEQ ID NO: 7741335 - DNA, 18 bp, Homo sapiens
cccacacagcagtagctc

SEQ ID NO: 7741336 - DNA, 22 bp, Homo sapiens
ccaggttggagttcagtggcgc

SEQ ID NO: 7741337 - DNA, 22 bp, Homo sapiens
ccaggcctgtgttgtgtggagg

SEQ ID NO: 7741338 - DNA, 22 bp, Homo sapiens
ccaggcctgtgcaaggagggag

SEQ ID NO: 7741339 - DNA, 20 bp, Homo sapiens
ccaggcctgggcctgctcta

SEQ ID NO: 7741340 - DNA, 22 bp, Homo sapiens
ccaggccttccagtacgcagaa

SEQ ID NO: 7741341 - DNA, 22 bp, Homo sapiens
ccaggccttctgaggacactct

SEQ ID NO: 7741342 - DNA, 22 bp, Homo sapiens
aggctcagcccaaggtggagag

SEQ ID NO: 7741343 - DNA, 22 bp, Homo sapiens
aggctctgggaagcagtgagtt

SEQ ID NO: 7741344 - DNA, 22 bp, Homo sapiens
aggctagaggcttctggcttca

SEQ ID NO: 7741345 - DNA, 22 bp, Homo sapiens
aggcctgggtctcgtgcctacc

SEQ ID NO: 7741346 - DNA, 22 bp, Homo sapiens
ccagctcccctcagcaggtaat

SEQ ID NO: 7741347 - DNA, 22 bp, Homo sapiens
ccagctcccattcttcacctgt

SEQ ID NO: 7741348 - DNA, 23 bp, Homo sapiens
ccagctcccaggtctgaggactg

SEQ ID NO: 7741349 - DNA, 23 bp, Homo sapiens
ccagctcccaggtctgaggactg

SEQ ID NO: 7741350 - DNA, 22 bp, Homo sapiens
ccagctccgggagttgctgctg

SEQ ID NO: 7741351 - DNA, 22 bp, Homo sapiens
ccagctccctgaagcctggtct

SEQ ID NO: 7741352 - DNA, 22 bp, Homo sapiens
ccagctccaggtagatgggcag

SEQ ID NO: 7741353 - DNA, 22 bp, Homo sapiens
ccagctccattgcttagtgtaa

SEQ ID NO: 7741354 - DNA, 22 bp, Homo sapiens
ccagctccaggtagatgggcag

SEQ ID NO: 7741355 - DNA, 22 bp, Homo sapiens
ccagctccaggactgggagctg

SEQ ID NO: 7741356 - DNA, 22 bp, Homo sapiens
ccaggaggtgctggaagaaagc

SEQ ID NO: 7741357 - DNA, 22 bp, Homo sapiens
ccagagtctatgagtcctcatt

SEQ ID NO: 7741358 - DNA, 22 bp, Homo sapiens
ccagccctcctccatcagagga

SEQ ID NO: 7741359 - DNA, 22 bp, Homo sapiens
ccagccctgaaccctgctgcat

SEQ ID NO: 7741360 - DNA, 22 bp, Homo sapiens
ccagccctgattagagaatgtc

SEQ ID NO: 7741361 - DNA, 22 bp, Homo sapiens
ccagaggatgctggtcagcctc

SEQ ID NO: 7741362 - DNA, 20 bp, Homo sapiens
ccagagctgatggctgcccg

SEQ ID NO: 7741363 - DNA, 19 bp, Homo sapiens
ccagagtcatgtctccccc

SEQ ID NO: 7741364 - DNA, 22 bp, Homo sapiens
aggaagaaaactaattagatgg

SEQ ID NO: 7741365 - DNA, 22 bp, Homo sapiens
aggaaaggcctcagcagaaacc

SEQ ID NO: 7741366 - DNA, 22 bp, Homo sapiens
cagggctggctgtggcaatctc

SEQ ID NO: 7741367 - DNA, 18 bp, Homo sapiens
cagggctgtggggtcact

SEQ ID NO: 7741368 - DNA, 22 bp, Homo sapiens
aggaagagggtggcagataatc

SEQ ID NO: 7741369 - DNA, 23 bp, Homo sapiens
aggaagaggcaatttctcttaga

SEQ ID NO: 7741370 - DNA, 22 bp, Homo sapiens
aggaagagcccgggtgacataa

SEQ ID NO: 7741371 - DNA, 22 bp, Homo sapiens
aggaagagcccgggtgacataa

SEQ ID NO: 7741372 - DNA, 22 bp, Homo sapiens
cagggctggctgtggcaatctc

SEQ ID NO: 7741373 - DNA, 22 bp, Homo sapiens
caggctgacaactgagcatttt

SEQ ID NO: 7741374 - DNA, 22 bp, Homo sapiens
caggctgaagtgcagtggtgtg

SEQ ID NO: 7741375 - DNA, 22 bp, Homo sapiens
cagggcaggatgctgtgattat

SEQ ID NO: 7741376 - DNA, 22 bp, Homo sapiens
cagggcttgaatcaaggaagtc

SEQ ID NO: 7741377 - DNA, 22 bp, Homo sapiens
cagggcttcgatggatggatgg

SEQ ID NO: 7741378 - DNA, 22 bp, Homo sapiens
cagggcttcgctcctggtgcac

SEQ ID NO: 7741379 - DNA, 22 bp, Homo sapiens
cagggcttcttggcatttgctg

SEQ ID NO: 7741380 - DNA, 22 bp, Homo sapiens
cagggcttctataccaattcat

SEQ ID NO: 7741381 - DNA, 22 bp, Homo sapiens
cagggcttcgtgtctcagtgct

SEQ ID NO: 7741382 - DNA, 22 bp, Homo sapiens
aggaatgaactcgagtgatctg

SEQ ID NO: 7741383 - DNA, 22 bp, Homo sapiens
aggaatgaactcgagtgatctg

SEQ ID NO: 7741384 - DNA, 22 bp, Homo sapiens
aggaatcaggagatgagcacgg

SEQ ID NO: 7741385 - DNA, 22 bp, Homo sapiens
cagtatttcattcagaattgtt

SEQ ID NO: 7741386 - DNA, 22 bp, Homo sapiens
cagtatttgttacagcattagc

SEQ ID NO: 7741387 - DNA, 22 bp, Homo sapiens
cagtatgtactcttatcatgta

SEQ ID NO: 7741388 - DNA, 22 bp, Homo sapiens
agctggtggaagggagcccaaa

SEQ ID NO: 7741389 - DNA, 22 bp, Homo sapiens
caggcccattctaggcttgcta

SEQ ID NO: 7741390 - DNA, 22 bp, Homo sapiens
agctgtctgtctcctgaggaga

SEQ ID NO: 7741391 - DNA, 22 bp, Homo sapiens
agcttctcagcttcagaactgt

SEQ ID NO: 7741392 - DNA, 22 bp, Homo sapiens
agcttctcagaagagtcctgta

SEQ ID NO: 7741393 - DNA, 22 bp, Homo sapiens
agcttcctgtcttctgcacaaa

SEQ ID NO: 7741394 - DNA, 22 bp, Homo sapiens
agcttccttggcgctgaggcct

SEQ ID NO: 7741395 - DNA, 22 bp, Homo sapiens
caggagccacattccaccttga

SEQ ID NO: 7741396 - DNA, 18 bp, Homo sapiens
caggagcaggagttgaac

SEQ ID NO: 7741397 - DNA, 22 bp, Homo sapiens
caggagcccagagtcctcagct

SEQ ID NO: 7741398 - DNA, 22 bp, Homo sapiens
ccacagaatgatgacacttcag

SEQ ID NO: 7741399 - DNA, 22 bp, Homo sapiens
ccacagaattctgtctccagga

SEQ ID NO: 7741400 - DNA, 22 bp, Homo sapiens
ccacagagcattagatttcaga

SEQ ID NO: 7741401 - DNA, 22 bp, Homo sapiens
cagtgtttaatcattgtgaatt

SEQ ID NO: 7741402 - DNA, 22 bp, Homo sapiens
cagtccagccagtagggtgtgg

SEQ ID NO: 7741403 - DNA, 22 bp, Homo sapiens
cagtccaggcctggaggagcca

SEQ ID NO: 7741404 - DNA, 22 bp, Homo sapiens
cagtccagctcatcagtggcac

SEQ ID NO: 7741405 - DNA, 20 bp, Homo sapiens
cagtccaggctagaaaacaa

SEQ ID NO: 7741406 - DNA, 23 bp, Homo sapiens
aggaggcctgaaactgaggctga

SEQ ID NO: 7741407 - DNA, 22 bp, Homo sapiens
aggaggcctacgcacatgtcta

SEQ ID NO: 7741408 - DNA, 22 bp, Homo sapiens
aggaggccgctgatgggctccc

SEQ ID NO: 7741409 - DNA, 22 bp, Homo sapiens
aggagctgtcatttgattcaca

SEQ ID NO: 7741410 - DNA, 22 bp, Homo sapiens
aggagctgtcagagtgccagag

SEQ ID NO: 7741411 - DNA, 22 bp, Homo sapiens
catcttctgggacttctcagtt

SEQ ID NO: 7741412 - DNA, 22 bp, Homo sapiens
catgagatttgggaggggccag

SEQ ID NO: 7741413 - DNA, 22 bp, Homo sapiens
catgagaatgaagaagacttaa

SEQ ID NO: 7741414 - DNA, 22 bp, Homo sapiens
catgagaatgaagaagacttaa

SEQ ID NO: 7741415 - DNA, 22 bp, Homo sapiens
catgagagatccttcatgagag

SEQ ID NO: 7741416 - DNA, 22 bp, Homo sapiens
aggtcctgagggttcgtctgca

SEQ ID NO: 7741417 - DNA, 22 bp, Homo sapiens
aggtcctgactccacgttctag

SEQ ID NO: 7741418 - DNA, 22 bp, Homo sapiens
aggtcctgacgccctttgaaat

SEQ ID NO: 7741419 - DNA, 22 bp, Homo sapiens
aggtcctgaagattttactaga

SEQ ID NO: 7741420 - DNA, 22 bp, Homo sapiens
cctggctctgccgtaaccacca

SEQ ID NO: 7741421 - DNA, 22 bp, Homo sapiens
cctggctctgcagccactccag

SEQ ID NO: 7741422 - DNA, 22 bp, Homo sapiens
aggtccagttttctgacaaggg

SEQ ID NO: 7741423 - DNA, 21 bp, Homo sapiens
cctgcagcaccagaaggagat

SEQ ID NO: 7741424 - DNA, 22 bp, Homo sapiens
aggtaggatgggtggagatgat

SEQ ID NO: 7741425 - DNA, 22 bp, Homo sapiens
cctggctctgcgtgcagctccg

SEQ ID NO: 7741426 - DNA, 22 bp, Homo sapiens
cctggctctggttccctcagct

SEQ ID NO: 7741427 - DNA, 22 bp, Homo sapiens
cctgggctcacagccaaggctc

SEQ ID NO: 7741428 - DNA, 22 bp, Homo sapiens
cctgggctcaccatgccttgga

SEQ ID NO: 7741429 - DNA, 22 bp, Homo sapiens
cctgggctcaagtgatggtccc

SEQ ID NO: 7741430 - DNA, 22 bp, Homo sapiens
cctgggctccactccaagagca

SEQ ID NO: 7741431 - DNA, 22 bp, Homo sapiens
cctgggctcaggcttgggcagc

SEQ ID NO: 7741432 - DNA, 22 bp, Homo sapiens
cctgggctcaccatgccttgga

SEQ ID NO: 7741433 - DNA, 22 bp, Homo sapiens
cctgggctttcaaaaccagcct

SEQ ID NO: 7741434 - DNA, 22 bp, Homo sapiens
cctgggctttcggcggcttcct

SEQ ID NO: 7741435 - DNA, 22 bp, Homo sapiens
cctgggcttctgtctagatgtt

SEQ ID NO: 7741436 - DNA, 22 bp, Homo sapiens
cctgggcttgcatctgtgctgg

SEQ ID NO: 7741437 - DNA, 22 bp, Homo sapiens
cctgggcttggttgttgagaac

SEQ ID NO: 7741438 - DNA, 20 bp, Homo sapiens
cctgggctccaggagccccg

SEQ ID NO: 7741439 - DNA, 22 bp, Homo sapiens
cctgggctcgcgcacttcaccc

SEQ ID NO: 7741440 - DNA, 22 bp, Homo sapiens
cctgtcctccaagagcacatct

SEQ ID NO: 7741441 - DNA, 22 bp, Homo sapiens
aggtggggaggagtgtctcttt

SEQ ID NO: 7741442 - DNA, 22 bp, Homo sapiens
aggtttctggatttattatggc

SEQ ID NO: 7741443 - DNA, 22 bp, Homo sapiens
aggtttctggaaaggttttgct

SEQ ID NO: 7741444 - DNA, 22 bp, Homo sapiens
aggtttctttatgctgctagaa

SEQ ID NO: 7741445 - DNA, 22 bp, Homo sapiens
aggtttcttcttaggaatatgt

SEQ ID NO: 7741446 - DNA, 22 bp, Homo sapiens
aggtttctgcaatgtgtgtaca

SEQ ID NO: 7741447 - DNA, 22 bp, Homo sapiens
aggtttctgctgtcctccttct

SEQ ID NO: 7741448 - DNA, 17 bp, Homo sapiens
cgggcatggagggcagg

SEQ ID NO: 7741449 - DNA, 22 bp, Homo sapiens
cgggcacacacttgacaggttc

SEQ ID NO: 7741450 - DNA, 22 bp, Homo sapiens
ctaagcaagaatgagtgcaaca

SEQ ID NO: 7741451 - DNA, 21 bp, Homo sapiens
ctaagcaaggagcaggggtag

SEQ ID NO: 7741452 - DNA, 19 bp, Homo sapiens
agtccatgaatggaggatg

SEQ ID NO: 7741453 - DNA, 22 bp, Homo sapiens
agtccagggcttagtcagcggg

SEQ ID NO: 7741454 - DNA, 22 bp, Homo sapiens
agtccagggctctctgtgggat

SEQ ID NO: 7741455 - DNA, 22 bp, Homo sapiens
agtcctgatgctctggcaggag

SEQ ID NO: 7741456 - DNA, 18 bp, Homo sapiens
agtcctggagatcaccaa

SEQ ID NO: 7741457 - DNA, 22 bp, Homo sapiens
agtcctggacttggagtcaggg

SEQ ID NO: 7741458 - DNA, 21 bp, Homo sapiens
agtcccctgtccttacttcta

SEQ ID NO: 7741459 - DNA, 22 bp, Homo sapiens
ctcattgcaacctccgcctccc

SEQ ID NO: 7741460 - DNA, 19 bp, Homo sapiens
agtcctggcctgggggacc

SEQ ID NO: 7741461 - DNA, 22 bp, Homo sapiens
agtcctggccccaaggaaggat

SEQ ID NO: 7741462 - DNA, 22 bp, Homo sapiens
agtcctggctctacgggcttca

SEQ ID NO: 7741463 - DNA, 18 bp, Homo sapiens
ctcagtgtttgctgaaaa

SEQ ID NO: 7741464 - DNA, 22 bp, Homo sapiens
agtcttctgaataagaatcact

SEQ ID NO: 7741465 - DNA, 22 bp, Homo sapiens
agtcttcagcagccttctcagg

SEQ ID NO: 7741466 - DNA, 23 bp, Homo sapiens
agtcttcattgtatttccagacc

SEQ ID NO: 7741467 - DNA, 22 bp, Homo sapiens
agtcttcactcttcactactat

SEQ ID NO: 7741468 - DNA, 22 bp, Homo sapiens
ctccctccctacgtgagctcac

SEQ ID NO: 7741469 - DNA, 22 bp, Homo sapiens
ctccctctcaccggagccctgg

SEQ ID NO: 7741470 - DNA, 18 bp, Homo sapiens
ctccagggaactcagtca

SEQ ID NO: 7741471 - DNA, 22 bp, Homo sapiens
ctccctctgtccgaggccggct

SEQ ID NO: 7741472 - DNA, 22 bp, Homo sapiens
ctcctgggtcattgccagcaaa

SEQ ID NO: 7741473 - DNA, 22 bp, Homo sapiens
ctcctgggggacagcggcaggg

SEQ ID NO: 7741474 - DNA, 22 bp, Homo sapiens
ctcctggggccatggaaggaac

SEQ ID NO: 7741475 - DNA, 22 bp, Homo sapiens
ctcctgggaatttagttgtgag

SEQ ID NO: 7741476 - DNA, 22 bp, Homo sapiens
ctcctgggaaatgaaggggcag

SEQ ID NO: 7741477 - DNA, 22 bp, Homo sapiens
ctcctgggaaaggctggacaca

SEQ ID NO: 7741478 - DNA, 22 bp, Homo sapiens
ctctcagaagtagcacgtgggc

SEQ ID NO: 7741479 - DNA, 22 bp, Homo sapiens
ctctcagtgcctgccctaggct

SEQ ID NO: 7741480 - DNA, 22 bp, Homo sapiens
ctctcagtgccacacagccatt

SEQ ID NO: 7741481 - DNA, 22 bp, Homo sapiens
ctctcagtcctgcgcgcctctg

SEQ ID NO: 7741482 - DNA, 22 bp, Homo sapiens
ctctcagtaaatttctgcccca

SEQ ID NO: 7741483 - DNA, 19 bp, Homo sapiens
ctctcagcctgtctccttg

SEQ ID NO: 7741484 - DNA, 22 bp, Homo sapiens
ctctgctgatctcagctgggct

SEQ ID NO: 7741485 - DNA, 22 bp, Homo sapiens
ctctgggcttgttgacctgcac

SEQ ID NO: 7741486 - DNA, 20 bp, Homo sapiens
ctctgggctgcgttgcaaac

SEQ ID NO: 7741487 - DNA, 22 bp, Homo sapiens
ctctgggcttacctgcttcctg

SEQ ID NO: 7741488 - DNA, 22 bp, Homo sapiens
ctctgggctgccttttagctct

SEQ ID NO: 7741489 - DNA, 22 bp, Homo sapiens
ctctgggcttcaagtcagattt

SEQ ID NO: 7741490 - DNA, 22 bp, Homo sapiens
ctctgggcttcctttgtgggtt

SEQ ID NO: 7741491 - DNA, 22 bp, Homo sapiens
ctctgggaattctgagcaagca

SEQ ID NO: 7741492 - DNA, 22 bp, Homo sapiens
agtgtctgcctgggaggagcat

SEQ ID NO: 7741493 - DNA, 22 bp, Homo sapiens
agtgtctgcgggcagaggagcg

SEQ ID NO: 7741494 - DNA, 22 bp, Homo sapiens
agtgtctgctcagacagctaca

SEQ ID NO: 7741495 - DNA, 22 bp, Homo sapiens
agtgtctgctttgagtcaggtg

SEQ ID NO: 7741496 - DNA, 22 bp, Homo sapiens
agttagaatataattatgttaa

SEQ ID NO: 7741497 - DNA, 22 bp, Homo sapiens
agttactttctgatcagtgtgt

SEQ ID NO: 7741498 - DNA, 22 bp, Homo sapiens
ctgagcagcaccttcaagaaac

SEQ ID NO: 7741499 - DNA, 22 bp, Homo sapiens
ctgagcagcacagggcgccagg

SEQ ID NO: 7741500 - DNA, 22 bp, Homo sapiens
ctgagcagcaacccagagcctc

SEQ ID NO: 7741501 - DNA, 22 bp, Homo sapiens
ctgagctgggactcagtagcaa

SEQ ID NO: 7741502 - DNA, 22 bp, Homo sapiens
ctgaggagagatcacgtggtgt

SEQ ID NO: 7741503 - DNA, 22 bp, Homo sapiens
ctgaggagaccatcaactaatt

SEQ ID NO: 7741504 - DNA, 20 bp, Homo sapiens
ctgcagggttagaggctcca

SEQ ID NO: 7741505 - DNA, 22 bp, Homo sapiens
ctgcatgtcactctgctgtccc

SEQ ID NO: 7741506 - DNA, 22 bp, Homo sapiens
agttatgtcctcagcaaatcaa

SEQ ID NO: 7741507 - DNA, 22 bp, Homo sapiens
ctgaggagctgaaggccctcca

SEQ ID NO: 7741508 - DNA, 22 bp, Homo sapiens
ctgaggagccccctctcagcat

SEQ ID NO: 7741509 - DNA, 22 bp, Homo sapiens
ctgctgcaatctggcttccatg

SEQ ID NO: 7741510 - DNA, 22 bp, Homo sapiens
ataagatgagatcagctttctg

SEQ ID NO: 7741511 - DNA, 22 bp, Homo sapiens
ataaatgattcagcaggaaata

SEQ ID NO: 7741512 - DNA, 22 bp, Homo sapiens
ataacagagttgggaagtgaaa

SEQ ID NO: 7741513 - DNA, 22 bp, Homo sapiens
ctggctccattactcagcatct

SEQ ID NO: 7741514 - DNA, 22 bp, Homo sapiens
ctggctccatcactgggtgatg

SEQ ID NO: 7741515 - DNA, 22 bp, Homo sapiens
ctggctccatcctaggcaaatg

SEQ ID NO: 7741516 - DNA, 22 bp, Homo sapiens
ctggctcccatgagctctcacg

SEQ ID NO: 7741517 - DNA, 19 bp, Homo sapiens
ctggctgcaatgccagggt

SEQ ID NO: 7741518 - DNA, 22 bp, Homo sapiens
ctggccccaggcagcctgctgg

SEQ ID NO: 7741519 - DNA, 22 bp, Homo sapiens
ctggcccatggtgagctctggg

SEQ ID NO: 7741520 - DNA, 22 bp, Homo sapiens
ctggcccatggtgagctctggg

SEQ ID NO: 7741521 - DNA, 22 bp, Homo sapiens
atagcaaagatgtcaattcccc

SEQ ID NO: 7741522 - DNA, 22 bp, Homo sapiens
atctgaagggaagtggaaggca

SEQ ID NO: 7741523 - DNA, 21 bp, Homo sapiens
atctgaagtttgagaggaaag

SEQ ID NO: 7741524 - DNA, 22 bp, Homo sapiens
atctgaagaatgaatggaatta

SEQ ID NO: 7741525 - DNA, 22 bp, Homo sapiens
cttccaggttctggttgggaag

SEQ ID NO: 7741526 - DNA, 22 bp, Homo sapiens
cttcccaagactgtattgcaag

SEQ ID NO: 7741527 - DNA, 22 bp, Homo sapiens
cttcctcaggcattagctggac

SEQ ID NO: 7741528 - DNA, 22 bp, Homo sapiens
cttcctaaaagcttcaagagaa

SEQ ID NO: 7741529 - DNA, 22 bp, Homo sapiens
cttccaggtgctggcctggcct

SEQ ID NO: 7741530 - DNA, 22 bp, Homo sapiens
atcctgtggggcggctgcaggg

SEQ ID NO: 7741531 - DNA, 22 bp, Homo sapiens
atcctgtgttgctactggagga

SEQ ID NO: 7741532 - DNA, 22 bp, Homo sapiens
ctgtggctttgcagggcttgtt

SEQ ID NO: 7741533 - DNA, 22 bp, Homo sapiens
ctgtggctttggggcggaggac

SEQ ID NO: 7741534 - DNA, 22 bp, Homo sapiens
ctgtggcttttccggggagcct

SEQ ID NO: 7741535 - DNA, 22 bp, Homo sapiens
ctgtggctaggaagctgtggga

SEQ ID NO: 7741536 - DNA, 21 bp, Homo sapiens
ctgtggcctggctagcaccgt

SEQ ID NO: 7741537 - DNA, 22 bp, Homo sapiens
ctgtggccttggaccagcatct

SEQ ID NO: 7741538 - DNA, 23 bp, Homo sapiens
ctgtggccctgcttcatgcagcc

SEQ ID NO: 7741539 - DNA, 22 bp, Homo sapiens
atcagagattgtagtatgtgca

SEQ ID NO: 7741540 - DNA, 22 bp, Homo sapiens
ctgtgtgtcctcggacgagttt

SEQ ID NO: 7741541 - DNA, 22 bp, Homo sapiens
ctgtgtgctgaaatgcagtgag

SEQ ID NO: 7741542 - DNA, 22 bp, Homo sapiens
ctgtgtgcctagagggtggccg

SEQ ID NO: 7741543 - DNA, 22 bp, Homo sapiens
atccagggtgtggagagagctc

SEQ ID NO: 7741544 - DNA, 22 bp, Homo sapiens
ctggcttccctgtcttatggaa

SEQ ID NO: 7741545 - DNA, 22 bp, Homo sapiens
ctgggctcaagtgatccaccca

SEQ ID NO: 7741546 - DNA, 20 bp, Homo sapiens
ctgggctcaagtgatcctcc

SEQ ID NO: 7741547 - DNA, 21 bp, Homo sapiens
ctgggctcaagcaatcctttc

SEQ ID NO: 7741548 - DNA, 20 bp, Homo sapiens
ctgggctcaagtgagcctcc

SEQ ID NO: 7741549 - DNA, 22 bp, Homo sapiens
ctgggctcaagaagtcttccct

SEQ ID NO: 7741550 - DNA, 22 bp, Homo sapiens
ctgggctcacctgtggctggca

SEQ ID NO: 7741551 - DNA, 22 bp, Homo sapiens
ctgggctcttctcaccctgttt

SEQ ID NO: 7741552 - DNA, 22 bp, Homo sapiens
ctgggctcttcccagatccaga

SEQ ID NO: 7741553 - DNA, 22 bp, Homo sapiens
ctgggctctgtgtttcagtttc

SEQ ID NO: 7741554 - DNA, 22 bp, Homo sapiens
ctgggctctgcggtgtcgctct

SEQ ID NO: 7741555 - DNA, 22 bp, Homo sapiens
atattacataaacatgagtgaa

SEQ ID NO: 7741556 - DNA, 22 bp, Homo sapiens
atcaaagtgatttgtaaacagg

SEQ ID NO: 7741557 - DNA, 22 bp, Homo sapiens
atcagaagcttgtagtctctct

SEQ ID NO: 7741558 - DNA, 22 bp, Homo sapiens
atcaacatgaatttctctgaag

SEQ ID NO: 7741559 - DNA, 22 bp, Homo sapiens
atcacattgccagtgattaccc

SEQ ID NO: 7741560 - DNA, 22 bp, Homo sapiens
atcaaatcattgcattaatgtt

SEQ ID NO: 7741561 - DNA, 22 bp, Homo sapiens
atcaaatacaaagggcataagg

SEQ ID NO: 7741562 - DNA, 22 bp, Homo sapiens
gcctggattccttgtttctcag

SEQ ID NO: 7741563 - DNA, 22 bp, Homo sapiens
gcctcaaaagtgttgtagaggg

SEQ ID NO: 7741564 - DNA, 19 bp, Homo sapiens
gcctatgtcttcaaatcat

SEQ ID NO: 7741565 - DNA, 22 bp, Homo sapiens
gccccctcaaagaggaagctct

SEQ ID NO: 7741566 - DNA, 22 bp, Homo sapiens
atttgccttttaaactcacaat

SEQ ID NO: 7741567 - DNA, 22 bp, Homo sapiens
gccccctctttggagccagcca

SEQ ID NO: 7741568 - DNA, 22 bp, Homo sapiens
atttccaggctgttttgtgaat

SEQ ID NO: 7741569 - DNA, 19 bp, Homo sapiens
gccaggtcttgggtccagg

SEQ ID NO: 7741570 - DNA, 22 bp, Homo sapiens
gccacagggcgagcggaggcca

SEQ ID NO: 7741571 - DNA, 22 bp, Homo sapiens
atttctgatacccggtcaccct

SEQ ID NO: 7741572 - DNA, 22 bp, Homo sapiens
atttctgataaacgtaagctgc

SEQ ID NO: 7741573 - DNA, 22 bp, Homo sapiens
atttctgtggcttcattctcct

SEQ ID NO: 7741574 - DNA, 22 bp, Homo sapiens
atttctgttatacctttctcag

SEQ ID NO: 7741575 - DNA, 23 bp, Homo sapiens
gctctttgttcatgtggatgcct

SEQ ID NO: 7741576 - DNA, 22 bp, Homo sapiens
gctctttgtattttggaatcaa

SEQ ID NO: 7741577 - DNA, 20 bp, Homo sapiens
gctctttgtaagggaatttg

SEQ ID NO: 7741578 - DNA, 22 bp, Homo sapiens
gctctttggattcctttacaaa

SEQ ID NO: 7741579 - DNA, 22 bp, Homo sapiens
gctctttgcacagctctgccct

SEQ ID NO: 7741580 - DNA, 18 bp, Homo sapiens
gctctggttccttcaacc

SEQ ID NO: 7741581 - DNA, 23 bp, Homo sapiens
gctgactgtgaaattctggagct

SEQ ID NO: 7741582 - DNA, 22 bp, Homo sapiens
caaatgcatagtttataagaag

SEQ ID NO: 7741583 - DNA, 22 bp, Homo sapiens
caaatgctatgattttgagttt

SEQ ID NO: 7741584 - DNA, 22 bp, Homo sapiens
caaatgctggccctgctactta

SEQ ID NO: 7741585 - DNA, 22 bp, Homo sapiens
caaatgcatgagaaataagagg

SEQ ID NO: 7741586 - DNA, 22 bp, Homo sapiens
caaatagaactcacagacaaga

SEQ ID NO: 7741587 - DNA, 22 bp, Homo sapiens
caaagctataaattcagacaga

SEQ ID NO: 7741588 - DNA, 22 bp, Homo sapiens
caaagtgctgggattacaggct

SEQ ID NO: 7741589 - DNA, 21 bp, Homo sapiens
caaaggactgtagctcactga

SEQ ID NO: 7741590 - DNA, 22 bp, Homo sapiens
caaaggaagctccttgatggcg

SEQ ID NO: 7741591 - DNA, 23 bp, Homo sapiens
atttttagcctctctgagctgag

SEQ ID NO: 7741592 - DNA, 22 bp, Homo sapiens
atttttgccctgcagtacataa

SEQ ID NO: 7741593 - DNA, 22 bp, Homo sapiens
caaacattcaagtacaagtctt

SEQ ID NO: 7741594 - DNA, 22 bp, Homo sapiens
caaagcaggaagaatattgaaa

SEQ ID NO: 7741595 - DNA, 22 bp, Homo sapiens
caaagcaggcttgtcaaattgc

SEQ ID NO: 7741596 - DNA, 22 bp, Homo sapiens
caaagcagtgatccttaaagga

SEQ ID NO: 7741597 - DNA, 22 bp, Homo sapiens
caaagccaggctttctaatgta

SEQ ID NO: 7741598 - DNA, 22 bp, Homo sapiens
caaaattagggagtgagctgga

SEQ ID NO: 7741599 - DNA, 22 bp, Homo sapiens
caaaattctgcatttctaataa

SEQ ID NO: 7741600 - DNA, 22 bp, Homo sapiens
caaaattagaaatgcagctgtt

SEQ ID NO: 7741601 - DNA, 22 bp, Homo sapiens
attgactttcccttctcctcat

SEQ ID NO: 7741602 - DNA, 22 bp, Homo sapiens
gcaggcctttatccctgcctca

SEQ ID NO: 7741603 - DNA, 22 bp, Homo sapiens
gcagctgctgtggcatcaagct

SEQ ID NO: 7741604 - DNA, 22 bp, Homo sapiens
gccaaagcccaggagacagcca

SEQ ID NO: 7741605 - DNA, 22 bp, Homo sapiens
attgtgaatagtgccgcagtaa

SEQ ID NO: 7741606 - DNA, 22 bp, Homo sapiens
gccaacaggccttgctctgctc

SEQ ID NO: 7741607 - DNA, 22 bp, Homo sapiens
gccaagagaatgtgagagaaat

SEQ ID NO: 7741608 - DNA, 22 bp, Homo sapiens
gcatcaagacgatgtgaaatcg

SEQ ID NO: 7741609 - DNA, 22 bp, Homo sapiens
attcagaatggcaaacttctag

SEQ ID NO: 7741610 - DNA, 22 bp, Homo sapiens
gcagcagagaccccaggaagga

SEQ ID NO: 7741611 - DNA, 22 bp, Homo sapiens
attcacatgcccaagcagcacc

SEQ ID NO: 7741612 - DNA, 22 bp, Homo sapiens
attcacctgttagtaaaaatct

SEQ ID NO: 7741613 - DNA, 22 bp, Homo sapiens
gcacggcaagacggggcctcct

SEQ ID NO: 7741614 - DNA, 22 bp, Homo sapiens
attcaaggttggctcaggaatt

SEQ ID NO: 7741615 - DNA, 22 bp, Homo sapiens
attcaaggtttattcagtttag

SEQ ID NO: 7741616 - DNA, 22 bp, Homo sapiens
attcaagtacagttttcttctt

SEQ ID NO: 7741617 - DNA, 22 bp, Homo sapiens
attcaagattaattctatgtca

SEQ ID NO: 7741618 - DNA, 22 bp, Homo sapiens
attcaaggtatttaaaacataa

SEQ ID NO: 7741619 - DNA, 22 bp, Homo sapiens
gcacggctaatttttgtatttt

SEQ ID NO: 7741620 - DNA, 22 bp, Homo sapiens
gaggagaatgcgcaccacatat

SEQ ID NO: 7741621 - DNA, 22 bp, Homo sapiens
gaggagaagggcacggagaaaa

SEQ ID NO: 7741622 - DNA, 22 bp, Homo sapiens
gaggagaagctattggaaggac

SEQ ID NO: 7741623 - DNA, 22 bp, Homo sapiens
gaggagaaatttggggacctga

SEQ ID NO: 7741624 - DNA, 22 bp, Homo sapiens
gaggagaagctaagaaacacag

SEQ ID NO: 7741625 - DNA, 22 bp, Homo sapiens
gaggcagcctcagtggacctcg

SEQ ID NO: 7741626 - DNA, 22 bp, Homo sapiens
gaggcagcattcgcatagacag

SEQ ID NO: 7741627 - DNA, 17 bp, Homo sapiens
atggcttccattgacca

SEQ ID NO: 7741628 - DNA, 22 bp, Homo sapiens
atggcttctagcattgtcacaa

SEQ ID NO: 7741629 - DNA, 21 bp, Homo sapiens
atggccactatggtgcagcag

SEQ ID NO: 7741630 - DNA, 22 bp, Homo sapiens
atggccaccatctctaaaacac

SEQ ID NO: 7741631 - DNA, 22 bp, Homo sapiens
atggccaccatctctaaaacac

SEQ ID NO: 7741632 - DNA, 22 bp, Homo sapiens
atggccaccatttaatgaagct

SEQ ID NO: 7741633 - DNA, 21 bp, Homo sapiens
atggccactatggtgcagcag

SEQ ID NO: 7741634 - DNA, 22 bp, Homo sapiens
atggccacatttagtaactggt

SEQ ID NO: 7741635 - DNA, 17 bp, Homo sapiens
gagatgggtggatcacc

SEQ ID NO: 7741636 - DNA, 21 bp, Homo sapiens
atggagggaccagggaagcag

SEQ ID NO: 7741637 - DNA, 22 bp, Homo sapiens
atggagggaaaagtggagagcc

SEQ ID NO: 7741638 - DNA, 22 bp, Homo sapiens
atggagggtggtaagacagaga

SEQ ID NO: 7741639 - DNA, 22 bp, Homo sapiens
gagagaggcctccatgtactga

SEQ ID NO: 7741640 - DNA, 22 bp, Homo sapiens
atgtcctgttttggcttgctct

SEQ ID NO: 7741641 - DNA, 22 bp, Homo sapiens
gaggcagcgggtcaggaccgtg

SEQ ID NO: 7741642 - DNA, 22 bp, Homo sapiens
atgtagaagctgacagtgctgt

SEQ ID NO: 7741643 - DNA, 22 bp, Homo sapiens
atgtagaggagtttctggtctg

SEQ ID NO: 7741644 - DNA, 20 bp, Homo sapiens
gaggtagggcttaaggcaag

SEQ ID NO: 7741645 - DNA, 22 bp, Homo sapiens
atgtctgataaataatgcataa

SEQ ID NO: 7741646 - DNA, 22 bp, Homo sapiens
atgtctgcggcccaggccaggg

SEQ ID NO: 7741647 - DNA, 20 bp, Homo sapiens
atgtctgaagtaatccattt

SEQ ID NO: 7741648 - DNA, 22 bp, Homo sapiens
atgttctttgtgattctgagct

SEQ ID NO: 7741649 - DNA, 22 bp, Homo sapiens
atgttcttccaaatctgtaaca

SEQ ID NO: 7741650 - DNA, 22 bp, Homo sapiens
atgttggagtcgtaaggcatgg

SEQ ID NO: 7741651 - DNA, 22 bp, Homo sapiens
gagttctattatggttagaagt

SEQ ID NO: 7741652 - DNA, 22 bp, Homo sapiens
gagttcagtgtttctagtagtg

SEQ ID NO: 7741653 - DNA, 22 bp, Homo sapiens
gactggcctggagatgcagctg

SEQ ID NO: 7741654 - DNA, 22 bp, Homo sapiens
gactggcctggggctgggcaca

SEQ ID NO: 7741655 - DNA, 22 bp, Homo sapiens
gactggatattgagtactgcaa

SEQ ID NO: 7741656 - DNA, 22 bp, Homo sapiens
atgctccttggcttcaaagcca

SEQ ID NO: 7741657 - DNA, 22 bp, Homo sapiens
gacaccagcaaggctgtgagga

SEQ ID NO: 7741658 - DNA, 22 bp, Homo sapiens
gacaattgcttttgccgaataa

SEQ ID NO: 7741659 - DNA, 22 bp, Homo sapiens
gacacaaagtttgtcagaaatt

SEQ ID NO: 7741660 - DNA, 22 bp, Homo sapiens
gaataatattgactttgcaggc

SEQ ID NO: 7741661 - DNA, 22 bp, Homo sapiens
gacaatcagccatatccagggt

SEQ ID NO: 7741662 - DNA, 22 bp, Homo sapiens
gaatcaaatcaagttcttttga

SEQ ID NO: 7741663 - DNA, 22 bp, Homo sapiens
gaatcaatggtagattaagtaa

SEQ ID NO: 7741664 - DNA, 22 bp, Homo sapiens
gaatcaattatccaggctgttg

SEQ ID NO: 7741665 - DNA, 22 bp, Homo sapiens
gaatcaattgtgaagactatga

SEQ ID NO: 7741666 - DNA, 22 bp, Homo sapiens
gaaggctggggccttctcatct

SEQ ID NO: 7741667 - DNA, 22 bp, Homo sapiens
atgcacaattaggatatagctt

SEQ ID NO: 7741668 - DNA, 22 bp, Homo sapiens
atgaaaagttcgatctagaagg

SEQ ID NO: 7741669 - DNA, 22 bp, Homo sapiens
atgaaaagttcgatctagaagg

SEQ ID NO: 7741670 - DNA, 22 bp, Homo sapiens
gaaatagatctctgggatgcaa

SEQ ID NO: 7741671 - DNA, 22 bp, Homo sapiens
atgatgaagagtaacaggctga

SEQ ID NO: 7741672 - DNA, 22 bp, Homo sapiens
gaaagtattagcctagaagtca

SEQ ID NO: 7741673 - DNA, 22 bp, Homo sapiens
gaaagtattcacaaagttcttg

SEQ ID NO: 7741674 - DNA, 22 bp, Homo sapiens
gaaagtatgccatctacctctt

SEQ ID NO: 7741675 - DNA, 22 bp, Homo sapiens
gaaagtatttacattaacatct

SEQ ID NO: 7741676 - DNA, 22 bp, Homo sapiens
gaaagtatttaagtccatattt

SEQ ID NO: 7741677 - DNA, 22 bp, Homo sapiens
gaaagtattctccctgaatttt

SEQ ID NO: 7741678 - DNA, 22 bp, Homo sapiens
gaaatagacactttctatgaat

SEQ ID NO: 7741679 - DNA, 22 bp, Homo sapiens
gaaagtgcagtcagacaaggca

SEQ ID NO: 7741680 - DNA, 21 bp, Homo sapiens
cagaccattgcatgagcaggt

SEQ ID NO: 7741681 - DNA, 22 bp, Homo sapiens
cagaccatcttgaagcaaactg

SEQ ID NO: 7741682 - DNA, 22 bp, Homo sapiens
cagaccccgagtttgcagagtt

SEQ ID NO: 7741683 - DNA, 22 bp, Homo sapiens
ggcttagcaactcctgaggctc

SEQ ID NO: 7741684 - DNA, 22 bp, Homo sapiens
cagacctggaaaacaggcttgc

SEQ ID NO: 7741685 - DNA, 22 bp, Homo sapiens
cagacctggaaaacaggcttgc

SEQ ID NO: 7741686 - DNA, 20 bp, Homo sapiens
cagacctgcacccacttcga

SEQ ID NO: 7741687 - DNA, 22 bp, Homo sapiens
cagacctgggtccctggcctgt

SEQ ID NO: 7741688 - DNA, 22 bp, Homo sapiens
cagacctgggtccctggcctgt

SEQ ID NO: 7741689 - DNA, 22 bp, Homo sapiens
gggcagcagcaggaggtctctg

SEQ ID NO: 7741690 - DNA, 22 bp, Homo sapiens
gggcagtgggaccaggcaccag

SEQ ID NO: 7741691 - DNA, 22 bp, Homo sapiens
cagagcctcatcatccactcca

SEQ ID NO: 7741692 - DNA, 22 bp, Homo sapiens
cagagcctaaaacgactccact

SEQ ID NO: 7741693 - DNA, 22 bp, Homo sapiens
gggctctgtttagatcagagat

SEQ ID NO: 7741694 - DNA, 22 bp, Homo sapiens
cagaggcaaaagaggtggaggt

SEQ ID NO: 7741695 - DNA, 22 bp, Homo sapiens
cagagctgggtttgggaaacct

SEQ ID NO: 7741696 - DNA, 22 bp, Homo sapiens
cagagcctccctcctctgccat

SEQ ID NO: 7741697 - DNA, 23 bp, Homo sapiens
cagagctggcttcatgggtgtgc

SEQ ID NO: 7741698 - DNA, 22 bp, Homo sapiens
cagagctgggcatggtgaaagg

SEQ ID NO: 7741699 - DNA, 22 bp, Homo sapiens
ggtctgagtgccagggagagaa

SEQ ID NO: 7741700 - DNA, 22 bp, Homo sapiens
ggtctgagcttgagcccatgct

SEQ ID NO: 7741701 - DNA, 22 bp, Homo sapiens
ggtctgagatatttgttcagct

SEQ ID NO: 7741702 - DNA, 18 bp, Homo sapiens
ggtctgagatcgtttttc

SEQ ID NO: 7741703 - DNA, 22 bp, Homo sapiens
ggtctgagtagagggctggcga

SEQ ID NO: 7741704 - DNA, 22 bp, Homo sapiens
ggtctgaggctccaaggaggtg

SEQ ID NO: 7741705 - DNA, 22 bp, Homo sapiens
cagcaaagtaagctgacatgta

SEQ ID NO: 7741706 - DNA, 22 bp, Homo sapiens
cagcaccagcatattccagggc

SEQ ID NO: 7741707 - DNA, 22 bp, Homo sapiens
cagcacatgctcatcagggaag

SEQ ID NO: 7741708 - DNA, 22 bp, Homo sapiens
cagagggaaaaggggagtaata

SEQ ID NO: 7741709 - DNA, 22 bp, Homo sapiens
ggggagcaatagttgaggtgtg

SEQ ID NO: 7741710 - DNA, 22 bp, Homo sapiens
ggggagcagaagcagcaacaac

SEQ ID NO: 7741711 - DNA, 22 bp, Homo sapiens
cagagtctctgggaggctgggt

SEQ ID NO: 7741712 - DNA, 22 bp, Homo sapiens
ggtcctgggaagatgctcatga

SEQ ID NO: 7741713 - DNA, 22 bp, Homo sapiens
cagagtcttgtgtgttcagccc

SEQ ID NO: 7741714 - DNA, 17 bp, Homo sapiens
cagagtctgtctgcatc

SEQ ID NO: 7741715 - DNA, 22 bp, Homo sapiens
cagagtctggactgcaggctcc

SEQ ID NO: 7741716 - DNA, 22 bp, Homo sapiens
cagaggtagcatgctgtggctt

SEQ ID NO: 7741717 - DNA, 22 bp, Homo sapiens
cagaggtagaactggccctcac

SEQ ID NO: 7741718 - DNA, 22 bp, Homo sapiens
cagaggtagaaggcatgcagtg

SEQ ID NO: 7741719 - DNA, 22 bp, Homo sapiens
cagaggtacaagctaagttggg

SEQ ID NO: 7741720 - DNA, 22 bp, Homo sapiens
cagaggtacagccattgaagat

SEQ ID NO: 7741721 - DNA, 22 bp, Homo sapiens
cagaggtaccagcagcctctgg

SEQ ID NO: 7741722 - DNA, 23 bp, Homo sapiens
ggtcagtgagttcgtttctctgg

SEQ ID NO: 7741723 - DNA, 22 bp, Homo sapiens
ggtcagtgcgatttcccactcc

SEQ ID NO: 7741724 - DNA, 22 bp, Homo sapiens
ggtcagtgacttttttctgtgg

SEQ ID NO: 7741725 - DNA, 22 bp, Homo sapiens
ggtcagtggcagggggtacttc

SEQ ID NO: 7741726 - DNA, 23 bp, Homo sapiens
cagccctggagatgtgggaggca

SEQ ID NO: 7741727 - DNA, 22 bp, Homo sapiens
cagccctggaacagctgactca

SEQ ID NO: 7741728 - DNA, 22 bp, Homo sapiens
cagccctggaacagctgactca

SEQ ID NO: 7741729 - DNA, 22 bp, Homo sapiens
cagccctgcttccccgctagtt

SEQ ID NO: 7741730 - DNA, 22 bp, Homo sapiens
cagcctgactatggctgcaggt

SEQ ID NO: 7741731 - DNA, 22 bp, Homo sapiens
cagcctgagccttctgtagcaa

SEQ ID NO: 7741732 - DNA, 22 bp, Homo sapiens
cagccctgcagccatggcctgt

SEQ ID NO: 7741733 - DNA, 22 bp, Homo sapiens
cagccctgctgacactgtctga

SEQ ID NO: 7741734 - DNA, 22 bp, Homo sapiens
cagccctgctcttagtgtctcc

SEQ ID NO: 7741735 - DNA, 22 bp, Homo sapiens
cagcctggattgcagaatgcta

SEQ ID NO: 7741736 - DNA, 22 bp, Homo sapiens
gtgcccaggtgtccctgagaag

SEQ ID NO: 7741737 - DNA, 22 bp, Homo sapiens
cagctaccatggtttgttccag

SEQ ID NO: 7741738 - DNA, 18 bp, Homo sapiens
gtgctgtgggcagtggcc

SEQ ID NO: 7741739 - DNA, 22 bp, Homo sapiens
gtgctgtgtgatccatgctggc

SEQ ID NO: 7741740 - DNA, 22 bp, Homo sapiens
gtctggagcctgggtccctgct

SEQ ID NO: 7741741 - DNA, 22 bp, Homo sapiens
gtctggagagctgagcagagtt

SEQ ID NO: 7741742 - DNA, 22 bp, Homo sapiens
gtctggagacttgggtcatcaa

SEQ ID NO: 7741743 - DNA, 22 bp, Homo sapiens
gtccctgggggtttaggactca

SEQ ID NO: 7741744 - DNA, 22 bp, Homo sapiens
gtccctggtttgcccaggacca

SEQ ID NO: 7741745 - DNA, 19 bp, Homo sapiens
gtccctgggcagaggcacc

SEQ ID NO: 7741746 - DNA, 22 bp, Homo sapiens
gtccctggggaatcagctggag

SEQ ID NO: 7741747 - DNA, 22 bp, Homo sapiens
cagccctcaggtcctcagcagc

SEQ ID NO: 7741748 - DNA, 22 bp, Homo sapiens
cagccccttcctggcatctgga

SEQ ID NO: 7741749 - DNA, 22 bp, Homo sapiens
cagcccctcacagagctgtcct

SEQ ID NO: 7741750 - DNA, 22 bp, Homo sapiens
cagcccctccctcaggcaggtg

SEQ ID NO: 7741751 - DNA, 22 bp, Homo sapiens
cagcagctggtgagacacagcc

SEQ ID NO: 7741752 - DNA, 22 bp, Homo sapiens
cagcagctgtttacggaacacc

SEQ ID NO: 7741753 - DNA, 22 bp, Homo sapiens
cagcagctggttgaatccttct

SEQ ID NO: 7741754 - DNA, 22 bp, Homo sapiens
cagcagctggttatacctgtgg

SEQ ID NO: 7741755 - DNA, 22 bp, Homo sapiens
cagcagctttgccaagtcagcc

SEQ ID NO: 7741756 - DNA, 22 bp, Homo sapiens
cagcagcttttgcattctcatt

SEQ ID NO: 7741757 - DNA, 22 bp, Homo sapiens
cagcagcttctgttgatcagaa

SEQ ID NO: 7741758 - DNA, 22 bp, Homo sapiens
gtcagcatgagcaagggctgac

SEQ ID NO: 7741759 - DNA, 22 bp, Homo sapiens
cagcaggacatggaggagtaaa

SEQ ID NO: 7741760 - DNA, 22 bp, Homo sapiens
cagcagctacttggagcagcag

SEQ ID NO: 7741761 - DNA, 22 bp, Homo sapiens
cagcagctagaggaagggcaga

SEQ ID NO: 7741762 - DNA, 22 bp, Homo sapiens
cagcacctgttagcattaaata

SEQ ID NO: 7741763 - DNA, 23 bp, Homo sapiens
cagcagctgcctggttttttggt

SEQ ID NO: 7741764 - DNA, 22 bp, Homo sapiens
cagcagctgcctcagctgggga

SEQ ID NO: 7741765 - DNA, 22 bp, Homo sapiens
cagcagctgcaaatggaaacag

SEQ ID NO: 7741766 - DNA, 22 bp, Homo sapiens
cagcagctgatggggaagtgat

SEQ ID NO: 7741767 - DNA, 22 bp, Homo sapiens
cagcagctgggaaggaggctga

SEQ ID NO: 7741768 - DNA, 22 bp, Homo sapiens
cagcagctgcgtgcccaggccg

SEQ ID NO: 7741769 - DNA, 22 bp, Homo sapiens
gtcccaggaacattctggctag

SEQ ID NO: 7741770 - DNA, 22 bp, Homo sapiens
gtccagccaccctggaggcacg

SEQ ID NO: 7741771 - DNA, 22 bp, Homo sapiens
ggctgagcttatatatgtgctg

SEQ ID NO: 7741772 - DNA, 22 bp, Homo sapiens
ggctctggtgagggtaggagat

SEQ ID NO: 7741773 - DNA, 22 bp, Homo sapiens
ggctctggtgccctggctccca

SEQ ID NO: 7741774 - DNA, 22 bp, Homo sapiens
ggctctggtggcaattgactgg

SEQ ID NO: 7741775 - DNA, 22 bp, Homo sapiens
ggctctggtcagtgaggggcct

SEQ ID NO: 7741776 - DNA, 22 bp, Homo sapiens
ggcctgaggccaccagcagccc

SEQ ID NO: 7741777 - DNA, 19 bp, Homo sapiens
ggcctgaggccacagatcc

SEQ ID NO: 7741778 - DNA, 22 bp, Homo sapiens
ggcctgtgcaagacagcacccc

SEQ ID NO: 7741779 - DNA, 22 bp, Homo sapiens
ggctcacacatgactgggctct

SEQ ID NO: 7741780 - DNA, 22 bp, Homo sapiens
cagaaatacccagcatttggag

SEQ ID NO: 7741781 - DNA, 22 bp, Homo sapiens
ggctgtcagggtgagctggctt

SEQ ID NO: 7741782 - DNA, 22 bp, Homo sapiens
ggctgtcaattcataggtcaga

SEQ ID NO: 7741783 - DNA, 22 bp, Homo sapiens
cagaaagccctatgtacagtgg

SEQ ID NO: 7741784 - DNA, 23 bp, Homo sapiens
cagaaagccctttccccacagta

SEQ ID NO: 7741785 - DNA, 22 bp, Homo sapiens
ggctgccctcgtctactgccca

SEQ ID NO: 7741786 - DNA, 22 bp, Homo sapiens
ggaggtgacgaaaagaaattgt

SEQ ID NO: 7741787 - DNA, 22 bp, Homo sapiens
ggcagggagagcatgctgataa

SEQ ID NO: 7741788 - DNA, 22 bp, Homo sapiens
ggcaggtgcacctgagccatct

SEQ ID NO: 7741789 - DNA, 22 bp, Homo sapiens
ggcaggtgccagttggcttggg

SEQ ID NO: 7741790 - DNA, 22 bp, Homo sapiens
ggcaggtgcccagagagcacga

SEQ ID NO: 7741791 - DNA, 22 bp, Homo sapiens
ggcagggagtggagactcccta

SEQ ID NO: 7741792 - DNA, 22 bp, Homo sapiens
ggcagggcaggaaagtcaggaa

SEQ ID NO: 7741793 - DNA, 22 bp, Homo sapiens
ggcagggcaggaaagtcaggaa

SEQ ID NO: 7741794 - DNA, 22 bp, Homo sapiens
ggccaccttcctgtggtctctg

SEQ ID NO: 7741795 - DNA, 22 bp, Homo sapiens
ggccactcggccacccctgccg

SEQ ID NO: 7741796 - DNA, 22 bp, Homo sapiens
ggcatcaggatctgtcttgctt

SEQ ID NO: 7741797 - DNA, 22 bp, Homo sapiens
ggcccttcctcttgtgctggca

SEQ ID NO: 7741798 - DNA, 22 bp, Homo sapiens
ggccctgttagagctcccacaa

SEQ ID NO: 7741799 - DNA, 22 bp, Homo sapiens
ggccactgctctccagcctggg

SEQ ID NO: 7741800 - DNA, 22 bp, Homo sapiens
caccttgtggcccagtcaggtt

SEQ ID NO: 7741801 - DNA, 20 bp, Homo sapiens
caccttcaaatttcctggca

SEQ ID NO: 7741802 - DNA, 22 bp, Homo sapiens
caccttcagaatgctccaggca

SEQ ID NO: 7741803 - DNA, 22 bp, Homo sapiens
cacctgttgtttattcatctct

SEQ ID NO: 7741804 - DNA, 22 bp, Homo sapiens
ggagctggcagcgcaacccaga

SEQ ID NO: 7741805 - DNA, 22 bp, Homo sapiens
cacaggagaaaggggaagctcg

SEQ ID NO: 7741806 - DNA, 22 bp, Homo sapiens
ggaggcagaatagagtgtgggt

SEQ ID NO: 7741807 - DNA, 22 bp, Homo sapiens
cacaggaatataagtttgagtt

SEQ ID NO: 7741808 - DNA, 22 bp, Homo sapiens
cacaggaatcagcattaatggc

SEQ ID NO: 7741809 - DNA, 20 bp, Homo sapiens
ggagctggcatccagcctct

SEQ ID NO: 7741810 - DNA, 22 bp, Homo sapiens
cacagctttgctttccttaata

SEQ ID NO: 7741811 - DNA, 22 bp, Homo sapiens
cacagaggactgtagcggggag

SEQ ID NO: 7741812 - DNA, 22 bp, Homo sapiens
cacagaggaatgcatcagcaga

SEQ ID NO: 7741813 - DNA, 22 bp, Homo sapiens
cacagagctggaaaggctgggc

SEQ ID NO: 7741814 - DNA, 22 bp, Homo sapiens
cacagagctgaacctgggtcat

SEQ ID NO: 7741815 - DNA, 22 bp, Homo sapiens
ggactgggattctggatctgct

SEQ ID NO: 7741816 - DNA, 22 bp, Homo sapiens
ggactgggcatgggtgctctgc

SEQ ID NO: 7741817 - DNA, 22 bp, Homo sapiens
ggaaggggagctaaatctactg

SEQ ID NO: 7741818 - DNA, 22 bp, Homo sapiens
ggaaggggagctggaaagggta

SEQ ID NO: 7741819 - DNA, 22 bp, Homo sapiens
ggaaggggagctggaaagggta

SEQ ID NO: 7741820 - DNA, 22 bp, Homo sapiens
caagtatttcctgatggcctgt

SEQ ID NO: 7741821 - DNA, 22 bp, Homo sapiens
caagtttgtgttctatcattct

SEQ ID NO: 7741822 - DNA, 22 bp, Homo sapiens
caagtttgctgatccttgtttt

SEQ ID NO: 7741823 - DNA, 22 bp, Homo sapiens
caagttttctgggttcagagca

SEQ ID NO: 7741824 - DNA, 22 bp, Homo sapiens
caatgtcatgattttccattag

SEQ ID NO: 7741825 - DNA, 22 bp, Homo sapiens
caatgtcaaggagaccaaaacg

SEQ ID NO: 7741826 - DNA, 22 bp, Homo sapiens
caaggccttcgtctcctagctt

SEQ ID NO: 7741827 - DNA, 21 bp, Homo sapiens
gctggctgtcccagggaagca

SEQ ID NO: 7741828 - DNA, 22 bp, Homo sapiens
gctggaggcagttcagacacca

SEQ ID NO: 7741829 - DNA, 22 bp, Homo sapiens
gctggaggcagttcagacacca

SEQ ID NO: 7741830 - DNA, 22 bp, Homo sapiens
gctggaggatggactggaagaa

SEQ ID NO: 7741831 - DNA, 22 bp, Homo sapiens
cctcagtgagtgtttccttctt

SEQ ID NO: 7741832 - DNA, 22 bp, Homo sapiens
cctcagtgcgtactgaacagtg

SEQ ID NO: 7741833 - DNA, 20 bp, Homo sapiens
cctcagtgtcctggactggg

SEQ ID NO: 7741834 - DNA, 22 bp, Homo sapiens
cctcagtgtgcagcagcatctg

SEQ ID NO: 7741835 - DNA, 22 bp, Homo sapiens
cctcagtgtgtggatgttagag

SEQ ID NO: 7741836 - DNA, 22 bp, Homo sapiens
cctcagtgttaggataagagaa

SEQ ID NO: 7741837 - DNA, 22 bp, Homo sapiens
cctcagtgtgtttggggtgagg

SEQ ID NO: 7741838 - DNA, 22 bp, Homo sapiens
cctcattaacacaatgtcattt

SEQ ID NO: 7741839 - DNA, 22 bp, Homo sapiens
tggcctgggccggcagatatac

SEQ ID NO: 7741840 - DNA, 22 bp, Homo sapiens
tggcctgggcatgaagcatcgt

SEQ ID NO: 7741841 - DNA, 22 bp, Homo sapiens
tggctctgtcaaactgcacaca

SEQ ID NO: 7741842 - DNA, 22 bp, Homo sapiens
tggctctggtgcgggctcctgc

SEQ ID NO: 7741843 - DNA, 22 bp, Homo sapiens
tggctctggtaacattgggtag

SEQ ID NO: 7741844 - DNA, 21 bp, Homo sapiens
tggctctgggtaggagagtgc

SEQ ID NO: 7741845 - DNA, 22 bp, Homo sapiens
cctcaggctgggctgcccctgg

SEQ ID NO: 7741846 - DNA, 22 bp, Homo sapiens
cctcaggcttacgggcaatgga

SEQ ID NO: 7741847 - DNA, 22 bp, Homo sapiens
tggcccagagcactgctgggca

SEQ ID NO: 7741848 - DNA, 22 bp, Homo sapiens
tggcccagatctctgaccttga

SEQ ID NO: 7741849 - DNA, 22 bp, Homo sapiens
cctcagaggttttcattctgta

SEQ ID NO: 7741850 - DNA, 18 bp, Homo sapiens
tggcaggtagactcaggt

SEQ ID NO: 7741851 - DNA, 22 bp, Homo sapiens
tggcaggtagagttctgagatg

SEQ ID NO: 7741852 - DNA, 22 bp, Homo sapiens
cctaggcccattaattcccctt

SEQ ID NO: 7741853 - DNA, 22 bp, Homo sapiens
cctaggaacccccaggcttctg

SEQ ID NO: 7741854 - DNA, 22 bp, Homo sapiens
cctaggaagctgagattgcagt

SEQ ID NO: 7741855 - DNA, 18 bp, Homo sapiens
cctaggaaagggaggcaa

SEQ ID NO: 7741856 - DNA, 19 bp, Homo sapiens
cctagagcagtacctggta

SEQ ID NO: 7741857 - DNA, 22 bp, Homo sapiens
cctagagccgcacctcctccac

SEQ ID NO: 7741858 - DNA, 22 bp, Homo sapiens
cctctgctccctggtgtctgag

SEQ ID NO: 7741859 - DNA, 22 bp, Homo sapiens
tggcttccagagctgctccacc

SEQ ID NO: 7741860 - DNA, 22 bp, Homo sapiens
tggcttccagtaatcaggattt

SEQ ID NO: 7741861 - DNA, 22 bp, Homo sapiens
tgggaaggcagtcactgtccta

SEQ ID NO: 7741862 - DNA, 22 bp, Homo sapiens
tgggaaggaactgcctttagct

SEQ ID NO: 7741863 - DNA, 22 bp, Homo sapiens
tggctggctgtccagctgggca

SEQ ID NO: 7741864 - DNA, 20 bp, Homo sapiens
tggcttcataatggtttctg

SEQ ID NO: 7741865 - DNA, 17 bp, Homo sapiens
tggcttcaggctgagca

SEQ ID NO: 7741866 - DNA, 16 bp, Homo sapiens
tggctgagagagggtt

SEQ ID NO: 7741867 - DNA, 22 bp, Homo sapiens
tggctgagagaagacggggaag

SEQ ID NO: 7741868 - DNA, 22 bp, Homo sapiens
tggctgagaccatcagggtgta

SEQ ID NO: 7741869 - DNA, 22 bp, Homo sapiens
tggctgagaccatcagggtgta

SEQ ID NO: 7741870 - DNA, 22 bp, Homo sapiens
tggctgagaagttctggtggga

SEQ ID NO: 7741871 - DNA, 22 bp, Homo sapiens
cctgagcctggctcatgcactc

SEQ ID NO: 7741872 - DNA, 22 bp, Homo sapiens
cctgagctcaaagggtgcctgg

SEQ ID NO: 7741873 - DNA, 22 bp, Homo sapiens
tgggccccagcacgtctgggga

SEQ ID NO: 7741874 - DNA, 22 bp, Homo sapiens
cctgagcctgagtggtgcaggg

SEQ ID NO: 7741875 - DNA, 22 bp, Homo sapiens
cctgagccgagcgctctttctc

SEQ ID NO: 7741876 - DNA, 22 bp, Homo sapiens
cctgagcattagacatccatca

SEQ ID NO: 7741877 - DNA, 22 bp, Homo sapiens
cctgagcatcagcgcctcctta

SEQ ID NO: 7741878 - DNA, 22 bp, Homo sapiens
cccaggcagtgtgtgcatgcgt

SEQ ID NO: 7741879 - DNA, 22 bp, Homo sapiens
tgcccagcctaaacttggcaag

SEQ ID NO: 7741880 - DNA, 22 bp, Homo sapiens
tgcccagccaatttgttatgtt

SEQ ID NO: 7741881 - DNA, 22 bp, Homo sapiens
tgccctgggagttggagctgct

SEQ ID NO: 7741882 - DNA, 22 bp, Homo sapiens
tgccctggggtctggagcagca

SEQ ID NO: 7741883 - DNA, 22 bp, Homo sapiens
tgccctggggagcccagccagg

SEQ ID NO: 7741884 - DNA, 22 bp, Homo sapiens
cccaggctagtatgatatcagt

SEQ ID NO: 7741885 - DNA, 22 bp, Homo sapiens
cccaggctagaaaggccaacaa

SEQ ID NO: 7741886 - DNA, 22 bp, Homo sapiens
cccaggctcactgtccgcttcc

SEQ ID NO: 7741887 - DNA, 22 bp, Homo sapiens
cccaggctcagactggcttgtt

SEQ ID NO: 7741888 - DNA, 20 bp, Homo sapiens
tgcacagacaatgagcccag

SEQ ID NO: 7741889 - DNA, 22 bp, Homo sapiens
tgcctgttgcccacctgataaa

SEQ ID NO: 7741890 - DNA, 22 bp, Homo sapiens
cccagggttgcctgcctctgct

SEQ ID NO: 7741891 - DNA, 22 bp, Homo sapiens
cccagggtggatgcaagcagca

SEQ ID NO: 7741892 - DNA, 19 bp, Homo sapiens
cccagggtttcctctctcc

SEQ ID NO: 7741893 - DNA, 22 bp, Homo sapiens
cccagggtagctgagctggcag

SEQ ID NO: 7741894 - DNA, 22 bp, Homo sapiens
cccagggtccctgctctctgtg

SEQ ID NO: 7741895 - DNA, 22 bp, Homo sapiens
cccaggctggagtgcaatggca

SEQ ID NO: 7741896 - DNA, 22 bp, Homo sapiens
cccaggctggagtgcagtggcg

SEQ ID NO: 7741897 - DNA, 22 bp, Homo sapiens
cccaggctggagtgcaatggtg

SEQ ID NO: 7741898 - DNA, 22 bp, Homo sapiens
cccaggctggaattccaggcct

SEQ ID NO: 7741899 - DNA, 22 bp, Homo sapiens
cccaggctggagggcagtgtca

SEQ ID NO: 7741900 - DNA, 22 bp, Homo sapiens
cccaggctggcactgctgaagt

SEQ ID NO: 7741901 - DNA, 22 bp, Homo sapiens
cccaggctggatttcggtggca

SEQ ID NO: 7741902 - DNA, 22 bp, Homo sapiens
cccaggctggggctcctccagc

SEQ ID NO: 7741903 - DNA, 22 bp, Homo sapiens
cccaggctggcactgctgaagt

SEQ ID NO: 7741904 - DNA, 22 bp, Homo sapiens
cccaggctggtcctgaactcct

SEQ ID NO: 7741905 - DNA, 22 bp, Homo sapiens
cccctcttggcattgagtgcca

SEQ ID NO: 7741906 - DNA, 22 bp, Homo sapiens
ccccttctctgcaagcctgctc

SEQ ID NO: 7741907 - DNA, 22 bp, Homo sapiens
ccccttctggtcttcaatggtg

SEQ ID NO: 7741908 - DNA, 22 bp, Homo sapiens
ccccttctgtgtcctgtcagcc

SEQ ID NO: 7741909 - DNA, 22 bp, Homo sapiens
cccctttctcccgcgtctggcc

SEQ ID NO: 7741910 - DNA, 22 bp, Homo sapiens
tgctggccctggctcagggaac

SEQ ID NO: 7741911 - DNA, 22 bp, Homo sapiens
tgctggcccatgaagacgcagt

SEQ ID NO: 7741912 - DNA, 22 bp, Homo sapiens
tgctggccggccaggtgctgag

SEQ ID NO: 7741913 - DNA, 22 bp, Homo sapiens
tgctggcctggttagaaagggg

SEQ ID NO: 7741914 - DNA, 22 bp, Homo sapiens
tgctggcctgggctgcaccttg

SEQ ID NO: 7741915 - DNA, 22 bp, Homo sapiens
tgctggcctcggcgctgggcct

SEQ ID NO: 7741916 - DNA, 22 bp, Homo sapiens
tgctggccaagcagaggtcaat

SEQ ID NO: 7741917 - DNA, 22 bp, Homo sapiens
tgctggccaatggcagaggcgg

SEQ ID NO: 7741918 - DNA, 21 bp, Homo sapiens
tgctggccatgtgctgggcat

SEQ ID NO: 7741919 - DNA, 21 bp, Homo sapiens
cccaggtcgtggtcttcccag

SEQ ID NO: 7741920 - DNA, 22 bp, Homo sapiens
cccaggtctccctgcagccctg

SEQ ID NO: 7741921 - DNA, 22 bp, Homo sapiens
cccagttgttgccggctctgga

SEQ ID NO: 7741922 - DNA, 22 bp, Homo sapiens
ccctctctcaggctgacagcct

SEQ ID NO: 7741923 - DNA, 18 bp, Homo sapiens
ccctctcctgctagtggg

SEQ ID NO: 7741924 - DNA, 22 bp, Homo sapiens
ccctctcagtcagagccagata

SEQ ID NO: 7741925 - DNA, 22 bp, Homo sapiens
ccctcctctccctaagagtcac

SEQ ID NO: 7741926 - DNA, 18 bp, Homo sapiens
cccggctaatttttggta

SEQ ID NO: 7741927 - DNA, 22 bp, Homo sapiens
tctcagaattgtgtccactggg

SEQ ID NO: 7741928 - DNA, 22 bp, Homo sapiens
ccagctctcagcgggagactca

SEQ ID NO: 7741929 - DNA, 22 bp, Homo sapiens
tctggaaagatcattaaatcca

SEQ ID NO: 7741930 - DNA, 22 bp, Homo sapiens
ccagctctgattttgacctcca

SEQ ID NO: 7741931 - DNA, 22 bp, Homo sapiens
ccagctctctgcagaaaggact

SEQ ID NO: 7741932 - DNA, 22 bp, Homo sapiens
ccagctctctgtcctccccaca

SEQ ID NO: 7741933 - DNA, 22 bp, Homo sapiens
ccagctctgattttgacctcca

SEQ ID NO: 7741934 - DNA, 22 bp, Homo sapiens
ccagctctgccaagcgtcagct

SEQ ID NO: 7741935 - DNA, 22 bp, Homo sapiens
tctggcctcttgggatgctccc

SEQ ID NO: 7741936 - DNA, 22 bp, Homo sapiens
tctggccttatctgtccaagcc

SEQ ID NO: 7741937 - DNA, 22 bp, Homo sapiens
tctggccctgctgctgtgagca

SEQ ID NO: 7741938 - DNA, 22 bp, Homo sapiens
tctggctcacttcaggcttcac

SEQ ID NO: 7741939 - DNA, 18 bp, Homo sapiens
tctggctcaggactgaac

SEQ ID NO: 7741940 - DNA, 22 bp, Homo sapiens
tctggctcaggagctgtgttca

SEQ ID NO: 7741941 - DNA, 22 bp, Homo sapiens
tctggctcagggctctgaggga

SEQ ID NO: 7741942 - DNA, 17 bp, Homo sapiens
tctggccttcctgaact

SEQ ID NO: 7741943 - DNA, 22 bp, Homo sapiens
tctggctcaaaatacgtactct

SEQ ID NO: 7741944 - DNA, 20 bp, Homo sapiens
tctggtccaggtcttcatgg

SEQ ID NO: 7741945 - DNA, 22 bp, Homo sapiens
tctggtccctgctcacttcttg

SEQ ID NO: 7741946 - DNA, 22 bp, Homo sapiens
tctggtcccttttcctgcagtc

SEQ ID NO: 7741947 - DNA, 22 bp, Homo sapiens
tctggtcctctctgtgatgcta

SEQ ID NO: 7741948 - DNA, 22 bp, Homo sapiens
tctggtgtcagtattctttgaa

SEQ ID NO: 7741949 - DNA, 21 bp, Homo sapiens
ccaggactccatggggtctct

SEQ ID NO: 7741950 - DNA, 22 bp, Homo sapiens
ccaggaggttgaggctgcagtg

SEQ ID NO: 7741951 - DNA, 22 bp, Homo sapiens
ccaggatctgatattgggctcc

SEQ ID NO: 7741952 - DNA, 22 bp, Homo sapiens
ccaggatctgtacacctctgag

SEQ ID NO: 7741953 - DNA, 22 bp, Homo sapiens
ccaggatctgggtccatgggac

SEQ ID NO: 7741954 - DNA, 22 bp, Homo sapiens
ccaggcctggaccatgccaggg

SEQ ID NO: 7741955 - DNA, 22 bp, Homo sapiens
ccaggcctggaccatgccaggg

SEQ ID NO: 7741956 - DNA, 22 bp, Homo sapiens
ccaggcctggacgggtggcctg

SEQ ID NO: 7741957 - DNA, 22 bp, Homo sapiens
ccaggcctggccaggggatgcc

SEQ ID NO: 7741958 - DNA, 22 bp, Homo sapiens
ccaggctgaatatgttccaggg

SEQ ID NO: 7741959 - DNA, 22 bp, Homo sapiens
tctttggggcatctgggagatt

SEQ ID NO: 7741960 - DNA, 22 bp, Homo sapiens
ccaggcctgcatctgctgcgca

SEQ ID NO: 7741961 - DNA, 22 bp, Homo sapiens
ccatgccctaaaggactggcag

SEQ ID NO: 7741962 - DNA, 22 bp, Homo sapiens
tgaggtatggtaaggtaaaatc

SEQ ID NO: 7741963 - DNA, 22 bp, Homo sapiens
tgagggctaaattgtggcaggt

SEQ ID NO: 7741964 - DNA, 22 bp, Homo sapiens
ccagtcctgccaccctgtctat

SEQ ID NO: 7741965 - DNA, 22 bp, Homo sapiens
ccagtcctcagatggtctgtgc

SEQ ID NO: 7741966 - DNA, 22 bp, Homo sapiens
ccagtcctagaagaggagtcga

SEQ ID NO: 7741967 - DNA, 22 bp, Homo sapiens
ccattctgagtcttatgtcttt

SEQ ID NO: 7741968 - DNA, 22 bp, Homo sapiens
ccattccatgtgctacacataa

SEQ ID NO: 7741969 - DNA, 22 bp, Homo sapiens
tgattcaagccaccacatactg

SEQ ID NO: 7741970 - DNA, 22 bp, Homo sapiens
tgatttctcatattgttcaaaa

SEQ ID NO: 7741971 - DNA, 22 bp, Homo sapiens
cccacccctggacaggtgagtg

SEQ ID NO: 7741972 - DNA, 22 bp, Homo sapiens
tgcaaatagcctgatgaaagaa

SEQ ID NO: 7741973 - DNA, 22 bp, Homo sapiens
tgcaaagccacaatgaaatcag

SEQ ID NO: 7741974 - DNA, 22 bp, Homo sapiens
tgcaaaggaggatgggaaagaa

SEQ ID NO: 7741975 - DNA, 22 bp, Homo sapiens
tgcacacattctatggggctga

SEQ ID NO: 7741976 - DNA, 22 bp, Homo sapiens
tgcacacatgtttacaagcatc

SEQ ID NO: 7741977 - DNA, 22 bp, Homo sapiens
tgaggcagaaaatagcagttca

SEQ ID NO: 7741978 - DNA, 22 bp, Homo sapiens
tgaggcagagtaagatacatga

SEQ ID NO: 7741979 - DNA, 22 bp, Homo sapiens
tgaggcagatatttattgggtt

SEQ ID NO: 7741980 - DNA, 22 bp, Homo sapiens
tgagacgaagtcttgctctgtt

SEQ ID NO: 7741981 - DNA, 17 bp, Homo sapiens
ccaggtgggaggtgggg

SEQ ID NO: 7741982 - DNA, 21 bp, Homo sapiens
tgagaagtatgtcttcagcca

SEQ ID NO: 7741983 - DNA, 22 bp, Homo sapiens
tgagaaggctcaggcttagaga

SEQ ID NO: 7741984 - DNA, 22 bp, Homo sapiens
tgagaatcatccagaggcttct

SEQ ID NO: 7741985 - DNA, 17 bp, Homo sapiens
ccaggtctccttgcttt

SEQ ID NO: 7741986 - DNA, 21 bp, Homo sapiens
ccagggtccagctgccatggt

SEQ ID NO: 7741987 - DNA, 22 bp, Homo sapiens
tgacagttaaggtatacattca

SEQ ID NO: 7741988 - DNA, 22 bp, Homo sapiens
tgacagttgtattacatgggaa

SEQ ID NO: 7741989 - DNA, 20 bp, Homo sapiens
tgacagtttcatatggttca

SEQ ID NO: 7741990 - DNA, 23 bp, Homo sapiens
tgacagtgtatttgactatatgg

SEQ ID NO: 7741991 - DNA, 20 bp, Homo sapiens
ccaggctggcaaatgggggc

SEQ ID NO: 7741992 - DNA, 22 bp, Homo sapiens
ccaggctggagtgtagtcgcat

SEQ ID NO: 7741993 - DNA, 22 bp, Homo sapiens
ccaggctggattttgcagttca

SEQ ID NO: 7741994 - DNA, 22 bp, Homo sapiens
ccaggctggagtgcagtggcac

SEQ ID NO: 7741995 - DNA, 22 bp, Homo sapiens
caggtgaagaggataaaaagtt

SEQ ID NO: 7741996 - DNA, 18 bp, Homo sapiens
caggtcagcctggcctca

SEQ ID NO: 7741997 - DNA, 22 bp, Homo sapiens
caggtcagaggtagatgagatg

SEQ ID NO: 7741998 - DNA, 22 bp, Homo sapiens
caggtcagaggcgcagccccca

SEQ ID NO: 7741999 - DNA, 22 bp, Homo sapiens
tcaagcggactgagatactctg

SEQ ID NO: 7742000 - DNA, 19 bp, Homo sapiens
tcaaaacacaaatggttga

SEQ ID NO: 7742001 - DNA, 22 bp, Homo sapiens
tcaaaacaatcattggatgtgc

SEQ ID NO: 7742002 - DNA, 22 bp, Homo sapiens
tcaaaacaacactcaggtgtaa

SEQ ID NO: 7742003 - DNA, 22 bp, Homo sapiens
cagtcaccttgaggactcagac

SEQ ID NO: 7742004 - DNA, 22 bp, Homo sapiens
tagcttaaggagtaccagatca

SEQ ID NO: 7742005 - DNA, 22 bp, Homo sapiens
cagggccagttctcgcagcagt

SEQ ID NO: 7742006 - DNA, 22 bp, Homo sapiens
tagatttaagaccctgaatttg

SEQ ID NO: 7742007 - DNA, 22 bp, Homo sapiens
tagcttggaataaaatgagaat

SEQ ID NO: 7742008 - DNA, 22 bp, Homo sapiens
tagcttcttgagaaagggtgcc

SEQ ID NO: 7742009 - DNA, 22 bp, Homo sapiens
cagggctgaactgagcttgtga

SEQ ID NO: 7742010 - DNA, 22 bp, Homo sapiens
cagggctggatttcatttctag

SEQ ID NO: 7742011 - DNA, 22 bp, Homo sapiens
cagggctggtttgtcgaagaaa

SEQ ID NO: 7742012 - DNA, 17 bp, Homo sapiens
cagggctgtctgcctag

SEQ ID NO: 7742013 - DNA, 22 bp, Homo sapiens
cagggctgtgcccatcttcccc

SEQ ID NO: 7742014 - DNA, 22 bp, Homo sapiens
cagggtcaggaggatctggctt

SEQ ID NO: 7742015 - DNA, 22 bp, Homo sapiens
cagggtccatctttcatcactg

SEQ ID NO: 7742016 - DNA, 22 bp, Homo sapiens
cagggtcccaggagctgctttc

SEQ ID NO: 7742017 - DNA, 22 bp, Homo sapiens
cagggtccccgggtctcctgtg

SEQ ID NO: 7742018 - DNA, 22 bp, Homo sapiens
cagggtccggctgcctggctgt

SEQ ID NO: 7742019 - DNA, 22 bp, Homo sapiens
caggctggagttcagtggtgtg

SEQ ID NO: 7742020 - DNA, 22 bp, Homo sapiens
caggcctgagacatctgagata

SEQ ID NO: 7742021 - DNA, 22 bp, Homo sapiens
tacatgttcaaatttgtctttc

SEQ ID NO: 7742022 - DNA, 22 bp, Homo sapiens
cagctcaagtttcccaggtcag

SEQ ID NO: 7742023 - DNA, 22 bp, Homo sapiens
cagctattggcaagaagtggtg

SEQ ID NO: 7742024 - DNA, 22 bp, Homo sapiens
taagtattggcctatagctaga

SEQ ID NO: 7742025 - DNA, 22 bp, Homo sapiens
caggcaccccaggtgagcactg

SEQ ID NO: 7742026 - DNA, 22 bp, Homo sapiens
caggcatgagccaggcccctcc

SEQ ID NO: 7742027 - DNA, 22 bp, Homo sapiens
caggcatgatcataggagttta

SEQ ID NO: 7742028 - DNA, 22 bp, Homo sapiens
caggccagagcgcgtggttggg

SEQ ID NO: 7742029 - DNA, 22 bp, Homo sapiens
tacaaaaggaagagggatctta

SEQ ID NO: 7742030 - DNA, 22 bp, Homo sapiens
caggccagtgtgcttcccaggc

SEQ ID NO: 7742031 - DNA, 22 bp, Homo sapiens
caggccagggttgagaagagaa

SEQ ID NO: 7742032 - DNA, 22 bp, Homo sapiens
caggccagtgggaaatagggat

SEQ ID NO: 7742033 - DNA, 22 bp, Homo sapiens
tcagagagtgcaaaatatagct

SEQ ID NO: 7742034 - DNA, 22 bp, Homo sapiens
cagttcttatttggccagtgtc

SEQ ID NO: 7742035 - DNA, 22 bp, Homo sapiens
cagttcttaataccatgtggtt

SEQ ID NO: 7742036 - DNA, 22 bp, Homo sapiens
cagttctggtttgcagatatat

SEQ ID NO: 7742037 - DNA, 22 bp, Homo sapiens
tcaatattcttctttagtagga

SEQ ID NO: 7742038 - DNA, 22 bp, Homo sapiens
tcaatagcatagcaattaatgt

SEQ ID NO: 7742039 - DNA, 22 bp, Homo sapiens
tcaatcaaagccagatgtcctt

SEQ ID NO: 7742040 - DNA, 22 bp, Homo sapiens
tcaatcaaagcactgggctttg

SEQ ID NO: 7742041 - DNA, 22 bp, Homo sapiens
tcaatcaatggtttccaaattt

SEQ ID NO: 7742042 - DNA, 22 bp, Homo sapiens
tcaatcaatgtgtcagttccca

SEQ ID NO: 7742043 - DNA, 22 bp, Homo sapiens
tcagaggaggcatttaaacaga

SEQ ID NO: 7742044 - DNA, 22 bp, Homo sapiens
cagtttgtcttgattcagaaca

SEQ ID NO: 7742045 - DNA, 22 bp, Homo sapiens
cagtttgtgctaggcactattt

SEQ ID NO: 7742046 - DNA, 22 bp, Homo sapiens
cagtttttgccattaagagtaa

SEQ ID NO: 7742047 - DNA, 22 bp, Homo sapiens
tcagcagtcctccaggatcaag

SEQ ID NO: 7742048 - DNA, 22 bp, Homo sapiens
cataatcagatgtgtacataag

SEQ ID NO: 7742049 - DNA, 22 bp, Homo sapiens
tcaggcagagtggaagctgcaa

SEQ ID NO: 7742050 - DNA, 22 bp, Homo sapiens
tcaggcccagagtcacggatcc

SEQ ID NO: 7742051 - DNA, 22 bp, Homo sapiens
catagaaatcaggtgagaatct

SEQ ID NO: 7742052 - DNA, 22 bp, Homo sapiens
tcaggctgttagccacctcctc

SEQ ID NO: 7742053 - DNA, 22 bp, Homo sapiens
tcaggcctcaagctgctttaag

SEQ ID NO: 7742054 - DNA, 22 bp, Homo sapiens
tcaggcctccaggttaccattt

SEQ ID NO: 7742055 - DNA, 22 bp, Homo sapiens
tcaggcccttctcccaggactc

SEQ ID NO: 7742056 - DNA, 22 bp, Homo sapiens
tcaggccccatcccagacttat

SEQ ID NO: 7742057 - DNA, 22 bp, Homo sapiens
catagaaacttgcagcaagcac

SEQ ID NO: 7742058 - DNA, 22 bp, Homo sapiens
catggccaaggatgctcaacca

SEQ ID NO: 7742059 - DNA, 22 bp, Homo sapiens
catggccaaagaattatatttt

SEQ ID NO: 7742060 - DNA, 22 bp, Homo sapiens
catggccacatctagctgcaag

SEQ ID NO: 7742061 - DNA, 22 bp, Homo sapiens
catggccagattctttcttctc

SEQ ID NO: 7742062 - DNA, 22 bp, Homo sapiens
catggccacattggaccgaagc

SEQ ID NO: 7742063 - DNA, 22 bp, Homo sapiens
catggccagcccccagttcctc

SEQ ID NO: 7742064 - DNA, 22 bp, Homo sapiens
catggccagcccccagttcctc

SEQ ID NO: 7742065 - DNA, 22 bp, Homo sapiens
catggccacatgataatcaagt

SEQ ID NO: 7742066 - DNA, 22 bp, Homo sapiens
catggcaggaaaatgaacaggc

SEQ ID NO: 7742067 - DNA, 22 bp, Homo sapiens
catggcagctttgggaggagga

SEQ ID NO: 7742068 - DNA, 22 bp, Homo sapiens
catgcattcctcctctgcctta

SEQ ID NO: 7742069 - DNA, 20 bp, Homo sapiens
catgagaagggcagtgtgag

SEQ ID NO: 7742070 - DNA, 22 bp, Homo sapiens
catgagaaccaggtctgtgttt

SEQ ID NO: 7742071 - DNA, 22 bp, Homo sapiens
catgagaaggggtggagttaga

SEQ ID NO: 7742072 - DNA, 22 bp, Homo sapiens
catgaccccccaaggcctgcag

SEQ ID NO: 7742073 - DNA, 22 bp, Homo sapiens
tcagtgctcctaaagtgaatgc

SEQ ID NO: 7742074 - DNA, 22 bp, Homo sapiens
tcagtgctcaggggagccgagg

SEQ ID NO: 7742075 - DNA, 22 bp, Homo sapiens
tcagtgctaaaagagctggtgt

SEQ ID NO: 7742076 - DNA, 22 bp, Homo sapiens
catctcaggtctgtggttcact

SEQ ID NO: 7742077 - DNA, 22 bp, Homo sapiens
tcagtgcattctaccaaaaggc

SEQ ID NO: 7742078 - DNA, 22 bp, Homo sapiens
tcagtgcattgttcattgtagg

SEQ ID NO: 7742079 - DNA, 21 bp, Homo sapiens
tcagtccctgggtgtgtccca

SEQ ID NO: 7742080 - DNA, 22 bp, Homo sapiens
tcagtgcattcatgggtggctg

SEQ ID NO: 7742081 - DNA, 22 bp, Homo sapiens
catcttaaattaaagcttaagg

SEQ ID NO: 7742082 - DNA, 22 bp, Homo sapiens
catctgggttctcagatggata

SEQ ID NO: 7742083 - DNA, 22 bp, Homo sapiens
tctaatcctatggtggggaggg

SEQ ID NO: 7742084 - DNA, 22 bp, Homo sapiens
tctaataaataaatgctctagg

SEQ ID NO: 7742085 - DNA, 19 bp, Homo sapiens
tcctggggaggggcatggc

SEQ ID NO: 7742086 - DNA, 22 bp, Homo sapiens
ccactgctaacttgctgcagct

SEQ ID NO: 7742087 - DNA, 22 bp, Homo sapiens
tccttggggacgctgacatcgt

SEQ ID NO: 7742088 - DNA, 22 bp, Homo sapiens
tcctggctcctgatctgtcact

SEQ ID NO: 7742089 - DNA, 22 bp, Homo sapiens
ccacagaaagttgtctagagta

SEQ ID NO: 7742090 - DNA, 22 bp, Homo sapiens
ccacagaacctcagctttgagc

SEQ ID NO: 7742091 - DNA, 22 bp, Homo sapiens
tcctgggcttaagtgatcctcc

SEQ ID NO: 7742092 - DNA, 22 bp, Homo sapiens
ccacagaaagcctgggaagtgg

SEQ ID NO: 7742093 - DNA, 22 bp, Homo sapiens
ccacagaaaataaagcacgatt

SEQ ID NO: 7742094 - DNA, 22 bp, Homo sapiens
ccacagaaaataaagcacgatt

SEQ ID NO: 7742095 - DNA, 22 bp, Homo sapiens
ccaaggctcctcagctggtctt

SEQ ID NO: 7742096 - DNA, 22 bp, Homo sapiens
ccaaggcttcccagagatgctc

SEQ ID NO: 7742097 - DNA, 22 bp, Homo sapiens
tcctaattgcttcatgtgttgt

SEQ ID NO: 7742098 - DNA, 20 bp, Homo sapiens
tccctcctgcagatagagaa

SEQ ID NO: 7742099 - DNA, 22 bp, Homo sapiens
tccctcctgcatgaggctcggc

SEQ ID NO: 7742100 - DNA, 22 bp, Homo sapiens
tccctcctggtgatgatgcaaa

SEQ ID NO: 7742101 - DNA, 22 bp, Homo sapiens
tccctcctggtgagcaggggct

SEQ ID NO: 7742102 - DNA, 22 bp, Homo sapiens
tccctccttaataagaggtctg

SEQ ID NO: 7742103 - DNA, 22 bp, Homo sapiens
tccctggggtatcgctgaggca

SEQ ID NO: 7742104 - DNA, 22 bp, Homo sapiens
tccctgctttcttgtgagggga

SEQ ID NO: 7742105 - DNA, 22 bp, Homo sapiens
tccctctacagggaagcgcttt

SEQ ID NO: 7742106 - DNA, 22 bp, Homo sapiens
ctgacagggtagacagagggca

SEQ ID NO: 7742107 - DNA, 22 bp, Homo sapiens
ctgaggcagagggcagaccaga

SEQ ID NO: 7742108 - DNA, 22 bp, Homo sapiens
ctgaggcagagggcagaccaga

SEQ ID NO: 7742109 - DNA, 22 bp, Homo sapiens
ctgagccatgagcctgcgccca

SEQ ID NO: 7742110 - DNA, 22 bp, Homo sapiens
ctgagccatgggtctaagcact

SEQ ID NO: 7742111 - DNA, 22 bp, Homo sapiens
ctgagccatgggtctaagcact

SEQ ID NO: 7742112 - DNA, 22 bp, Homo sapiens
ctgagccataagggaggctggg

SEQ ID NO: 7742113 - DNA, 22 bp, Homo sapiens
ctgagccaaccacagcaggagc

SEQ ID NO: 7742114 - DNA, 20 bp, Homo sapiens
ctgagccaactctcttcttg

SEQ ID NO: 7742115 - DNA, 22 bp, Homo sapiens
ctgacctgctaagcccctgtcc

SEQ ID NO: 7742116 - DNA, 22 bp, Homo sapiens
ctgacctggccttggtgggcca

SEQ ID NO: 7742117 - DNA, 22 bp, Homo sapiens
ctgagccaaccacagcaggagc

SEQ ID NO: 7742118 - DNA, 22 bp, Homo sapiens
ctgaggccagctgcagagctct

SEQ ID NO: 7742119 - DNA, 22 bp, Homo sapiens
ctgaggcatgggaagttgggtg

SEQ ID NO: 7742120 - DNA, 22 bp, Homo sapiens
ctgaggccagctgcagagctct

SEQ ID NO: 7742121 - DNA, 22 bp, Homo sapiens
ctgaggcccctctcttgagctt

SEQ ID NO: 7742122 - DNA, 22 bp, Homo sapiens
ctgaggccgtctgggtctgcag

SEQ ID NO: 7742123 - DNA, 22 bp, Homo sapiens
ctgcacagaggtcggtctgcca

SEQ ID NO: 7742124 - DNA, 22 bp, Homo sapiens
ctgcacagtggacagtgaagat

SEQ ID NO: 7742125 - DNA, 22 bp, Homo sapiens
ctgcacagtgggtggggcgtca

SEQ ID NO: 7742126 - DNA, 22 bp, Homo sapiens
ctgcacagggatatggggagct

SEQ ID NO: 7742127 - DNA, 22 bp, Homo sapiens
ctgcacagccctcaagagcctg

SEQ ID NO: 7742128 - DNA, 22 bp, Homo sapiens
ctgcacagcctgtctgggggcc

SEQ ID NO: 7742129 - DNA, 22 bp, Homo sapiens
ctgcacagctggccagggagag

SEQ ID NO: 7742130 - DNA, 20 bp, Homo sapiens
ctgcactgaacatgtctgag

SEQ ID NO: 7742131 - DNA, 22 bp, Homo sapiens
ctgcactgacttccccggctgc

SEQ ID NO: 7742132 - DNA, 22 bp, Homo sapiens
ctgcactgagctctcccagccc

SEQ ID NO: 7742133 - DNA, 22 bp, Homo sapiens
ctgcaggcatctaactgtgggc

SEQ ID NO: 7742134 - DNA, 22 bp, Homo sapiens
ctcttcagtaaatgacactgtt

SEQ ID NO: 7742135 - DNA, 22 bp, Homo sapiens
ctcttcaggatggcttgtgatg

SEQ ID NO: 7742136 - DNA, 22 bp, Homo sapiens
ctcttcaggaatatgtcagtca

SEQ ID NO: 7742137 - DNA, 21 bp, Homo sapiens
ctcttgtgtcagagccagagg

SEQ ID NO: 7742138 - DNA, 22 bp, Homo sapiens
tttgtacactgtctactatgaa

SEQ ID NO: 7742139 - DNA, 21 bp, Homo sapiens
tttgccttcacgaagcatcct

SEQ ID NO: 7742140 - DNA, 22 bp, Homo sapiens
tttgcctgattctaagagctca

SEQ ID NO: 7742141 - DNA, 22 bp, Homo sapiens
ctctgcccgcggatgccacgtc

SEQ ID NO: 7742142 - DNA, 22 bp, Homo sapiens
ctctgccctcgcacatctgcca

SEQ ID NO: 7742143 - DNA, 22 bp, Homo sapiens
ctctgcccacgtcttgcccaga

SEQ ID NO: 7742144 - DNA, 22 bp, Homo sapiens
ctccagtgcgcaggacagcccc

SEQ ID NO: 7742145 - DNA, 22 bp, Homo sapiens
tttaatatttctttcctgaagc

SEQ ID NO: 7742146 - DNA, 22 bp, Homo sapiens
ctccaagtccgagggctctcaa

SEQ ID NO: 7742147 - DNA, 22 bp, Homo sapiens
ttgtacaagtattatgtgaaca

SEQ ID NO: 7742148 - DNA, 22 bp, Homo sapiens
ctccagattccgtttattcagg

SEQ ID NO: 7742149 - DNA, 22 bp, Homo sapiens
ttgaaatagatgcgtcagagat

SEQ ID NO: 7742150 - DNA, 22 bp, Homo sapiens
ctcccgtgatcctggaggagag

SEQ ID NO: 7742151 - DNA, 22 bp, Homo sapiens
ctccccatccaggcagcaggtg

SEQ ID NO: 7742152 - DNA, 22 bp, Homo sapiens
ctcccccttagctcttgtcttt

SEQ ID NO: 7742153 - DNA, 22 bp, Homo sapiens
ctcctcagttgtcccatggaga

SEQ ID NO: 7742154 - DNA, 22 bp, Homo sapiens
tttattccagtgtttctcaaat

SEQ ID NO: 7742155 - DNA, 22 bp, Homo sapiens
tttatttaaagtcgtgtgttaa

SEQ ID NO: 7742156 - DNA, 22 bp, Homo sapiens
tttatttaaagtcgtgtgttaa

SEQ ID NO: 7742157 - DNA, 22 bp, Homo sapiens
tttatttaccttatgtcctcca

SEQ ID NO: 7742158 - DNA, 16 bp, Homo sapiens
tttatttactagtgtt

SEQ ID NO: 7742159 - DNA, 22 bp, Homo sapiens
ctctctggaagggggagctgat

SEQ ID NO: 7742160 - DNA, 22 bp, Homo sapiens
tttcaatgtaacatttccaggc

SEQ ID NO: 7742161 - DNA, 22 bp, Homo sapiens
tttcacagtcaatttggagtca

SEQ ID NO: 7742162 - DNA, 22 bp, Homo sapiens
tttcacagtgctctgtaagtat

SEQ ID NO: 7742163 - DNA, 22 bp, Homo sapiens
tgtgtctgaactagttgctctc

SEQ ID NO: 7742164 - DNA, 22 bp, Homo sapiens
tgtgtctgcactgagtcctcac

SEQ ID NO: 7742165 - DNA, 21 bp, Homo sapiens
tgggggagaattggttgcttt

SEQ ID NO: 7742166 - DNA, 22 bp, Homo sapiens
tggggcagctccatctattcca

SEQ ID NO: 7742167 - DNA, 22 bp, Homo sapiens
tggggcagtggcttttcaccct

SEQ ID NO: 7742168 - DNA, 22 bp, Homo sapiens
tggggctgtgagactacaggat

SEQ ID NO: 7742169 - DNA, 23 bp, Homo sapiens
tgttccagatacgccttttcctc

SEQ ID NO: 7742170 - DNA, 22 bp, Homo sapiens
tgttacagtactacaattctgc

SEQ ID NO: 7742171 - DNA, 22 bp, Homo sapiens
cctggtggaaggtgagtgaggc

SEQ ID NO: 7742172 - DNA, 22 bp, Homo sapiens
cctggtggccttcagcccacaa

SEQ ID NO: 7742173 - DNA, 17 bp, Homo sapiens
tgttaattccaatgata

SEQ ID NO: 7742174 - DNA, 22 bp, Homo sapiens
tgttacaaactgttgtttctat

SEQ ID NO: 7742175 - DNA, 21 bp, Homo sapiens
cctgggctgtggtttggagac

SEQ ID NO: 7742176 - DNA, 22 bp, Homo sapiens
cctgggctgtacctgtgcgcgg

SEQ ID NO: 7742177 - DNA, 22 bp, Homo sapiens
cctgggctgggcgtctcatggg

SEQ ID NO: 7742178 - DNA, 22 bp, Homo sapiens
cctgggctgttgcatcatcctt

SEQ ID NO: 7742179 - DNA, 22 bp, Homo sapiens
cctgggcttacgacctctgact

SEQ ID NO: 7742180 - DNA, 22 bp, Homo sapiens
cctgggctgctcatggggatga

SEQ ID NO: 7742181 - DNA, 22 bp, Homo sapiens
cctgggctggagtacagcagtg

SEQ ID NO: 7742182 - DNA, 16 bp, Homo sapiens
cctgggctctgttgga

SEQ ID NO: 7742183 - DNA, 22 bp, Homo sapiens
cctgggctctgtcagaattggg

SEQ ID NO: 7742184 - DNA, 22 bp, Homo sapiens
cctgggctgaagtcaagtgtgg

SEQ ID NO: 7742185 - DNA, 22 bp, Homo sapiens
cctgggctgaagtcaagtgtgg

SEQ ID NO: 7742186 - DNA, 22 bp, Homo sapiens
cctgggctgcatgatggcattt

SEQ ID NO: 7742187 - DNA, 22 bp, Homo sapiens
cctgggctctgaggagggagtc

SEQ ID NO: 7742188 - DNA, 22 bp, Homo sapiens
cctgggctctatcctgacccag

SEQ ID NO: 7742189 - DNA, 22 bp, Homo sapiens
cctgggctcaagtgatcctcct

SEQ ID NO: 7742190 - DNA, 22 bp, Homo sapiens
tgtttagactcaaaattgaaag

SEQ ID NO: 7742191 - DNA, 22 bp, Homo sapiens
tgtttagaggaactggaatcag

SEQ ID NO: 7742192 - DNA, 22 bp, Homo sapiens
tgtttagatgcaaagtctcaca

SEQ ID NO: 7742193 - DNA, 22 bp, Homo sapiens
cctgtctgtcctctcatgagcc

SEQ ID NO: 7742194 - DNA, 22 bp, Homo sapiens
cctgtgctcccatagcttctgt

SEQ ID NO: 7742195 - DNA, 18 bp, Homo sapiens
cctgtgctccagcatctg

SEQ ID NO: 7742196 - DNA, 22 bp, Homo sapiens
cctgtgccctcagcctggctct

SEQ ID NO: 7742197 - DNA, 22 bp, Homo sapiens
ccttctagcaaatcaacataaa

SEQ ID NO: 7742198 - DNA, 22 bp, Homo sapiens
ttagaatctaacattcttatct

SEQ ID NO: 7742199 - DNA, 22 bp, Homo sapiens
ccttcaggtcatatatgtcaga

SEQ ID NO: 7742200 - DNA, 22 bp, Homo sapiens
cctgtgtgtctgtcactgcaca

SEQ ID NO: 7742201 - DNA, 23 bp, Homo sapiens
ctatggaataccaatgattctca

SEQ ID NO: 7742202 - DNA, 22 bp, Homo sapiens
ctatgagaagaaaacaagatta

SEQ ID NO: 7742203 - DNA, 22 bp, Homo sapiens
ctattaaatactcttcaaattg

SEQ ID NO: 7742204 - DNA, 22 bp, Homo sapiens
ctagcagcatcacaggaagact

SEQ ID NO: 7742205 - DNA, 22 bp, Homo sapiens
ctatatacttttcacagatgtt

SEQ ID NO: 7742206 - DNA, 21 bp, Homo sapiens
ttctctggcttctgtagctgg

SEQ ID NO: 7742207 - DNA, 22 bp, Homo sapiens
ttctctgggaacataaatgaag

SEQ ID NO: 7742208 - DNA, 22 bp, Homo sapiens
ttctctggcctgaggcgaggcc

SEQ ID NO: 7742209 - DNA, 22 bp, Homo sapiens
ttctctggcctgaggcgaggcc

SEQ ID NO: 7742210 - DNA, 22 bp, Homo sapiens
ttctctggcgcgctgtgctatg

SEQ ID NO: 7742211 - DNA, 22 bp, Homo sapiens
ttctctggcggtgtgttttcct

SEQ ID NO: 7742212 - DNA, 22 bp, Homo sapiens
ttctctggccatagctggctag

SEQ ID NO: 7742213 - DNA, 22 bp, Homo sapiens
ttctctggatgtttctcagtca

SEQ ID NO: 7742214 - DNA, 22 bp, Homo sapiens
ctcaaggaaagtctggagaaga

SEQ ID NO: 7742215 - DNA, 22 bp, Homo sapiens
ttctctggactatttgcactcc

SEQ ID NO: 7742216 - DNA, 21 bp, Homo sapiens
ttctctggataggccagtcct

SEQ ID NO: 7742217 - DNA, 20 bp, Homo sapiens
ttctctggatagccagatgt

SEQ ID NO: 7742218 - DNA, 22 bp, Homo sapiens
ttctctggagagtatcttctta

SEQ ID NO: 7742219 - DNA, 22 bp, Homo sapiens
ttctctggagggctgcccggcc

SEQ ID NO: 7742220 - DNA, 22 bp, Homo sapiens
ttccaggactgggtgtttgaag

SEQ ID NO: 7742221 - DNA, 22 bp, Homo sapiens
ttccaggactcgttctggctca

SEQ ID NO: 7742222 - DNA, 22 bp, Homo sapiens
ttccaggaggcattcttagttt

SEQ ID NO: 7742223 - DNA, 22 bp, Homo sapiens
ttccaggatgctgctgcttttt

SEQ ID NO: 7742224 - DNA, 22 bp, Homo sapiens
cgcatccagggcgcaggatctg

SEQ ID NO: 7742225 - DNA, 20 bp, Homo sapiens
ttcaagttgggtctctggct

SEQ ID NO: 7742226 - DNA, 20 bp, Homo sapiens
cgcccagtgcggttctgacc

SEQ ID NO: 7742227 - DNA, 22 bp, Homo sapiens
cgccggcttgaggcaggcggca

SEQ ID NO: 7742228 - DNA, 22 bp, Homo sapiens
ttcaagtgaggctgtctttaga

SEQ ID NO: 7742229 - DNA, 22 bp, Homo sapiens
cgcccctcagcgacccaccagc

SEQ ID NO: 7742230 - DNA, 22 bp, Homo sapiens
ttcagggactttgatgtatcag

SEQ ID NO: 7742231 - DNA, 22 bp, Homo sapiens
ttcagggacttagtgtcagttt

SEQ ID NO: 7742232 - DNA, 22 bp, Homo sapiens
ttcaggcctaatttctagcccc

SEQ ID NO: 7742233 - DNA, 22 bp, Homo sapiens
ttcagagggttttagggtcaga

SEQ ID NO: 7742234 - DNA, 22 bp, Homo sapiens
ttcagagggacattcaagggaa

SEQ ID NO: 7742235 - DNA, 22 bp, Homo sapiens
cggtcctgtacttgatgagata

SEQ ID NO: 7742236 - DNA, 22 bp, Homo sapiens
cggtcctggcacttgcggctcc

SEQ ID NO: 7742237 - DNA, 22 bp, Homo sapiens
cggtctcccgtgtgtgtgcgct

SEQ ID NO: 7742238 - DNA, 22 bp, Homo sapiens
ctaaataatccctctggtctta

SEQ ID NO: 7742239 - DNA, 22 bp, Homo sapiens
ctaaagcaactgagacacatag

SEQ ID NO: 7742240 - DNA, 22 bp, Homo sapiens
ctaaagcattctcagattttgc

SEQ ID NO: 7742241 - DNA, 22 bp, Homo sapiens
ctgttgctgggaacgcatgtca

SEQ ID NO: 7742242 - DNA, 22 bp, Homo sapiens
ctgtgtctgcctgggatccatt

SEQ ID NO: 7742243 - DNA, 22 bp, Homo sapiens
ctgtgtcttctgcttacagtct

SEQ ID NO: 7742244 - DNA, 20 bp, Homo sapiens
ctgtggctcatgcatctgcc

SEQ ID NO: 7742245 - DNA, 22 bp, Homo sapiens
ctgtggctctccaatggaggga

SEQ ID NO: 7742246 - DNA, 22 bp, Homo sapiens
ctgtggctctctgcagggtccc

SEQ ID NO: 7742247 - DNA, 22 bp, Homo sapiens
ctgtggctctcagaggctgctg

SEQ ID NO: 7742248 - DNA, 22 bp, Homo sapiens
ctgtggctctttagttgagcac

SEQ ID NO: 7742249 - DNA, 22 bp, Homo sapiens
ctgtggctgagttccttatgtt

SEQ ID NO: 7742250 - DNA, 23 bp, Homo sapiens
ctgtggctgagtcctgttggagt

SEQ ID NO: 7742251 - DNA, 19 bp, Homo sapiens
ctgtggctgacctctggcc

SEQ ID NO: 7742252 - DNA, 22 bp, Homo sapiens
ctgtggctgcgccctgggggag

SEQ ID NO: 7742253 - DNA, 22 bp, Homo sapiens
ctgtggctgcagccttggtcct

SEQ ID NO: 7742254 - DNA, 23 bp, Homo sapiens
ctgtgtctatgcagccatatcca

SEQ ID NO: 7742255 - DNA, 22 bp, Homo sapiens
ctgtggctggcctgtctgacat

SEQ ID NO: 7742256 - DNA, 22 bp, Homo sapiens
ctgtggctgcgtaggtctggca

SEQ ID NO: 7742257 - DNA, 22 bp, Homo sapiens
ctgtggctgtatttggccagag

SEQ ID NO: 7742258 - DNA, 22 bp, Homo sapiens
ctgtgccactgccctgccacgc

SEQ ID NO: 7742259 - DNA, 22 bp, Homo sapiens
ctgtgccactgccccaggcctc

SEQ ID NO: 7742260 - DNA, 22 bp, Homo sapiens
ctgtgagggccagagtcagggc

SEQ ID NO: 7742261 - DNA, 22 bp, Homo sapiens
ctgtgcccacctggctctgagg

SEQ ID NO: 7742262 - DNA, 22 bp, Homo sapiens
ctgtcctggagggcataggacg

SEQ ID NO: 7742263 - DNA, 22 bp, Homo sapiens
ctgtcctgtagctccatcagtc

SEQ ID NO: 7742264 - DNA, 22 bp, Homo sapiens
ctgtcctgcccaccctgcaggg

SEQ ID NO: 7742265 - DNA, 22 bp, Homo sapiens
ctgtccctgagcaactcctgtt

SEQ ID NO: 7742266 - DNA, 22 bp, Homo sapiens
ctgggtcttcagcagcaggcgg

SEQ ID NO: 7742267 - DNA, 22 bp, Homo sapiens
ctgggtctttttcttccattga

SEQ ID NO: 7742268 - DNA, 22 bp, Homo sapiens
ctgggtctgtgcccagggacct

SEQ ID NO: 7742269 - DNA, 22 bp, Homo sapiens
ctgggtctgtcactagataaat

SEQ ID NO: 7742270 - DNA, 19 bp, Homo sapiens
ctgggtcttattctgtgaa

SEQ ID NO: 7742271 - DNA, 22 bp, Homo sapiens
cttcaggatttaggaagatgaa

SEQ ID NO: 7742272 - DNA, 22 bp, Homo sapiens
cttcaggagtagttacctagca

SEQ ID NO: 7742273 - DNA, 22 bp, Homo sapiens
cttcaggattaatttggggcct

SEQ ID NO: 7742274 - DNA, 22 bp, Homo sapiens
cttcaggaaaatctctaaggat

SEQ ID NO: 7742275 - DNA, 22 bp, Homo sapiens
cttcctctgtgtcctgggcttc

SEQ ID NO: 7742276 - DNA, 22 bp, Homo sapiens
cttcctctgtgtcctgggcttg

SEQ ID NO: 7742277 - DNA, 22 bp, Homo sapiens
cttgcaggattttgctgctgta

SEQ ID NO: 7742278 - DNA, 22 bp, Homo sapiens
cttcctgggtctggagactgga

SEQ ID NO: 7742279 - DNA, 22 bp, Homo sapiens
ctggcccagtctcagagtgtca

SEQ ID NO: 7742280 - DNA, 22 bp, Homo sapiens
ctggcccagtctcagagtgtca

SEQ ID NO: 7742281 - DNA, 22 bp, Homo sapiens
ctggccctcagactcatgggca

SEQ ID NO: 7742282 - DNA, 22 bp, Homo sapiens
ctggccctcggagtccagctgc

SEQ ID NO: 7742283 - DNA, 22 bp, Homo sapiens
ctggccctggagggctgtgcga

SEQ ID NO: 7742284 - DNA, 22 bp, Homo sapiens
ctggccctgcctaatgtacttg

SEQ ID NO: 7742285 - DNA, 22 bp, Homo sapiens
ctggcctggtctggcctctcca

SEQ ID NO: 7742286 - DNA, 22 bp, Homo sapiens
ctggcctggtctggcctctcca

SEQ ID NO: 7742287 - DNA, 22 bp, Homo sapiens
ctggccctgtaggatgtgagtt

SEQ ID NO: 7742288 - DNA, 22 bp, Homo sapiens
ctggccctggtaaggacaccca

SEQ ID NO: 7742289 - DNA, 22 bp, Homo sapiens
ctggccctggctggagcccagg

SEQ ID NO: 7742290 - DNA, 23 bp, Homo sapiens
ctggccctggctctgtgatcatg

SEQ ID NO: 7742291 - DNA, 22 bp, Homo sapiens
ctggccctggctggagcccagg

SEQ ID NO: 7742292 - DNA, 22 bp, Homo sapiens
ctggctgccagcatttggggga

SEQ ID NO: 7742293 - DNA, 22 bp, Homo sapiens
ctggctgcctggagtgagggag

SEQ ID NO: 7742294 - DNA, 22 bp, Homo sapiens
ctggctgcctatagtctccctt

SEQ ID NO: 7742295 - DNA, 22 bp, Homo sapiens
ctggctgccacttcagggtctt

SEQ ID NO: 7742296 - DNA, 22 bp, Homo sapiens
ctggctgcattggcaagtcaat

SEQ ID NO: 7742297 - DNA, 22 bp, Homo sapiens
ctggctgcttgggacagccatg

SEQ ID NO: 7742298 - DNA, 22 bp, Homo sapiens
ctggctgctggcctgaggatgc

SEQ ID NO: 7742299 - DNA, 22 bp, Homo sapiens
ctggctgcgtctgctctgacag

SEQ ID NO: 7742300 - DNA, 22 bp, Homo sapiens
ctggctgcttgtagactcgact

SEQ ID NO: 7742301 - DNA, 22 bp, Homo sapiens
ctggctgcttgttttgatgggt

SEQ ID NO: 7742302 - DNA, 22 bp, Homo sapiens
ctggctgcaggaaggagtgggc

SEQ ID NO: 7742303 - DNA, 22 bp, Homo sapiens
ctggctgcaggatgaggctgcc

SEQ ID NO: 7742304 - DNA, 22 bp, Homo sapiens
ctggctccaaattctgatgttc

SEQ ID NO: 7742305 - DNA, 22 bp, Homo sapiens
ctggctccaaggaagaggtttt

SEQ ID NO: 7742306 - DNA, 22 bp, Homo sapiens
ctggctcatgtgatgagggcaa

SEQ ID NO: 7742307 - DNA, 22 bp, Homo sapiens
ctggccagcctgtcgatgccct

SEQ ID NO: 7742308 - DNA, 21 bp, Homo sapiens
ctggccactgcacctcttcct

SEQ ID NO: 7742309 - DNA, 22 bp, Homo sapiens
ctggccagaggttcctctgccc

SEQ ID NO: 7742310 - DNA, 22 bp, Homo sapiens
ctgcatccatgttgctgcaaag

SEQ ID NO: 7742311 - DNA, 18 bp, Homo sapiens
ctgggccagagtttctgc

SEQ ID NO: 7742312 - DNA, 22 bp, Homo sapiens
ctgggctctaggaaccattcct

SEQ ID NO: 7742313 - DNA, 22 bp, Homo sapiens
ctgggctctgcagttgatgttt

SEQ ID NO: 7742314 - DNA, 18 bp, Homo sapiens
ctgggccagagtttctgc

SEQ ID NO: 7742315 - DNA, 22 bp, Homo sapiens
ctgggctgcagcgggagcgacg

SEQ ID NO: 7742316 - DNA, 20 bp, Homo sapiens
ctggggaggaggatgtgttc

SEQ ID NO: 7742317 - DNA, 22 bp, Homo sapiens
ctggggcattgggagaggcctg

SEQ ID NO: 7742318 - DNA, 22 bp, Homo sapiens
ctggggctcactccagccctgg

SEQ ID NO: 7742319 - DNA, 22 bp, Homo sapiens
ctggggtgtgctcagagcaggg

SEQ ID NO: 7742320 - DNA, 22 bp, Homo sapiens
ctggggctgcagcgatcttcat

SEQ ID NO: 7742321 - DNA, 22 bp, Homo sapiens
ctgggtctgggcctcctggagt

SEQ ID NO: 7742322 - DNA, 22 bp, Homo sapiens
ctgggtctggtgtcaggcgacg

SEQ ID NO: 7742323 - DNA, 22 bp, Homo sapiens
ctgggtctggccacaggaagta

SEQ ID NO: 7742324 - DNA, 22 bp, Homo sapiens
ctgggtctggccacaggaagta

SEQ ID NO: 7742325 - DNA, 22 bp, Homo sapiens
ctgggtctggctactgcttcct

SEQ ID NO: 7742326 - DNA, 22 bp, Homo sapiens
ctgggtctggaggccaagggtg

SEQ ID NO: 7742327 - DNA, 22 bp, Homo sapiens
ctgggtctctttagggtgccgt

SEQ ID NO: 7742328 - DNA, 22 bp, Homo sapiens
ctgggtctccggcagcctcggg

SEQ ID NO: 7742329 - DNA, 22 bp, Homo sapiens
ctgggtctcttaccatgtgact

SEQ ID NO: 7742330 - DNA, 22 bp, Homo sapiens
ctgggcaggagaggtggttgga

SEQ ID NO: 7742331 - DNA, 22 bp, Homo sapiens
ctgggccacaaaaaactcctgt

SEQ ID NO: 7742332 - DNA, 22 bp, Homo sapiens
ctgggccaaaagaagtgttctt

SEQ ID NO: 7742333 - DNA, 22 bp, Homo sapiens
ctgggccacatcagatgaagac

SEQ ID NO: 7742334 - DNA, 22 bp, Homo sapiens
ctgggccactccagatgcccac

SEQ ID NO: 7742335 - DNA, 19 bp, Homo sapiens
ctgggccagaatcagctca

SEQ ID NO: 7742336 - DNA, 22 bp, Homo sapiens
ctgggccagaagacatttagga

SEQ ID NO: 7742337 - DNA, 22 bp, Homo sapiens
ctgggccacaagcctgtgtgat

SEQ ID NO: 7742338 - DNA, 22 bp, Homo sapiens
ctgggaggcactattcaggagg

SEQ ID NO: 7742339 - DNA, 22 bp, Homo sapiens
ctgggaggcagaggttgcagtg

SEQ ID NO: 7742340 - DNA, 22 bp, Homo sapiens
gagcagcttatgtcaagccaga

SEQ ID NO: 7742341 - DNA, 22 bp, Homo sapiens
gagcagctgcagtgcagaccct

SEQ ID NO: 7742342 - DNA, 22 bp, Homo sapiens
gagcagctggacaggcctccct

SEQ ID NO: 7742343 - DNA, 22 bp, Homo sapiens
gagcagctggaggccttgttgg

SEQ ID NO: 7742344 - DNA, 22 bp, Homo sapiens
gagcagctgtccccaaagcttc

SEQ ID NO: 7742345 - DNA, 22 bp, Homo sapiens
gagcagctggctgtattggttt

SEQ ID NO: 7742346 - DNA, 22 bp, Homo sapiens
gagcagctggtaggtgaaccca

SEQ ID NO: 7742347 - DNA, 22 bp, Homo sapiens
gagcagctgtggggttgaccat

SEQ ID NO: 7742348 - DNA, 20 bp, Homo sapiens
gagcagctgtttgcattgca

SEQ ID NO: 7742349 - DNA, 22 bp, Homo sapiens
gagcagctgttctgacttgtct

SEQ ID NO: 7742350 - DNA, 22 bp, Homo sapiens
gagccagactgcctgaagctca

SEQ ID NO: 7742351 - DNA, 22 bp, Homo sapiens
gagccaccttcaactcaggaat

SEQ ID NO: 7742352 - DNA, 22 bp, Homo sapiens
gagccagaaaagctgcctgact

SEQ ID NO: 7742353 - DNA, 22 bp, Homo sapiens
gagcagcactgagttagcagct

SEQ ID NO: 7742354 - DNA, 21 bp, Homo sapiens
gagatttagaaggatcaattt

SEQ ID NO: 7742355 - DNA, 22 bp, Homo sapiens
gagatttagctgcttaactcct

SEQ ID NO: 7742356 - DNA, 18 bp, Homo sapiens
gagcagcaggatcaagaa

SEQ ID NO: 7742357 - DNA, 22 bp, Homo sapiens
gagatggagtctttttctgtca

SEQ ID NO: 7742358 - DNA, 22 bp, Homo sapiens
gagatttaattggattaactta

SEQ ID NO: 7742359 - DNA, 22 bp, Homo sapiens
gagatgttaactacatagctac

SEQ ID NO: 7742360 - DNA, 22 bp, Homo sapiens
gagatgttattcttcagtgtgt

SEQ ID NO: 7742361 - DNA, 22 bp, Homo sapiens
gagattagagttgtttcattgt

SEQ ID NO: 7742362 - DNA, 22 bp, Homo sapiens
gagatgttttgctgagaatggg

SEQ ID NO: 7742363 - DNA, 22 bp, Homo sapiens
gagaaggaggcgaagcgtgtgc

SEQ ID NO: 7742364 - DNA, 22 bp, Homo sapiens
gagaaggagtagctgacctggg

SEQ ID NO: 7742365 - DNA, 22 bp, Homo sapiens
gagaaggagtagctgacctggg

SEQ ID NO: 7742366 - DNA, 22 bp, Homo sapiens
gacctccagcggccctgcagag

SEQ ID NO: 7742367 - DNA, 22 bp, Homo sapiens
gagaattagggcgtaattcaga

SEQ ID NO: 7742368 - DNA, 22 bp, Homo sapiens
gagaatgggaatgaaagtagca

SEQ ID NO: 7742369 - DNA, 22 bp, Homo sapiens
gagaagggggctcgagtgtcct

SEQ ID NO: 7742370 - DNA, 22 bp, Homo sapiens
gagaagggcttgggagtcaaca

SEQ ID NO: 7742371 - DNA, 22 bp, Homo sapiens
gagaagggcttgggagtcaaca

SEQ ID NO: 7742372 - DNA, 22 bp, Homo sapiens
gagaagggatatgccactctcg

SEQ ID NO: 7742373 - DNA, 22 bp, Homo sapiens
gagaagggatatggcttcttga

SEQ ID NO: 7742374 - DNA, 22 bp, Homo sapiens
gagaagggatatggcttcttga

SEQ ID NO: 7742375 - DNA, 22 bp, Homo sapiens
gagaggccctgtggtcccagct

SEQ ID NO: 7742376 - DNA, 22 bp, Homo sapiens
gagaggccctgaagcccacaga

SEQ ID NO: 7742377 - DNA, 19 bp, Homo sapiens
gagaggcctgtgcttgaag

SEQ ID NO: 7742378 - DNA, 22 bp, Homo sapiens
gagacacaaacacatttagagg

SEQ ID NO: 7742379 - DNA, 22 bp, Homo sapiens
gagaggctgtgtgccattgttg

SEQ ID NO: 7742380 - DNA, 22 bp, Homo sapiens
gagagggagccagccaggaacc

SEQ ID NO: 7742381 - DNA, 22 bp, Homo sapiens
gagatgaatgtaaacaaaggca

SEQ ID NO: 7742382 - DNA, 22 bp, Homo sapiens
gagatgagtgggggatctctca

SEQ ID NO: 7742383 - DNA, 22 bp, Homo sapiens
gaggagcctggccccacatcca

SEQ ID NO: 7742384 - DNA, 22 bp, Homo sapiens
gaggagccctgttccccaggcc

SEQ ID NO: 7742385 - DNA, 19 bp, Homo sapiens
gaggagctatcggagacag

SEQ ID NO: 7742386 - DNA, 22 bp, Homo sapiens
gaggagcttcagaggaatctta

SEQ ID NO: 7742387 - DNA, 22 bp, Homo sapiens
gaggaggaaaggagttgaaatg

SEQ ID NO: 7742388 - DNA, 22 bp, Homo sapiens
gaggaggaggaagtggaaccca

SEQ ID NO: 7742389 - DNA, 22 bp, Homo sapiens
gaggaggaggaagtggaaccca

SEQ ID NO: 7742390 - DNA, 22 bp, Homo sapiens
gaggaggagtatatattagaat

SEQ ID NO: 7742391 - DNA, 22 bp, Homo sapiens
gaggcaaggccgcacgtctcag

SEQ ID NO: 7742392 - DNA, 22 bp, Homo sapiens
gaggcaagagaagccagctttc

SEQ ID NO: 7742393 - DNA, 22 bp, Homo sapiens
gaggccaggacatgaaagctga

SEQ ID NO: 7742394 - DNA, 22 bp, Homo sapiens
gaggcacatcacttggtgcatt

SEQ ID NO: 7742395 - DNA, 22 bp, Homo sapiens
gaggcagaagttgcagtgagca

SEQ ID NO: 7742396 - DNA, 22 bp, Homo sapiens
gagctctgtgtagcctgagggt

SEQ ID NO: 7742397 - DNA, 22 bp, Homo sapiens
gagcttggaagcagatcctcac

SEQ ID NO: 7742398 - DNA, 22 bp, Homo sapiens
gagcttggatgtcttttgttca

SEQ ID NO: 7742399 - DNA, 22 bp, Homo sapiens
gagcttggacaccttggcaggt

SEQ ID NO: 7742400 - DNA, 22 bp, Homo sapiens
gagcttggacaagctctgaagg

SEQ ID NO: 7742401 - DNA, 22 bp, Homo sapiens
gagcttggcagtgtcactaggg

SEQ ID NO: 7742402 - DNA, 22 bp, Homo sapiens
gagcttggcctcttgaacgtgg

SEQ ID NO: 7742403 - DNA, 22 bp, Homo sapiens
gagctgaatcagagatattatt

SEQ ID NO: 7742404 - DNA, 18 bp, Homo sapiens
gagctgagaagaggatgc

SEQ ID NO: 7742405 - DNA, 22 bp, Homo sapiens
gagctgaattgaagcaaggagc

SEQ ID NO: 7742406 - DNA, 22 bp, Homo sapiens
gagctgaacatcatggaaaggc

SEQ ID NO: 7742407 - DNA, 22 bp, Homo sapiens
gaagaggactgtggcatcctag

SEQ ID NO: 7742408 - DNA, 22 bp, Homo sapiens
gaagaggatgacaggagccggt

SEQ ID NO: 7742409 - DNA, 22 bp, Homo sapiens
gaagatttgaaacacatagaca

SEQ ID NO: 7742410 - DNA, 22 bp, Homo sapiens
gaagattaaacatatttagtgt

SEQ ID NO: 7742411 - DNA, 22 bp, Homo sapiens
gaagatttctttatgaaagatg

SEQ ID NO: 7742412 - DNA, 22 bp, Homo sapiens
gaagatttcagttaagtatcta

SEQ ID NO: 7742413 - DNA, 22 bp, Homo sapiens
gaaatatttctcttgagcccct

SEQ ID NO: 7742414 - DNA, 22 bp, Homo sapiens
gaaatcaatttcttggttgata

SEQ ID NO: 7742415 - DNA, 22 bp, Homo sapiens
gaaatcaaggctacattcaggt

SEQ ID NO: 7742416 - DNA, 22 bp, Homo sapiens
gaacagctctgaagcagtaaat

SEQ ID NO: 7742417 - DNA, 22 bp, Homo sapiens
gaacagctataatcatctgtcc

SEQ ID NO: 7742418 - DNA, 22 bp, Homo sapiens
gaacagctgctagagatctgtg

SEQ ID NO: 7742419 - DNA, 22 bp, Homo sapiens
gaacagcttcttgggagctggg

SEQ ID NO: 7742420 - DNA, 22 bp, Homo sapiens
gaacagggttgggtgagagagg

SEQ ID NO: 7742421 - DNA, 22 bp, Homo sapiens
gaacagcagctcgttctcgatg

SEQ ID NO: 7742422 - DNA, 22 bp, Homo sapiens
gacaggccaggggctgaggtgg

SEQ ID NO: 7742423 - DNA, 22 bp, Homo sapiens
gaatacatggcagggagtcatc

SEQ ID NO: 7742424 - DNA, 22 bp, Homo sapiens
gaatatattattcagcttttca

SEQ ID NO: 7742425 - DNA, 22 bp, Homo sapiens
gaatatatttctcttaccttta

SEQ ID NO: 7742426 - DNA, 22 bp, Homo sapiens
gaatacaagccaggcacaaggc

SEQ ID NO: 7742427 - DNA, 22 bp, Homo sapiens
gaagttcttagtctcatttgca

SEQ ID NO: 7742428 - DNA, 22 bp, Homo sapiens
gaagttctggtgtatgtgataa

SEQ ID NO: 7742429 - DNA, 22 bp, Homo sapiens
gaagttctttatagcagtgtga

SEQ ID NO: 7742430 - DNA, 23 bp, Homo sapiens
gaagttctttcttctcatgctgt

SEQ ID NO: 7742431 - DNA, 22 bp, Homo sapiens
gaagttctttgctccccagtac

SEQ ID NO: 7742432 - DNA, 22 bp, Homo sapiens
gaaggaagactggtttaaatgt

SEQ ID NO: 7742433 - DNA, 20 bp, Homo sapiens
ggcatgggtggggctcccag

SEQ ID NO: 7742434 - DNA, 22 bp, Homo sapiens
ggccacagaacagctacaggac

SEQ ID NO: 7742435 - DNA, 22 bp, Homo sapiens
ggccacactctggtagaggtga

SEQ ID NO: 7742436 - DNA, 22 bp, Homo sapiens
ggccacaacttgctcctagccc

SEQ ID NO: 7742437 - DNA, 22 bp, Homo sapiens
ggccacacagatgactgctttc

SEQ ID NO: 7742438 - DNA, 22 bp, Homo sapiens
ggcaggtggaagttggcagagc

SEQ ID NO: 7742439 - DNA, 22 bp, Homo sapiens
ggcaggtggacgtgctaaagct

SEQ ID NO: 7742440 - DNA, 22 bp, Homo sapiens
ggcaggtggcactgctgctccc

SEQ ID NO: 7742441 - DNA, 22 bp, Homo sapiens
ggcaggtggccaagtgtctaag

SEQ ID NO: 7742442 - DNA, 21 bp, Homo sapiens
ggcaggtgggtctctgttgct

SEQ ID NO: 7742443 - DNA, 22 bp, Homo sapiens
ggcatggggtgtatgtggcacg

SEQ ID NO: 7742444 - DNA, 22 bp, Homo sapiens
ggcatgggccgaggtgcctcct

SEQ ID NO: 7742445 - DNA, 22 bp, Homo sapiens
ggcatggcctgtaagacggaga

SEQ ID NO: 7742446 - DNA, 21 bp, Homo sapiens
ggcctcagccacctggctctg

SEQ ID NO: 7742447 - DNA, 18 bp, Homo sapiens
ggcctcagcctggccgga

SEQ ID NO: 7742448 - DNA, 22 bp, Homo sapiens
ggcctcttatctggctcctgca

SEQ ID NO: 7742449 - DNA, 22 bp, Homo sapiens
ggcctctggttcgtggtgacct

SEQ ID NO: 7742450 - DNA, 22 bp, Homo sapiens
ggcctcagtttctccatgggtt

SEQ ID NO: 7742451 - DNA, 22 bp, Homo sapiens
ggcctcagtttcttcaactgta

SEQ ID NO: 7742452 - DNA, 22 bp, Homo sapiens
ggccttgggtataggtgggtat

SEQ ID NO: 7742453 - DNA, 22 bp, Homo sapiens
ggcacagccctctctgtggaca

SEQ ID NO: 7742454 - DNA, 22 bp, Homo sapiens
ggcacagccactttggagaact

SEQ ID NO: 7742455 - DNA, 22 bp, Homo sapiens
ggcacagcaggagctatgtgaa

SEQ ID NO: 7742456 - DNA, 22 bp, Homo sapiens
ggcacagcgactaccatcgaaa

SEQ ID NO: 7742457 - DNA, 21 bp, Homo sapiens
ggcacagcctgaaatgcctca

SEQ ID NO: 7742458 - DNA, 22 bp, Homo sapiens
ggcacagctacttgctcactct

SEQ ID NO: 7742459 - DNA, 22 bp, Homo sapiens
ggcacagctgatgcagacacac

SEQ ID NO: 7742460 - DNA, 22 bp, Homo sapiens
ggcacagctcaggtcccagctc

SEQ ID NO: 7742461 - DNA, 20 bp, Homo sapiens
ggcagagggcctgggagaag

SEQ ID NO: 7742462 - DNA, 22 bp, Homo sapiens
ggcaggaggaagagttagcacc

SEQ ID NO: 7742463 - DNA, 22 bp, Homo sapiens
ggcaggagggcggacaatgacc

SEQ ID NO: 7742464 - DNA, 22 bp, Homo sapiens
ggcaggaggtgagtggcgggtg

SEQ ID NO: 7742465 - DNA, 22 bp, Homo sapiens
ggcaaagcggccctgtggccag

SEQ ID NO: 7742466 - DNA, 22 bp, Homo sapiens
ggcaaagccttccagctgttac

SEQ ID NO: 7742467 - DNA, 22 bp, Homo sapiens
ggcaaagccctgcctggttcaa

SEQ ID NO: 7742468 - DNA, 19 bp, Homo sapiens
ggagtctgagcccaggtat

SEQ ID NO: 7742469 - DNA, 22 bp, Homo sapiens
ggagtctgagtcctcatagaca

SEQ ID NO: 7742470 - DNA, 22 bp, Homo sapiens
ggagtctgagcttgtgtcctgg

SEQ ID NO: 7742471 - DNA, 22 bp, Homo sapiens
ggagtctgatactgagttcctc

SEQ ID NO: 7742472 - DNA, 22 bp, Homo sapiens
ggagtctgattttttatgggtg

SEQ ID NO: 7742473 - DNA, 22 bp, Homo sapiens
ggagtctgactctgaccctgga

SEQ ID NO: 7742474 - DNA, 22 bp, Homo sapiens
gggagacccccaatgccaggtc

SEQ ID NO: 7742475 - DNA, 22 bp, Homo sapiens
gggagacaaggagaaccaaaga

SEQ ID NO: 7742476 - DNA, 22 bp, Homo sapiens
gggagacacgctgcaggcataa

SEQ ID NO: 7742477 - DNA, 22 bp, Homo sapiens
gggagacacgctgcaggcataa

SEQ ID NO: 7742478 - DNA, 22 bp, Homo sapiens
gggagagcgcgctagggccgag

SEQ ID NO: 7742479 - DNA, 19 bp, Homo sapiens
gggagagccaggctcaccc

SEQ ID NO: 7742480 - DNA, 18 bp, Homo sapiens
gggagctgggaagctggt

SEQ ID NO: 7742481 - DNA, 17 bp, Homo sapiens
gggagatgaagggatat

SEQ ID NO: 7742482 - DNA, 22 bp, Homo sapiens
gggagaggttacccgagcaact

SEQ ID NO: 7742483 - DNA, 22 bp, Homo sapiens
gggagaggttacccgagcaact

SEQ ID NO: 7742484 - DNA, 22 bp, Homo sapiens
ggcttcttaatcatgagagtga

SEQ ID NO: 7742485 - DNA, 23 bp, Homo sapiens
gggagaatatgaggatgatggtg

SEQ ID NO: 7742486 - DNA, 19 bp, Homo sapiens
gggcacagcctccccccag

SEQ ID NO: 7742487 - DNA, 22 bp, Homo sapiens
gggcacagcctaactatggaga

SEQ ID NO: 7742488 - DNA, 22 bp, Homo sapiens
gggcacagcccagtggggtccc

SEQ ID NO: 7742489 - DNA, 22 bp, Homo sapiens
gggatggggtcgggaccctgct

SEQ ID NO: 7742490 - DNA, 22 bp, Homo sapiens
gggatggggtcgggaccctgct

SEQ ID NO: 7742491 - DNA, 22 bp, Homo sapiens
gggatggggagctggaaagggg

SEQ ID NO: 7742492 - DNA, 22 bp, Homo sapiens
gggcacaggaatttgggatgtg

SEQ ID NO: 7742493 - DNA, 22 bp, Homo sapiens
gggcacagctgctacccagtgc

SEQ ID NO: 7742494 - DNA, 22 bp, Homo sapiens
gggcagctgtatctgagcttat

SEQ ID NO: 7742495 - DNA, 22 bp, Homo sapiens
gggcatgcctgcgcagtgcatg

SEQ ID NO: 7742496 - DNA, 22 bp, Homo sapiens
gggcaggagagggccacctgga

SEQ ID NO: 7742497 - DNA, 20 bp, Homo sapiens
ggctgaaagtagaaagtatt

SEQ ID NO: 7742498 - DNA, 22 bp, Homo sapiens
ggctgaaaggtgggaggatggc

SEQ ID NO: 7742499 - DNA, 22 bp, Homo sapiens
ggctctggcgtccaatggagcg

SEQ ID NO: 7742500 - DNA, 22 bp, Homo sapiens
ggctctggctactccaccctgt

SEQ ID NO: 7742501 - DNA, 22 bp, Homo sapiens
ggctctgggaaatggtcttcct

SEQ ID NO: 7742502 - DNA, 22 bp, Homo sapiens
ggctctgggcatagaaggaagc

SEQ ID NO: 7742503 - DNA, 22 bp, Homo sapiens
ggctctggcaaggggaggctac

SEQ ID NO: 7742504 - DNA, 22 bp, Homo sapiens
ggctctggagcacagacgtctg

SEQ ID NO: 7742505 - DNA, 22 bp, Homo sapiens
ggctctggagatgtccgacctg

SEQ ID NO: 7742506 - DNA, 22 bp, Homo sapiens
ggctctggagacatgtggagag

SEQ ID NO: 7742507 - DNA, 22 bp, Homo sapiens
ggctccagccctggctcttcac

SEQ ID NO: 7742508 - DNA, 22 bp, Homo sapiens
ggctccagatgtctcctggcaa

SEQ ID NO: 7742509 - DNA, 22 bp, Homo sapiens
ggctgctgacaaacatgatcat

SEQ ID NO: 7742510 - DNA, 19 bp, Homo sapiens
ggctgctgaagagaattac

SEQ ID NO: 7742511 - DNA, 22 bp, Homo sapiens
ggctgctgaagtgtggcaatct

SEQ ID NO: 7742512 - DNA, 19 bp, Homo sapiens
gggctttactccaagtggg

SEQ ID NO: 7742513 - DNA, 18 bp, Homo sapiens
gggctttacagagtggag

SEQ ID NO: 7742514 - DNA, 22 bp, Homo sapiens
gggctttaatcttgttaactag

SEQ ID NO: 7742515 - DNA, 22 bp, Homo sapiens
gggctttaacacccagtcaggg

SEQ ID NO: 7742516 - DNA, 22 bp, Homo sapiens
ggggaagaatggcagaaaacat

SEQ ID NO: 7742517 - DNA, 22 bp, Homo sapiens
gggctttaggggccagtgacca

SEQ ID NO: 7742518 - DNA, 22 bp, Homo sapiens
gggctttagattgcagaggatt

SEQ ID NO: 7742519 - DNA, 22 bp, Homo sapiens
gggctttatgagattgagatct

SEQ ID NO: 7742520 - DNA, 17 bp, Homo sapiens
gggctttaggtggtgta

SEQ ID NO: 7742521 - DNA, 22 bp, Homo sapiens
ggggaagaggcgtgatggatcc

SEQ ID NO: 7742522 - DNA, 22 bp, Homo sapiens
ggggtgggcgtgcagggacacc

SEQ ID NO: 7742523 - DNA, 22 bp, Homo sapiens
ggggtgggcgtgcagggacacc

SEQ ID NO: 7742524 - DNA, 22 bp, Homo sapiens
ggggtggggttactcattgtgc

SEQ ID NO: 7742525 - DNA, 22 bp, Homo sapiens
gggtaggagaggtgtctgtgtg

SEQ ID NO: 7742526 - DNA, 22 bp, Homo sapiens
gggccacacagaacctcctggt

SEQ ID NO: 7742527 - DNA, 22 bp, Homo sapiens
gggctgatgatgagcagaggtg

SEQ ID NO: 7742528 - DNA, 22 bp, Homo sapiens
gggctgatcgcttgagctcagg

SEQ ID NO: 7742529 - DNA, 22 bp, Homo sapiens
gggctgctacgagaactgaata

SEQ ID NO: 7742530 - DNA, 22 bp, Homo sapiens
gggcttcttgccatggggacgg

SEQ ID NO: 7742531 - DNA, 22 bp, Homo sapiens
ggtctctggccttggagattga

SEQ ID NO: 7742532 - DNA, 22 bp, Homo sapiens
ggtctctgctcagatgccactt

SEQ ID NO: 7742533 - DNA, 22 bp, Homo sapiens
ggtctccattccttcatctcac

SEQ ID NO: 7742534 - DNA, 22 bp, Homo sapiens
ggtcagcagtgcagggcagagc

SEQ ID NO: 7742535 - DNA, 18 bp, Homo sapiens
ggtcctgggcctggctca

SEQ ID NO: 7742536 - DNA, 22 bp, Homo sapiens
ggtcctgtctgacatcactgct

SEQ ID NO: 7742537 - DNA, 22 bp, Homo sapiens
ggtccttgggtctcctgtgttt

SEQ ID NO: 7742538 - DNA, 22 bp, Homo sapiens
ggtcacccatgatcacatcacc

SEQ ID NO: 7742539 - DNA, 22 bp, Homo sapiens
ggtgttgcagttgaagactggt

SEQ ID NO: 7742540 - DNA, 22 bp, Homo sapiens
ggtctctgttgcctccatcaag

SEQ ID NO: 7742541 - DNA, 22 bp, Homo sapiens
ggtctggcaggtgaggactcag

SEQ ID NO: 7742542 - DNA, 22 bp, Homo sapiens
ggtctggccaatagacagcccc

SEQ ID NO: 7742543 - DNA, 22 bp, Homo sapiens
ggtctggcactcatgcagcagg

SEQ ID NO: 7742544 - DNA, 22 bp, Homo sapiens
ggtctggcctcgggcaccccca

SEQ ID NO: 7742545 - DNA, 22 bp, Homo sapiens
gtcctggggaatacagaagccg

SEQ ID NO: 7742546 - DNA, 22 bp, Homo sapiens
gtcctggggatacagaagtgaa

SEQ ID NO: 7742547 - DNA, 22 bp, Homo sapiens
gtcctgggggcagctgtgtcca

SEQ ID NO: 7742548 - DNA, 22 bp, Homo sapiens
gtctgctgttcagagatgttgc

SEQ ID NO: 7742549 - DNA, 22 bp, Homo sapiens
gtctggaggcactttctcatga

SEQ ID NO: 7742550 - DNA, 22 bp, Homo sapiens
gtctggaggcccgtcagcccta

SEQ ID NO: 7742551 - DNA, 22 bp, Homo sapiens
gtgaaggaccaatatgactcat

SEQ ID NO: 7742552 - DNA, 22 bp, Homo sapiens
gtgaaggaggggccacagatat

SEQ ID NO: 7742553 - DNA, 22 bp, Homo sapiens
gtgaaggactgaatgaaaatgt

SEQ ID NO: 7742554 - DNA, 22 bp, Homo sapiens
gtgaccataatagattatgagt

SEQ ID NO: 7742555 - DNA, 22 bp, Homo sapiens
gtgaaggataaggatctaaatt

SEQ ID NO: 7742556 - DNA, 22 bp, Homo sapiens
gtgaccatttgacatatccttg

SEQ ID NO: 7742557 - DNA, 22 bp, Homo sapiens
gtctggagggaagagatgtcag

SEQ ID NO: 7742558 - DNA, 18 bp, Homo sapiens
gtctggaggtcaggagct

SEQ ID NO: 7742559 - DNA, 17 bp, Homo sapiens
gtctggagtggccttca

SEQ ID NO: 7742560 - DNA, 22 bp, Homo sapiens
gtctggagtggggcctgagaat

SEQ ID NO: 7742561 - DNA, 22 bp, Homo sapiens
gtgaaattgtatttggcattga

SEQ ID NO: 7742562 - DNA, 23 bp, Homo sapiens
gtgcacagtcaagcccagcttag

SEQ ID NO: 7742563 - DNA, 22 bp, Homo sapiens
gtgcacagaaattggtaagact

SEQ ID NO: 7742564 - DNA, 22 bp, Homo sapiens
gtgcacagagcccagggccgcg

SEQ ID NO: 7742565 - DNA, 22 bp, Homo sapiens
gtgcacagattcagaggttttg

SEQ ID NO: 7742566 - DNA, 22 bp, Homo sapiens
gtgactgtaattaccttagcaa

SEQ ID NO: 7742567 - DNA, 22 bp, Homo sapiens
gtgactgtttttaggaggagta

SEQ ID NO: 7742568 - DNA, 22 bp, Homo sapiens
gtgagcaggataggggctccct

SEQ ID NO: 7742569 - DNA, 22 bp, Homo sapiens
gtgagcaggataggggctccct

SEQ ID NO: 7742570 - DNA, 23 bp, Homo sapiens
gtgagcagcccactaggaatgcc

SEQ ID NO: 7742571 - DNA, 22 bp, Homo sapiens
gtgcagtgaccctggagagctg

SEQ ID NO: 7742572 - DNA, 22 bp, Homo sapiens
gtcatttttcactgcatataga

SEQ ID NO: 7742573 - DNA, 20 bp, Homo sapiens
gtcctgggagccacagcaca

SEQ ID NO: 7742574 - DNA, 17 bp, Homo sapiens
gtcctgggaggagagag

SEQ ID NO: 7742575 - DNA, 17 bp, Homo sapiens
gtcctgggaggagagag

SEQ ID NO: 7742576 - DNA, 22 bp, Homo sapiens
gtcctgggaggggctggtcctg

SEQ ID NO: 7742577 - DNA, 22 bp, Homo sapiens
gtcctgggagatgggaccctga

SEQ ID NO: 7742578 - DNA, 22 bp, Homo sapiens
gtcctgggaactggacagctaa

SEQ ID NO: 7742579 - DNA, 22 bp, Homo sapiens
gtcctgggaactggacagctaa

SEQ ID NO: 7742580 - DNA, 22 bp, Homo sapiens
gtccctctcaaatttatatgct

SEQ ID NO: 7742581 - DNA, 22 bp, Homo sapiens
gtccctctgtgtccctgcagtc

SEQ ID NO: 7742582 - DNA, 22 bp, Homo sapiens
gtccctctgctctagagagcca

SEQ ID NO: 7742583 - DNA, 22 bp, Homo sapiens
gtccctctgggccatcaggtcc

SEQ ID NO: 7742584 - DNA, 22 bp, Homo sapiens
gtccctctgcctgtggttctct

SEQ ID NO: 7742585 - DNA, 22 bp, Homo sapiens
gtacatttcatttaaatgatgt

SEQ ID NO: 7742586 - DNA, 22 bp, Homo sapiens
ggttttctccccctcttctcag

SEQ ID NO: 7742587 - DNA, 22 bp, Homo sapiens
ggtttcagccctgctgttcctg

SEQ ID NO: 7742588 - DNA, 22 bp, Homo sapiens
gtagaattacctctctatgtcc

SEQ ID NO: 7742589 - DNA, 22 bp, Homo sapiens
gtagaattttaataatggagat

SEQ ID NO: 7742590 - DNA, 22 bp, Homo sapiens
gcccagctgcaccctggtgggt

SEQ ID NO: 7742591 - DNA, 22 bp, Homo sapiens
gcccagctgagaagcgcggggc

SEQ ID NO: 7742592 - DNA, 22 bp, Homo sapiens
gccagggttcgaatccgtatgg

SEQ ID NO: 7742593 - DNA, 22 bp, Homo sapiens
gcccagctttttgaggcaggca

SEQ ID NO: 7742594 - DNA, 22 bp, Homo sapiens
gcccagctgtctggcagggatg

SEQ ID NO: 7742595 - DNA, 22 bp, Homo sapiens
gccctgtgtgtttgcactgatt

SEQ ID NO: 7742596 - DNA, 22 bp, Homo sapiens
gccctgggcaaggttctggcca

SEQ ID NO: 7742597 - DNA, 22 bp, Homo sapiens
gccctgggattgggtggaggct

SEQ ID NO: 7742598 - DNA, 22 bp, Homo sapiens
gccctgtgcgctgagttcaggg

SEQ ID NO: 7742599 - DNA, 22 bp, Homo sapiens
gccctgtggacagtgagaagtg

SEQ ID NO: 7742600 - DNA, 22 bp, Homo sapiens
gccagggcaggggagcatctgc

SEQ ID NO: 7742601 - DNA, 22 bp, Homo sapiens
gccaccccataggtgttaggtg

SEQ ID NO: 7742602 - DNA, 22 bp, Homo sapiens
gccacccccaagtaggtggtct

SEQ ID NO: 7742603 - DNA, 22 bp, Homo sapiens
gccaccccaacctccctaagtt

SEQ ID NO: 7742604 - DNA, 22 bp, Homo sapiens
gccaccatgtagcccattagag

SEQ ID NO: 7742605 - DNA, 21 bp, Homo sapiens
gccacccctggcacaggtgct

SEQ ID NO: 7742606 - DNA, 21 bp, Homo sapiens
gccagcctgtttacctgtggt

SEQ ID NO: 7742607 - DNA, 22 bp, Homo sapiens
gccagcctgtgcttggccaggc

SEQ ID NO: 7742608 - DNA, 22 bp, Homo sapiens
gccagctgaagggaagctcctg

SEQ ID NO: 7742609 - DNA, 22 bp, Homo sapiens
gccagctcagatgcaggaagga

SEQ ID NO: 7742610 - DNA, 23 bp, Homo sapiens
gccagccttgctctcctgcagcc

SEQ ID NO: 7742611 - DNA, 22 bp, Homo sapiens
gcagtgggaaggttggcacatg

SEQ ID NO: 7742612 - DNA, 22 bp, Homo sapiens
gcaggggagtggatgatggatt

SEQ ID NO: 7742613 - DNA, 22 bp, Homo sapiens
gccacattagccctcaccatct

SEQ ID NO: 7742614 - DNA, 22 bp, Homo sapiens
gcatggccttgctgtagtggta

SEQ ID NO: 7742615 - DNA, 22 bp, Homo sapiens
gcatggccttgtgctccttctc

SEQ ID NO: 7742616 - DNA, 22 bp, Homo sapiens
gcatggccttcagggacagctg

SEQ ID NO: 7742617 - DNA, 22 bp, Homo sapiens
gcatggcctccagccaacagca

SEQ ID NO: 7742618 - DNA, 22 bp, Homo sapiens
gcatggcctctgtgcttgttgc

SEQ ID NO: 7742619 - DNA, 22 bp, Homo sapiens
gcatggccaggaaaggtagaaa

SEQ ID NO: 7742620 - DNA, 22 bp, Homo sapiens
gcatggccaggaaaggtagaaa

SEQ ID NO: 7742621 - DNA, 22 bp, Homo sapiens
gcatggccatggcactatggac

SEQ ID NO: 7742622 - DNA, 21 bp, Homo sapiens
gcagatgggaagagacgaggc

SEQ ID NO: 7742623 - DNA, 22 bp, Homo sapiens
gcaggaagggaaaggttgactc

SEQ ID NO: 7742624 - DNA, 20 bp, Homo sapiens
gcagcctcaacaggcacagc

SEQ ID NO: 7742625 - DNA, 22 bp, Homo sapiens
gcagggctttttgaaacatggt

SEQ ID NO: 7742626 - DNA, 22 bp, Homo sapiens
gcagggacagggcagggccttt

SEQ ID NO: 7742627 - DNA, 22 bp, Homo sapiens
gcagggacatctttgtctagta

SEQ ID NO: 7742628 - DNA, 22 bp, Homo sapiens
gcagggaagacccggagcagcg

SEQ ID NO: 7742629 - DNA, 21 bp, Homo sapiens
gcagggacaaagcttcaggag

SEQ ID NO: 7742630 - DNA, 22 bp, Homo sapiens
gcagaggcagggccctcctcca

SEQ ID NO: 7742631 - DNA, 21 bp, Homo sapiens
gcagaggcacggcaccaaggg

SEQ ID NO: 7742632 - DNA, 22 bp, Homo sapiens
gcagaggcacagccccagatga

SEQ ID NO: 7742633 - DNA, 22 bp, Homo sapiens
gcagaggtctagcaccaagaat

SEQ ID NO: 7742634 - DNA, 22 bp, Homo sapiens
gcagaggtctcttcaaaataat

SEQ ID NO: 7742635 - DNA, 22 bp, Homo sapiens
gcagaggcatttctgacgctgc

SEQ ID NO: 7742636 - DNA, 22 bp, Homo sapiens
gcagaggccaggccaccagcaa

SEQ ID NO: 7742637 - DNA, 22 bp, Homo sapiens
gcagactgcgagcgtgctggtg

SEQ ID NO: 7742638 - DNA, 18 bp, Homo sapiens
gcagagcagaagctcaag

SEQ ID NO: 7742639 - DNA, 22 bp, Homo sapiens
gcacagtgtaccacagtcccta

SEQ ID NO: 7742640 - DNA, 22 bp, Homo sapiens
gcaaatcaccacctagctggat

SEQ ID NO: 7742641 - DNA, 22 bp, Homo sapiens
gcacagaaatgtctacacatgt

SEQ ID NO: 7742642 - DNA, 22 bp, Homo sapiens
gcacagaacactggtgagtccc

SEQ ID NO: 7742643 - DNA, 22 bp, Homo sapiens
gcacagaacagagaaatagcca

SEQ ID NO: 7742644 - DNA, 22 bp, Homo sapiens
gcaaagcattctgtggagtcta

SEQ ID NO: 7742645 - DNA, 22 bp, Homo sapiens
gcaaagcatcagtagaaatgtt

SEQ ID NO: 7742646 - DNA, 22 bp, Homo sapiens
gcaaagcatcagtagaaatgtt

SEQ ID NO: 7742647 - DNA, 22 bp, Homo sapiens
gcaaagcagaaccctctctatc

SEQ ID NO: 7742648 - DNA, 22 bp, Homo sapiens
gcaaagcacactggagatgtcg

SEQ ID NO: 7742649 - DNA, 22 bp, Homo sapiens
gcaaagcagtcttctgtgccta

SEQ ID NO: 7742650 - DNA, 22 bp, Homo sapiens
gcaaagcaagattcagatgtag

SEQ ID NO: 7742651 - DNA, 22 bp, Homo sapiens
gcaaagcaagctgtcagcctca

SEQ ID NO: 7742652 - DNA, 22 bp, Homo sapiens
gcaaagcaagattcagatgtag

SEQ ID NO: 7742653 - DNA, 22 bp, Homo sapiens
gcaaagcaaatgcctgaaggcg

SEQ ID NO: 7742654 - DNA, 22 bp, Homo sapiens
gcaaagcaagctgtcagcctca

SEQ ID NO: 7742655 - DNA, 22 bp, Homo sapiens
gcaaagcacaccctcagagttt

SEQ ID NO: 7742656 - DNA, 22 bp, Homo sapiens
gcaaagcaatcaggagtagcat

SEQ ID NO: 7742657 - DNA, 22 bp, Homo sapiens
gcaaagatattagaatagagta

SEQ ID NO: 7742658 - DNA, 22 bp, Homo sapiens
gaggcccagagaggttgcatga

SEQ ID NO: 7742659 - DNA, 20 bp, Homo sapiens
gaggcccagagaggtgaagc

SEQ ID NO: 7742660 - DNA, 22 bp, Homo sapiens
gctgcctgtggcccttctgggt

SEQ ID NO: 7742661 - DNA, 22 bp, Homo sapiens
gctgctgtctggtctgagggct

SEQ ID NO: 7742662 - DNA, 22 bp, Homo sapiens
gctcctctattccccacatttt

SEQ ID NO: 7742663 - DNA, 22 bp, Homo sapiens
gctctggctagttacctcttac

SEQ ID NO: 7742664 - DNA, 22 bp, Homo sapiens
gctcctctcccagagctgcagg

SEQ ID NO: 7742665 - DNA, 22 bp, Homo sapiens
gctctgggaagtcctttaccat

SEQ ID NO: 7742666 - DNA, 22 bp, Homo sapiens
gctctgggaactgactgccttc

SEQ ID NO: 7742667 - DNA, 22 bp, Homo sapiens
gctctgggaaggatcgtagtga

SEQ ID NO: 7742668 - DNA, 18 bp, Homo sapiens
gctctggctcacctccag

SEQ ID NO: 7742669 - DNA, 18 bp, Homo sapiens
gctctggctcacctccag

SEQ ID NO: 7742670 - DNA, 22 bp, Homo sapiens
gctctggctcaaaccaccggct

SEQ ID NO: 7742671 - DNA, 22 bp, Homo sapiens
gctctggctcaaaccaccggct

SEQ ID NO: 7742672 - DNA, 22 bp, Homo sapiens
gctctggcttggggcactcgtc

SEQ ID NO: 7742673 - DNA, 22 bp, Homo sapiens
gctctgggctgaatcatttatc

SEQ ID NO: 7742674 - DNA, 22 bp, Homo sapiens
gctctgggctgccctctggaca

SEQ ID NO: 7742675 - DNA, 22 bp, Homo sapiens
gctctggggcccagggatcaca

SEQ ID NO: 7742676 - DNA, 22 bp, Homo sapiens
gctctggggatgcttctgccgt

SEQ ID NO: 7742677 - DNA, 22 bp, Homo sapiens
gctctgggattaccagccttag

SEQ ID NO: 7742678 - DNA, 20 bp, Homo sapiens
gctctgggagggatgtgatg

SEQ ID NO: 7742679 - DNA, 22 bp, Homo sapiens
gctctgggaattcagaaagcct

SEQ ID NO: 7742680 - DNA, 22 bp, Homo sapiens
gctctgggccatcctggccggg

SEQ ID NO: 7742681 - DNA, 22 bp, Homo sapiens
gctctgggccgggcaccagcct

SEQ ID NO: 7742682 - DNA, 22 bp, Homo sapiens
gctgaggctcaagtcatgggtc

SEQ ID NO: 7742683 - DNA, 22 bp, Homo sapiens
gctgaggcggaaggattgctag

SEQ ID NO: 7742684 - DNA, 22 bp, Homo sapiens
gctgaggcctcagaaggctgag

SEQ ID NO: 7742685 - DNA, 22 bp, Homo sapiens
gctgaggcctcagaaggctgag

SEQ ID NO: 7742686 - DNA, 22 bp, Homo sapiens
gctgaggccagtttaatgagga

SEQ ID NO: 7742687 - DNA, 22 bp, Homo sapiens
gctgaggccaggccccaccgga

SEQ ID NO: 7742688 - DNA, 22 bp, Homo sapiens
gctgaggccaggccccaccgga

SEQ ID NO: 7742689 - DNA, 22 bp, Homo sapiens
gctgaggccccagggtgatggg

SEQ ID NO: 7742690 - DNA, 22 bp, Homo sapiens
gctgaggctcaatccccttctg

SEQ ID NO: 7742691 - DNA, 22 bp, Homo sapiens
gctgaggctcaagtcatgggtc

SEQ ID NO: 7742692 - DNA, 22 bp, Homo sapiens
gctgaggctcaatccccttctg

SEQ ID NO: 7742693 - DNA, 22 bp, Homo sapiens
gctgaggctcctcgggaggaca

SEQ ID NO: 7742694 - DNA, 22 bp, Homo sapiens
gctgaggctgggagcagcctgt

SEQ ID NO: 7742695 - DNA, 22 bp, Homo sapiens
gctgaggcttagctaaaaattt

SEQ ID NO: 7742696 - DNA, 22 bp, Homo sapiens
gctgaggctgggagcagcctgt

SEQ ID NO: 7742697 - DNA, 22 bp, Homo sapiens
gctgagagcaaggacaaagcat

SEQ ID NO: 7742698 - DNA, 22 bp, Homo sapiens
gctgagagtccaggaaaacatc

SEQ ID NO: 7742699 - DNA, 22 bp, Homo sapiens
gcctgaggaatgctcctgactt

SEQ ID NO: 7742700 - DNA, 22 bp, Homo sapiens
gccttggaaagctggagcagtt

SEQ ID NO: 7742701 - DNA, 22 bp, Homo sapiens
gccttggactaccactcccaca

SEQ ID NO: 7742702 - DNA, 22 bp, Homo sapiens
gccttggactcgggtggactca

SEQ ID NO: 7742703 - DNA, 23 bp, Homo sapiens
gccttggagaagtcactcaggga

SEQ ID NO: 7742704 - DNA, 22 bp, Homo sapiens
gccttggagatcactgctcatg

SEQ ID NO: 7742705 - DNA, 22 bp, Homo sapiens
gcctctggggtggagcccagca

SEQ ID NO: 7742706 - DNA, 22 bp, Homo sapiens
gcctctggtccctcatgctgtg

SEQ ID NO: 7742707 - DNA, 22 bp, Homo sapiens
gcctctggtccctcatgctgtg

SEQ ID NO: 7742708 - DNA, 23 bp, Homo sapiens
gctcagatgccctaggaggtggc

SEQ ID NO: 7742709 - DNA, 22 bp, Homo sapiens
gctcccaactcaggcctcctcc

SEQ ID NO: 7742710 - DNA, 22 bp, Homo sapiens
gctccagtggactgggggaggc

SEQ ID NO: 7742711 - DNA, 23 bp, Homo sapiens
ggacacaggccttgtctgcgcct

SEQ ID NO: 7742712 - DNA, 22 bp, Homo sapiens
ggaccatgaggagatgggcctc

SEQ ID NO: 7742713 - DNA, 22 bp, Homo sapiens
ggagcagcactgccacacagag

SEQ ID NO: 7742714 - DNA, 22 bp, Homo sapiens
ggagagaattccatggacatgt

SEQ ID NO: 7742715 - DNA, 22 bp, Homo sapiens
ggagaccttaaggtgcttccta

SEQ ID NO: 7742716 - DNA, 22 bp, Homo sapiens
ggagacatattccagagctggg

SEQ ID NO: 7742717 - DNA, 22 bp, Homo sapiens
ggagacatgcagactgagatac

SEQ ID NO: 7742718 - DNA, 22 bp, Homo sapiens
ggagagaaattgaggtagcaag

SEQ ID NO: 7742719 - DNA, 22 bp, Homo sapiens
ggagagaaattgaggtagcaag

SEQ ID NO: 7742720 - DNA, 22 bp, Homo sapiens
ggagagaactgacctgaaagga

SEQ ID NO: 7742721 - DNA, 22 bp, Homo sapiens
ggagagaactggctccttctag

SEQ ID NO: 7742722 - DNA, 22 bp, Homo sapiens
ggacaaaatccaaacttcttag

SEQ ID NO: 7742723 - DNA, 22 bp, Homo sapiens
ggaagagggaaccacgactgta

SEQ ID NO: 7742724 - DNA, 22 bp, Homo sapiens
ggaagaggctgaggccatgctg

SEQ ID NO: 7742725 - DNA, 22 bp, Homo sapiens
gctttggaaggggctggtggag

SEQ ID NO: 7742726 - DNA, 22 bp, Homo sapiens
ggaagacagaagcctacagctt

SEQ ID NO: 7742727 - DNA, 22 bp, Homo sapiens
ggaagacaagcagtggctgagc

SEQ ID NO: 7742728 - DNA, 22 bp, Homo sapiens
gctttattttgtgagggattac

SEQ ID NO: 7742729 - DNA, 22 bp, Homo sapiens
gctgggctggaaggccaaggca

SEQ ID NO: 7742730 - DNA, 22 bp, Homo sapiens
gctgggctggccgccgagatcg

SEQ ID NO: 7742731 - DNA, 22 bp, Homo sapiens
gctgggcttcacagagccttta

SEQ ID NO: 7742732 - DNA, 22 bp, Homo sapiens
gctgggcttcacctccagagtt

SEQ ID NO: 7742733 - DNA, 22 bp, Homo sapiens
gctgggctgtagtttgctgacc

SEQ ID NO: 7742734 - DNA, 23 bp, Homo sapiens
gctgggcttactctttcagtgag

SEQ ID NO: 7742735 - DNA, 22 bp, Homo sapiens
gctggctggaggtgaggaagaa

SEQ ID NO: 7742736 - DNA, 22 bp, Homo sapiens
gctggctggaatgggagaagaa

SEQ ID NO: 7742737 - DNA, 22 bp, Homo sapiens
gctggctgcgtcatcacagggc

SEQ ID NO: 7742738 - DNA, 22 bp, Homo sapiens
gctgggcttctcaatgctgcct

SEQ ID NO: 7742739 - DNA, 19 bp, Homo sapiens
gctgggcttgggtttgtag

SEQ ID NO: 7742740 - DNA, 22 bp, Homo sapiens
gctgggcttggtttccctgctt

SEQ ID NO: 7742741 - DNA, 18 bp, Homo sapiens
gctttatttcttggggaa

SEQ ID NO: 7742742 - DNA, 22 bp, Homo sapiens
gcttctttggcaaccctgacat

SEQ ID NO: 7742743 - DNA, 22 bp, Homo sapiens
gcttgagttttgggacaaagcc

SEQ ID NO: 7742744 - DNA, 22 bp, Homo sapiens
tccagagctgagggtcagtaga

SEQ ID NO: 7742745 - DNA, 22 bp, Homo sapiens
tccagagcctgcgcactggctg

SEQ ID NO: 7742746 - DNA, 23 bp, Homo sapiens
tccagctcccttcaatggcactg

SEQ ID NO: 7742747 - DNA, 22 bp, Homo sapiens
tccagctcagatgcagggatca

SEQ ID NO: 7742748 - DNA, 22 bp, Homo sapiens
tccagcattcttagacctctat

SEQ ID NO: 7742749 - DNA, 22 bp, Homo sapiens
tccagcatgactagttccccat

SEQ ID NO: 7742750 - DNA, 20 bp, Homo sapiens
tccagcatataaactcctct

SEQ ID NO: 7742751 - DNA, 22 bp, Homo sapiens
tccagctctggcttggctagct

SEQ ID NO: 7742752 - DNA, 23 bp, Homo sapiens
tccaggctgaaggagcagatttt

SEQ ID NO: 7742753 - DNA, 22 bp, Homo sapiens
tccaggatgcccgcttttgctt

SEQ ID NO: 7742754 - DNA, 22 bp, Homo sapiens
tccaggatggtgacggtggcca

SEQ ID NO: 7742755 - DNA, 22 bp, Homo sapiens
tccaggattgcaggtgcacaac

SEQ ID NO: 7742756 - DNA, 22 bp, Homo sapiens
tccaggattgtcagccagaagg

SEQ ID NO: 7742757 - DNA, 22 bp, Homo sapiens
tccagggctccccaacatccag

SEQ ID NO: 7742758 - DNA, 22 bp, Homo sapiens
tccatcatgttcacagctatat

SEQ ID NO: 7742759 - DNA, 22 bp, Homo sapiens
tccatcatggcagcagcagtga

SEQ ID NO: 7742760 - DNA, 20 bp, Homo sapiens
tcccaaggatgcctgggtgt

SEQ ID NO: 7742761 - DNA, 22 bp, Homo sapiens
tcccagggttacagccagggca

SEQ ID NO: 7742762 - DNA, 22 bp, Homo sapiens
tcccatggtctatatagaggca

SEQ ID NO: 7742763 - DNA, 22 bp, Homo sapiens
tcccagtgaggtcctggctgtc

SEQ ID NO: 7742764 - DNA, 20 bp, Homo sapiens
tcccagtcagccagagtgag

SEQ ID NO: 7742765 - DNA, 19 bp, Homo sapiens
tccccaagagttctagctc

SEQ ID NO: 7742766 - DNA, 22 bp, Homo sapiens
tcagcactgtcttttatttgaa

SEQ ID NO: 7742767 - DNA, 22 bp, Homo sapiens
tcagaggaaagggaacatagtc

SEQ ID NO: 7742768 - DNA, 22 bp, Homo sapiens
tcagagcccctccgctgtccca

SEQ ID NO: 7742769 - DNA, 22 bp, Homo sapiens
tcagagccctgctcctccccaa

SEQ ID NO: 7742770 - DNA, 22 bp, Homo sapiens
tcagagaggttggtgataagaa

SEQ ID NO: 7742771 - DNA, 22 bp, Homo sapiens
tcagagccaatcatggtgcatt

SEQ ID NO: 7742772 - DNA, 23 bp, Homo sapiens
tcagagaactcgggcagatgacc

SEQ ID NO: 7742773 - DNA, 22 bp, Homo sapiens
tcagacagtgtgatcagtctct

SEQ ID NO: 7742774 - DNA, 22 bp, Homo sapiens
tcactctggagtccgctaccag

SEQ ID NO: 7742775 - DNA, 22 bp, Homo sapiens
tcacaaagggagggatagctgg

SEQ ID NO: 7742776 - DNA, 22 bp, Homo sapiens
tcacaaagtgaagtgtgtcatg

SEQ ID NO: 7742777 - DNA, 22 bp, Homo sapiens
tcacaaagagaattgtgggtgt

SEQ ID NO: 7742778 - DNA, 22 bp, Homo sapiens
tcacaaagctttgataagcaga

SEQ ID NO: 7742779 - DNA, 22 bp, Homo sapiens
tcacaaagctttgataagcaga

SEQ ID NO: 7742780 - DNA, 22 bp, Homo sapiens
tcacagaacacaaatgccactt

SEQ ID NO: 7742781 - DNA, 22 bp, Homo sapiens
tcacagaacaatgtttagttct

SEQ ID NO: 7742782 - DNA, 22 bp, Homo sapiens
tcacagaagagatattgacaga

SEQ ID NO: 7742783 - DNA, 22 bp, Homo sapiens
tcacagaagaagtagattgcat

SEQ ID NO: 7742784 - DNA, 22 bp, Homo sapiens
tcacagaaatctgttttttcta

SEQ ID NO: 7742785 - DNA, 22 bp, Homo sapiens
tcacagaaataagatagttatt

SEQ ID NO: 7742786 - DNA, 22 bp, Homo sapiens
tcacagaacaagcctggtggag

SEQ ID NO: 7742787 - DNA, 22 bp, Homo sapiens
tcacagaaacagaatggcacag

SEQ ID NO: 7742788 - DNA, 22 bp, Homo sapiens
tcacagaaagctgtgtcctgac

SEQ ID NO: 7742789 - DNA, 22 bp, Homo sapiens
tcacagaaaagctgagcatcag

SEQ ID NO: 7742790 - DNA, 22 bp, Homo sapiens
tcacagaaaagtggagagccta

SEQ ID NO: 7742791 - DNA, 20 bp, Homo sapiens
tcacagaaacaaatagagaa

SEQ ID NO: 7742792 - DNA, 22 bp, Homo sapiens
tcacagaagcatcatacccgga

SEQ ID NO: 7742793 - DNA, 22 bp, Homo sapiens
tcacagaagatgctggatgttg

SEQ ID NO: 7742794 - DNA, 22 bp, Homo sapiens
tcacagaagagcattaagatga

SEQ ID NO: 7742795 - DNA, 22 bp, Homo sapiens
tcacagaagcttgaagattttc

SEQ ID NO: 7742796 - DNA, 22 bp, Homo sapiens
tcacagaagccctcgcaaacta

SEQ ID NO: 7742797 - DNA, 22 bp, Homo sapiens
tcacagaaggaccttgtttcat

SEQ ID NO: 7742798 - DNA, 22 bp, Homo sapiens
tcacagaaggagggaagctagt

SEQ ID NO: 7742799 - DNA, 22 bp, Homo sapiens
tcacagaaggcatcacagaaga

SEQ ID NO: 7742800 - DNA, 22 bp, Homo sapiens
tcacagaagggaaagatgccaa

SEQ ID NO: 7742801 - DNA, 22 bp, Homo sapiens
tcacagaaggtggccatagctg

SEQ ID NO: 7742802 - DNA, 22 bp, Homo sapiens
tcacagaagtgtagtgaggaaa

SEQ ID NO: 7742803 - DNA, 22 bp, Homo sapiens
tcacagaagtgtgtttcaggag

SEQ ID NO: 7742804 - DNA, 22 bp, Homo sapiens
tcacagaagttgaatttgcatg

SEQ ID NO: 7742805 - DNA, 22 bp, Homo sapiens
tcacagaataaatgtactggcc

SEQ ID NO: 7742806 - DNA, 22 bp, Homo sapiens
tcaataactttgtttagcattg

SEQ ID NO: 7742807 - DNA, 22 bp, Homo sapiens
tcaagtatttatttctgctggc

SEQ ID NO: 7742808 - DNA, 22 bp, Homo sapiens
tcaaggagcccacagtctaatg

SEQ ID NO: 7742809 - DNA, 22 bp, Homo sapiens
tcaaggcaaagtaaatattcaa

SEQ ID NO: 7742810 - DNA, 22 bp, Homo sapiens
tcaaggaatttagtttagtaaa

SEQ ID NO: 7742811 - DNA, 22 bp, Homo sapiens
tcaaggaatgactatatgagga

SEQ ID NO: 7742812 - DNA, 22 bp, Homo sapiens
tcaaggaatgactatatgagga

SEQ ID NO: 7742813 - DNA, 22 bp, Homo sapiens
tcaaggaaggtctgttgctcca

SEQ ID NO: 7742814 - DNA, 22 bp, Homo sapiens
tcaaggaagggatattcttgaa

SEQ ID NO: 7742815 - DNA, 22 bp, Homo sapiens
tcaaggaagatagctattatga

SEQ ID NO: 7742816 - DNA, 22 bp, Homo sapiens
tatttcttcgggattcaagcta

SEQ ID NO: 7742817 - DNA, 21 bp, Homo sapiens
tcagcagaaagcaaggtcagt

SEQ ID NO: 7742818 - DNA, 22 bp, Homo sapiens
tcagctccagagttgcacagtg

SEQ ID NO: 7742819 - DNA, 22 bp, Homo sapiens
tcaggaagacaatctttggctc

SEQ ID NO: 7742820 - DNA, 21 bp, Homo sapiens
tcaggaagagcttctcccact

SEQ ID NO: 7742821 - DNA, 22 bp, Homo sapiens
tcaggaaggcacttggtgtgtt

SEQ ID NO: 7742822 - DNA, 22 bp, Homo sapiens
tcaggaaggagctggcctgcca

SEQ ID NO: 7742823 - DNA, 22 bp, Homo sapiens
tcaggaagctgctctgggtggt

SEQ ID NO: 7742824 - DNA, 22 bp, Homo sapiens
tcaggccttcagacctggcccg

SEQ ID NO: 7742825 - DNA, 22 bp, Homo sapiens
tcagggaaaagtcacactgggt

SEQ ID NO: 7742826 - DNA, 22 bp, Homo sapiens
tcagggaaatagcagggctgaa

SEQ ID NO: 7742827 - DNA, 22 bp, Homo sapiens
tcaggcctgcaggcttcctgga

SEQ ID NO: 7742828 - DNA, 22 bp, Homo sapiens
tcagtgcagggtgggagagaga

SEQ ID NO: 7742829 - DNA, 22 bp, Homo sapiens
tcagtgcagggtgggagagaga

SEQ ID NO: 7742830 - DNA, 22 bp, Homo sapiens
tcagtgcagtagaactttagtt

SEQ ID NO: 7742831 - DNA, 22 bp, Homo sapiens
tcagtgcacaatgacggtggct

SEQ ID NO: 7742832 - DNA, 21 bp, Homo sapiens
tcagtgcaattctatggggaa

SEQ ID NO: 7742833 - DNA, 22 bp, Homo sapiens
tcagtgcacccaattctctcca

SEQ ID NO: 7742834 - DNA, 22 bp, Homo sapiens
tcagtgcacagagatttttgtt

SEQ ID NO: 7742835 - DNA, 22 bp, Homo sapiens
tcagtgcaaaaaatgggctaga

SEQ ID NO: 7742836 - DNA, 22 bp, Homo sapiens
tcagtgcaatcaaggtatgttt

SEQ ID NO: 7742837 - DNA, 23 bp, Homo sapiens
tcagtgcaaaaataggattttgg

SEQ ID NO: 7742838 - DNA, 22 bp, Homo sapiens
tcagtgcaggaatctctagcca

SEQ ID NO: 7742839 - DNA, 22 bp, Homo sapiens
tcagtgcaggaatttccttaga

SEQ ID NO: 7742840 - DNA, 22 bp, Homo sapiens
tcagtgcagcggcagcagctct

SEQ ID NO: 7742841 - DNA, 22 bp, Homo sapiens
tcagtgcagaatagtgatgcat

SEQ ID NO: 7742842 - DNA, 20 bp, Homo sapiens
tcagtgcagattgtccaagt

SEQ ID NO: 7742843 - DNA, 22 bp, Homo sapiens
tcagtgcagactgtaagttgga

SEQ ID NO: 7742844 - DNA, 19 bp, Homo sapiens
tcagggaagttcaaagctc

SEQ ID NO: 7742845 - DNA, 22 bp, Homo sapiens
tcagggaagacttcttagagga

SEQ ID NO: 7742846 - DNA, 22 bp, Homo sapiens
tcatggaaacagcaatgctaat

SEQ ID NO: 7742847 - DNA, 21 bp, Homo sapiens
tcatatttctcttgctattgt

SEQ ID NO: 7742848 - DNA, 22 bp, Homo sapiens
tcatataagagctttagagtca

SEQ ID NO: 7742849 - DNA, 22 bp, Homo sapiens
tacattctgaaataaatggttt

SEQ ID NO: 7742850 - DNA, 22 bp, Homo sapiens
tacattctatatctgttacatc

SEQ ID NO: 7742851 - DNA, 22 bp, Homo sapiens
tacattgaaagtcatttaatcc

SEQ ID NO: 7742852 - DNA, 23 bp, Homo sapiens
tacattctgtatttttatagagt

SEQ ID NO: 7742853 - DNA, 22 bp, Homo sapiens
tacattctggtggagaaagtaa

SEQ ID NO: 7742854 - DNA, 22 bp, Homo sapiens
tacattgacttggattgttaga

SEQ ID NO: 7742855 - DNA, 21 bp, Homo sapiens
tacattgactacaaataaagc

SEQ ID NO: 7742856 - DNA, 22 bp, Homo sapiens
tacagaaaaactggcattgaag

SEQ ID NO: 7742857 - DNA, 22 bp, Homo sapiens
tacagaaagacctctcgggaaa

SEQ ID NO: 7742858 - DNA, 20 bp, Homo sapiens
tacagaaacaggacttttgg

SEQ ID NO: 7742859 - DNA, 22 bp, Homo sapiens
tacagaaaaacatctggagccg

SEQ ID NO: 7742860 - DNA, 22 bp, Homo sapiens
taattacaaagcaagcacaggg

SEQ ID NO: 7742861 - DNA, 22 bp, Homo sapiens
taatagaaaggtattttttgca

SEQ ID NO: 7742862 - DNA, 22 bp, Homo sapiens
taatagaatagtggaaacattg

SEQ ID NO: 7742863 - DNA, 22 bp, Homo sapiens
taataatagcagtagctgccac

SEQ ID NO: 7742864 - DNA, 22 bp, Homo sapiens
taatacagggcactttgagtga

SEQ ID NO: 7742865 - DNA, 22 bp, Homo sapiens
taatacatcattcatctaagga

SEQ ID NO: 7742866 - DNA, 22 bp, Homo sapiens
gttcacatgtggtcatgctgtc

SEQ ID NO: 7742867 - DNA, 22 bp, Homo sapiens
gttcagcaagtactcagtccac

SEQ ID NO: 7742868 - DNA, 22 bp, Homo sapiens
gttcagcaagaatgtttctatt

SEQ ID NO: 7742869 - DNA, 22 bp, Homo sapiens
gttcaatttagaaagcacagtt

SEQ ID NO: 7742870 - DNA, 22 bp, Homo sapiens
gttcacaaagtactgtatgcat

SEQ ID NO: 7742871 - DNA, 22 bp, Homo sapiens
gttcatatttaactaagatagg

SEQ ID NO: 7742872 - DNA, 22 bp, Homo sapiens
gttcattctgaaaagcagcttg

SEQ ID NO: 7742873 - DNA, 22 bp, Homo sapiens
gttgcaggaagcacacacatgt

SEQ ID NO: 7742874 - DNA, 22 bp, Homo sapiens
gttgtaaatacagcagataatt

SEQ ID NO: 7742875 - DNA, 22 bp, Homo sapiens
gtttcatataccaagcacttga

SEQ ID NO: 7742876 - DNA, 22 bp, Homo sapiens
gtttcatatgcagttaacagca

SEQ ID NO: 7742877 - DNA, 22 bp, Homo sapiens
gtgtgccaggaactggctgctg

SEQ ID NO: 7742878 - DNA, 22 bp, Homo sapiens
gtgtgccactgcctgaggaccc

SEQ ID NO: 7742879 - DNA, 23 bp, Homo sapiens
gttaataatgaacactttctccc

SEQ ID NO: 7742880 - DNA, 22 bp, Homo sapiens
gtgtgggaaggctaggatgctg

SEQ ID NO: 7742881 - DNA, 22 bp, Homo sapiens
gtgtggctgtttagtgactttc

SEQ ID NO: 7742882 - DNA, 22 bp, Homo sapiens
gtgtggctagaagtgtcttgtt

SEQ ID NO: 7742883 - DNA, 22 bp, Homo sapiens
taaattatggctggcagagcag

SEQ ID NO: 7742884 - DNA, 23 bp, Homo sapiens
taaattacctttccagtgcaggg

SEQ ID NO: 7742885 - DNA, 22 bp, Homo sapiens
taaattaccctttagggaattg

SEQ ID NO: 7742886 - DNA, 22 bp, Homo sapiens
taaattactcaatgcacataaa

SEQ ID NO: 7742887 - DNA, 22 bp, Homo sapiens
taaagtgcttcctaacccagag

SEQ ID NO: 7742888 - DNA, 22 bp, Homo sapiens
taaagtgctggatttgagtaaa

SEQ ID NO: 7742889 - DNA, 22 bp, Homo sapiens
taaagtgctgggattataggcc

SEQ ID NO: 7742890 - DNA, 22 bp, Homo sapiens
taaagtgcttatgataaccaag

SEQ ID NO: 7742891 - DNA, 22 bp, Homo sapiens
taaagtgcgacccagtccccag

SEQ ID NO: 7742892 - DNA, 22 bp, Homo sapiens
taaagtgctcataaaaatggat

SEQ ID NO: 7742893 - DNA, 23 bp, Homo sapiens
taaagtgctgatggtgagggagc

SEQ ID NO: 7742894 - DNA, 22 bp, Homo sapiens
taaagtgcctcaggtcctgggt

SEQ ID NO: 7742895 - DNA, 22 bp, Homo sapiens
taaagtatattttttctcaata

SEQ ID NO: 7742896 - DNA, 22 bp, Homo sapiens
taaagtatccagttattcttct

SEQ ID NO: 7742897 - DNA, 22 bp, Homo sapiens
taaagtataagcattggagtat

SEQ ID NO: 7742898 - DNA, 22 bp, Homo sapiens
taaaggttattgcactggagtt

SEQ ID NO: 7742899 - DNA, 22 bp, Homo sapiens
taaaggtatgtcttaatcaaac

SEQ ID NO: 7742900 - DNA, 22 bp, Homo sapiens
taaaggtagtgtgacatattgt

SEQ ID NO: 7742901 - DNA, 22 bp, Homo sapiens
taaccaaagggcctaaggaatg

SEQ ID NO: 7742902 - DNA, 22 bp, Homo sapiens
taactctagtcccaggcatgaa

SEQ ID NO: 7742903 - DNA, 22 bp, Homo sapiens
taaaatgatctctcatgttctt

SEQ ID NO: 7742904 - DNA, 19 bp, Homo sapiens
taaaatgtctgtggtcagt

SEQ ID NO: 7742905 - DNA, 22 bp, Homo sapiens
gttttgtgaggcacccacaggt

SEQ ID NO: 7742906 - DNA, 22 bp, Homo sapiens
tatctaagagagtcaatattta

SEQ ID NO: 7742907 - DNA, 22 bp, Homo sapiens
tatctacagttaatatgtcatc

SEQ ID NO: 7742908 - DNA, 22 bp, Homo sapiens
tatgagaagaacaggtgacttt

SEQ ID NO: 7742909 - DNA, 22 bp, Homo sapiens
tatgagaactgacagagtgcca

SEQ ID NO: 7742910 - DNA, 18 bp, Homo sapiens
tatgagaagattagcaat

SEQ ID NO: 7742911 - DNA, 22 bp, Homo sapiens
tatgagaaggtatggtgacttg

SEQ ID NO: 7742912 - DNA, 22 bp, Homo sapiens
tatgagaaattgctgatatttg

SEQ ID NO: 7742913 - DNA, 22 bp, Homo sapiens
tatgagaacgggggcgtgtggg

SEQ ID NO: 7742914 - DNA, 22 bp, Homo sapiens
tatgagaacaagaacaatctcc

SEQ ID NO: 7742915 - DNA, 23 bp, Homo sapiens
tatgagaacccatacgctgtctt

SEQ ID NO: 7742916 - DNA, 22 bp, Homo sapiens
tatgagaaagtcgtatgtctcc

SEQ ID NO: 7742917 - DNA, 22 bp, Homo sapiens
tatgagaaattatacctaggtt

SEQ ID NO: 7742918 - DNA, 22 bp, Homo sapiens
tatgagaaaggagaatgacttt

SEQ ID NO: 7742919 - DNA, 21 bp, Homo sapiens
tatgagaaaactgaggtgcat

SEQ ID NO: 7742920 - DNA, 22 bp, Homo sapiens
tatgagaaaataaatatctgtt

SEQ ID NO: 7742921 - DNA, 22 bp, Homo sapiens
tataaattaatgtgcccatgag

SEQ ID NO: 7742922 - DNA, 22 bp, Homo sapiens
tataaatgccaggactttagat

SEQ ID NO: 7742923 - DNA, 22 bp, Homo sapiens
tataaatgccaggactttagat

SEQ ID NO: 7742924 - DNA, 22 bp, Homo sapiens
tataaagtttcgaaagatgtat

SEQ ID NO: 7742925 - DNA, 22 bp, Homo sapiens
tataaatgcacttttgaaatat

SEQ ID NO: 7742926 - DNA, 23 bp, Homo sapiens
tatacacatgtggcagtatagtg

SEQ ID NO: 7742927 - DNA, 22 bp, Homo sapiens
tatacacacctccaaagcagga

SEQ ID NO: 7742928 - DNA, 22 bp, Homo sapiens
tatacaagaggtgagatgagca

SEQ ID NO: 7742929 - DNA, 22 bp, Homo sapiens
tatacaagtgagaagaagagtt

SEQ ID NO: 7742930 - DNA, 22 bp, Homo sapiens
tatacaagtaatgctgaatgat

SEQ ID NO: 7742931 - DNA, 22 bp, Homo sapiens
tataatttggggaaagtggtgt

SEQ ID NO: 7742932 - DNA, 22 bp, Homo sapiens
tattgaattagaccctaaaatg

SEQ ID NO: 7742933 - DNA, 22 bp, Homo sapiens
tattgaattagaccctaaaatg

SEQ ID NO: 7742934 - DNA, 22 bp, Homo sapiens
tatttattctttgtactgcctt

SEQ ID NO: 7742935 - DNA, 22 bp, Homo sapiens
tatttatcaaggtaggagaata

SEQ ID NO: 7742936 - DNA, 22 bp, Homo sapiens
tatgtacataacatgaaatgca

SEQ ID NO: 7742937 - DNA, 22 bp, Homo sapiens
tatgtacaccggggaaggtggg

SEQ ID NO: 7742938 - DNA, 22 bp, Homo sapiens
tatgtacaccggggaaggtggg

SEQ ID NO: 7742939 - DNA, 22 bp, Homo sapiens
tatgtacacttaagtttgagaa

SEQ ID NO: 7742940 - DNA, 22 bp, Homo sapiens
tatgtacaccaaggattgaaaa

SEQ ID NO: 7742941 - DNA, 22 bp, Homo sapiens
tatgtacacacacatgcatgta

SEQ ID NO: 7742942 - DNA, 22 bp, Homo sapiens
tatgtacaatttgttgtatgtc

SEQ ID NO: 7742943 - DNA, 22 bp, Homo sapiens
tatgtacaatcagcagttcata

SEQ ID NO: 7742944 - DNA, 22 bp, Homo sapiens
tatgagaatttgctaattggct

SEQ ID NO: 7742945 - DNA, 22 bp, Homo sapiens
tatgagaataatctggtaaata

SEQ ID NO: 7742946 - DNA, 22 bp, Homo sapiens
tatgagaatctgcagtatgctt

SEQ ID NO: 7742947 - DNA, 23 bp, Homo sapiens
tatgagaattaagtgcgagtgcc

SEQ ID NO: 7742948 - DNA, 22 bp, Homo sapiens
tattagaggaaccaaggtggag

SEQ ID NO: 7742949 - DNA, 22 bp, Homo sapiens
tagaaataaatctgcagctggg

SEQ ID NO: 7742950 - DNA, 22 bp, Homo sapiens
tagaaatgattggttgagctct

SEQ ID NO: 7742951 - DNA, 22 bp, Homo sapiens
tagaaatgattggttgagctct

SEQ ID NO: 7742952 - DNA, 22 bp, Homo sapiens
tagaaatgcccagattctgcta

SEQ ID NO: 7742953 - DNA, 22 bp, Homo sapiens
tagaaagctgagtaatacattt

SEQ ID NO: 7742954 - DNA, 22 bp, Homo sapiens
tagaaaggcaagcgtgaaatat

SEQ ID NO: 7742955 - DNA, 21 bp, Homo sapiens
tagaaagtcaaagctatcagc

SEQ ID NO: 7742956 - DNA, 22 bp, Homo sapiens
tagaggcctgaaagaatgatca

SEQ ID NO: 7742957 - DNA, 22 bp, Homo sapiens
tagaaatggagaacagattaat

SEQ ID NO: 7742958 - DNA, 22 bp, Homo sapiens
taccaaaagcttgtttcataca

SEQ ID NO: 7742959 - DNA, 22 bp, Homo sapiens
tagaaaagataacattctgtgc

SEQ ID NO: 7742960 - DNA, 22 bp, Homo sapiens
tagggaggctacttcttgtagg

SEQ ID NO: 7742961 - DNA, 22 bp, Homo sapiens
tagggaggagggttttcaaatc

SEQ ID NO: 7742962 - DNA, 22 bp, Homo sapiens
tagaggtatttttgatggtcat

SEQ ID NO: 7742963 - DNA, 22 bp, Homo sapiens
tagaggtataccaaaaaggcat

SEQ ID NO: 7742964 - DNA, 22 bp, Homo sapiens
tagaggtagcaacaggactaga

SEQ ID NO: 7742965 - DNA, 22 bp, Homo sapiens
tagaggtagatggtcagccaat

SEQ ID NO: 7742966 - DNA, 22 bp, Homo sapiens
tagaggtagagttacattagtc

SEQ ID NO: 7742967 - DNA, 22 bp, Homo sapiens
tagaggtactcccctcaaagtt

SEQ ID NO: 7742968 - DNA, 23 bp, Homo sapiens
tagcagcatttttagcctctgtc

SEQ ID NO: 7742969 - DNA, 22 bp, Homo sapiens
tagcagctacctggctaagagt

SEQ ID NO: 7742970 - DNA, 22 bp, Homo sapiens
tagcagcaggggaaacagctgt

SEQ ID NO: 7742971 - DNA, 22 bp, Homo sapiens
tagcagctatgccattttgaca

SEQ ID NO: 7742972 - DNA, 22 bp, Homo sapiens
tagcagctcacagcctcccatt

SEQ ID NO: 7742973 - DNA, 22 bp, Homo sapiens
tagcagctcactaactctgcgt

SEQ ID NO: 7742974 - DNA, 22 bp, Homo sapiens
tagcagctccatttctctggca

SEQ ID NO: 7742975 - DNA, 22 bp, Homo sapiens
tagcttaaaccaatctgaataa

SEQ ID NO: 7742976 - DNA, 22 bp, Homo sapiens
tagctcctggtgagcctactct

SEQ ID NO: 7742977 - DNA, 22 bp, Homo sapiens
ttcctctggggccaggccaaca

SEQ ID NO: 7742978 - DNA, 22 bp, Homo sapiens
ttcctctgtagttgctgatgaa

SEQ ID NO: 7742979 - DNA, 22 bp, Homo sapiens
ttcctctgtatgctttgctgct

SEQ ID NO: 7742980 - DNA, 22 bp, Homo sapiens
ttcctcagagggcgctggggaa

SEQ ID NO: 7742981 - DNA, 22 bp, Homo sapiens
ttcctcagccaaggctgggatc

SEQ ID NO: 7742982 - DNA, 22 bp, Homo sapiens
ttcctcagaccctcattgtgag

SEQ ID NO: 7742983 - DNA, 22 bp, Homo sapiens
ttcctacatcaccagggggagt

SEQ ID NO: 7742984 - DNA, 22 bp, Homo sapiens
ttccagagcagttttcagatca

SEQ ID NO: 7742985 - DNA, 20 bp, Homo sapiens
ttccacatctttgcacatgc

SEQ ID NO: 7742986 - DNA, 19 bp, Homo sapiens
ttctaagttttgcttgctg

SEQ ID NO: 7742987 - DNA, 22 bp, Homo sapiens
ttctaagtcctacctgaaagca

SEQ ID NO: 7742988 - DNA, 22 bp, Homo sapiens
ttctagcatgccttttagcaca

SEQ ID NO: 7742989 - DNA, 20 bp, Homo sapiens
ttctagcatacttacaagga

SEQ ID NO: 7742990 - DNA, 20 bp, Homo sapiens
ttctagcatacttacaagga

SEQ ID NO: 7742991 - DNA, 22 bp, Homo sapiens
ttctagcacaagatatgaaagt

SEQ ID NO: 7742992 - DNA, 22 bp, Homo sapiens
ttctaagctctgaaataaatct

SEQ ID NO: 7742993 - DNA, 22 bp, Homo sapiens
ttctaagtcactcagattttgg

SEQ ID NO: 7742994 - DNA, 22 bp, Homo sapiens
ttcctgtggccttacatctgtg

SEQ ID NO: 7742995 - DNA, 22 bp, Homo sapiens
ttcctgtgatattagccactgt

SEQ ID NO: 7742996 - DNA, 22 bp, Homo sapiens
ttcctgtgtgaccgagacagtg

SEQ ID NO: 7742997 - DNA, 22 bp, Homo sapiens
ttcctgtggtccagagtcatcc

SEQ ID NO: 7742998 - DNA, 22 bp, Homo sapiens
ttccaatttgtggtgagttaat

SEQ ID NO: 7742999 - DNA, 22 bp, Homo sapiens
ttcagtgtacagtgaagggatt

SEQ ID NO: 7743000 - DNA, 22 bp, Homo sapiens
ttcagtgtatattttttgagta

SEQ ID NO: 7743001 - DNA, 22 bp, Homo sapiens
ttcagtgtcacaagagcaagcc

SEQ ID NO: 7743002 - DNA, 22 bp, Homo sapiens
ttcacattacaaggccatattt

SEQ ID NO: 7743003 - DNA, 22 bp, Homo sapiens
ttcacagtggccctctctgagt

SEQ ID NO: 7743004 - DNA, 22 bp, Homo sapiens
ttcacagtggctaagttctgca

SEQ ID NO: 7743005 - DNA, 22 bp, Homo sapiens
ttcaactttggagatttaataa

SEQ ID NO: 7743006 - DNA, 22 bp, Homo sapiens
ttcaacatgttctacataaggg

SEQ ID NO: 7743007 - DNA, 22 bp, Homo sapiens
ttcaacatcaagaatgcatgga

SEQ ID NO: 7743008 - DNA, 17 bp, Homo sapiens
ttcaaagcttatcaagg

SEQ ID NO: 7743009 - DNA, 22 bp, Homo sapiens
ttagataaattgcaacttgatt

SEQ ID NO: 7743010 - DNA, 22 bp, Homo sapiens
ttagataaattaagactttaca

SEQ ID NO: 7743011 - DNA, 22 bp, Homo sapiens
ttagataaaagtgttcaataaa

SEQ ID NO: 7743012 - DNA, 22 bp, Homo sapiens
ttcacagtgccagggggcaggc

SEQ ID NO: 7743013 - DNA, 22 bp, Homo sapiens
ttcacagtgagctatgtcttgt

SEQ ID NO: 7743014 - DNA, 22 bp, Homo sapiens
ttcacaagtcattagctgcata

SEQ ID NO: 7743015 - DNA, 18 bp, Homo sapiens
ttcacaagggcttggttt

SEQ ID NO: 7743016 - DNA, 22 bp, Homo sapiens
ttcacaaagctggagcatttcc

SEQ ID NO: 7743017 - DNA, 22 bp, Homo sapiens
ttcaattctaaactaatattct

SEQ ID NO: 7743018 - DNA, 22 bp, Homo sapiens
ttcaattcaattctaaatatat

SEQ ID NO: 7743019 - DNA, 22 bp, Homo sapiens
ttcaatgtttcttatcaagttg

SEQ ID NO: 7743020 - DNA, 22 bp, Homo sapiens
ttcaattctgatgaaggcaata

SEQ ID NO: 7743021 - DNA, 22 bp, Homo sapiens
ttcaattctgctctgatcttag

SEQ ID NO: 7743022 - DNA, 22 bp, Homo sapiens
ttcaatgcctagaacttagcat

SEQ ID NO: 7743023 - DNA, 22 bp, Homo sapiens
ttcaatgcatatagatatagaa

SEQ ID NO: 7743024 - DNA, 22 bp, Homo sapiens
ttgatttatagaatgttcaagc

SEQ ID NO: 7743025 - DNA, 22 bp, Homo sapiens
ttgatttcttactcttccaagg

SEQ ID NO: 7743026 - DNA, 22 bp, Homo sapiens
ttgcaaatgaccattgccacat

SEQ ID NO: 7743027 - DNA, 22 bp, Homo sapiens
ttgcaaatgtgaataattacac

SEQ ID NO: 7743028 - DNA, 22 bp, Homo sapiens
ttgcaaatattgtttacctttc

SEQ ID NO: 7743029 - DNA, 22 bp, Homo sapiens
ttgaggcattactgtaatgaga

SEQ ID NO: 7743030 - DNA, 22 bp, Homo sapiens
ttgattaatcccatgtgagtag

SEQ ID NO: 7743031 - DNA, 22 bp, Homo sapiens
ttgaggcaaaatcaacgggaag

SEQ ID NO: 7743032 - DNA, 22 bp, Homo sapiens
ttgagcccaggaggcctgggtg

SEQ ID NO: 7743033 - DNA, 22 bp, Homo sapiens
ttctgttttgcacagacttgaa

SEQ ID NO: 7743034 - DNA, 22 bp, Homo sapiens
ttctgttttagaaataagtagt

SEQ ID NO: 7743035 - DNA, 22 bp, Homo sapiens
ttctgggcttgaaagtttaata

SEQ ID NO: 7743036 - DNA, 22 bp, Homo sapiens
ttctgggcttggctgtttccat

SEQ ID NO: 7743037 - DNA, 22 bp, Homo sapiens
ttctgggctcccacatatttca

SEQ ID NO: 7743038 - DNA, 22 bp, Homo sapiens
ttctgggctctctttctgtgtg

SEQ ID NO: 7743039 - DNA, 23 bp, Homo sapiens
ttctgggctgtggaagcctcggg

SEQ ID NO: 7743040 - DNA, 22 bp, Homo sapiens
ttctgggctgtccagagggtga

SEQ ID NO: 7743041 - DNA, 22 bp, Homo sapiens
ttctgggcctcctaggacaggc

SEQ ID NO: 7743042 - DNA, 22 bp, Homo sapiens
ttctgggctcacagagcagcag

SEQ ID NO: 7743043 - DNA, 22 bp, Homo sapiens
ttctgggctaccttcccggcag

SEQ ID NO: 7743044 - DNA, 22 bp, Homo sapiens
ttctgggcccactgtagcatcc

SEQ ID NO: 7743045 - DNA, 21 bp, Homo sapiens
ttctgggccggagaaggggcg

SEQ ID NO: 7743046 - DNA, 22 bp, Homo sapiens
ttctgggcccaaccctagagtg

SEQ ID NO: 7743047 - DNA, 21 bp, Homo sapiens
ttctgggccatgctgcttctc

SEQ ID NO: 7743048 - DNA, 18 bp, Homo sapiens
ttctttaattcagtttga

SEQ ID NO: 7743049 - DNA, 22 bp, Homo sapiens
ttctttatcagttactcatagg

SEQ ID NO: 7743050 - DNA, 22 bp, Homo sapiens
ttctgaaggtcagcagcttggt

SEQ ID NO: 7743051 - DNA, 22 bp, Homo sapiens
ttctgaagggctaagtgtctat

SEQ ID NO: 7743052 - DNA, 22 bp, Homo sapiens
ttctagttgagggagacaaata

SEQ ID NO: 7743053 - DNA, 22 bp, Homo sapiens
ttctagttttcagtccaccagg

SEQ ID NO: 7743054 - DNA, 22 bp, Homo sapiens
ttctagtgtccttggacttgct

SEQ ID NO: 7743055 - DNA, 22 bp, Homo sapiens
ttctgaattcatgagatttggg

SEQ ID NO: 7743056 - DNA, 21 bp, Homo sapiens
ttctgccttcccctagctggg

SEQ ID NO: 7743057 - DNA, 22 bp, Homo sapiens
ttctgagcctcattcatgaggc

SEQ ID NO: 7743058 - DNA, 22 bp, Homo sapiens
ttctgagccagagtcagttatg

SEQ ID NO: 7743059 - DNA, 22 bp, Homo sapiens
ttctgagcctcattcatgaggc

SEQ ID NO: 7743060 - DNA, 22 bp, Homo sapiens
ttctgggcaccaccacagactt

SEQ ID NO: 7743061 - DNA, 22 bp, Homo sapiens
ttctggaaaagaaagttaagat

SEQ ID NO: 7743062 - DNA, 22 bp, Homo sapiens
ttctgggccaatctcttaatct

SEQ ID NO: 7743063 - DNA, 19 bp, Homo sapiens
ttctgggcattcatattta

SEQ ID NO: 7743064 - DNA, 22 bp, Homo sapiens
ttctgggcatgttacattctgt

SEQ ID NO: 7743065 - DNA, 22 bp, Homo sapiens
ttctgggcaggactggggaccc

SEQ ID NO: 7743066 - DNA, 22 bp, Homo sapiens
ttctgggcagttggaaatttca

SEQ ID NO: 7743067 - DNA, 20 bp, Homo sapiens
ttctgggcagccatgtactt

SEQ ID NO: 7743068 - DNA, 19 bp, Homo sapiens
ttctgggcagcacatgaat

SEQ ID NO: 7743069 - DNA, 22 bp, Homo sapiens
ttctgggcagagctggagctgc

SEQ ID NO: 7743070 - DNA, 22 bp, Homo sapiens
tcccctctggaggctgcagggg

SEQ ID NO: 7743071 - DNA, 22 bp, Homo sapiens
tgtggagatgtgagcaagggga

SEQ ID NO: 7743072 - DNA, 22 bp, Homo sapiens
tcccctccaactccaactatgg

SEQ ID NO: 7743073 - DNA, 22 bp, Homo sapiens
tgtggcagtataagagctagaa

SEQ ID NO: 7743074 - DNA, 22 bp, Homo sapiens
tgtggcagtaaaattgggcaac

SEQ ID NO: 7743075 - DNA, 22 bp, Homo sapiens
tgtggccaaaataaaatgaggt

SEQ ID NO: 7743076 - DNA, 22 bp, Homo sapiens
tgtggccaccagagctgctatt

SEQ ID NO: 7743077 - DNA, 22 bp, Homo sapiens
tgtggcagtctcactggagggc

SEQ ID NO: 7743078 - DNA, 22 bp, Homo sapiens
tgtggccaggcccctgatggtg

SEQ ID NO: 7743079 - DNA, 22 bp, Homo sapiens
tgtggccagggggccatgtccc

SEQ ID NO: 7743080 - DNA, 22 bp, Homo sapiens
tgtggccaggaaaaggagatgg

SEQ ID NO: 7743081 - DNA, 19 bp, Homo sapiens
tgtggccatggttcagctg

SEQ ID NO: 7743082 - DNA, 22 bp, Homo sapiens
tgtggaggattctgatgccagc

SEQ ID NO: 7743083 - DNA, 22 bp, Homo sapiens
tgtggcagaactgggactcaaa

SEQ ID NO: 7743084 - DNA, 22 bp, Homo sapiens
tgtggcagagagagcttccttg

SEQ ID NO: 7743085 - DNA, 22 bp, Homo sapiens
tgtggcagagtaaggacccagt

SEQ ID NO: 7743086 - DNA, 22 bp, Homo sapiens
tgtgtaaatttatttacataaa

SEQ ID NO: 7743087 - DNA, 18 bp, Homo sapiens
tgtggtggagctgccttc

SEQ ID NO: 7743088 - DNA, 22 bp, Homo sapiens
tgtgggtttaagaggcagcatg

SEQ ID NO: 7743089 - DNA, 22 bp, Homo sapiens
tgtggcctcctgttcctgggta

SEQ ID NO: 7743090 - DNA, 19 bp, Homo sapiens
tgtgtcctagcagccagtc

SEQ ID NO: 7743091 - DNA, 22 bp, Homo sapiens
tgtgtcctgcagacagactcag

SEQ ID NO: 7743092 - DNA, 22 bp, Homo sapiens
tgtgtcctttggaggatcagcg

SEQ ID NO: 7743093 - DNA, 22 bp, Homo sapiens
tgtgtctgttttgctcaccatt

SEQ ID NO: 7743094 - DNA, 22 bp, Homo sapiens
tgttctaagctgccaaaatgct

SEQ ID NO: 7743095 - DNA, 22 bp, Homo sapiens
tgttccttcacagcagtggaca

SEQ ID NO: 7743096 - DNA, 22 bp, Homo sapiens
tgtttaatttcacaaagttgac

SEQ ID NO: 7743097 - DNA, 22 bp, Homo sapiens
tgtttaattcaccatcatgttc

SEQ ID NO: 7743098 - DNA, 21 bp, Homo sapiens
tgtttaatacatatttgtgga

SEQ ID NO: 7743099 - DNA, 22 bp, Homo sapiens
tgttttcacaatgatgtcagat

SEQ ID NO: 7743100 - DNA, 19 bp, Homo sapiens
tgttttcaagtgggattat

SEQ ID NO: 7743101 - DNA, 22 bp, Homo sapiens
tgtttcttgggtgctcacatca

SEQ ID NO: 7743102 - DNA, 22 bp, Homo sapiens
tgtgttcaatcaccaaaggtat

SEQ ID NO: 7743103 - DNA, 22 bp, Homo sapiens
tgtgttcttaaaagcagtgata

SEQ ID NO: 7743104 - DNA, 21 bp, Homo sapiens
tgtgttcttctaggtcagcta

SEQ ID NO: 7743105 - DNA, 22 bp, Homo sapiens
tgtgttttatctattgtatctt

SEQ ID NO: 7743106 - DNA, 22 bp, Homo sapiens
tgttatcacttgtaaaagcaat

SEQ ID NO: 7743107 - DNA, 22 bp, Homo sapiens
tgttcctgacggccaaagaggt

SEQ ID NO: 7743108 - DNA, 22 bp, Homo sapiens
ttaacttgtcagaaaatacagt

SEQ ID NO: 7743109 - DNA, 22 bp, Homo sapiens
ttaagtaagaccttatgtcttg

SEQ ID NO: 7743110 - DNA, 22 bp, Homo sapiens
ttaagtgtcataatttccaaga

SEQ ID NO: 7743111 - DNA, 22 bp, Homo sapiens
ttaattacaaaacacataggtt

SEQ ID NO: 7743112 - DNA, 22 bp, Homo sapiens
ttaataaacaggtgcagctgaa

SEQ ID NO: 7743113 - DNA, 22 bp, Homo sapiens
ttaataaacaggtgcagctgaa

SEQ ID NO: 7743114 - DNA, 22 bp, Homo sapiens
ttaataaagtatgaattggaaa

SEQ ID NO: 7743115 - DNA, 22 bp, Homo sapiens
ttaaatattatgttgtctgcaa

SEQ ID NO: 7743116 - DNA, 22 bp, Homo sapiens
ttaaatattatgttgtctgcaa

SEQ ID NO: 7743117 - DNA, 22 bp, Homo sapiens
ttaaatattttcagcagggtca

SEQ ID NO: 7743118 - DNA, 22 bp, Homo sapiens
ttaaagcatgttgcttaacagg

SEQ ID NO: 7743119 - DNA, 22 bp, Homo sapiens
ttaaagcatcctgtcagtctgt

SEQ ID NO: 7743120 - DNA, 22 bp, Homo sapiens
ttaaagcatcacactattaatt

SEQ ID NO: 7743121 - DNA, 22 bp, Homo sapiens
ttaaattaggactctagttctg

SEQ ID NO: 7743122 - DNA, 22 bp, Homo sapiens
ttaaatgacttttattattctc

SEQ ID NO: 7743123 - DNA, 22 bp, Homo sapiens
ttaaatgatgcatatcatttag

SEQ ID NO: 7743124 - DNA, 22 bp, Homo sapiens
ttaaatgaggctgatgtagatt

SEQ ID NO: 7743125 - DNA, 22 bp, Homo sapiens
ttacacagttggtaggggcaga

SEQ ID NO: 7743126 - DNA, 22 bp, Homo sapiens
ttacagtagattttgaatgtgg

SEQ ID NO: 7743127 - DNA, 22 bp, Homo sapiens
ttacagtagatacaatgagtaa

SEQ ID NO: 7743128 - DNA, 22 bp, Homo sapiens
ttactagtatatgtcaagcaac

SEQ ID NO: 7743129 - DNA, 22 bp, Homo sapiens
ttagaggggctgctgaatggga

SEQ ID NO: 7743130 - DNA, 22 bp, Homo sapiens
ttagagagaaccatcaggatct

SEQ ID NO: 7743131 - DNA, 22 bp, Homo sapiens
ttagaaagctttccatagtcaa

SEQ ID NO: 7743132 - DNA, 22 bp, Homo sapiens
ttactttcaaaaactacgtggg

SEQ ID NO: 7743133 - DNA, 22 bp, Homo sapiens
tttgtactggaagaacatgcaa

SEQ ID NO: 7743134 - DNA, 22 bp, Homo sapiens
tttgtttgaaagtctctacagc

SEQ ID NO: 7743135 - DNA, 22 bp, Homo sapiens
tttggactgcatgatgatctgg

SEQ ID NO: 7743136 - DNA, 22 bp, Homo sapiens
tttggacttagcctgcagaatt

SEQ ID NO: 7743137 - DNA, 22 bp, Homo sapiens
ttttggcactgcgtctacatgg

SEQ ID NO: 7743138 - DNA, 22 bp, Homo sapiens
tttttccttaggggttactcac

SEQ ID NO: 7743139 - DNA, 22 bp, Homo sapiens
tttttcctagtgctttctggta

SEQ ID NO: 7743140 - DNA, 22 bp, Homo sapiens
ttttggatgagcccagatttct

SEQ ID NO: 7743141 - DNA, 22 bp, Homo sapiens
ttttctaaaagaagtcactgat

SEQ ID NO: 7743142 - DNA, 22 bp, Homo sapiens
ttttctaacatctagtaatttg

SEQ ID NO: 7743143 - DNA, 22 bp, Homo sapiens
ttttctaaaatatccaggacag

SEQ ID NO: 7743144 - DNA, 22 bp, Homo sapiens
ttttctaatttagttaccctcc

SEQ ID NO: 7743145 - DNA, 22 bp, Homo sapiens
ttttctaactttacactcgaaa

SEQ ID NO: 7743146 - DNA, 22 bp, Homo sapiens
tttttccttggatgtgtctctc

SEQ ID NO: 7743147 - DNA, 22 bp, Homo sapiens
tttttgaaggctgatgtgatta

SEQ ID NO: 7743148 - DNA, 22 bp, Homo sapiens
ttgtgttaaggtgcatctagtg

SEQ ID NO: 7743149 - DNA, 22 bp, Homo sapiens
ttgttttctccactgcatctta

SEQ ID NO: 7743150 - DNA, 22 bp, Homo sapiens
ttgtttgtaaggctcttagaat

SEQ ID NO: 7743151 - DNA, 22 bp, Homo sapiens
ttgtctgaagtcacacagatgc

SEQ ID NO: 7743152 - DNA, 22 bp, Homo sapiens
ttgtctgaaccatctccctggc

SEQ ID NO: 7743153 - DNA, 22 bp, Homo sapiens
ttgtctgaattcttctaggcag

SEQ ID NO: 7743154 - DNA, 22 bp, Homo sapiens
ttgtctgacttctttagttact

SEQ ID NO: 7743155 - DNA, 22 bp, Homo sapiens
ttgtctgaatctggagctctct

SEQ ID NO: 7743156 - DNA, 22 bp, Homo sapiens
ttgtctgaatatgtatgtatcc

SEQ ID NO: 7743157 - DNA, 22 bp, Homo sapiens
ttgtctgagggtttgagagaat

SEQ ID NO: 7743158 - DNA, 22 bp, Homo sapiens
ttgtctgagagatggcagaggt

SEQ ID NO: 7743159 - DNA, 22 bp, Homo sapiens
ttgtctgagaaagtgagttgct

SEQ ID NO: 7743160 - DNA, 22 bp, Homo sapiens
ttgtctgatgttccctcatgat

SEQ ID NO: 7743161 - DNA, 22 bp, Homo sapiens
ttgtgaatagtgctgcaataaa

SEQ ID NO: 7743162 - DNA, 23 bp, Homo sapiens
ttgtccttctgaaatatatctgg

SEQ ID NO: 7743163 - DNA, 23 bp, Homo sapiens
ttgtaaaacagtgtgacggttcc

SEQ ID NO: 7743164 - DNA, 22 bp, Homo sapiens
ttgtccttgtgatagtttgctg

SEQ ID NO: 7743165 - DNA, 22 bp, Homo sapiens
ttgcaacattgtaagtttatat

SEQ ID NO: 7743166 - DNA, 22 bp, Homo sapiens
ttgcaactaaaagaacttgaca

SEQ ID NO: 7743167 - DNA, 23 bp, Homo sapiens
ttgcaaatttcagttagttcatg

SEQ ID NO: 7743168 - DNA, 22 bp, Homo sapiens
ttgcaattaacatatgtcaact

SEQ ID NO: 7743169 - DNA, 21 bp, Homo sapiens
tttaatttgcatgtatgacgc

SEQ ID NO: 7743170 - DNA, 22 bp, Homo sapiens
tttaattagcaagccagagagc

SEQ ID NO: 7743171 - DNA, 22 bp, Homo sapiens
tttaatttgaaatgagtaaccc

SEQ ID NO: 7743172 - DNA, 22 bp, Homo sapiens
tttactaagtacttgtatccct

SEQ ID NO: 7743173 - DNA, 22 bp, Homo sapiens
tttacaagtacacctaacagct

SEQ ID NO: 7743174 - DNA, 22 bp, Homo sapiens
tttacaaggcagttattttcct

SEQ ID NO: 7743175 - DNA, 22 bp, Homo sapiens
tttacaaggcagaactgattaa

SEQ ID NO: 7743176 - DNA, 22 bp, Homo sapiens
tttacaagaaatcatgatgcta

SEQ ID NO: 7743177 - DNA, 22 bp, Homo sapiens
tttacaaggatcaagggatctc

SEQ ID NO: 7743178 - DNA, 22 bp, Homo sapiens
tttactgttcaacttgcaagta

SEQ ID NO: 7743179 - DNA, 17 bp, Homo sapiens
tttataattggcctctt

SEQ ID NO: 7743180 - DNA, 20 bp, Homo sapiens
tttatagtgatcaatttata

SEQ ID NO: 7743181 - DNA, 22 bp, Homo sapiens
tttattaatgtagcatccatgg

SEQ ID NO: 7743182 - DNA, 22 bp, Homo sapiens
tttcttccaaaggcacgttctc

SEQ ID NO: 7743183 - DNA, 20 bp, Homo sapiens
tttctgtgcccaggtctgtt

SEQ ID NO: 7743184 - DNA, 20 bp, Homo sapiens
tttctgtgatagagaggtgt

SEQ ID NO: 7743185 - DNA, 22 bp, Homo sapiens
tttctgttaggcatcattttaa

SEQ ID NO: 7743186 - DNA, 22 bp, Homo sapiens
tttctgaattcctaggatgttg

SEQ ID NO: 7743187 - DNA, 22 bp, Homo sapiens
tttctggcagcgggacaggggt

SEQ ID NO: 7743188 - DNA, 22 bp, Homo sapiens
tttctgaagatacagctttgct

SEQ ID NO: 7743189 - DNA, 22 bp, Homo sapiens
tttctctttgacaggaatcaga

SEQ ID NO: 7743190 - DNA, 22 bp, Homo sapiens
tttcaggagagaccagaaatga

SEQ ID NO: 7743191 - DNA, 22 bp, Homo sapiens
tttctaagtgtgtttcatagga

SEQ ID NO: 7743192 - DNA, 22 bp, Homo sapiens
tttctaagtgtgtttcatagga

SEQ ID NO: 7743193 - DNA, 22 bp, Homo sapiens
tttctaatatcacttccagctg

SEQ ID NO: 7743194 - DNA, 21 bp, Homo sapiens
tttctaagtgcttggtttggg

SEQ ID NO: 7743195 - DNA, 22 bp, Homo sapiens
tttctaagtgtattgagcttgg

SEQ ID NO: 7743196 - DNA, 22 bp, Homo sapiens
tttctaagtgtattgagcttgg

SEQ ID NO: 7743197 - DNA, 22 bp, Homo sapiens
tttctaagtgtgattttagatt

SEQ ID NO: 7743198 - DNA, 22 bp, Homo sapiens
tttctaagtgtgattttagatt

SEQ ID NO: 7743199 - DNA, 22 bp, Homo sapiens
tttctaagtgtgtttcatagga

SEQ ID NO: 7743200 - DNA, 21 bp, Homo sapiens
tttctaagtgcttggtttggg

SEQ ID NO: 7743201 - DNA, 22 bp, Homo sapiens
tttctaagtgaacattcaagtt

SEQ ID NO: 7743202 - DNA, 22 bp, Homo sapiens
tttctaagtgaacattcaagtt

SEQ ID NO: 7743203 - DNA, 22 bp, Homo sapiens
tttctaagtatcttgcagtttt

SEQ ID NO: 7743204 - DNA, 22 bp, Homo sapiens
tttctaagtatcttgcagtttt

SEQ ID NO: 7743205 - DNA, 21 bp, Homo sapiens
tttctaagtaactggcagcat

SEQ ID NO: 7743206 - DNA, 22 bp, Homo sapiens
tttctaagtatcttgcagtttt

SEQ ID NO: 7743207 - DNA, 22 bp, Homo sapiens
tttctaagtaagattaacttct

SEQ ID NO: 7743208 - DNA, 22 bp, Homo sapiens
tttctaagtaaacacagcatac

SEQ ID NO: 7743209 - DNA, 22 bp, Homo sapiens
tttctaagtaaacacagcatac

SEQ ID NO: 7743210 - DNA, 22 bp, Homo sapiens
tttcctgtgcttaacaaatatt

SEQ ID NO: 7743211 - DNA, 22 bp, Homo sapiens
tttctaaggtgatcctttctta

SEQ ID NO: 7743212 - DNA, 22 bp, Homo sapiens
tttctcatctggaaacagtgct

SEQ ID NO: 7743213 - DNA, 22 bp, Homo sapiens
tttctcagttctctgcaaggag

SEQ ID NO: 7743214 - DNA, 22 bp, Homo sapiens
caagccagtgatgtttgctgcc

SEQ ID NO: 7743215 - DNA, 22 bp, Homo sapiens
gctttcttcatactcaagcatc

SEQ ID NO: 7743216 - DNA, 22 bp, Homo sapiens
caagttttagaaatatctggat

SEQ ID NO: 7743217 - DNA, 22 bp, Homo sapiens
caagtttgctgatccttgtttt

SEQ ID NO: 7743218 - DNA, 18 bp, Homo sapiens
gctttctgtagaaaaggg

SEQ ID NO: 7743219 - DNA, 22 bp, Homo sapiens
gctttctgtggtgatgtaaagg

SEQ ID NO: 7743220 - DNA, 22 bp, Homo sapiens
gctttctgtgcagtgaacacta

SEQ ID NO: 7743221 - DNA, 22 bp, Homo sapiens
gctttctgctctgtaaaatggg

SEQ ID NO: 7743222 - DNA, 22 bp, Homo sapiens
gctttctggttctcaaagcact

SEQ ID NO: 7743223 - DNA, 22 bp, Homo sapiens
gctttctgggctatagaacggg

SEQ ID NO: 7743224 - DNA, 22 bp, Homo sapiens
ggaaggggccttgagcaaactg

SEQ ID NO: 7743225 - DNA, 22 bp, Homo sapiens
ggactgggattctggatctgct

SEQ ID NO: 7743226 - DNA, 22 bp, Homo sapiens
ggactgggtaggagcccagggc

SEQ ID NO: 7743227 - DNA, 22 bp, Homo sapiens
ggaggcagaatagagtgtgggt

SEQ ID NO: 7743228 - DNA, 22 bp, Homo sapiens
cacgagggcacacgtgggaggg

SEQ ID NO: 7743229 - DNA, 22 bp, Homo sapiens
ggcatttatttgtctcattctt

SEQ ID NO: 7743230 - DNA, 20 bp, Homo sapiens
ggcatttatgaaccaagcct

SEQ ID NO: 7743231 - DNA, 22 bp, Homo sapiens
ggccaaatttatttgcagctgg

SEQ ID NO: 7743232 - DNA, 22 bp, Homo sapiens
ggccaaatgaaggcaatgggac

SEQ ID NO: 7743233 - DNA, 22 bp, Homo sapiens
ggccaaatctgtaaggcaagat

SEQ ID NO: 7743234 - DNA, 22 bp, Homo sapiens
ggccaaatgaaatctgagcaat

SEQ ID NO: 7743235 - DNA, 22 bp, Homo sapiens
ggccaaatttggccatgagcat

SEQ ID NO: 7743236 - DNA, 22 bp, Homo sapiens
ggccaaatcctccatggtggct

SEQ ID NO: 7743237 - DNA, 22 bp, Homo sapiens
cacatacatacgtatgtataca

SEQ ID NO: 7743238 - DNA, 22 bp, Homo sapiens
cagaaaagggtgtttgttcagg

SEQ ID NO: 7743239 - DNA, 22 bp, Homo sapiens
ggctgggaggatgacttgctac

SEQ ID NO: 7743240 - DNA, 20 bp, Homo sapiens
ggcctgagcatggctggcag

SEQ ID NO: 7743241 - DNA, 22 bp, Homo sapiens
ggctctggtgggaaggttagat

SEQ ID NO: 7743242 - DNA, 22 bp, Homo sapiens
ggctctggtgccctggctccca

SEQ ID NO: 7743243 - DNA, 22 bp, Homo sapiens
ggctgaggcggcgatgcccttg

SEQ ID NO: 7743244 - DNA, 22 bp, Homo sapiens
gtcatatacactgcatgtaatc

SEQ ID NO: 7743245 - DNA, 22 bp, Homo sapiens
gtcatagaggcctatataattt

SEQ ID NO: 7743246 - DNA, 19 bp, Homo sapiens
gtcccttcactcctgctgg

SEQ ID NO: 7743247 - DNA, 22 bp, Homo sapiens
cagccctgcttccccgctagtt

SEQ ID NO: 7743248 - DNA, 22 bp, Homo sapiens
cagccctgcagccatggcctgt

SEQ ID NO: 7743249 - DNA, 22 bp, Homo sapiens
cagccctggcccaggtgcctta

SEQ ID NO: 7743250 - DNA, 22 bp, Homo sapiens
cagagggctgtgtaaggatgtt

SEQ ID NO: 7743251 - DNA, 22 bp, Homo sapiens
cagagggctgccctgagttcgt

SEQ ID NO: 7743252 - DNA, 22 bp, Homo sapiens
cagagggctcggcggccgctcc

SEQ ID NO: 7743253 - DNA, 22 bp, Homo sapiens
cagcaagagttggggttgttgg

SEQ ID NO: 7743254 - DNA, 22 bp, Homo sapiens
ggtctggaataaggtccaggaa

SEQ ID NO: 7743255 - DNA, 22 bp, Homo sapiens
gggctgaggggtatctcatggg

SEQ ID NO: 7743256 - DNA, 22 bp, Homo sapiens
gggctgagtgacctcaggccaa

SEQ ID NO: 7743257 - DNA, 22 bp, Homo sapiens
gggctgaactcaagtcagctcc

SEQ ID NO: 7743258 - DNA, 22 bp, Homo sapiens
gggctgaaaggccgcctcagat

SEQ ID NO: 7743259 - DNA, 22 bp, Homo sapiens
gaaaatgttagcttcatagtca

SEQ ID NO: 7743260 - DNA, 22 bp, Homo sapiens
gaaacattcagtcaacagtgtt

SEQ ID NO: 7743261 - DNA, 22 bp, Homo sapiens
gaaacattgagcagaaggagaa

SEQ ID NO: 7743262 - DNA, 22 bp, Homo sapiens
atgacagtaggtaaatgatagc

SEQ ID NO: 7743263 - DNA, 22 bp, Homo sapiens
atgaagacaaactgggtagaaa

SEQ ID NO: 7743264 - DNA, 22 bp, Homo sapiens
atgcacagaaaaattgcttact

SEQ ID NO: 7743265 - DNA, 22 bp, Homo sapiens
atgctccttggcttcaaagcca

SEQ ID NO: 7743266 - DNA, 22 bp, Homo sapiens
atgctctgggcaggagccctgg

SEQ ID NO: 7743267 - DNA, 22 bp, Homo sapiens
gactgggagggttcagctgggt

SEQ ID NO: 7743268 - DNA, 22 bp, Homo sapiens
atgtttaagaaagtcttccata

SEQ ID NO: 7743269 - DNA, 20 bp, Homo sapiens
gagggctcgtggatggataa

SEQ ID NO: 7743270 - DNA, 22 bp, Homo sapiens
gagggctctgaaaggaggtcac

SEQ ID NO: 7743271 - DNA, 22 bp, Homo sapiens
gagggctgaagattgtggcccc

SEQ ID NO: 7743272 - DNA, 22 bp, Homo sapiens
gagggctctgtctggaagggaa

SEQ ID NO: 7743273 - DNA, 22 bp, Homo sapiens
atggtgtccccagcctttgaag

SEQ ID NO: 7743274 - DNA, 22 bp, Homo sapiens
atgggctgggatctgagtgtca

SEQ ID NO: 7743275 - DNA, 22 bp, Homo sapiens
atgggctgtccattgctggctg

SEQ ID NO: 7743276 - DNA, 22 bp, Homo sapiens
atgggctgacccagtcgtggca

SEQ ID NO: 7743277 - DNA, 22 bp, Homo sapiens
atgggctgaggaagctcctgag

SEQ ID NO: 7743278 - DNA, 22 bp, Homo sapiens
atgggctgaggtgggatagaag

SEQ ID NO: 7743279 - DNA, 22 bp, Homo sapiens
attcataagtaaatgattacct

SEQ ID NO: 7743280 - DNA, 22 bp, Homo sapiens
attcaacatattctgagtaaaa

SEQ ID NO: 7743281 - DNA, 22 bp, Homo sapiens
gatttccaggacgggaggtggg

SEQ ID NO: 7743282 - DNA, 22 bp, Homo sapiens
gatttcctagacatggggcaga

SEQ ID NO: 7743283 - DNA, 22 bp, Homo sapiens
gatttcctaatgtggatctctg

SEQ ID NO: 7743284 - DNA, 17 bp, Homo sapiens
gatttcctgaagttctt

SEQ ID NO: 7743285 - DNA, 22 bp, Homo sapiens
gatttccatgattgggccagaa

SEQ ID NO: 7743286 - DNA, 19 bp, Homo sapiens
gatattgcttgagtaactg

SEQ ID NO: 7743287 - DNA, 22 bp, Homo sapiens
attacagtgggtaaacagaatt

SEQ ID NO: 7743288 - DNA, 22 bp, Homo sapiens
attgtccatctccacattaatg

SEQ ID NO: 7743289 - DNA, 22 bp, Homo sapiens
gccaaatactggaatcatagaa

SEQ ID NO: 7743290 - DNA, 22 bp, Homo sapiens
gccaaatataattctccacctt

SEQ ID NO: 7743291 - DNA, 22 bp, Homo sapiens
gccaaataccattaaccagaaa

SEQ ID NO: 7743292 - DNA, 22 bp, Homo sapiens
gccaaatatggtggacagtttg

SEQ ID NO: 7743293 - DNA, 22 bp, Homo sapiens
gccaaatacagtagtcattgcc

SEQ ID NO: 7743294 - DNA, 22 bp, Homo sapiens
gccaaataagtggaatcacaca

SEQ ID NO: 7743295 - DNA, 22 bp, Homo sapiens
gccaaataagtgtccggccctc

SEQ ID NO: 7743296 - DNA, 22 bp, Homo sapiens
gccaaactacaagttaaatttt

SEQ ID NO: 7743297 - DNA, 22 bp, Homo sapiens
caaacattcagatgcaatggta

SEQ ID NO: 7743298 - DNA, 22 bp, Homo sapiens
caaacattcaagtacaagtctt

SEQ ID NO: 7743299 - DNA, 22 bp, Homo sapiens
caaagctgtaccccaacctatg

SEQ ID NO: 7743300 - DNA, 22 bp, Homo sapiens
caaagctgtgaattcctacaaa

SEQ ID NO: 7743301 - DNA, 21 bp, Homo sapiens
caaatacttagaaacttaaga

SEQ ID NO: 7743302 - DNA, 22 bp, Homo sapiens
caaatactttatatacttcaaa

SEQ ID NO: 7743303 - DNA, 22 bp, Homo sapiens
caaatactgggtaagttaattt

SEQ ID NO: 7743304 - DNA, 22 bp, Homo sapiens
atttccaggctgttttgtgaat

SEQ ID NO: 7743305 - DNA, 22 bp, Homo sapiens
gcctagggttggcctgagaatc

SEQ ID NO: 7743306 - DNA, 20 bp, Homo sapiens
gcctagggtcacttcagtga

SEQ ID NO: 7743307 - DNA, 22 bp, Homo sapiens
gcctagggtgctcagggacgag

SEQ ID NO: 7743308 - DNA, 21 bp, Homo sapiens
gcctagggagatgggactgcc

SEQ ID NO: 7743309 - DNA, 22 bp, Homo sapiens
gcctagggatgacaaatattct

SEQ ID NO: 7743310 - DNA, 22 bp, Homo sapiens
gcctaggggtaagagtactggc

SEQ ID NO: 7743311 - DNA, 20 bp, Homo sapiens
gcctaggggttgggaaagca

SEQ ID NO: 7743312 - DNA, 22 bp, Homo sapiens
atcaacatgtgagagcaccagt

SEQ ID NO: 7743313 - DNA, 22 bp, Homo sapiens
atcaacttaaagaaaagatact

SEQ ID NO: 7743314 - DNA, 22 bp, Homo sapiens
atatttaactggtcccaatata

SEQ ID NO: 7743315 - DNA, 22 bp, Homo sapiens
ctgggctctgcggtgtcgctct

SEQ ID NO: 7743316 - DNA, 22 bp, Homo sapiens
ctgggctcacctgtggctggca

SEQ ID NO: 7743317 - DNA, 22 bp, Homo sapiens
ctgggctcagatgagaggaagg

SEQ ID NO: 7743318 - DNA, 22 bp, Homo sapiens
ctgggctcagcaggccaaggcc

SEQ ID NO: 7743319 - DNA, 20 bp, Homo sapiens
ctgggctcaagtgagcctcc

SEQ ID NO: 7743320 - DNA, 22 bp, Homo sapiens
atcctgggctgcaccctcagcc

SEQ ID NO: 7743321 - DNA, 18 bp, Homo sapiens
atcctgggccagtctttc

SEQ ID NO: 7743322 - DNA, 22 bp, Homo sapiens
atcctgggcaagtcaatgtccc

SEQ ID NO: 7743323 - DNA, 22 bp, Homo sapiens
cttagagatgggttttacttag

SEQ ID NO: 7743324 - DNA, 22 bp, Homo sapiens
atactacatactatgtaaacat

SEQ ID NO: 7743325 - DNA, 22 bp, Homo sapiens
atactacatttgaaaattgcag

SEQ ID NO: 7743326 - DNA, 22 bp, Homo sapiens
atactacatactatgtaaacat

SEQ ID NO: 7743327 - DNA, 22 bp, Homo sapiens
atactatattaccttctcaact

SEQ ID NO: 7743328 - DNA, 22 bp, Homo sapiens
ataccacaacatggctcagagg

SEQ ID NO: 7743329 - DNA, 22 bp, Homo sapiens
ataccacaacatggctcagagg

SEQ ID NO: 7743330 - DNA, 22 bp, Homo sapiens
ataagatataaatccacagagt

SEQ ID NO: 7743331 - DNA, 22 bp, Homo sapiens
ataatttactaagctctacctt

SEQ ID NO: 7743332 - DNA, 22 bp, Homo sapiens
atacaacagaaaatgattattc

SEQ ID NO: 7743333 - DNA, 22 bp, Homo sapiens
ctgaggagaggtggcctgtgtt

SEQ ID NO: 7743334 - DNA, 22 bp, Homo sapiens
ctctgggaagggctgagcactg

SEQ ID NO: 7743335 - DNA, 22 bp, Homo sapiens
ctctgggactagaaccccaggg

SEQ ID NO: 7743336 - DNA, 22 bp, Homo sapiens
ctctgggaccatggcaagtgcg

SEQ ID NO: 7743337 - DNA, 22 bp, Homo sapiens
ctctgggacatcccttggccta

SEQ ID NO: 7743338 - DNA, 22 bp, Homo sapiens
ctcctgggaaaggctggacaca

SEQ ID NO: 7743339 - DNA, 22 bp, Homo sapiens
ctcctgggaatttagttgtgag

SEQ ID NO: 7743340 - DNA, 20 bp, Homo sapiens
ctcctgggactgctggttat

SEQ ID NO: 7743341 - DNA, 22 bp, Homo sapiens
ctcctggggccatggaaggaac

SEQ ID NO: 7743342 - DNA, 22 bp, Homo sapiens
ctcctggggcacttagaagcaa

SEQ ID NO: 7743343 - DNA, 22 bp, Homo sapiens
ctcctgggggacagcggcaggg

SEQ ID NO: 7743344 - DNA, 22 bp, Homo sapiens
ctcctaggtgctcactggggtc

SEQ ID NO: 7743345 - DNA, 22 bp, Homo sapiens
ctcctaggtaacagggtggttt

SEQ ID NO: 7743346 - DNA, 20 bp, Homo sapiens
ctccagggaacagactggag

SEQ ID NO: 7743347 - DNA, 22 bp, Homo sapiens
agtccataattttcatatctga

SEQ ID NO: 7743348 - DNA, 22 bp, Homo sapiens
agtccatagtttacattacagc

SEQ ID NO: 7743349 - DNA, 22 bp, Homo sapiens
ctagggtctgttttccaggtgt

SEQ ID NO: 7743350 - DNA, 22 bp, Homo sapiens
ctaggggcatgaaatagagaat

SEQ ID NO: 7743351 - DNA, 22 bp, Homo sapiens
agtatttagagacacaagatgg

SEQ ID NO: 7743352 - DNA, 22 bp, Homo sapiens
agtatttcctggcttatctgct

SEQ ID NO: 7743353 - DNA, 17 bp, Homo sapiens
cgggcatggagggcagg

SEQ ID NO: 7743354 - DNA, 22 bp, Homo sapiens
cggctcagctagcttggcccca

SEQ ID NO: 7743355 - DNA, 22 bp, Homo sapiens
agtaaaaagttcagaatggttg

SEQ ID NO: 7743356 - DNA, 22 bp, Homo sapiens
cctgttctaatcttggggcaga

SEQ ID NO: 7743357 - DNA, 22 bp, Homo sapiens
cctgtgcaatgttgaggtttca

SEQ ID NO: 7743358 - DNA, 22 bp, Homo sapiens
cctgggctttgagggcaggatg

SEQ ID NO: 7743359 - DNA, 22 bp, Homo sapiens
cctgggctcaggcttgggcagc

SEQ ID NO: 7743360 - DNA, 22 bp, Homo sapiens
cctgggctccactccaagagca

SEQ ID NO: 7743361 - DNA, 22 bp, Homo sapiens
cctgggctcacagccaaggctc

SEQ ID NO: 7743362 - DNA, 22 bp, Homo sapiens
catgagggttggggtggagctt

SEQ ID NO: 7743363 - DNA, 22 bp, Homo sapiens
aggatgagagatacatggagca

SEQ ID NO: 7743364 - DNA, 22 bp, Homo sapiens
aggaggctgaactagggtctgg

SEQ ID NO: 7743365 - DNA, 22 bp, Homo sapiens
catacagagaaggataataaag

SEQ ID NO: 7743366 - DNA, 22 bp, Homo sapiens
catttctgattacagaatacta

SEQ ID NO: 7743367 - DNA, 22 bp, Homo sapiens
caggactgaagggcacagggaa

SEQ ID NO: 7743368 - DNA, 22 bp, Homo sapiens
caggactggaagtctcaagaga

SEQ ID NO: 7743369 - DNA, 22 bp, Homo sapiens
cagctggtactcagttcttgtc

SEQ ID NO: 7743370 - DNA, 22 bp, Homo sapiens
cagctgtgtctaattatggctg

SEQ ID NO: 7743371 - DNA, 21 bp, Homo sapiens
caggctctgctagaggagcct

SEQ ID NO: 7743372 - DNA, 22 bp, Homo sapiens
agcttactcttcaagaacaagc

SEQ ID NO: 7743373 - DNA, 22 bp, Homo sapiens
cagtaactgatgtgatcaaacg

SEQ ID NO: 7743374 - DNA, 22 bp, Homo sapiens
aggacagcaaccgttattcaca

SEQ ID NO: 7743375 - DNA, 22 bp, Homo sapiens
cagtaacatgaagagacatgga

SEQ ID NO: 7743376 - DNA, 22 bp, Homo sapiens
cagtaacacaaccactccgtga

SEQ ID NO: 7743377 - DNA, 22 bp, Homo sapiens
aggaagtgggaagggtctgcca

SEQ ID NO: 7743378 - DNA, 22 bp, Homo sapiens
agctttggatgatctttgatac

SEQ ID NO: 7743379 - DNA, 22 bp, Homo sapiens
aggaagagcccgggtgacataa

SEQ ID NO: 7743380 - DNA, 22 bp, Homo sapiens
aggaagagctggaccagaggac

SEQ ID NO: 7743381 - DNA, 22 bp, Homo sapiens
aggaagagggtggcagataatc

SEQ ID NO: 7743382 - DNA, 23 bp, Homo sapiens
aggaagaggcaatttctcttaga

SEQ ID NO: 7743383 - DNA, 20 bp, Homo sapiens
aggctcagatacccagggaa

SEQ ID NO: 7743384 - DNA, 22 bp, Homo sapiens
aggctcagcccctgggaggaga

SEQ ID NO: 7743385 - DNA, 22 bp, Homo sapiens
agggcagaccacgtgcaaggat

SEQ ID NO: 7743386 - DNA, 22 bp, Homo sapiens
agggcagaaaccaccttgatgg

SEQ ID NO: 7743387 - DNA, 21 bp, Homo sapiens
agggagctttaggtagaagtt

SEQ ID NO: 7743388 - DNA, 22 bp, Homo sapiens
ccctgaggatagggcaggaccc

SEQ ID NO: 7743389 - DNA, 22 bp, Homo sapiens
ccctgaggggagtggtgaggtg

SEQ ID NO: 7743390 - DNA, 22 bp, Homo sapiens
ccctgaggctgaggataggtgg

SEQ ID NO: 7743391 - DNA, 22 bp, Homo sapiens
ccctgaggcagtaggagctttt

SEQ ID NO: 7743392 - DNA, 22 bp, Homo sapiens
agggagctgggccacactgatc

SEQ ID NO: 7743393 - DNA, 22 bp, Homo sapiens
agggagcttctacttcaaggca

SEQ ID NO: 7743394 - DNA, 22 bp, Homo sapiens
agggaccttgatgggtttggga

SEQ ID NO: 7743395 - DNA, 23 bp, Homo sapiens
cctcagggtctagcagagagaag

SEQ ID NO: 7743396 - DNA, 22 bp, Homo sapiens
cctcaggggtcactgtgaggag

SEQ ID NO: 7743397 - DNA, 22 bp, Homo sapiens
cctcagggaggcctctgtggct

SEQ ID NO: 7743398 - DNA, 18 bp, Homo sapiens
cctcagggagatccagtg

SEQ ID NO: 7743399 - DNA, 22 bp, Homo sapiens
agggctgagcccaggcatgtag

SEQ ID NO: 7743400 - DNA, 20 bp, Homo sapiens
agggctgagaagggactagc

SEQ ID NO: 7743401 - DNA, 22 bp, Homo sapiens
agggctgagactaaggccagat

SEQ ID NO: 7743402 - DNA, 22 bp, Homo sapiens
aggggctctgagtgggccagga

SEQ ID NO: 7743403 - DNA, 22 bp, Homo sapiens
acaggcaagtacacaggctcat

SEQ ID NO: 7743404 - DNA, 22 bp, Homo sapiens
acaggacagtctagtaacagta

SEQ ID NO: 7743405 - DNA, 21 bp, Homo sapiens
acagcatgtttgtgtgtttgc

SEQ ID NO: 7743406 - DNA, 22 bp, Homo sapiens
acagcagtggtgcactgagcca

SEQ ID NO: 7743407 - DNA, 22 bp, Homo sapiens
acagcagttaacgatcagactc

SEQ ID NO: 7743408 - DNA, 22 bp, Homo sapiens
acagcagtttagaggacagcca

SEQ ID NO: 7743409 - DNA, 22 bp, Homo sapiens
acaggaagaaagtgcagtagat

SEQ ID NO: 7743410 - DNA, 22 bp, Homo sapiens
acagcttctctgaaattcatgt

SEQ ID NO: 7743411 - DNA, 22 bp, Homo sapiens
acaggaagtgctggcacttaca

SEQ ID NO: 7743412 - DNA, 22 bp, Homo sapiens
acaggaagctggagacccttga

SEQ ID NO: 7743413 - DNA, 22 bp, Homo sapiens
acaggaagtgggaagaaacagg

SEQ ID NO: 7743414 - DNA, 22 bp, Homo sapiens
acaggaagtttggaaagcctca

SEQ ID NO: 7743415 - DNA, 22 bp, Homo sapiens
aggactggccctgaggggaggc

SEQ ID NO: 7743416 - DNA, 22 bp, Homo sapiens
acagtctggaggctgcttcatt

SEQ ID NO: 7743417 - DNA, 22 bp, Homo sapiens
acagtgttcactaaggttagct

SEQ ID NO: 7743418 - DNA, 22 bp, Homo sapiens
acatctttgctcttatagagct

SEQ ID NO: 7743419 - DNA, 22 bp, Homo sapiens
aggctctgaagcaaccctttga

SEQ ID NO: 7743420 - DNA, 22 bp, Homo sapiens
aggctcctttaccattctggag

SEQ ID NO: 7743421 - DNA, 22 bp, Homo sapiens
aggctcagggacggggcccctt

SEQ ID NO: 7743422 - DNA, 22 bp, Homo sapiens
aggctcagctggtggtgatcgc

SEQ ID NO: 7743423 - DNA, 22 bp, Homo sapiens
aggggagcatctgtgatggtta

SEQ ID NO: 7743424 - DNA, 22 bp, Homo sapiens
aggggagccgaggggcatctgt

SEQ ID NO: 7743425 - DNA, 22 bp, Homo sapiens
agggctgacaaatggcagtgac

SEQ ID NO: 7743426 - DNA, 22 bp, Homo sapiens
agggctgaagggaggtgctcat

SEQ ID NO: 7743427 - DNA, 22 bp, Homo sapiens
agggcctgtcagcggtgtcctg

SEQ ID NO: 7743428 - DNA, 22 bp, Homo sapiens
agaaagaacgcacttgtgctgc

SEQ ID NO: 7743429 - DNA, 22 bp, Homo sapiens
agaaatcagaaccctgaagttc

SEQ ID NO: 7743430 - DNA, 22 bp, Homo sapiens
ataacactaaatgtatgtaaca

SEQ ID NO: 7743431 - DNA, 22 bp, Homo sapiens
agttcacagaatggccagaact

SEQ ID NO: 7743432 - DNA, 22 bp, Homo sapiens
agttgacatccataacaggaag

SEQ ID NO: 7743433 - DNA, 22 bp, Homo sapiens
ataagcttcctgttagaaaccg

SEQ ID NO: 7743434 - DNA, 22 bp, Homo sapiens
ataagcttgatgtaactaacca

SEQ ID NO: 7743435 - DNA, 22 bp, Homo sapiens
ataagctttgctggagagacct

SEQ ID NO: 7743436 - DNA, 22 bp, Homo sapiens
atacactactaagcacagattg

SEQ ID NO: 7743437 - DNA, 23 bp, Homo sapiens
atagaagattattgcaacagtcc

SEQ ID NO: 7743438 - DNA, 22 bp, Homo sapiens
atagaagaggaaactgaggttg

SEQ ID NO: 7743439 - DNA, 22 bp, Homo sapiens
atagaataaggcacagattctt

SEQ ID NO: 7743440 - DNA, 22 bp, Homo sapiens
agaaaaagtcaaggaattggac

SEQ ID NO: 7743441 - DNA, 20 bp, Homo sapiens
agaaaaagtgtggaaatttc

SEQ ID NO: 7743442 - DNA, 17 bp, Homo sapiens
agaaaagagaccagcag

SEQ ID NO: 7743443 - DNA, 17 bp, Homo sapiens
agaaaagagaccagcag

SEQ ID NO: 7743444 - DNA, 22 bp, Homo sapiens
agaaaagaggctttctaagcat

SEQ ID NO: 7743445 - DNA, 22 bp, Homo sapiens
actgggtggctgcctccttctc

SEQ ID NO: 7743446 - DNA, 22 bp, Homo sapiens
actgggtgtaaaggacttaagc

SEQ ID NO: 7743447 - DNA, 22 bp, Homo sapiens
agttacacataaacattaaagg

SEQ ID NO: 7743448 - DNA, 22 bp, Homo sapiens
agttacatataagaagacagac

SEQ ID NO: 7743449 - DNA, 21 bp, Homo sapiens
agttacatgtatagataaagt

SEQ ID NO: 7743450 - DNA, 21 bp, Homo sapiens
agttacaagtttattcagagg

SEQ ID NO: 7743451 - DNA, 22 bp, Homo sapiens
agttacaagctattttacttaa

SEQ ID NO: 7743452 - DNA, 22 bp, Homo sapiens
agttacaagtacaggctttgga

SEQ ID NO: 7743453 - DNA, 22 bp, Homo sapiens
agttacaaacactatcagttct

SEQ ID NO: 7743454 - DNA, 22 bp, Homo sapiens
agttacaaccatgacacaagca

SEQ ID NO: 7743455 - DNA, 20 bp, Homo sapiens
actctggggctcattagggg

SEQ ID NO: 7743456 - DNA, 22 bp, Homo sapiens
actctgggccccaggtggagct

SEQ ID NO: 7743457 - DNA, 22 bp, Homo sapiens
actctgggctgttaggagctgt

SEQ ID NO: 7743458 - DNA, 22 bp, Homo sapiens
actctgggcccaccctcagagt

SEQ ID NO: 7743459 - DNA, 22 bp, Homo sapiens
actctgggatcttgaaaagagt

SEQ ID NO: 7743460 - DNA, 22 bp, Homo sapiens
actctgggatgagaaaagggtt

SEQ ID NO: 7743461 - DNA, 21 bp, Homo sapiens
agggtcctacagggctcagga

SEQ ID NO: 7743462 - DNA, 22 bp, Homo sapiens
aggttcccaggatctgtctggg

SEQ ID NO: 7743463 - DNA, 22 bp, Homo sapiens
aggttccagggattaggatgtg

SEQ ID NO: 7743464 - DNA, 22 bp, Homo sapiens
aggtgtccaatcctggttggat

SEQ ID NO: 7743465 - DNA, 20 bp, Homo sapiens
aggtgtccacgtggcagggt

SEQ ID NO: 7743466 - DNA, 22 bp, Homo sapiens
aggttccttatggggatggcta

SEQ ID NO: 7743467 - DNA, 22 bp, Homo sapiens
atttacagacgtggattagtgc

SEQ ID NO: 7743468 - DNA, 22 bp, Homo sapiens
attgtgtcctcattgaccttca

SEQ ID NO: 7743469 - DNA, 22 bp, Homo sapiens
attggtctgtgagctgttgaca

SEQ ID NO: 7743470 - DNA, 22 bp, Homo sapiens
agaggcctaaccaagatgtcct

SEQ ID NO: 7743471 - DNA, 19 bp, Homo sapiens
agaggcctcagcagctggc

SEQ ID NO: 7743472 - DNA, 22 bp, Homo sapiens
caaacattttctacttccagga

SEQ ID NO: 7743473 - DNA, 22 bp, Homo sapiens
caaacattttgagtggtttctg

SEQ ID NO: 7743474 - DNA, 22 bp, Homo sapiens
caaacattttaaataagggata

SEQ ID NO: 7743475 - DNA, 22 bp, Homo sapiens
caaacatttgttggaacccctg

SEQ ID NO: 7743476 - DNA, 22 bp, Homo sapiens
caaacatttgacttctctcagg

SEQ ID NO: 7743477 - DNA, 22 bp, Homo sapiens
caaacatttaggaggagggagg

SEQ ID NO: 7743478 - DNA, 22 bp, Homo sapiens
caaacattgctaccagaggttt

SEQ ID NO: 7743479 - DNA, 22 bp, Homo sapiens
caaacattgggggcttcaacac

SEQ ID NO: 7743480 - DNA, 23 bp, Homo sapiens
agatgaggcttctccatgttggt

SEQ ID NO: 7743481 - DNA, 22 bp, Homo sapiens
atttgaagaaagttttctagat

SEQ ID NO: 7743482 - DNA, 22 bp, Homo sapiens
atttacagatgatgctatttga

SEQ ID NO: 7743483 - DNA, 22 bp, Homo sapiens
atttacagccttgccatctata

SEQ ID NO: 7743484 - DNA, 22 bp, Homo sapiens
atttacagccttgaaaacagca

SEQ ID NO: 7743485 - DNA, 22 bp, Homo sapiens
atttacaggacagcttggcatt

SEQ ID NO: 7743486 - DNA, 22 bp, Homo sapiens
agattggttccttgctttgaaa

SEQ ID NO: 7743487 - DNA, 22 bp, Homo sapiens
atctgggggagctgctcatgga

SEQ ID NO: 7743488 - DNA, 22 bp, Homo sapiens
atgatttccagttgttgctaag

SEQ ID NO: 7743489 - DNA, 22 bp, Homo sapiens
agacataagccagtcactcact

SEQ ID NO: 7743490 - DNA, 22 bp, Homo sapiens
agacataagtgctatgacattg

SEQ ID NO: 7743491 - DNA, 22 bp, Homo sapiens
agacataaacttactgaaatac

SEQ ID NO: 7743492 - DNA, 22 bp, Homo sapiens
agacagtgctatcccatctgtg

SEQ ID NO: 7743493 - DNA, 22 bp, Homo sapiens
agagctccgtgcctggctgcca

SEQ ID NO: 7743494 - DNA, 22 bp, Homo sapiens
atgttcagttagcactgaagtc

SEQ ID NO: 7743495 - DNA, 22 bp, Homo sapiens
atgttacacataggcataaatg

SEQ ID NO: 7743496 - DNA, 22 bp, Homo sapiens
atgggctctatgtctaggagat

SEQ ID NO: 7743497 - DNA, 22 bp, Homo sapiens
atgggctcggcgctgctgggat

SEQ ID NO: 7743498 - DNA, 22 bp, Homo sapiens
atgggctatcaaatggaggtat

SEQ ID NO: 7743499 - DNA, 22 bp, Homo sapiens
atgggctaaacttagaggatat

SEQ ID NO: 7743500 - DNA, 18 bp, Homo sapiens
atgggaggggccaagaga

SEQ ID NO: 7743501 - DNA, 22 bp, Homo sapiens
cagagtggagatgtgtgtggaa

SEQ ID NO: 7743502 - DNA, 22 bp, Homo sapiens
agctctgggagtagttccacct

SEQ ID NO: 7743503 - DNA, 22 bp, Homo sapiens
agctctggcactggcgcgggat

SEQ ID NO: 7743504 - DNA, 23 bp, Homo sapiens
agctctggcgttggggaggtagt

SEQ ID NO: 7743505 - DNA, 22 bp, Homo sapiens
agctctggaataatgatgtgat

SEQ ID NO: 7743506 - DNA, 22 bp, Homo sapiens
cagcggtggcaaggtgactgtg

SEQ ID NO: 7743507 - DNA, 22 bp, Homo sapiens
agcgagtgggtcagcgttgcag

SEQ ID NO: 7743508 - DNA, 21 bp, Homo sapiens
agcgcctgcaacaaggcagat

SEQ ID NO: 7743509 - DNA, 22 bp, Homo sapiens
agccaaatacaaactggggtgg

SEQ ID NO: 7743510 - DNA, 22 bp, Homo sapiens
agccaaatctaaagtgaatatt

SEQ ID NO: 7743511 - DNA, 23 bp, Homo sapiens
agccaaatcttaacttctgttac

SEQ ID NO: 7743512 - DNA, 20 bp, Homo sapiens
cagaaagaaggtagattttt

SEQ ID NO: 7743513 - DNA, 22 bp, Homo sapiens
cagaaagacctgattggcagtt

SEQ ID NO: 7743514 - DNA, 22 bp, Homo sapiens
cacagctggtgacagagcccag

SEQ ID NO: 7743515 - DNA, 19 bp, Homo sapiens
cacagctggcgctgaccgc

SEQ ID NO: 7743516 - DNA, 22 bp, Homo sapiens
cacagctggaatggggtacctg

SEQ ID NO: 7743517 - DNA, 22 bp, Homo sapiens
cacagctgggaaaatttgtaca

SEQ ID NO: 7743518 - DNA, 22 bp, Homo sapiens
cacagctggggaagctgaggcc

SEQ ID NO: 7743519 - DNA, 22 bp, Homo sapiens
cacagctgaccaccctgctccc

SEQ ID NO: 7743520 - DNA, 22 bp, Homo sapiens
cacagctgcacagaggaggtgc

SEQ ID NO: 7743521 - DNA, 22 bp, Homo sapiens
cacagctgccatgcagtcagtg

SEQ ID NO: 7743522 - DNA, 22 bp, Homo sapiens
cacagctgccatggctgcactt

SEQ ID NO: 7743523 - DNA, 22 bp, Homo sapiens
cacagctgccctactccatgtg

SEQ ID NO: 7743524 - DNA, 22 bp, Homo sapiens
cacagctgccctaactgtactc

SEQ ID NO: 7743525 - DNA, 22 bp, Homo sapiens
cacagctgccccctctctaact

SEQ ID NO: 7743526 - DNA, 22 bp, Homo sapiens
cacagctgcttgttagaatagc

SEQ ID NO: 7743527 - DNA, 22 bp, Homo sapiens
aagaagctatacataatttggg

SEQ ID NO: 7743528 - DNA, 22 bp, Homo sapiens
aaatatacggtccctaacagtc

SEQ ID NO: 7743529 - DNA, 22 bp, Homo sapiens
aacttctgcagaaaagtgcatg

SEQ ID NO: 7743530 - DNA, 22 bp, Homo sapiens
aacttctgacctcaagaactgt

SEQ ID NO: 7743531 - DNA, 22 bp, Homo sapiens
aacttctgcttttacaggcagt

SEQ ID NO: 7743532 - DNA, 22 bp, Homo sapiens
aaagtacacacagagccaagaa

SEQ ID NO: 7743533 - DNA, 22 bp, Homo sapiens
aaagacagtggattcaaaatcc

SEQ ID NO: 7743534 - DNA, 22 bp, Homo sapiens
aaaacattgaattgcacactat

SEQ ID NO: 7743535 - DNA, 22 bp, Homo sapiens
aagtaacatctgaacatgatgt

SEQ ID NO: 7743536 - DNA, 22 bp, Homo sapiens
aatgtacaaaccttctttgtag

SEQ ID NO: 7743537 - DNA, 22 bp, Homo sapiens
aagttacagttatgaaactcac

SEQ ID NO: 7743538 - DNA, 22 bp, Homo sapiens
aataatgtacatacatatttcg

SEQ ID NO: 7743539 - DNA, 22 bp, Homo sapiens
aatatttcgttgcgtggctaga

SEQ ID NO: 7743540 - DNA, 21 bp, Homo sapiens
aatatccaaatgattagatct

SEQ ID NO: 7743541 - DNA, 23 bp, Homo sapiens
acagccaggatgggagcagaagc

SEQ ID NO: 7743542 - DNA, 21 bp, Homo sapiens
acagctggaaattacttgccc

SEQ ID NO: 7743543 - DNA, 23 bp, Homo sapiens
acagactgtattcaaagtaggac

SEQ ID NO: 7743544 - DNA, 22 bp, Homo sapiens
acagactgattcattgctcagg

SEQ ID NO: 7743545 - DNA, 22 bp, Homo sapiens
acagacatttaataaatgctga

SEQ ID NO: 7743546 - DNA, 22 bp, Homo sapiens
aagaatcatagagccactgata

SEQ ID NO: 7743547 - DNA, 22 bp, Homo sapiens
acacagctatggggtaggaaac

SEQ ID NO: 7743548 - DNA, 22 bp, Homo sapiens
aagataatattcattaactaga

SEQ ID NO: 7743549 - DNA, 22 bp, Homo sapiens
aagataatgttctagctgtcag

SEQ ID NO: 7743550 - DNA, 19 bp, Homo sapiens
agcaaatacatcaaaattg

SEQ ID NO: 7743551 - DNA, 22 bp, Homo sapiens
acaacagtccagtatagactgt

SEQ ID NO: 7743552 - DNA, 22 bp, Homo sapiens
agcaaatacttttcactgagcc

SEQ ID NO: 7743553 - DNA, 22 bp, Homo sapiens
agcaaatacatttttagcataa

SEQ ID NO: 7743554 - DNA, 18 bp, Homo sapiens
agcaaatattaagtgcat

SEQ ID NO: 7743555 - DNA, 19 bp, Homo sapiens
agcaaatataatagtgttc

SEQ ID NO: 7743556 - DNA, 18 bp, Homo sapiens
aatttctttgacaactta

SEQ ID NO: 7743557 - DNA, 22 bp, Homo sapiens
agacattatgctgagtgaaaga

SEQ ID NO: 7743558 - DNA, 22 bp, Homo sapiens
agacattatggctttcactggg

SEQ ID NO: 7743559 - DNA, 22 bp, Homo sapiens
agaggaagtaatcaggacctgc

SEQ ID NO: 7743560 - DNA, 22 bp, Homo sapiens
agccagagattgagatgcaggc

SEQ ID NO: 7743561 - DNA, 22 bp, Homo sapiens
agccagagggaatctttgggga

SEQ ID NO: 7743562 - DNA, 22 bp, Homo sapiens
acacagttcaggatcaaatagc

SEQ ID NO: 7743563 - DNA, 22 bp, Homo sapiens
acacatctatctctacacaagg

SEQ ID NO: 7743564 - DNA, 23 bp, Homo sapiens
acacaatagagtactattcagcc

SEQ ID NO: 7743565 - DNA, 22 bp, Homo sapiens
acacaatacagggctcaaaata

SEQ ID NO: 7743566 - DNA, 21 bp, Homo sapiens
acagatatttcattgaacatt

SEQ ID NO: 7743567 - DNA, 22 bp, Homo sapiens
acagatatatgattgtgtaaat

SEQ ID NO: 7743568 - DNA, 22 bp, Homo sapiens
acagatagtatgtaaattaagc

SEQ ID NO: 7743569 - DNA, 22 bp, Homo sapiens
acagatataaactatagtagtg

SEQ ID NO: 7743570 - DNA, 22 bp, Homo sapiens
acagatacaaatatacaaatac

SEQ ID NO: 7743571 - DNA, 19 bp, Homo sapiens
agcggttctcaaagtcagg

SEQ ID NO: 7743572 - DNA, 22 bp, Homo sapiens
agcggtggtgtcggcagcggct

SEQ ID NO: 7743573 - DNA, 22 bp, Homo sapiens
agcgtggatgtggggcgcggct

SEQ ID NO: 7743574 - DNA, 22 bp, Homo sapiens
agcgtggactgctgggcaaggt

SEQ ID NO: 7743575 - DNA, 22 bp, Homo sapiens
acagagggggccttggagtgca

SEQ ID NO: 7743576 - DNA, 22 bp, Homo sapiens
acagagggtctgggcacaggac

SEQ ID NO: 7743577 - DNA, 22 bp, Homo sapiens
acagagggtgtggaggaagacg

SEQ ID NO: 7743578 - DNA, 22 bp, Homo sapiens
acagagggtttctaaggatttg

SEQ ID NO: 7743579 - DNA, 22 bp, Homo sapiens
acagaataggtacagtcagtca

SEQ ID NO: 7743580 - DNA, 22 bp, Homo sapiens
acagaatattttatttagatca

SEQ ID NO: 7743581 - DNA, 22 bp, Homo sapiens
aatctacatagagatcaaatga

SEQ ID NO: 7743582 - DNA, 22 bp, Homo sapiens
aatctacatttcagttttgccc

SEQ ID NO: 7743583 - DNA, 22 bp, Homo sapiens
agaactgatttgaaggttgggg

SEQ ID NO: 7743584 - DNA, 20 bp, Homo sapiens
agaactgaatcattttgggt

SEQ ID NO: 7743585 - DNA, 22 bp, Homo sapiens
aatgccaacttggatatacatt

SEQ ID NO: 7743586 - DNA, 22 bp, Homo sapiens
aatgccaatgggcagaactaga

SEQ ID NO: 7743587 - DNA, 22 bp, Homo sapiens
actgggagttctccatgtccct

SEQ ID NO: 7743588 - DNA, 22 bp, Homo sapiens
actgggaggcatctggagctga

SEQ ID NO: 7743589 - DNA, 22 bp, Homo sapiens
aagttcaatcagatgaaaaagc

SEQ ID NO: 7743590 - DNA, 18 bp, Homo sapiens
actctgggacctgttatt

SEQ ID NO: 7743591 - DNA, 22 bp, Homo sapiens
aaggtacagttttaagaataag

SEQ ID NO: 7743592 - DNA, 22 bp, Homo sapiens
aaggtacagaaattaacaagga

SEQ ID NO: 7743593 - DNA, 19 bp, Homo sapiens
aagggctgggcacctcact

SEQ ID NO: 7743594 - DNA, 22 bp, Homo sapiens
acatgaagtggtcagatcaaac

SEQ ID NO: 7743595 - DNA, 22 bp, Homo sapiens
acatgaagcaagaaagatgcta

SEQ ID NO: 7743596 - DNA, 22 bp, Homo sapiens
aaggaagaatcatcacgttggg

SEQ ID NO: 7743597 - DNA, 22 bp, Homo sapiens
aaggaagatgctggcctgggga

SEQ ID NO: 7743598 - DNA, 20 bp, Homo sapiens
aagcttcacttcatttgatc

SEQ ID NO: 7743599 - DNA, 22 bp, Homo sapiens
acagctggagccctatggctgg

SEQ ID NO: 7743600 - DNA, 22 bp, Homo sapiens
aagctgtgaaatctctagtgca

SEQ ID NO: 7743601 - DNA, 22 bp, Homo sapiens
aagctgtgcctttgcctagaat

SEQ ID NO: 7743602 - DNA, 22 bp, Homo sapiens
aagctgtggcttggaggaaaca

SEQ ID NO: 7743603 - DNA, 22 bp, Homo sapiens
aagctgtgcaggaactgcttgc

SEQ ID NO: 7743604 - DNA, 22 bp, Homo sapiens
aagctgtgagctggatgctcca

SEQ ID NO: 7743605 - DNA, 22 bp, Homo sapiens
aagctgtgaagagcaagtgagg

SEQ ID NO: 7743606 - DNA, 21 bp, Homo sapiens
aagctgtgttccactgatagc

SEQ ID NO: 7743607 - DNA, 22 bp, Homo sapiens
aagctgtgtgactatttctgag

SEQ ID NO: 7743608 - DNA, 22 bp, Homo sapiens
aagctgtgtgcagatgatctca

SEQ ID NO: 7743609 - DNA, 22 bp, Homo sapiens
aagctgtggtaaagggtagagg

SEQ ID NO: 7743610 - DNA, 22 bp, Homo sapiens
aagctgtgtaagttgcttggtt

SEQ ID NO: 7743611 - DNA, 22 bp, Homo sapiens
aagctgtgtcctagaggtgtaa

SEQ ID NO: 7743612 - DNA, 22 bp, Homo sapiens
aagctgtgtattacagaatatt

SEQ ID NO: 7743613 - DNA, 22 bp, Homo sapiens
tagggactgtgtgagggacttg

SEQ ID NO: 7743614 - DNA, 22 bp, Homo sapiens
tagggactagtttcaaggctaa

SEQ ID NO: 7743615 - DNA, 22 bp, Homo sapiens
taggatatgtgaaatcatatta

SEQ ID NO: 7743616 - DNA, 22 bp, Homo sapiens
taccaaaaccaagccattatct

SEQ ID NO: 7743617 - DNA, 22 bp, Homo sapiens
tagagggccagctggacagcga

SEQ ID NO: 7743618 - DNA, 22 bp, Homo sapiens
tagagggcaggagtgtcctact

SEQ ID NO: 7743619 - DNA, 20 bp, Homo sapiens
tattacacacaatgagcagt

SEQ ID NO: 7743620 - DNA, 22 bp, Homo sapiens
tatgtacaatcagcagttcata

SEQ ID NO: 7743621 - DNA, 22 bp, Homo sapiens
tatgtacagtccttaacttaaa

SEQ ID NO: 7743622 - DNA, 22 bp, Homo sapiens
tatttattcattcagcaagcat

SEQ ID NO: 7743623 - DNA, 22 bp, Homo sapiens
tatttattctttgtactgcctt

SEQ ID NO: 7743624 - DNA, 22 bp, Homo sapiens
tatttattggacagtgttgctg

SEQ ID NO: 7743625 - DNA, 22 bp, Homo sapiens
tattctgcatgaaaataaacag

SEQ ID NO: 7743626 - DNA, 22 bp, Homo sapiens
tataattttaagtggtaaatta

SEQ ID NO: 7743627 - DNA, 23 bp, Homo sapiens
tatacacatgtggcagtatagtg

SEQ ID NO: 7743628 - DNA, 22 bp, Homo sapiens
tataacaggaagtattcaaaca

SEQ ID NO: 7743629 - DNA, 22 bp, Homo sapiens
taggtgagtttggggaagatag

SEQ ID NO: 7743630 - DNA, 22 bp, Homo sapiens
tatctagagcctggaagtcttg

SEQ ID NO: 7743631 - DNA, 22 bp, Homo sapiens
tatctagaaacagagttttact

SEQ ID NO: 7743632 - DNA, 22 bp, Homo sapiens
tatctaaaggatttaatttagt

SEQ ID NO: 7743633 - DNA, 23 bp, Homo sapiens
tatccagtagggcccagagctga

SEQ ID NO: 7743634 - DNA, 22 bp, Homo sapiens
tatccatattcagactgtgaat

SEQ ID NO: 7743635 - DNA, 22 bp, Homo sapiens
tataggactgatcacattttca

SEQ ID NO: 7743636 - DNA, 22 bp, Homo sapiens
tataggaccgacttgtttatag

SEQ ID NO: 7743637 - DNA, 22 bp, Homo sapiens
gttttgatatatgcatacatta

SEQ ID NO: 7743638 - DNA, 22 bp, Homo sapiens
gtttccaggctttggtatggtt

SEQ ID NO: 7743639 - DNA, 22 bp, Homo sapiens
gtttccaggctgggcagcgagc

SEQ ID NO: 7743640 - DNA, 22 bp, Homo sapiens
gtttccaagatgctgccatcag

SEQ ID NO: 7743641 - DNA, 22 bp, Homo sapiens
gtttccaagtctctcaacaccc

SEQ ID NO: 7743642 - DNA, 22 bp, Homo sapiens
gtttccaaccccaccaaagtgc

SEQ ID NO: 7743643 - DNA, 22 bp, Homo sapiens
gtttccagcctcctgggtaaag

SEQ ID NO: 7743644 - DNA, 22 bp, Homo sapiens
gtttccagagtgagggcacttg

SEQ ID NO: 7743645 - DNA, 22 bp, Homo sapiens
gtttccaggaagggttgggagg

SEQ ID NO: 7743646 - DNA, 22 bp, Homo sapiens
gtttccagcttgggcccgggga

SEQ ID NO: 7743647 - DNA, 22 bp, Homo sapiens
taaacactcacttcatagccat

SEQ ID NO: 7743648 - DNA, 22 bp, Homo sapiens
taactaggattacaagcgtgcg

SEQ ID NO: 7743649 - DNA, 22 bp, Homo sapiens
taaattctacaacttcaaagat

SEQ ID NO: 7743650 - DNA, 22 bp, Homo sapiens
gtgctcagggcctggctgggga

SEQ ID NO: 7743651 - DNA, 20 bp, Homo sapiens
gtttccaaattgtgcatttt

SEQ ID NO: 7743652 - DNA, 22 bp, Homo sapiens
tacaaactgtccagcccagagg

SEQ ID NO: 7743653 - DNA, 22 bp, Homo sapiens
tacaaactctttatatttcata

SEQ ID NO: 7743654 - DNA, 22 bp, Homo sapiens
tacaaactgttattattattgt

SEQ ID NO: 7743655 - DNA, 22 bp, Homo sapiens
tacaacaggaatttcaactttg

SEQ ID NO: 7743656 - DNA, 20 bp, Homo sapiens
tacagaaacaggacttttgg

SEQ ID NO: 7743657 - DNA, 22 bp, Homo sapiens
tacagaaaaacatctggagccg

SEQ ID NO: 7743658 - DNA, 22 bp, Homo sapiens
tacaacagacaggaataagatt

SEQ ID NO: 7743659 - DNA, 22 bp, Homo sapiens
tacaacagacctagatgaatga

SEQ ID NO: 7743660 - DNA, 22 bp, Homo sapiens
tacagaaatcacatcgctttga

SEQ ID NO: 7743661 - DNA, 22 bp, Homo sapiens
tacagataaaaatgctgttctt

SEQ ID NO: 7743662 - DNA, 22 bp, Homo sapiens
tacagagtgttattacagaatc

SEQ ID NO: 7743663 - DNA, 22 bp, Homo sapiens
tacagattttgtgaagaagtgt

SEQ ID NO: 7743664 - DNA, 22 bp, Homo sapiens
tacagatttggggagtaaagtt

SEQ ID NO: 7743665 - DNA, 22 bp, Homo sapiens
tacagatatttctcttcaacaa

SEQ ID NO: 7743666 - DNA, 18 bp, Homo sapiens
tacagattatagatacat

SEQ ID NO: 7743667 - DNA, 22 bp, Homo sapiens
tcataggaatgatattttatct

SEQ ID NO: 7743668 - DNA, 22 bp, Homo sapiens
tcagtgaaatgcatattcttcg

SEQ ID NO: 7743669 - DNA, 22 bp, Homo sapiens
tcagtgaagtaatggtgagaga

SEQ ID NO: 7743670 - DNA, 22 bp, Homo sapiens
tcagtgaatgagataactttag

SEQ ID NO: 7743671 - DNA, 22 bp, Homo sapiens
tcaggcctgcaggcttcctgga

SEQ ID NO: 7743672 - DNA, 22 bp, Homo sapiens
tcaggaagctgctctgggtggt

SEQ ID NO: 7743673 - DNA, 22 bp, Homo sapiens
tcaggaagctgaattacaaaaa

SEQ ID NO: 7743674 - DNA, 22 bp, Homo sapiens
tcaggaaggcaaattgcatgat

SEQ ID NO: 7743675 - DNA, 22 bp, Homo sapiens
tcaggaaggagctggcctgcca

SEQ ID NO: 7743676 - DNA, 22 bp, Homo sapiens
tcaggaaggcgccccatcagga

SEQ ID NO: 7743677 - DNA, 22 bp, Homo sapiens
tcaggaaggcacttggtgtgtt

SEQ ID NO: 7743678 - DNA, 22 bp, Homo sapiens
tcaggaaggcttcacacgagtg

SEQ ID NO: 7743679 - DNA, 22 bp, Homo sapiens
tcaggaagggctcagtctgtgc

SEQ ID NO: 7743680 - DNA, 22 bp, Homo sapiens
tcaggaggttgaccacggggca

SEQ ID NO: 7743681 - DNA, 21 bp, Homo sapiens
tcaggaagagcttctcccact

SEQ ID NO: 7743682 - DNA, 21 bp, Homo sapiens
tcaggaagagccagttcatgc

SEQ ID NO: 7743683 - DNA, 22 bp, Homo sapiens
tcaggaagattagtttcctacc

SEQ ID NO: 7743684 - DNA, 22 bp, Homo sapiens
tcaggaagcatcctgaggtgtc

SEQ ID NO: 7743685 - DNA, 22 bp, Homo sapiens
tcaggaagctcttgctgattct

SEQ ID NO: 7743686 - DNA, 22 bp, Homo sapiens
tcaggaagctactgccagcagc

SEQ ID NO: 7743687 - DNA, 22 bp, Homo sapiens
tcaggaagccactccacagaga

SEQ ID NO: 7743688 - DNA, 22 bp, Homo sapiens
tcaggaagccggttaaatagat

SEQ ID NO: 7743689 - DNA, 22 bp, Homo sapiens
tcaggaagacaatctttggctc

SEQ ID NO: 7743690 - DNA, 22 bp, Homo sapiens
tcaggaagaagacggggcagga

SEQ ID NO: 7743691 - DNA, 22 bp, Homo sapiens
tcaggaagaaattctgtatctt

SEQ ID NO: 7743692 - DNA, 22 bp, Homo sapiens
tcaggaagaaagaagggagtgt

SEQ ID NO: 7743693 - DNA, 22 bp, Homo sapiens
tcagctacagcatctctgcttt

SEQ ID NO: 7743694 - DNA, 22 bp, Homo sapiens
tatttcttcgggattcaagcta

SEQ ID NO: 7743695 - DNA, 22 bp, Homo sapiens
tatttcttgagactcgtcttcc

SEQ ID NO: 7743696 - DNA, 22 bp, Homo sapiens
tatttcttgagtggtcagtttc

SEQ ID NO: 7743697 - DNA, 22 bp, Homo sapiens
tcaagataagtcagtatatcaa

SEQ ID NO: 7743698 - DNA, 22 bp, Homo sapiens
tcaataaaattgttttcctatc

SEQ ID NO: 7743699 - DNA, 22 bp, Homo sapiens
tcaagtttctctcagattatgg

SEQ ID NO: 7743700 - DNA, 22 bp, Homo sapiens
tcactacattttagacagtaaa

SEQ ID NO: 7743701 - DNA, 22 bp, Homo sapiens
tcagaaaaggtagctgtgacaa

SEQ ID NO: 7743702 - DNA, 22 bp, Homo sapiens
tcagaaaagagaaaatcttata

SEQ ID NO: 7743703 - DNA, 22 bp, Homo sapiens
tcagaaaagaccacattattct

SEQ ID NO: 7743704 - DNA, 22 bp, Homo sapiens
tcagaaaagactcaggggctga

SEQ ID NO: 7743705 - DNA, 22 bp, Homo sapiens
tcacttttgatccctatgcagt

SEQ ID NO: 7743706 - DNA, 22 bp, Homo sapiens
tccagttgtttgtattaactct

SEQ ID NO: 7743707 - DNA, 22 bp, Homo sapiens
tccagttgcctgtctctgatta

SEQ ID NO: 7743708 - DNA, 22 bp, Homo sapiens
tccagggcgtgtgtgaaggaaa

SEQ ID NO: 7743709 - DNA, 22 bp, Homo sapiens
tccagctccacagcctccctgt

SEQ ID NO: 7743710 - DNA, 22 bp, Homo sapiens
tcattgatggcttctttcttgc

SEQ ID NO: 7743711 - DNA, 22 bp, Homo sapiens
tccagcaggtccgagacaagtt

SEQ ID NO: 7743712 - DNA, 22 bp, Homo sapiens
gcttggaagtaggattgggaga

SEQ ID NO: 7743713 - DNA, 22 bp, Homo sapiens
gctggggcctctgtgaggttaa

SEQ ID NO: 7743714 - DNA, 22 bp, Homo sapiens
gctggggcctgaacagtcagct

SEQ ID NO: 7743715 - DNA, 22 bp, Homo sapiens
gctggggctgggctgaggaaga

SEQ ID NO: 7743716 - DNA, 19 bp, Homo sapiens
gctgtgggacagcagggtg

SEQ ID NO: 7743717 - DNA, 22 bp, Homo sapiens
gctgtgggccacacggctgagt

SEQ ID NO: 7743718 - DNA, 22 bp, Homo sapiens
gctggctggaatgggagaagaa

SEQ ID NO: 7743719 - DNA, 22 bp, Homo sapiens
gctttctgattgcgaaaacaaa

SEQ ID NO: 7743720 - DNA, 22 bp, Homo sapiens
gctttctgatgagcttaagaaa

SEQ ID NO: 7743721 - DNA, 22 bp, Homo sapiens
ggaagaggaggagccaggcttt

SEQ ID NO: 7743722 - DNA, 22 bp, Homo sapiens
ggaagaggctgaggccatgctg

SEQ ID NO: 7743723 - DNA, 22 bp, Homo sapiens
ggaagaggctgagccaggtccc

SEQ ID NO: 7743724 - DNA, 22 bp, Homo sapiens
ggaagaggctctcattgagggc

SEQ ID NO: 7743725 - DNA, 22 bp, Homo sapiens
ggaagagggaaccacgactgta

SEQ ID NO: 7743726 - DNA, 22 bp, Homo sapiens
ggaagaggctggtagtgcccgt

SEQ ID NO: 7743727 - DNA, 22 bp, Homo sapiens
ggaagatgagaagtggggctcc

SEQ ID NO: 7743728 - DNA, 22 bp, Homo sapiens
ggaatgaaacacttctgattct

SEQ ID NO: 7743729 - DNA, 22 bp, Homo sapiens
ggacagtattctcttgaaataa

SEQ ID NO: 7743730 - DNA, 22 bp, Homo sapiens
ggacagtagtcactaaactaga

SEQ ID NO: 7743731 - DNA, 23 bp, Homo sapiens
ggacagtagtgtggtatttagaa

SEQ ID NO: 7743732 - DNA, 22 bp, Homo sapiens
gctcccagaaccaaggctgggg

SEQ ID NO: 7743733 - DNA, 22 bp, Homo sapiens
gcctctgggttggtgacaggct

SEQ ID NO: 7743734 - DNA, 22 bp, Homo sapiens
gcctctgggggctcagacctgt

SEQ ID NO: 7743735 - DNA, 22 bp, Homo sapiens
gcggtcggcagaggggctctgc

SEQ ID NO: 7743736 - DNA, 22 bp, Homo sapiens
gctacagagctctgtgaagaga

SEQ ID NO: 7743737 - DNA, 22 bp, Homo sapiens
gcctttgtaactcttttattgt

SEQ ID NO: 7743738 - DNA, 19 bp, Homo sapiens
gcctttgttccttttgtct

SEQ ID NO: 7743739 - DNA, 22 bp, Homo sapiens
gctctgggccgggcaccagcct

SEQ ID NO: 7743740 - DNA, 22 bp, Homo sapiens
gctctgggccatcctggccggg

SEQ ID NO: 7743741 - DNA, 20 bp, Homo sapiens
gctctgggagggatgtgatg

SEQ ID NO: 7743742 - DNA, 22 bp, Homo sapiens
gctctggggatgcttctgccgt

SEQ ID NO: 7743743 - DNA, 22 bp, Homo sapiens
gctctgggctgccctctggaca

SEQ ID NO: 7743744 - DNA, 22 bp, Homo sapiens
gctctgggaaggatcgtagtga

SEQ ID NO: 7743745 - DNA, 22 bp, Homo sapiens
gctctgggaattcagaaagcct

SEQ ID NO: 7743746 - DNA, 22 bp, Homo sapiens
gctgagggccgcatagggtcat

SEQ ID NO: 7743747 - DNA, 22 bp, Homo sapiens
gctgagggcagcctcctaggtc

SEQ ID NO: 7743748 - DNA, 22 bp, Homo sapiens
gcacagaacactggtgagtccc

SEQ ID NO: 7743749 - DNA, 22 bp, Homo sapiens
gcagagggtcctgtgccagcag

SEQ ID NO: 7743750 - DNA, 22 bp, Homo sapiens
gcagagggggtacttcggccct

SEQ ID NO: 7743751 - DNA, 22 bp, Homo sapiens
gcagaggggaagctgaggaatt

SEQ ID NO: 7743752 - DNA, 22 bp, Homo sapiens
gcagctgtcatttacaacaggg

SEQ ID NO: 7743753 - DNA, 22 bp, Homo sapiens
gcagctgtcgctaggagctgtg

SEQ ID NO: 7743754 - DNA, 22 bp, Homo sapiens
gcagctgtcggaaagctaagtg

SEQ ID NO: 7743755 - DNA, 20 bp, Homo sapiens
gcagctgtgcattcttagga

SEQ ID NO: 7743756 - DNA, 22 bp, Homo sapiens
gcaggaagggaaaggttgactc

SEQ ID NO: 7743757 - DNA, 22 bp, Homo sapiens
gcaggaagcatagaagaatgcc

SEQ ID NO: 7743758 - DNA, 22 bp, Homo sapiens
gcaggaagccttaccaagccca

SEQ ID NO: 7743759 - DNA, 22 bp, Homo sapiens
gcaggaagaggctcgaagcccc

SEQ ID NO: 7743760 - DNA, 22 bp, Homo sapiens
gcaggaagatgagctcaggtaa

SEQ ID NO: 7743761 - DNA, 22 bp, Homo sapiens
ggtttccaaagatagagtagta

SEQ ID NO: 7743762 - DNA, 22 bp, Homo sapiens
ggtttccattattttatgggtg

SEQ ID NO: 7743763 - DNA, 22 bp, Homo sapiens
ggtttccacttgctgaagaaag

SEQ ID NO: 7743764 - DNA, 22 bp, Homo sapiens
gtccccagctgtgacgagagcc

SEQ ID NO: 7743765 - DNA, 22 bp, Homo sapiens
gtcctgggaaggaagccaggga

SEQ ID NO: 7743766 - DNA, 22 bp, Homo sapiens
gtcctgggcccaggggctgcct

SEQ ID NO: 7743767 - DNA, 17 bp, Homo sapiens
gtcctgggaggagagag

SEQ ID NO: 7743768 - DNA, 22 bp, Homo sapiens
gtccaaattccacagatttctc

SEQ ID NO: 7743769 - DNA, 22 bp, Homo sapiens
gtccaaatttttcacatgtaga

SEQ ID NO: 7743770 - DNA, 22 bp, Homo sapiens
gtgaaacaccctccaatgcaca

SEQ ID NO: 7743771 - DNA, 22 bp, Homo sapiens
gtgaccatcatctcagctagtt

SEQ ID NO: 7743772 - DNA, 22 bp, Homo sapiens
gtgaagcagggaaggaaaggat

SEQ ID NO: 7743773 - DNA, 22 bp, Homo sapiens
gtctgctcatgctaccgcgggc

SEQ ID NO: 7743774 - DNA, 22 bp, Homo sapiens
gtcctgggggcagctgtgtcca

SEQ ID NO: 7743775 - DNA, 22 bp, Homo sapiens
gtcctggggattatagagtgtt

SEQ ID NO: 7743776 - DNA, 22 bp, Homo sapiens
gtcctggggaatacagaagccg

SEQ ID NO: 7743777 - DNA, 22 bp, Homo sapiens
gtcctgggcctgctgaggctga

SEQ ID NO: 7743778 - DNA, 22 bp, Homo sapiens
ggtctggatgctgaggttccca

SEQ ID NO: 7743779 - DNA, 22 bp, Homo sapiens
ggtcagagaaaagtagggtgtt

SEQ ID NO: 7743780 - DNA, 20 bp, Homo sapiens
ggtccttgtcacaaggagag

SEQ ID NO: 7743781 - DNA, 20 bp, Homo sapiens
ggtcctgtactctcattgaa

SEQ ID NO: 7743782 - DNA, 22 bp, Homo sapiens
ggtctcccttgctggttggctg

SEQ ID NO: 7743783 - DNA, 22 bp, Homo sapiens
gggcttgaggtgaaggtaggga

SEQ ID NO: 7743784 - DNA, 22 bp, Homo sapiens
gggcttggccccagaagagcta

SEQ ID NO: 7743785 - DNA, 22 bp, Homo sapiens
gggcttggctcataagtggatg

SEQ ID NO: 7743786 - DNA, 22 bp, Homo sapiens
gggcttgggtattgtgagaggt

SEQ ID NO: 7743787 - DNA, 22 bp, Homo sapiens
gggcttggagtaggctgatgaa

SEQ ID NO: 7743788 - DNA, 22 bp, Homo sapiens
gggctgagttcctgcctcactc

SEQ ID NO: 7743789 - DNA, 22 bp, Homo sapiens
gggcatggggcggacctggttc

SEQ ID NO: 7743790 - DNA, 22 bp, Homo sapiens
gggctgagccatttgaaccttg

SEQ ID NO: 7743791 - DNA, 22 bp, Homo sapiens
gggctgagctgttctgagttta

SEQ ID NO: 7743792 - DNA, 22 bp, Homo sapiens
gggctgagagctggaatctgag

SEQ ID NO: 7743793 - DNA, 22 bp, Homo sapiens
gggtaggagaggtgtctgtgtg

SEQ ID NO: 7743794 - DNA, 22 bp, Homo sapiens
gggcttggtggagagaatgctg

SEQ ID NO: 7743795 - DNA, 22 bp, Homo sapiens
ggggctaactttctgagggtag

SEQ ID NO: 7743796 - DNA, 22 bp, Homo sapiens
ggggccgaccgcggttcaggcc

SEQ ID NO: 7743797 - DNA, 22 bp, Homo sapiens
ggggctggctcactaagagact

SEQ ID NO: 7743798 - DNA, 22 bp, Homo sapiens
ggggctgatggaactcaggcct

SEQ ID NO: 7743799 - DNA, 22 bp, Homo sapiens
ggggctgacgggcatgtggctt

SEQ ID NO: 7743800 - DNA, 22 bp, Homo sapiens
ggggctgaacctggaggtggtc

SEQ ID NO: 7743801 - DNA, 22 bp, Homo sapiens
ggctgggaggccgtgctgacct

SEQ ID NO: 7743802 - DNA, 22 bp, Homo sapiens
ggctgggctgctgggtcagagc

SEQ ID NO: 7743803 - DNA, 22 bp, Homo sapiens
ggcttctggtgggagcatgact

SEQ ID NO: 7743804 - DNA, 22 bp, Homo sapiens
ggctgggctccgggagcatgcg

SEQ ID NO: 7743805 - DNA, 22 bp, Homo sapiens
ggctccaggagatgctgggcag

SEQ ID NO: 7743806 - DNA, 22 bp, Homo sapiens
ggctctggagatgtccgacctg

SEQ ID NO: 7743807 - DNA, 19 bp, Homo sapiens
ggctctggcggctgtagcc

SEQ ID NO: 7743808 - DNA, 22 bp, Homo sapiens
ggctcttgggagctcagagttg

SEQ ID NO: 7743809 - DNA, 22 bp, Homo sapiens
ggctctgggccagagttggctt

SEQ ID NO: 7743810 - DNA, 22 bp, Homo sapiens
ggctgaagtgtagtggctcact

SEQ ID NO: 7743811 - DNA, 22 bp, Homo sapiens
gggcaggagaaggtggatgtcc

SEQ ID NO: 7743812 - DNA, 22 bp, Homo sapiens
gggaggagcttggagattcact

SEQ ID NO: 7743813 - DNA, 22 bp, Homo sapiens
gggagcttctggaaggcaggaa

SEQ ID NO: 7743814 - DNA, 22 bp, Homo sapiens
ggcttgggagcaggcatgtgac

SEQ ID NO: 7743815 - DNA, 22 bp, Homo sapiens
gggagagatgctgattgccaat

SEQ ID NO: 7743816 - DNA, 22 bp, Homo sapiens
gggagagaagggcatgtacact

SEQ ID NO: 7743817 - DNA, 21 bp, Homo sapiens
ggagtcattagtcatttcctt

SEQ ID NO: 7743818 - DNA, 22 bp, Homo sapiens
ggcaagagtgaggagtgtctct

SEQ ID NO: 7743819 - DNA, 22 bp, Homo sapiens
ggcaagagttgaagctccagga

SEQ ID NO: 7743820 - DNA, 22 bp, Homo sapiens
ggcaggagggcggacaatgacc

SEQ ID NO: 7743821 - DNA, 20 bp, Homo sapiens
ggcagagggcctgggagaag

SEQ ID NO: 7743822 - DNA, 22 bp, Homo sapiens
ggcagaggaagctggaagtggg

SEQ ID NO: 7743823 - DNA, 22 bp, Homo sapiens
ggcagaggaaggatgaattcac

SEQ ID NO: 7743824 - DNA, 22 bp, Homo sapiens
ggcctgagtcccacctggctgt

SEQ ID NO: 7743825 - DNA, 22 bp, Homo sapiens
gaagcttggataactgtatggg

SEQ ID NO: 7743826 - DNA, 22 bp, Homo sapiens
gacacagagacttgcagttgta

SEQ ID NO: 7743827 - DNA, 22 bp, Homo sapiens
gacaagttacacctgtgcttga

SEQ ID NO: 7743828 - DNA, 22 bp, Homo sapiens
gacaagttgtggagaagagggt

SEQ ID NO: 7743829 - DNA, 22 bp, Homo sapiens
gacaggttgaagtatcaaaggt

SEQ ID NO: 7743830 - DNA, 22 bp, Homo sapiens
gaaatgtaattctcttgaagat

SEQ ID NO: 7743831 - DNA, 22 bp, Homo sapiens
gaacagtatcagtagtgccagt

SEQ ID NO: 7743832 - DNA, 22 bp, Homo sapiens
gaacatttggatttgtaaattt

SEQ ID NO: 7743833 - DNA, 22 bp, Homo sapiens
gaaatcacttttttcatagttg

SEQ ID NO: 7743834 - DNA, 22 bp, Homo sapiens
ctttcattcttagatattagtg

SEQ ID NO: 7743835 - DNA, 22 bp, Homo sapiens
gaagaggactgtggcatcctag

SEQ ID NO: 7743836 - DNA, 22 bp, Homo sapiens
gaagacatgtggattctagttt

SEQ ID NO: 7743837 - DNA, 22 bp, Homo sapiens
gagctgaagtttccatttgtac

SEQ ID NO: 7743838 - DNA, 21 bp, Homo sapiens
gagctgaatatgttctagggg

SEQ ID NO: 7743839 - DNA, 22 bp, Homo sapiens
gagctgagacacactttggcaa

SEQ ID NO: 7743840 - DNA, 22 bp, Homo sapiens
gagctgagaagcagcgcttgat

SEQ ID NO: 7743841 - DNA, 22 bp, Homo sapiens
gagctgtgttgtctagtaccga

SEQ ID NO: 7743842 - DNA, 22 bp, Homo sapiens
gagctctgtgtagcctgagggt

SEQ ID NO: 7743843 - DNA, 22 bp, Homo sapiens
gagctctgtgtggcttgggtgg

SEQ ID NO: 7743844 - DNA, 22 bp, Homo sapiens
gagctctgttctcgtcctgctg

SEQ ID NO: 7743845 - DNA, 22 bp, Homo sapiens
gagctaggatatcatgagggta

SEQ ID NO: 7743846 - DNA, 22 bp, Homo sapiens
gaggaggaaaccctgttcctct

SEQ ID NO: 7743847 - DNA, 22 bp, Homo sapiens
gaggagcttgtgagaagatgtc

SEQ ID NO: 7743848 - DNA, 22 bp, Homo sapiens
gagatgagtgggggatctctca

SEQ ID NO: 7743849 - DNA, 22 bp, Homo sapiens
gacctgaaagagattaaatgac

SEQ ID NO: 7743850 - DNA, 22 bp, Homo sapiens
gagccacagcaacctcaaagga

SEQ ID NO: 7743851 - DNA, 22 bp, Homo sapiens
gagccacagtggtggcccacgt

SEQ ID NO: 7743852 - DNA, 22 bp, Homo sapiens
gagccacagtggattgattcca

SEQ ID NO: 7743853 - DNA, 22 bp, Homo sapiens
ctgggaggcagaggttgcagtg

SEQ ID NO: 7743854 - DNA, 22 bp, Homo sapiens
ctgggcaggagaggtggttgga

SEQ ID NO: 7743855 - DNA, 22 bp, Homo sapiens
ctgggaggcagtctctctagaa

SEQ ID NO: 7743856 - DNA, 22 bp, Homo sapiens
ctgggcagtttattcagttctg

SEQ ID NO: 7743857 - DNA, 22 bp, Homo sapiens
ctgggagctgaggctgacgctg

SEQ ID NO: 7743858 - DNA, 22 bp, Homo sapiens
ctggggctcactttggtcaggc

SEQ ID NO: 7743859 - DNA, 22 bp, Homo sapiens
ctggggcccgagccttgggcca

SEQ ID NO: 7743860 - DNA, 22 bp, Homo sapiens
ctggggctctctggaatgcttg

SEQ ID NO: 7743861 - DNA, 22 bp, Homo sapiens
ctggggcattgggagaggcctg

SEQ ID NO: 7743862 - DNA, 22 bp, Homo sapiens
ctggggccagtgaggaggcttt

SEQ ID NO: 7743863 - DNA, 22 bp, Homo sapiens
ctggggcccatcgagggctgag

SEQ ID NO: 7743864 - DNA, 20 bp, Homo sapiens
ctgggctgcccagctatggg

SEQ ID NO: 7743865 - DNA, 22 bp, Homo sapiens
ctgggctgcaggagtggggcaa

SEQ ID NO: 7743866 - DNA, 22 bp, Homo sapiens
ctgccagaagagaacaccagtt

SEQ ID NO: 7743867 - DNA, 22 bp, Homo sapiens
ctggctcttgcgactcagcttg

SEQ ID NO: 7743868 - DNA, 20 bp, Homo sapiens
cttgtacatgataaagattt

SEQ ID NO: 7743869 - DNA, 22 bp, Homo sapiens
cttatttactgatccacagatg

SEQ ID NO: 7743870 - DNA, 22 bp, Homo sapiens
ctgggtgacagagtgagatggt

SEQ ID NO: 7743871 - DNA, 22 bp, Homo sapiens
ctgggtgctgtgggctcagagg

SEQ ID NO: 7743872 - DNA, 22 bp, Homo sapiens
ctgggtgccagcatggctgagt

SEQ ID NO: 7743873 - DNA, 22 bp, Homo sapiens
ttcaggattatactctcttccc

SEQ ID NO: 7743874 - DNA, 22 bp, Homo sapiens
ttcaaatttggtatgcaagcca

SEQ ID NO: 7743875 - DNA, 20 bp, Homo sapiens
ttcaagttgggtctctggct

SEQ ID NO: 7743876 - DNA, 22 bp, Homo sapiens
ttcaagttctgtggagagctgt

SEQ ID NO: 7743877 - DNA, 22 bp, Homo sapiens
ttcaagttctagtgttcacttc

SEQ ID NO: 7743878 - DNA, 22 bp, Homo sapiens
ttcaagttaatgattctggttt

SEQ ID NO: 7743879 - DNA, 22 bp, Homo sapiens
ttcaagttagagatatatttag

SEQ ID NO: 7743880 - DNA, 22 bp, Homo sapiens
ttcaagtttgtatttctgtatt

SEQ ID NO: 7743881 - DNA, 22 bp, Homo sapiens
ttcaagtttactttgaagttta

SEQ ID NO: 7743882 - DNA, 22 bp, Homo sapiens
ttcaagttttatattgaagcaa

SEQ ID NO: 7743883 - DNA, 22 bp, Homo sapiens
ctacaacaccaggcacggagtg

SEQ ID NO: 7743884 - DNA, 22 bp, Homo sapiens
ctacaacatagtcttctacaga

SEQ ID NO: 7743885 - DNA, 22 bp, Homo sapiens
ctatgttctcggcactatggat

SEQ ID NO: 7743886 - DNA, 22 bp, Homo sapiens
ccttccttgtctacaaaagctc

SEQ ID NO: 7743887 - DNA, 22 bp, Homo sapiens
ttacttttgcaccaaactaata

SEQ ID NO: 7743888 - DNA, 21 bp, Homo sapiens
cctgtgctccacacagggtcc

SEQ ID NO: 7743889 - DNA, 21 bp, Homo sapiens
cctgtgctatcagcttgggtt

SEQ ID NO: 7743890 - DNA, 22 bp, Homo sapiens
ttaaagcttgattcgaagctta

SEQ ID NO: 7743891 - DNA, 22 bp, Homo sapiens
ttaaaggatctttgtcattaat

SEQ ID NO: 7743892 - DNA, 22 bp, Homo sapiens
tgtttagaatcattcaaaagtt

SEQ ID NO: 7743893 - DNA, 22 bp, Homo sapiens
cctgggctctgaggagggagtc

SEQ ID NO: 7743894 - DNA, 22 bp, Homo sapiens
cctgggctgctcatggggatga

SEQ ID NO: 7743895 - DNA, 22 bp, Homo sapiens
tgttacaaggaagaatgtaggt

SEQ ID NO: 7743896 - DNA, 22 bp, Homo sapiens
tgttacaagtcttgaggtactt

SEQ ID NO: 7743897 - DNA, 22 bp, Homo sapiens
tggggctgtgagactacaggat

SEQ ID NO: 7743898 - DNA, 19 bp, Homo sapiens
cctgggagtcagctgaagg

SEQ ID NO: 7743899 - DNA, 22 bp, Homo sapiens
cctgggagtggcactcacagca

SEQ ID NO: 7743900 - DNA, 22 bp, Homo sapiens
cctgggagtgcacaggtttcgt

SEQ ID NO: 7743901 - DNA, 21 bp, Homo sapiens
tttcaatttgccttgagtcat

SEQ ID NO: 7743902 - DNA, 22 bp, Homo sapiens
tttcaatttccaggctagaatt

SEQ ID NO: 7743903 - DNA, 22 bp, Homo sapiens
tttcaattgactttggaagaaa

SEQ ID NO: 7743904 - DNA, 22 bp, Homo sapiens
tttccttgcctcctgtccttct

SEQ ID NO: 7743905 - DNA, 22 bp, Homo sapiens
tttaggccagatttatttgaca

SEQ ID NO: 7743906 - DNA, 22 bp, Homo sapiens
ctcccagattcctgctgtggga

SEQ ID NO: 7743907 - DNA, 22 bp, Homo sapiens
ctcccagagagcaggtgggccg

SEQ ID NO: 7743908 - DNA, 22 bp, Homo sapiens
ctcccagagaccaagctgagaa

SEQ ID NO: 7743909 - DNA, 22 bp, Homo sapiens
tttccttgttattatttgtcct

SEQ ID NO: 7743910 - DNA, 18 bp, Homo sapiens
tttccttgtatgaacata

SEQ ID NO: 7743911 - DNA, 22 bp, Homo sapiens
tttcctttatgacatcaccact

SEQ ID NO: 7743912 - DNA, 22 bp, Homo sapiens
tttgggcaattcagtgggacct

SEQ ID NO: 7743913 - DNA, 22 bp, Homo sapiens
tttgtacactgtctactatgaa

SEQ ID NO: 7743914 - DNA, 22 bp, Homo sapiens
ttttagatagtttaactgcact

SEQ ID NO: 7743915 - DNA, 20 bp, Homo sapiens
ctcttcaaatattttattct

SEQ ID NO: 7743916 - DNA, 22 bp, Homo sapiens
ctgaggccggagcactgaagag

SEQ ID NO: 7743917 - DNA, 22 bp, Homo sapiens
ctgaggccagctgcagagctct

SEQ ID NO: 7743918 - DNA, 20 bp, Homo sapiens
ctctttgcaatgcagaagac

SEQ ID NO: 7743919 - DNA, 22 bp, Homo sapiens
catttattcatgatctgtagct

SEQ ID NO: 7743920 - DNA, 22 bp, Homo sapiens
tccctggggtatcgctgaggca

SEQ ID NO: 7743921 - DNA, 22 bp, Homo sapiens
tccctgggttacctttcaaggt

SEQ ID NO: 7743922 - DNA, 22 bp, Homo sapiens
catttaagagaaatatttagtt

SEQ ID NO: 7743923 - DNA, 22 bp, Homo sapiens
catttaatagatgctgtttcag

SEQ ID NO: 7743924 - DNA, 22 bp, Homo sapiens
cattgtcacccaaagctcatag

SEQ ID NO: 7743925 - DNA, 22 bp, Homo sapiens
cattgtcattctatgctattca

SEQ ID NO: 7743926 - DNA, 22 bp, Homo sapiens
tccatttgaaatgaaagtgata

SEQ ID NO: 7743927 - DNA, 22 bp, Homo sapiens
cattagcattcagtgacttgta

SEQ ID NO: 7743928 - DNA, 22 bp, Homo sapiens
cattagcattacttcaaagagt

SEQ ID NO: 7743929 - DNA, 22 bp, Homo sapiens
cattagaaggttttaaaggaat

SEQ ID NO: 7743930 - DNA, 22 bp, Homo sapiens
cattagaacctataaaaagcat

SEQ ID NO: 7743931 - DNA, 22 bp, Homo sapiens
cattacagaatatgtaatgatc

SEQ ID NO: 7743932 - DNA, 22 bp, Homo sapiens
cattacagtgtcagaggaactg

SEQ ID NO: 7743933 - DNA, 22 bp, Homo sapiens
tcctgggcttagtggctaggtc

SEQ ID NO: 7743934 - DNA, 22 bp, Homo sapiens
tcctgggagcatgaagagggat

SEQ ID NO: 7743935 - DNA, 22 bp, Homo sapiens
tcctgggagcccttgctccacc

SEQ ID NO: 7743936 - DNA, 23 bp, Homo sapiens
tccttgggcctgcccagagtggt

SEQ ID NO: 7743937 - DNA, 22 bp, Homo sapiens
tccttgggtcagtgagtgaggt

SEQ ID NO: 7743938 - DNA, 22 bp, Homo sapiens
tccttggtgcaaatgatttaat

SEQ ID NO: 7743939 - DNA, 22 bp, Homo sapiens
tccttggtgctggagctcagac

SEQ ID NO: 7743940 - DNA, 22 bp, Homo sapiens
catctgtgtatctgtgcttaga

SEQ ID NO: 7743941 - DNA, 22 bp, Homo sapiens
catgaagatcctgtatgttttt

SEQ ID NO: 7743942 - DNA, 22 bp, Homo sapiens
tcagggattaaggtcaaaggtg

SEQ ID NO: 7743943 - DNA, 22 bp, Homo sapiens
tcagggagggacctgaggctgg

SEQ ID NO: 7743944 - DNA, 22 bp, Homo sapiens
tcagggagatttggggactcaa

SEQ ID NO: 7743945 - DNA, 22 bp, Homo sapiens
tcagggagtgttggcaggatca

SEQ ID NO: 7743946 - DNA, 22 bp, Homo sapiens
tcagggaggtgtctgccagaga

SEQ ID NO: 7743947 - DNA, 22 bp, Homo sapiens
tcagggagaggtgagagcctgt

SEQ ID NO: 7743948 - DNA, 22 bp, Homo sapiens
cataatgtgtgtcatacagact

SEQ ID NO: 7743949 - DNA, 22 bp, Homo sapiens
cataatgtctgacacagtaaga

SEQ ID NO: 7743950 - DNA, 22 bp, Homo sapiens
cataatatctccgattacttgc

SEQ ID NO: 7743951 - DNA, 22 bp, Homo sapiens
cagttttccatgactcagagag

SEQ ID NO: 7743952 - DNA, 22 bp, Homo sapiens
cagttttctaaagtctctttaa

SEQ ID NO: 7743953 - DNA, 22 bp, Homo sapiens
cagttttggtcctttctaggta

SEQ ID NO: 7743954 - DNA, 22 bp, Homo sapiens
tcagatgagtgctttcagctgc

SEQ ID NO: 7743955 - DNA, 22 bp, Homo sapiens
tcagatatgaattcatatctct

SEQ ID NO: 7743956 - DNA, 22 bp, Homo sapiens
tcagatatagtcatttaaataa

SEQ ID NO: 7743957 - DNA, 22 bp, Homo sapiens
tcagatatgaattcatatctct

SEQ ID NO: 7743958 - DNA, 22 bp, Homo sapiens
tcaatagattaggtattagatt

SEQ ID NO: 7743959 - DNA, 22 bp, Homo sapiens
taatgtacctccagatgttgta

SEQ ID NO: 7743960 - DNA, 22 bp, Homo sapiens
taagtccacctcattcttcagc

SEQ ID NO: 7743961 - DNA, 22 bp, Homo sapiens
cagctcacttgtttcatcttct

SEQ ID NO: 7743962 - DNA, 22 bp, Homo sapiens
caggctgggactgacccctgct

SEQ ID NO: 7743963 - DNA, 22 bp, Homo sapiens
cagggaagagccgatgctgcag

SEQ ID NO: 7743964 - DNA, 22 bp, Homo sapiens
caggggcttttcctctataagg

SEQ ID NO: 7743965 - DNA, 22 bp, Homo sapiens
caggggcttaagtgacagaagg

SEQ ID NO: 7743966 - DNA, 18 bp, Homo sapiens
taggctgggggctgtagt

SEQ ID NO: 7743967 - DNA, 22 bp, Homo sapiens
cagggctccatgcagggactcc

SEQ ID NO: 7743968 - DNA, 22 bp, Homo sapiens
taggccaagttgatcagacatc

SEQ ID NO: 7743969 - DNA, 22 bp, Homo sapiens
tagatttcaggagacaaaatgg

SEQ ID NO: 7743970 - DNA, 22 bp, Homo sapiens
cagggagatcttggctcctggt

SEQ ID NO: 7743971 - DNA, 22 bp, Homo sapiens
tagatttctcattcatagattg

SEQ ID NO: 7743972 - DNA, 20 bp, Homo sapiens
tatttgaaatggccaagtgt

SEQ ID NO: 7743973 - DNA, 22 bp, Homo sapiens
tatttgaagattcttctgatgt

SEQ ID NO: 7743974 - DNA, 22 bp, Homo sapiens
tattttactttaaagcgagaga

SEQ ID NO: 7743975 - DNA, 22 bp, Homo sapiens
tcaatagagccttctttcaggt

SEQ ID NO: 7743976 - DNA, 22 bp, Homo sapiens
tattatagactgagggtcaggc

SEQ ID NO: 7743977 - DNA, 22 bp, Homo sapiens
tgaatgcaagaaggaacatgaa

SEQ ID NO: 7743978 - DNA, 22 bp, Homo sapiens
tgagacctctgggttctgagct

SEQ ID NO: 7743979 - DNA, 22 bp, Homo sapiens
tgagaccttaaaaggtatgtca

SEQ ID NO: 7743980 - DNA, 22 bp, Homo sapiens
tgagacctgtagcttcacagag

SEQ ID NO: 7743981 - DNA, 22 bp, Homo sapiens
tgatttcctgtgcgcccttagg

SEQ ID NO: 7743982 - DNA, 22 bp, Homo sapiens
tgagggcagagcactggggagc

SEQ ID NO: 7743983 - DNA, 22 bp, Homo sapiens
tgagggcaaagtggtgctgagg

SEQ ID NO: 7743984 - DNA, 22 bp, Homo sapiens
tgaggggaactgatgcccattg

SEQ ID NO: 7743985 - DNA, 22 bp, Homo sapiens
tctttcttctttcatagtgtga

SEQ ID NO: 7743986 - DNA, 22 bp, Homo sapiens
tctttgggctaggagtttggat

SEQ ID NO: 7743987 - DNA, 22 bp, Homo sapiens
ccaggctctgtgtgggctagag

SEQ ID NO: 7743988 - DNA, 22 bp, Homo sapiens
ccaggctctgttccccgaggag

SEQ ID NO: 7743989 - DNA, 22 bp, Homo sapiens
ccaggctctgtctggtcagaag

SEQ ID NO: 7743990 - DNA, 22 bp, Homo sapiens
ccaggactcagtggggaaaggg

SEQ ID NO: 7743991 - DNA, 19 bp, Homo sapiens
tctgggagagtgaatctga

SEQ ID NO: 7743992 - DNA, 22 bp, Homo sapiens
tctgggagcctgaaagtgaatg

SEQ ID NO: 7743993 - DNA, 22 bp, Homo sapiens
tctgggagcagctcagcagatt

SEQ ID NO: 7743994 - DNA, 22 bp, Homo sapiens
tctgggagccatgccttggagt

SEQ ID NO: 7743995 - DNA, 22 bp, Homo sapiens
ccaggacttcgaggctacagtg

SEQ ID NO: 7743996 - DNA, 20 bp, Homo sapiens
ccaggactgctggggactct

SEQ ID NO: 7743997 - DNA, 22 bp, Homo sapiens
ccaggaaggatcgtttgggagt

SEQ ID NO: 7743998 - DNA, 22 bp, Homo sapiens
ccctgaggaaagggtggagggc

SEQ ID NO: 7743999 - DNA, 22 bp, Homo sapiens
tggagcagaaatggcctcttgt

SEQ ID NO: 7744000 - DNA, 22 bp, Homo sapiens
ccctgaggaccaggaaggaggg

SEQ ID NO: 7744001 - DNA, 22 bp, Homo sapiens
tgctgggatatagcttctaggg

SEQ ID NO: 7744002 - DNA, 20 bp, Homo sapiens
cccaggggttgtggtgagga

SEQ ID NO: 7744003 - DNA, 22 bp, Homo sapiens
tgggctggcccaccacacctcg

SEQ ID NO: 7744004 - DNA, 22 bp, Homo sapiens
tggctggctgtccagctgggca

SEQ ID NO: 7744005 - DNA, 22 bp, Homo sapiens
cctagactagaggcagggagcc

SEQ ID NO: 7744006 - DNA, 22 bp, Homo sapiens
cctaggagaggtaatgaagttc

SEQ ID NO: 7744007 - DNA, 22 bp, Homo sapiens
cctcagggaatgggaggctggg

SEQ ID NO: 7744008 - DNA, 21 bp, Homo sapiens
tggctctgggtaggagagtgc

SEQ ID NO: 7744009 - DNA, 22 bp, Homo sapiens
tggcctggggacctgtgagacc

SEQ ID NO: 7744010 - DNA, 22 bp, Homo sapiens
tggcctggctgccctgtctgga

SEQ ID NO: 7744011 - DNA, 22 bp, Homo sapiens
tttctagaaacattatctctat

SEQ ID NO: 7744012 - DNA, 18 bp, Homo sapiens
tttctcagactctctttc

SEQ ID NO: 7744013 - DNA, 22 bp, Homo sapiens
tttctacattcaaaaactacca

SEQ ID NO: 7744014 - DNA, 22 bp, Homo sapiens
tttcagagttgtcttcttgacc

SEQ ID NO: 7744015 - DNA, 22 bp, Homo sapiens
tttccaaaggtggcaggaacaa

SEQ ID NO: 7744016 - DNA, 22 bp, Homo sapiens
tttccaaaggtggcaggaacaa

SEQ ID NO: 7744017 - DNA, 22 bp, Homo sapiens
tttccaaagttgccataagctt

SEQ ID NO: 7744018 - DNA, 22 bp, Homo sapiens
tttcttatgagcaagactctat

SEQ ID NO: 7744019 - DNA, 22 bp, Homo sapiens
tttacaagaaatcatgatgcta

SEQ ID NO: 7744020 - DNA, 22 bp, Homo sapiens
tttacaactttctgttctgtat

SEQ ID NO: 7744021 - DNA, 22 bp, Homo sapiens
tttacaacctcatattctgatg

SEQ ID NO: 7744022 - DNA, 22 bp, Homo sapiens
tttacaacgttcctggtgctaa

SEQ ID NO: 7744023 - DNA, 22 bp, Homo sapiens
tttacaacccaagtccagagag

SEQ ID NO: 7744024 - DNA, 22 bp, Homo sapiens
tttacaaggcagaactgattaa

SEQ ID NO: 7744025 - DNA, 22 bp, Homo sapiens
tttacaagtacacctaacagct

SEQ ID NO: 7744026 - DNA, 22 bp, Homo sapiens
tttaattttcctcttcctggag

SEQ ID NO: 7744027 - DNA, 22 bp, Homo sapiens
tttacaacataggccccaagaa

SEQ ID NO: 7744028 - DNA, 22 bp, Homo sapiens
ttggtcttgagtggcttgttaa

SEQ ID NO: 7744029 - DNA, 22 bp, Homo sapiens
ttggtctgtgttacatcattta

SEQ ID NO: 7744030 - DNA, 22 bp, Homo sapiens
ttggtcttcagagatctggtgg

SEQ ID NO: 7744031 - DNA, 22 bp, Homo sapiens
ttggtcttcatccgtcacagca

SEQ ID NO: 7744032 - DNA, 22 bp, Homo sapiens
ttggtctgtagttttcttatgt

SEQ ID NO: 7744033 - DNA, 22 bp, Homo sapiens
ttggtctgctctgatgttttct

SEQ ID NO: 7744034 - DNA, 22 bp, Homo sapiens
ttggtcctgcagaggggtctgg

SEQ ID NO: 7744035 - DNA, 22 bp, Homo sapiens
ttgtgaatagtgccgcaataaa

SEQ ID NO: 7744036 - DNA, 23 bp, Homo sapiens
ttgtttctttgtattgtctctat

SEQ ID NO: 7744037 - DNA, 22 bp, Homo sapiens
ttgtttctttgaagtttctaga

SEQ ID NO: 7744038 - DNA, 22 bp, Homo sapiens
ttgtttcttcaggcttttagga

SEQ ID NO: 7744039 - DNA, 22 bp, Homo sapiens
ttgtttcttcaggcttttagga

SEQ ID NO: 7744040 - DNA, 20 bp, Homo sapiens
ttgtttctgctattttctaa

SEQ ID NO: 7744041 - DNA, 22 bp, Homo sapiens
ttgtgaatggtgccgcaataaa

SEQ ID NO: 7744042 - DNA, 22 bp, Homo sapiens
ttgttacatcttatgtaagtgg

SEQ ID NO: 7744043 - DNA, 22 bp, Homo sapiens
tttttgatctgagcagttggag

SEQ ID NO: 7744044 - DNA, 22 bp, Homo sapiens
tttttcttgtgctggatctaat

SEQ ID NO: 7744045 - DNA, 22 bp, Homo sapiens
ttttgacaatgctaatctcaat

SEQ ID NO: 7744046 - DNA, 22 bp, Homo sapiens
ttttgaataattcagaaacagc

SEQ ID NO: 7744047 - DNA, 22 bp, Homo sapiens
tttgtacattcaaatgtcccat

SEQ ID NO: 7744048 - DNA, 22 bp, Homo sapiens
tttgtacatgaatgtgcaccca

SEQ ID NO: 7744049 - DNA, 22 bp, Homo sapiens
ttttatcagcagggataacaag

SEQ ID NO: 7744050 - DNA, 22 bp, Homo sapiens
ttagaagcatcacctgttctgg

SEQ ID NO: 7744051 - DNA, 22 bp, Homo sapiens
ttagaagcaggctgtgtcccca

SEQ ID NO: 7744052 - DNA, 19 bp, Homo sapiens
ttagaagccataggtacag

SEQ ID NO: 7744053 - DNA, 22 bp, Homo sapiens
ttagagattggttgacagattt

SEQ ID NO: 7744054 - DNA, 22 bp, Homo sapiens
ttagagattgtctagtattgtg

SEQ ID NO: 7744055 - DNA, 22 bp, Homo sapiens
ttagagctagatgaggtcatga

SEQ ID NO: 7744056 - DNA, 22 bp, Homo sapiens
ttacacagtggttaagtctggg

SEQ ID NO: 7744057 - DNA, 22 bp, Homo sapiens
ttacacagtgcacaagcagagt

SEQ ID NO: 7744058 - DNA, 22 bp, Homo sapiens
ttacacaggcacttaaaatgca

SEQ ID NO: 7744059 - DNA, 17 bp, Homo sapiens
ttacacaggagagctct

SEQ ID NO: 7744060 - DNA, 22 bp, Homo sapiens
ttacacagcttctatccttgaa

SEQ ID NO: 7744061 - DNA, 22 bp, Homo sapiens
ttacacagaaattttattgcct

SEQ ID NO: 7744062 - DNA, 22 bp, Homo sapiens
ttaacacagggggagacaaagt

SEQ ID NO: 7744063 - DNA, 22 bp, Homo sapiens
tgtttttatctctgtgtacaac

SEQ ID NO: 7744064 - DNA, 22 bp, Homo sapiens
ttaaagcatcctgtcagtctgt

SEQ ID NO: 7744065 - DNA, 22 bp, Homo sapiens
tgtttttaaataatgatagaaa

SEQ ID NO: 7744066 - DNA, 22 bp, Homo sapiens
ttaaatattttcagcagggtca

SEQ ID NO: 7744067 - DNA, 22 bp, Homo sapiens
tgttttcttcctaattgctcat

SEQ ID NO: 7744068 - DNA, 22 bp, Homo sapiens
ttaagtccttggtaattttctt

SEQ ID NO: 7744069 - DNA, 22 bp, Homo sapiens
ttaaggaatttatagttgtact

SEQ ID NO: 7744070 - DNA, 22 bp, Homo sapiens
ttaacttttatttctgctcgcc

SEQ ID NO: 7744071 - DNA, 22 bp, Homo sapiens
ttaacagcttgtaatagaaggg

SEQ ID NO: 7744072 - DNA, 22 bp, Homo sapiens
tgttccgaccgtggggtttgat

SEQ ID NO: 7744073 - DNA, 22 bp, Homo sapiens
tgttatatctaaatagccacat

SEQ ID NO: 7744074 - DNA, 20 bp, Homo sapiens
tgttattagcaagcttcttt

SEQ ID NO: 7744075 - DNA, 22 bp, Homo sapiens
tgtttcaagcaatagcatttca

SEQ ID NO: 7744076 - DNA, 22 bp, Homo sapiens
tgtttccatggtgacagcagct

SEQ ID NO: 7744077 - DNA, 22 bp, Homo sapiens
tgtttacagggtgattttacct

SEQ ID NO: 7744078 - DNA, 22 bp, Homo sapiens
tgtttacacaatagtctctctc

SEQ ID NO: 7744079 - DNA, 22 bp, Homo sapiens
tgtttacagaaggcagacttcc

SEQ ID NO: 7744080 - DNA, 22 bp, Homo sapiens
tgtttacaaggagaatttgagg

SEQ ID NO: 7744081 - DNA, 22 bp, Homo sapiens
tgtttaagttctgctccttatt

SEQ ID NO: 7744082 - DNA, 22 bp, Homo sapiens
tgtgtgaaggagccactgttca

SEQ ID NO: 7744083 - DNA, 21 bp, Homo sapiens
tgtggtcttttagttccatca

SEQ ID NO: 7744084 - DNA, 22 bp, Homo sapiens
tgtggtctcctgtcttggcctt

SEQ ID NO: 7744085 - DNA, 22 bp, Homo sapiens
tgtggtctcgttatgttgccca

SEQ ID NO: 7744086 - DNA, 19 bp, Homo sapiens
ttctgggcattcatattta

SEQ ID NO: 7744087 - DNA, 22 bp, Homo sapiens
ttctagttaatgtagcatcttg

SEQ ID NO: 7744088 - DNA, 22 bp, Homo sapiens
ttctagttttgccacaggatac

SEQ ID NO: 7744089 - DNA, 22 bp, Homo sapiens
ttctttagcaacttggatttag

SEQ ID NO: 7744090 - DNA, 22 bp, Homo sapiens
ttcttgatttcatgcagttaag

SEQ ID NO: 7744091 - DNA, 22 bp, Homo sapiens
ttcttgattcttccttgaagga

SEQ ID NO: 7744092 - DNA, 22 bp, Homo sapiens
ttcttgatgaatgctaagaact

SEQ ID NO: 7744093 - DNA, 22 bp, Homo sapiens
ttcttacatctataaagttggg

SEQ ID NO: 7744094 - DNA, 22 bp, Homo sapiens
ttcttacagagtttacagagcc

SEQ ID NO: 7744095 - DNA, 22 bp, Homo sapiens
ttctgggcctcctaggacaggc

SEQ ID NO: 7744096 - DNA, 22 bp, Homo sapiens
ttctggggccccagtgtcctcg

SEQ ID NO: 7744097 - DNA, 22 bp, Homo sapiens
ttctgggggccaggacagtggt

SEQ ID NO: 7744098 - DNA, 19 bp, Homo sapiens
ttctggggcctggccttgg

SEQ ID NO: 7744099 - DNA, 22 bp, Homo sapiens
ttctggggctaatacagaggtc

SEQ ID NO: 7744100 - DNA, 22 bp, Homo sapiens
ttctgggggaatacagctatga

SEQ ID NO: 7744101 - DNA, 22 bp, Homo sapiens
ttcttacaagtattccaggtcc

SEQ ID NO: 7744102 - DNA, 22 bp, Homo sapiens
ttgagatattcagttccattga

SEQ ID NO: 7744103 - DNA, 22 bp, Homo sapiens
ttctttatgcttctgtttaggc

SEQ ID NO: 7744104 - DNA, 22 bp, Homo sapiens
ttcacagtgctcacagttcagt

SEQ ID NO: 7744105 - DNA, 22 bp, Homo sapiens
ttcaactttggagatttaataa

SEQ ID NO: 7744106 - DNA, 22 bp, Homo sapiens
ttcaactttatgcatatgtatt

SEQ ID NO: 7744107 - DNA, 22 bp, Homo sapiens
ttccaatttgtggtgagttaat

SEQ ID NO: 7744108 - DNA, 22 bp, Homo sapiens
ttccttagttgactgtcttagt

SEQ ID NO: 7744109 - DNA, 22 bp, Homo sapiens
ttccttagcagacctggtatcc

SEQ ID NO: 7744110 - DNA, 22 bp, Homo sapiens
ttctaggaccctgcgtgagaac

SEQ ID NO: 7744111 - DNA, 23 bp, Homo sapiens
ttctaggctctgattgggcttcc

SEQ ID NO: 7744112 - DNA, 22 bp, Homo sapiens
ttctacaaatatttactgttcc

SEQ ID NO: 7744113 - DNA, 22 bp, Homo sapiens
ttcctagggcagagccgctggg

SEQ ID NO: 7744114 - DNA, 18 bp, Homo sapiens
ttcctaggaactaagctt

SEQ ID NO: 7744115 - DNA, 22 bp, Homo sapiens
ttcctatggccagagtcaaaga

SEQ ID NO: 7744116 - DNA, 22 bp, Homo sapiens
ttcctctggaggctctaggaga

SEQ ID NO: 7744117 - DNA, 22 bp, Homo sapiens
ggaagctaagataatttaagta

SEQ ID NO: 7744118 - DNA, 22 bp, Homo sapiens
ggaagcggccctgagcgcaggg

SEQ ID NO: 7744119 - DNA, 22 bp, Homo sapiens
ggagagaggctggccgtgatga

SEQ ID NO: 7744120 - DNA, 22 bp, Homo sapiens
gctctggatccggctgggtctg

SEQ ID NO: 7744121 - DNA, 22 bp, Homo sapiens
gctctggactggggcctgagaa

SEQ ID NO: 7744122 - DNA, 22 bp, Homo sapiens
caaattttgtgtgttctctagt

SEQ ID NO: 7744123 - DNA, 22 bp, Homo sapiens
caagcgtggctgctctgatgga

SEQ ID NO: 7744124 - DNA, 22 bp, Homo sapiens
gctggaagaatgagtgcctcgt

SEQ ID NO: 7744125 - DNA, 22 bp, Homo sapiens
caagaagaggtgattggtaagt

SEQ ID NO: 7744126 - DNA, 22 bp, Homo sapiens
cacatgaattgatgccaagtgc

SEQ ID NO: 7744127 - DNA, 22 bp, Homo sapiens
ggcaaggggtcaggctgagaca

SEQ ID NO: 7744128 - DNA, 22 bp, Homo sapiens
cagaataaaggtacaattgagt

SEQ ID NO: 7744129 - DNA, 22 bp, Homo sapiens
cagacaaagcggaaactgttta

SEQ ID NO: 7744130 - DNA, 22 bp, Homo sapiens
ggctggcactgaggagagctct

SEQ ID NO: 7744131 - DNA, 22 bp, Homo sapiens
ggctggcacctgccctccgctg

SEQ ID NO: 7744132 - DNA, 22 bp, Homo sapiens
ggctggcacgaagccctgctgg

SEQ ID NO: 7744133 - DNA, 22 bp, Homo sapiens
gggagctgatcaggtggattca

SEQ ID NO: 7744134 - DNA, 22 bp, Homo sapiens
cagagaagagtctggcctctct

SEQ ID NO: 7744135 - DNA, 22 bp, Homo sapiens
gggatgactacttatgggaagt

SEQ ID NO: 7744136 - DNA, 22 bp, Homo sapiens
gggctggaggaccggcctcgga

SEQ ID NO: 7744137 - DNA, 22 bp, Homo sapiens
gggctggagtcttctgaaagcc

SEQ ID NO: 7744138 - DNA, 22 bp, Homo sapiens
gggctggaggagatccagaggc

SEQ ID NO: 7744139 - DNA, 22 bp, Homo sapiens
gggctggaggcctgcctggtta

SEQ ID NO: 7744140 - DNA, 19 bp, Homo sapiens
gggctggagggatagagcc

SEQ ID NO: 7744141 - DNA, 22 bp, Homo sapiens
gggctgtgctgagtaggaggtg

SEQ ID NO: 7744142 - DNA, 22 bp, Homo sapiens
gggctgtgagagtggggctgct

SEQ ID NO: 7744143 - DNA, 22 bp, Homo sapiens
gggctggatctcacgtgagacc

SEQ ID NO: 7744144 - DNA, 21 bp, Homo sapiens
gggctggatattggaaagagg

SEQ ID NO: 7744145 - DNA, 22 bp, Homo sapiens
gggctggagttgggaagacaaa

SEQ ID NO: 7744146 - DNA, 22 bp, Homo sapiens
ggtatttactgagagccactct

SEQ ID NO: 7744147 - DNA, 22 bp, Homo sapiens
cagatatattttccttattagg

SEQ ID NO: 7744148 - DNA, 22 bp, Homo sapiens
ggtcctctgagcacgccaggca

SEQ ID NO: 7744149 - DNA, 20 bp, Homo sapiens
gggtcctgacttggtctcct

SEQ ID NO: 7744150 - DNA, 18 bp, Homo sapiens
gggtcctgttcttggaag

SEQ ID NO: 7744151 - DNA, 18 bp, Homo sapiens
gggtcctgtgggagacag

SEQ ID NO: 7744152 - DNA, 22 bp, Homo sapiens
gtacacatactattcaaagaga

SEQ ID NO: 7744153 - DNA, 22 bp, Homo sapiens
cagattaagtgctcaacagtgt

SEQ ID NO: 7744154 - DNA, 22 bp, Homo sapiens
cagattctccaggggctgcaga

SEQ ID NO: 7744155 - DNA, 22 bp, Homo sapiens
cagatttggggtctcctgttag

SEQ ID NO: 7744156 - DNA, 22 bp, Homo sapiens
cagatttcatgcgaaatggggt

SEQ ID NO: 7744157 - DNA, 22 bp, Homo sapiens
gaggagctgtcaccgtgactca

SEQ ID NO: 7744158 - DNA, 22 bp, Homo sapiens
gaggagggcagttcctctttta

SEQ ID NO: 7744159 - DNA, 22 bp, Homo sapiens
gaggagggctttgttgatgtta

SEQ ID NO: 7744160 - DNA, 22 bp, Homo sapiens
gaggagggcctggtgtcccttc

SEQ ID NO: 7744161 - DNA, 22 bp, Homo sapiens
gaggaggggacagtacttgtgc

SEQ ID NO: 7744162 - DNA, 22 bp, Homo sapiens
gaggcctgggttggaggtgcat

SEQ ID NO: 7744163 - DNA, 22 bp, Homo sapiens
gaggctccttgaaagggggact

SEQ ID NO: 7744164 - DNA, 22 bp, Homo sapiens
gaggctccctttaggtccagat

SEQ ID NO: 7744165 - DNA, 22 bp, Homo sapiens
gaggctcctcattcagtatgct

SEQ ID NO: 7744166 - DNA, 22 bp, Homo sapiens
gaggctccctcaactctgggtg

SEQ ID NO: 7744167 - DNA, 22 bp, Homo sapiens
gaggctcccaaggggctaggcc

SEQ ID NO: 7744168 - DNA, 22 bp, Homo sapiens
gaggttccagacagcttaggga

SEQ ID NO: 7744169 - DNA, 22 bp, Homo sapiens
gaggttccccattgtactggct

SEQ ID NO: 7744170 - DNA, 22 bp, Homo sapiens
gagacagcttaattggtggtca

SEQ ID NO: 7744171 - DNA, 22 bp, Homo sapiens
atgggagggtggaaaggctctg

SEQ ID NO: 7744172 - DNA, 20 bp, Homo sapiens
gagctgagtgtggtcatggg

SEQ ID NO: 7744173 - DNA, 22 bp, Homo sapiens
ctttttactctgttgtctcagc

SEQ ID NO: 7744174 - DNA, 22 bp, Homo sapiens
ctttttatagctatgtcctatg

SEQ ID NO: 7744175 - DNA, 22 bp, Homo sapiens
ctttggtcagagggatggagtt

SEQ ID NO: 7744176 - DNA, 22 bp, Homo sapiens
ctttgctgagctggttgttcaa

SEQ ID NO: 7744177 - DNA, 22 bp, Homo sapiens
atctttcatctctattatttga

SEQ ID NO: 7744178 - DNA, 22 bp, Homo sapiens
atctttcagggccatttgtatt

SEQ ID NO: 7744179 - DNA, 22 bp, Homo sapiens
atctttcaatcaggaaaaatct

SEQ ID NO: 7744180 - DNA, 22 bp, Homo sapiens
atctttcttatttgaagaaaga

SEQ ID NO: 7744181 - DNA, 22 bp, Homo sapiens
atgctacatagatacaaaaatg

SEQ ID NO: 7744182 - DNA, 22 bp, Homo sapiens
atgctacattttggtttataaa

SEQ ID NO: 7744183 - DNA, 23 bp, Homo sapiens
atgctctgggctgtgggacctgc

SEQ ID NO: 7744184 - DNA, 22 bp, Homo sapiens
gaagtcatgctcccatcttgct

SEQ ID NO: 7744185 - DNA, 22 bp, Homo sapiens
gaagagagccgcgggacatcag

SEQ ID NO: 7744186 - DNA, 22 bp, Homo sapiens
gaaggaggtctgcattctacag

SEQ ID NO: 7744187 - DNA, 22 bp, Homo sapiens
gaaggaggcgttagccctagga

SEQ ID NO: 7744188 - DNA, 22 bp, Homo sapiens
caaagacacgggaaacaacgtt

SEQ ID NO: 7744189 - DNA, 22 bp, Homo sapiens
caaagaatgagtgagtacataa

SEQ ID NO: 7744190 - DNA, 22 bp, Homo sapiens
caaagaatagcatggcatttgt

SEQ ID NO: 7744191 - DNA, 22 bp, Homo sapiens
gctcccaggttcttgggccttg

SEQ ID NO: 7744192 - DNA, 22 bp, Homo sapiens
gctcccagtctgatggaggaga

SEQ ID NO: 7744193 - DNA, 22 bp, Homo sapiens
gctcccagggaccgcagggcag

SEQ ID NO: 7744194 - DNA, 22 bp, Homo sapiens
gctcccagggacactggccact

SEQ ID NO: 7744195 - DNA, 22 bp, Homo sapiens
atttggtctccatactggttag

SEQ ID NO: 7744196 - DNA, 22 bp, Homo sapiens
atttggtctgtaattacatgga

SEQ ID NO: 7744197 - DNA, 21 bp, Homo sapiens
atttggtcaaggacaactctg

SEQ ID NO: 7744198 - DNA, 22 bp, Homo sapiens
atttggtcagaactctctttag

SEQ ID NO: 7744199 - DNA, 22 bp, Homo sapiens
atttggtcccttgttgtgtccc

SEQ ID NO: 7744200 - DNA, 22 bp, Homo sapiens
atttggggctcaccagggctga

SEQ ID NO: 7744201 - DNA, 22 bp, Homo sapiens
gcccagtagttcaaggttgcag

SEQ ID NO: 7744202 - DNA, 20 bp, Homo sapiens
atttatgtatagcttgttgt

SEQ ID NO: 7744203 - DNA, 22 bp, Homo sapiens
gccagctggaaatctgcttgaa

SEQ ID NO: 7744204 - DNA, 22 bp, Homo sapiens
atttatcaccagttagctgact

SEQ ID NO: 7744205 - DNA, 22 bp, Homo sapiens
gattcactcatattttacgttt

SEQ ID NO: 7744206 - DNA, 22 bp, Homo sapiens
gattcccatgtctgaggaggtg

SEQ ID NO: 7744207 - DNA, 19 bp, Homo sapiens
gcagctgtgggaagagcca

SEQ ID NO: 7744208 - DNA, 22 bp, Homo sapiens
gcagctgtgggttccaagtcta

SEQ ID NO: 7744209 - DNA, 22 bp, Homo sapiens
gcagctgtgggcctcggagagc

SEQ ID NO: 7744210 - DNA, 22 bp, Homo sapiens
gcagctgtggtgctgagatagg

SEQ ID NO: 7744211 - DNA, 22 bp, Homo sapiens
gcagctgtgtaatgagcccaca

SEQ ID NO: 7744212 - DNA, 22 bp, Homo sapiens
gcagctgttcagctggccagat

SEQ ID NO: 7744213 - DNA, 22 bp, Homo sapiens
attcttttttaaggaatagaac

SEQ ID NO: 7744214 - DNA, 22 bp, Homo sapiens
attctgcacatccaagaacagg

SEQ ID NO: 7744215 - DNA, 22 bp, Homo sapiens
attcttttaaatggcagtagta

SEQ ID NO: 7744216 - DNA, 22 bp, Homo sapiens
attcttttcccaactgctttaa

SEQ ID NO: 7744217 - DNA, 22 bp, Homo sapiens
attcttttgtcctagcttgata

SEQ ID NO: 7744218 - DNA, 22 bp, Homo sapiens
attcttttaagccccagggatt

SEQ ID NO: 7744219 - DNA, 23 bp, Homo sapiens
atatcacacccagtacagtctcc

SEQ ID NO: 7744220 - DNA, 22 bp, Homo sapiens
atatcattatgttatgagcaca

SEQ ID NO: 7744221 - DNA, 22 bp, Homo sapiens
ctgggcctggacgggcagatct

SEQ ID NO: 7744222 - DNA, 22 bp, Homo sapiens
ctgggcctggagcccacgagcc

SEQ ID NO: 7744223 - DNA, 22 bp, Homo sapiens
ctgggctgcagcgggagcgacg

SEQ ID NO: 7744224 - DNA, 22 bp, Homo sapiens
ctgggcagtttacattcctacc

SEQ ID NO: 7744225 - DNA, 22 bp, Homo sapiens
ctgtattctgggcagggaagga

SEQ ID NO: 7744226 - DNA, 22 bp, Homo sapiens
ctggtccttgacgcgtgggagg

SEQ ID NO: 7744227 - DNA, 20 bp, Homo sapiens
atccttggcagaatccagga

SEQ ID NO: 7744228 - DNA, 22 bp, Homo sapiens
atcaggaagaattggatgctac

SEQ ID NO: 7744229 - DNA, 20 bp, Homo sapiens
atcaggaagagagactgacc

SEQ ID NO: 7744230 - DNA, 22 bp, Homo sapiens
atcaggaacgttcatggactgt

SEQ ID NO: 7744231 - DNA, 19 bp, Homo sapiens
atcaggaacaaggctgatc

SEQ ID NO: 7744232 - DNA, 23 bp, Homo sapiens
ctgtgctcagagggagggagagc

SEQ ID NO: 7744233 - DNA, 22 bp, Homo sapiens
ataatttacaactgcttttaat

SEQ ID NO: 7744234 - DNA, 22 bp, Homo sapiens
ataatttaaattagtatgtgat

SEQ ID NO: 7744235 - DNA, 22 bp, Homo sapiens
ataatttaattttcacagtggt

SEQ ID NO: 7744236 - DNA, 21 bp, Homo sapiens
ataatgtacaaaaactgtctt

SEQ ID NO: 7744237 - DNA, 22 bp, Homo sapiens
ataattaatttcagtaatctcc

SEQ ID NO: 7744238 - DNA, 22 bp, Homo sapiens
ataattacattatactgttaga

SEQ ID NO: 7744239 - DNA, 22 bp, Homo sapiens
ataatgtttttgtataagcatg

SEQ ID NO: 7744240 - DNA, 20 bp, Homo sapiens
ataattatttacttttgtgc

SEQ ID NO: 7744241 - DNA, 22 bp, Homo sapiens
ctggaactcctggggagctggt

SEQ ID NO: 7744242 - DNA, 22 bp, Homo sapiens
ctggaactcaggatggttagga

SEQ ID NO: 7744243 - DNA, 18 bp, Homo sapiens
atagacaggaaaaatgga

SEQ ID NO: 7744244 - DNA, 22 bp, Homo sapiens
atagacagctacatagaatata

SEQ ID NO: 7744245 - DNA, 22 bp, Homo sapiens
atagacagaaagataatagaat

SEQ ID NO: 7744246 - DNA, 22 bp, Homo sapiens
atagacacagctatgatttgag

SEQ ID NO: 7744247 - DNA, 22 bp, Homo sapiens
atagacagatgatagataaatc

SEQ ID NO: 7744248 - DNA, 22 bp, Homo sapiens
agtttatttctccatttaccta

SEQ ID NO: 7744249 - DNA, 22 bp, Homo sapiens
agttttgatactttctcttcat

SEQ ID NO: 7744250 - DNA, 22 bp, Homo sapiens
agtgggcttactgagggagtgt

SEQ ID NO: 7744251 - DNA, 22 bp, Homo sapiens
agtctgtgtatattcactgccc

SEQ ID NO: 7744252 - DNA, 22 bp, Homo sapiens
agtctgcactcaggtggaggtc

SEQ ID NO: 7744253 - DNA, 22 bp, Homo sapiens
agtccaaggagagacagcattt

SEQ ID NO: 7744254 - DNA, 22 bp, Homo sapiens
agtcatatgacccttcacaaac

SEQ ID NO: 7744255 - DNA, 22 bp, Homo sapiens
agtcatatgtggcattttctaa

SEQ ID NO: 7744256 - DNA, 20 bp, Homo sapiens
agtccaaagcctgtttactt

SEQ ID NO: 7744257 - DNA, 22 bp, Homo sapiens
agtccaaatcttgtttcatatc

SEQ ID NO: 7744258 - DNA, 22 bp, Homo sapiens
aggtctggtgttgggcctgaaa

SEQ ID NO: 7744259 - DNA, 22 bp, Homo sapiens
aggtgagggtgccagtgcatgg

SEQ ID NO: 7744260 - DNA, 22 bp, Homo sapiens
ctacaacattatgctttctgtc

SEQ ID NO: 7744261 - DNA, 22 bp, Homo sapiens
aggtttccagcatggggaaggc

SEQ ID NO: 7744262 - DNA, 22 bp, Homo sapiens
agtaacaggatccaaagaatgt

SEQ ID NO: 7744263 - DNA, 22 bp, Homo sapiens
agtaacaggtgtacagactatc

SEQ ID NO: 7744264 - DNA, 22 bp, Homo sapiens
ccaagataagagacaagattta

SEQ ID NO: 7744265 - DNA, 22 bp, Homo sapiens
catgttttgtgtacagaatatt

SEQ ID NO: 7744266 - DNA, 22 bp, Homo sapiens
catgggctgctgacaggggctc

SEQ ID NO: 7744267 - DNA, 22 bp, Homo sapiens
cagttttatacactgcagctcc

SEQ ID NO: 7744268 - DNA, 22 bp, Homo sapiens
aggacctgacattgtgttttct

SEQ ID NO: 7744269 - DNA, 22 bp, Homo sapiens
aggacctgactggctcctgctt

SEQ ID NO: 7744270 - DNA, 22 bp, Homo sapiens
aggacctgtacctcagcatcta

SEQ ID NO: 7744271 - DNA, 22 bp, Homo sapiens
aggacctgtgttttccttgaat

SEQ ID NO: 7744272 - DNA, 22 bp, Homo sapiens
aggactgaaaatgagttcttct

SEQ ID NO: 7744273 - DNA, 22 bp, Homo sapiens
caggggctccctgggtgccagt

SEQ ID NO: 7744274 - DNA, 22 bp, Homo sapiens
caggggctagcacttaatgttt

SEQ ID NO: 7744275 - DNA, 22 bp, Homo sapiens
caggtgaggctgaacagatgaa

SEQ ID NO: 7744276 - DNA, 23 bp, Homo sapiens
cagggtgaccaatgtggccatca

SEQ ID NO: 7744277 - DNA, 22 bp, Homo sapiens
caggggctgtttgcctcaggcc

SEQ ID NO: 7744278 - DNA, 22 bp, Homo sapiens
caggggctgtgggcggagcctc

SEQ ID NO: 7744279 - DNA, 22 bp, Homo sapiens
cagggtgactgccctggccact

SEQ ID NO: 7744280 - DNA, 22 bp, Homo sapiens
cagggtgagcctctggagccct

SEQ ID NO: 7744281 - DNA, 22 bp, Homo sapiens
caggggctctaatgcatgatca

SEQ ID NO: 7744282 - DNA, 22 bp, Homo sapiens
caggggctctgggtgatgtgag

SEQ ID NO: 7744283 - DNA, 22 bp, Homo sapiens
caggggctctgagattgtctaa

SEQ ID NO: 7744284 - DNA, 22 bp, Homo sapiens
caggggctgaaatgttggggtt

SEQ ID NO: 7744285 - DNA, 22 bp, Homo sapiens
caggggctgagaaggaacgtcc

SEQ ID NO: 7744286 - DNA, 22 bp, Homo sapiens
caggggctgtggcacatggtgt

SEQ ID NO: 7744287 - DNA, 22 bp, Homo sapiens
caggctggagttacctttaggg

SEQ ID NO: 7744288 - DNA, 22 bp, Homo sapiens
caggctggacattagatacata

SEQ ID NO: 7744289 - DNA, 22 bp, Homo sapiens
agctgtggattgggtactttct

SEQ ID NO: 7744290 - DNA, 22 bp, Homo sapiens
agctgtgctgccaagttgctga

SEQ ID NO: 7744291 - DNA, 22 bp, Homo sapiens
cagctctggggcagagtgacta

SEQ ID NO: 7744292 - DNA, 22 bp, Homo sapiens
caggaagagaacatggaggctg

SEQ ID NO: 7744293 - DNA, 22 bp, Homo sapiens
aggccagaacagctctgcacca

SEQ ID NO: 7744294 - DNA, 22 bp, Homo sapiens
aggccagagaggggaccagcct

SEQ ID NO: 7744295 - DNA, 17 bp, Homo sapiens
aggccagatgaggcaag

SEQ ID NO: 7744296 - DNA, 22 bp, Homo sapiens
aggctctgtgcatcctccccaa

SEQ ID NO: 7744297 - DNA, 22 bp, Homo sapiens
aggctgagtcgggaggatcact

SEQ ID NO: 7744298 - DNA, 20 bp, Homo sapiens
aggctcctccaggatgtgtg

SEQ ID NO: 7744299 - DNA, 22 bp, Homo sapiens
aggctcctgagaggcagaggct

SEQ ID NO: 7744300 - DNA, 22 bp, Homo sapiens
aggctcctcggggctgacggcg

SEQ ID NO: 7744301 - DNA, 22 bp, Homo sapiens
aggctcctgatcctggggtctg

SEQ ID NO: 7744302 - DNA, 22 bp, Homo sapiens
aggctcctgcaggtgaggtgct

SEQ ID NO: 7744303 - DNA, 20 bp, Homo sapiens
aggctcctgtacctgaggaa

SEQ ID NO: 7744304 - DNA, 22 bp, Homo sapiens
aggctccttcacagcactcgcc

SEQ ID NO: 7744305 - DNA, 22 bp, Homo sapiens
aggctcaggtgcctcattcaca

SEQ ID NO: 7744306 - DNA, 22 bp, Homo sapiens
aggctcagtatagctggcaagt

SEQ ID NO: 7744307 - DNA, 22 bp, Homo sapiens
agggctaggaatggaactggag

SEQ ID NO: 7744308 - DNA, 21 bp, Homo sapiens
ccgccgctgatagctctgggc

SEQ ID NO: 7744309 - DNA, 22 bp, Homo sapiens
cctctgggaagccagtcctgct

SEQ ID NO: 7744310 - DNA, 22 bp, Homo sapiens
cctctgggagactgctactgag

SEQ ID NO: 7744311 - DNA, 22 bp, Homo sapiens
cctctgggcctggaagggcagt

SEQ ID NO: 7744312 - DNA, 22 bp, Homo sapiens
cctctgggcggagatctgctgc

SEQ ID NO: 7744313 - DNA, 22 bp, Homo sapiens
cctctgggccagcctggaccct

SEQ ID NO: 7744314 - DNA, 22 bp, Homo sapiens
cctctgggcaggtagcagcagc

SEQ ID NO: 7744315 - DNA, 18 bp, Homo sapiens
agggctgatgagtttggg

SEQ ID NO: 7744316 - DNA, 22 bp, Homo sapiens
aggggctggagttcgaggttac

SEQ ID NO: 7744317 - DNA, 22 bp, Homo sapiens
aggggctgctgggtccgcccct

SEQ ID NO: 7744318 - DNA, 22 bp, Homo sapiens
cctgaggattgttggtgcttcc

SEQ ID NO: 7744319 - DNA, 21 bp, Homo sapiens
acataggcgaatgttcgggag

SEQ ID NO: 7744320 - DNA, 22 bp, Homo sapiens
aggatgaggctggcaggtcttg

SEQ ID NO: 7744321 - DNA, 22 bp, Homo sapiens
acagtttgagaaccactagcct

SEQ ID NO: 7744322 - DNA, 20 bp, Homo sapiens
acagtcagggaatagaaaaa

SEQ ID NO: 7744323 - DNA, 19 bp, Homo sapiens
acagtcagggaataaagac

SEQ ID NO: 7744324 - DNA, 22 bp, Homo sapiens
acagtgtgacaattgtgtcaga

SEQ ID NO: 7744325 - DNA, 22 bp, Homo sapiens
acagtatatatagtctaaaagc

SEQ ID NO: 7744326 - DNA, 23 bp, Homo sapiens
aggaagagagagtgcctctttct

SEQ ID NO: 7744327 - DNA, 22 bp, Homo sapiens
aggaagagcatctttgggtctg

SEQ ID NO: 7744328 - DNA, 22 bp, Homo sapiens
agctggtggattatgctgtaca

SEQ ID NO: 7744329 - DNA, 22 bp, Homo sapiens
agctctgggtcacggctgccga

SEQ ID NO: 7744330 - DNA, 22 bp, Homo sapiens
agctctggttattgaagcaggg

SEQ ID NO: 7744331 - DNA, 22 bp, Homo sapiens
acagctgtatccccagagctca

SEQ ID NO: 7744332 - DNA, 22 bp, Homo sapiens
acagctggtgaatgttctctgt

SEQ ID NO: 7744333 - DNA, 22 bp, Homo sapiens
acagctgtattcaagttgcaag

SEQ ID NO: 7744334 - DNA, 22 bp, Homo sapiens
aggctgagaaagtgggaagatg

SEQ ID NO: 7744335 - DNA, 22 bp, Homo sapiens
acatttgattgatgaatcaaat

SEQ ID NO: 7744336 - DNA, 22 bp, Homo sapiens
acatgttagggacagagtatgt

SEQ ID NO: 7744337 - DNA, 22 bp, Homo sapiens
aggcctgacttgaatttagggc

SEQ ID NO: 7744338 - DNA, 22 bp, Homo sapiens
aggcctgaagtgtggagtgggg

SEQ ID NO: 7744339 - DNA, 22 bp, Homo sapiens
aggcctgagccccaggtttgtt

SEQ ID NO: 7744340 - DNA, 22 bp, Homo sapiens
aggcctgagcagaggagtggac

SEQ ID NO: 7744341 - DNA, 22 bp, Homo sapiens
acatgctgggcaatgttgtttt

SEQ ID NO: 7744342 - DNA, 22 bp, Homo sapiens
agggctgacagtgaggagtcaa

SEQ ID NO: 7744343 - DNA, 22 bp, Homo sapiens
ataaaatttgctactgttaaat

SEQ ID NO: 7744344 - DNA, 22 bp, Homo sapiens
actgtactccagcctgggaaac

SEQ ID NO: 7744345 - DNA, 22 bp, Homo sapiens
actgggagaaactgacacctta

SEQ ID NO: 7744346 - DNA, 19 bp, Homo sapiens
acttctgaggaactgcaca

SEQ ID NO: 7744347 - DNA, 22 bp, Homo sapiens
acttctcttcataggtggcaat

SEQ ID NO: 7744348 - DNA, 22 bp, Homo sapiens
agaaattatgcagtagttttat

SEQ ID NO: 7744349 - DNA, 22 bp, Homo sapiens
agaacagcagttatggttcatt

SEQ ID NO: 7744350 - DNA, 22 bp, Homo sapiens
atctaaactgtttactctctgc

SEQ ID NO: 7744351 - DNA, 22 bp, Homo sapiens
atctaaaccctactttctttct

SEQ ID NO: 7744352 - DNA, 18 bp, Homo sapiens
atcctgggagcagacagc

SEQ ID NO: 7744353 - DNA, 22 bp, Homo sapiens
atcatcttaaatctagaatgtg

SEQ ID NO: 7744354 - DNA, 22 bp, Homo sapiens
atcatctggcattcagattggc

SEQ ID NO: 7744355 - DNA, 22 bp, Homo sapiens
atatgcttgggactgatacagt

SEQ ID NO: 7744356 - DNA, 22 bp, Homo sapiens
actttcctagacttcagtgaca

SEQ ID NO: 7744357 - DNA, 22 bp, Homo sapiens
actttcctggccctgtcctctg

SEQ ID NO: 7744358 - DNA, 22 bp, Homo sapiens
agaaagctccccatgagatgat

SEQ ID NO: 7744359 - DNA, 22 bp, Homo sapiens
actgagggccaaaggcactgag

SEQ ID NO: 7744360 - DNA, 22 bp, Homo sapiens
actgagggactcccacctggca

SEQ ID NO: 7744361 - DNA, 22 bp, Homo sapiens
actgagggagagtcttaggttg

SEQ ID NO: 7744362 - DNA, 20 bp, Homo sapiens
agtgtacagacactagaaat

SEQ ID NO: 7744363 - DNA, 22 bp, Homo sapiens
agtgtacagtttgtagtactac

SEQ ID NO: 7744364 - DNA, 22 bp, Homo sapiens
actagccaagttttacgactaa

SEQ ID NO: 7744365 - DNA, 22 bp, Homo sapiens
actagattttggccattataca

SEQ ID NO: 7744366 - DNA, 22 bp, Homo sapiens
agtaaacactgtctttatatat

SEQ ID NO: 7744367 - DNA, 22 bp, Homo sapiens
agtatttcttcatatgattact

SEQ ID NO: 7744368 - DNA, 22 bp, Homo sapiens
actaggggctcaggcccaggga

SEQ ID NO: 7744369 - DNA, 22 bp, Homo sapiens
actagggattacactgtattca

SEQ ID NO: 7744370 - DNA, 17 bp, Homo sapiens
actcaggatctgggagt

SEQ ID NO: 7744371 - DNA, 22 bp, Homo sapiens
actcaggaatggggctgggact

SEQ ID NO: 7744372 - DNA, 22 bp, Homo sapiens
actcaggaaatgaagactggtt

SEQ ID NO: 7744373 - DNA, 22 bp, Homo sapiens
agtcaacacctggttctattac

SEQ ID NO: 7744374 - DNA, 22 bp, Homo sapiens
agtcaacatttgagatgcaatg

SEQ ID NO: 7744375 - DNA, 22 bp, Homo sapiens
aggtcctgtgtccaggggcctg

SEQ ID NO: 7744376 - DNA, 22 bp, Homo sapiens
aggtctcccaagggccagggag

SEQ ID NO: 7744377 - DNA, 22 bp, Homo sapiens
aggtctccttgtgggtcttgcc

SEQ ID NO: 7744378 - DNA, 22 bp, Homo sapiens
atttgtgttgtattaagctgct

SEQ ID NO: 7744379 - DNA, 22 bp, Homo sapiens
agagtttgtatttttcagtgaa

SEQ ID NO: 7744380 - DNA, 22 bp, Homo sapiens
agagctgtgtcctgtgcactag

SEQ ID NO: 7744381 - DNA, 22 bp, Homo sapiens
agaggacagcccccttgtctgg

SEQ ID NO: 7744382 - DNA, 22 bp, Homo sapiens
agaggaggctgggtccagataa

SEQ ID NO: 7744383 - DNA, 22 bp, Homo sapiens
agaggagcttttggaaaaggcc

SEQ ID NO: 7744384 - DNA, 22 bp, Homo sapiens
agaggagctgggaggccctcgt

SEQ ID NO: 7744385 - DNA, 22 bp, Homo sapiens
agaggctgtgcagagggagtgc

SEQ ID NO: 7744386 - DNA, 22 bp, Homo sapiens
agacagctgggagtgtccttct

SEQ ID NO: 7744387 - DNA, 22 bp, Homo sapiens
agacagctgctcgcagagctat

SEQ ID NO: 7744388 - DNA, 22 bp, Homo sapiens
agacatttggagccaactttcc

SEQ ID NO: 7744389 - DNA, 22 bp, Homo sapiens
agacagctgcctccaccacagc

SEQ ID NO: 7744390 - DNA, 18 bp, Homo sapiens
agacagctgaaaggaaaa

SEQ ID NO: 7744391 - DNA, 22 bp, Homo sapiens
agacagctccaagtgtctctgt

SEQ ID NO: 7744392 - DNA, 22 bp, Homo sapiens
agacagctctgggttccacact

SEQ ID NO: 7744393 - DNA, 22 bp, Homo sapiens
agaagtttggatgccatcatag

SEQ ID NO: 7744394 - DNA, 22 bp, Homo sapiens
agaagtttgctcacttgggaca

SEQ ID NO: 7744395 - DNA, 22 bp, Homo sapiens
agaagtttgaaattaggagaaa

SEQ ID NO: 7744396 - DNA, 22 bp, Homo sapiens
agaagtttaaccaggtgctact

SEQ ID NO: 7744397 - DNA, 22 bp, Homo sapiens
atgaacaataaaatagatcaca

SEQ ID NO: 7744398 - DNA, 22 bp, Homo sapiens
agagcctggggattggcaaggg

SEQ ID NO: 7744399 - DNA, 22 bp, Homo sapiens
agagatgactgatggctgatta

SEQ ID NO: 7744400 - DNA, 22 bp, Homo sapiens
agaccacaggcatgcacagagc

SEQ ID NO: 7744401 - DNA, 22 bp, Homo sapiens
cagaataagctgtgttgtcaag

SEQ ID NO: 7744402 - DNA, 22 bp, Homo sapiens
agccactgtctgaacttctgtg

SEQ ID NO: 7744403 - DNA, 22 bp, Homo sapiens
agccagagactgtgtctgtaat

SEQ ID NO: 7744404 - DNA, 22 bp, Homo sapiens
cagacagtttatcctaaataac

SEQ ID NO: 7744405 - DNA, 22 bp, Homo sapiens
cagacttttgacattaatacag

SEQ ID NO: 7744406 - DNA, 22 bp, Homo sapiens
cagccctgcacgctgcctccgc

SEQ ID NO: 7744407 - DNA, 22 bp, Homo sapiens
cagcagttgaaattgacatgtg

SEQ ID NO: 7744408 - DNA, 22 bp, Homo sapiens
cagcagttcaatccagtgcacg

SEQ ID NO: 7744409 - DNA, 22 bp, Homo sapiens
cagcagttcacacttaacaagt

SEQ ID NO: 7744410 - DNA, 22 bp, Homo sapiens
cagcaggggaactgtgggccag

SEQ ID NO: 7744411 - DNA, 20 bp, Homo sapiens
agctcctgagggttactttc

SEQ ID NO: 7744412 - DNA, 22 bp, Homo sapiens
agctcctgatacatgcaggaat

SEQ ID NO: 7744413 - DNA, 22 bp, Homo sapiens
cagcagggcccccgggtgcgcc

SEQ ID NO: 7744414 - DNA, 22 bp, Homo sapiens
agcctctgtagaaagcagtgtg

SEQ ID NO: 7744415 - DNA, 22 bp, Homo sapiens
cagagggcactcggagtgacat

SEQ ID NO: 7744416 - DNA, 22 bp, Homo sapiens
caagacattgattttgtacaga

SEQ ID NO: 7744417 - DNA, 22 bp, Homo sapiens
caacagaaggtgtactactgaa

SEQ ID NO: 7744418 - DNA, 22 bp, Homo sapiens
caaatatctttggcaaagagaa

SEQ ID NO: 7744419 - DNA, 22 bp, Homo sapiens
caagatttggcattctgaggag

SEQ ID NO: 7744420 - DNA, 22 bp, Homo sapiens
cacagtttatgatctcagtgaa

SEQ ID NO: 7744421 - DNA, 22 bp, Homo sapiens
aacactgaagaccaggtaattt

SEQ ID NO: 7744422 - DNA, 22 bp, Homo sapiens
aacactgagaacaatacagagt

SEQ ID NO: 7744423 - DNA, 22 bp, Homo sapiens
aagtccaagaggaaaggtttcc

SEQ ID NO: 7744424 - DNA, 21 bp, Homo sapiens
aagtccaatacctaaggctcc

SEQ ID NO: 7744425 - DNA, 22 bp, Homo sapiens
aacagcatgctgggtaacattg

SEQ ID NO: 7744426 - DNA, 20 bp, Homo sapiens
aacaaactacaaaattatgt

SEQ ID NO: 7744427 - DNA, 20 bp, Homo sapiens
aacaaactacaaaattatgt

SEQ ID NO: 7744428 - DNA, 22 bp, Homo sapiens
aactacattttacagaagatga

SEQ ID NO: 7744429 - DNA, 22 bp, Homo sapiens
aactgtttatgtaagtatgcag

SEQ ID NO: 7744430 - DNA, 22 bp, Homo sapiens
aacaggctagttttaaagcata

SEQ ID NO: 7744431 - DNA, 22 bp, Homo sapiens
aacaggctggccttgaagcagt

SEQ ID NO: 7744432 - DNA, 22 bp, Homo sapiens
aacaggcttttggaaagttaca

SEQ ID NO: 7744433 - DNA, 22 bp, Homo sapiens
aagacataaaacagtcagcgaa

SEQ ID NO: 7744434 - DNA, 18 bp, Homo sapiens
aagcacaggtgtttcagg

SEQ ID NO: 7744435 - DNA, 22 bp, Homo sapiens
aagatttattagatgcttacct

SEQ ID NO: 7744436 - DNA, 22 bp, Homo sapiens
aagatttccttcagtagagcta

SEQ ID NO: 7744437 - DNA, 17 bp, Homo sapiens
aagatttcattagctga

SEQ ID NO: 7744438 - DNA, 22 bp, Homo sapiens
aagatttctgcttttggaggca

SEQ ID NO: 7744439 - DNA, 22 bp, Homo sapiens
aagatttctgctcctgagagaa

SEQ ID NO: 7744440 - DNA, 22 bp, Homo sapiens
aagatttctctcctggaaagca

SEQ ID NO: 7744441 - DNA, 22 bp, Homo sapiens
aagattctgtcagttaggagga

SEQ ID NO: 7744442 - DNA, 22 bp, Homo sapiens
aagattcttattaggtaatttt

SEQ ID NO: 7744443 - DNA, 22 bp, Homo sapiens
aagattctttgaggattttact

SEQ ID NO: 7744444 - DNA, 22 bp, Homo sapiens
aaagaatcgtgtgtagtttgaa

SEQ ID NO: 7744445 - DNA, 21 bp, Homo sapiens
aaagaatcatgggtaatttca

SEQ ID NO: 7744446 - DNA, 22 bp, Homo sapiens
aaagaataccctgggtcataaa

SEQ ID NO: 7744447 - DNA, 22 bp, Homo sapiens
aaagagtctggcgttttaatgg

SEQ ID NO: 7744448 - DNA, 22 bp, Homo sapiens
aaagacacaaatgtagaccaaa

SEQ ID NO: 7744449 - DNA, 22 bp, Homo sapiens
aaactaggaagttcatcttatt

SEQ ID NO: 7744450 - DNA, 22 bp, Homo sapiens
aaagactaagaagagtattatt

SEQ ID NO: 7744451 - DNA, 22 bp, Homo sapiens
aaagaccatgtttacagctagg

SEQ ID NO: 7744452 - DNA, 22 bp, Homo sapiens
aaaaaatcagatctttggttaa

SEQ ID NO: 7744453 - DNA, 22 bp, Homo sapiens
aaaaaagattgatggtggatgc

SEQ ID NO: 7744454 - DNA, 22 bp, Homo sapiens
aaaaacagaatgtgtctaactc

SEQ ID NO: 7744455 - DNA, 22 bp, Homo sapiens
aaaaatcacttttataggcagc

SEQ ID NO: 7744456 - DNA, 22 bp, Homo sapiens
aaacagaaatttcctcatgctc

SEQ ID NO: 7744457 - DNA, 22 bp, Homo sapiens
aaacacttcctgtaacatgaca

SEQ ID NO: 7744458 - DNA, 22 bp, Homo sapiens
aactaaaagtgtgtctcttgta

SEQ ID NO: 7744459 - DNA, 22 bp, Homo sapiens
aacagatttgtgaagctactca

SEQ ID NO: 7744460 - DNA, 22 bp, Homo sapiens
aacagattgtaacctgatagcc

SEQ ID NO: 7744461 - DNA, 22 bp, Homo sapiens
aacagatttaagaagccaaggt

SEQ ID NO: 7744462 - DNA, 22 bp, Homo sapiens
aaagatatgtctccaaagagat

SEQ ID NO: 7744463 - DNA, 23 bp, Homo sapiens
aaagatcaaagtggcaggcctgt

SEQ ID NO: 7744464 - DNA, 22 bp, Homo sapiens
aacaaaacatttgtcttgtttc

SEQ ID NO: 7744465 - DNA, 22 bp, Homo sapiens
aaatcctgtccatttaccagat

SEQ ID NO: 7744466 - DNA, 23 bp, Homo sapiens
aaatcctgcctcttgtatttatc

SEQ ID NO: 7744467 - DNA, 22 bp, Homo sapiens
aaatgtattgcataggatattt

SEQ ID NO: 7744468 - DNA, 22 bp, Homo sapiens
aagctgaaataatatctatgtt

SEQ ID NO: 7744469 - DNA, 22 bp, Homo sapiens
aaataatcaatttttgtagata

SEQ ID NO: 7744470 - DNA, 22 bp, Homo sapiens
aaataacttggtttcatcagag

SEQ ID NO: 7744471 - DNA, 22 bp, Homo sapiens
aatgaacatataaagagatctt

SEQ ID NO: 7744472 - DNA, 22 bp, Homo sapiens
agaaaaatcttggcgcttgtct

SEQ ID NO: 7744473 - DNA, 22 bp, Homo sapiens
acttcttttcaaatcatgcaaa

SEQ ID NO: 7744474 - DNA, 22 bp, Homo sapiens
actaagttgtagtcacacatcc

SEQ ID NO: 7744475 - DNA, 22 bp, Homo sapiens
aagtgctttttcttgagctgct

SEQ ID NO: 7744476 - DNA, 22 bp, Homo sapiens
aagtgctttacaaatgtctgtt

SEQ ID NO: 7744477 - DNA, 22 bp, Homo sapiens
aagtttcaaatataaaattaca

SEQ ID NO: 7744478 - DNA, 22 bp, Homo sapiens
aagtttcattgttcatgtaaca

SEQ ID NO: 7744479 - DNA, 19 bp, Homo sapiens
aataatgttcatgagattg

SEQ ID NO: 7744480 - DNA, 22 bp, Homo sapiens
aataattttagctcagagttgt

SEQ ID NO: 7744481 - DNA, 22 bp, Homo sapiens
aaggaagaaatgaataggtgga

SEQ ID NO: 7744482 - DNA, 22 bp, Homo sapiens
aaggaagaagactctttactcc

SEQ ID NO: 7744483 - DNA, 22 bp, Homo sapiens
aaggaagaagggaagttactta

SEQ ID NO: 7744484 - DNA, 22 bp, Homo sapiens
aagggcggacagggcacatttc

SEQ ID NO: 7744485 - DNA, 22 bp, Homo sapiens
aagtcacacagttaacatgagg

SEQ ID NO: 7744486 - DNA, 22 bp, Homo sapiens
aatgttcagtgcctttaaacat

SEQ ID NO: 7744487 - DNA, 22 bp, Homo sapiens
aatgttcattgattaaatgaat

SEQ ID NO: 7744488 - DNA, 22 bp, Homo sapiens
aatttagtgtaaagctactgga

SEQ ID NO: 7744489 - DNA, 21 bp, Homo sapiens
aatttagtcaacagactgtgg

SEQ ID NO: 7744490 - DNA, 19 bp, Homo sapiens
aatttagttcttgtttaga

SEQ ID NO: 7744491 - DNA, 23 bp, Homo sapiens
aatttagtttgagacattagcct

SEQ ID NO: 7744492 - DNA, 22 bp, Homo sapiens
aattatatgttaatcttcaatt

SEQ ID NO: 7744493 - DNA, 22 bp, Homo sapiens
aattatattgaagttgaatgtc

SEQ ID NO: 7744494 - DNA, 22 bp, Homo sapiens
agaagggctacacgggctctcc

SEQ ID NO: 7744495 - DNA, 22 bp, Homo sapiens
acaagtcactctatcattttca

SEQ ID NO: 7744496 - DNA, 22 bp, Homo sapiens
acaaatggaacaatgaagactg

SEQ ID NO: 7744497 - DNA, 22 bp, Homo sapiens
acaaaaagctccattactgtcc

SEQ ID NO: 7744498 - DNA, 22 bp, Homo sapiens
acaaactgaatgggttttctgt

SEQ ID NO: 7744499 - DNA, 22 bp, Homo sapiens
acaaactaaaattctttattga

SEQ ID NO: 7744500 - DNA, 22 bp, Homo sapiens
acactgtgagctgaagggctgc

SEQ ID NO: 7744501 - DNA, 22 bp, Homo sapiens
acactgtgcttagatgctgaac

SEQ ID NO: 7744502 - DNA, 21 bp, Homo sapiens
acactgtgtcataatgcttaa

SEQ ID NO: 7744503 - DNA, 22 bp, Homo sapiens
agctctgggggaaagtctgctc

SEQ ID NO: 7744504 - DNA, 22 bp, Homo sapiens
agctctggggcctgtcccacat

SEQ ID NO: 7744505 - DNA, 18 bp, Homo sapiens
agctctggggagatgggc

SEQ ID NO: 7744506 - DNA, 22 bp, Homo sapiens
acagcaaaagacaagaacttaa

SEQ ID NO: 7744507 - DNA, 22 bp, Homo sapiens
agctagggcaaatatgagatac

SEQ ID NO: 7744508 - DNA, 22 bp, Homo sapiens
agctaggggaccaaggtggccc

SEQ ID NO: 7744509 - DNA, 22 bp, Homo sapiens
acagagttagcagaaagttgga

SEQ ID NO: 7744510 - DNA, 22 bp, Homo sapiens
acagataaggcagttaagagtt

SEQ ID NO: 7744511 - DNA, 22 bp, Homo sapiens
acagagttgtgtttgtacaacg

SEQ ID NO: 7744512 - DNA, 22 bp, Homo sapiens
acagataaaagttgtttaaaat

SEQ ID NO: 7744513 - DNA, 22 bp, Homo sapiens
gttcttttggtagagtgtgcat

SEQ ID NO: 7744514 - DNA, 19 bp, Homo sapiens
gttcttttcacctctgtgc

SEQ ID NO: 7744515 - DNA, 22 bp, Homo sapiens
gtttatgaatgtgtcagacata

SEQ ID NO: 7744516 - DNA, 22 bp, Homo sapiens
gtttatgaatgttactatagag

SEQ ID NO: 7744517 - DNA, 22 bp, Homo sapiens
gtttcttttaaaatatgtagac

SEQ ID NO: 7744518 - DNA, 22 bp, Homo sapiens
gtttcttttgtgatcaccaacc

SEQ ID NO: 7744519 - DNA, 22 bp, Homo sapiens
gtttgtatgaatgttttatgct

SEQ ID NO: 7744520 - DNA, 22 bp, Homo sapiens
gttaacaaccaaacagaagttc

SEQ ID NO: 7744521 - DNA, 22 bp, Homo sapiens
gttaacaaatgtaaagcaatta

SEQ ID NO: 7744522 - DNA, 22 bp, Homo sapiens
taagactgtgagctcagagact

SEQ ID NO: 7744523 - DNA, 22 bp, Homo sapiens
taaagattgctcaaaactgtga

SEQ ID NO: 7744524 - DNA, 22 bp, Homo sapiens
taaaagaccctctagagtccca

SEQ ID NO: 7744525 - DNA, 22 bp, Homo sapiens
taaaagaagcttcaaggccggc

SEQ ID NO: 7744526 - DNA, 22 bp, Homo sapiens
tacacagttccatttaagccag

SEQ ID NO: 7744527 - DNA, 22 bp, Homo sapiens
tacacagttttgctcccatgat

SEQ ID NO: 7744528 - DNA, 22 bp, Homo sapiens
tacaagattaaaacttatacca

SEQ ID NO: 7744529 - DNA, 22 bp, Homo sapiens
tacaaccatagacatatactag

SEQ ID NO: 7744530 - DNA, 22 bp, Homo sapiens
taatttatagaatttcttggat

SEQ ID NO: 7744531 - DNA, 22 bp, Homo sapiens
taatctaccactattgcaatat

SEQ ID NO: 7744532 - DNA, 22 bp, Homo sapiens
tacagtgtttcccccaggatag

SEQ ID NO: 7744533 - DNA, 22 bp, Homo sapiens
tacagtcaagcataagaagtca

SEQ ID NO: 7744534 - DNA, 20 bp, Homo sapiens
tacagacatgacaataatgg

SEQ ID NO: 7744535 - DNA, 22 bp, Homo sapiens
tactagaatgccactgttagtg

SEQ ID NO: 7744536 - DNA, 17 bp, Homo sapiens
tactagaatagagacag

SEQ ID NO: 7744537 - DNA, 23 bp, Homo sapiens
tactacagggtcttgctatgaat

SEQ ID NO: 7744538 - DNA, 21 bp, Homo sapiens
tactacagtctctttatcagt

SEQ ID NO: 7744539 - DNA, 22 bp, Homo sapiens
tactacagtatgtgtgttatac

SEQ ID NO: 7744540 - DNA, 22 bp, Homo sapiens
tcaaagactatatattttattt

SEQ ID NO: 7744541 - DNA, 22 bp, Homo sapiens
tattttctggacagtcttgctt

SEQ ID NO: 7744542 - DNA, 22 bp, Homo sapiens
tatttcttgttattctcgttga

SEQ ID NO: 7744543 - DNA, 22 bp, Homo sapiens
tatttgaatcctggttcttcag

SEQ ID NO: 7744544 - DNA, 22 bp, Homo sapiens
tatcagataatcttttacaagc

SEQ ID NO: 7744545 - DNA, 22 bp, Homo sapiens
tatcatttaacagaatcattgc

SEQ ID NO: 7744546 - DNA, 22 bp, Homo sapiens
tatcatttagagtatttcttca

SEQ ID NO: 7744547 - DNA, 22 bp, Homo sapiens
tagatactgcccattgagcaat

SEQ ID NO: 7744548 - DNA, 22 bp, Homo sapiens
tagatatttctactgtggatta

SEQ ID NO: 7744549 - DNA, 22 bp, Homo sapiens
tagttacagtgcatagcaagat

SEQ ID NO: 7744550 - DNA, 22 bp, Homo sapiens
taggggctcagaacatgtcctt

SEQ ID NO: 7744551 - DNA, 21 bp, Homo sapiens
taggggctggggctccagctg

SEQ ID NO: 7744552 - DNA, 23 bp, Homo sapiens
taggggctggcgtggagcctgcg

SEQ ID NO: 7744553 - DNA, 22 bp, Homo sapiens
tagggggctgtcctgtgcatta

SEQ ID NO: 7744554 - DNA, 22 bp, Homo sapiens
taggggcttgtaatttaataga

SEQ ID NO: 7744555 - DNA, 21 bp, Homo sapiens
tagggggcagtgggatgctta

SEQ ID NO: 7744556 - DNA, 22 bp, Homo sapiens
tagttacagcaggcaggatata

SEQ ID NO: 7744557 - DNA, 22 bp, Homo sapiens
tagctgtgtaagcttggtaaga

SEQ ID NO: 7744558 - DNA, 22 bp, Homo sapiens
tagctgtgtaacatgagaatgt

SEQ ID NO: 7744559 - DNA, 23 bp, Homo sapiens
tagctgtggcgtaaggctcagct

SEQ ID NO: 7744560 - DNA, 22 bp, Homo sapiens
tagctgtgtatggtttacaaat

SEQ ID NO: 7744561 - DNA, 22 bp, Homo sapiens
tagctgtgtgatgggaaacctt

SEQ ID NO: 7744562 - DNA, 22 bp, Homo sapiens
tagctgtgtagacactcagagc

SEQ ID NO: 7744563 - DNA, 22 bp, Homo sapiens
tagctgtgtgtccttgggcaaa

SEQ ID NO: 7744564 - DNA, 17 bp, Homo sapiens
tagctgtgtttcagcta

SEQ ID NO: 7744565 - DNA, 22 bp, Homo sapiens
tagctgtggagcagaggtctcc

SEQ ID NO: 7744566 - DNA, 22 bp, Homo sapiens
tagctgtggccttgctggtctg

SEQ ID NO: 7744567 - DNA, 22 bp, Homo sapiens
tagctgtgcccagggaagttgt

SEQ ID NO: 7744568 - DNA, 22 bp, Homo sapiens
tagctgtgcccgccacccaacg

SEQ ID NO: 7744569 - DNA, 22 bp, Homo sapiens
tagctgtgacgtatctctatgg

SEQ ID NO: 7744570 - DNA, 22 bp, Homo sapiens
tagctgtgaagagctaaaaaat

SEQ ID NO: 7744571 - DNA, 22 bp, Homo sapiens
tagctgtgagcacccaggctgt

SEQ ID NO: 7744572 - DNA, 21 bp, Homo sapiens
tagctgtgcaactttgggcaa

SEQ ID NO: 7744573 - DNA, 22 bp, Homo sapiens
tagctgtgaaacagcagaagag

SEQ ID NO: 7744574 - DNA, 22 bp, Homo sapiens
tagggctgggtacactcttgcc

SEQ ID NO: 7744575 - DNA, 22 bp, Homo sapiens
tagggctgtggtcagtcctcta

SEQ ID NO: 7744576 - DNA, 22 bp, Homo sapiens
tagggctgccatttgcttttct

SEQ ID NO: 7744577 - DNA, 22 bp, Homo sapiens
tagggctgcagaacaatggcct

SEQ ID NO: 7744578 - DNA, 22 bp, Homo sapiens
tagggctgcctatggctagata

SEQ ID NO: 7744579 - DNA, 22 bp, Homo sapiens
tagggctggcgtgctcagggaa

SEQ ID NO: 7744580 - DNA, 19 bp, Homo sapiens
tagggctggccgggcggtg

SEQ ID NO: 7744581 - DNA, 22 bp, Homo sapiens
tagggcagattcggtggagttt

SEQ ID NO: 7744582 - DNA, 22 bp, Homo sapiens
tccaataacatctaaaaactta

SEQ ID NO: 7744583 - DNA, 22 bp, Homo sapiens
tccaaatattcatctacttctg

SEQ ID NO: 7744584 - DNA, 22 bp, Homo sapiens
tccaaatattcggtctttctga

SEQ ID NO: 7744585 - DNA, 22 bp, Homo sapiens
tccaaatatcttggtggttagg

SEQ ID NO: 7744586 - DNA, 22 bp, Homo sapiens
tccaaatatattcacgtcctag

SEQ ID NO: 7744587 - DNA, 22 bp, Homo sapiens
tccaaatataggatgtgatata

SEQ ID NO: 7744588 - DNA, 22 bp, Homo sapiens
tccaaatattatgattatagga

SEQ ID NO: 7744589 - DNA, 22 bp, Homo sapiens
tccaaataccagatgggctaat

SEQ ID NO: 7744590 - DNA, 23 bp, Homo sapiens
tccaaatacctgtcaccttgtct

SEQ ID NO: 7744591 - DNA, 22 bp, Homo sapiens
tccaaatacatttactgtattt

SEQ ID NO: 7744592 - DNA, 22 bp, Homo sapiens
tccaaatatagatgagttgtaa

SEQ ID NO: 7744593 - DNA, 22 bp, Homo sapiens
tccaaatatacagaatctcctc

SEQ ID NO: 7744594 - DNA, 22 bp, Homo sapiens
tccaaatagttctggaagactg

SEQ ID NO: 7744595 - DNA, 22 bp, Homo sapiens
tccaaatagctggatgatggtg

SEQ ID NO: 7744596 - DNA, 22 bp, Homo sapiens
tcatttagttctttcatgtcca

SEQ ID NO: 7744597 - DNA, 22 bp, Homo sapiens
tcataaatcatactccatttgc

SEQ ID NO: 7744598 - DNA, 22 bp, Homo sapiens
tcatctgttcatacacatgcgt

SEQ ID NO: 7744599 - DNA, 22 bp, Homo sapiens
tcagtaacttacttattcacct

SEQ ID NO: 7744600 - DNA, 22 bp, Homo sapiens
tcagtaacctttagcacagttg

SEQ ID NO: 7744601 - DNA, 22 bp, Homo sapiens
tcagaaaataactgttagtttg

SEQ ID NO: 7744602 - DNA, 22 bp, Homo sapiens
tcagaaaatgaaatggactctc

SEQ ID NO: 7744603 - DNA, 22 bp, Homo sapiens
tcacagtttcttttctgataaa

SEQ ID NO: 7744604 - DNA, 22 bp, Homo sapiens
tcacagttttagaaaatagata

SEQ ID NO: 7744605 - DNA, 22 bp, Homo sapiens
tcaacagctagaaatatagaga

SEQ ID NO: 7744606 - DNA, 22 bp, Homo sapiens
tcaacattcatatatagccaca

SEQ ID NO: 7744607 - DNA, 22 bp, Homo sapiens
tcaacacaacagagaaatgctg

SEQ ID NO: 7744608 - DNA, 22 bp, Homo sapiens
tcaggaagggtggtccacaggg

SEQ ID NO: 7744609 - DNA, 22 bp, Homo sapiens
tcaggaagtataatcagattca

SEQ ID NO: 7744610 - DNA, 21 bp, Homo sapiens
tcagctgtagagattacattc

SEQ ID NO: 7744611 - DNA, 22 bp, Homo sapiens
tcagctgtactgtgccatagct

SEQ ID NO: 7744612 - DNA, 22 bp, Homo sapiens
tcccagagccaagctatggatg

SEQ ID NO: 7744613 - DNA, 22 bp, Homo sapiens
tcccaagatgacacagtggacg

SEQ ID NO: 7744614 - DNA, 22 bp, Homo sapiens
tcccaagattaggttggaaagg

SEQ ID NO: 7744615 - DNA, 22 bp, Homo sapiens
tcccagagaagagctggatgga

SEQ ID NO: 7744616 - DNA, 22 bp, Homo sapiens
tccatggtaggtttcttaaaga

SEQ ID NO: 7744617 - DNA, 22 bp, Homo sapiens
tccatggggcccaggatgagag

SEQ ID NO: 7744618 - DNA, 22 bp, Homo sapiens
tcctagggtaatcagcatacat

SEQ ID NO: 7744619 - DNA, 22 bp, Homo sapiens
tcctagggattcaacactgaac

SEQ ID NO: 7744620 - DNA, 22 bp, Homo sapiens
tcctaggaatactgcctgaaat

SEQ ID NO: 7744621 - DNA, 22 bp, Homo sapiens
tccctgggaacaaaggatgaga

SEQ ID NO: 7744622 - DNA, 22 bp, Homo sapiens
tcctcaggtcaaagcaggagaa

SEQ ID NO: 7744623 - DNA, 22 bp, Homo sapiens
tcctgaggactaacaggaagga

SEQ ID NO: 7744624 - DNA, 22 bp, Homo sapiens
tcctctgggctccctgcaacag

SEQ ID NO: 7744625 - DNA, 22 bp, Homo sapiens
tcctctggtcctgcagcagatc

SEQ ID NO: 7744626 - DNA, 22 bp, Homo sapiens
ggtcccaggttgacagggagac

SEQ ID NO: 7744627 - DNA, 22 bp, Homo sapiens
ggtcccaggctgcgggctggtg

SEQ ID NO: 7744628 - DNA, 22 bp, Homo sapiens
ggtcccaggaagtgcggcggcg

SEQ ID NO: 7744629 - DNA, 22 bp, Homo sapiens
gggttggatcctggtggctgcc

SEQ ID NO: 7744630 - DNA, 22 bp, Homo sapiens
gtaatttaattctctgacttga

SEQ ID NO: 7744631 - DNA, 19 bp, Homo sapiens
ggttaccagtgtgtctggc

SEQ ID NO: 7744632 - DNA, 22 bp, Homo sapiens
ggggaggaagctggaacacggg

SEQ ID NO: 7744633 - DNA, 22 bp, Homo sapiens
ggggccagatatcactaaggtt

SEQ ID NO: 7744634 - DNA, 22 bp, Homo sapiens
ggggcagggaggttatcgccga

SEQ ID NO: 7744635 - DNA, 22 bp, Homo sapiens
gggcttctctcaggggcatgag

SEQ ID NO: 7744636 - DNA, 22 bp, Homo sapiens
gggcttctctgggagtcctggt

SEQ ID NO: 7744637 - DNA, 22 bp, Homo sapiens
ggggccagtaggagtgatgtac

SEQ ID NO: 7744638 - DNA, 22 bp, Homo sapiens
gggtgaggcccatttgaggcca

SEQ ID NO: 7744639 - DNA, 22 bp, Homo sapiens
gtgagcttctgcctctcagtcc

SEQ ID NO: 7744640 - DNA, 22 bp, Homo sapiens
gtcttttttacaccttacatca

SEQ ID NO: 7744641 - DNA, 22 bp, Homo sapiens
gtctttttctacgatagcgcct

SEQ ID NO: 7744642 - DNA, 22 bp, Homo sapiens
gtctttttattatagagtggag

SEQ ID NO: 7744643 - DNA, 22 bp, Homo sapiens
gtctttttgtctggcagaggtc

SEQ ID NO: 7744644 - DNA, 21 bp, Homo sapiens
gtctttttaattgcgatttcc

SEQ ID NO: 7744645 - DNA, 22 bp, Homo sapiens
gtctcccaatccgggacagcct

SEQ ID NO: 7744646 - DNA, 22 bp, Homo sapiens
gtctacaaagcttcaagtctct

SEQ ID NO: 7744647 - DNA, 22 bp, Homo sapiens
gtctacaaagcatataaaagag

SEQ ID NO: 7744648 - DNA, 22 bp, Homo sapiens
gtgcaggagtaggagagggctt

SEQ ID NO: 7744649 - DNA, 22 bp, Homo sapiens
gtcaaacaaattaacatatcca

SEQ ID NO: 7744650 - DNA, 22 bp, Homo sapiens
gtcaaataattttctcaatagt

SEQ ID NO: 7744651 - DNA, 22 bp, Homo sapiens
gtagtaatagtacattagaatg

SEQ ID NO: 7744652 - DNA, 22 bp, Homo sapiens
gtacaagtgtatttggcttgat

SEQ ID NO: 7744653 - DNA, 22 bp, Homo sapiens
gtacaacatgattttactctct

SEQ ID NO: 7744654 - DNA, 19 bp, Homo sapiens
gtacaacaatgctgagcat

SEQ ID NO: 7744655 - DNA, 22 bp, Homo sapiens
gtacaacaggattgatgtacca

SEQ ID NO: 7744656 - DNA, 21 bp, Homo sapiens
gtccagagagccggctcctga

SEQ ID NO: 7744657 - DNA, 22 bp, Homo sapiens
gtcctgcttgttaggcctagtc

SEQ ID NO: 7744658 - DNA, 22 bp, Homo sapiens
gtcgtggagctcacagtgtgcc

SEQ ID NO: 7744659 - DNA, 22 bp, Homo sapiens
ggaggatgccaagctgtgcaca

SEQ ID NO: 7744660 - DNA, 22 bp, Homo sapiens
ggcagggcttgtctctgtgatg

SEQ ID NO: 7744661 - DNA, 22 bp, Homo sapiens
ggctctgaacatggggaggagt

SEQ ID NO: 7744662 - DNA, 22 bp, Homo sapiens
ggctctgagtttagaagggtgg

SEQ ID NO: 7744663 - DNA, 22 bp, Homo sapiens
ggctagggaaaatgattggata

SEQ ID NO: 7744664 - DNA, 22 bp, Homo sapiens
gggaagagtaactagcccatgt

SEQ ID NO: 7744665 - DNA, 22 bp, Homo sapiens
gggaagagtgtcggttgaagtg

SEQ ID NO: 7744666 - DNA, 22 bp, Homo sapiens
ggctgtggcagctggaagtggt

SEQ ID NO: 7744667 - DNA, 22 bp, Homo sapiens
gggaagagggagctggaatgat

SEQ ID NO: 7744668 - DNA, 17 bp, Homo sapiens
ggctggagcagctcccc

SEQ ID NO: 7744669 - DNA, 19 bp, Homo sapiens
ggctggagtggccatctgt

SEQ ID NO: 7744670 - DNA, 22 bp, Homo sapiens
ggctggaggtagaagaacactt

SEQ ID NO: 7744671 - DNA, 22 bp, Homo sapiens
ggctggcagaagtgtgctggct

SEQ ID NO: 7744672 - DNA, 22 bp, Homo sapiens
gggcagaggctctggcccatcc

SEQ ID NO: 7744673 - DNA, 21 bp, Homo sapiens
gggcagaggggcctcctgggt

SEQ ID NO: 7744674 - DNA, 20 bp, Homo sapiens
gggcagagccagccagtccc

SEQ ID NO: 7744675 - DNA, 22 bp, Homo sapiens
gggcagaggctctggcccatcc

SEQ ID NO: 7744676 - DNA, 22 bp, Homo sapiens
gggccggagctgggtcccgcgc

SEQ ID NO: 7744677 - DNA, 22 bp, Homo sapiens
gggccctgtgatttcttgagga

SEQ ID NO: 7744678 - DNA, 22 bp, Homo sapiens
gggctaggtctgatcagagaag

SEQ ID NO: 7744679 - DNA, 22 bp, Homo sapiens
gggccctgccccgtggctctga

SEQ ID NO: 7744680 - DNA, 18 bp, Homo sapiens
gggctctggcatctgggt

SEQ ID NO: 7744681 - DNA, 22 bp, Homo sapiens
gggctcagctccttccttccta

SEQ ID NO: 7744682 - DNA, 21 bp, Homo sapiens
gggctcagcgctcggctcctc

SEQ ID NO: 7744683 - DNA, 22 bp, Homo sapiens
gggctcagaggagtggcctggg

SEQ ID NO: 7744684 - DNA, 22 bp, Homo sapiens
gggctcagcctcctcacttcga

SEQ ID NO: 7744685 - DNA, 20 bp, Homo sapiens
gctcagggcctgggtctgga

SEQ ID NO: 7744686 - DNA, 22 bp, Homo sapiens
gctcccagcaattgaggcagcc

SEQ ID NO: 7744687 - DNA, 22 bp, Homo sapiens
gctaggagtaaggagaccttca

SEQ ID NO: 7744688 - DNA, 22 bp, Homo sapiens
gctagggaacctcttctgagga

SEQ ID NO: 7744689 - DNA, 20 bp, Homo sapiens
gctctgtctggcctactttt

SEQ ID NO: 7744690 - DNA, 22 bp, Homo sapiens
gctcccagcattgctgctgaat

SEQ ID NO: 7744691 - DNA, 22 bp, Homo sapiens
gctcccaggaagagaagggcca

SEQ ID NO: 7744692 - DNA, 22 bp, Homo sapiens
gctgagggtaacacttcgggat

SEQ ID NO: 7744693 - DNA, 22 bp, Homo sapiens
gctggaggtagggaggtcctgt

SEQ ID NO: 7744694 - DNA, 22 bp, Homo sapiens
gctggagttaggtgggcttgaa

SEQ ID NO: 7744695 - DNA, 22 bp, Homo sapiens
gctggagttagaactagcctgg

SEQ ID NO: 7744696 - DNA, 22 bp, Homo sapiens
ggaggaggcggcagaagttcct

SEQ ID NO: 7744697 - DNA, 22 bp, Homo sapiens
ggagcctggtatagtgttgcat

SEQ ID NO: 7744698 - DNA, 23 bp, Homo sapiens
ggagcctggcatatgagacgcat

SEQ ID NO: 7744699 - DNA, 19 bp, Homo sapiens
ggagcctggcaggggcgtg

SEQ ID NO: 7744700 - DNA, 22 bp, Homo sapiens
ggaaggaggatgctctggcctt

SEQ ID NO: 7744701 - DNA, 22 bp, Homo sapiens
gctttgtgtagaaggaggatgg

SEQ ID NO: 7744702 - DNA, 22 bp, Homo sapiens
gctttgtgtgaagtccatggcg

SEQ ID NO: 7744703 - DNA, 22 bp, Homo sapiens
gctttgtgaattattactcaca

SEQ ID NO: 7744704 - DNA, 18 bp, Homo sapiens
gctttttagtgcatcttc

SEQ ID NO: 7744705 - DNA, 22 bp, Homo sapiens
gcttggggtcatgaggctgctg

SEQ ID NO: 7744706 - DNA, 22 bp, Homo sapiens
gcagttttagtggatctggggc

SEQ ID NO: 7744707 - DNA, 22 bp, Homo sapiens
gcccaatagagaaatagtgaaa

SEQ ID NO: 7744708 - DNA, 22 bp, Homo sapiens
gcccaatagtggggatatacct

SEQ ID NO: 7744709 - DNA, 22 bp, Homo sapiens
gccctagggcttttgggcctgt

SEQ ID NO: 7744710 - DNA, 22 bp, Homo sapiens
gccctagggggaaccgaggact

SEQ ID NO: 7744711 - DNA, 21 bp, Homo sapiens
gccctaggctacctggagcgc

SEQ ID NO: 7744712 - DNA, 22 bp, Homo sapiens
gccctaggcttttgtgactgcc

SEQ ID NO: 7744713 - DNA, 18 bp, Homo sapiens
gcctgagggtcaagtgtg

SEQ ID NO: 7744714 - DNA, 22 bp, Homo sapiens
gcagctgtactggcagcattgt

SEQ ID NO: 7744715 - DNA, 22 bp, Homo sapiens
gcagctgtaaagcagaaatagt

SEQ ID NO: 7744716 - DNA, 22 bp, Homo sapiens
gcagctgtagaggggagaaaga

SEQ ID NO: 7744717 - DNA, 22 bp, Homo sapiens
gcagctgtcactttcacaatgc

SEQ ID NO: 7744718 - DNA, 22 bp, Homo sapiens
gcagctgtatcacttttaaaca

SEQ ID NO: 7744719 - DNA, 22 bp, Homo sapiens
gcagctgtcagaagttggaatc

SEQ ID NO: 7744720 - DNA, 22 bp, Homo sapiens
gcagacagggctacagaggtac

SEQ ID NO: 7744721 - DNA, 22 bp, Homo sapiens
gcagacagactgcagtgatttt

SEQ ID NO: 7744722 - DNA, 22 bp, Homo sapiens
gcagacagatgagggtgctggg

SEQ ID NO: 7744723 - DNA, 22 bp, Homo sapiens
ctgtgggctgaaagtgctcccg

SEQ ID NO: 7744724 - DNA, 18 bp, Homo sapiens
ctgtgggctggtgcatga

SEQ ID NO: 7744725 - DNA, 22 bp, Homo sapiens
ctgtgggcctgatgttcttctc

SEQ ID NO: 7744726 - DNA, 20 bp, Homo sapiens
ctgtgggcctcacttggggt

SEQ ID NO: 7744727 - DNA, 22 bp, Homo sapiens
ctgtgggcctagtctggcctag

SEQ ID NO: 7744728 - DNA, 22 bp, Homo sapiens
ctgtgggcatttgagtgtgggt

SEQ ID NO: 7744729 - DNA, 22 bp, Homo sapiens
ctgggctcagtggctcatggct

SEQ ID NO: 7744730 - DNA, 22 bp, Homo sapiens
ctgggcctccagctctgccagc

SEQ ID NO: 7744731 - DNA, 22 bp, Homo sapiens
ctgggcctagcaacagaggagt

SEQ ID NO: 7744732 - DNA, 22 bp, Homo sapiens
ctgggcctaggatggaagggcc

SEQ ID NO: 7744733 - DNA, 22 bp, Homo sapiens
ctgggaggcggaggttgcagtg

SEQ ID NO: 7744734 - DNA, 22 bp, Homo sapiens
ctgggagtcaccaggagcaagg

SEQ ID NO: 7744735 - DNA, 22 bp, Homo sapiens
ctgggagtgaaaggagggctgc

SEQ ID NO: 7744736 - DNA, 22 bp, Homo sapiens
ctgggagttgacgaggcttgta

SEQ ID NO: 7744737 - DNA, 22 bp, Homo sapiens
ctgggagtgtccctctggtaat

SEQ ID NO: 7744738 - DNA, 18 bp, Homo sapiens
ctgggctcgagagatcct

SEQ ID NO: 7744739 - DNA, 22 bp, Homo sapiens
ctgggctccctcatgtgtctgc

SEQ ID NO: 7744740 - DNA, 20 bp, Homo sapiens
ctgggctcggtggccctggc

SEQ ID NO: 7744741 - DNA, 22 bp, Homo sapiens
ctgggggcagcaagaagccatg

SEQ ID NO: 7744742 - DNA, 22 bp, Homo sapiens
ctgggggccttacggaactcca

SEQ ID NO: 7744743 - DNA, 22 bp, Homo sapiens
ctgggctctagaaaggaaagaa

SEQ ID NO: 7744744 - DNA, 22 bp, Homo sapiens
gaaacctatttataacttctag

SEQ ID NO: 7744745 - DNA, 22 bp, Homo sapiens
gaaatgtagagtatctgaggat

SEQ ID NO: 7744746 - DNA, 22 bp, Homo sapiens
gaagaacacttcatgattcatt

SEQ ID NO: 7744747 - DNA, 20 bp, Homo sapiens
cttcttcagtagtttgttct

SEQ ID NO: 7744748 - DNA, 22 bp, Homo sapiens
cttgcttggagaagagatcagt

SEQ ID NO: 7744749 - DNA, 22 bp, Homo sapiens
cttggagagggagaaaaataac

SEQ ID NO: 7744750 - DNA, 22 bp, Homo sapiens
cttggaatggggcagaaaatgg

SEQ ID NO: 7744751 - DNA, 22 bp, Homo sapiens
cttggaacaaattaaacaatac

SEQ ID NO: 7744752 - DNA, 22 bp, Homo sapiens
cttggacttccaggaagtattt

SEQ ID NO: 7744753 - DNA, 22 bp, Homo sapiens
cttggagcaacacatgacatct

SEQ ID NO: 7744754 - DNA, 22 bp, Homo sapiens
gacaaataggtcaacaggaggg

SEQ ID NO: 7744755 - DNA, 22 bp, Homo sapiens
gacctggggtaagcttggcaac

SEQ ID NO: 7744756 - DNA, 22 bp, Homo sapiens
gactaggctctcatagaggtag

SEQ ID NO: 7744757 - DNA, 22 bp, Homo sapiens
gactaggggcagcgtgggagct

SEQ ID NO: 7744758 - DNA, 22 bp, Homo sapiens
gaccttggttgagcttcctaat

SEQ ID NO: 7744759 - DNA, 22 bp, Homo sapiens
gacattaatggcaaattaatta

SEQ ID NO: 7744760 - DNA, 18 bp, Homo sapiens
gacagctgtcctgagccc

SEQ ID NO: 7744761 - DNA, 22 bp, Homo sapiens
gacagctgtacactcctggtta

SEQ ID NO: 7744762 - DNA, 17 bp, Homo sapiens
gacagctgggcgcacgc

SEQ ID NO: 7744763 - DNA, 17 bp, Homo sapiens
gacagctggttcctggc

SEQ ID NO: 7744764 - DNA, 22 bp, Homo sapiens
gacagctgggaggatgacataa

SEQ ID NO: 7744765 - DNA, 22 bp, Homo sapiens
gacagctggcagtggaaaggtg

SEQ ID NO: 7744766 - DNA, 22 bp, Homo sapiens
gacagctggacagacactgatg

SEQ ID NO: 7744767 - DNA, 22 bp, Homo sapiens
gacagctgcttatgaaccaacg

SEQ ID NO: 7744768 - DNA, 22 bp, Homo sapiens
gacagctgaaggatgattcagg

SEQ ID NO: 7744769 - DNA, 22 bp, Homo sapiens
gacagctgcatcctcagacaca

SEQ ID NO: 7744770 - DNA, 22 bp, Homo sapiens
gacagctgctcccgtttctgct

SEQ ID NO: 7744771 - DNA, 22 bp, Homo sapiens
gacagctgcctctgtgtagatc

SEQ ID NO: 7744772 - DNA, 22 bp, Homo sapiens
gacagctgaaaaatgtaaggta

SEQ ID NO: 7744773 - DNA, 22 bp, Homo sapiens
gacagctgaacaggtgggataa

SEQ ID NO: 7744774 - DNA, 22 bp, Homo sapiens
gagcagcttgcgctgtcttcac

SEQ ID NO: 7744775 - DNA, 22 bp, Homo sapiens
gagatttcttttgatgcctgtc

SEQ ID NO: 7744776 - DNA, 22 bp, Homo sapiens
gaggatggatccgaccccttcc

SEQ ID NO: 7744777 - DNA, 22 bp, Homo sapiens
gaggccagaagtgcctcgggct

SEQ ID NO: 7744778 - DNA, 22 bp, Homo sapiens
gaggccagaagtgcctcgggct

SEQ ID NO: 7744779 - DNA, 22 bp, Homo sapiens
gaggcctggaccagccacagag

SEQ ID NO: 7744780 - DNA, 22 bp, Homo sapiens
gaggatgctgcagtgcaggaca

SEQ ID NO: 7744781 - DNA, 22 bp, Homo sapiens
gagctgtgagggacacattgct

SEQ ID NO: 7744782 - DNA, 22 bp, Homo sapiens
gagctgtgattggtgtctcact

SEQ ID NO: 7744783 - DNA, 22 bp, Homo sapiens
gagctgtgacacgcagcccagg

SEQ ID NO: 7744784 - DNA, 22 bp, Homo sapiens
gagctgtgaaaagtgcctgggg

SEQ ID NO: 7744785 - DNA, 22 bp, Homo sapiens
gagctgtgttcatgaggagaaa

SEQ ID NO: 7744786 - DNA, 22 bp, Homo sapiens
gagctgtgtgcctggatggtct

SEQ ID NO: 7744787 - DNA, 22 bp, Homo sapiens
gagctgtgccaatctgtctggg

SEQ ID NO: 7744788 - DNA, 20 bp, Homo sapiens
gagctgtgctctcaggagcc

SEQ ID NO: 7744789 - DNA, 22 bp, Homo sapiens
gagctgtggtcaacaggaaatt

SEQ ID NO: 7744790 - DNA, 22 bp, Homo sapiens
gagctgtgtatgcatcattctg

SEQ ID NO: 7744791 - DNA, 22 bp, Homo sapiens
gagctgtggaaggcagggacca

SEQ ID NO: 7744792 - DNA, 22 bp, Homo sapiens
gagctgtgcttataccaattca

SEQ ID NO: 7744793 - DNA, 22 bp, Homo sapiens
gagctcctgaaacgttcctgcc

SEQ ID NO: 7744794 - DNA, 22 bp, Homo sapiens
gagctcctcccagggtagcact

SEQ ID NO: 7744795 - DNA, 22 bp, Homo sapiens
gagctcctgctgcatcctgcct

SEQ ID NO: 7744796 - DNA, 22 bp, Homo sapiens
gagctcctggattgctcctagg

SEQ ID NO: 7744797 - DNA, 20 bp, Homo sapiens
gagggtgggacttcctaggc

SEQ ID NO: 7744798 - DNA, 22 bp, Homo sapiens
gagggtggaagagctgctgaga

SEQ ID NO: 7744799 - DNA, 22 bp, Homo sapiens
gagtaacaaatacttcagtagt

SEQ ID NO: 7744800 - DNA, 19 bp, Homo sapiens
gaggtttctgaagtgggct

SEQ ID NO: 7744801 - DNA, 22 bp, Homo sapiens
gaggtgagaagggggtcagatg

SEQ ID NO: 7744802 - DNA, 22 bp, Homo sapiens
gaggcctggtttgcatgagaat

SEQ ID NO: 7744803 - DNA, 22 bp, Homo sapiens
gaggcctggtttccagcatcct

SEQ ID NO: 7744804 - DNA, 22 bp, Homo sapiens
gaggcctggtgtgtctcccgct

SEQ ID NO: 7744805 - DNA, 22 bp, Homo sapiens
gaggcctggtgctgtgtccaca

SEQ ID NO: 7744806 - DNA, 22 bp, Homo sapiens
gaggcctggtctatgagatgtt

SEQ ID NO: 7744807 - DNA, 22 bp, Homo sapiens
gaggcctggtagccgagcccca

SEQ ID NO: 7744808 - DNA, 22 bp, Homo sapiens
gaggctggttctgaagtactgt

SEQ ID NO: 7744809 - DNA, 22 bp, Homo sapiens
ttataacactgccttgtcacca

SEQ ID NO: 7744810 - DNA, 22 bp, Homo sapiens
ttacataaaagttcacgtaggc

SEQ ID NO: 7744811 - DNA, 22 bp, Homo sapiens
tgtcagatgcgataaactagtg

SEQ ID NO: 7744812 - DNA, 22 bp, Homo sapiens
ttcaaattaccacatttgctta

SEQ ID NO: 7744813 - DNA, 22 bp, Homo sapiens
cggggcctcagtttccccacct

SEQ ID NO: 7744814 - DNA, 22 bp, Homo sapiens
ctcaggaaggaagcagggagcc

SEQ ID NO: 7744815 - DNA, 23 bp, Homo sapiens
ctcagaggcctgtccagggtggt

SEQ ID NO: 7744816 - DNA, 23 bp, Homo sapiens
ctcagggatagaaaggaagacag

SEQ ID NO: 7744817 - DNA, 22 bp, Homo sapiens
ctcagggatgggcagatgttaa

SEQ ID NO: 7744818 - DNA, 22 bp, Homo sapiens
ttggatacagatgaaaggaagg

SEQ ID NO: 7744819 - DNA, 22 bp, Homo sapiens
ctataattatgctcaaaatgta

SEQ ID NO: 7744820 - DNA, 22 bp, Homo sapiens
ctcagaggcaagcaaggagctg

SEQ ID NO: 7744821 - DNA, 22 bp, Homo sapiens
ctagaggggaaaaaggtcttgt

SEQ ID NO: 7744822 - DNA, 17 bp, Homo sapiens
tttctacagttggcagc

SEQ ID NO: 7744823 - DNA, 22 bp, Homo sapiens
tttctacagtactgatttcata

SEQ ID NO: 7744824 - DNA, 22 bp, Homo sapiens
tttctacagctggtgcaacttt

SEQ ID NO: 7744825 - DNA, 22 bp, Homo sapiens
tttctacagaagatacactgct

SEQ ID NO: 7744826 - DNA, 22 bp, Homo sapiens
tttccacaatttgagcagcaga

SEQ ID NO: 7744827 - DNA, 22 bp, Homo sapiens
tttccaactgtaccccagtgtt

SEQ ID NO: 7744828 - DNA, 22 bp, Homo sapiens
ctctgtgtgctggtggggtcct

SEQ ID NO: 7744829 - DNA, 22 bp, Homo sapiens
ctctgtgttaaattgggttttt

SEQ ID NO: 7744830 - DNA, 23 bp, Homo sapiens
ctctgggtccgatgtcctgacag

SEQ ID NO: 7744831 - DNA, 22 bp, Homo sapiens
ctctgggtgtcttaggagctca

SEQ ID NO: 7744832 - DNA, 22 bp, Homo sapiens
ctctgggtggtctcactgagtg

SEQ ID NO: 7744833 - DNA, 22 bp, Homo sapiens
ctctgggtgggcagcagatgga

SEQ ID NO: 7744834 - DNA, 22 bp, Homo sapiens
ctctgggtctccctgaggctaa

SEQ ID NO: 7744835 - DNA, 22 bp, Homo sapiens
ttttgcttgagtgcacaaaatg

SEQ ID NO: 7744836 - DNA, 22 bp, Homo sapiens
ctgaggctgagacaggtgaaat

SEQ ID NO: 7744837 - DNA, 19 bp, Homo sapiens
ctgctgggtgctgagggag

SEQ ID NO: 7744838 - DNA, 22 bp, Homo sapiens
ctggaaggttcctcccagctcc

SEQ ID NO: 7744839 - DNA, 22 bp, Homo sapiens
ctggagagggagccctggcagt

SEQ ID NO: 7744840 - DNA, 22 bp, Homo sapiens
tagggcaggggaggaatctgaa

SEQ ID NO: 7744841 - DNA, 22 bp, Homo sapiens
taggagcttttggagtcctgtg

SEQ ID NO: 7744842 - DNA, 22 bp, Homo sapiens
tagctacacatctaaacagcaa

SEQ ID NO: 7744843 - DNA, 20 bp, Homo sapiens
cagccctgtgacctggccct

SEQ ID NO: 7744844 - DNA, 22 bp, Homo sapiens
tactcaaactcactaagacaga

SEQ ID NO: 7744845 - DNA, 22 bp, Homo sapiens
caggctggagtgcagtggggcg

SEQ ID NO: 7744846 - DNA, 22 bp, Homo sapiens
caggctgggctccggagataaa

SEQ ID NO: 7744847 - DNA, 22 bp, Homo sapiens
caggctgggctggtgttagagt

SEQ ID NO: 7744848 - DNA, 22 bp, Homo sapiens
tagacattttctcaacatctct

SEQ ID NO: 7744849 - DNA, 22 bp, Homo sapiens
caggctggtcccagagcattgc

SEQ ID NO: 7744850 - DNA, 22 bp, Homo sapiens
tagctacaaatctgataagtgg

SEQ ID NO: 7744851 - DNA, 22 bp, Homo sapiens
caggttcccttgcagctaagtg

SEQ ID NO: 7744852 - DNA, 22 bp, Homo sapiens
tatttcagtcacttcttctctg

SEQ ID NO: 7744853 - DNA, 22 bp, Homo sapiens
tatttcttgttccctccaagtt

SEQ ID NO: 7744854 - DNA, 21 bp, Homo sapiens
tatttctttgactctctccct

SEQ ID NO: 7744855 - DNA, 22 bp, Homo sapiens
tatttccaccctcagtaaggaa

SEQ ID NO: 7744856 - DNA, 22 bp, Homo sapiens
tcacagttactccttcagatga

SEQ ID NO: 7744857 - DNA, 22 bp, Homo sapiens
tcacagttaattgttggaatgt

SEQ ID NO: 7744858 - DNA, 23 bp, Homo sapiens
tcacagttacttttgcatcaacc

SEQ ID NO: 7744859 - DNA, 21 bp, Homo sapiens
tcacagttcaagatgaacccc

SEQ ID NO: 7744860 - DNA, 22 bp, Homo sapiens
tcacagttcatctgataaacta

SEQ ID NO: 7744861 - DNA, 22 bp, Homo sapiens
tatttgaaagtgtacaaaaact

SEQ ID NO: 7744862 - DNA, 22 bp, Homo sapiens
tatttcttttcgtgacttattg

SEQ ID NO: 7744863 - DNA, 22 bp, Homo sapiens
cagttacattaataatgcacat

SEQ ID NO: 7744864 - DNA, 22 bp, Homo sapiens
cagttacatatttagtaggtta

SEQ ID NO: 7744865 - DNA, 22 bp, Homo sapiens
cagttacatgctcatgtcatca

SEQ ID NO: 7744866 - DNA, 22 bp, Homo sapiens
cagttacagagccagttagaga

SEQ ID NO: 7744867 - DNA, 22 bp, Homo sapiens
cagttacataaatgataaaatg

SEQ ID NO: 7744868 - DNA, 22 bp, Homo sapiens
cataacacattcatcagcagag

SEQ ID NO: 7744869 - DNA, 22 bp, Homo sapiens
tcccggcgctgggaggtgggtc

SEQ ID NO: 7744870 - DNA, 22 bp, Homo sapiens
tccccagacagcgggaggcctg

SEQ ID NO: 7744871 - DNA, 22 bp, Homo sapiens
catttgtagttaaaaatgtctc

SEQ ID NO: 7744872 - DNA, 22 bp, Homo sapiens
tcctcaggatctaggagtgctt

SEQ ID NO: 7744873 - DNA, 22 bp, Homo sapiens
tcctcaggcggtgaggaggggc

SEQ ID NO: 7744874 - DNA, 22 bp, Homo sapiens
tcctcaggatgtggggtagaat

SEQ ID NO: 7744875 - DNA, 22 bp, Homo sapiens
tctctgggagccaggatgacac

SEQ ID NO: 7744876 - DNA, 22 bp, Homo sapiens
tctctgggagttgagcagcagc

SEQ ID NO: 7744877 - DNA, 22 bp, Homo sapiens
tctccgggtgcatgtgtgtgcc

SEQ ID NO: 7744878 - DNA, 22 bp, Homo sapiens
ccacttttcactaagatgaatt

SEQ ID NO: 7744879 - DNA, 22 bp, Homo sapiens
ccagaaaaatcctcccttgtcc

SEQ ID NO: 7744880 - DNA, 22 bp, Homo sapiens
tctcaactttgagaaacattgt

SEQ ID NO: 7744881 - DNA, 22 bp, Homo sapiens
tcttgttacagtttattacatg

SEQ ID NO: 7744882 - DNA, 22 bp, Homo sapiens
tcttgtttctgtatataatgac

SEQ ID NO: 7744883 - DNA, 22 bp, Homo sapiens
ccaggctcaggtgcgagagaca

SEQ ID NO: 7744884 - DNA, 22 bp, Homo sapiens
ccatttttcataaactatccaa

SEQ ID NO: 7744885 - DNA, 22 bp, Homo sapiens
ccctgtgcctcagtttcctcat

SEQ ID NO: 7744886 - DNA, 22 bp, Homo sapiens
ccgggggcgggacgagcttgac

SEQ ID NO: 7744887 - DNA, 22 bp, Homo sapiens
tgggagctcagaaagggaggtc

SEQ ID NO: 7744888 - DNA, 23 bp, Homo sapiens
tgggagctcaagggaggctgccc

SEQ ID NO: 7744889 - DNA, 21 bp, Homo sapiens
cctgagggtggttgtgaagat

SEQ ID NO: 7744890 - DNA, 22 bp, Homo sapiens
tgggggagagaggcattctttc

SEQ ID NO: 7744891 - DNA, 22 bp, Homo sapiens
cctgactctggccaggccagct

SEQ ID NO: 7744892 - DNA, 22 bp, Homo sapiens
cctgctggacgtggaggagggg

SEQ ID NO: 7744893 - DNA, 22 bp, Homo sapiens
cctgctggctggtagagttccg

SEQ ID NO: 7744894 - DNA, 22 bp, Homo sapiens
tgggtaggtgtggcctgaatgt

SEQ ID NO: 7744895 - DNA, 22 bp, Homo sapiens
tgggtcagacagccagtgggcc

SEQ ID NO: 7744896 - DNA, 22 bp, Homo sapiens
tgggtcagaggacctcgtggcc

SEQ ID NO: 7744897 - DNA, 22 bp, Homo sapiens
tgggtcagagcagacctctgga

SEQ ID NO: 7744898 - DNA, 22 bp, Homo sapiens
tgggtcaggctgggagtcctga

SEQ ID NO: 7744899 - DNA, 22 bp, Homo sapiens
tgggtcagattgagcccctggt

SEQ ID NO: 7744900 - DNA, 22 bp, Homo sapiens
tgtcaaatagtagaaagatggc

SEQ ID NO: 7744901 - DNA, 19 bp, Homo sapiens
tttttacaagtaggtgtga

SEQ ID NO: 7744902 - DNA, 22 bp, Homo sapiens
tttttacacttagcattgagcg

SEQ ID NO: 7744903 - DNA, 22 bp, Homo sapiens
tttttacagtcatggtcactca

SEQ ID NO: 7744904 - DNA, 22 bp, Homo sapiens
tttttagagtgttaccagtata

SEQ ID NO: 7744905 - DNA, 22 bp, Homo sapiens
tttgagtctgcttccattttca

SEQ ID NO: 7744906 - DNA, 22 bp, Homo sapiens
tttgattctaagttctgtcaac

SEQ ID NO: 7744907 - DNA, 22 bp, Homo sapiens
tttggtctcattcactcatggg

SEQ ID NO: 7744908 - DNA, 22 bp, Homo sapiens
tttggtctggaatcttcagggt

SEQ ID NO: 7744909 - DNA, 22 bp, Homo sapiens
tttggtcttggatttatcagtg

SEQ ID NO: 7744910 - DNA, 22 bp, Homo sapiens
tttggtctctgtgcatcctcct

SEQ ID NO: 7744911 - DNA, 22 bp, Homo sapiens
tttggtcttttatttaaagcag

SEQ ID NO: 7744912 - DNA, 19 bp, Homo sapiens
tttcttttcccctcagcac

SEQ ID NO: 7744913 - DNA, 22 bp, Homo sapiens
tttcttttccaatatccctact

SEQ ID NO: 7744914 - DNA, 22 bp, Homo sapiens
tttcttttgctgagaggggcac

SEQ ID NO: 7744915 - DNA, 22 bp, Homo sapiens
tttcttttgccctgtgggttag

SEQ ID NO: 7744916 - DNA, 22 bp, Homo sapiens
tttcttttgaatagtgtgtggt

SEQ ID NO: 7744917 - DNA, 22 bp, Homo sapiens
tttcttttacagtgtggctatt

SEQ ID NO: 7744918 - DNA, 22 bp, Homo sapiens
tttgacaactgtgcagtttgta

SEQ ID NO: 7744919 - DNA, 22 bp, Homo sapiens
tttgaatctgatatggcagcat

SEQ ID NO: 7744920 - DNA, 22 bp, Homo sapiens
ttttcacacaaggtgataagtt

SEQ ID NO: 7744921 - DNA, 20 bp, Homo sapiens
ttttctgtgccaagaaaact

SEQ ID NO: 7744922 - DNA, 22 bp, Homo sapiens
ttttcttatggtgaagcacaaa

SEQ ID NO: 7744923 - DNA, 22 bp, Homo sapiens
tttgttcaatccagacaatagc

SEQ ID NO: 7744924 - DNA, 22 bp, Homo sapiens
tttgttcaaggaatagtaaatg

SEQ ID NO: 7744925 - DNA, 22 bp, Homo sapiens
ttcagttttattgtactgctat

SEQ ID NO: 7744926 - DNA, 22 bp, Homo sapiens
ttccagttcccatgaggattaa

SEQ ID NO: 7744927 - DNA, 22 bp, Homo sapiens
ttccagttcagatgcaacaggg

SEQ ID NO: 7744928 - DNA, 22 bp, Homo sapiens
ttccagttcactccatttctgg

SEQ ID NO: 7744929 - DNA, 22 bp, Homo sapiens
ttccagtgaccatagagtatgg

SEQ ID NO: 7744930 - DNA, 22 bp, Homo sapiens
ttccagttaaggaagctattct

SEQ ID NO: 7744931 - DNA, 22 bp, Homo sapiens
ttatagatctaaatgtgaaggg

SEQ ID NO: 7744932 - DNA, 22 bp, Homo sapiens
ttatagatgccttgagtaaatg

SEQ ID NO: 7744933 - DNA, 22 bp, Homo sapiens
ttatagtgcataattaacatgg

SEQ ID NO: 7744934 - DNA, 22 bp, Homo sapiens
ttctgtgtgcttactggtgttc

SEQ ID NO: 7744935 - DNA, 22 bp, Homo sapiens
ttcttacattactttacatgtg

SEQ ID NO: 7744936 - DNA, 22 bp, Homo sapiens
ttctgtggaatatgaactagca

SEQ ID NO: 7744937 - DNA, 22 bp, Homo sapiens
ttctttttaaagtgtgtatgca

SEQ ID NO: 7744938 - DNA, 22 bp, Homo sapiens
ttctttgtttgataagtatgct

SEQ ID NO: 7744939 - DNA, 22 bp, Homo sapiens
ttctttgtagcaaaacgtgtat

SEQ ID NO: 7744940 - DNA, 22 bp, Homo sapiens
ttctctagtgcaaattgtttga

SEQ ID NO: 7744941 - DNA, 18 bp, Homo sapiens
ttccttggtaacatatgc

SEQ ID NO: 7744942 - DNA, 17 bp, Homo sapiens
ttccttgggtgctgggt

SEQ ID NO: 7744943 - DNA, 22 bp, Homo sapiens
ttccttgggttctgatgtgttt

SEQ ID NO: 7744944 - DNA, 17 bp, Homo sapiens
ttccttgggtgctgggt

SEQ ID NO: 7744945 - DNA, 22 bp, Homo sapiens
ttccttgggagaaaaaatatat

SEQ ID NO: 7744946 - DNA, 22 bp, Homo sapiens
ttccttgggaaatgctcgttta

SEQ ID NO: 7744947 - DNA, 22 bp, Homo sapiens
ttccttggtagagagaatattt

SEQ ID NO: 7744948 - DNA, 22 bp, Homo sapiens
ttccttggtagggacaactctg

SEQ ID NO: 7744949 - DNA, 22 bp, Homo sapiens
ttccttggtgcccgatgtattt

SEQ ID NO: 7744950 - DNA, 22 bp, Homo sapiens
ttccttggtgcgcctgctgcag

SEQ ID NO: 7744951 - DNA, 22 bp, Homo sapiens
ttccttggtgcgcctgctgcag

SEQ ID NO: 7744952 - DNA, 22 bp, Homo sapiens
ttcctggtaacaatctcaaagt

SEQ ID NO: 7744953 - DNA, 22 bp, Homo sapiens
ttcctggtcctattatatacac

SEQ ID NO: 7744954 - DNA, 22 bp, Homo sapiens
ttccttggatacaagtaacttt

SEQ ID NO: 7744955 - DNA, 22 bp, Homo sapiens
ttccttggccacactggtgctt

SEQ ID NO: 7744956 - DNA, 22 bp, Homo sapiens
ttccttggccccatgcccaggg

SEQ ID NO: 7744957 - DNA, 22 bp, Homo sapiens
ttccttggccacactggtgctt

SEQ ID NO: 7744958 - DNA, 20 bp, Homo sapiens
ttccttggattgtgtcttga

SEQ ID NO: 7744959 - DNA, 22 bp, Homo sapiens
ttccttggagcgctaaagctct

SEQ ID NO: 7744960 - DNA, 22 bp, Homo sapiens
ttccttggaaattctgacttca

SEQ ID NO: 7744961 - DNA, 19 bp, Homo sapiens
ttccagttctaatctcttc

SEQ ID NO: 7744962 - DNA, 22 bp, Homo sapiens
ttccagttggcactgcaattta

SEQ ID NO: 7744963 - DNA, 22 bp, Homo sapiens
ttccagttcttctgtaagcact

SEQ ID NO: 7744964 - DNA, 17 bp, Homo sapiens
ttccagtttagtattgt

SEQ ID NO: 7744965 - DNA, 22 bp, Homo sapiens
ttccagtttgcagttgacacta

SEQ ID NO: 7744966 - DNA, 22 bp, Homo sapiens
tttcagagcctttatctctcta

SEQ ID NO: 7744967 - DNA, 22 bp, Homo sapiens
tttcccaggccctcagggctgc

SEQ ID NO: 7744968 - DNA, 21 bp, Homo sapiens
tttcccagcagagatagctgg

SEQ ID NO: 7744969 - DNA, 22 bp, Homo sapiens
tttcaacaggatgataataggc

SEQ ID NO: 7744970 - DNA, 22 bp, Homo sapiens
tttcaagactcattgagtattg

SEQ ID NO: 7744971 - DNA, 22 bp, Homo sapiens
tttcaacagaatatgatcagag

SEQ ID NO: 7744972 - DNA, 22 bp, Homo sapiens
tttattgacccaaagcgagagt

SEQ ID NO: 7744973 - DNA, 22 bp, Homo sapiens
tttacagcttctatactatgtg

SEQ ID NO: 7744974 - DNA, 22 bp, Homo sapiens
tttaatctattccctaaacacc

SEQ ID NO: 7744975 - DNA, 22 bp, Homo sapiens
tttaagctaatgtcataattag

SEQ ID NO: 7744976 - DNA, 20 bp, Homo sapiens
tttatcaggcacttactatt

SEQ ID NO: 7744977 - DNA, 20 bp, Homo sapiens
tttatcaggcacttactatt

SEQ ID NO: 7744978 - DNA, 22 bp, Homo sapiens
tttatcagtagcaaagttttaa

SEQ ID NO: 7744979 - DNA, 22 bp, Homo sapiens
tttatcagaggctatgtttcat

SEQ ID NO: 7744980 - DNA, 22 bp, Homo sapiens
tttatcagaggctatgtttcat

SEQ ID NO: 7744981 - DNA, 22 bp, Homo sapiens
tttagagctgtgctgccacatg

SEQ ID NO: 7744982 - DNA, 22 bp, Homo sapiens
tttagaaggactacagtgtgat

SEQ ID NO: 7744983 - DNA, 20 bp, Homo sapiens
tttagaagaatgagcacttt

SEQ ID NO: 7744984 - DNA, 22 bp, Homo sapiens
tttaccaagagttgtcactgtt

SEQ ID NO: 7744985 - DNA, 21 bp, Homo sapiens
ttggaatttgggagctatgtg

SEQ ID NO: 7744986 - DNA, 22 bp, Homo sapiens
ttggaatttagtaaaataatgc

SEQ ID NO: 7744987 - DNA, 22 bp, Homo sapiens
ttgctctgtcagggcctcagtc

SEQ ID NO: 7744988 - DNA, 22 bp, Homo sapiens
ttgctctgactggagtgcagtg

SEQ ID NO: 7744989 - DNA, 22 bp, Homo sapiens
ttgctctgtaataatctggggt

SEQ ID NO: 7744990 - DNA, 22 bp, Homo sapiens
ttgggcagtgattagttcatga

SEQ ID NO: 7744991 - DNA, 22 bp, Homo sapiens
ttgggcagtagcctcttggtgt

SEQ ID NO: 7744992 - DNA, 22 bp, Homo sapiens
ttgggcagggaaaggacaggca

SEQ ID NO: 7744993 - DNA, 22 bp, Homo sapiens
ttgggagattcattgagccaag

SEQ ID NO: 7744994 - DNA, 22 bp, Homo sapiens
ttgggagaaatagttgatccgc

SEQ ID NO: 7744995 - DNA, 22 bp, Homo sapiens
ttggaggaggcattggaggatt

SEQ ID NO: 7744996 - DNA, 22 bp, Homo sapiens
ttggacctcagttattctatca

SEQ ID NO: 7744997 - DNA, 22 bp, Homo sapiens
ttgtacaagtattatgtgaaca

SEQ ID NO: 7744998 - DNA, 22 bp, Homo sapiens
ttgggcctgatcggaataagga

SEQ ID NO: 7744999 - DNA, 22 bp, Homo sapiens
ttgtgtcatgttccattgaaaa

SEQ ID NO: 7745000 - DNA, 22 bp, Homo sapiens
ggacagcgtggctggtggaggg

SEQ ID NO: 7745001 - DNA, 22 bp, Homo sapiens
ggaaggggtcacctcctgatga

SEQ ID NO: 7745002 - DNA, 22 bp, Homo sapiens
cacagcataatgaaatatactt

SEQ ID NO: 7745003 - DNA, 22 bp, Homo sapiens
ggaggggatggtttgaccctgg

SEQ ID NO: 7745004 - DNA, 22 bp, Homo sapiens
ggaggggatttagtagatgcta

SEQ ID NO: 7745005 - DNA, 22 bp, Homo sapiens
cacagctgaagtagccatgtgg

SEQ ID NO: 7745006 - DNA, 22 bp, Homo sapiens
gctggcagagctctgggctggg

SEQ ID NO: 7745007 - DNA, 22 bp, Homo sapiens
gctggcagcattagaccctggg

SEQ ID NO: 7745008 - DNA, 19 bp, Homo sapiens
gctggcagatgtggccgtg

SEQ ID NO: 7745009 - DNA, 22 bp, Homo sapiens
gctgggagccgtacctgtcacg

SEQ ID NO: 7745010 - DNA, 22 bp, Homo sapiens
gctgggaggaatttggggaata

SEQ ID NO: 7745011 - DNA, 19 bp, Homo sapiens
gctgggagcagaccctccc

SEQ ID NO: 7745012 - DNA, 22 bp, Homo sapiens
gctgggagcaaagccatgcata

SEQ ID NO: 7745013 - DNA, 22 bp, Homo sapiens
gctgggagccctggtctgctcc

SEQ ID NO: 7745014 - DNA, 22 bp, Homo sapiens
gctggtggttaccgtgctaatg

SEQ ID NO: 7745015 - DNA, 22 bp, Homo sapiens
gctggtggtgggccagttctgt

SEQ ID NO: 7745016 - DNA, 22 bp, Homo sapiens
caagttacattagaaatcatgc

SEQ ID NO: 7745017 - DNA, 22 bp, Homo sapiens
ggcttggaaatggtaatgagct

SEQ ID NO: 7745018 - DNA, 22 bp, Homo sapiens
ggcttggaaactagagtgtgca

SEQ ID NO: 7745019 - DNA, 22 bp, Homo sapiens
ggcttggagtcatactgagaat

SEQ ID NO: 7745020 - DNA, 22 bp, Homo sapiens
ggcttggaattggtaggatgta

SEQ ID NO: 7745021 - DNA, 22 bp, Homo sapiens
cagaacattcactcatatgtgg

SEQ ID NO: 7745022 - DNA, 19 bp, Homo sapiens
cagaacagaggtcatggcc

SEQ ID NO: 7745023 - DNA, 23 bp, Homo sapiens
ggctgggagctccgggtgcacgt

SEQ ID NO: 7745024 - DNA, 22 bp, Homo sapiens
ggctgggagccccacagagtca

SEQ ID NO: 7745025 - DNA, 22 bp, Homo sapiens
ggctgggacgatgaggattagt

SEQ ID NO: 7745026 - DNA, 22 bp, Homo sapiens
ggctcctgtagatctctaaagc

SEQ ID NO: 7745027 - DNA, 22 bp, Homo sapiens
ggctcctgtcctcctggagctc

SEQ ID NO: 7745028 - DNA, 22 bp, Homo sapiens
ggctcctgggggtgctcctgcc

SEQ ID NO: 7745029 - DNA, 22 bp, Homo sapiens
ggatcaggctgaagctaggact

SEQ ID NO: 7745030 - DNA, 22 bp, Homo sapiens
ggagtgaataagtagggggaaa

SEQ ID NO: 7745031 - DNA, 22 bp, Homo sapiens
ggcaggactcttctgtgggccg

SEQ ID NO: 7745032 - DNA, 20 bp, Homo sapiens
gtcctaggtttgaaggtaaa

SEQ ID NO: 7745033 - DNA, 22 bp, Homo sapiens
cagcaggtcttgttgctgctga

SEQ ID NO: 7745034 - DNA, 22 bp, Homo sapiens
cagccctgtgcggagggccctg

SEQ ID NO: 7745035 - DNA, 22 bp, Homo sapiens
gggctctgcgctcagctccagc

SEQ ID NO: 7745036 - DNA, 22 bp, Homo sapiens
gggctcaggagtttgaggctgc

SEQ ID NO: 7745037 - DNA, 22 bp, Homo sapiens
gggctcaggcctggcctctcac

SEQ ID NO: 7745038 - DNA, 22 bp, Homo sapiens
gggctcaggtcagggcatcagc

SEQ ID NO: 7745039 - DNA, 22 bp, Homo sapiens
gggctctgcagtgacttgaggg

SEQ ID NO: 7745040 - DNA, 22 bp, Homo sapiens
gggctcagtcggcaagcccctt

SEQ ID NO: 7745041 - DNA, 22 bp, Homo sapiens
gggctcagtctgcggcgcgcgg

SEQ ID NO: 7745042 - DNA, 22 bp, Homo sapiens
gggctcagtctggcgtggaatg

SEQ ID NO: 7745043 - DNA, 21 bp, Homo sapiens
gggctcagtggaaaagagtgt

SEQ ID NO: 7745044 - DNA, 22 bp, Homo sapiens
cagaggctgatgtgggatgggc

SEQ ID NO: 7745045 - DNA, 22 bp, Homo sapiens
cagaggctgctctgggtggcat

SEQ ID NO: 7745046 - DNA, 22 bp, Homo sapiens
cagatatattttatttggtcaa

SEQ ID NO: 7745047 - DNA, 22 bp, Homo sapiens
cagcagaacaggcagggaagct

SEQ ID NO: 7745048 - DNA, 22 bp, Homo sapiens
cagcagaacagttaaagaaacc

SEQ ID NO: 7745049 - DNA, 20 bp, Homo sapiens
atgtttaatgttgtccaccc

SEQ ID NO: 7745050 - DNA, 22 bp, Homo sapiens
gagcagctaaaattctcatgca

SEQ ID NO: 7745051 - DNA, 22 bp, Homo sapiens
gagctctgtacacagagggtgt

SEQ ID NO: 7745052 - DNA, 22 bp, Homo sapiens
gagctctgggtgtgttgtcagt

SEQ ID NO: 7745053 - DNA, 22 bp, Homo sapiens
gagctctggcagggcaggtctg

SEQ ID NO: 7745054 - DNA, 22 bp, Homo sapiens
gagctctgggaaacaaagtgta

SEQ ID NO: 7745055 - DNA, 22 bp, Homo sapiens
gactttccaggtcctgggctat

SEQ ID NO: 7745056 - DNA, 22 bp, Homo sapiens
gacaggaaatatgggggttgtt

SEQ ID NO: 7745057 - DNA, 22 bp, Homo sapiens
gaaaagaactgcatgggattaa

SEQ ID NO: 7745058 - DNA, 22 bp, Homo sapiens
gaaaagaactgcatgggattaa

SEQ ID NO: 7745059 - DNA, 22 bp, Homo sapiens
gaaatctactttgggttagaca

SEQ ID NO: 7745060 - DNA, 18 bp, Homo sapiens
gaacttttggctttgtgt

SEQ ID NO: 7745061 - DNA, 22 bp, Homo sapiens
gaactttgcgcagttcccgggg

SEQ ID NO: 7745062 - DNA, 22 bp, Homo sapiens
gaacatttccagaaaggaacta

SEQ ID NO: 7745063 - DNA, 22 bp, Homo sapiens
gctctgggtgaagggtaccatt

SEQ ID NO: 7745064 - DNA, 22 bp, Homo sapiens
gctctgggtgaatggcagattg

SEQ ID NO: 7745065 - DNA, 22 bp, Homo sapiens
gctctgggtgaacttggagcaa

SEQ ID NO: 7745066 - DNA, 22 bp, Homo sapiens
gctctgagacacaaagggtgca

SEQ ID NO: 7745067 - DNA, 22 bp, Homo sapiens
gctctgagaggatgctgagcag

SEQ ID NO: 7745068 - DNA, 19 bp, Homo sapiens
gctctgagaggggcatggg

SEQ ID NO: 7745069 - DNA, 22 bp, Homo sapiens
caaatattccaggtacatccct

SEQ ID NO: 7745070 - DNA, 22 bp, Homo sapiens
gctcggagtcccacctgggaaa

SEQ ID NO: 7745071 - DNA, 20 bp, Homo sapiens
gctctaaagccacagattga

SEQ ID NO: 7745072 - DNA, 22 bp, Homo sapiens
gctctaggaggtgtgcttagaa

SEQ ID NO: 7745073 - DNA, 22 bp, Homo sapiens
gctcagggctaaggctgagggg

SEQ ID NO: 7745074 - DNA, 22 bp, Homo sapiens
gctatttagtgagtcacatcct

SEQ ID NO: 7745075 - DNA, 22 bp, Homo sapiens
gctacaagtcttgtcattcatt

SEQ ID NO: 7745076 - DNA, 22 bp, Homo sapiens
attttcttctctccctggctgc

SEQ ID NO: 7745077 - DNA, 23 bp, Homo sapiens
attttacaggtcagttccttgaa

SEQ ID NO: 7745078 - DNA, 22 bp, Homo sapiens
attttacataaggaaggtttaa

SEQ ID NO: 7745079 - DNA, 22 bp, Homo sapiens
atttacagaccctcccactaag

SEQ ID NO: 7745080 - DNA, 23 bp, Homo sapiens
atttacaggttaaatgaaatcag

SEQ ID NO: 7745081 - DNA, 22 bp, Homo sapiens
atttacagtgtgcctactatat

SEQ ID NO: 7745082 - DNA, 22 bp, Homo sapiens
gcactgggtgtgaggcagcgtc

SEQ ID NO: 7745083 - DNA, 20 bp, Homo sapiens
gcaaaataggctctgttggt

SEQ ID NO: 7745084 - DNA, 22 bp, Homo sapiens
attgtgcagcacagatcatgac

SEQ ID NO: 7745085 - DNA, 22 bp, Homo sapiens
atttacagaagcatgtaatagc

SEQ ID NO: 7745086 - DNA, 22 bp, Homo sapiens
gccactgattccaagtcaattt

SEQ ID NO: 7745087 - DNA, 22 bp, Homo sapiens
gcagggaggtttgctgacctgg

SEQ ID NO: 7745088 - DNA, 22 bp, Homo sapiens
ctgggggcaatggtcagagtgt

SEQ ID NO: 7745089 - DNA, 19 bp, Homo sapiens
ctgggaggtgttcagagaa

SEQ ID NO: 7745090 - DNA, 23 bp, Homo sapiens
ctggggctttcaaatctgggcag

SEQ ID NO: 7745091 - DNA, 22 bp, Homo sapiens
ctgggagcttgttaggaatgca

SEQ ID NO: 7745092 - DNA, 22 bp, Homo sapiens
atcaggaaagagtggaactctg

SEQ ID NO: 7745093 - DNA, 22 bp, Homo sapiens
atcagctggaacaagtgtctga

SEQ ID NO: 7745094 - DNA, 22 bp, Homo sapiens
ctgtctctgataagctcgaggg

SEQ ID NO: 7745095 - DNA, 22 bp, Homo sapiens
atctgtcttgccttgcatattt

SEQ ID NO: 7745096 - DNA, 22 bp, Homo sapiens
atctgtcttttaatgttaatgc

SEQ ID NO: 7745097 - DNA, 22 bp, Homo sapiens
cttcttaatcccttatatattt

SEQ ID NO: 7745098 - DNA, 22 bp, Homo sapiens
cttcttaaattggattgctatt

SEQ ID NO: 7745099 - DNA, 22 bp, Homo sapiens
cttcttaactgtatatactatg

SEQ ID NO: 7745100 - DNA, 22 bp, Homo sapiens
cttccttgctgtctgctccagg

SEQ ID NO: 7745101 - DNA, 19 bp, Homo sapiens
cttattagagtgagagctt

SEQ ID NO: 7745102 - DNA, 22 bp, Homo sapiens
ctgctgtgggcagggtagctgg

SEQ ID NO: 7745103 - DNA, 22 bp, Homo sapiens
ctgctgggcctggtctctgagg

SEQ ID NO: 7745104 - DNA, 22 bp, Homo sapiens
ctgctagggttcagcagtgcct

SEQ ID NO: 7745105 - DNA, 22 bp, Homo sapiens
ctgggagctgtcaggagcgtgt

SEQ ID NO: 7745106 - DNA, 20 bp, Homo sapiens
atacacatgcagacagatgc

SEQ ID NO: 7745107 - DNA, 22 bp, Homo sapiens
agtcaatattcaagtgtaaata

SEQ ID NO: 7745108 - DNA, 22 bp, Homo sapiens
agtaaacattttcatattttct

SEQ ID NO: 7745109 - DNA, 22 bp, Homo sapiens
agtcaggacacagcatgaacat

SEQ ID NO: 7745110 - DNA, 22 bp, Homo sapiens
ctattctgattaccagatattg

SEQ ID NO: 7745111 - DNA, 22 bp, Homo sapiens
ctattctgcttgaaattattct

SEQ ID NO: 7745112 - DNA, 22 bp, Homo sapiens
aggtaaatataaatcttactct

SEQ ID NO: 7745113 - DNA, 22 bp, Homo sapiens
aggtaaatgaatgtttagtctt

SEQ ID NO: 7745114 - DNA, 22 bp, Homo sapiens
aggtatttacccacttttgttt

SEQ ID NO: 7745115 - DNA, 22 bp, Homo sapiens
cctgggaggctgtttccagcct

SEQ ID NO: 7745116 - DNA, 22 bp, Homo sapiens
cctgggaggtggaggttgcagc

SEQ ID NO: 7745117 - DNA, 22 bp, Homo sapiens
cctgggaggtggaggttgcagt

SEQ ID NO: 7745118 - DNA, 21 bp, Homo sapiens
cctgggagaattgggtgtggc

SEQ ID NO: 7745119 - DNA, 22 bp, Homo sapiens
aggtcataatcagttattcaaa

SEQ ID NO: 7745120 - DNA, 22 bp, Homo sapiens
cctgtgggtacaacagggtcac

SEQ ID NO: 7745121 - DNA, 22 bp, Homo sapiens
cctgtgggagcccaggcagata

SEQ ID NO: 7745122 - DNA, 22 bp, Homo sapiens
aggtcctgatgatctctgagag

SEQ ID NO: 7745123 - DNA, 22 bp, Homo sapiens
aggtcctggactgctcttgtta

SEQ ID NO: 7745124 - DNA, 20 bp, Homo sapiens
aggtcctggttctctgggat

SEQ ID NO: 7745125 - DNA, 22 bp, Homo sapiens
cctggggctctgcacagagcag

SEQ ID NO: 7745126 - DNA, 22 bp, Homo sapiens
agtggaaggtcaggggacagtg

SEQ ID NO: 7745127 - DNA, 22 bp, Homo sapiens
agtctacaatcttaaatgaact

SEQ ID NO: 7745128 - DNA, 19 bp, Homo sapiens
agtctttcccactcgtctt

SEQ ID NO: 7745129 - DNA, 23 bp, Homo sapiens
ctcaccaagcgccgccgctgtgt

SEQ ID NO: 7745130 - DNA, 22 bp, Homo sapiens
agttaacacatccagaatagag

SEQ ID NO: 7745131 - DNA, 22 bp, Homo sapiens
agttaacacagtcaggagtaac

SEQ ID NO: 7745132 - DNA, 22 bp, Homo sapiens
agttaacaagttggcaatcaac

SEQ ID NO: 7745133 - DNA, 22 bp, Homo sapiens
agttaacacaagtaagattcca

SEQ ID NO: 7745134 - DNA, 22 bp, Homo sapiens
ctctggagttctcatgaggaac

SEQ ID NO: 7745135 - DNA, 17 bp, Homo sapiens
agtgtcagggcccttcc

SEQ ID NO: 7745136 - DNA, 19 bp, Homo sapiens
ccctaggggctcctgaggg

SEQ ID NO: 7745137 - DNA, 22 bp, Homo sapiens
ccctaggggcaatgatggtgct

SEQ ID NO: 7745138 - DNA, 22 bp, Homo sapiens
ccctagggctaagcaggactgc

SEQ ID NO: 7745139 - DNA, 22 bp, Homo sapiens
aggctgtgaaatgtggcaagga

SEQ ID NO: 7745140 - DNA, 22 bp, Homo sapiens
aggctgtgaactctatgctgaa

SEQ ID NO: 7745141 - DNA, 22 bp, Homo sapiens
agggcctgcatcaggagcttgg

SEQ ID NO: 7745142 - DNA, 20 bp, Homo sapiens
agggcctgctctgtggtgtc

SEQ ID NO: 7745143 - DNA, 22 bp, Homo sapiens
agggcctggcgcgtggccgccg

SEQ ID NO: 7745144 - DNA, 22 bp, Homo sapiens
agggctggcatctctaatgctg

SEQ ID NO: 7745145 - DNA, 22 bp, Homo sapiens
agggctggcaagggattgaaat

SEQ ID NO: 7745146 - DNA, 22 bp, Homo sapiens
agggctggagccacagctggga

SEQ ID NO: 7745147 - DNA, 22 bp, Homo sapiens
aggctggacccgacacctgccc

SEQ ID NO: 7745148 - DNA, 19 bp, Homo sapiens
aggctggagacaccaggcc

SEQ ID NO: 7745149 - DNA, 22 bp, Homo sapiens
aggctggaaatcactagattcc

SEQ ID NO: 7745150 - DNA, 22 bp, Homo sapiens
aggctggaaagggaccagagtg

SEQ ID NO: 7745151 - DNA, 22 bp, Homo sapiens
aggctggagacccgccaagaaa

SEQ ID NO: 7745152 - DNA, 22 bp, Homo sapiens
aggctggagcaagggggcatat

SEQ ID NO: 7745153 - DNA, 22 bp, Homo sapiens
aggctggaggtttgttgcggct

SEQ ID NO: 7745154 - DNA, 22 bp, Homo sapiens
aggctggagggcaatggcaaga

SEQ ID NO: 7745155 - DNA, 22 bp, Homo sapiens
aggctggagtacagtggctatt

SEQ ID NO: 7745156 - DNA, 22 bp, Homo sapiens
aggctggagtgctggagtgctg

SEQ ID NO: 7745157 - DNA, 22 bp, Homo sapiens
ccatttagtaaggaagaacagc

SEQ ID NO: 7745158 - DNA, 22 bp, Homo sapiens
aggctgaggcaagaggatcact

SEQ ID NO: 7745159 - DNA, 22 bp, Homo sapiens
ccagaaaatgcagaacatagaa

SEQ ID NO: 7745160 - DNA, 22 bp, Homo sapiens
ccagaaaatatggctaaggtga

SEQ ID NO: 7745161 - DNA, 22 bp, Homo sapiens
ccagaaaaggagctgcaggatg

SEQ ID NO: 7745162 - DNA, 22 bp, Homo sapiens
aggccacaagaaaatgcttcat

SEQ ID NO: 7745163 - DNA, 22 bp, Homo sapiens
aggccacatagcttgcatgtag

SEQ ID NO: 7745164 - DNA, 22 bp, Homo sapiens
aggcctgctgtcttgaggccaa

SEQ ID NO: 7745165 - DNA, 22 bp, Homo sapiens
ccaggaaggcctggatgccccc

SEQ ID NO: 7745166 - DNA, 22 bp, Homo sapiens
ccaggaaggcgttgttcctctc

SEQ ID NO: 7745167 - DNA, 22 bp, Homo sapiens
ccaggaaggtatgggaagaaaa

SEQ ID NO: 7745168 - DNA, 22 bp, Homo sapiens
ccaggaagggctctttaaagac

SEQ ID NO: 7745169 - DNA, 22 bp, Homo sapiens
aggcctgggacgggagccgtga

SEQ ID NO: 7745170 - DNA, 22 bp, Homo sapiens
ccaggaaggcaggcctccccgc

SEQ ID NO: 7745171 - DNA, 22 bp, Homo sapiens
aggcctggctttggtttgctga

SEQ ID NO: 7745172 - DNA, 22 bp, Homo sapiens
ccaggaagtatgacccaacaga

SEQ ID NO: 7745173 - DNA, 22 bp, Homo sapiens
ccaggaaggtgtttaactagag

SEQ ID NO: 7745174 - DNA, 22 bp, Homo sapiens
aggcgctgcgctggggccagaa

SEQ ID NO: 7745175 - DNA, 22 bp, Homo sapiens
aggcggagctcagtgtgtccaa

SEQ ID NO: 7745176 - DNA, 22 bp, Homo sapiens
aggcggcttctgaggaggctgc

SEQ ID NO: 7745177 - DNA, 22 bp, Homo sapiens
agctttctcttctttagaaagt

SEQ ID NO: 7745178 - DNA, 22 bp, Homo sapiens
aggaagaggtgtgcaatggtgt

SEQ ID NO: 7745179 - DNA, 22 bp, Homo sapiens
aggaagagtgttacctatgggt

SEQ ID NO: 7745180 - DNA, 22 bp, Homo sapiens
aggaagcaaaaggcagggtcta

SEQ ID NO: 7745181 - DNA, 22 bp, Homo sapiens
aggaagaggtagctgtcaaggg

SEQ ID NO: 7745182 - DNA, 20 bp, Homo sapiens
aggaaggagaatctgagcaa

SEQ ID NO: 7745183 - DNA, 22 bp, Homo sapiens
caggtcctctgagatgggaggt

SEQ ID NO: 7745184 - DNA, 22 bp, Homo sapiens
caggtcctcgggggaggccggc

SEQ ID NO: 7745185 - DNA, 22 bp, Homo sapiens
caggtcctggcatcaggcaggt

SEQ ID NO: 7745186 - DNA, 22 bp, Homo sapiens
agctgggactcaactgtctggg

SEQ ID NO: 7745187 - DNA, 22 bp, Homo sapiens
caggaagaccagggctgtggct

SEQ ID NO: 7745188 - DNA, 22 bp, Homo sapiens
caggaagaagggtggtgagtcc

SEQ ID NO: 7745189 - DNA, 22 bp, Homo sapiens
caggaagaaagaggtgaggtgt

SEQ ID NO: 7745190 - DNA, 14 bp, Homo sapiens
caggaagactcagc

SEQ ID NO: 7745191 - DNA, 22 bp, Homo sapiens
aggcactgacagattctgtgtc

SEQ ID NO: 7745192 - DNA, 22 bp, Homo sapiens
ccaaacatttcaaatttagaga

SEQ ID NO: 7745193 - DNA, 22 bp, Homo sapiens
aggaggctggttcaggccatat

SEQ ID NO: 7745194 - DNA, 22 bp, Homo sapiens
agaaaaagaaagtggatttgtc

SEQ ID NO: 7745195 - DNA, 22 bp, Homo sapiens
acttttgaagaattatgcaaaa

SEQ ID NO: 7745196 - DNA, 22 bp, Homo sapiens
actttttacagggtgtatacca

SEQ ID NO: 7745197 - DNA, 22 bp, Homo sapiens
actttttagtttcctcaaacat

SEQ ID NO: 7745198 - DNA, 22 bp, Homo sapiens
atcagcaagtcctgttaattct

SEQ ID NO: 7745199 - DNA, 21 bp, Homo sapiens
agtttttactcttaactgtgg

SEQ ID NO: 7745200 - DNA, 22 bp, Homo sapiens
actgttttctgtaaagggccag

SEQ ID NO: 7745201 - DNA, 21 bp, Homo sapiens
actttgggaggtgtgaggggc

SEQ ID NO: 7745202 - DNA, 20 bp, Homo sapiens
atagatatcatctttagaag

SEQ ID NO: 7745203 - DNA, 22 bp, Homo sapiens
actttgtgcccaacagaaagaa

SEQ ID NO: 7745204 - DNA, 22 bp, Homo sapiens
atacatcacctatatattcaca

SEQ ID NO: 7745205 - DNA, 22 bp, Homo sapiens
aggtgaagttgaggaggcagaa

SEQ ID NO: 7745206 - DNA, 22 bp, Homo sapiens
aggtatttcccaaagtggcatg

SEQ ID NO: 7745207 - DNA, 22 bp, Homo sapiens
aggtatttcaaagcccacttcc

SEQ ID NO: 7745208 - DNA, 22 bp, Homo sapiens
aggtgggcccagtgggctccag

SEQ ID NO: 7745209 - DNA, 22 bp, Homo sapiens
actccgggagccaggagaggct

SEQ ID NO: 7745210 - DNA, 22 bp, Homo sapiens
aggaggggcatagaaatgtaat

SEQ ID NO: 7745211 - DNA, 22 bp, Homo sapiens
aggaggcttttgcaggtgccac

SEQ ID NO: 7745212 - DNA, 22 bp, Homo sapiens
acataacaatcataggacatag

SEQ ID NO: 7745213 - DNA, 20 bp, Homo sapiens
aggacttgtttgggcagagt

SEQ ID NO: 7745214 - DNA, 22 bp, Homo sapiens
aggacttgtttaaagtttgtgc

SEQ ID NO: 7745215 - DNA, 22 bp, Homo sapiens
acagcctgacttttgttgtcac

SEQ ID NO: 7745216 - DNA, 22 bp, Homo sapiens
aggaagagcattcacatggtag

SEQ ID NO: 7745217 - DNA, 22 bp, Homo sapiens
aggaaaaacctgttaatggtag

SEQ ID NO: 7745218 - DNA, 22 bp, Homo sapiens
agctgggaggctcctctgtgac

SEQ ID NO: 7745219 - DNA, 22 bp, Homo sapiens
aggccacagagagtgcatgtgc

SEQ ID NO: 7745220 - DNA, 22 bp, Homo sapiens
aggcttccgagtagctgggact

SEQ ID NO: 7745221 - DNA, 23 bp, Homo sapiens
aggcttcctatcttagagctggg

SEQ ID NO: 7745222 - DNA, 18 bp, Homo sapiens
aggcttcccaggcaggcc

SEQ ID NO: 7745223 - DNA, 22 bp, Homo sapiens
accaaataggcttcctgggttg

SEQ ID NO: 7745224 - DNA, 22 bp, Homo sapiens
accaaatatatcttttgacctg

SEQ ID NO: 7745225 - DNA, 22 bp, Homo sapiens
accacagaggaatttgaagagg

SEQ ID NO: 7745226 - DNA, 22 bp, Homo sapiens
agggcctgagaccgtggcttga

SEQ ID NO: 7745227 - DNA, 22 bp, Homo sapiens
agggcctgagctctcctccagt

SEQ ID NO: 7745228 - DNA, 22 bp, Homo sapiens
acccagtctggagtgcagtgac

SEQ ID NO: 7745229 - DNA, 22 bp, Homo sapiens
attggtctctagagtctattgt

SEQ ID NO: 7745230 - DNA, 22 bp, Homo sapiens
attggtctctgctaaagggagg

SEQ ID NO: 7745231 - DNA, 22 bp, Homo sapiens
attggtctaggctttaaaaaga

SEQ ID NO: 7745232 - DNA, 22 bp, Homo sapiens
attggtctccacttgttttaga

SEQ ID NO: 7745233 - DNA, 22 bp, Homo sapiens
attggtctggggaaatgaagag

SEQ ID NO: 7745234 - DNA, 22 bp, Homo sapiens
attggtctaaagttaagaagat

SEQ ID NO: 7745235 - DNA, 22 bp, Homo sapiens
agatattttgtgtgatgtttca

SEQ ID NO: 7745236 - DNA, 22 bp, Homo sapiens
agatatttgtatcttgctattg

SEQ ID NO: 7745237 - DNA, 22 bp, Homo sapiens
agatattaatcgtacataaggt

SEQ ID NO: 7745238 - DNA, 22 bp, Homo sapiens
agatattctgcctaacaggttt

SEQ ID NO: 7745239 - DNA, 22 bp, Homo sapiens
agatattaggaggattcataat

SEQ ID NO: 7745240 - DNA, 22 bp, Homo sapiens
caaagatatgacatggaaaatg

SEQ ID NO: 7745241 - DNA, 22 bp, Homo sapiens
caaagataatcacagaataccc

SEQ ID NO: 7745242 - DNA, 22 bp, Homo sapiens
agcaagaaatcttcagtgttct

SEQ ID NO: 7745243 - DNA, 22 bp, Homo sapiens
agcaaatattttgttgaagtgc

SEQ ID NO: 7745244 - DNA, 22 bp, Homo sapiens
agaggggaggcgaaccagagtc

SEQ ID NO: 7745245 - DNA, 22 bp, Homo sapiens
agaggggacagccacctgcccg

SEQ ID NO: 7745246 - DNA, 23 bp, Homo sapiens
agaggggagcatctgctggctga

SEQ ID NO: 7745247 - DNA, 22 bp, Homo sapiens
agaggggagagctaagcaattc

SEQ ID NO: 7745248 - DNA, 18 bp, Homo sapiens
agaggggaggtaagtctg

SEQ ID NO: 7745249 - DNA, 22 bp, Homo sapiens
agaggggagtcctaatctgatt

SEQ ID NO: 7745250 - DNA, 22 bp, Homo sapiens
agaggggcagggtctccggatt

SEQ ID NO: 7745251 - DNA, 22 bp, Homo sapiens
agaggctgggaagggtccccgg

SEQ ID NO: 7745252 - DNA, 22 bp, Homo sapiens
agaggggaagtaatgaatgata

SEQ ID NO: 7745253 - DNA, 22 bp, Homo sapiens
agaggggaaggatgtgatgtga

SEQ ID NO: 7745254 - DNA, 22 bp, Homo sapiens
agagggcttccctaggagtgag

SEQ ID NO: 7745255 - DNA, 22 bp, Homo sapiens
agagtcatagtttaacttttgt

SEQ ID NO: 7745256 - DNA, 20 bp, Homo sapiens
agagctgggaagctccctat

SEQ ID NO: 7745257 - DNA, 22 bp, Homo sapiens
atgccaaagcccaagttcatca

SEQ ID NO: 7745258 - DNA, 19 bp, Homo sapiens
atgatacaggtgaaaattg

SEQ ID NO: 7745259 - DNA, 22 bp, Homo sapiens
agacttctcttggctatattat

SEQ ID NO: 7745260 - DNA, 22 bp, Homo sapiens
agagctggctggtagccctgat

SEQ ID NO: 7745261 - DNA, 22 bp, Homo sapiens
agagagtctttctcttcctgtt

SEQ ID NO: 7745262 - DNA, 22 bp, Homo sapiens
agcagccgtattatggtggttt

SEQ ID NO: 7745263 - DNA, 20 bp, Homo sapiens
cagatgggacgtggaggagt

SEQ ID NO: 7745264 - DNA, 22 bp, Homo sapiens
agcctgggcatgggacgggagg

SEQ ID NO: 7745265 - DNA, 17 bp, Homo sapiens
agcctgggaaggagtga

SEQ ID NO: 7745266 - DNA, 22 bp, Homo sapiens
cagcaagaaaattcacatgctc

SEQ ID NO: 7745267 - DNA, 22 bp, Homo sapiens
agctacagtggacaagtgaact

SEQ ID NO: 7745268 - DNA, 20 bp, Homo sapiens
agctacaatgcgaagctggc

SEQ ID NO: 7745269 - DNA, 21 bp, Homo sapiens
agcctgggtatcctttgagga

SEQ ID NO: 7745270 - DNA, 18 bp, Homo sapiens
agcctgggctctgcctgg

SEQ ID NO: 7745271 - DNA, 22 bp, Homo sapiens
agctctggtttagaaggggaaa

SEQ ID NO: 7745272 - DNA, 19 bp, Homo sapiens
agctcctgggctctgggcc

SEQ ID NO: 7745273 - DNA, 18 bp, Homo sapiens
agctcctggtctcaggga

SEQ ID NO: 7745274 - DNA, 17 bp, Homo sapiens
agctcctggggtcttta

SEQ ID NO: 7745275 - DNA, 22 bp, Homo sapiens
agctcctgtctcaagggagcct

SEQ ID NO: 7745276 - DNA, 23 bp, Homo sapiens
agctcctgtaaggtggtcgtcac

SEQ ID NO: 7745277 - DNA, 20 bp, Homo sapiens
agctcctggactagagagtg

SEQ ID NO: 7745278 - DNA, 19 bp, Homo sapiens
agctcctgattgtgcctcg

SEQ ID NO: 7745279 - DNA, 22 bp, Homo sapiens
cagagctcagagctgccaggca

SEQ ID NO: 7745280 - DNA, 22 bp, Homo sapiens
cagagcggccactagagggcgc

SEQ ID NO: 7745281 - DNA, 22 bp, Homo sapiens
agccagagagtgttggagatgt

SEQ ID NO: 7745282 - DNA, 22 bp, Homo sapiens
agccagagttgaatgtgagtct

SEQ ID NO: 7745283 - DNA, 20 bp, Homo sapiens
aactcctagcctcaagtgat

SEQ ID NO: 7745284 - DNA, 21 bp, Homo sapiens
aagtttgggattcagtttcca

SEQ ID NO: 7745285 - DNA, 22 bp, Homo sapiens
aagtttggccaaggagacatgg

SEQ ID NO: 7745286 - DNA, 22 bp, Homo sapiens
aagtttggaatgatagagacct

SEQ ID NO: 7745287 - DNA, 22 bp, Homo sapiens
aaggggctcttgtcaggcgcag

SEQ ID NO: 7745288 - DNA, 22 bp, Homo sapiens
aacaagatgttttgatatatgt

SEQ ID NO: 7745289 - DNA, 21 bp, Homo sapiens
aagcttttcctgagagttgtc

SEQ ID NO: 7745290 - DNA, 22 bp, Homo sapiens
aagctgtgaaatagattacaca

SEQ ID NO: 7745291 - DNA, 22 bp, Homo sapiens
aaggactgtctaaggcctccaa

SEQ ID NO: 7745292 - DNA, 22 bp, Homo sapiens
aatgttacgatcaacaacacat

SEQ ID NO: 7745293 - DNA, 22 bp, Homo sapiens
aattcaatctaagaaatgatca

SEQ ID NO: 7745294 - DNA, 22 bp, Homo sapiens
aagacacaatgtagcccagcac

SEQ ID NO: 7745295 - DNA, 22 bp, Homo sapiens
aagacacacacatatgctgagt

SEQ ID NO: 7745296 - DNA, 22 bp, Homo sapiens
acaagaaaggtaggattcaggt

SEQ ID NO: 7745297 - DNA, 22 bp, Homo sapiens
aagaggtcacactaggtcctag

SEQ ID NO: 7745298 - DNA, 22 bp, Homo sapiens
aagaggtgagaagctacactta

SEQ ID NO: 7745299 - DNA, 23 bp, Homo sapiens
acacctgtgctgtagtcactaca

SEQ ID NO: 7745300 - DNA, 22 bp, Homo sapiens
acactacttttcataaaagtaa

SEQ ID NO: 7745301 - DNA, 23 bp, Homo sapiens
acactaaatgtgaaggagcaaag

SEQ ID NO: 7745302 - DNA, 22 bp, Homo sapiens
aaacacacctttggaactgtga

SEQ ID NO: 7745303 - DNA, 22 bp, Homo sapiens
aaaaatgtcattatggaactga

SEQ ID NO: 7745304 - DNA, 22 bp, Homo sapiens
aaagatctatgggcatttagct

SEQ ID NO: 7745305 - DNA, 22 bp, Homo sapiens
aaagaagagcaaatttgttgta

SEQ ID NO: 7745306 - DNA, 22 bp, Homo sapiens
aaagaagagctggaaggagtct

SEQ ID NO: 7745307 - DNA, 22 bp, Homo sapiens
aaagaacttaagaaattaggct

SEQ ID NO: 7745308 - DNA, 22 bp, Homo sapiens
aaagaactcagagaggatttta

SEQ ID NO: 7745309 - DNA, 22 bp, Homo sapiens
aaacatctttctattgcaagtt

SEQ ID NO: 7745310 - DNA, 22 bp, Homo sapiens
aaacatttgcaactcggtttgg

SEQ ID NO: 7745311 - DNA, 23 bp, Homo sapiens
aaacatttctcttttcctgcctc

SEQ ID NO: 7745312 - DNA, 22 bp, Homo sapiens
aaacatttttctaggtcttggt

SEQ ID NO: 7745313 - DNA, 22 bp, Homo sapiens
aaacatttttcttcatcatcct

SEQ ID NO: 7745314 - DNA, 22 bp, Homo sapiens
aacaagaacacctacagttcta

SEQ ID NO: 7745315 - DNA, 22 bp, Homo sapiens
aacatttgtactaaagaagttc

SEQ ID NO: 7745316 - DNA, 22 bp, Homo sapiens
aacatttgcagaggaaagctat

SEQ ID NO: 7745317 - DNA, 22 bp, Homo sapiens
aagccacaatctgcatcagcat

SEQ ID NO: 7745318 - DNA, 18 bp, Homo sapiens
aagccagagaccactgcc

SEQ ID NO: 7745319 - DNA, 22 bp, Homo sapiens
aagattctccctgagatattta

SEQ ID NO: 7745320 - DNA, 22 bp, Homo sapiens
aaatatcattctggtgcacaga

SEQ ID NO: 7745321 - DNA, 22 bp, Homo sapiens
aagacactttctaaatagaagt

SEQ ID NO: 7745322 - DNA, 17 bp, Homo sapiens
aagacagaagccatgag

SEQ ID NO: 7745323 - DNA, 22 bp, Homo sapiens
acttatttattcattcagctca

SEQ ID NO: 7745324 - DNA, 22 bp, Homo sapiens
aatattatcaaaagctttttca

SEQ ID NO: 7745325 - DNA, 22 bp, Homo sapiens
aagtgaagaaatacatgagaat

SEQ ID NO: 7745326 - DNA, 22 bp, Homo sapiens
aagtttggggagaatttcattt

SEQ ID NO: 7745327 - DNA, 22 bp, Homo sapiens
aagtttgtggttatacttgatt

SEQ ID NO: 7745328 - DNA, 22 bp, Homo sapiens
aagtttgttgtacatgttagta

SEQ ID NO: 7745329 - DNA, 22 bp, Homo sapiens
acataataggtgcctgaatatt

SEQ ID NO: 7745330 - DNA, 22 bp, Homo sapiens
acataatgaaatgcagaaatca

SEQ ID NO: 7745331 - DNA, 22 bp, Homo sapiens
acataatgagctctttataaat

SEQ ID NO: 7745332 - DNA, 22 bp, Homo sapiens
acataacactcttctctagtga

SEQ ID NO: 7745333 - DNA, 22 bp, Homo sapiens
acataacatagttgacattttt

SEQ ID NO: 7745334 - DNA, 22 bp, Homo sapiens
acataataggtacctgaataat

SEQ ID NO: 7745335 - DNA, 22 bp, Homo sapiens
acattctgaaatccatgtgggt

SEQ ID NO: 7745336 - DNA, 22 bp, Homo sapiens
acattacataagattgtaacct

SEQ ID NO: 7745337 - DNA, 22 bp, Homo sapiens
acattctgttgaggctgggtca

SEQ ID NO: 7745338 - DNA, 22 bp, Homo sapiens
agaggttcagagaaggcgatct

SEQ ID NO: 7745339 - DNA, 20 bp, Homo sapiens
agagtaactggcacataggg

SEQ ID NO: 7745340 - DNA, 22 bp, Homo sapiens
agatataataatttacaagtgt

SEQ ID NO: 7745341 - DNA, 22 bp, Homo sapiens
agatatgtgccaattgttataa

SEQ ID NO: 7745342 - DNA, 22 bp, Homo sapiens
agatatgtccctgtctaatatt

SEQ ID NO: 7745343 - DNA, 22 bp, Homo sapiens
agatatctgtattgtttccaat

SEQ ID NO: 7745344 - DNA, 22 bp, Homo sapiens
agatatctggaaaaaatgtatg

SEQ ID NO: 7745345 - DNA, 22 bp, Homo sapiens
agatatcaccagttttacatac

SEQ ID NO: 7745346 - DNA, 22 bp, Homo sapiens
agatatatttaaggtaataagt

SEQ ID NO: 7745347 - DNA, 22 bp, Homo sapiens
agatatacacccatatcacata

SEQ ID NO: 7745348 - DNA, 22 bp, Homo sapiens
agattacagcatgggaatggga

SEQ ID NO: 7745349 - DNA, 17 bp, Homo sapiens
agagggctcaaggcatc

SEQ ID NO: 7745350 - DNA, 22 bp, Homo sapiens
agagggctaactgggaagcagg

SEQ ID NO: 7745351 - DNA, 22 bp, Homo sapiens
agagggctaaggtttgggagat

SEQ ID NO: 7745352 - DNA, 21 bp, Homo sapiens
agagggcgaaggcggggtccg

SEQ ID NO: 7745353 - DNA, 21 bp, Homo sapiens
agagggcgaaggcggggtccg

SEQ ID NO: 7745354 - DNA, 22 bp, Homo sapiens
aatgtacaccgtgggtttttta

SEQ ID NO: 7745355 - DNA, 22 bp, Homo sapiens
agaatttctggaagattgcaag

SEQ ID NO: 7745356 - DNA, 22 bp, Homo sapiens
aatgtacagctgctgctgaagg

SEQ ID NO: 7745357 - DNA, 22 bp, Homo sapiens
agaatcttcggtaactggaaga

SEQ ID NO: 7745358 - DNA, 22 bp, Homo sapiens
agaatcctcttcagtaaattct

SEQ ID NO: 7745359 - DNA, 18 bp, Homo sapiens
agagaaagaccaaagcat

SEQ ID NO: 7745360 - DNA, 22 bp, Homo sapiens
agactgaaacaatctgcaggca

SEQ ID NO: 7745361 - DNA, 20 bp, Homo sapiens
agactgaagccatgtgacta

SEQ ID NO: 7745362 - DNA, 22 bp, Homo sapiens
agactgaagctccttgaggaca

SEQ ID NO: 7745363 - DNA, 22 bp, Homo sapiens
agactgaataacaagcaaataa

SEQ ID NO: 7745364 - DNA, 22 bp, Homo sapiens
agacactggtgaagaaatcagg

SEQ ID NO: 7745365 - DNA, 22 bp, Homo sapiens
agagatataagtataaataggg

SEQ ID NO: 7745366 - DNA, 19 bp, Homo sapiens
agagatccagcttctagct

SEQ ID NO: 7745367 - DNA, 23 bp, Homo sapiens
agagaaagggataacacgttgaa

SEQ ID NO: 7745368 - DNA, 20 bp, Homo sapiens
agcatcttgcatcttcaagt

SEQ ID NO: 7745369 - DNA, 22 bp, Homo sapiens
acagacagtaaatagtgtggct

SEQ ID NO: 7745370 - DNA, 22 bp, Homo sapiens
acagacatcatcaacatcttcc

SEQ ID NO: 7745371 - DNA, 22 bp, Homo sapiens
agcctgtgagggatgctgcagt

SEQ ID NO: 7745372 - DNA, 22 bp, Homo sapiens
agatttggtgtctggttgatat

SEQ ID NO: 7745373 - DNA, 22 bp, Homo sapiens
agatttgggggctagggctggt

SEQ ID NO: 7745374 - DNA, 23 bp, Homo sapiens
agatttggaaagctgagtggcgt

SEQ ID NO: 7745375 - DNA, 22 bp, Homo sapiens
agatttcctgcactgcctttga

SEQ ID NO: 7745376 - DNA, 22 bp, Homo sapiens
agatttccgttctctcttcagt

SEQ ID NO: 7745377 - DNA, 22 bp, Homo sapiens
agatttccctcttgtatttgca

SEQ ID NO: 7745378 - DNA, 22 bp, Homo sapiens
agatttcctatggtaattatag

SEQ ID NO: 7745379 - DNA, 22 bp, Homo sapiens
agatttcctcttttgtaaagtg

SEQ ID NO: 7745380 - DNA, 22 bp, Homo sapiens
agatttcccaaatacttgttat

SEQ ID NO: 7745381 - DNA, 22 bp, Homo sapiens
agatttcccactccatgtattg

SEQ ID NO: 7745382 - DNA, 22 bp, Homo sapiens
tcaatacatacaatgtatagtg

SEQ ID NO: 7745383 - DNA, 22 bp, Homo sapiens
tcaaacataggcacacattcag

SEQ ID NO: 7745384 - DNA, 22 bp, Homo sapiens
tcaaacataaaactaaatcgag

SEQ ID NO: 7745385 - DNA, 22 bp, Homo sapiens
tcaaacatgttagcagtctgtg

SEQ ID NO: 7745386 - DNA, 21 bp, Homo sapiens
tcaaacatgatctgggtcatc

SEQ ID NO: 7745387 - DNA, 22 bp, Homo sapiens
tcaaacatgaaagcttgatttt

SEQ ID NO: 7745388 - DNA, 22 bp, Homo sapiens
tcaaacatctaaactacccact

SEQ ID NO: 7745389 - DNA, 22 bp, Homo sapiens
tcaaacatccccaccagggact

SEQ ID NO: 7745390 - DNA, 23 bp, Homo sapiens
tcaaacatattgtgagacacagg

SEQ ID NO: 7745391 - DNA, 22 bp, Homo sapiens
tcaaacatatctgattttccat

SEQ ID NO: 7745392 - DNA, 22 bp, Homo sapiens
tcaattaagaggctaagttact

SEQ ID NO: 7745393 - DNA, 22 bp, Homo sapiens
tcagctgttttgagtttaattg

SEQ ID NO: 7745394 - DNA, 23 bp, Homo sapiens
tcagctgttcttttccctgggac

SEQ ID NO: 7745395 - DNA, 22 bp, Homo sapiens
tcagctgttatcactgtctgtc

SEQ ID NO: 7745396 - DNA, 22 bp, Homo sapiens
tcagctgtgtatcccagggcct

SEQ ID NO: 7745397 - DNA, 22 bp, Homo sapiens
tcagctgtccgcagcccacttc

SEQ ID NO: 7745398 - DNA, 22 bp, Homo sapiens
tcagctgtgatccatctatcta

SEQ ID NO: 7745399 - DNA, 22 bp, Homo sapiens
tcagctgtatcagaaatacaat

SEQ ID NO: 7745400 - DNA, 22 bp, Homo sapiens
tcagctgtatcttgctgcactt

SEQ ID NO: 7745401 - DNA, 22 bp, Homo sapiens
tcagctgtaggtatggatgtcc

SEQ ID NO: 7745402 - DNA, 22 bp, Homo sapiens
tcaggaggtccgcccgggaggg

SEQ ID NO: 7745403 - DNA, 22 bp, Homo sapiens
tcagtttttgtttgccagatag

SEQ ID NO: 7745404 - DNA, 22 bp, Homo sapiens
tcagttttcaatttcatcagag

SEQ ID NO: 7745405 - DNA, 22 bp, Homo sapiens
tcagttttcatttcatgagcag

SEQ ID NO: 7745406 - DNA, 19 bp, Homo sapiens
tcagttttagtcatcagtt

SEQ ID NO: 7745407 - DNA, 22 bp, Homo sapiens
tcaggggcccttccctcagcag

SEQ ID NO: 7745408 - DNA, 21 bp, Homo sapiens
tccaccagctcttcctcttca

SEQ ID NO: 7745409 - DNA, 22 bp, Homo sapiens
tccacagataaaaacagaggtt

SEQ ID NO: 7745410 - DNA, 22 bp, Homo sapiens
tcccagagttcaatgggaaggt

SEQ ID NO: 7745411 - DNA, 21 bp, Homo sapiens
tcccagagtgcttgggactgc

SEQ ID NO: 7745412 - DNA, 22 bp, Homo sapiens
tcccagaatctttggaagagca

SEQ ID NO: 7745413 - DNA, 21 bp, Homo sapiens
tccagttgagactgaagatct

SEQ ID NO: 7745414 - DNA, 22 bp, Homo sapiens
tccctttgatcactaacagaac

SEQ ID NO: 7745415 - DNA, 22 bp, Homo sapiens
tccgaggccaaagctgtgaata

SEQ ID NO: 7745416 - DNA, 22 bp, Homo sapiens
tccgggagctgaacgtcttgcg

SEQ ID NO: 7745417 - DNA, 22 bp, Homo sapiens
taacttctctgctatcatagga

SEQ ID NO: 7745418 - DNA, 22 bp, Homo sapiens
taacttctgaatagcaatagta

SEQ ID NO: 7745419 - DNA, 22 bp, Homo sapiens
gttttacaaggttaatcagcag

SEQ ID NO: 7745420 - DNA, 23 bp, Homo sapiens
gttttacaggtgagaaaatggag

SEQ ID NO: 7745421 - DNA, 22 bp, Homo sapiens
gttttacacacctatgaaagac

SEQ ID NO: 7745422 - DNA, 22 bp, Homo sapiens
gttttacaaatgacggcattca

SEQ ID NO: 7745423 - DNA, 22 bp, Homo sapiens
gtttcccatatctagggagagg

SEQ ID NO: 7745424 - DNA, 18 bp, Homo sapiens
gttcccagatggtgctga

SEQ ID NO: 7745425 - DNA, 22 bp, Homo sapiens
gttccagacttgccagtggaag

SEQ ID NO: 7745426 - DNA, 22 bp, Homo sapiens
tacaagctcgggcagctcatta

SEQ ID NO: 7745427 - DNA, 19 bp, Homo sapiens
tacaagcttaaagtaatgt

SEQ ID NO: 7745428 - DNA, 22 bp, Homo sapiens
tacaatcaggataataatagtg

SEQ ID NO: 7745429 - DNA, 22 bp, Homo sapiens
taagtttaccactttcagaatt

SEQ ID NO: 7745430 - DNA, 22 bp, Homo sapiens
taagttcattagactacagata

SEQ ID NO: 7745431 - DNA, 22 bp, Homo sapiens
tactaagtagcagaactaagaa

SEQ ID NO: 7745432 - DNA, 22 bp, Homo sapiens
tacactattttactgatacaaa

SEQ ID NO: 7745433 - DNA, 22 bp, Homo sapiens
tacagttaccctggaaagaaat

SEQ ID NO: 7745434 - DNA, 22 bp, Homo sapiens
tacagttacgctgagaaacgaa

SEQ ID NO: 7745435 - DNA, 22 bp, Homo sapiens
tacatacacaaatatactgttt

SEQ ID NO: 7745436 - DNA, 22 bp, Homo sapiens
tacatacacaaatatactgttt

SEQ ID NO: 7745437 - DNA, 22 bp, Homo sapiens
tacatacatattcatacaggtg

SEQ ID NO: 7745438 - DNA, 22 bp, Homo sapiens
tatttcaggctatatttcttgt

SEQ ID NO: 7745439 - DNA, 22 bp, Homo sapiens
tatttcagagttgttttctgtc

SEQ ID NO: 7745440 - DNA, 22 bp, Homo sapiens
tatttccagcagtaagaagaca

SEQ ID NO: 7745441 - DNA, 22 bp, Homo sapiens
tatttgttgagttgttatgtct

SEQ ID NO: 7745442 - DNA, 18 bp, Homo sapiens
tatatttcacacatattc

SEQ ID NO: 7745443 - DNA, 22 bp, Homo sapiens
tagaagttgaactaaaaatatt

SEQ ID NO: 7745444 - DNA, 17 bp, Homo sapiens
tagaagttagaacactt

SEQ ID NO: 7745445 - DNA, 22 bp, Homo sapiens
tagaagtctctcaagaaacata

SEQ ID NO: 7745446 - DNA, 22 bp, Homo sapiens
tagcacaggtcttgttgccatt

SEQ ID NO: 7745447 - DNA, 22 bp, Homo sapiens
tagcacagtatttctcaactgg

SEQ ID NO: 7745448 - DNA, 22 bp, Homo sapiens
tagcacagcttcttgatgtcac

SEQ ID NO: 7745449 - DNA, 22 bp, Homo sapiens
tagccaaaaagtagcaattatt

SEQ ID NO: 7745450 - DNA, 22 bp, Homo sapiens
tagccaaagaaggtatatttgt

SEQ ID NO: 7745451 - DNA, 22 bp, Homo sapiens
tagccaaagtagctgttatagc

SEQ ID NO: 7745452 - DNA, 23 bp, Homo sapiens
taggaagacagcaaaagaatgga

SEQ ID NO: 7745453 - DNA, 22 bp, Homo sapiens
taggaagaagcagccttgctta

SEQ ID NO: 7745454 - DNA, 22 bp, Homo sapiens
taggaagaaactttccctgcag

SEQ ID NO: 7745455 - DNA, 22 bp, Homo sapiens
taggaagatgagtatcaacttg

SEQ ID NO: 7745456 - DNA, 22 bp, Homo sapiens
taggaagatcaagtttatctca

SEQ ID NO: 7745457 - DNA, 22 bp, Homo sapiens
taggaagataaacatttgtatg

SEQ ID NO: 7745458 - DNA, 22 bp, Homo sapiens
taggaagagctataggtcccca

SEQ ID NO: 7745459 - DNA, 22 bp, Homo sapiens
taggcctggatctctgggagca

SEQ ID NO: 7745460 - DNA, 22 bp, Homo sapiens
tagtatttcctgtaagctatag

SEQ ID NO: 7745461 - DNA, 22 bp, Homo sapiens
tagtcataattttgatgtttgt

SEQ ID NO: 7745462 - DNA, 22 bp, Homo sapiens
taggtttcagaggtgccgggaa

SEQ ID NO: 7745463 - DNA, 22 bp, Homo sapiens
taggctggaacttaggcagagg

SEQ ID NO: 7745464 - DNA, 22 bp, Homo sapiens
taggttccatgagggaggcaaa

SEQ ID NO: 7745465 - DNA, 22 bp, Homo sapiens
taggctgggagcctgaggctag

SEQ ID NO: 7745466 - DNA, 22 bp, Homo sapiens
gtaacacagaaatgaaattcca

SEQ ID NO: 7745467 - DNA, 22 bp, Homo sapiens
gtctggggtccttttggcttta

SEQ ID NO: 7745468 - DNA, 22 bp, Homo sapiens
gtcttatttaaagagatcatac

SEQ ID NO: 7745469 - DNA, 22 bp, Homo sapiens
gtcttattatgaggttagactt

SEQ ID NO: 7745470 - DNA, 22 bp, Homo sapiens
gtcttattaaaatgcagtttct

SEQ ID NO: 7745471 - DNA, 22 bp, Homo sapiens
gtgctgggtgctgcagacaggt

SEQ ID NO: 7745472 - DNA, 22 bp, Homo sapiens
gtgctgggccctgagaccaggg

SEQ ID NO: 7745473 - DNA, 22 bp, Homo sapiens
ggtgaaggtggaacgcagagca

SEQ ID NO: 7745474 - DNA, 22 bp, Homo sapiens
ggtgaaggtcagagcaggaaaa

SEQ ID NO: 7745475 - DNA, 22 bp, Homo sapiens
ggtgaagcgtatttgtggagct

SEQ ID NO: 7745476 - DNA, 22 bp, Homo sapiens
ggtgaagggccttaggagacag

SEQ ID NO: 7745477 - DNA, 22 bp, Homo sapiens
ggtgaaatgtagtcttgtgaga

SEQ ID NO: 7745478 - DNA, 22 bp, Homo sapiens
ggtgcggagactccatgaggcc

SEQ ID NO: 7745479 - DNA, 22 bp, Homo sapiens
gggtcagggctgcctgggctca

SEQ ID NO: 7745480 - DNA, 22 bp, Homo sapiens
gggtcaggcctcaaggtgggct

SEQ ID NO: 7745481 - DNA, 22 bp, Homo sapiens
gggtcaggaagaattctgccaa

SEQ ID NO: 7745482 - DNA, 20 bp, Homo sapiens
gggctggcgcatggggaaag

SEQ ID NO: 7745483 - DNA, 22 bp, Homo sapiens
gggctggctcccaggtgttgaa

SEQ ID NO: 7745484 - DNA, 22 bp, Homo sapiens
gggctccgcccttggctgagct

SEQ ID NO: 7745485 - DNA, 21 bp, Homo sapiens
gggcctggctgcgcaggacgg

SEQ ID NO: 7745486 - DNA, 22 bp, Homo sapiens
ggggcaggagcccttcttcagc

SEQ ID NO: 7745487 - DNA, 22 bp, Homo sapiens
gggggactaactggatcctgga

SEQ ID NO: 7745488 - DNA, 22 bp, Homo sapiens
gggggaagaggcatgaagtcct

SEQ ID NO: 7745489 - DNA, 22 bp, Homo sapiens
gggggactggaccgtcctgggt

SEQ ID NO: 7745490 - DNA, 22 bp, Homo sapiens
ggctcccacccatagggcgagt

SEQ ID NO: 7745491 - DNA, 22 bp, Homo sapiens
ggctcccaggagggcctggagg

SEQ ID NO: 7745492 - DNA, 22 bp, Homo sapiens
ggctaaggaacgcaggcttctc

SEQ ID NO: 7745493 - DNA, 22 bp, Homo sapiens
ggctagagtggaactggagcgg

SEQ ID NO: 7745494 - DNA, 23 bp, Homo sapiens
ggctagagtggaggggaactgca

SEQ ID NO: 7745495 - DNA, 18 bp, Homo sapiens
ggctccgacgggccgtgc

SEQ ID NO: 7745496 - DNA, 22 bp, Homo sapiens
ggctctggggggaagtctgttg

SEQ ID NO: 7745497 - DNA, 22 bp, Homo sapiens
ggctctggggttggcccatctc

SEQ ID NO: 7745498 - DNA, 22 bp, Homo sapiens
ggctctgggcctccaaggtctg

SEQ ID NO: 7745499 - DNA, 22 bp, Homo sapiens
ggctggaaactcaggtagggtt

SEQ ID NO: 7745500 - DNA, 22 bp, Homo sapiens
ggctggaaccagagtgaggcag

SEQ ID NO: 7745501 - DNA, 22 bp, Homo sapiens
ggctggaagagactgaggacac

SEQ ID NO: 7745502 - DNA, 22 bp, Homo sapiens
ggctggaatgtgtggatgtgat

SEQ ID NO: 7745503 - DNA, 22 bp, Homo sapiens
ggctgagggttaagatcagaca

SEQ ID NO: 7745504 - DNA, 22 bp, Homo sapiens
ggctgaggtgtggggaactata

SEQ ID NO: 7745505 - DNA, 18 bp, Homo sapiens
ggctgaggttgactagaa

SEQ ID NO: 7745506 - DNA, 22 bp, Homo sapiens
ggctgagtgctgctgttcacga

SEQ ID NO: 7745507 - DNA, 22 bp, Homo sapiens
ggctgagggtcccagaccctaa

SEQ ID NO: 7745508 - DNA, 22 bp, Homo sapiens
ggctgtgacaaggctgcgggaa

SEQ ID NO: 7745509 - DNA, 22 bp, Homo sapiens
ggctggagaagggtggttgaca

SEQ ID NO: 7745510 - DNA, 19 bp, Homo sapiens
ggctggagaaaggaatcag

SEQ ID NO: 7745511 - DNA, 22 bp, Homo sapiens
ggctggacttggtcctgttttg

SEQ ID NO: 7745512 - DNA, 22 bp, Homo sapiens
ggctggagacaacgtcctgccc

SEQ ID NO: 7745513 - DNA, 22 bp, Homo sapiens
gggaggttgaggctgcagtgag

SEQ ID NO: 7745514 - DNA, 22 bp, Homo sapiens
gggaggttctgttcgcacttga

SEQ ID NO: 7745515 - DNA, 22 bp, Homo sapiens
gggaagggagctgggtatttag

SEQ ID NO: 7745516 - DNA, 22 bp, Homo sapiens
gggagctggagctggaagactc

SEQ ID NO: 7745517 - DNA, 19 bp, Homo sapiens
ggcagaaggtgtaggggga

SEQ ID NO: 7745518 - DNA, 22 bp, Homo sapiens
ggatttccagcttcattgtcta

SEQ ID NO: 7745519 - DNA, 22 bp, Homo sapiens
ggatttcctcttgactctaaag

SEQ ID NO: 7745520 - DNA, 22 bp, Homo sapiens
ggatctggttacgtaagagtct

SEQ ID NO: 7745521 - DNA, 22 bp, Homo sapiens
ggatctggggtagagcagtggg

SEQ ID NO: 7745522 - DNA, 22 bp, Homo sapiens
ggagttggtgagcaccaggctt

SEQ ID NO: 7745523 - DNA, 19 bp, Homo sapiens
ggatgagggtcaggcatag

SEQ ID NO: 7745524 - DNA, 19 bp, Homo sapiens
ggatgagggtcaggcatag

SEQ ID NO: 7745525 - DNA, 22 bp, Homo sapiens
ggagttggaggctccagggaac

SEQ ID NO: 7745526 - DNA, 22 bp, Homo sapiens
ggagatgggggattttacagcg

SEQ ID NO: 7745527 - DNA, 22 bp, Homo sapiens
ggcaggggtggccttcctttgg

SEQ ID NO: 7745528 - DNA, 22 bp, Homo sapiens
ggccagctttgagctgcaggaa

SEQ ID NO: 7745529 - DNA, 22 bp, Homo sapiens
ggcctgctccgggggctgagct

SEQ ID NO: 7745530 - DNA, 22 bp, Homo sapiens
ggcctgctattggtgggcagac

SEQ ID NO: 7745531 - DNA, 22 bp, Homo sapiens
ggcctgctgctatgacttcctg

SEQ ID NO: 7745532 - DNA, 22 bp, Homo sapiens
ggaagcaggaggctggggtaaa

SEQ ID NO: 7745533 - DNA, 22 bp, Homo sapiens
ggacctgatgtttagtcttgtt

SEQ ID NO: 7745534 - DNA, 22 bp, Homo sapiens
ggaccggtggcttcctcgggtc

SEQ ID NO: 7745535 - DNA, 22 bp, Homo sapiens
ggagagcttggagtgcgatttt

SEQ ID NO: 7745536 - DNA, 22 bp, Homo sapiens
ggacctgtgtctacagcatgtg

SEQ ID NO: 7745537 - DNA, 22 bp, Homo sapiens
ggacctgccctggctcagatgc

SEQ ID NO: 7745538 - DNA, 22 bp, Homo sapiens
ggactgaagtgctgtctagtgt

SEQ ID NO: 7745539 - DNA, 22 bp, Homo sapiens
ggactgaaggacaatctggttc

SEQ ID NO: 7745540 - DNA, 22 bp, Homo sapiens
ggactgaacacttaaatgtcca

SEQ ID NO: 7745541 - DNA, 22 bp, Homo sapiens
ggactgaaatctttccatgtca

SEQ ID NO: 7745542 - DNA, 22 bp, Homo sapiens
ggactgaaagcgaagaatttgt

SEQ ID NO: 7745543 - DNA, 20 bp, Homo sapiens
ggactgaaaacacaaacctg

SEQ ID NO: 7745544 - DNA, 22 bp, Homo sapiens
ggactgaggcccacttgaggga

SEQ ID NO: 7745545 - DNA, 22 bp, Homo sapiens
ggactgaggacatgtgaggcat

SEQ ID NO: 7745546 - DNA, 22 bp, Homo sapiens
ggactgaatggaagatatatgg

SEQ ID NO: 7745547 - DNA, 22 bp, Homo sapiens
ggactgaatgccagtctatgga

SEQ ID NO: 7745548 - DNA, 22 bp, Homo sapiens
gctgggagacagacttggaacc

SEQ ID NO: 7745549 - DNA, 22 bp, Homo sapiens
gctgggagaggcagctttcgga

SEQ ID NO: 7745550 - DNA, 22 bp, Homo sapiens
gctgggaggatctctccctgtc

SEQ ID NO: 7745551 - DNA, 22 bp, Homo sapiens
gctgggagcaaagccatgcata

SEQ ID NO: 7745552 - DNA, 22 bp, Homo sapiens
gctgggacaggcttggccctgt

SEQ ID NO: 7745553 - DNA, 22 bp, Homo sapiens
gctgggacaacaggtgagcacc

SEQ ID NO: 7745554 - DNA, 22 bp, Homo sapiens
gctgggactgagacagtgacct

SEQ ID NO: 7745555 - DNA, 22 bp, Homo sapiens
gctgggtgtcacggggctcgtg

SEQ ID NO: 7745556 - DNA, 22 bp, Homo sapiens
gctgggttttcttccgggccta

SEQ ID NO: 7745557 - DNA, 22 bp, Homo sapiens
gctggtaggaagtgctcctgcc

SEQ ID NO: 7745558 - DNA, 22 bp, Homo sapiens
gctgggagtcgcgtctgtggcc

SEQ ID NO: 7745559 - DNA, 16 bp, Homo sapiens
gctgggagggagaggt

SEQ ID NO: 7745560 - DNA, 22 bp, Homo sapiens
gctgggaggcagcacctttagc

SEQ ID NO: 7745561 - DNA, 18 bp, Homo sapiens
gctcctggttggaaagaa

SEQ ID NO: 7745562 - DNA, 22 bp, Homo sapiens
gctcctggtgctgtagagattt

SEQ ID NO: 7745563 - DNA, 21 bp, Homo sapiens
gctcctggtgctgcgtggcgc

SEQ ID NO: 7745564 - DNA, 22 bp, Homo sapiens
gctgaagctgcagcaggaggaa

SEQ ID NO: 7745565 - DNA, 22 bp, Homo sapiens
gctgaagctgacacatagtgct

SEQ ID NO: 7745566 - DNA, 22 bp, Homo sapiens
gctcactaaataacaggaagaa

SEQ ID NO: 7745567 - DNA, 22 bp, Homo sapiens
gcgcctggcacacagcaagggc

SEQ ID NO: 7745568 - DNA, 22 bp, Homo sapiens
gcgggccaccttggagagcgct

SEQ ID NO: 7745569 - DNA, 22 bp, Homo sapiens
gcgcggggtacacgcggtggcc

SEQ ID NO: 7745570 - DNA, 22 bp, Homo sapiens
gcggaaatgcagggctagggtg

SEQ ID NO: 7745571 - DNA, 22 bp, Homo sapiens
gcctggcttcccttggagcatt

SEQ ID NO: 7745572 - DNA, 22 bp, Homo sapiens
gcctggggccagcttgggctga

SEQ ID NO: 7745573 - DNA, 22 bp, Homo sapiens
gcctgggtgtcgatcactagtg

SEQ ID NO: 7745574 - DNA, 22 bp, Homo sapiens
gcatttgagcacattttaaaga

SEQ ID NO: 7745575 - DNA, 23 bp, Homo sapiens
gcatcttaaaacctacatatgtg

SEQ ID NO: 7745576 - DNA, 22 bp, Homo sapiens
gcataacaacagactctgtgtt

SEQ ID NO: 7745577 - DNA, 22 bp, Homo sapiens
gcagtcatatcattccaacagg

SEQ ID NO: 7745578 - DNA, 22 bp, Homo sapiens
gcagtcatcacggcttttaggc

SEQ ID NO: 7745579 - DNA, 22 bp, Homo sapiens
gccagcagtatgtcctggcagt

SEQ ID NO: 7745580 - DNA, 22 bp, Homo sapiens
gccagcaggttgtcaaggagct

SEQ ID NO: 7745581 - DNA, 22 bp, Homo sapiens
gcactgggctccaggaaggagg

SEQ ID NO: 7745582 - DNA, 22 bp, Homo sapiens
gcactgggagtctgtgggggtt

SEQ ID NO: 7745583 - DNA, 22 bp, Homo sapiens
gcactgggaatgctgatgggct

SEQ ID NO: 7745584 - DNA, 22 bp, Homo sapiens
gcactgaatgcttttactgtaa

SEQ ID NO: 7745585 - DNA, 22 bp, Homo sapiens
gcactgaactttaatcatttct

SEQ ID NO: 7745586 - DNA, 22 bp, Homo sapiens
gagggtccccatgcagagctca

SEQ ID NO: 7745587 - DNA, 22 bp, Homo sapiens
gaggggcttgaggccctgatgg

SEQ ID NO: 7745588 - DNA, 22 bp, Homo sapiens
gaggggctgggtagggcaaccc

SEQ ID NO: 7745589 - DNA, 22 bp, Homo sapiens
gaggggctggggttgactccaa

SEQ ID NO: 7745590 - DNA, 22 bp, Homo sapiens
gaggggctgtggagctctctgg

SEQ ID NO: 7745591 - DNA, 22 bp, Homo sapiens
ttacaagttcagattttctcat

SEQ ID NO: 7745592 - DNA, 23 bp, Homo sapiens
ttacaagttctgaaatttccttc

SEQ ID NO: 7745593 - DNA, 22 bp, Homo sapiens
ttacaagtttctggcttcatcc

SEQ ID NO: 7745594 - DNA, 22 bp, Homo sapiens
ttacaagtatttaagatgctgt

SEQ ID NO: 7745595 - DNA, 22 bp, Homo sapiens
tgttttcatttgatgtaacaaa

SEQ ID NO: 7745596 - DNA, 22 bp, Homo sapiens
tgtttcttacgtttttagaggc

SEQ ID NO: 7745597 - DNA, 22 bp, Homo sapiens
cctggggccccgagccagaagc

SEQ ID NO: 7745598 - DNA, 23 bp, Homo sapiens
cctggggcacttgagtcctcatc

SEQ ID NO: 7745599 - DNA, 22 bp, Homo sapiens
tggttcccttaacagctgtata

SEQ ID NO: 7745600 - DNA, 20 bp, Homo sapiens
tgttgattggtgtcatctca

SEQ ID NO: 7745601 - DNA, 22 bp, Homo sapiens
cgatttccgcttgatctgatct

SEQ ID NO: 7745602 - DNA, 21 bp, Homo sapiens
cgcagagcgaacttgcggcgc

SEQ ID NO: 7745603 - DNA, 22 bp, Homo sapiens
ttaccaaatgaaatagagattt

SEQ ID NO: 7745604 - DNA, 22 bp, Homo sapiens
ccttctggaagctctaagggag

SEQ ID NO: 7745605 - DNA, 22 bp, Homo sapiens
ttctcttttgtgatgtgagatg

SEQ ID NO: 7745606 - DNA, 19 bp, Homo sapiens
ctagggcttggcagcaggc

SEQ ID NO: 7745607 - DNA, 22 bp, Homo sapiens
ctagtgctctaggggctgaagg

SEQ ID NO: 7745608 - DNA, 22 bp, Homo sapiens
ctagggcttccaagatgccttc

SEQ ID NO: 7745609 - DNA, 18 bp, Homo sapiens
ctagggctgtggctctca

SEQ ID NO: 7745610 - DNA, 22 bp, Homo sapiens
ctagggctcgcaagggctggag

SEQ ID NO: 7745611 - DNA, 22 bp, Homo sapiens
ttctcaggtgaggctgaggctg

SEQ ID NO: 7745612 - DNA, 22 bp, Homo sapiens
ttcctttttacataatcacatt

SEQ ID NO: 7745613 - DNA, 22 bp, Homo sapiens
ctaactttatttgctaagtaga

SEQ ID NO: 7745614 - DNA, 22 bp, Homo sapiens
ttccacttttctctctcatgcc

SEQ ID NO: 7745615 - DNA, 21 bp, Homo sapiens
ttcagtttcttcctcatctat

SEQ ID NO: 7745616 - DNA, 18 bp, Homo sapiens
tttttctgataaaacaag

SEQ ID NO: 7745617 - DNA, 22 bp, Homo sapiens
ctctggagtgcagcctggtggc

SEQ ID NO: 7745618 - DNA, 22 bp, Homo sapiens
ctgagggccctgaagcttggca

SEQ ID NO: 7745619 - DNA, 21 bp, Homo sapiens
ctgagggccgcagctgggctc

SEQ ID NO: 7745620 - DNA, 22 bp, Homo sapiens
ctgagggcagtgatgaaggtga

SEQ ID NO: 7745621 - DNA, 18 bp, Homo sapiens
ctgagggcagcccctggg

SEQ ID NO: 7745622 - DNA, 22 bp, Homo sapiens
ctgagatactgtggcgaatgca

SEQ ID NO: 7745623 - DNA, 22 bp, Homo sapiens
ctgagggctggagctgaggcct

SEQ ID NO: 7745624 - DNA, 22 bp, Homo sapiens
ctgagggcttccttgtcccggg

SEQ ID NO: 7745625 - DNA, 23 bp, Homo sapiens
ctgagggctggtctgaagtctgc

SEQ ID NO: 7745626 - DNA, 22 bp, Homo sapiens
ctgagggcctgaggacctagat

SEQ ID NO: 7745627 - DNA, 22 bp, Homo sapiens
ctgcgggctgtcaggcgtgcca

SEQ ID NO: 7745628 - DNA, 21 bp, Homo sapiens
ctgctgctggggtctgggcag

SEQ ID NO: 7745629 - DNA, 22 bp, Homo sapiens
tttacaagtttacagaatgatg

SEQ ID NO: 7745630 - DNA, 22 bp, Homo sapiens
ctcctgggcttcgaaggctccc

SEQ ID NO: 7745631 - DNA, 21 bp, Homo sapiens
ctcaggctggcagcaggctag

SEQ ID NO: 7745632 - DNA, 22 bp, Homo sapiens
ctcaggcttgggaggaggccca

SEQ ID NO: 7745633 - DNA, 22 bp, Homo sapiens
ctctaggctgcccaggagctga

SEQ ID NO: 7745634 - DNA, 22 bp, Homo sapiens
ctctagggaagaatgagagccc

SEQ ID NO: 7745635 - DNA, 22 bp, Homo sapiens
ctctagggctctgtgaggttgg

SEQ ID NO: 7745636 - DNA, 22 bp, Homo sapiens
ctctagggtgcaggccccagga

SEQ ID NO: 7745637 - DNA, 22 bp, Homo sapiens
tttctgtttagcataaagtggc

SEQ ID NO: 7745638 - DNA, 22 bp, Homo sapiens
tttctgttgtacttaaactagg

SEQ ID NO: 7745639 - DNA, 22 bp, Homo sapiens
tttctgcaggtattgcataagt

SEQ ID NO: 7745640 - DNA, 22 bp, Homo sapiens
tttctgattctcactttggcat

SEQ ID NO: 7745641 - DNA, 22 bp, Homo sapiens
tttctgatttgacttgaagtat

SEQ ID NO: 7745642 - DNA, 22 bp, Homo sapiens
tttgaagggcacgacaatagtt

SEQ ID NO: 7745643 - DNA, 23 bp, Homo sapiens
tttgaagcattttgtatcttagt

SEQ ID NO: 7745644 - DNA, 22 bp, Homo sapiens
cttttgatggagttcaagaagc

SEQ ID NO: 7745645 - DNA, 22 bp, Homo sapiens
cttttgatagttgctgagcagg

SEQ ID NO: 7745646 - DNA, 22 bp, Homo sapiens
cttttacagtggacctgccatt

SEQ ID NO: 7745647 - DNA, 22 bp, Homo sapiens
cttttacactcatctgggaggg

SEQ ID NO: 7745648 - DNA, 19 bp, Homo sapiens
ctttgcaggggatgggtga

SEQ ID NO: 7745649 - DNA, 21 bp, Homo sapiens
cttttacattcagtcatgatg

SEQ ID NO: 7745650 - DNA, 22 bp, Homo sapiens
ctttctttgcagtgagccagag

SEQ ID NO: 7745651 - DNA, 22 bp, Homo sapiens
ctttacaaatagggagggagtg

SEQ ID NO: 7745652 - DNA, 22 bp, Homo sapiens
ctttacaaagcaattttgtctc

SEQ ID NO: 7745653 - DNA, 22 bp, Homo sapiens
ctttacaaactataaagtgcgg

SEQ ID NO: 7745654 - DNA, 22 bp, Homo sapiens
cttctgggtattccagatacct

SEQ ID NO: 7745655 - DNA, 22 bp, Homo sapiens
cttctgggtgtggagtgaggac

SEQ ID NO: 7745656 - DNA, 22 bp, Homo sapiens
cttctggggatggagcccagaa

SEQ ID NO: 7745657 - DNA, 22 bp, Homo sapiens
cttacaacttgtatgtgattgt

SEQ ID NO: 7745658 - DNA, 22 bp, Homo sapiens
ctgttttataaagtccaaaagt

SEQ ID NO: 7745659 - DNA, 21 bp, Homo sapiens
ctgtgctttttaagtgtgatg

SEQ ID NO: 7745660 - DNA, 21 bp, Homo sapiens
ctgtgcttcttcctaagccag

SEQ ID NO: 7745661 - DNA, 22 bp, Homo sapiens
ctgtgcttcgcaactccaaggt

SEQ ID NO: 7745662 - DNA, 19 bp, Homo sapiens
ctgtgctttaaactcctat

SEQ ID NO: 7745663 - DNA, 22 bp, Homo sapiens
cttaggcaagcagagcccatcc

SEQ ID NO: 7745664 - DNA, 22 bp, Homo sapiens
cttctcagaggccagaagctat

SEQ ID NO: 7745665 - DNA, 22 bp, Homo sapiens
ctgggaagaatccaagggccct

SEQ ID NO: 7745666 - DNA, 22 bp, Homo sapiens
ctgggagatctcctgagggcag

SEQ ID NO: 7745667 - DNA, 22 bp, Homo sapiens
ctgggagatatgaggatctgga

SEQ ID NO: 7745668 - DNA, 22 bp, Homo sapiens
ctgggagatgactcagagcagg

SEQ ID NO: 7745669 - DNA, 22 bp, Homo sapiens
ctgggagattcaggtgaagttt

SEQ ID NO: 7745670 - DNA, 22 bp, Homo sapiens
ctgggagattgctagagatgca

SEQ ID NO: 7745671 - DNA, 22 bp, Homo sapiens
ctgggaccagtgaagcaactca

SEQ ID NO: 7745672 - DNA, 22 bp, Homo sapiens
ctgggacccacacctggaatct

SEQ ID NO: 7745673 - DNA, 22 bp, Homo sapiens
ctgggacccccactgcgtagct

SEQ ID NO: 7745674 - DNA, 22 bp, Homo sapiens
ctgggaccctgccctgtggcct

SEQ ID NO: 7745675 - DNA, 22 bp, Homo sapiens
ctgggacctcctcactgttcta

SEQ ID NO: 7745676 - DNA, 22 bp, Homo sapiens
ctgggacctgtgtgcctgggcc

SEQ ID NO: 7745677 - DNA, 22 bp, Homo sapiens
ctgggcgcgtcccctgaggcgg

SEQ ID NO: 7745678 - DNA, 22 bp, Homo sapiens
ctgggcctttacctacggagtt

SEQ ID NO: 7745679 - DNA, 22 bp, Homo sapiens
ctgggcctcctctgcccaagct

SEQ ID NO: 7745680 - DNA, 22 bp, Homo sapiens
ctgggcctgtgactcccatcct

SEQ ID NO: 7745681 - DNA, 22 bp, Homo sapiens
ctgggccttgccttgcccacag

SEQ ID NO: 7745682 - DNA, 22 bp, Homo sapiens
ctgggccttgccaggggtgtct

SEQ ID NO: 7745683 - DNA, 22 bp, Homo sapiens
ctgggccttgcatcccagagcc

SEQ ID NO: 7745684 - DNA, 22 bp, Homo sapiens
ctgggcagagctaacacctgag

SEQ ID NO: 7745685 - DNA, 22 bp, Homo sapiens
ctgggcagctaccaccactgct

SEQ ID NO: 7745686 - DNA, 22 bp, Homo sapiens
ctgggagcaagaggctgcaaat

SEQ ID NO: 7745687 - DNA, 22 bp, Homo sapiens
ctgggagcaagtcaggaaaggt

SEQ ID NO: 7745688 - DNA, 22 bp, Homo sapiens
ctgggagcgcagcaggcacaac

SEQ ID NO: 7745689 - DNA, 22 bp, Homo sapiens
ctgggagcggctgtcactggtt

SEQ ID NO: 7745690 - DNA, 22 bp, Homo sapiens
ctgtgctctgagcgtggggttg

SEQ ID NO: 7745691 - DNA, 23 bp, Homo sapiens
ctgtatttgacttgagcggaaat

SEQ ID NO: 7745692 - DNA, 22 bp, Homo sapiens
ctgggcttgtgttagctgacaa

SEQ ID NO: 7745693 - DNA, 22 bp, Homo sapiens
ctgggcttgcactgcagcgaga

SEQ ID NO: 7745694 - DNA, 22 bp, Homo sapiens
ctggggactcattcagagcata

SEQ ID NO: 7745695 - DNA, 22 bp, Homo sapiens
ctggtccttgctacccagcaag

SEQ ID NO: 7745696 - DNA, 22 bp, Homo sapiens
gagaaagatggaatcttacagg

SEQ ID NO: 7745697 - DNA, 22 bp, Homo sapiens
gagaaagaaagggaagtttgtt

SEQ ID NO: 7745698 - DNA, 21 bp, Homo sapiens
gagagggcattataggaagtg

SEQ ID NO: 7745699 - DNA, 22 bp, Homo sapiens
gagagggcaaacttgtagctaa

SEQ ID NO: 7745700 - DNA, 22 bp, Homo sapiens
gagacctcttggtatcgctagg

SEQ ID NO: 7745701 - DNA, 22 bp, Homo sapiens
gactgaggctcccctaggctca

SEQ ID NO: 7745702 - DNA, 22 bp, Homo sapiens
gactgaaggtctcagcatgtga

SEQ ID NO: 7745703 - DNA, 22 bp, Homo sapiens
gaagccactatagatattctaa

SEQ ID NO: 7745704 - DNA, 22 bp, Homo sapiens
gaagccaccctccttccagccc

SEQ ID NO: 7745705 - DNA, 22 bp, Homo sapiens
gaaagctgtgaaatagtgctct

SEQ ID NO: 7745706 - DNA, 22 bp, Homo sapiens
gaagggtgtgtgtgagggacac

SEQ ID NO: 7745707 - DNA, 22 bp, Homo sapiens
gaagggtgcatggagggaagtc

SEQ ID NO: 7745708 - DNA, 22 bp, Homo sapiens
gacagacaaatgtttttaactt

SEQ ID NO: 7745709 - DNA, 22 bp, Homo sapiens
gacagacacctggggggttgct

SEQ ID NO: 7745710 - DNA, 22 bp, Homo sapiens
gacagacactattggtatgcct

SEQ ID NO: 7745711 - DNA, 22 bp, Homo sapiens
gacagacagagaatgggcttga

SEQ ID NO: 7745712 - DNA, 22 bp, Homo sapiens
gagctgaggctcaggctggcgt

SEQ ID NO: 7745713 - DNA, 22 bp, Homo sapiens
gaggaagaagggattagaactc

SEQ ID NO: 7745714 - DNA, 22 bp, Homo sapiens
gaggaagaagcaaaccagctaa

SEQ ID NO: 7745715 - DNA, 22 bp, Homo sapiens
gaggaagaatcagggtggtgag

SEQ ID NO: 7745716 - DNA, 22 bp, Homo sapiens
gaggaagaattggttattggag

SEQ ID NO: 7745717 - DNA, 22 bp, Homo sapiens
gaggaacttatgatattctact

SEQ ID NO: 7745718 - DNA, 22 bp, Homo sapiens
gaggaagaaagcataggtgggg

SEQ ID NO: 7745719 - DNA, 22 bp, Homo sapiens
gagagggctggaaacttcctgg

SEQ ID NO: 7745720 - DNA, 22 bp, Homo sapiens
gagggaggcatcatgaatccag

SEQ ID NO: 7745721 - DNA, 22 bp, Homo sapiens
gagggagggccaggtcccaacc

SEQ ID NO: 7745722 - DNA, 22 bp, Homo sapiens
gagggctgatgttgccacctca

SEQ ID NO: 7745723 - DNA, 22 bp, Homo sapiens
gagggctgccacgttgggcgag

SEQ ID NO: 7745724 - DNA, 22 bp, Homo sapiens
gagggctggggcttaggcttag

SEQ ID NO: 7745725 - DNA, 22 bp, Homo sapiens
gaggggctggctgtggtcccat

SEQ ID NO: 7745726 - DNA, 22 bp, Homo sapiens
gaggggctgggcagtccctgga

SEQ ID NO: 7745727 - DNA, 22 bp, Homo sapiens
gaggggctggcacgatggctgc

SEQ ID NO: 7745728 - DNA, 22 bp, Homo sapiens
gaggggctgccctggtgtcagg

SEQ ID NO: 7745729 - DNA, 21 bp, Homo sapiens
tgcttgggggcttcaggagct

SEQ ID NO: 7745730 - DNA, 22 bp, Homo sapiens
tgcttgggaatgtggagtcaga

SEQ ID NO: 7745731 - DNA, 22 bp, Homo sapiens
tgctgggggttcagatgagtaa

SEQ ID NO: 7745732 - DNA, 23 bp, Homo sapiens
tgctggggtagtttgtggcacag

SEQ ID NO: 7745733 - DNA, 19 bp, Homo sapiens
tgctctctggtgcttcatg

SEQ ID NO: 7745734 - DNA, 22 bp, Homo sapiens
tgctctggaatagtcctaggca

SEQ ID NO: 7745735 - DNA, 22 bp, Homo sapiens
tggaaactgggagttaaatgta

SEQ ID NO: 7745736 - DNA, 22 bp, Homo sapiens
tggcagagaacacacatgattc

SEQ ID NO: 7745737 - DNA, 22 bp, Homo sapiens
ccctgggagaagttgagggctg

SEQ ID NO: 7745738 - DNA, 22 bp, Homo sapiens
ccctgggacccgctgcagaggc

SEQ ID NO: 7745739 - DNA, 22 bp, Homo sapiens
tgggcagacgggagcttgcctt

SEQ ID NO: 7745740 - DNA, 22 bp, Homo sapiens
cctcctgggagagcacggaggg

SEQ ID NO: 7745741 - DNA, 22 bp, Homo sapiens
cctcctggggtgaaggatggga

SEQ ID NO: 7745742 - DNA, 22 bp, Homo sapiens
tggcatttctgttagactctca

SEQ ID NO: 7745743 - DNA, 23 bp, Homo sapiens
tggggagagttaccctggaagcg

SEQ ID NO: 7745744 - DNA, 22 bp, Homo sapiens
tgggctccgttgcctggggcag

SEQ ID NO: 7745745 - DNA, 22 bp, Homo sapiens
tgggcaggatgcgttgattctt

SEQ ID NO: 7745746 - DNA, 22 bp, Homo sapiens
tgggcaggcaagtgaatacctt

SEQ ID NO: 7745747 - DNA, 20 bp, Homo sapiens
tctgggagggacaagtctcc

SEQ ID NO: 7745748 - DNA, 22 bp, Homo sapiens
tctggggatgaggacctagatg

SEQ ID NO: 7745749 - DNA, 22 bp, Homo sapiens
tcttttcttcttaatggttaat

SEQ ID NO: 7745750 - DNA, 22 bp, Homo sapiens
tcttttgtagctaacacattca

SEQ ID NO: 7745751 - DNA, 22 bp, Homo sapiens
tcttttgtcatcccttgtacat

SEQ ID NO: 7745752 - DNA, 22 bp, Homo sapiens
tcttttgtgaggacaaggtacg

SEQ ID NO: 7745753 - DNA, 22 bp, Homo sapiens
tgcaggaatgaggttctcagtt

SEQ ID NO: 7745754 - DNA, 18 bp, Homo sapiens
tgaggctgagggtagagg

SEQ ID NO: 7745755 - DNA, 22 bp, Homo sapiens
tgaggtcctgcatgttgaggtc

SEQ ID NO: 7745756 - DNA, 22 bp, Homo sapiens
tgagtcatgtaataatgctgct

SEQ ID NO: 7745757 - DNA, 22 bp, Homo sapiens
tgagccatgggactccaaggga

SEQ ID NO: 7745758 - DNA, 22 bp, Homo sapiens
tattccagttcaccttttcatc

SEQ ID NO: 7745759 - DNA, 22 bp, Homo sapiens
cagtagaagcttgtttttcaga

SEQ ID NO: 7745760 - DNA, 22 bp, Homo sapiens
cagtagcaggcactcagcacgt

SEQ ID NO: 7745761 - DNA, 22 bp, Homo sapiens
tatgtacatcttgagcaatgaa

SEQ ID NO: 7745762 - DNA, 22 bp, Homo sapiens
tatgtacatgatttcatttgct

SEQ ID NO: 7745763 - DNA, 22 bp, Homo sapiens
tatgtacatggagagcaattga

SEQ ID NO: 7745764 - DNA, 22 bp, Homo sapiens
caggcctgtgagttgaggcccc

SEQ ID NO: 7745765 - DNA, 22 bp, Homo sapiens
tacagctggactggtagctgtg

SEQ ID NO: 7745766 - DNA, 22 bp, Homo sapiens
tacagctgctggtgctccatgc

SEQ ID NO: 7745767 - DNA, 23 bp, Homo sapiens
tacagctgcagaatcaggctaag

SEQ ID NO: 7745768 - DNA, 22 bp, Homo sapiens
tacagctgcaagggtttctggg

SEQ ID NO: 7745769 - DNA, 22 bp, Homo sapiens
tacagctgagtttaggtacagg

SEQ ID NO: 7745770 - DNA, 22 bp, Homo sapiens
tacagccatggttaatttacct

SEQ ID NO: 7745771 - DNA, 22 bp, Homo sapiens
tacagcagggcgctgtgatgaa

SEQ ID NO: 7745772 - DNA, 22 bp, Homo sapiens
caggctccttcccagggatggt

SEQ ID NO: 7745773 - DNA, 22 bp, Homo sapiens
caggctcccgctccactgggca

SEQ ID NO: 7745774 - DNA, 22 bp, Homo sapiens
caggctccagcttcctgctcag

SEQ ID NO: 7745775 - DNA, 22 bp, Homo sapiens
tacacagagactcaaaagggca

SEQ ID NO: 7745776 - DNA, 19 bp, Homo sapiens
tccagtttggcaggaagac

SEQ ID NO: 7745777 - DNA, 22 bp, Homo sapiens
tccataaaccagaaaatcaaga

SEQ ID NO: 7745778 - DNA, 22 bp, Homo sapiens
tccataaaccatgcttccaggt

SEQ ID NO: 7745779 - DNA, 22 bp, Homo sapiens
catttccagctcctgcatcatg

SEQ ID NO: 7745780 - DNA, 22 bp, Homo sapiens
ccaaattaaatcatacagacag

SEQ ID NO: 7745781 - DNA, 20 bp, Homo sapiens
tcctgtgtgtctcatcaacc

SEQ ID NO: 7745782 - DNA, 22 bp, Homo sapiens
tcctgtgtgtcagatgcacagt

SEQ ID NO: 7745783 - DNA, 23 bp, Homo sapiens
ccagatttgccacgagagaggct

SEQ ID NO: 7745784 - DNA, 22 bp, Homo sapiens
ccagagggccctggtctcagct

SEQ ID NO: 7745785 - DNA, 22 bp, Homo sapiens
ccagagggcttggtttgggcca

SEQ ID NO: 7745786 - DNA, 22 bp, Homo sapiens
ccagaggggctgagcaggtcac

SEQ ID NO: 7745787 - DNA, 22 bp, Homo sapiens
ccagagggacgttaccagttca

SEQ ID NO: 7745788 - DNA, 22 bp, Homo sapiens
tcaggaagttttgaatcaactg

SEQ ID NO: 7745789 - DNA, 22 bp, Homo sapiens
catctacaggagaatgtcactg

SEQ ID NO: 7745790 - DNA, 22 bp, Homo sapiens
tcatacacattcttattacttt

SEQ ID NO: 7745791 - DNA, 22 bp, Homo sapiens
tccagagtttgagtctccttcc

SEQ ID NO: 7745792 - DNA, 22 bp, Homo sapiens
catgtacaaggatgctcagagt

SEQ ID NO: 7745793 - DNA, 22 bp, Homo sapiens
tttgggcatgttgtggccagct

SEQ ID NO: 7745794 - DNA, 22 bp, Homo sapiens
tttgctgggctctgtgccagac

SEQ ID NO: 7745795 - DNA, 22 bp, Homo sapiens
tttgctgtgcttacatatgtat

SEQ ID NO: 7745796 - DNA, 22 bp, Homo sapiens
tttctaggatactctaaatgta

SEQ ID NO: 7745797 - DNA, 22 bp, Homo sapiens
tttctaggtcttccatactgcc

SEQ ID NO: 7745798 - DNA, 22 bp, Homo sapiens
tttctaggtttacaatactgca

SEQ ID NO: 7745799 - DNA, 22 bp, Homo sapiens
tttgaagactactgggagtgaa

SEQ ID NO: 7745800 - DNA, 22 bp, Homo sapiens
ttttacaaatgaggagctggag

SEQ ID NO: 7745801 - DNA, 22 bp, Homo sapiens
ttttacaagctgagtcgttaaa

SEQ ID NO: 7745802 - DNA, 22 bp, Homo sapiens
ttttacaggtgaaaaatgaaga

SEQ ID NO: 7745803 - DNA, 22 bp, Homo sapiens
ttttacaggtcataggtatagt

SEQ ID NO: 7745804 - DNA, 22 bp, Homo sapiens
tttgtcttccccctttaatcag

SEQ ID NO: 7745805 - DNA, 22 bp, Homo sapiens
tttgtcttaaatcttgttactg

SEQ ID NO: 7745806 - DNA, 22 bp, Homo sapiens
tttgtgcagctaagaaaatggc

SEQ ID NO: 7745807 - DNA, 22 bp, Homo sapiens
tttgtgcataaagggctatagt

SEQ ID NO: 7745808 - DNA, 22 bp, Homo sapiens
tttgtgctgacatttgggtcat

SEQ ID NO: 7745809 - DNA, 22 bp, Homo sapiens
tttgtggcaggagcggagaccg

SEQ ID NO: 7745810 - DNA, 22 bp, Homo sapiens
ttttaccactgggtgacatgga

SEQ ID NO: 7745811 - DNA, 22 bp, Homo sapiens
ttttacagttccatgcaaagcg

SEQ ID NO: 7745812 - DNA, 19 bp, Homo sapiens
ttttgtgtagctgctggtt

SEQ ID NO: 7745813 - DNA, 22 bp, Homo sapiens
ttttgtgtagagatggggtctt

SEQ ID NO: 7745814 - DNA, 22 bp, Homo sapiens
tttacagctagacatacctgag

SEQ ID NO: 7745815 - DNA, 22 bp, Homo sapiens
tttagtgtagcattcagagtca

SEQ ID NO: 7745816 - DNA, 22 bp, Homo sapiens
ttgttgatgtggacgtctggaa

SEQ ID NO: 7745817 - DNA, 22 bp, Homo sapiens
tttacaccaaaatgacacagag

SEQ ID NO: 7745818 - DNA, 22 bp, Homo sapiens
tttacaccattagaagctactt

SEQ ID NO: 7745819 - DNA, 22 bp, Homo sapiens
tttacagctactgtcctatttc

SEQ ID NO: 7745820 - DNA, 22 bp, Homo sapiens
tttacagcaacagtgcagaggt

SEQ ID NO: 7745821 - DNA, 22 bp, Homo sapiens
tttacagagaatgtacataaag

SEQ ID NO: 7745822 - DNA, 22 bp, Homo sapiens
tttccagagctgagaaggcttg

SEQ ID NO: 7745823 - DNA, 22 bp, Homo sapiens
tttccagtgaaattttgaatgt

SEQ ID NO: 7745824 - DNA, 22 bp, Homo sapiens
tttccagtgggccccttgaaat

SEQ ID NO: 7745825 - DNA, 22 bp, Homo sapiens
tttccttgcacattggtttcca

SEQ ID NO: 7745826 - DNA, 22 bp, Homo sapiens
tttcctttgagggtcctacact

SEQ ID NO: 7745827 - DNA, 22 bp, Homo sapiens
tttcctttgcccaatacatgtc

SEQ ID NO: 7745828 - DNA, 22 bp, Homo sapiens
tttcctttgggagcatgaattt

SEQ ID NO: 7745829 - DNA, 22 bp, Homo sapiens
tttcctttgggcacccgagctc

SEQ ID NO: 7745830 - DNA, 22 bp, Homo sapiens
tttcaagtggggacatttgaga

SEQ ID NO: 7745831 - DNA, 22 bp, Homo sapiens
ttggaggatgcaatgagggagt

SEQ ID NO: 7745832 - DNA, 22 bp, Homo sapiens
ttggaattaaaaggagaacttc

SEQ ID NO: 7745833 - DNA, 22 bp, Homo sapiens
ttggaatcctgagatgagaatt

SEQ ID NO: 7745834 - DNA, 22 bp, Homo sapiens
ttggcaacacatggaaaaattt

SEQ ID NO: 7745835 - DNA, 22 bp, Homo sapiens
ttggattcactgttggtagagt

SEQ ID NO: 7745836 - DNA, 22 bp, Homo sapiens
ttggattctgttaggcaccttc

SEQ ID NO: 7745837 - DNA, 22 bp, Homo sapiens
ttggggcatgattagattatga

SEQ ID NO: 7745838 - DNA, 22 bp, Homo sapiens
ttgtgctccctcccgtctggcc

SEQ ID NO: 7745839 - DNA, 22 bp, Homo sapiens
ttgtgctctaaggtcagggcga

SEQ ID NO: 7745840 - DNA, 22 bp, Homo sapiens
ttgtgctcctgtgagaatctag

SEQ ID NO: 7745841 - DNA, 22 bp, Homo sapiens
ttgtgctcctatgagaatctaa

SEQ ID NO: 7745842 - DNA, 21 bp, Homo sapiens
ttccagttttaattaaattgt

SEQ ID NO: 7745843 - DNA, 22 bp, Homo sapiens
ttccaattgcagatcagataca

SEQ ID NO: 7745844 - DNA, 22 bp, Homo sapiens
ttccaatatttacaatgcatta

SEQ ID NO: 7745845 - DNA, 22 bp, Homo sapiens
ttccaagtgtcagatcagattt

SEQ ID NO: 7745846 - DNA, 22 bp, Homo sapiens
ttccaagtgttgagattagagg

SEQ ID NO: 7745847 - DNA, 22 bp, Homo sapiens
ttccaagaagtcaacaggtagt

SEQ ID NO: 7745848 - DNA, 22 bp, Homo sapiens
ttccaactttgaaaatgttatg

SEQ ID NO: 7745849 - DNA, 22 bp, Homo sapiens
ttccaactttgtcatatattat

SEQ ID NO: 7745850 - DNA, 22 bp, Homo sapiens
ttccaactttaaaattcattct

SEQ ID NO: 7745851 - DNA, 20 bp, Homo sapiens
ttccaactcacatctctaca

SEQ ID NO: 7745852 - DNA, 22 bp, Homo sapiens
ttccaactctgaaatgtgaaat

SEQ ID NO: 7745853 - DNA, 22 bp, Homo sapiens
ttcccagacctgtaggatcaga

SEQ ID NO: 7745854 - DNA, 22 bp, Homo sapiens
ttcccagaattgttgggaactg

SEQ ID NO: 7745855 - DNA, 22 bp, Homo sapiens
ttccattgagtacctggagaca

SEQ ID NO: 7745856 - DNA, 19 bp, Homo sapiens
ttcccagagccatgagtga

SEQ ID NO: 7745857 - DNA, 22 bp, Homo sapiens
ttcccagaggcaaagtctggat

SEQ ID NO: 7745858 - DNA, 22 bp, Homo sapiens
ttcccagagaaggatgaaaaag

SEQ ID NO: 7745859 - DNA, 22 bp, Homo sapiens
ttcccagagataagacgtctta

SEQ ID NO: 7745860 - DNA, 22 bp, Homo sapiens
ttccatattggaaggcacaggc

SEQ ID NO: 7745861 - DNA, 22 bp, Homo sapiens
ttcccagattggagggcagggg

SEQ ID NO: 7745862 - DNA, 22 bp, Homo sapiens
ttatttatatctctgcagttta

SEQ ID NO: 7745863 - DNA, 22 bp, Homo sapiens
tcctctggccttggaatccttt

SEQ ID NO: 7745864 - DNA, 22 bp, Homo sapiens
ttctttttatcttcccataaga

SEQ ID NO: 7745865 - DNA, 22 bp, Homo sapiens
ttctttttggatagctgatgaa

SEQ ID NO: 7745866 - DNA, 22 bp, Homo sapiens
ttgagataggtggaatctcttt

SEQ ID NO: 7745867 - DNA, 22 bp, Homo sapiens
ttgagatagatctcatcttccc

SEQ ID NO: 7745868 - DNA, 19 bp, Homo sapiens
ttgaggggccaggggagat

SEQ ID NO: 7745869 - DNA, 22 bp, Homo sapiens
ttctgggacattgcaggtattc

SEQ ID NO: 7745870 - DNA, 22 bp, Homo sapiens
ttctgggaacaaagtggagtgg

SEQ ID NO: 7745871 - DNA, 20 bp, Homo sapiens
ttctgggaattgggtagctg

SEQ ID NO: 7745872 - DNA, 22 bp, Homo sapiens
ttctgggacatctggacagttt

SEQ ID NO: 7745873 - DNA, 22 bp, Homo sapiens
ttctttcttggggaacacactc

SEQ ID NO: 7745874 - DNA, 20 bp, Homo sapiens
ttcgctgggagtggccaggc

SEQ ID NO: 7745875 - DNA, 22 bp, Homo sapiens
ttctgccaaagaagtaaatgga

SEQ ID NO: 7745876 - DNA, 22 bp, Homo sapiens
ttctgccagtgaaaataatgat

SEQ ID NO: 7745877 - DNA, 22 bp, Homo sapiens
attacaagtagactaactttca

SEQ ID NO: 7745878 - DNA, 22 bp, Homo sapiens
attacaactggaatggtgctgg

SEQ ID NO: 7745879 - DNA, 22 bp, Homo sapiens
attacaactatgtgctctgcaa

SEQ ID NO: 7745880 - DNA, 22 bp, Homo sapiens
attacaactgttcccactgtct

SEQ ID NO: 7745881 - DNA, 22 bp, Homo sapiens
attacaactacataatctcaga

SEQ ID NO: 7745882 - DNA, 22 bp, Homo sapiens
attacaacaagaaaagggtaag

SEQ ID NO: 7745883 - DNA, 22 bp, Homo sapiens
attgaatagatgcattatacta

SEQ ID NO: 7745884 - DNA, 22 bp, Homo sapiens
attctaggacttgagagctaag

SEQ ID NO: 7745885 - DNA, 22 bp, Homo sapiens
attctaggcttgaaacatgaag

SEQ ID NO: 7745886 - DNA, 22 bp, Homo sapiens
atttcatcccaggctctggaag

SEQ ID NO: 7745887 - DNA, 22 bp, Homo sapiens
atttccttgcaagtttctgtaa

SEQ ID NO: 7745888 - DNA, 22 bp, Homo sapiens
atttcctagggtagatgtcaca

SEQ ID NO: 7745889 - DNA, 22 bp, Homo sapiens
atttcaagtgttgagctcataa

SEQ ID NO: 7745890 - DNA, 21 bp, Homo sapiens
atttcagaaatattggtggga

SEQ ID NO: 7745891 - DNA, 21 bp, Homo sapiens
atttacaaaacagtcccttcc

SEQ ID NO: 7745892 - DNA, 22 bp, Homo sapiens
atttacagaaacttaatcatag

SEQ ID NO: 7745893 - DNA, 22 bp, Homo sapiens
atttactcgtgtctccagtgct

SEQ ID NO: 7745894 - DNA, 18 bp, Homo sapiens
gcctgggaggaggaaatg

SEQ ID NO: 7745895 - DNA, 22 bp, Homo sapiens
gcctggctgaggtggggaggca

SEQ ID NO: 7745896 - DNA, 22 bp, Homo sapiens
gcctggagctcggctgagggcg

SEQ ID NO: 7745897 - DNA, 22 bp, Homo sapiens
caaacctgctgctattttatcc

SEQ ID NO: 7745898 - DNA, 22 bp, Homo sapiens
caaacattgcactttctgctat

SEQ ID NO: 7745899 - DNA, 22 bp, Homo sapiens
caaacattccgcttctcccagg

SEQ ID NO: 7745900 - DNA, 22 bp, Homo sapiens
caaaaaacacctgtgtgagtat

SEQ ID NO: 7745901 - DNA, 22 bp, Homo sapiens
gcctgggagtgcacagtgaggt

SEQ ID NO: 7745902 - DNA, 22 bp, Homo sapiens
cttggtctactagagaaaaaga

SEQ ID NO: 7745903 - DNA, 22 bp, Homo sapiens
cttggtctagtgagtgagcata

SEQ ID NO: 7745904 - DNA, 22 bp, Homo sapiens
cttggtctataggagagattgt

SEQ ID NO: 7745905 - DNA, 22 bp, Homo sapiens
cttggtctaatggtaataagca

SEQ ID NO: 7745906 - DNA, 22 bp, Homo sapiens
cttggtctctttaccggagtgt

SEQ ID NO: 7745907 - DNA, 22 bp, Homo sapiens
cttggtcttgggagcagggaca

SEQ ID NO: 7745908 - DNA, 22 bp, Homo sapiens
atctacactataacagaatgct

SEQ ID NO: 7745909 - DNA, 22 bp, Homo sapiens
atctacagcagtgccaggtagc

SEQ ID NO: 7745910 - DNA, 22 bp, Homo sapiens
ctttggtctgtggcttgggtct

SEQ ID NO: 7745911 - DNA, 22 bp, Homo sapiens
cttttacatttgttgaagagta

SEQ ID NO: 7745912 - DNA, 22 bp, Homo sapiens
atcttggactacagaagagagg

SEQ ID NO: 7745913 - DNA, 22 bp, Homo sapiens
atcttggattggagaaagaagt

SEQ ID NO: 7745914 - DNA, 22 bp, Homo sapiens
atctttttatctgtttggaaca

SEQ ID NO: 7745915 - DNA, 22 bp, Homo sapiens
atctttttactaacactgctta

SEQ ID NO: 7745916 - DNA, 22 bp, Homo sapiens
atctttttgacatggtgatggt

SEQ ID NO: 7745917 - DNA, 22 bp, Homo sapiens
atcttttttgtcttggtcactg

SEQ ID NO: 7745918 - DNA, 22 bp, Homo sapiens
atggaactgagcttgccaaact

SEQ ID NO: 7745919 - DNA, 22 bp, Homo sapiens
atggaactgatcaggagtgcca

SEQ ID NO: 7745920 - DNA, 22 bp, Homo sapiens
atggaactgctaataatagttg

SEQ ID NO: 7745921 - DNA, 22 bp, Homo sapiens
atggaagagtccccatggatga

SEQ ID NO: 7745922 - DNA, 22 bp, Homo sapiens
atggaagaacgctcagggttac

SEQ ID NO: 7745923 - DNA, 22 bp, Homo sapiens
gaggcctgggagcctgtcctcc

SEQ ID NO: 7745924 - DNA, 22 bp, Homo sapiens
gaggcctgggcaagggggtctg

SEQ ID NO: 7745925 - DNA, 23 bp, Homo sapiens
gaggcctggccctgccacatctc

SEQ ID NO: 7745926 - DNA, 22 bp, Homo sapiens
gaggcctggctctgccctcctg

SEQ ID NO: 7745927 - DNA, 22 bp, Homo sapiens
gaggcctggctgggaggaggtg

SEQ ID NO: 7745928 - DNA, 22 bp, Homo sapiens
gaggcctggctgtcagtcccca

SEQ ID NO: 7745929 - DNA, 22 bp, Homo sapiens
gaggcctgggagaactgttttt

SEQ ID NO: 7745930 - DNA, 22 bp, Homo sapiens
atgtacatagcatcatctagga

SEQ ID NO: 7745931 - DNA, 22 bp, Homo sapiens
atggtcctttttgcctggatgc

SEQ ID NO: 7745932 - DNA, 18 bp, Homo sapiens
atgtacatgtactcacac

SEQ ID NO: 7745933 - DNA, 22 bp, Homo sapiens
atgtacatctttataacaagct

SEQ ID NO: 7745934 - DNA, 21 bp, Homo sapiens
atgtacattcggcaacagata

SEQ ID NO: 7745935 - DNA, 22 bp, Homo sapiens
gaggagctgagccacgtcctgg

SEQ ID NO: 7745936 - DNA, 22 bp, Homo sapiens
gaggagctcatgaaagcggtgt

SEQ ID NO: 7745937 - DNA, 22 bp, Homo sapiens
gaggccaggagtgctgtaagtt

SEQ ID NO: 7745938 - DNA, 22 bp, Homo sapiens
cacaagtttgggtcactcagct

SEQ ID NO: 7745939 - DNA, 22 bp, Homo sapiens
caagagggaacctaagatgtat

SEQ ID NO: 7745940 - DNA, 22 bp, Homo sapiens
caacatattgtgggatgagaga

SEQ ID NO: 7745941 - DNA, 18 bp, Homo sapiens
gctcctggagtctgactc

SEQ ID NO: 7745942 - DNA, 22 bp, Homo sapiens
cacagctgtatccaggagatcc

SEQ ID NO: 7745943 - DNA, 22 bp, Homo sapiens
cacagctgtcagctgacctagg

SEQ ID NO: 7745944 - DNA, 22 bp, Homo sapiens
cacagctgttttctccaggcag

SEQ ID NO: 7745945 - DNA, 22 bp, Homo sapiens
cacagctgtgagaagggagcct

SEQ ID NO: 7745946 - DNA, 22 bp, Homo sapiens
cacagctggtgcactagctctg

SEQ ID NO: 7745947 - DNA, 22 bp, Homo sapiens
ggctaggggaataatctgtggt

SEQ ID NO: 7745948 - DNA, 22 bp, Homo sapiens
ggctagggatctagaccaggac

SEQ ID NO: 7745949 - DNA, 22 bp, Homo sapiens
ggttccagagtgggctgggaaa

SEQ ID NO: 7745950 - DNA, 22 bp, Homo sapiens
ggttcctgtgcctctagctggc

SEQ ID NO: 7745951 - DNA, 22 bp, Homo sapiens
ggttctttgtatatatcacttt

SEQ ID NO: 7745952 - DNA, 22 bp, Homo sapiens
gtatattttgatcaccctctat

SEQ ID NO: 7745953 - DNA, 22 bp, Homo sapiens
cagcatttagaatttgaagtgt

SEQ ID NO: 7745954 - DNA, 22 bp, Homo sapiens
gggactgggagatcctcctggc

SEQ ID NO: 7745955 - DNA, 20 bp, Homo sapiens
gggatgagagtcctagctct

SEQ ID NO: 7745956 - DNA, 22 bp, Homo sapiens
gggaggggttgcatgtttgagt

SEQ ID NO: 7745957 - DNA, 22 bp, Homo sapiens
gggaggtagcaagcctgcagct

SEQ ID NO: 7745958 - DNA, 22 bp, Homo sapiens
gggacaatggaggcctctctcc

SEQ ID NO: 7745959 - DNA, 22 bp, Homo sapiens
gggactggatagatgtgggtga

SEQ ID NO: 7745960 - DNA, 19 bp, Homo sapiens
gggactggaggatgtggag

SEQ ID NO: 7745961 - DNA, 22 bp, Homo sapiens
gggactggaactactggtgcag

SEQ ID NO: 7745962 - DNA, 22 bp, Homo sapiens
gggcgaggactgactctgggca

SEQ ID NO: 7745963 - DNA, 22 bp, Homo sapiens
atataactcttgttcttatagt

SEQ ID NO: 7745964 - DNA, 22 bp, Homo sapiens
atataacatacatacagaaaag

SEQ ID NO: 7745965 - DNA, 22 bp, Homo sapiens
ctgggaagtggtgagggcctga

SEQ ID NO: 7745966 - DNA, 22 bp, Homo sapiens
ctgggagagcctttcctgagtc

SEQ ID NO: 7745967 - DNA, 22 bp, Homo sapiens
ctgggagaggaacctcgagggt

SEQ ID NO: 7745968 - DNA, 22 bp, Homo sapiens
ctgggagagacacttctgatta

SEQ ID NO: 7745969 - DNA, 22 bp, Homo sapiens
ctgggagacgcagctggggatc

SEQ ID NO: 7745970 - DNA, 22 bp, Homo sapiens
ctgggactttgtaggccagttg

SEQ ID NO: 7745971 - DNA, 22 bp, Homo sapiens
atatttctccaaatgttttcaa

SEQ ID NO: 7745972 - DNA, 22 bp, Homo sapiens
atatttctgggggtgtgtttct

SEQ ID NO: 7745973 - DNA, 20 bp, Homo sapiens
atatttcttaagaactttca

SEQ ID NO: 7745974 - DNA, 22 bp, Homo sapiens
ctgggcagtggtggcccttccc

SEQ ID NO: 7745975 - DNA, 22 bp, Homo sapiens
atcattctattgttgagctgcc

SEQ ID NO: 7745976 - DNA, 22 bp, Homo sapiens
ctgtcctcaccttggcaggggg

SEQ ID NO: 7745977 - DNA, 22 bp, Homo sapiens
agtttggggcaagaggacagat

SEQ ID NO: 7745978 - DNA, 20 bp, Homo sapiens
ctgaggggtctgacttggac

SEQ ID NO: 7745979 - DNA, 22 bp, Homo sapiens
ctgaggggtcgtgggagcccag

SEQ ID NO: 7745980 - DNA, 22 bp, Homo sapiens
ctgaggcctcgttggctggaac

SEQ ID NO: 7745981 - DNA, 22 bp, Homo sapiens
ctggagagaccgaaagaggctg

SEQ ID NO: 7745982 - DNA, 22 bp, Homo sapiens
ctgctctggggaagccagatgt

SEQ ID NO: 7745983 - DNA, 19 bp, Homo sapiens
ctcttgggtggcagaggcc

SEQ ID NO: 7745984 - DNA, 20 bp, Homo sapiens
ctcttgggcccaaagggcct

SEQ ID NO: 7745985 - DNA, 22 bp, Homo sapiens
ctcttgggtgggcagtgggcct

SEQ ID NO: 7745986 - DNA, 18 bp, Homo sapiens
ctccttggagaagaggcc

SEQ ID NO: 7745987 - DNA, 22 bp, Homo sapiens
ctccttggtgtagtactgagca

SEQ ID NO: 7745988 - DNA, 22 bp, Homo sapiens
ctcagggaggccctgggaccct

SEQ ID NO: 7745989 - DNA, 22 bp, Homo sapiens
ctcagggacgttagaggacagg

SEQ ID NO: 7745990 - DNA, 22 bp, Homo sapiens
ctcagggacttggatcctggcc

SEQ ID NO: 7745991 - DNA, 22 bp, Homo sapiens
ctcagggacaaggggagacccc

SEQ ID NO: 7745992 - DNA, 22 bp, Homo sapiens
ctcagggacggaggcttgcgga

SEQ ID NO: 7745993 - DNA, 22 bp, Homo sapiens
cggggtgggaatagacctgtct

SEQ ID NO: 7745994 - DNA, 22 bp, Homo sapiens
ctcagaggtcaagagcagagct

SEQ ID NO: 7745995 - DNA, 22 bp, Homo sapiens
ctcagagggttgaaggtgctct

SEQ ID NO: 7745996 - DNA, 22 bp, Homo sapiens
cggaggttgaggctgcagtgag

SEQ ID NO: 7745997 - DNA, 22 bp, Homo sapiens
cggctcagacttcccaagaaca

SEQ ID NO: 7745998 - DNA, 22 bp, Homo sapiens
cctttgtgcatctctgctccta

SEQ ID NO: 7745999 - DNA, 22 bp, Homo sapiens
cctttgtggggcggtgggtaat

SEQ ID NO: 7746000 - DNA, 22 bp, Homo sapiens
cctttgtggtggcccagtgtgg

SEQ ID NO: 7746001 - DNA, 22 bp, Homo sapiens
cctttgtgaatatgcagaaaat

SEQ ID NO: 7746002 - DNA, 22 bp, Homo sapiens
cctttgtgaggtcctgtggggg

SEQ ID NO: 7746003 - DNA, 22 bp, Homo sapiens
agggtccttctgttcctgagca

SEQ ID NO: 7746004 - DNA, 23 bp, Homo sapiens
agggtctgctcagtgtcgttcaa

SEQ ID NO: 7746005 - DNA, 22 bp, Homo sapiens
agggtctgaccaccagtaggga

SEQ ID NO: 7746006 - DNA, 22 bp, Homo sapiens
ccagtttgaggaagaagtagat

SEQ ID NO: 7746007 - DNA, 22 bp, Homo sapiens
agggagctttttcatgtgtcta

SEQ ID NO: 7746008 - DNA, 22 bp, Homo sapiens
agggaggaaggatgttccaaag

SEQ ID NO: 7746009 - DNA, 22 bp, Homo sapiens
aggccagatgtcgggctagaag

SEQ ID NO: 7746010 - DNA, 22 bp, Homo sapiens
aggcatttttgttaatctttgg

SEQ ID NO: 7746011 - DNA, 22 bp, Homo sapiens
aggccctggtcaggtctggctg

SEQ ID NO: 7746012 - DNA, 22 bp, Homo sapiens
aggcagttgagtggctttttca

SEQ ID NO: 7746013 - DNA, 20 bp, Homo sapiens
aggcagtttcaattttgtta

SEQ ID NO: 7746014 - DNA, 22 bp, Homo sapiens
ccactggagatgtcagacaggt

SEQ ID NO: 7746015 - DNA, 22 bp, Homo sapiens
aggctgaggcgggaggatcact

SEQ ID NO: 7746016 - DNA, 22 bp, Homo sapiens
aggctgagcggggtcccagagc

SEQ ID NO: 7746017 - DNA, 22 bp, Homo sapiens
aggctccttgttcatcatccat

SEQ ID NO: 7746018 - DNA, 19 bp, Homo sapiens
aggctctgagctcctggag

SEQ ID NO: 7746019 - DNA, 22 bp, Homo sapiens
aggctctgcagaccccagctgt

SEQ ID NO: 7746020 - DNA, 22 bp, Homo sapiens
aggctgagcctgggcgtggtgg

SEQ ID NO: 7746021 - DNA, 22 bp, Homo sapiens
aggctgagccacggggctggct

SEQ ID NO: 7746022 - DNA, 22 bp, Homo sapiens
aggctcccatggtgtggcagga

SEQ ID NO: 7746023 - DNA, 22 bp, Homo sapiens
agctctggaactcccggctgct

SEQ ID NO: 7746024 - DNA, 22 bp, Homo sapiens
agctgtttttccagtctctgga

SEQ ID NO: 7746025 - DNA, 22 bp, Homo sapiens
agctgtttttgtctgctgatcc

SEQ ID NO: 7746026 - DNA, 22 bp, Homo sapiens
agcttacagttcaatgacaaag

SEQ ID NO: 7746027 - DNA, 22 bp, Homo sapiens
agcttcttttaccaggaagttg

SEQ ID NO: 7746028 - DNA, 22 bp, Homo sapiens
agctgtgttctggttgattcac

SEQ ID NO: 7746029 - DNA, 22 bp, Homo sapiens
agctgttttactggttgtataa

SEQ ID NO: 7746030 - DNA, 22 bp, Homo sapiens
agctgttttctaatgcatttga

SEQ ID NO: 7746031 - DNA, 20 bp, Homo sapiens
agctgtttacatggatttct

SEQ ID NO: 7746032 - DNA, 22 bp, Homo sapiens
agctgtttccattcttgagtag

SEQ ID NO: 7746033 - DNA, 22 bp, Homo sapiens
agctgggaagactggaagacag

SEQ ID NO: 7746034 - DNA, 22 bp, Homo sapiens
caggcctgggcttcggggctga

SEQ ID NO: 7746035 - DNA, 22 bp, Homo sapiens
aggaactggtgaagtgtagtga

SEQ ID NO: 7746036 - DNA, 22 bp, Homo sapiens
aggaactggtgggaggtgattg

SEQ ID NO: 7746037 - DNA, 22 bp, Homo sapiens
aggaactgtcatgtattgctca

SEQ ID NO: 7746038 - DNA, 20 bp, Homo sapiens
aggaactggaagggaggaaa

SEQ ID NO: 7746039 - DNA, 22 bp, Homo sapiens
aggaactggatataatgtgaga

SEQ ID NO: 7746040 - DNA, 22 bp, Homo sapiens
aggaactgatttataactttag

SEQ ID NO: 7746041 - DNA, 21 bp, Homo sapiens
agcttgtgtgtatcacagtgt

SEQ ID NO: 7746042 - DNA, 22 bp, Homo sapiens
agcttgtgtttttctaagtatc

SEQ ID NO: 7746043 - DNA, 22 bp, Homo sapiens
aggaagcttagatttccagatc

SEQ ID NO: 7746044 - DNA, 22 bp, Homo sapiens
aggagctgataaaagggggtca

SEQ ID NO: 7746045 - DNA, 22 bp, Homo sapiens
aggaggaaggcttcattaggtt

SEQ ID NO: 7746046 - DNA, 22 bp, Homo sapiens
aggagctaattcataagccact

SEQ ID NO: 7746047 - DNA, 22 bp, Homo sapiens
aggagaggtctcccttccccag

SEQ ID NO: 7746048 - DNA, 22 bp, Homo sapiens
aggagagagctgagctttgctg

SEQ ID NO: 7746049 - DNA, 22 bp, Homo sapiens
agagtggggacagggcctgtcc

SEQ ID NO: 7746050 - DNA, 22 bp, Homo sapiens
atttagagaataagacataaat

SEQ ID NO: 7746051 - DNA, 22 bp, Homo sapiens
atttagagtgttcactctgagc

SEQ ID NO: 7746052 - DNA, 22 bp, Homo sapiens
atttagtaagtacttgttgaat

SEQ ID NO: 7746053 - DNA, 22 bp, Homo sapiens
atttagcctcatttttgacata

SEQ ID NO: 7746054 - DNA, 22 bp, Homo sapiens
agagggtgggcacgtgatggat

SEQ ID NO: 7746055 - DNA, 22 bp, Homo sapiens
agatttccatctttttcatgtg

SEQ ID NO: 7746056 - DNA, 22 bp, Homo sapiens
agatttccagaccaatttctca

SEQ ID NO: 7746057 - DNA, 22 bp, Homo sapiens
atttccaagaaagctttaggat

SEQ ID NO: 7746058 - DNA, 19 bp, Homo sapiens
atttccaagaattggagag

SEQ ID NO: 7746059 - DNA, 21 bp, Homo sapiens
atttccaagggtacctaagat

SEQ ID NO: 7746060 - DNA, 22 bp, Homo sapiens
atttccaactacccctccattt

SEQ ID NO: 7746061 - DNA, 22 bp, Homo sapiens
atttccaaaaccacttattgcc

SEQ ID NO: 7746062 - DNA, 21 bp, Homo sapiens
atttccaaataaggtcacatt

SEQ ID NO: 7746063 - DNA, 22 bp, Homo sapiens
atttccaaggtaattttgagta

SEQ ID NO: 7746064 - DNA, 22 bp, Homo sapiens
atttccaatctctgcatatggg

SEQ ID NO: 7746065 - DNA, 22 bp, Homo sapiens
atttccaccatctctctgggcc

SEQ ID NO: 7746066 - DNA, 22 bp, Homo sapiens
atttccaccggctcaggaagtt

SEQ ID NO: 7746067 - DNA, 22 bp, Homo sapiens
agagggtgggcacgtgatggat

SEQ ID NO: 7746068 - DNA, 23 bp, Homo sapiens
agagggtgcaacatggggatcta

SEQ ID NO: 7746069 - DNA, 22 bp, Homo sapiens
atgttacaattcaaaatgctgc

SEQ ID NO: 7746070 - DNA, 22 bp, Homo sapiens
atgttacaatccaacaaaatta

SEQ ID NO: 7746071 - DNA, 22 bp, Homo sapiens
atgttacaatccaacaaaatta

SEQ ID NO: 7746072 - DNA, 22 bp, Homo sapiens
atgggaggcaaagatcgcagaa

SEQ ID NO: 7746073 - DNA, 22 bp, Homo sapiens
atgggaggatgctcgggtgctc

SEQ ID NO: 7746074 - DNA, 22 bp, Homo sapiens
atgggaggatcacttgaggcca

SEQ ID NO: 7746075 - DNA, 22 bp, Homo sapiens
atgtacagtggaaactaacaaa

SEQ ID NO: 7746076 - DNA, 22 bp, Homo sapiens
atgtccaatagaagggagaagc

SEQ ID NO: 7746077 - DNA, 22 bp, Homo sapiens
agaatagtggcaatgactgcac

SEQ ID NO: 7746078 - DNA, 20 bp, Homo sapiens
agaagaggatacaaccaggc

SEQ ID NO: 7746079 - DNA, 22 bp, Homo sapiens
agacagtgattcttcacatttc

SEQ ID NO: 7746080 - DNA, 22 bp, Homo sapiens
agacacagtacttgccctcatg

SEQ ID NO: 7746081 - DNA, 22 bp, Homo sapiens
agcacagagaagatttcaatta

SEQ ID NO: 7746082 - DNA, 22 bp, Homo sapiens
agcataacacccgacactcagg

SEQ ID NO: 7746083 - DNA, 22 bp, Homo sapiens
agcagttttcctgagctcctca

SEQ ID NO: 7746084 - DNA, 22 bp, Homo sapiens
agcagttttagggagacacatt

SEQ ID NO: 7746085 - DNA, 22 bp, Homo sapiens
agcagtttggaaaatactagaa

SEQ ID NO: 7746086 - DNA, 22 bp, Homo sapiens
agcagtttagctatactgcttg

SEQ ID NO: 7746087 - DNA, 23 bp, Homo sapiens
cacagtcatttactttgccatca

SEQ ID NO: 7746088 - DNA, 22 bp, Homo sapiens
cagcagaaacccagcaaagcca

SEQ ID NO: 7746089 - DNA, 22 bp, Homo sapiens
cagaactgggctcgctctggtt

SEQ ID NO: 7746090 - DNA, 22 bp, Homo sapiens
agccacaatgccaacctctact

SEQ ID NO: 7746091 - DNA, 22 bp, Homo sapiens
cagaagaaagtggggagacaag

SEQ ID NO: 7746092 - DNA, 22 bp, Homo sapiens
atagtttacaaaaatgatgcat

SEQ ID NO: 7746093 - DNA, 22 bp, Homo sapiens
actttgggtaagccaggtgcta

SEQ ID NO: 7746094 - DNA, 22 bp, Homo sapiens
atatcttctttattttgtgagg

SEQ ID NO: 7746095 - DNA, 22 bp, Homo sapiens
atcagatatttaagttatcaac

SEQ ID NO: 7746096 - DNA, 22 bp, Homo sapiens
atcatttaaaacaagtctctat

SEQ ID NO: 7746097 - DNA, 22 bp, Homo sapiens
atcatttatgccccaattagat

SEQ ID NO: 7746098 - DNA, 23 bp, Homo sapiens
atcattctccaatctggagcagg

SEQ ID NO: 7746099 - DNA, 22 bp, Homo sapiens
agtttccaaaaggagacaggga

SEQ ID NO: 7746100 - DNA, 22 bp, Homo sapiens
agtttccaggcaggagctaatt

SEQ ID NO: 7746101 - DNA, 22 bp, Homo sapiens
agtttccagcacagggcaagct

SEQ ID NO: 7746102 - DNA, 22 bp, Homo sapiens
agtttaggcaggctcctatggt

SEQ ID NO: 7746103 - DNA, 22 bp, Homo sapiens
agtttacataaaaaggcagagg

SEQ ID NO: 7746104 - DNA, 22 bp, Homo sapiens
agtttacactatgaaaagacta

SEQ ID NO: 7746105 - DNA, 22 bp, Homo sapiens
agtctacaacgcaagcaacatg

SEQ ID NO: 7746106 - DNA, 22 bp, Homo sapiens
agtctgggcatttaggatgttg

SEQ ID NO: 7746107 - DNA, 22 bp, Homo sapiens
agtctgggctgtctgcaggagt

SEQ ID NO: 7746108 - DNA, 22 bp, Homo sapiens
actgaaatactgctcttggatt

SEQ ID NO: 7746109 - DNA, 23 bp, Homo sapiens
actgctgtctttgaagtgcttga

SEQ ID NO: 7746110 - DNA, 22 bp, Homo sapiens
actgcaaggaggtggggtatca

SEQ ID NO: 7746111 - DNA, 19 bp, Homo sapiens
actaaaaatgatgtttgag

SEQ ID NO: 7746112 - DNA, 19 bp, Homo sapiens
actcagggaaaggagaatt

SEQ ID NO: 7746113 - DNA, 22 bp, Homo sapiens
agggcttgtggtcgtggctgtg

SEQ ID NO: 7746114 - DNA, 22 bp, Homo sapiens
agggctggtatgtccatgaaag

SEQ ID NO: 7746115 - DNA, 22 bp, Homo sapiens
agggcttgacaagggctggagc

SEQ ID NO: 7746116 - DNA, 22 bp, Homo sapiens
aggctgagggctcctgagggca

SEQ ID NO: 7746117 - DNA, 22 bp, Homo sapiens
agggagctcacagtccagtaga

SEQ ID NO: 7746118 - DNA, 22 bp, Homo sapiens
agggagctctaagtagagggac

SEQ ID NO: 7746119 - DNA, 22 bp, Homo sapiens
agggagctcgatgcctgagtgt

SEQ ID NO: 7746120 - DNA, 22 bp, Homo sapiens
agggcctgggatgtcctcctag

SEQ ID NO: 7746121 - DNA, 19 bp, Homo sapiens
accctaggaggtctggtga

SEQ ID NO: 7746122 - DNA, 22 bp, Homo sapiens
agggcctggtgacctgggtcct

SEQ ID NO: 7746123 - DNA, 22 bp, Homo sapiens
agggcctgggtctgtactcctc

SEQ ID NO: 7746124 - DNA, 22 bp, Homo sapiens
aggctggatgtgcctcaccgag

SEQ ID NO: 7746125 - DNA, 22 bp, Homo sapiens
aggctggatttatggggacttc

SEQ ID NO: 7746126 - DNA, 19 bp, Homo sapiens
aggctggatgcccatctta

SEQ ID NO: 7746127 - DNA, 22 bp, Homo sapiens
agggagctaggatcctgaaggt

SEQ ID NO: 7746128 - DNA, 22 bp, Homo sapiens
agggagctatttcagggttatt

SEQ ID NO: 7746129 - DNA, 22 bp, Homo sapiens
aggagtcataaatgtgaacaaa

SEQ ID NO: 7746130 - DNA, 18 bp, Homo sapiens
acagggagggcgctgggg

SEQ ID NO: 7746131 - DNA, 22 bp, Homo sapiens
acagtttggcaaatgtcccaca

SEQ ID NO: 7746132 - DNA, 20 bp, Homo sapiens
acagtgtttttgagtagagc

SEQ ID NO: 7746133 - DNA, 22 bp, Homo sapiens
acagttaccacttagcagttac

SEQ ID NO: 7746134 - DNA, 22 bp, Homo sapiens
acagttacattaaacaaaagga

SEQ ID NO: 7746135 - DNA, 22 bp, Homo sapiens
aggaatgacttgtagctctgag

SEQ ID NO: 7746136 - DNA, 22 bp, Homo sapiens
acagctgtgttttataatcagc

SEQ ID NO: 7746137 - DNA, 22 bp, Homo sapiens
acagctgtggggactcttgccc

SEQ ID NO: 7746138 - DNA, 22 bp, Homo sapiens
acagctgtggtctccttagtgt

SEQ ID NO: 7746139 - DNA, 23 bp, Homo sapiens
acagctgttgaaatttcagtggg

SEQ ID NO: 7746140 - DNA, 22 bp, Homo sapiens
acagctgtggccacttgcatcc

SEQ ID NO: 7746141 - DNA, 22 bp, Homo sapiens
acagctgtgatttctatcatga

SEQ ID NO: 7746142 - DNA, 22 bp, Homo sapiens
acagctgtgggctctgcatata

SEQ ID NO: 7746143 - DNA, 22 bp, Homo sapiens
acagctgtgagggtcacttgta

SEQ ID NO: 7746144 - DNA, 22 bp, Homo sapiens
acagctgtgacttagagaagtt

SEQ ID NO: 7746145 - DNA, 22 bp, Homo sapiens
acagctgtgaagcaagcactct

SEQ ID NO: 7746146 - DNA, 22 bp, Homo sapiens
acagctgtgaaaatccacagga

SEQ ID NO: 7746147 - DNA, 21 bp, Homo sapiens
acagctgtcttagcttgggct

SEQ ID NO: 7746148 - DNA, 22 bp, Homo sapiens
acagctactctgcagataaatc

SEQ ID NO: 7746149 - DNA, 22 bp, Homo sapiens
acagcctgctgcctgcttcttg

SEQ ID NO: 7746150 - DNA, 19 bp, Homo sapiens
acagcacagaaatatttca

SEQ ID NO: 7746151 - DNA, 22 bp, Homo sapiens
acagattcactgcactggccat

SEQ ID NO: 7746152 - DNA, 22 bp, Homo sapiens
acagaaaaatgagggagctgga

SEQ ID NO: 7746153 - DNA, 22 bp, Homo sapiens
acagaaaatgccagaagggtgg

SEQ ID NO: 7746154 - DNA, 22 bp, Homo sapiens
acagaaaagtttacttttgctc

SEQ ID NO: 7746155 - DNA, 20 bp, Homo sapiens
acagaaagagagaatgtcag

SEQ ID NO: 7746156 - DNA, 22 bp, Homo sapiens
acagacagattttgtctgatgt

SEQ ID NO: 7746157 - DNA, 22 bp, Homo sapiens
acactataagacagatacagca

SEQ ID NO: 7746158 - DNA, 22 bp, Homo sapiens
agataaattcctaagatttcag

SEQ ID NO: 7746159 - DNA, 22 bp, Homo sapiens
agataacatttattgaatgtaa

SEQ ID NO: 7746160 - DNA, 22 bp, Homo sapiens
agataacatgttgcagattctg

SEQ ID NO: 7746161 - DNA, 17 bp, Homo sapiens
acaacagaaatgtattc

SEQ ID NO: 7746162 - DNA, 22 bp, Homo sapiens
agataactggtttacattattg

SEQ ID NO: 7746163 - DNA, 22 bp, Homo sapiens
agataagtcttccatatttcta

SEQ ID NO: 7746164 - DNA, 22 bp, Homo sapiens
agataataagtctggtaataat

SEQ ID NO: 7746165 - DNA, 22 bp, Homo sapiens
acaagatactcagctacaagac

SEQ ID NO: 7746166 - DNA, 22 bp, Homo sapiens
acaagataaggtgtcagtgtgt

SEQ ID NO: 7746167 - DNA, 22 bp, Homo sapiens
acaagcgggccacagtgctggt

SEQ ID NO: 7746168 - DNA, 22 bp, Homo sapiens
acaagcgggccacagtgctggt

SEQ ID NO: 7746169 - DNA, 22 bp, Homo sapiens
acaagcgagcggcttctggccg

SEQ ID NO: 7746170 - DNA, 22 bp, Homo sapiens
acaagataggttgagtctagcc

SEQ ID NO: 7746171 - DNA, 23 bp, Homo sapiens
acaagatagggataaaaagataa

SEQ ID NO: 7746172 - DNA, 22 bp, Homo sapiens
acaagatagcttagaagattca

SEQ ID NO: 7746173 - DNA, 22 bp, Homo sapiens
agaggctgatggagtagtgtct

SEQ ID NO: 7746174 - DNA, 22 bp, Homo sapiens
aatgggctttcttggacaggag

SEQ ID NO: 7746175 - DNA, 20 bp, Homo sapiens
aatgggctttgatgagtgtg

SEQ ID NO: 7746176 - DNA, 22 bp, Homo sapiens
aattaaaggtcatgttaaaggg

SEQ ID NO: 7746177 - DNA, 22 bp, Homo sapiens
aaggctgggaaacatgcaggcc

SEQ ID NO: 7746178 - DNA, 19 bp, Homo sapiens
aaggctggagaaggcctct

SEQ ID NO: 7746179 - DNA, 22 bp, Homo sapiens
aagcagaactgggaagtagtgg

SEQ ID NO: 7746180 - DNA, 22 bp, Homo sapiens
aagcagagaaaagcttaggttc

SEQ ID NO: 7746181 - DNA, 22 bp, Homo sapiens
acacatgaaataatattatgca

SEQ ID NO: 7746182 - DNA, 22 bp, Homo sapiens
acacatgagaaacatcagttgt

SEQ ID NO: 7746183 - DNA, 22 bp, Homo sapiens
acacatgataagaaagtttaaa

SEQ ID NO: 7746184 - DNA, 22 bp, Homo sapiens
aagatatagatggtggtataaa

SEQ ID NO: 7746185 - DNA, 22 bp, Homo sapiens
acacatttattacatgcatgtg

SEQ ID NO: 7746186 - DNA, 22 bp, Homo sapiens
aagaaagagatcactcctccat

SEQ ID NO: 7746187 - DNA, 22 bp, Homo sapiens
aagaaagataaggtttgcttgg

SEQ ID NO: 7746188 - DNA, 21 bp, Homo sapiens
aactggcagaccaactatggc

SEQ ID NO: 7746189 - DNA, 22 bp, Homo sapiens
aacagactcacagctagagaag

SEQ ID NO: 7746190 - DNA, 22 bp, Homo sapiens
aacagaatatcaaaagattatg

SEQ ID NO: 7746191 - DNA, 22 bp, Homo sapiens
aacagaatagttgatgtacagt

SEQ ID NO: 7746192 - DNA, 22 bp, Homo sapiens
aaggctggtggattatgaggtc

SEQ ID NO: 7746193 - DNA, 22 bp, Homo sapiens
aaggctggttccatccctggtg

SEQ ID NO: 7746194 - DNA, 22 bp, Homo sapiens
aaggaagactcgcaggtctatg

SEQ ID NO: 7746195 - DNA, 22 bp, Homo sapiens
aaggaagacacagatgaagtga

SEQ ID NO: 7746196 - DNA, 22 bp, Homo sapiens
aaggaagacttgagaaggttcc

SEQ ID NO: 7746197 - DNA, 22 bp, Homo sapiens
aaggaagagcaaagaattatgt

SEQ ID NO: 7746198 - DNA, 22 bp, Homo sapiens
aaggaagagaatccttctcaga

SEQ ID NO: 7746199 - DNA, 22 bp, Homo sapiens
aaggaagatatatcaagcttaa

SEQ ID NO: 7746200 - DNA, 22 bp, Homo sapiens
aaggaagatgaaagtactgcta

SEQ ID NO: 7746201 - DNA, 22 bp, Homo sapiens
aaggaagatgaggtgctgctta

SEQ ID NO: 7746202 - DNA, 22 bp, Homo sapiens
aaggaagaggcaggttttgctg

SEQ ID NO: 7746203 - DNA, 22 bp, Homo sapiens
aaggaagagtctagaacaggca

SEQ ID NO: 7746204 - DNA, 22 bp, Homo sapiens
aacagctgttcgcagatgtagg

SEQ ID NO: 7746205 - DNA, 22 bp, Homo sapiens
aacagctgtctgcctatctctg

SEQ ID NO: 7746206 - DNA, 22 bp, Homo sapiens
aacagctgcttctatcttttca

SEQ ID NO: 7746207 - DNA, 22 bp, Homo sapiens
aacagctgtatactgtagctgt

SEQ ID NO: 7746208 - DNA, 22 bp, Homo sapiens
aacagctgcttcagtacttgaa

SEQ ID NO: 7746209 - DNA, 22 bp, Homo sapiens
aacagctgcaaaaggttgcctg

SEQ ID NO: 7746210 - DNA, 22 bp, Homo sapiens
aatagatactacttagatgtag

SEQ ID NO: 7746211 - DNA, 19 bp, Homo sapiens
aacatctttccagtagagg

SEQ ID NO: 7746212 - DNA, 22 bp, Homo sapiens
aaagatcagtctgaagcaacat

SEQ ID NO: 7746213 - DNA, 22 bp, Homo sapiens
aaacttttcctgctcttgtcct

SEQ ID NO: 7746214 - DNA, 22 bp, Homo sapiens
aaacagctaatggccaggaata

SEQ ID NO: 7746215 - DNA, 22 bp, Homo sapiens
aaacagctaagtacattcaagg

SEQ ID NO: 7746216 - DNA, 22 bp, Homo sapiens
aaacagctgcagtacacggcct

SEQ ID NO: 7746217 - DNA, 22 bp, Homo sapiens
aaacagctcaagaagttactct

SEQ ID NO: 7746218 - DNA, 22 bp, Homo sapiens
aaacatgttttctgaatatttt

SEQ ID NO: 7746219 - DNA, 22 bp, Homo sapiens
aaactggattaccaggctggtg

SEQ ID NO: 7746220 - DNA, 22 bp, Homo sapiens
aaaaagtattggccatggttga

SEQ ID NO: 7746221 - DNA, 22 bp, Homo sapiens
aaacagcttgtttcaggaaagt

SEQ ID NO: 7746222 - DNA, 22 bp, Homo sapiens
aagccctgtccggggggaagaa

SEQ ID NO: 7746223 - DNA, 22 bp, Homo sapiens
aagccctgttaggcactgggga

SEQ ID NO: 7746224 - DNA, 22 bp, Homo sapiens
aaatctgtaagcaattgctcag

SEQ ID NO: 7746225 - DNA, 22 bp, Homo sapiens
aaatctctggtcacagaactta

SEQ ID NO: 7746226 - DNA, 22 bp, Homo sapiens
aaatctcagtgttctaagcatt

SEQ ID NO: 7746227 - DNA, 22 bp, Homo sapiens
aagattctagaggaacttctta

SEQ ID NO: 7746228 - DNA, 23 bp, Homo sapiens
aaatacctgaattagatattatc

SEQ ID NO: 7746229 - DNA, 22 bp, Homo sapiens
aaatactagaattcagagttga

SEQ ID NO: 7746230 - DNA, 22 bp, Homo sapiens
aacacttaaggagagatcaaat

SEQ ID NO: 7746231 - DNA, 22 bp, Homo sapiens
ggtgtcccaggccagctgtgtg

SEQ ID NO: 7746232 - DNA, 22 bp, Homo sapiens
gtacataagaaattactacaga

SEQ ID NO: 7746233 - DNA, 22 bp, Homo sapiens
gtcaggctgctggagcttgggt

SEQ ID NO: 7746234 - DNA, 22 bp, Homo sapiens
gtccatacagtggcacacatct

SEQ ID NO: 7746235 - DNA, 22 bp, Homo sapiens
gtccttggctgtggctgtaatg

SEQ ID NO: 7746236 - DNA, 22 bp, Homo sapiens
gtccttggccttcttgtaggca

SEQ ID NO: 7746237 - DNA, 22 bp, Homo sapiens
gtccttggagtcaggcaaggct

SEQ ID NO: 7746238 - DNA, 22 bp, Homo sapiens
gtctgggcaagggagatggcgc

SEQ ID NO: 7746239 - DNA, 17 bp, Homo sapiens
gtctgggctttagagac

SEQ ID NO: 7746240 - DNA, 22 bp, Homo sapiens
gtctggggaagtcagggcatca

SEQ ID NO: 7746241 - DNA, 22 bp, Homo sapiens
gtggaagctgatgggagacagg

SEQ ID NO: 7746242 - DNA, 22 bp, Homo sapiens
gtggaagcctaagagtagggag

SEQ ID NO: 7746243 - DNA, 22 bp, Homo sapiens
gtggaagcaaccctggcaggag

SEQ ID NO: 7746244 - DNA, 22 bp, Homo sapiens
gtggactgcgcttgagggggcc

SEQ ID NO: 7746245 - DNA, 22 bp, Homo sapiens
gtggcagaggctctgggaccag

SEQ ID NO: 7746246 - DNA, 22 bp, Homo sapiens
gtggcagaggctgtgaggatgc

SEQ ID NO: 7746247 - DNA, 22 bp, Homo sapiens
taacagaatttgctaaactccg

SEQ ID NO: 7746248 - DNA, 22 bp, Homo sapiens
gtgtcaataaatagcggtgtgg

SEQ ID NO: 7746249 - DNA, 18 bp, Homo sapiens
gtggtctttctgtcttct

SEQ ID NO: 7746250 - DNA, 22 bp, Homo sapiens
gtggtctttaaatttgtgcctg

SEQ ID NO: 7746251 - DNA, 22 bp, Homo sapiens
gtggtcctgagtagctttagaa

SEQ ID NO: 7746252 - DNA, 22 bp, Homo sapiens
gtggtcctgccagccaggtcca

SEQ ID NO: 7746253 - DNA, 22 bp, Homo sapiens
gtggtcctcttcttctgtttgg

SEQ ID NO: 7746254 - DNA, 22 bp, Homo sapiens
gtggtcctcataattcagtgag

SEQ ID NO: 7746255 - DNA, 22 bp, Homo sapiens
gtgggctgttgttccctgttct

SEQ ID NO: 7746256 - DNA, 22 bp, Homo sapiens
gtgggctgcccttgaggtcagc

SEQ ID NO: 7746257 - DNA, 22 bp, Homo sapiens
gtgggctggaccctcctgctcc

SEQ ID NO: 7746258 - DNA, 22 bp, Homo sapiens
gtgggcagttggtgattctcgt

SEQ ID NO: 7746259 - DNA, 20 bp, Homo sapiens
gtgggcagatgtgtgcatgg

SEQ ID NO: 7746260 - DNA, 22 bp, Homo sapiens
gtgggcagagcaagggaactca

SEQ ID NO: 7746261 - DNA, 22 bp, Homo sapiens
gtgtcctgggctggtagagctg

SEQ ID NO: 7746262 - DNA, 22 bp, Homo sapiens
ggctccttatctctcctatgcc

SEQ ID NO: 7746263 - DNA, 22 bp, Homo sapiens
ggctctagagactctagagaaa

SEQ ID NO: 7746264 - DNA, 22 bp, Homo sapiens
ggctctagagctgtgcacacat

SEQ ID NO: 7746265 - DNA, 22 bp, Homo sapiens
ggctcctgggcagctgctccct

SEQ ID NO: 7746266 - DNA, 18 bp, Homo sapiens
gggaagaggatctggccc

SEQ ID NO: 7746267 - DNA, 22 bp, Homo sapiens
gggaagagatttccacatcatt

SEQ ID NO: 7746268 - DNA, 22 bp, Homo sapiens
gggaagagaccgtaccctggcc

SEQ ID NO: 7746269 - DNA, 22 bp, Homo sapiens
gggaagagaggaggtggtttcg

SEQ ID NO: 7746270 - DNA, 22 bp, Homo sapiens
gggaactgtgtggtgctctgat

SEQ ID NO: 7746271 - DNA, 22 bp, Homo sapiens
ggcttccctttccgagaggaga

SEQ ID NO: 7746272 - DNA, 22 bp, Homo sapiens
ggcctgggcccactgtcaagag

SEQ ID NO: 7746273 - DNA, 22 bp, Homo sapiens
ggctcaggtttccttcccagct

SEQ ID NO: 7746274 - DNA, 22 bp, Homo sapiens
ggctcagtaagtcaggttcatt

SEQ ID NO: 7746275 - DNA, 22 bp, Homo sapiens
ggctcataaactcagttcagtt

SEQ ID NO: 7746276 - DNA, 22 bp, Homo sapiens
ggctcctgatttgagggggctg

SEQ ID NO: 7746277 - DNA, 22 bp, Homo sapiens
ggctcaggactgcagcgtagag

SEQ ID NO: 7746278 - DNA, 18 bp, Homo sapiens
ggccagagggagggtccc

SEQ ID NO: 7746279 - DNA, 22 bp, Homo sapiens
ggccagaggccacagctgtgtc

SEQ ID NO: 7746280 - DNA, 22 bp, Homo sapiens
ggccagagagccgctgttagga

SEQ ID NO: 7746281 - DNA, 22 bp, Homo sapiens
ggccagagctcaaacagtcgca

SEQ ID NO: 7746282 - DNA, 22 bp, Homo sapiens
gggctgagacgatggggtcttc

SEQ ID NO: 7746283 - DNA, 22 bp, Homo sapiens
gggctggaagacaggaaatgct

SEQ ID NO: 7746284 - DNA, 22 bp, Homo sapiens
gggctggaaaaacaacatacaa

SEQ ID NO: 7746285 - DNA, 20 bp, Homo sapiens
gggctagaccagggcagagg

SEQ ID NO: 7746286 - DNA, 18 bp, Homo sapiens
gggctaggcaaggaccac

SEQ ID NO: 7746287 - DNA, 20 bp, Homo sapiens
gggctaggtagccatttggc

SEQ ID NO: 7746288 - DNA, 22 bp, Homo sapiens
gggctagggcctgctatggttt

SEQ ID NO: 7746289 - DNA, 22 bp, Homo sapiens
gggctggcaggacctgggctga

SEQ ID NO: 7746290 - DNA, 22 bp, Homo sapiens
gggctggatgggagccttggcc

SEQ ID NO: 7746291 - DNA, 22 bp, Homo sapiens
gggctggagccagctgtggctg

SEQ ID NO: 7746292 - DNA, 22 bp, Homo sapiens
gggctggatctcctgcaggcag

SEQ ID NO: 7746293 - DNA, 22 bp, Homo sapiens
gggtgggatggcaggagccgct

SEQ ID NO: 7746294 - DNA, 22 bp, Homo sapiens
ggggacctgggcttcaagggtt

SEQ ID NO: 7746295 - DNA, 22 bp, Homo sapiens
ggggactgaggcactgaaggtg

SEQ ID NO: 7746296 - DNA, 22 bp, Homo sapiens
gggacctggggactccttgttc

SEQ ID NO: 7746297 - DNA, 23 bp, Homo sapiens
gggacctggtaggaggtgattgg

SEQ ID NO: 7746298 - DNA, 19 bp, Homo sapiens
gggacctgactaattggca

SEQ ID NO: 7746299 - DNA, 22 bp, Homo sapiens
gggacctgaggaggggtttcag

SEQ ID NO: 7746300 - DNA, 22 bp, Homo sapiens
gggacctgaggccctgctccac

SEQ ID NO: 7746301 - DNA, 22 bp, Homo sapiens
gggatggatcttggctgaggct

SEQ ID NO: 7746302 - DNA, 22 bp, Homo sapiens
gggatggacttggggactccag

SEQ ID NO: 7746303 - DNA, 22 bp, Homo sapiens
gggatctgagtaggcagaagct

SEQ ID NO: 7746304 - DNA, 22 bp, Homo sapiens
gggagggaaggtacctgtgtga

SEQ ID NO: 7746305 - DNA, 22 bp, Homo sapiens
gggctaagtggatcagtcagga

SEQ ID NO: 7746306 - DNA, 22 bp, Homo sapiens
gggctacagacatgctctaagc

SEQ ID NO: 7746307 - DNA, 22 bp, Homo sapiens
gggctaagctcgcccagggcca

SEQ ID NO: 7746308 - DNA, 22 bp, Homo sapiens
gggctaagcagagtgggaacag

SEQ ID NO: 7746309 - DNA, 22 bp, Homo sapiens
gggctaagtgaagattgctcca

SEQ ID NO: 7746310 - DNA, 21 bp, Homo sapiens
gggctaagagtgaccaggcag

SEQ ID NO: 7746311 - DNA, 22 bp, Homo sapiens
gggctagaatccgcgtctcttg

SEQ ID NO: 7746312 - DNA, 22 bp, Homo sapiens
gggctagaaattctgcagtgga

SEQ ID NO: 7746313 - DNA, 22 bp, Homo sapiens
gggcctgtgtgttcaggagcct

SEQ ID NO: 7746314 - DNA, 22 bp, Homo sapiens
ggaggaagtgcagttctactac

SEQ ID NO: 7746315 - DNA, 22 bp, Homo sapiens
ggaggaaatccttagtaaggca

SEQ ID NO: 7746316 - DNA, 22 bp, Homo sapiens
ggagctgaggaatagctttgat

SEQ ID NO: 7746317 - DNA, 22 bp, Homo sapiens
ggagctgaaggggtgggctcag

SEQ ID NO: 7746318 - DNA, 22 bp, Homo sapiens
ggagcctgtgggatgagatgtg

SEQ ID NO: 7746319 - DNA, 20 bp, Homo sapiens
ggagctagagctgaaagact

SEQ ID NO: 7746320 - DNA, 22 bp, Homo sapiens
ggagcctggtcaggttggctcc

SEQ ID NO: 7746321 - DNA, 22 bp, Homo sapiens
gcttattaggttatttcaagga

SEQ ID NO: 7746322 - DNA, 22 bp, Homo sapiens
gcttccttgggaaaattagatg

SEQ ID NO: 7746323 - DNA, 22 bp, Homo sapiens
gcttccttctaccacatcatgc

SEQ ID NO: 7746324 - DNA, 22 bp, Homo sapiens
ggaaagacctgagataggaata

SEQ ID NO: 7746325 - DNA, 22 bp, Homo sapiens
ggaaaccaggactgcaccgtct

SEQ ID NO: 7746326 - DNA, 22 bp, Homo sapiens
ggaactgagaagcagctatgcc

SEQ ID NO: 7746327 - DNA, 22 bp, Homo sapiens
ggaactgagcaatggcatgaaa

SEQ ID NO: 7746328 - DNA, 22 bp, Homo sapiens
ggagttccagaccagactggcc

SEQ ID NO: 7746329 - DNA, 22 bp, Homo sapiens
ggaggcttgatgatcttggata

SEQ ID NO: 7746330 - DNA, 22 bp, Homo sapiens
ggaggggaactaatcccgtgac

SEQ ID NO: 7746331 - DNA, 22 bp, Homo sapiens
ggaggctcagtgaggaaatgga

SEQ ID NO: 7746332 - DNA, 23 bp, Homo sapiens
ggaggctcaagtatcacgggcag

SEQ ID NO: 7746333 - DNA, 22 bp, Homo sapiens
ggaggctccatgagctcctgca

SEQ ID NO: 7746334 - DNA, 22 bp, Homo sapiens
ggaggctcccacgcagctcaca

SEQ ID NO: 7746335 - DNA, 22 bp, Homo sapiens
ggaggctcttgagaggggagta

SEQ ID NO: 7746336 - DNA, 22 bp, Homo sapiens
ggagggggaagaagctaaagac

SEQ ID NO: 7746337 - DNA, 22 bp, Homo sapiens
ggaggggaggattaatgacaaa

SEQ ID NO: 7746338 - DNA, 22 bp, Homo sapiens
ggaggggagatgtttgggctca

SEQ ID NO: 7746339 - DNA, 22 bp, Homo sapiens
ggaggggagtctcccaaagccg

SEQ ID NO: 7746340 - DNA, 22 bp, Homo sapiens
ggaggggaggtccagctgatct

SEQ ID NO: 7746341 - DNA, 22 bp, Homo sapiens
ggagggggactgacactgattt

SEQ ID NO: 7746342 - DNA, 22 bp, Homo sapiens
gctctgagtgatcagctgggaa

SEQ ID NO: 7746343 - DNA, 22 bp, Homo sapiens
gctctgagtgattaaggagctt

SEQ ID NO: 7746344 - DNA, 22 bp, Homo sapiens
gctctgaggctgtgaggtgctg

SEQ ID NO: 7746345 - DNA, 22 bp, Homo sapiens
gctctgagccgggggcctgtcc

SEQ ID NO: 7746346 - DNA, 22 bp, Homo sapiens
gctcctggcaggcagtgtgtgt

SEQ ID NO: 7746347 - DNA, 22 bp, Homo sapiens
gctcctggctctctgagggctg

SEQ ID NO: 7746348 - DNA, 22 bp, Homo sapiens
gctgggagttactgtctccttt

SEQ ID NO: 7746349 - DNA, 22 bp, Homo sapiens
gctgggagtgggcaagatgaga

SEQ ID NO: 7746350 - DNA, 22 bp, Homo sapiens
gctgggcaagtgccttgggttt

SEQ ID NO: 7746351 - DNA, 22 bp, Homo sapiens
gctgggcaggcctcgtgagggc

SEQ ID NO: 7746352 - DNA, 22 bp, Homo sapiens
gcctgctctgagtgtggggggt

SEQ ID NO: 7746353 - DNA, 22 bp, Homo sapiens
gcctgggattcccagaggggca

SEQ ID NO: 7746354 - DNA, 22 bp, Homo sapiens
gccagcagggaagccttgggct

SEQ ID NO: 7746355 - DNA, 22 bp, Homo sapiens
gccagtggtcagtgggagggtg

SEQ ID NO: 7746356 - DNA, 22 bp, Homo sapiens
gccatatatattttgcactagg

SEQ ID NO: 7746357 - DNA, 22 bp, Homo sapiens
gccagtttaaaccttgtgaata

SEQ ID NO: 7746358 - DNA, 22 bp, Homo sapiens
gccagcagctcttgggcgggca

SEQ ID NO: 7746359 - DNA, 22 bp, Homo sapiens
gccagcagctgtggggtggcca

SEQ ID NO: 7746360 - DNA, 20 bp, Homo sapiens
gccagaggccggcaggggct

SEQ ID NO: 7746361 - DNA, 22 bp, Homo sapiens
gccacagacagagagtctagtg

SEQ ID NO: 7746362 - DNA, 22 bp, Homo sapiens
gcaggggctgctgggaactcgg

SEQ ID NO: 7746363 - DNA, 21 bp, Homo sapiens
gcagagcctgaggttcttgag

SEQ ID NO: 7746364 - DNA, 17 bp, Homo sapiens
gcacaaatcaattacta

SEQ ID NO: 7746365 - DNA, 22 bp, Homo sapiens
gcaaacattccacagaaggaag

SEQ ID NO: 7746366 - DNA, 18 bp, Homo sapiens
gcaaacattcttccagtc

SEQ ID NO: 7746367 - DNA, 22 bp, Homo sapiens
gcaaacatttggtctagtgtgt

SEQ ID NO: 7746368 - DNA, 22 bp, Homo sapiens
gcaaacattcaggagtacagga

SEQ ID NO: 7746369 - DNA, 22 bp, Homo sapiens
gcaaacatgttgtgagatacca

SEQ ID NO: 7746370 - DNA, 22 bp, Homo sapiens
gcaaacatgtgctcattttgtg

SEQ ID NO: 7746371 - DNA, 22 bp, Homo sapiens
gcaaacatgctgagaaataaga

SEQ ID NO: 7746372 - DNA, 22 bp, Homo sapiens
gcaaacatctttatttggcaag

SEQ ID NO: 7746373 - DNA, 22 bp, Homo sapiens
gattttcttgggaaacaatgag

SEQ ID NO: 7746374 - DNA, 17 bp, Homo sapiens
gcagaaaagtcaaggga

SEQ ID NO: 7746375 - DNA, 17 bp, Homo sapiens
gatgtcctctggactac

SEQ ID NO: 7746376 - DNA, 22 bp, Homo sapiens
gatggtcctcctgctgcctctc

SEQ ID NO: 7746377 - DNA, 22 bp, Homo sapiens
gatgggctggggagaaagcatg

SEQ ID NO: 7746378 - DNA, 19 bp, Homo sapiens
gagtcctgtgctccttgtt

SEQ ID NO: 7746379 - DNA, 18 bp, Homo sapiens
gagtgcggtggtgcacac

SEQ ID NO: 7746380 - DNA, 22 bp, Homo sapiens
gataaacacaaggtgatttcat

SEQ ID NO: 7746381 - DNA, 22 bp, Homo sapiens
gagtttgggtggaaggagggta

SEQ ID NO: 7746382 - DNA, 22 bp, Homo sapiens
gagtttccaaatccctgaaggg

SEQ ID NO: 7746383 - DNA, 22 bp, Homo sapiens
gatcaacaacttttgaatagct

SEQ ID NO: 7746384 - DNA, 22 bp, Homo sapiens
gatcaacatgtatttaagagtt

SEQ ID NO: 7746385 - DNA, 22 bp, Homo sapiens
gatctgggctggagactgagaa

SEQ ID NO: 7746386 - DNA, 22 bp, Homo sapiens
gaggggctctttaatagtaaca

SEQ ID NO: 7746387 - DNA, 22 bp, Homo sapiens
gaggggctcttgggcatgaagg

SEQ ID NO: 7746388 - DNA, 22 bp, Homo sapiens
gaggggcgctgtcgggtcacct

SEQ ID NO: 7746389 - DNA, 22 bp, Homo sapiens
gaggtgtcatgagggcctgctc

SEQ ID NO: 7746390 - DNA, 22 bp, Homo sapiens
gaggggaaagtgtgaggctgcg

SEQ ID NO: 7746391 - DNA, 22 bp, Homo sapiens
gagggcagagtctaatgatgca

SEQ ID NO: 7746392 - DNA, 22 bp, Homo sapiens
gaggctggaggtcaaagatgaa

SEQ ID NO: 7746393 - DNA, 22 bp, Homo sapiens
gaggcctgcagcgtggtccctg

SEQ ID NO: 7746394 - DNA, 22 bp, Homo sapiens
gagagtgattccctcccataga

SEQ ID NO: 7746395 - DNA, 22 bp, Homo sapiens
gaggaagatggttgagtggtcc

SEQ ID NO: 7746396 - DNA, 22 bp, Homo sapiens
gaggaagagcatggccagtttc

SEQ ID NO: 7746397 - DNA, 22 bp, Homo sapiens
gaggaagagagctctgccttgt

SEQ ID NO: 7746398 - DNA, 22 bp, Homo sapiens
gaggagggttggccttaggtag

SEQ ID NO: 7746399 - DNA, 22 bp, Homo sapiens
gaggagggagctggaagctctt

SEQ ID NO: 7746400 - DNA, 22 bp, Homo sapiens
gaggcagctgggctggtggttt

SEQ ID NO: 7746401 - DNA, 18 bp, Homo sapiens
gaggcctgagaaccaggt

SEQ ID NO: 7746402 - DNA, 22 bp, Homo sapiens
ctttgtgatagtgttaagacca

SEQ ID NO: 7746403 - DNA, 22 bp, Homo sapiens
ctttgttctgcacacacagaca

SEQ ID NO: 7746404 - DNA, 22 bp, Homo sapiens
ctttgttgtgcctgagtgcacc

SEQ ID NO: 7746405 - DNA, 22 bp, Homo sapiens
ctttgtattcagttgggctgtg

SEQ ID NO: 7746406 - DNA, 22 bp, Homo sapiens
ctttacaattcaagggaactct

SEQ ID NO: 7746407 - DNA, 22 bp, Homo sapiens
ctttacaacctaagttgaagct

SEQ ID NO: 7746408 - DNA, 22 bp, Homo sapiens
ctttagatggcttaggaggccc

SEQ ID NO: 7746409 - DNA, 22 bp, Homo sapiens
cttggctttagaacatgggagc

SEQ ID NO: 7746410 - DNA, 22 bp, Homo sapiens
cttggattcattgtgggaggga

SEQ ID NO: 7746411 - DNA, 22 bp, Homo sapiens
cttggatatcactcagaaagat

SEQ ID NO: 7746412 - DNA, 21 bp, Homo sapiens
cttggagttggttgaggatgc

SEQ ID NO: 7746413 - DNA, 22 bp, Homo sapiens
cttgggctataaatataaccat

SEQ ID NO: 7746414 - DNA, 22 bp, Homo sapiens
cttggggctgtcactctggcat

SEQ ID NO: 7746415 - DNA, 22 bp, Homo sapiens
cttggggcagcccaggctgagc

SEQ ID NO: 7746416 - DNA, 22 bp, Homo sapiens
cttgggggccattaaggggcct

SEQ ID NO: 7746417 - DNA, 22 bp, Homo sapiens
ctttacaaattagctctcggga

SEQ ID NO: 7746418 - DNA, 22 bp, Homo sapiens
cttcttttacaggtcttgggtt

SEQ ID NO: 7746419 - DNA, 22 bp, Homo sapiens
cttcttttgaagggcgttgtgt

SEQ ID NO: 7746420 - DNA, 22 bp, Homo sapiens
cttcttttcatggcttgggaag

SEQ ID NO: 7746421 - DNA, 22 bp, Homo sapiens
cttcttgaagtcctccagaagt

SEQ ID NO: 7746422 - DNA, 22 bp, Homo sapiens
cttctcagtcttggttagagag

SEQ ID NO: 7746423 - DNA, 22 bp, Homo sapiens
cttctctatgatgttctaaggt

SEQ ID NO: 7746424 - DNA, 22 bp, Homo sapiens
ctggctggttggggagaagaca

SEQ ID NO: 7746425 - DNA, 22 bp, Homo sapiens
ctggctggtcctcggggacagc

SEQ ID NO: 7746426 - DNA, 22 bp, Homo sapiens
ctggctggtcatgtcatgagcc

SEQ ID NO: 7746427 - DNA, 22 bp, Homo sapiens
ctggctggagctgttgtaggct

SEQ ID NO: 7746428 - DNA, 21 bp, Homo sapiens
ctggctctgttgtcacccggc

SEQ ID NO: 7746429 - DNA, 22 bp, Homo sapiens
gacacagatgatcaggtgtgga

SEQ ID NO: 7746430 - DNA, 22 bp, Homo sapiens
gacagctgtggagaggcatgtg

SEQ ID NO: 7746431 - DNA, 22 bp, Homo sapiens
gacagctgtgcaggagaagggg

SEQ ID NO: 7746432 - DNA, 19 bp, Homo sapiens
gacaggaaggctaccagta

SEQ ID NO: 7746433 - DNA, 22 bp, Homo sapiens
gacaggaacataaatgtaggag

SEQ ID NO: 7746434 - DNA, 22 bp, Homo sapiens
gacaggaatgtgtggatgcgga

SEQ ID NO: 7746435 - DNA, 22 bp, Homo sapiens
cctgggtctgtattggtaggta

SEQ ID NO: 7746436 - DNA, 22 bp, Homo sapiens
cctgggtctcctcctgctggct

SEQ ID NO: 7746437 - DNA, 22 bp, Homo sapiens
cctgggtccctgagagatgatt

SEQ ID NO: 7746438 - DNA, 19 bp, Homo sapiens
cctgggtccactcagacta

SEQ ID NO: 7746439 - DNA, 22 bp, Homo sapiens
cctggggctccagagcagcgga

SEQ ID NO: 7746440 - DNA, 22 bp, Homo sapiens
tgtggcaggaagagcttctgag

SEQ ID NO: 7746441 - DNA, 22 bp, Homo sapiens
cctgggaggcagaggttgcagt

SEQ ID NO: 7746442 - DNA, 17 bp, Homo sapiens
cctgggaggagttatga

SEQ ID NO: 7746443 - DNA, 19 bp, Homo sapiens
cctgggaggcggaggttgc

SEQ ID NO: 7746444 - DNA, 22 bp, Homo sapiens
cctgggaggcggaggttgcagg

SEQ ID NO: 7746445 - DNA, 22 bp, Homo sapiens
cctgggaggcggaggttgcagt

SEQ ID NO: 7746446 - DNA, 22 bp, Homo sapiens
cctggctgtttgagcggggaat

SEQ ID NO: 7746447 - DNA, 22 bp, Homo sapiens
cctgggagagccatctgtggcc

SEQ ID NO: 7746448 - DNA, 22 bp, Homo sapiens
cctgggagagtctgtggtctcc

SEQ ID NO: 7746449 - DNA, 22 bp, Homo sapiens
tgtgccagtgccttgggtatta

SEQ ID NO: 7746450 - DNA, 22 bp, Homo sapiens
tggtctttaaggtagctgtcat

SEQ ID NO: 7746451 - DNA, 22 bp, Homo sapiens
tggtctttgagagaagttgatt

SEQ ID NO: 7746452 - DNA, 22 bp, Homo sapiens
tggtctttgtccctccttgatc

SEQ ID NO: 7746453 - DNA, 22 bp, Homo sapiens
cctggctcgctgacctcagggg

SEQ ID NO: 7746454 - DNA, 22 bp, Homo sapiens
cctctgggtatctgtggaagta

SEQ ID NO: 7746455 - DNA, 22 bp, Homo sapiens
cctctgggtgggaggccgggcg

SEQ ID NO: 7746456 - DNA, 22 bp, Homo sapiens
cctctgggggtcctcagagtct

SEQ ID NO: 7746457 - DNA, 22 bp, Homo sapiens
cctctggggtgagtgggccact

SEQ ID NO: 7746458 - DNA, 22 bp, Homo sapiens
cctctgggttagtttagggagc

SEQ ID NO: 7746459 - DNA, 22 bp, Homo sapiens
cctctgggctgcctgcacgggt

SEQ ID NO: 7746460 - DNA, 22 bp, Homo sapiens
cctctggggcatcagacaaagg

SEQ ID NO: 7746461 - DNA, 22 bp, Homo sapiens
cctctctgtcacaccagtggcc

SEQ ID NO: 7746462 - DNA, 20 bp, Homo sapiens
cctagggcaagtgggtgggc

SEQ ID NO: 7746463 - DNA, 22 bp, Homo sapiens
tgcctgggactctgttatcttg

SEQ ID NO: 7746464 - DNA, 22 bp, Homo sapiens
tgcctgggactgtactaaattt

SEQ ID NO: 7746465 - DNA, 22 bp, Homo sapiens
ctggaggaataatggcatcttg

SEQ ID NO: 7746466 - DNA, 22 bp, Homo sapiens
ctggaggcaaagcagaggcatg

SEQ ID NO: 7746467 - DNA, 22 bp, Homo sapiens
ctggaggctgagttgggtctcc

SEQ ID NO: 7746468 - DNA, 22 bp, Homo sapiens
ctggagttagagtagacactga

SEQ ID NO: 7746469 - DNA, 22 bp, Homo sapiens
ctgcctggcccagggatgggcc

SEQ ID NO: 7746470 - DNA, 22 bp, Homo sapiens
ctggaaaatgaagaagcagagg

SEQ ID NO: 7746471 - DNA, 22 bp, Homo sapiens
ctggctctgaccgcgctggcct

SEQ ID NO: 7746472 - DNA, 22 bp, Homo sapiens
ctggcatttagacccacagcaa

SEQ ID NO: 7746473 - DNA, 22 bp, Homo sapiens
ctggcattgagggtcacaaggc

SEQ ID NO: 7746474 - DNA, 22 bp, Homo sapiens
ctggataatcacagaggagcat

SEQ ID NO: 7746475 - DNA, 22 bp, Homo sapiens
ctggataaatgctttagttgga

SEQ ID NO: 7746476 - DNA, 22 bp, Homo sapiens
ctgccgggccctggatttggca

SEQ ID NO: 7746477 - DNA, 22 bp, Homo sapiens
ctgaggagaacaatgagatcaa

SEQ ID NO: 7746478 - DNA, 22 bp, Homo sapiens
ctgcagagcatgaggaggtctg

SEQ ID NO: 7746479 - DNA, 22 bp, Homo sapiens
ctgaagactgctgagaagttac

SEQ ID NO: 7746480 - DNA, 22 bp, Homo sapiens
ctctgggttcactgaggctctg

SEQ ID NO: 7746481 - DNA, 22 bp, Homo sapiens
ctctttgtaaagaagtggtagg

SEQ ID NO: 7746482 - DNA, 22 bp, Homo sapiens
ctctttgtggaacggcagtgtc

SEQ ID NO: 7746483 - DNA, 22 bp, Homo sapiens
ctctttttcagccttaccaaag

SEQ ID NO: 7746484 - DNA, 22 bp, Homo sapiens
ctctttttcacctctgtcagcg

SEQ ID NO: 7746485 - DNA, 22 bp, Homo sapiens
ctctgggatagagcctcggtct

SEQ ID NO: 7746486 - DNA, 18 bp, Homo sapiens
ctctgggagaggcataca

SEQ ID NO: 7746487 - DNA, 22 bp, Homo sapiens
ctctgggatgaggcctaggcac

SEQ ID NO: 7746488 - DNA, 22 bp, Homo sapiens
tttgtcttggcctcagttttct

SEQ ID NO: 7746489 - DNA, 22 bp, Homo sapiens
ttcttggcatcatgaaaaatta

SEQ ID NO: 7746490 - DNA, 22 bp, Homo sapiens
ttcttgttccatgaaagacaga

SEQ ID NO: 7746491 - DNA, 22 bp, Homo sapiens
ctattttgcctgcctagaaatc

SEQ ID NO: 7746492 - DNA, 22 bp, Homo sapiens
ttccttttcttaaacatatgtg

SEQ ID NO: 7746493 - DNA, 22 bp, Homo sapiens
ttcctttgggaaatcactaagg

SEQ ID NO: 7746494 - DNA, 22 bp, Homo sapiens
ctaggcagggtgctgtgccatg

SEQ ID NO: 7746495 - DNA, 22 bp, Homo sapiens
ctaggccttcataggcatggaa

SEQ ID NO: 7746496 - DNA, 22 bp, Homo sapiens
ctaggctgagctgggctgagct

SEQ ID NO: 7746497 - DNA, 22 bp, Homo sapiens
ctaggctgcacctaggatggct

SEQ ID NO: 7746498 - DNA, 22 bp, Homo sapiens
ctaggctgcagatgcatggaat

SEQ ID NO: 7746499 - DNA, 22 bp, Homo sapiens
ctagggagcactagctgccttg

SEQ ID NO: 7746500 - DNA, 22 bp, Homo sapiens
ctagggacagaaagagggtaga

SEQ ID NO: 7746501 - DNA, 22 bp, Homo sapiens
ctagggactgggaccttagtta

SEQ ID NO: 7746502 - DNA, 22 bp, Homo sapiens
ctagggctccaaagctgagaag

SEQ ID NO: 7746503 - DNA, 22 bp, Homo sapiens
ctagggagggatgttggcatga

SEQ ID NO: 7746504 - DNA, 22 bp, Homo sapiens
ctagggagtggcagagctggga

SEQ ID NO: 7746505 - DNA, 22 bp, Homo sapiens
ttcccagaatgaatggatggag

SEQ ID NO: 7746506 - DNA, 22 bp, Homo sapiens
ttccggggatagtgtttcccat

SEQ ID NO: 7746507 - DNA, 22 bp, Homo sapiens
ttccatttattcttgtccagat

SEQ ID NO: 7746508 - DNA, 22 bp, Homo sapiens
ttccatttggcacttcactgag

SEQ ID NO: 7746509 - DNA, 22 bp, Homo sapiens
ttcccaaagctttgtctgtgaa

SEQ ID NO: 7746510 - DNA, 22 bp, Homo sapiens
ttcccaagtctccaatgtggga

SEQ ID NO: 7746511 - DNA, 22 bp, Homo sapiens
ctaatttaatgaatgagtctta

SEQ ID NO: 7746512 - DNA, 22 bp, Homo sapiens
cctgggtggttccggcaaggag

SEQ ID NO: 7746513 - DNA, 22 bp, Homo sapiens
cggctcaggccacaggacggca

SEQ ID NO: 7746514 - DNA, 22 bp, Homo sapiens
cggaagcgttctcagcaggggc

SEQ ID NO: 7746515 - DNA, 22 bp, Homo sapiens
cggaagagggacagcgccagcc

SEQ ID NO: 7746516 - DNA, 22 bp, Homo sapiens
cggctggagctttgaacctgat

SEQ ID NO: 7746517 - DNA, 22 bp, Homo sapiens
cggctggaagctggacaggccg

SEQ ID NO: 7746518 - DNA, 21 bp, Homo sapiens
ctcctgggctaagatatagtg

SEQ ID NO: 7746519 - DNA, 22 bp, Homo sapiens
ctcctgggctcaagtgatcctc

SEQ ID NO: 7746520 - DNA, 18 bp, Homo sapiens
ctcctgggctgcagatgc

SEQ ID NO: 7746521 - DNA, 22 bp, Homo sapiens
ctcctgggagctgtggcagagc

SEQ ID NO: 7746522 - DNA, 22 bp, Homo sapiens
ctcctgggagcagggatggatg

SEQ ID NO: 7746523 - DNA, 22 bp, Homo sapiens
ctcctgggaggatgcggacccg

SEQ ID NO: 7746524 - DNA, 22 bp, Homo sapiens
ctcctgggagtcttcctggatg

SEQ ID NO: 7746525 - DNA, 22 bp, Homo sapiens
tttcagttgtcctgttaatagc

SEQ ID NO: 7746526 - DNA, 22 bp, Homo sapiens
tttcagttcatgtattccgagt

SEQ ID NO: 7746527 - DNA, 22 bp, Homo sapiens
tttacatctcaccagattcata

SEQ ID NO: 7746528 - DNA, 22 bp, Homo sapiens
tttacatctcaccagattcata

SEQ ID NO: 7746529 - DNA, 22 bp, Homo sapiens
ctcctgagaattttcagttgga

SEQ ID NO: 7746530 - DNA, 22 bp, Homo sapiens
ttgggcagaggctgtgcagagg

SEQ ID NO: 7746531 - DNA, 22 bp, Homo sapiens
ttgggcagatgtttcctgtgga

SEQ ID NO: 7746532 - DNA, 22 bp, Homo sapiens
ttgggcaggaacagatgcttga

SEQ ID NO: 7746533 - DNA, 22 bp, Homo sapiens
ttgggcaggcacatagagttta

SEQ ID NO: 7746534 - DNA, 22 bp, Homo sapiens
ttgttaaaggcaaaacaagcac

SEQ ID NO: 7746535 - DNA, 22 bp, Homo sapiens
ctccagggagctgtggaggttt

SEQ ID NO: 7746536 - DNA, 22 bp, Homo sapiens
caggcaagatccagaggctgct

SEQ ID NO: 7746537 - DNA, 22 bp, Homo sapiens
tacaggttacacttttaaaagt

SEQ ID NO: 7746538 - DNA, 22 bp, Homo sapiens
tacatcaaatcaatgttccagt

SEQ ID NO: 7746539 - DNA, 22 bp, Homo sapiens
tacaaactaacatgtctcatcc

SEQ ID NO: 7746540 - DNA, 19 bp, Homo sapiens
tacaagcttttttggcagg

SEQ ID NO: 7746541 - DNA, 22 bp, Homo sapiens
tacagctgttggtgtttcctct

SEQ ID NO: 7746542 - DNA, 22 bp, Homo sapiens
caggaatgaaaggtcagggttg

SEQ ID NO: 7746543 - DNA, 22 bp, Homo sapiens
caggaagctgatgtctagtcat

SEQ ID NO: 7746544 - DNA, 22 bp, Homo sapiens
caggaagcatctggctagctaa

SEQ ID NO: 7746545 - DNA, 22 bp, Homo sapiens
caggacaggagtggggtcaaag

SEQ ID NO: 7746546 - DNA, 22 bp, Homo sapiens
caggacagtataggctttagga

SEQ ID NO: 7746547 - DNA, 22 bp, Homo sapiens
caggaatgggtgacagtcagct

SEQ ID NO: 7746548 - DNA, 22 bp, Homo sapiens
caggaatgtagcagcgatggaa

SEQ ID NO: 7746549 - DNA, 22 bp, Homo sapiens
caggaatgtatgatacagtggt

SEQ ID NO: 7746550 - DNA, 22 bp, Homo sapiens
caggaatgagttctggtgctct

SEQ ID NO: 7746551 - DNA, 22 bp, Homo sapiens
taaaaaacattactctgtcctg

SEQ ID NO: 7746552 - DNA, 22 bp, Homo sapiens
taaaaatcttatgaatggcaag

SEQ ID NO: 7746553 - DNA, 22 bp, Homo sapiens
caggagctgggtctggaagcag

SEQ ID NO: 7746554 - DNA, 22 bp, Homo sapiens
taaatgtactgaggcaacagga

SEQ ID NO: 7746555 - DNA, 22 bp, Homo sapiens
taaatgtataggcactaaacct

SEQ ID NO: 7746556 - DNA, 22 bp, Homo sapiens
caggaagaggacaggcttcccc

SEQ ID NO: 7746557 - DNA, 22 bp, Homo sapiens
caggaagaggtatcaccgagca

SEQ ID NO: 7746558 - DNA, 22 bp, Homo sapiens
caggaagattagaccaagagct

SEQ ID NO: 7746559 - DNA, 22 bp, Homo sapiens
caggaagaggtggggctaaagt

SEQ ID NO: 7746560 - DNA, 22 bp, Homo sapiens
caggaagattgtggaggtggtt

SEQ ID NO: 7746561 - DNA, 22 bp, Homo sapiens
gtttacaacatgccaactgggc

SEQ ID NO: 7746562 - DNA, 22 bp, Homo sapiens
gtttacaaatattttaaatggt

SEQ ID NO: 7746563 - DNA, 22 bp, Homo sapiens
gtttacaacatcttgtccttca

SEQ ID NO: 7746564 - DNA, 21 bp, Homo sapiens
gtttacaaggctttgctcctg

SEQ ID NO: 7746565 - DNA, 22 bp, Homo sapiens
caggaaagggatgggctgccac

SEQ ID NO: 7746566 - DNA, 22 bp, Homo sapiens
gttcccaggccctgggctctcc

SEQ ID NO: 7746567 - DNA, 22 bp, Homo sapiens
gttctgggaaggtggacctgtt

SEQ ID NO: 7746568 - DNA, 22 bp, Homo sapiens
gttctgggtgatgaggttggct

SEQ ID NO: 7746569 - DNA, 22 bp, Homo sapiens
cagcttgtgcaaaggtcctggg

SEQ ID NO: 7746570 - DNA, 22 bp, Homo sapiens
gttcacaagagttacagacaga

SEQ ID NO: 7746571 - DNA, 22 bp, Homo sapiens
cagcttgggagtttggttttat

SEQ ID NO: 7746572 - DNA, 22 bp, Homo sapiens
cagcttggcttcacattctgta

SEQ ID NO: 7746573 - DNA, 22 bp, Homo sapiens
cagctgtgtaaacacatgtgta

SEQ ID NO: 7746574 - DNA, 22 bp, Homo sapiens
cagctgtgtagatgcagggtca

SEQ ID NO: 7746575 - DNA, 22 bp, Homo sapiens
cagctgtgtatgagagcatgct

SEQ ID NO: 7746576 - DNA, 22 bp, Homo sapiens
cagctgtgggcctgacgtggca

SEQ ID NO: 7746577 - DNA, 22 bp, Homo sapiens
cagctgtggggagcttgggcca

SEQ ID NO: 7746578 - DNA, 22 bp, Homo sapiens
cagctgtggctgccactgctcc

SEQ ID NO: 7746579 - DNA, 22 bp, Homo sapiens
cagctgtgatatgcctgcctga

SEQ ID NO: 7746580 - DNA, 22 bp, Homo sapiens
cagctgtgattcctgctgtcca

SEQ ID NO: 7746581 - DNA, 18 bp, Homo sapiens
cagctgtgccctgtttgg

SEQ ID NO: 7746582 - DNA, 22 bp, Homo sapiens
cagctgtgctagaagccacgaa

SEQ ID NO: 7746583 - DNA, 22 bp, Homo sapiens
cagctgtggagggaggaaatgc

SEQ ID NO: 7746584 - DNA, 22 bp, Homo sapiens
cagctgtggagatggggtgcat

SEQ ID NO: 7746585 - DNA, 22 bp, Homo sapiens
cagctgtgctgattgctcagta

SEQ ID NO: 7746586 - DNA, 22 bp, Homo sapiens
cagctgtgctgtattaagctct

SEQ ID NO: 7746587 - DNA, 22 bp, Homo sapiens
gttaaagaagaatagttccttt

SEQ ID NO: 7746588 - DNA, 22 bp, Homo sapiens
gttacaactccctgaacctcgg

SEQ ID NO: 7746589 - DNA, 22 bp, Homo sapiens
cagctgagtttccaagtctgcc

SEQ ID NO: 7746590 - DNA, 22 bp, Homo sapiens
cagctctgcttccttgtacagg

SEQ ID NO: 7746591 - DNA, 22 bp, Homo sapiens
cagctgtctggggagtgctcgc

SEQ ID NO: 7746592 - DNA, 22 bp, Homo sapiens
cagctgtgagagtgcattgaag

SEQ ID NO: 7746593 - DNA, 22 bp, Homo sapiens
cagctgtgagcagccagttgcc

SEQ ID NO: 7746594 - DNA, 22 bp, Homo sapiens
cagctgtgacagccagttgatg

SEQ ID NO: 7746595 - DNA, 22 bp, Homo sapiens
cagctgtgaattgtcttatcta

SEQ ID NO: 7746596 - DNA, 17 bp, Homo sapiens
cagctgtgagagcctta

SEQ ID NO: 7746597 - DNA, 22 bp, Homo sapiens
cagctggggcagccacgtgcgg

SEQ ID NO: 7746598 - DNA, 22 bp, Homo sapiens
gtgtacagtgatttgagttcac

SEQ ID NO: 7746599 - DNA, 22 bp, Homo sapiens
ccagaaaactctacatgcttgt

SEQ ID NO: 7746600 - DNA, 22 bp, Homo sapiens
ccagaaaagcatctggttcttt

SEQ ID NO: 7746601 - DNA, 22 bp, Homo sapiens
tcctggtcagtgccaaactggt

SEQ ID NO: 7746602 - DNA, 22 bp, Homo sapiens
ccagatatcactgccgtgttgt

SEQ ID NO: 7746603 - DNA, 22 bp, Homo sapiens
ccagatggtatagtagggagag

SEQ ID NO: 7746604 - DNA, 22 bp, Homo sapiens
ccagatggtttgcatgggaggg

SEQ ID NO: 7746605 - DNA, 22 bp, Homo sapiens
ccaaatcaggggccacaagcat

SEQ ID NO: 7746606 - DNA, 22 bp, Homo sapiens
ccaaatcaccagcacgatcatt

SEQ ID NO: 7746607 - DNA, 22 bp, Homo sapiens
ccaaaaattagatacacatata

SEQ ID NO: 7746608 - DNA, 22 bp, Homo sapiens
catttagtacaacttttacagt

SEQ ID NO: 7746609 - DNA, 22 bp, Homo sapiens
ccaggaagcggtgagggctgcc

SEQ ID NO: 7746610 - DNA, 22 bp, Homo sapiens
ccaggaagcctttttctttgac

SEQ ID NO: 7746611 - DNA, 22 bp, Homo sapiens
ccaggaaggaagcaggggtttc

SEQ ID NO: 7746612 - DNA, 22 bp, Homo sapiens
ccaggaagctgtgagattccaa

SEQ ID NO: 7746613 - DNA, 22 bp, Homo sapiens
ccaggaagctgtctgatatgaa

SEQ ID NO: 7746614 - DNA, 22 bp, Homo sapiens
ccaggaagctctgctccacggg

SEQ ID NO: 7746615 - DNA, 21 bp, Homo sapiens
ccaggaaggactgagctccct

SEQ ID NO: 7746616 - DNA, 22 bp, Homo sapiens
ccaggaagatttattttggctt

SEQ ID NO: 7746617 - DNA, 22 bp, Homo sapiens
ccaggaagcataatgtagtggg

SEQ ID NO: 7746618 - DNA, 23 bp, Homo sapiens
ccaggaagaggccatccacagtc

SEQ ID NO: 7746619 - DNA, 22 bp, Homo sapiens
ccaggaagcctcagatgctgag

SEQ ID NO: 7746620 - DNA, 22 bp, Homo sapiens
ccaggaagcctgtgtctctgga

SEQ ID NO: 7746621 - DNA, 22 bp, Homo sapiens
ccaggaagacacatgctcatcc

SEQ ID NO: 7746622 - DNA, 22 bp, Homo sapiens
ccaggaagaaacagtctttata

SEQ ID NO: 7746623 - DNA, 22 bp, Homo sapiens
tctggagcttgtttcagatggt

SEQ ID NO: 7746624 - DNA, 22 bp, Homo sapiens
ccagctgtcactcagaaaggcc

SEQ ID NO: 7746625 - DNA, 22 bp, Homo sapiens
ccagctgtaggcagggggttta

SEQ ID NO: 7746626 - DNA, 22 bp, Homo sapiens
ccagctgtctggttccagagcc

SEQ ID NO: 7746627 - DNA, 22 bp, Homo sapiens
ccagctgtcagtgtgaaaataa

SEQ ID NO: 7746628 - DNA, 22 bp, Homo sapiens
ccagctgtgccgtgtggatagc

SEQ ID NO: 7746629 - DNA, 22 bp, Homo sapiens
ccagctgtgcctaggagcaggg

SEQ ID NO: 7746630 - DNA, 22 bp, Homo sapiens
ccagctgtgccggggacctggg

SEQ ID NO: 7746631 - DNA, 18 bp, Homo sapiens
ccagctgtgcagcatctg

SEQ ID NO: 7746632 - DNA, 22 bp, Homo sapiens
ccagctgtcttgagaggaggca

SEQ ID NO: 7746633 - DNA, 21 bp, Homo sapiens
ccagctgtctgtccttaggca

SEQ ID NO: 7746634 - DNA, 22 bp, Homo sapiens
ccagctgtttctgatgctaggc

SEQ ID NO: 7746635 - DNA, 22 bp, Homo sapiens
ccagctgttggagtttcactgc

SEQ ID NO: 7746636 - DNA, 21 bp, Homo sapiens
ccagctgttcctcgtccgatg

SEQ ID NO: 7746637 - DNA, 22 bp, Homo sapiens
ccagctgtgctgttggcttgtc

SEQ ID NO: 7746638 - DNA, 23 bp, Homo sapiens
ccagctgtgcctggcccaggagc

SEQ ID NO: 7746639 - DNA, 22 bp, Homo sapiens
ccagctggtaagtgatggagcc

SEQ ID NO: 7746640 - DNA, 22 bp, Homo sapiens
tctcttgagctcagttctgatg

SEQ ID NO: 7746641 - DNA, 22 bp, Homo sapiens
tctctcttcatgcttttagaat

SEQ ID NO: 7746642 - DNA, 22 bp, Homo sapiens
tcaggaagtggtaaaggatgtt

SEQ ID NO: 7746643 - DNA, 22 bp, Homo sapiens
tcaggaagttgaggcgtagaga

SEQ ID NO: 7746644 - DNA, 22 bp, Homo sapiens
tcaggaagtctcaattagctac

SEQ ID NO: 7746645 - DNA, 22 bp, Homo sapiens
tcaggaagtgcctaggctggcc

SEQ ID NO: 7746646 - DNA, 22 bp, Homo sapiens
tcaggaagtgctgaggctgctt

SEQ ID NO: 7746647 - DNA, 19 bp, Homo sapiens
tcaggaagttgatgaggtg

SEQ ID NO: 7746648 - DNA, 22 bp, Homo sapiens
cataatttttttaagtcagaac

SEQ ID NO: 7746649 - DNA, 22 bp, Homo sapiens
catacattgaatttgcacgtgt

SEQ ID NO: 7746650 - DNA, 22 bp, Homo sapiens
catacattgctcattcagtatc

SEQ ID NO: 7746651 - DNA, 22 bp, Homo sapiens
catacatttatacacatctatg

SEQ ID NO: 7746652 - DNA, 22 bp, Homo sapiens
tatctcttgtctgttttgcaaa

SEQ ID NO: 7746653 - DNA, 22 bp, Homo sapiens
tatctctttcattttagagtca

SEQ ID NO: 7746654 - DNA, 22 bp, Homo sapiens
tgtgacagatctctatacatga

SEQ ID NO: 7746655 - DNA, 22 bp, Homo sapiens
tgtgacagcacggttcaactgc

SEQ ID NO: 7746656 - DNA, 22 bp, Homo sapiens
tgtgctctacctcagtgtcatt

SEQ ID NO: 7746657 - DNA, 22 bp, Homo sapiens
tgttcttttctctaaactgata

SEQ ID NO: 7746658 - DNA, 22 bp, Homo sapiens
tgttctttcagttagacacagt

SEQ ID NO: 7746659 - DNA, 18 bp, Homo sapiens
tgtttatttttctcttac

SEQ ID NO: 7746660 - DNA, 22 bp, Homo sapiens
tgtggctgcaaaggaaggctgc

SEQ ID NO: 7746661 - DNA, 22 bp, Homo sapiens
tgtgggacctcagagggtcccc

SEQ ID NO: 7746662 - DNA, 22 bp, Homo sapiens
tgtgggcaggcccgggtctgag

SEQ ID NO: 7746663 - DNA, 22 bp, Homo sapiens
ttacaagataacctgatgctgt

SEQ ID NO: 7746664 - DNA, 22 bp, Homo sapiens
ttacaagataacggagaaagca

SEQ ID NO: 7746665 - DNA, 22 bp, Homo sapiens
ttacaagcagctacatatcaca

SEQ ID NO: 7746666 - DNA, 20 bp, Homo sapiens
ttacaagccttgttaaatct

SEQ ID NO: 7746667 - DNA, 22 bp, Homo sapiens
ttacaagctaattgtttcagct

SEQ ID NO: 7746668 - DNA, 19 bp, Homo sapiens
ttacaagcattgaaagaaa

SEQ ID NO: 7746669 - DNA, 22 bp, Homo sapiens
ttacaacaaaggcacgtgcatg

SEQ ID NO: 7746670 - DNA, 22 bp, Homo sapiens
ttacaacaccaggcagtatcct

SEQ ID NO: 7746671 - DNA, 17 bp, Homo sapiens
ttacaacaattcatgag

SEQ ID NO: 7746672 - DNA, 22 bp, Homo sapiens
ttacaacactacttatccttga

SEQ ID NO: 7746673 - DNA, 22 bp, Homo sapiens
ttacaacagcgatttacctgtc

SEQ ID NO: 7746674 - DNA, 22 bp, Homo sapiens
ttacaacagacacatattctaa

SEQ ID NO: 7746675 - DNA, 22 bp, Homo sapiens
ttacaactgggcttgtcagctt

SEQ ID NO: 7746676 - DNA, 22 bp, Homo sapiens
ttacaacatatttagcttgatt

SEQ ID NO: 7746677 - DNA, 21 bp, Homo sapiens
ttacaacatttgtgttctatg

SEQ ID NO: 7746678 - DNA, 23 bp, Homo sapiens
ttacaacagtgtccatatttgta

SEQ ID NO: 7746679 - DNA, 22 bp, Homo sapiens
ttacaacatatgataggagtct

SEQ ID NO: 7746680 - DNA, 22 bp, Homo sapiens
ttaaagcagtttgtatacatgg

SEQ ID NO: 7746681 - DNA, 22 bp, Homo sapiens
ttaaagacatcacagattacac

SEQ ID NO: 7746682 - DNA, 22 bp, Homo sapiens
ttagggttacaccagcctcctg

SEQ ID NO: 7746683 - DNA, 22 bp, Homo sapiens
ttagaacatagcaacagaatta

SEQ ID NO: 7746684 - DNA, 22 bp, Homo sapiens
ttagaacactgagaaagtgatg

SEQ ID NO: 7746685 - DNA, 22 bp, Homo sapiens
ttattcagtgcatatattaaaa

SEQ ID NO: 7746686 - DNA, 20 bp, Homo sapiens
ttatttctcattctcctact

SEQ ID NO: 7746687 - DNA, 22 bp, Homo sapiens
ttatttggttgctgacttggaa

SEQ ID NO: 7746688 - DNA, 22 bp, Homo sapiens
ttccagaggcttcagggaagaa

SEQ ID NO: 7746689 - DNA, 22 bp, Homo sapiens
tggtcctgtagctctctaagtt

SEQ ID NO: 7746690 - DNA, 22 bp, Homo sapiens
tggtcctggggtgcaggctgac

SEQ ID NO: 7746691 - DNA, 23 bp, Homo sapiens
tggtcctggttgaggtgggcccc

SEQ ID NO: 7746692 - DNA, 22 bp, Homo sapiens
tggtcctggtagcggtgtgctt

SEQ ID NO: 7746693 - DNA, 22 bp, Homo sapiens
tggtcctggtcatctgggctgg

SEQ ID NO: 7746694 - DNA, 22 bp, Homo sapiens
tggtgaggtcatagagaactgt

SEQ ID NO: 7746695 - DNA, 22 bp, Homo sapiens
tggtgaggccaaagccatgaca

SEQ ID NO: 7746696 - DNA, 22 bp, Homo sapiens
tggtcctggaaggtcctgaggg

SEQ ID NO: 7746697 - DNA, 22 bp, Homo sapiens
tggtcctgatcaccgctgggca

SEQ ID NO: 7746698 - DNA, 22 bp, Homo sapiens
tggtcaggggcttctgagctgt

SEQ ID NO: 7746699 - DNA, 22 bp, Homo sapiens
tggtgggagtgagggcatgcca

SEQ ID NO: 7746700 - DNA, 22 bp, Homo sapiens
tgtacacaattcttaacataca

SEQ ID NO: 7746701 - DNA, 20 bp, Homo sapiens
tgtacacagtactttacaat

SEQ ID NO: 7746702 - DNA, 17 bp, Homo sapiens
tggttcttttcattccc

SEQ ID NO: 7746703 - DNA, 22 bp, Homo sapiens
tggtggttatgcgctttgtggg

SEQ ID NO: 7746704 - DNA, 22 bp, Homo sapiens
tggtgtttaatgggctgtttat

SEQ ID NO: 7746705 - DNA, 22 bp, Homo sapiens
tgtatttaattgtatcatcaca

SEQ ID NO: 7746706 - DNA, 22 bp, Homo sapiens
tgtatttaagctttacctaaaa

SEQ ID NO: 7746707 - DNA, 22 bp, Homo sapiens
tgtagaaggctatagactagga

SEQ ID NO: 7746708 - DNA, 22 bp, Homo sapiens
tgtagaagttcttcaggagaat

SEQ ID NO: 7746709 - DNA, 22 bp, Homo sapiens
tgtatcagatcaaatactggct

SEQ ID NO: 7746710 - DNA, 22 bp, Homo sapiens
tgggggctgtgcacaggctcac

SEQ ID NO: 7746711 - DNA, 22 bp, Homo sapiens
tgggtccttgccatcttggagt

SEQ ID NO: 7746712 - DNA, 22 bp, Homo sapiens
tgggtcctcgtcttccaaggca

SEQ ID NO: 7746713 - DNA, 22 bp, Homo sapiens
tgggtagggcctgcgcctgtgc

SEQ ID NO: 7746714 - DNA, 22 bp, Homo sapiens
tgggtgagtggagggcattcta

SEQ ID NO: 7746715 - DNA, 22 bp, Homo sapiens
tgggtgaggagaggctgtctaa

SEQ ID NO: 7746716 - DNA, 22 bp, Homo sapiens
tgggttccctgacagcgatgct

SEQ ID NO: 7746717 - DNA, 22 bp, Homo sapiens
tggtatttcctcattctgcttt

SEQ ID NO: 7746718 - DNA, 22 bp, Homo sapiens
tggtatttaagacttcactcct

SEQ ID NO: 7746719 - DNA, 22 bp, Homo sapiens
tggggcctgaggtggagctgca

SEQ ID NO: 7746720 - DNA, 19 bp, Homo sapiens
tggggcctcctgtccctgg

SEQ ID NO: 7746721 - DNA, 22 bp, Homo sapiens
tggggccagggaggaccagaca

SEQ ID NO: 7746722 - DNA, 22 bp, Homo sapiens
tggggccagcggggaggactca

SEQ ID NO: 7746723 - DNA, 22 bp, Homo sapiens
tggggctctccacagtgtctca

SEQ ID NO: 7746724 - DNA, 22 bp, Homo sapiens
tggggctggcacagtctctatt

SEQ ID NO: 7746725 - DNA, 22 bp, Homo sapiens
tggggcctgcacaggctgaatg

SEQ ID NO: 7746726 - DNA, 22 bp, Homo sapiens
tggggcctggtcagagctgcac

SEQ ID NO: 7746727 - DNA, 22 bp, Homo sapiens
tggggctaaacacgcctggcct

SEQ ID NO: 7746728 - DNA, 20 bp, Homo sapiens
tggggcctgtttctgtggtt

SEQ ID NO: 7746729 - DNA, 22 bp, Homo sapiens
tgggggctgagtaagatgagat

SEQ ID NO: 7746730 - DNA, 22 bp, Homo sapiens
tggggctgtccttagtctgaga

SEQ ID NO: 7746731 - DNA, 22 bp, Homo sapiens
tgggggagagtttagatgattt

SEQ ID NO: 7746732 - DNA, 17 bp, Homo sapiens
tggggaagctcagattt

SEQ ID NO: 7746733 - DNA, 22 bp, Homo sapiens
tggggaaaagcgttaggagttc

SEQ ID NO: 7746734 - DNA, 18 bp, Homo sapiens
tgggctcaaaggatcctc

SEQ ID NO: 7746735 - DNA, 22 bp, Homo sapiens
tgggctagatatttttgggctg

SEQ ID NO: 7746736 - DNA, 22 bp, Homo sapiens
tgggctcagcctcagtctgtgg

SEQ ID NO: 7746737 - DNA, 22 bp, Homo sapiens
tgggctctgaagtcagtctgct

SEQ ID NO: 7746738 - DNA, 22 bp, Homo sapiens
tgggctctggaattgagtggcc

SEQ ID NO: 7746739 - DNA, 22 bp, Homo sapiens
tgggctctggagggcctaggat

SEQ ID NO: 7746740 - DNA, 22 bp, Homo sapiens
tgggctctgggtggcctgagca

SEQ ID NO: 7746741 - DNA, 22 bp, Homo sapiens
tgggctctcctggaggacaaca

SEQ ID NO: 7746742 - DNA, 22 bp, Homo sapiens
tgggctcagtctgcttggtcct

SEQ ID NO: 7746743 - DNA, 22 bp, Homo sapiens
tgggctctctcacctggaggct

SEQ ID NO: 7746744 - DNA, 22 bp, Homo sapiens
tgggcctcctggaagaatgtgg

SEQ ID NO: 7746745 - DNA, 22 bp, Homo sapiens
tgggcagggtctctgttatcag

SEQ ID NO: 7746746 - DNA, 22 bp, Homo sapiens
tgggcaggggccctgcttccgt

SEQ ID NO: 7746747 - DNA, 22 bp, Homo sapiens
tgggccagcactgggtgctcat

SEQ ID NO: 7746748 - DNA, 22 bp, Homo sapiens
tgggcagggagctggaaccaca

SEQ ID NO: 7746749 - DNA, 22 bp, Homo sapiens
tgggcagatgtcctctgaagtg

SEQ ID NO: 7746750 - DNA, 22 bp, Homo sapiens
tgggcagaggctctgaagtcca

SEQ ID NO: 7746751 - DNA, 22 bp, Homo sapiens
tgggattcaccatgggcttcag

SEQ ID NO: 7746752 - DNA, 22 bp, Homo sapiens
tgggaggtctcttgcggcctag

SEQ ID NO: 7746753 - DNA, 22 bp, Homo sapiens
tgggaggcttccagaccttgct

SEQ ID NO: 7746754 - DNA, 22 bp, Homo sapiens
tgctggggtcatggggcgcccg

SEQ ID NO: 7746755 - DNA, 20 bp, Homo sapiens
tgctggggacatacagggtg

SEQ ID NO: 7746756 - DNA, 23 bp, Homo sapiens
tgctggagaagcaaagttctgag

SEQ ID NO: 7746757 - DNA, 22 bp, Homo sapiens
tgctcattggcgatctgaggga

SEQ ID NO: 7746758 - DNA, 17 bp, Homo sapiens
tgctcctgggacaagga

SEQ ID NO: 7746759 - DNA, 22 bp, Homo sapiens
tgctcctggcttcaggttgggc

SEQ ID NO: 7746760 - DNA, 22 bp, Homo sapiens
tgctcctatcctcctgctgaca

SEQ ID NO: 7746761 - DNA, 22 bp, Homo sapiens
tggaaaatgtgactattctaaa

SEQ ID NO: 7746762 - DNA, 22 bp, Homo sapiens
tggaacctggcctgagctacca

SEQ ID NO: 7746763 - DNA, 22 bp, Homo sapiens
tggaacctggcattagggacac

SEQ ID NO: 7746764 - DNA, 22 bp, Homo sapiens
tggaacctggtgatgtacaagt

SEQ ID NO: 7746765 - DNA, 22 bp, Homo sapiens
tggaagagaaaggagtggatct

SEQ ID NO: 7746766 - DNA, 22 bp, Homo sapiens
tggaagagaaaatccaccctta

SEQ ID NO: 7746767 - DNA, 22 bp, Homo sapiens
tggaagagacacttacattcag

SEQ ID NO: 7746768 - DNA, 19 bp, Homo sapiens
tggaagaggaagggaaata

SEQ ID NO: 7746769 - DNA, 22 bp, Homo sapiens
tggaagagcaggcagacaatgc

SEQ ID NO: 7746770 - DNA, 22 bp, Homo sapiens
tggaagaggtggaagtggcttc

SEQ ID NO: 7746771 - DNA, 22 bp, Homo sapiens
tggaagagggagctgggtggcc

SEQ ID NO: 7746772 - DNA, 22 bp, Homo sapiens
tggaagaggcccatgactgcct

SEQ ID NO: 7746773 - DNA, 22 bp, Homo sapiens
tggaagaggccagaaagtggga

SEQ ID NO: 7746774 - DNA, 20 bp, Homo sapiens
tggaagaggagatgcctctg

SEQ ID NO: 7746775 - DNA, 22 bp, Homo sapiens
tggaagcggacgttgtggggtg

SEQ ID NO: 7746776 - DNA, 22 bp, Homo sapiens
tggactgggctaatggcagaca

SEQ ID NO: 7746777 - DNA, 21 bp, Homo sapiens
tggactggtgagtttaggctg

SEQ ID NO: 7746778 - DNA, 22 bp, Homo sapiens
tggactgatgctccctattgaa

SEQ ID NO: 7746779 - DNA, 19 bp, Homo sapiens
tggacctgtgcccatggct

SEQ ID NO: 7746780 - DNA, 23 bp, Homo sapiens
tggaggttttactgagttgagga

SEQ ID NO: 7746781 - DNA, 23 bp, Homo sapiens
tggagcctgggatacaatagatg

SEQ ID NO: 7746782 - DNA, 22 bp, Homo sapiens
tggagcctgagtcagcggaggc

SEQ ID NO: 7746783 - DNA, 22 bp, Homo sapiens
tggagcctcctcacactgtggc

SEQ ID NO: 7746784 - DNA, 22 bp, Homo sapiens
tggagcaggaagtctatggctg

SEQ ID NO: 7746785 - DNA, 22 bp, Homo sapiens
tggagaaagctgcatatggaaa

SEQ ID NO: 7746786 - DNA, 22 bp, Homo sapiens
tggagaggttgaataacttgtc

SEQ ID NO: 7746787 - DNA, 22 bp, Homo sapiens
tggagcagagatgggagcccaa

SEQ ID NO: 7746788 - DNA, 22 bp, Homo sapiens
tggcctggaacctggcagggac

SEQ ID NO: 7746789 - DNA, 22 bp, Homo sapiens
tggcctggaaaaatgcagatgg

SEQ ID NO: 7746790 - DNA, 23 bp, Homo sapiens
tggcctggagagaaaagatgagt

SEQ ID NO: 7746791 - DNA, 22 bp, Homo sapiens
tggcatttcctcagtgctcaga

SEQ ID NO: 7746792 - DNA, 20 bp, Homo sapiens
tggcagagttgtcccaccca

SEQ ID NO: 7746793 - DNA, 22 bp, Homo sapiens
tggcagagtggaccatactcaa

SEQ ID NO: 7746794 - DNA, 22 bp, Homo sapiens
tggcagagtgcggcatcccctg

SEQ ID NO: 7746795 - DNA, 22 bp, Homo sapiens
tggatttcagcatatggatttt

SEQ ID NO: 7746796 - DNA, 22 bp, Homo sapiens
tggatttcagcaagggtgggtg

SEQ ID NO: 7746797 - DNA, 22 bp, Homo sapiens
tggcacctgaacttagaggtgt

SEQ ID NO: 7746798 - DNA, 23 bp, Homo sapiens
tggcagagacccagaatctacat

SEQ ID NO: 7746799 - DNA, 22 bp, Homo sapiens
tggcagagagagtgcagtcgac

SEQ ID NO: 7746800 - DNA, 22 bp, Homo sapiens
tggcagagctggctgcggatga

SEQ ID NO: 7746801 - DNA, 22 bp, Homo sapiens
tggcagagcccagactccagtc

SEQ ID NO: 7746802 - DNA, 22 bp, Homo sapiens
tggcagagcaaaaagatagaat

SEQ ID NO: 7746803 - DNA, 22 bp, Homo sapiens
tgggaagatgaggtgccatggg

SEQ ID NO: 7746804 - DNA, 23 bp, Homo sapiens
tgggacctgtttgcccacagatg

SEQ ID NO: 7746805 - DNA, 22 bp, Homo sapiens
tgggacctgttacattgagtta

SEQ ID NO: 7746806 - DNA, 22 bp, Homo sapiens
tgggacctgccctggccccatc

SEQ ID NO: 7746807 - DNA, 21 bp, Homo sapiens
tgggacctagctttgcacagg

SEQ ID NO: 7746808 - DNA, 22 bp, Homo sapiens
tgggacctctcttgagagagca

SEQ ID NO: 7746809 - DNA, 22 bp, Homo sapiens
tgggacctgaagcaggttggca

SEQ ID NO: 7746810 - DNA, 21 bp, Homo sapiens
tgggacctatttcaactggat

SEQ ID NO: 7746811 - DNA, 22 bp, Homo sapiens
tgggactgctcttgctggggtc

SEQ ID NO: 7746812 - DNA, 22 bp, Homo sapiens
tgggactgtgacctccagggta

SEQ ID NO: 7746813 - DNA, 20 bp, Homo sapiens
tgggactgacccatctgagc

SEQ ID NO: 7746814 - DNA, 22 bp, Homo sapiens
tgggagctggggttggacgtct

SEQ ID NO: 7746815 - DNA, 22 bp, Homo sapiens
tgggagctctgagcctgctgtg

SEQ ID NO: 7746816 - DNA, 20 bp, Homo sapiens
tgggagctggtgaggtctca

SEQ ID NO: 7746817 - DNA, 22 bp, Homo sapiens
tgggaggatctcttgaggccag

SEQ ID NO: 7746818 - DNA, 22 bp, Homo sapiens
tgggaggatcgcttgagcccag

SEQ ID NO: 7746819 - DNA, 22 bp, Homo sapiens
tgggagctcctggagggcagga

SEQ ID NO: 7746820 - DNA, 22 bp, Homo sapiens
tgggagaaagaaccctgagtga

SEQ ID NO: 7746821 - DNA, 22 bp, Homo sapiens
tggctgttactcttttcatttc

SEQ ID NO: 7746822 - DNA, 22 bp, Homo sapiens
tggctggggcctgaatcctgca

SEQ ID NO: 7746823 - DNA, 22 bp, Homo sapiens
tggctggatgtgagatcaagag

SEQ ID NO: 7746824 - DNA, 22 bp, Homo sapiens
tggctggatatcagaggaagtg

SEQ ID NO: 7746825 - DNA, 21 bp, Homo sapiens
tggctggatagatgggaactg

SEQ ID NO: 7746826 - DNA, 22 bp, Homo sapiens
tggctggagtataggagtagga

SEQ ID NO: 7746827 - DNA, 22 bp, Homo sapiens
tggctggagtctggtgctagcc

SEQ ID NO: 7746828 - DNA, 22 bp, Homo sapiens
tggctggaggaaggaactgagg

SEQ ID NO: 7746829 - DNA, 22 bp, Homo sapiens
tggctggaggcatgcaagctcc

SEQ ID NO: 7746830 - DNA, 22 bp, Homo sapiens
tggctggagggttagtgagata

SEQ ID NO: 7746831 - DNA, 22 bp, Homo sapiens
tggctggacctgggctggaatt

SEQ ID NO: 7746832 - DNA, 22 bp, Homo sapiens
tggctggagaacttggggatct

SEQ ID NO: 7746833 - DNA, 22 bp, Homo sapiens
tggctggacagtgggcagtgga

SEQ ID NO: 7746834 - DNA, 18 bp, Homo sapiens
tggctggcagtgggcagc

SEQ ID NO: 7746835 - DNA, 22 bp, Homo sapiens
tgggaactggggcattgtttct

SEQ ID NO: 7746836 - DNA, 22 bp, Homo sapiens
tggctggaaacaggagattcag

SEQ ID NO: 7746837 - DNA, 22 bp, Homo sapiens
tggctggaagtcagaaatggga

SEQ ID NO: 7746838 - DNA, 22 bp, Homo sapiens
tggctggaatatgtggagacca

SEQ ID NO: 7746839 - DNA, 22 bp, Homo sapiens
tggctcctttccagcctggttt

SEQ ID NO: 7746840 - DNA, 22 bp, Homo sapiens
tggctcctttccgggtctccag

SEQ ID NO: 7746841 - DNA, 22 bp, Homo sapiens
tggctctgctgaacctagtgca

SEQ ID NO: 7746842 - DNA, 21 bp, Homo sapiens
tggctctgctcagagcagtcc

SEQ ID NO: 7746843 - DNA, 22 bp, Homo sapiens
tggctctgttgctcgcagtttt

SEQ ID NO: 7746844 - DNA, 22 bp, Homo sapiens
tggctctgttcgccatcaggag

SEQ ID NO: 7746845 - DNA, 19 bp, Homo sapiens
tggctctgtttctctggag

SEQ ID NO: 7746846 - DNA, 22 bp, Homo sapiens
tggctctgttgtgctgagccag

SEQ ID NO: 7746847 - DNA, 22 bp, Homo sapiens
tggctcttggtgctagtttctg

SEQ ID NO: 7746848 - DNA, 22 bp, Homo sapiens
tggctctgggcaccgtgtccac

SEQ ID NO: 7746849 - DNA, 22 bp, Homo sapiens
tggctctggagctggcggctga

SEQ ID NO: 7746850 - DNA, 22 bp, Homo sapiens
tggctctgtgcttctagtatct

SEQ ID NO: 7746851 - DNA, 22 bp, Homo sapiens
tggctcctcttctgggtgtccc

SEQ ID NO: 7746852 - DNA, 20 bp, Homo sapiens
tggctcctcttggctgtggc

SEQ ID NO: 7746853 - DNA, 20 bp, Homo sapiens
tggctcctgcggtggaacca

SEQ ID NO: 7746854 - DNA, 22 bp, Homo sapiens
tggctcctatcaaggagtgggt

SEQ ID NO: 7746855 - DNA, 22 bp, Homo sapiens
tggctcctaggatggtgcctgg

SEQ ID NO: 7746856 - DNA, 22 bp, Homo sapiens
tggctcagataattcaaggggc

SEQ ID NO: 7746857 - DNA, 22 bp, Homo sapiens
tctttgtttgtactgttagaat

SEQ ID NO: 7746858 - DNA, 20 bp, Homo sapiens
tctttgtgtcagatggacag

SEQ ID NO: 7746859 - DNA, 22 bp, Homo sapiens
tctttgtgttcaggagccacgt

SEQ ID NO: 7746860 - DNA, 22 bp, Homo sapiens
tcttttatctgttgtgtaacaa

SEQ ID NO: 7746861 - DNA, 22 bp, Homo sapiens
tcttttgtggatgaagaaatgg

SEQ ID NO: 7746862 - DNA, 22 bp, Homo sapiens
tctttgcaggccaaattgttaa

SEQ ID NO: 7746863 - DNA, 22 bp, Homo sapiens
tctttgattttgttactaagac

SEQ ID NO: 7746864 - DNA, 22 bp, Homo sapiens
tctttgcatggacatgtgtttt

SEQ ID NO: 7746865 - DNA, 22 bp, Homo sapiens
tctttgcattcctgtgtgcttt

SEQ ID NO: 7746866 - DNA, 22 bp, Homo sapiens
tctttgctgagtacatctccaa

SEQ ID NO: 7746867 - DNA, 22 bp, Homo sapiens
tctttgtggcgggcttaaatac

SEQ ID NO: 7746868 - DNA, 22 bp, Homo sapiens
tctttgtgccatgcagtgaggc

SEQ ID NO: 7746869 - DNA, 22 bp, Homo sapiens
tgaaaactccaagtttcatcag

SEQ ID NO: 7746870 - DNA, 22 bp, Homo sapiens
tgaaaagtgatcatggattagg

SEQ ID NO: 7746871 - DNA, 22 bp, Homo sapiens
tctttttatattgacaaaaggt

SEQ ID NO: 7746872 - DNA, 23 bp, Homo sapiens
tctttttaagagatctagtgacg

SEQ ID NO: 7746873 - DNA, 22 bp, Homo sapiens
tgaagacagggtctttaacgag

SEQ ID NO: 7746874 - DNA, 22 bp, Homo sapiens
tgaactttgtagtaatggagat

SEQ ID NO: 7746875 - DNA, 22 bp, Homo sapiens
tgaaccctgacctctggaagga

SEQ ID NO: 7746876 - DNA, 22 bp, Homo sapiens
tgaacatgctgttgatggcctg

SEQ ID NO: 7746877 - DNA, 22 bp, Homo sapiens
tgaaatctgcatgcaaagtcct

SEQ ID NO: 7746878 - DNA, 22 bp, Homo sapiens
tgacttcctgcactcaggtgat

SEQ ID NO: 7746879 - DNA, 22 bp, Homo sapiens
tgacagctgagccccaggcaag

SEQ ID NO: 7746880 - DNA, 22 bp, Homo sapiens
tgacagctgaggcccagagtac

SEQ ID NO: 7746881 - DNA, 22 bp, Homo sapiens
tgagcctgggagatggaggctg

SEQ ID NO: 7746882 - DNA, 22 bp, Homo sapiens
tgagcctggggcctgggcagcg

SEQ ID NO: 7746883 - DNA, 22 bp, Homo sapiens
tgagcctgggtggtcgaggctg

SEQ ID NO: 7746884 - DNA, 22 bp, Homo sapiens
tgagcctggagtcgtggagggg

SEQ ID NO: 7746885 - DNA, 22 bp, Homo sapiens
tgaggggccgcccaagcacttc

SEQ ID NO: 7746886 - DNA, 22 bp, Homo sapiens
tgagggtctggaatctgggctt

SEQ ID NO: 7746887 - DNA, 22 bp, Homo sapiens
tgaggttcagttcttggccaca

SEQ ID NO: 7746888 - DNA, 22 bp, Homo sapiens
tgaggggagacagagtggactc

SEQ ID NO: 7746889 - DNA, 22 bp, Homo sapiens
tgaggggagaagcagcagcctg

SEQ ID NO: 7746890 - DNA, 22 bp, Homo sapiens
tgaggggaaggcatgataaata

SEQ ID NO: 7746891 - DNA, 22 bp, Homo sapiens
tgaggggaggttggggcacatc

SEQ ID NO: 7746892 - DNA, 22 bp, Homo sapiens
tgaggggcagagaggtgtccag

SEQ ID NO: 7746893 - DNA, 22 bp, Homo sapiens
tgaggggatacggtacacattg

SEQ ID NO: 7746894 - DNA, 22 bp, Homo sapiens
tgaggggagctagcatgccttg

SEQ ID NO: 7746895 - DNA, 22 bp, Homo sapiens
tgaggggagcccgccctggacg

SEQ ID NO: 7746896 - DNA, 19 bp, Homo sapiens
tgaggggaggagaggcctg

SEQ ID NO: 7746897 - DNA, 22 bp, Homo sapiens
tgagggaggcctccatctgcca

SEQ ID NO: 7746898 - DNA, 22 bp, Homo sapiens
tgaggctcttcctcccctgctc

SEQ ID NO: 7746899 - DNA, 22 bp, Homo sapiens
tgaggctctgcttctgtggctc

SEQ ID NO: 7746900 - DNA, 22 bp, Homo sapiens
tgaggctctccaagcagatgag

SEQ ID NO: 7746901 - DNA, 17 bp, Homo sapiens
tgaggctcggtgaggag

SEQ ID NO: 7746902 - DNA, 22 bp, Homo sapiens
tgaggctgccttgggaagaggg

SEQ ID NO: 7746903 - DNA, 22 bp, Homo sapiens
tgaggctggcaaggctggtatt

SEQ ID NO: 7746904 - DNA, 22 bp, Homo sapiens
tgaggctcagagaagtgctgtt

SEQ ID NO: 7746905 - DNA, 18 bp, Homo sapiens
tgaggctcagagacggtg

SEQ ID NO: 7746906 - DNA, 21 bp, Homo sapiens
tgaggctcatcttatgtggct

SEQ ID NO: 7746907 - DNA, 22 bp, Homo sapiens
tgaggctcaaggtctggtggag

SEQ ID NO: 7746908 - DNA, 19 bp, Homo sapiens
tgaggagcagctggttgat

SEQ ID NO: 7746909 - DNA, 21 bp, Homo sapiens
tgaggcctctcctgggctggc

SEQ ID NO: 7746910 - DNA, 22 bp, Homo sapiens
tgaggcctgcattgaactagaa

SEQ ID NO: 7746911 - DNA, 22 bp, Homo sapiens
tgaggcctgaagcctgaagtga

SEQ ID NO: 7746912 - DNA, 21 bp, Homo sapiens
tgaggcaggggtgcttttgtc

SEQ ID NO: 7746913 - DNA, 22 bp, Homo sapiens
tgccaaattttctcagagatgc

SEQ ID NO: 7746914 - DNA, 22 bp, Homo sapiens
tgccaaattgccctataaatga

SEQ ID NO: 7746915 - DNA, 22 bp, Homo sapiens
tgccaaatttgtatcttaagga

SEQ ID NO: 7746916 - DNA, 22 bp, Homo sapiens
tgccaaattgaattacataatt

SEQ ID NO: 7746917 - DNA, 22 bp, Homo sapiens
tgccaaatgccaccacagctgc

SEQ ID NO: 7746918 - DNA, 22 bp, Homo sapiens
tgccaaattagagttcccaggc

SEQ ID NO: 7746919 - DNA, 22 bp, Homo sapiens
tgccaaatattctctacgtgct

SEQ ID NO: 7746920 - DNA, 19 bp, Homo sapiens
tgccaaatccatgcccagg

SEQ ID NO: 7746921 - DNA, 22 bp, Homo sapiens
tgccaaatatgcacgtgtatgc

SEQ ID NO: 7746922 - DNA, 22 bp, Homo sapiens
tgcattctgaacgtaaatgtga

SEQ ID NO: 7746923 - DNA, 22 bp, Homo sapiens
tgcaaatattgggacagtctag

SEQ ID NO: 7746924 - DNA, 22 bp, Homo sapiens
tgatttcctaggtctggagaag

SEQ ID NO: 7746925 - DNA, 22 bp, Homo sapiens
tgatttcctctactagcaatta

SEQ ID NO: 7746926 - DNA, 22 bp, Homo sapiens
tgatttcctggctttggagttc

SEQ ID NO: 7746927 - DNA, 21 bp, Homo sapiens
tgatttccatcttaaaataaa

SEQ ID NO: 7746928 - DNA, 22 bp, Homo sapiens
tgatttccatgaagctgaaggc

SEQ ID NO: 7746929 - DNA, 22 bp, Homo sapiens
tgatttccagttgctgggtgct

SEQ ID NO: 7746930 - DNA, 22 bp, Homo sapiens
tgatttccacgtgcacccaggt

SEQ ID NO: 7746931 - DNA, 22 bp, Homo sapiens
tgatttccacagtcaggggtgc

SEQ ID NO: 7746932 - DNA, 22 bp, Homo sapiens
tgatttccagttgctgggtgct

SEQ ID NO: 7746933 - DNA, 23 bp, Homo sapiens
tgatttccagtgagtcagtggga

SEQ ID NO: 7746934 - DNA, 21 bp, Homo sapiens
tgatttccagaaaattggccc

SEQ ID NO: 7746935 - DNA, 22 bp, Homo sapiens
tgatttccccagtcttgctgct

SEQ ID NO: 7746936 - DNA, 22 bp, Homo sapiens
tgatttccatgaagctgaaggc

SEQ ID NO: 7746937 - DNA, 22 bp, Homo sapiens
tgatttccctcatcataacaga

SEQ ID NO: 7746938 - DNA, 22 bp, Homo sapiens
tgatttccctgtagcctctgaa

SEQ ID NO: 7746939 - DNA, 22 bp, Homo sapiens
tgatttcctagctgacatgaaa

SEQ ID NO: 7746940 - DNA, 15 bp, Homo sapiens
tgatttcctactaac

SEQ ID NO: 7746941 - DNA, 22 bp, Homo sapiens
tgatttcctaggtctggagaag

SEQ ID NO: 7746942 - DNA, 22 bp, Homo sapiens
tgatttccaataaggagaatgt

SEQ ID NO: 7746943 - DNA, 22 bp, Homo sapiens
tgatttccaataaggagaatgt

SEQ ID NO: 7746944 - DNA, 22 bp, Homo sapiens
tgatttccaaaaggcttctaag

SEQ ID NO: 7746945 - DNA, 22 bp, Homo sapiens
tgatctggtcctactgtgggca

SEQ ID NO: 7746946 - DNA, 22 bp, Homo sapiens
tgatcagcatcttcccagctcg

SEQ ID NO: 7746947 - DNA, 22 bp, Homo sapiens
tgcagcagacataatgtggatt

SEQ ID NO: 7746948 - DNA, 22 bp, Homo sapiens
tctctttaagtataatcttata

SEQ ID NO: 7746949 - DNA, 22 bp, Homo sapiens
tctctgggtttttgtcctgtac

SEQ ID NO: 7746950 - DNA, 22 bp, Homo sapiens
tctctgggaaatggagaatttt

SEQ ID NO: 7746951 - DNA, 22 bp, Homo sapiens
tctctgggctcaggagcccggc

SEQ ID NO: 7746952 - DNA, 22 bp, Homo sapiens
tctctggggcctttctacatca

SEQ ID NO: 7746953 - DNA, 22 bp, Homo sapiens
tctcccagtggtgcagaaagca

SEQ ID NO: 7746954 - DNA, 20 bp, Homo sapiens
tctcccaggctcagggaaga

SEQ ID NO: 7746955 - DNA, 22 bp, Homo sapiens
tctcacattttaaaaggacata

SEQ ID NO: 7746956 - DNA, 22 bp, Homo sapiens
tctcattcatccaaggatttat

SEQ ID NO: 7746957 - DNA, 22 bp, Homo sapiens
tctcatgatgcctatgcagggt

SEQ ID NO: 7746958 - DNA, 22 bp, Homo sapiens
tctatttacagaaagcagaatt

SEQ ID NO: 7746959 - DNA, 22 bp, Homo sapiens
tctattttatactcaaatcttc

SEQ ID NO: 7746960 - DNA, 22 bp, Homo sapiens
tctatttttatagttgaagtgc

SEQ ID NO: 7746961 - DNA, 22 bp, Homo sapiens
tctattttgtttccagctctac

SEQ ID NO: 7746962 - DNA, 22 bp, Homo sapiens
tctattttcttgccaaaactgc

SEQ ID NO: 7746963 - DNA, 22 bp, Homo sapiens
tctattagattattctcaagga

SEQ ID NO: 7746964 - DNA, 22 bp, Homo sapiens
tctatgtctcgacccaagacaa

SEQ ID NO: 7746965 - DNA, 22 bp, Homo sapiens
tctagggagctctagcagtggt

SEQ ID NO: 7746966 - DNA, 22 bp, Homo sapiens
tctaggggcaatgtgcaaggac

SEQ ID NO: 7746967 - DNA, 22 bp, Homo sapiens
tctaggggtgcagaagggatcc

SEQ ID NO: 7746968 - DNA, 22 bp, Homo sapiens
tctagggaattgtggttttctt

SEQ ID NO: 7746969 - DNA, 22 bp, Homo sapiens
tctagggaacctatcctatgat

SEQ ID NO: 7746970 - DNA, 22 bp, Homo sapiens
tctagtactagttaggaagagt

SEQ ID NO: 7746971 - DNA, 22 bp, Homo sapiens
tctagggtggagctgggaatcc

SEQ ID NO: 7746972 - DNA, 22 bp, Homo sapiens
tctagggtgatgattcaggatg

SEQ ID NO: 7746973 - DNA, 22 bp, Homo sapiens
tctacaagtttaattccactta

SEQ ID NO: 7746974 - DNA, 22 bp, Homo sapiens
tcctttgttgtacaattatttt

SEQ ID NO: 7746975 - DNA, 22 bp, Homo sapiens
tcctttgttgagataaattggg

SEQ ID NO: 7746976 - DNA, 22 bp, Homo sapiens
tcctttgtggaaatacttgtgg

SEQ ID NO: 7746977 - DNA, 22 bp, Homo sapiens
tcctttttctcacacaacgaac

SEQ ID NO: 7746978 - DNA, 22 bp, Homo sapiens
tcctttttatagttagagaaac

SEQ ID NO: 7746979 - DNA, 22 bp, Homo sapiens
tcctttttggtccaaggtgacc

SEQ ID NO: 7746980 - DNA, 22 bp, Homo sapiens
tctaaagaaacattgagacctg

SEQ ID NO: 7746981 - DNA, 22 bp, Homo sapiens
tccttaggcaatttgggagagt

SEQ ID NO: 7746982 - DNA, 22 bp, Homo sapiens
taagaacttcggacatgttatc

SEQ ID NO: 7746983 - DNA, 22 bp, Homo sapiens
taagaactcgtgatcatttgaa

SEQ ID NO: 7746984 - DNA, 22 bp, Homo sapiens
tcctgggcagcctctctggaag

SEQ ID NO: 7746985 - DNA, 22 bp, Homo sapiens
tcctgggccctccggatcaggt

SEQ ID NO: 7746986 - DNA, 22 bp, Homo sapiens
tcctgggcccaggctgccaggg

SEQ ID NO: 7746987 - DNA, 22 bp, Homo sapiens
tcctggggaggtcgaggctgag

SEQ ID NO: 7746988 - DNA, 19 bp, Homo sapiens
tcctgggctgggccaggtc

SEQ ID NO: 7746989 - DNA, 19 bp, Homo sapiens
tcctggggatgtggtcacc

SEQ ID NO: 7746990 - DNA, 21 bp, Homo sapiens
tcctggggggtaggtgagttt

SEQ ID NO: 7746991 - DNA, 22 bp, Homo sapiens
tcctgggtagcctgtccaagat

SEQ ID NO: 7746992 - DNA, 22 bp, Homo sapiens
tcctgggtagagacctgatgaa

SEQ ID NO: 7746993 - DNA, 22 bp, Homo sapiens
tcctgggtctcttccttagttc

SEQ ID NO: 7746994 - DNA, 22 bp, Homo sapiens
tcctgggtggtggtaggagcag

SEQ ID NO: 7746995 - DNA, 22 bp, Homo sapiens
tcctgggtgaaagaacaggcag

SEQ ID NO: 7746996 - DNA, 18 bp, Homo sapiens
tcctggtattgcaagcac

SEQ ID NO: 7746997 - DNA, 22 bp, Homo sapiens
tcctgggttcatgtcctggtgc

SEQ ID NO: 7746998 - DNA, 22 bp, Homo sapiens
tcctgggttaattatgattcac

SEQ ID NO: 7746999 - DNA, 22 bp, Homo sapiens
tctttacaatctaagcatagtt

SEQ ID NO: 7747000 - DNA, 22 bp, Homo sapiens
tctttacacaagacaagaataa

SEQ ID NO: 7747001 - DNA, 22 bp, Homo sapiens
tctttacaagtcacattttctg

SEQ ID NO: 7747002 - DNA, 22 bp, Homo sapiens
tctttcctctgagctcctgtag

SEQ ID NO: 7747003 - DNA, 22 bp, Homo sapiens
tctttcctactttattgtgaac

SEQ ID NO: 7747004 - DNA, 23 bp, Homo sapiens
tctttcctaatgaaacagtgaaa

SEQ ID NO: 7747005 - DNA, 22 bp, Homo sapiens
tctttcctagaggctgatgagt

SEQ ID NO: 7747006 - DNA, 22 bp, Homo sapiens
tctttgatgcttctgaaggtgt

SEQ ID NO: 7747007 - DNA, 22 bp, Homo sapiens
tctttgatacagatgtaagctg

SEQ ID NO: 7747008 - DNA, 22 bp, Homo sapiens
tctttgatgggagatctgagag

SEQ ID NO: 7747009 - DNA, 22 bp, Homo sapiens
tctttctgatgggaagggtcaa

SEQ ID NO: 7747010 - DNA, 22 bp, Homo sapiens
tctttagctaactggatgccaa

SEQ ID NO: 7747011 - DNA, 22 bp, Homo sapiens
tcttctttggatgaaagaatat

SEQ ID NO: 7747012 - DNA, 22 bp, Homo sapiens
tcttctttgaatcatagtgacc

SEQ ID NO: 7747013 - DNA, 22 bp, Homo sapiens
tcttccttgtaagggctttaga

SEQ ID NO: 7747014 - DNA, 22 bp, Homo sapiens
tcttccagaagtgttttcagaa

SEQ ID NO: 7747015 - DNA, 22 bp, Homo sapiens
tcttcaatttagaatggattta

SEQ ID NO: 7747016 - DNA, 22 bp, Homo sapiens
tcttattattgttgtaaaagca

SEQ ID NO: 7747017 - DNA, 22 bp, Homo sapiens
tctgggggttaagtgaggacaa

SEQ ID NO: 7747018 - DNA, 21 bp, Homo sapiens
tctgggggtgagcctagaaat

SEQ ID NO: 7747019 - DNA, 22 bp, Homo sapiens
tctggggcagttactggggcct

SEQ ID NO: 7747020 - DNA, 22 bp, Homo sapiens
tctgggcttggttagggctgtt

SEQ ID NO: 7747021 - DNA, 17 bp, Homo sapiens
tctgggcttcagtggtc

SEQ ID NO: 7747022 - DNA, 22 bp, Homo sapiens
tctgggtcactgtgggagggca

SEQ ID NO: 7747023 - DNA, 22 bp, Homo sapiens
tctgggtcatgactcagcgtga

SEQ ID NO: 7747024 - DNA, 22 bp, Homo sapiens
tctgggtggcttcagaggccac

SEQ ID NO: 7747025 - DNA, 22 bp, Homo sapiens
tctgggtggcagtgatggcgtg

SEQ ID NO: 7747026 - DNA, 22 bp, Homo sapiens
tctgttgcaatgtgcatggtga

SEQ ID NO: 7747027 - DNA, 22 bp, Homo sapiens
tctgtttaatgggaatgatact

SEQ ID NO: 7747028 - DNA, 22 bp, Homo sapiens
tctgtttatgcatatttaaaac

SEQ ID NO: 7747029 - DNA, 22 bp, Homo sapiens
tctgttttgtaccagatacagc

SEQ ID NO: 7747030 - DNA, 22 bp, Homo sapiens
tctgttttgcataatgttcttt

SEQ ID NO: 7747031 - DNA, 23 bp, Homo sapiens
tctgttttgcaacatgtgacaag

SEQ ID NO: 7747032 - DNA, 22 bp, Homo sapiens
tctgtgtcagcagcactcagcc

SEQ ID NO: 7747033 - DNA, 22 bp, Homo sapiens
tctgtgctagcacgcagcaagg

SEQ ID NO: 7747034 - DNA, 22 bp, Homo sapiens
tctgtgctagaggagttggcca

SEQ ID NO: 7747035 - DNA, 19 bp, Homo sapiens
tctgtgctgggaggcagca

SEQ ID NO: 7747036 - DNA, 22 bp, Homo sapiens
tctgtgctcttctcagtatcac

SEQ ID NO: 7747037 - DNA, 22 bp, Homo sapiens
tctgggctgctgtgcagtgacc

SEQ ID NO: 7747038 - DNA, 22 bp, Homo sapiens
tctgggcactgctgagcctgta

SEQ ID NO: 7747039 - DNA, 21 bp, Homo sapiens
tctgggacagggcctgaggag

SEQ ID NO: 7747040 - DNA, 22 bp, Homo sapiens
tctgggacattctctccatagt

SEQ ID NO: 7747041 - DNA, 22 bp, Homo sapiens
tctgggagagggaaagaagact

SEQ ID NO: 7747042 - DNA, 22 bp, Homo sapiens
tctgggagagctgctgtcagag

SEQ ID NO: 7747043 - DNA, 22 bp, Homo sapiens
tctgggagagagttgataaagg

SEQ ID NO: 7747044 - DNA, 22 bp, Homo sapiens
tctgggagagcacgtggctgac

SEQ ID NO: 7747045 - DNA, 22 bp, Homo sapiens
tctgggagggagcctcagaatc

SEQ ID NO: 7747046 - DNA, 22 bp, Homo sapiens
tctgggagagtagataaaggaa

SEQ ID NO: 7747047 - DNA, 22 bp, Homo sapiens
tctgggagggctggttcagtat

SEQ ID NO: 7747048 - DNA, 22 bp, Homo sapiens
tctgggaggtactgggaggtgt

SEQ ID NO: 7747049 - DNA, 22 bp, Homo sapiens
tctgggaggtcacattggtctt

SEQ ID NO: 7747050 - DNA, 22 bp, Homo sapiens
tctgggagtgggtccaaggaat

SEQ ID NO: 7747051 - DNA, 21 bp, Homo sapiens
tctgggagtgggaaaatggtc

SEQ ID NO: 7747052 - DNA, 22 bp, Homo sapiens
tctgggagtttctgtgggagct

SEQ ID NO: 7747053 - DNA, 22 bp, Homo sapiens
tctgggagtgaagcaacagatg

SEQ ID NO: 7747054 - DNA, 22 bp, Homo sapiens
tctgggaggtggcagggtgcat

SEQ ID NO: 7747055 - DNA, 21 bp, Homo sapiens
tctggaccaccttgtaaagct

SEQ ID NO: 7747056 - DNA, 22 bp, Homo sapiens
tctggaaggcttcaaggtctaa

SEQ ID NO: 7747057 - DNA, 22 bp, Homo sapiens
tctggaaggaagagctgagtcc

SEQ ID NO: 7747058 - DNA, 22 bp, Homo sapiens
tctggaaggttggctcccagtt

SEQ ID NO: 7747059 - DNA, 22 bp, Homo sapiens
tctggaagctggagtccaggaa

SEQ ID NO: 7747060 - DNA, 22 bp, Homo sapiens
tctggaagaacggggcatgctg

SEQ ID NO: 7747061 - DNA, 23 bp, Homo sapiens
tctgctctgaagttcggctgagc

SEQ ID NO: 7747062 - DNA, 23 bp, Homo sapiens
tctggaggggacactgcagatgc

SEQ ID NO: 7747063 - DNA, 22 bp, Homo sapiens
tctggaggctctgagggtgagt

SEQ ID NO: 7747064 - DNA, 22 bp, Homo sapiens
tctgcatacccctttagcagag

SEQ ID NO: 7747065 - DNA, 23 bp, Homo sapiens
aaagcaaggaattggcaacagag

SEQ ID NO: 7747066 - DNA, 22 bp, Homo sapiens
aaagatttaagaataatttgtg

SEQ ID NO: 7747067 - DNA, 22 bp, Homo sapiens
aaagatgttttacatagcacct

SEQ ID NO: 7747068 - DNA, 22 bp, Homo sapiens
aaagatgttgctgctccgccct

SEQ ID NO: 7747069 - DNA, 22 bp, Homo sapiens
aaagcctcccaggttatgagta

SEQ ID NO: 7747070 - DNA, 22 bp, Homo sapiens
aagaggggtggtctgtgaggat

SEQ ID NO: 7747071 - DNA, 22 bp, Homo sapiens
aagacccttctctgaggaggaa

SEQ ID NO: 7747072 - DNA, 22 bp, Homo sapiens
aagaccctatactcagtgaccc

SEQ ID NO: 7747073 - DNA, 22 bp, Homo sapiens
aagaccctacccctggagagga

SEQ ID NO: 7747074 - DNA, 22 bp, Homo sapiens
aagaccctaagacctcttgatg

SEQ ID NO: 7747075 - DNA, 22 bp, Homo sapiens
aagacgggagtcaggtgagctc

SEQ ID NO: 7747076 - DNA, 22 bp, Homo sapiens
aagactctgtatcatgagggag

SEQ ID NO: 7747077 - DNA, 22 bp, Homo sapiens
aagcaggcagggtggagagttt

SEQ ID NO: 7747078 - DNA, 22 bp, Homo sapiens
aagcaggcatcttggaggtcaa

SEQ ID NO: 7747079 - DNA, 22 bp, Homo sapiens
aagatattcaaagatttattag

SEQ ID NO: 7747080 - DNA, 22 bp, Homo sapiens
aagcaggcattccagagacaat

SEQ ID NO: 7747081 - DNA, 22 bp, Homo sapiens
aagcaggcaaggttgtggggca

SEQ ID NO: 7747082 - DNA, 22 bp, Homo sapiens
aaatctttccctttactatcca

SEQ ID NO: 7747083 - DNA, 22 bp, Homo sapiens
aaaattatagatctagtgcctg

SEQ ID NO: 7747084 - DNA, 22 bp, Homo sapiens
aaaattatggagtatcccaaag

SEQ ID NO: 7747085 - DNA, 21 bp, Homo sapiens
aaaaagctggggcatgcatgc

SEQ ID NO: 7747086 - DNA, 22 bp, Homo sapiens
aaaactacatttgacattttgt

SEQ ID NO: 7747087 - DNA, 22 bp, Homo sapiens
aaaatattttagggccaggaga

SEQ ID NO: 7747088 - DNA, 22 bp, Homo sapiens
aaacattcaaagcaggatgtgt

SEQ ID NO: 7747089 - DNA, 22 bp, Homo sapiens
aaacagctccttagtttccatc

SEQ ID NO: 7747090 - DNA, 22 bp, Homo sapiens
aaacagctgcactgctgatgtc

SEQ ID NO: 7747091 - DNA, 22 bp, Homo sapiens
aaacagctgggaggtagaggcg

SEQ ID NO: 7747092 - DNA, 22 bp, Homo sapiens
aaacagctgtcattgttttaaa

SEQ ID NO: 7747093 - DNA, 22 bp, Homo sapiens
aaacagctacttctgtataatg

SEQ ID NO: 7747094 - DNA, 22 bp, Homo sapiens
aaagccagctctgagctgcacc

SEQ ID NO: 7747095 - DNA, 22 bp, Homo sapiens
aaatagttagccctgcatatat

SEQ ID NO: 7747096 - DNA, 21 bp, Homo sapiens
aaagaacaggcagatgttctt

SEQ ID NO: 7747097 - DNA, 22 bp, Homo sapiens
aatagacattatttctctatga

SEQ ID NO: 7747098 - DNA, 22 bp, Homo sapiens
aacagctgcttctatcttttca

SEQ ID NO: 7747099 - DNA, 22 bp, Homo sapiens
aagtgcttggattgcaggtatg

SEQ ID NO: 7747100 - DNA, 22 bp, Homo sapiens
aacagctgtctgcctatctctg

SEQ ID NO: 7747101 - DNA, 22 bp, Homo sapiens
aacagctgtatactgtagctgt

SEQ ID NO: 7747102 - DNA, 22 bp, Homo sapiens
aacagctgtatactgtagctgt

SEQ ID NO: 7747103 - DNA, 22 bp, Homo sapiens
aacagctgtctgcctatctctg

SEQ ID NO: 7747104 - DNA, 22 bp, Homo sapiens
aacagctgttcgcagatgtagg

SEQ ID NO: 7747105 - DNA, 22 bp, Homo sapiens
aacatcacaatttcatttatgc

SEQ ID NO: 7747106 - DNA, 15 bp, Homo sapiens
aacatcactattttg

SEQ ID NO: 7747107 - DNA, 22 bp, Homo sapiens
aaccctcagctgtttgaggaga

SEQ ID NO: 7747108 - DNA, 22 bp, Homo sapiens
aatgacagccagattcttctct

SEQ ID NO: 7747109 - DNA, 22 bp, Homo sapiens
aactagaacgagaaagctgaac

SEQ ID NO: 7747110 - DNA, 22 bp, Homo sapiens
aatgacatgctttttaattata

SEQ ID NO: 7747111 - DNA, 22 bp, Homo sapiens
aatgacatgctttttaattata

SEQ ID NO: 7747112 - DNA, 22 bp, Homo sapiens
aactagctggattagtgttttc

SEQ ID NO: 7747113 - DNA, 22 bp, Homo sapiens
aactagtcagtgattctcagaa

SEQ ID NO: 7747114 - DNA, 22 bp, Homo sapiens
aaggaagaggcaggttttgctg

SEQ ID NO: 7747115 - DNA, 22 bp, Homo sapiens
aaggaagagtctagaacaggca

SEQ ID NO: 7747116 - DNA, 22 bp, Homo sapiens
aaggaagatgaggtgctgctta

SEQ ID NO: 7747117 - DNA, 22 bp, Homo sapiens
aaggaagacttgagaaggttcc

SEQ ID NO: 7747118 - DNA, 22 bp, Homo sapiens
aaggaagacacagatgaagtga

SEQ ID NO: 7747119 - DNA, 22 bp, Homo sapiens
aaggaagactcgcaggtctatg

SEQ ID NO: 7747120 - DNA, 22 bp, Homo sapiens
aaggctgggtttgggatgtgat

SEQ ID NO: 7747121 - DNA, 22 bp, Homo sapiens
aaggctggtcagatgtggtgaa

SEQ ID NO: 7747122 - DNA, 22 bp, Homo sapiens
aacacagaagtgccaagagcca

SEQ ID NO: 7747123 - DNA, 22 bp, Homo sapiens
aacacagagtatttgaagcatt

SEQ ID NO: 7747124 - DNA, 22 bp, Homo sapiens
aacacagacatagtgattacag

SEQ ID NO: 7747125 - DNA, 20 bp, Homo sapiens
aacacagataccaaaggttg

SEQ ID NO: 7747126 - DNA, 22 bp, Homo sapiens
aacacagctaatttctgtcaat

SEQ ID NO: 7747127 - DNA, 22 bp, Homo sapiens
aacacagatcaaaatatttcct

SEQ ID NO: 7747128 - DNA, 22 bp, Homo sapiens
aacagaatatcaaaagattatg

SEQ ID NO: 7747129 - DNA, 22 bp, Homo sapiens
aacagaaatcatttagggctct

SEQ ID NO: 7747130 - DNA, 22 bp, Homo sapiens
aacagaaaaggtaggtggcttt

SEQ ID NO: 7747131 - DNA, 22 bp, Homo sapiens
aacagaacccgagtgtgaatct

SEQ ID NO: 7747132 - DNA, 22 bp, Homo sapiens
aacagactcacagctagagaag

SEQ ID NO: 7747133 - DNA, 22 bp, Homo sapiens
aacagacatatttttaatatgc

SEQ ID NO: 7747134 - DNA, 22 bp, Homo sapiens
aacagaattgctgctgccaatg

SEQ ID NO: 7747135 - DNA, 22 bp, Homo sapiens
aacagaattgtacaccagggag

SEQ ID NO: 7747136 - DNA, 22 bp, Homo sapiens
aacagacagaaaaatgtgatct

SEQ ID NO: 7747137 - DNA, 22 bp, Homo sapiens
aagaaaatcagttctggtcagt

SEQ ID NO: 7747138 - DNA, 22 bp, Homo sapiens
aagaaagagatcactcctccat

SEQ ID NO: 7747139 - DNA, 22 bp, Homo sapiens
aagaaagagatcactcctccat

SEQ ID NO: 7747140 - DNA, 22 bp, Homo sapiens
aagagaaggtgaggaagccggt

SEQ ID NO: 7747141 - DNA, 22 bp, Homo sapiens
aagagacaatgtcttttggata

SEQ ID NO: 7747142 - DNA, 22 bp, Homo sapiens
acacaaattgtaggataattgc

SEQ ID NO: 7747143 - DNA, 22 bp, Homo sapiens
aagagcagattcctagtggagc

SEQ ID NO: 7747144 - DNA, 22 bp, Homo sapiens
aattttatctctaagcaggctt

SEQ ID NO: 7747145 - DNA, 20 bp, Homo sapiens
aattttatctccatcctttg

SEQ ID NO: 7747146 - DNA, 22 bp, Homo sapiens
aagagaaagcagactttgtcat

SEQ ID NO: 7747147 - DNA, 22 bp, Homo sapiens
acacatttattacatgcatgtg

SEQ ID NO: 7747148 - DNA, 22 bp, Homo sapiens
acacatgataagaaagtttaaa

SEQ ID NO: 7747149 - DNA, 22 bp, Homo sapiens
acacatgagaaacatcagttgt

SEQ ID NO: 7747150 - DNA, 22 bp, Homo sapiens
acacatgaaataatattatgca

SEQ ID NO: 7747151 - DNA, 22 bp, Homo sapiens
acacatgaaagacattaaggtg

SEQ ID NO: 7747152 - DNA, 22 bp, Homo sapiens
aagagcaggctgctgtggagta

SEQ ID NO: 7747153 - DNA, 22 bp, Homo sapiens
aagagcaggctgtcaatggggc

SEQ ID NO: 7747154 - DNA, 22 bp, Homo sapiens
aagatgcctgtagcaggaagat

SEQ ID NO: 7747155 - DNA, 22 bp, Homo sapiens
aagatggcaggaatcataagct

SEQ ID NO: 7747156 - DNA, 22 bp, Homo sapiens
aagcaagccaatctgttttgtt

SEQ ID NO: 7747157 - DNA, 22 bp, Homo sapiens
aagcagagcctgagacagggat

SEQ ID NO: 7747158 - DNA, 22 bp, Homo sapiens
aagcagaatttcccactagttg

SEQ ID NO: 7747159 - DNA, 22 bp, Homo sapiens
aagcacccaatttacagcagtt

SEQ ID NO: 7747160 - DNA, 22 bp, Homo sapiens
aagcaccctttgtctggacatg

SEQ ID NO: 7747161 - DNA, 21 bp, Homo sapiens
acagcagagatcaagactaag

SEQ ID NO: 7747162 - DNA, 22 bp, Homo sapiens
acagcagagtagttttccaact

SEQ ID NO: 7747163 - DNA, 22 bp, Homo sapiens
acagcagagcctggtacttact

SEQ ID NO: 7747164 - DNA, 22 bp, Homo sapiens
aagcagcttttgaagagtgagg

SEQ ID NO: 7747165 - DNA, 22 bp, Homo sapiens
acagccagggcattgtcgccga

SEQ ID NO: 7747166 - DNA, 21 bp, Homo sapiens
aaggctggagatgcaggtctg

SEQ ID NO: 7747167 - DNA, 22 bp, Homo sapiens
aaggctgggaaacatgcaggcc

SEQ ID NO: 7747168 - DNA, 22 bp, Homo sapiens
aaggctcatcagggcatttaga

SEQ ID NO: 7747169 - DNA, 22 bp, Homo sapiens
aaggctcagctactcagcctgc

SEQ ID NO: 7747170 - DNA, 22 bp, Homo sapiens
aaggctcaattaactaagaagt

SEQ ID NO: 7747171 - DNA, 22 bp, Homo sapiens
aaggcggggggatcacgaggtc

SEQ ID NO: 7747172 - DNA, 22 bp, Homo sapiens
aaggccctttagcagaggaggg

SEQ ID NO: 7747173 - DNA, 22 bp, Homo sapiens
aaggcccttggaaaatgcagta

SEQ ID NO: 7747174 - DNA, 22 bp, Homo sapiens
aaggccttgccgaaggatgcca

SEQ ID NO: 7747175 - DNA, 21 bp, Homo sapiens
aaggcctgcttactgctagtt

SEQ ID NO: 7747176 - DNA, 22 bp, Homo sapiens
acccaggagccgtgagaggtta

SEQ ID NO: 7747177 - DNA, 22 bp, Homo sapiens
acccagaggcggaggttgcagt

SEQ ID NO: 7747178 - DNA, 22 bp, Homo sapiens
acccaggaggcagaggttgcag

SEQ ID NO: 7747179 - DNA, 22 bp, Homo sapiens
accctgagggatgagagttgca

SEQ ID NO: 7747180 - DNA, 22 bp, Homo sapiens
acccaggatgataatgttcaca

SEQ ID NO: 7747181 - DNA, 22 bp, Homo sapiens
acccctcagctcttcgtgcccc

SEQ ID NO: 7747182 - DNA, 22 bp, Homo sapiens
acccctcatcagttgcttccta

SEQ ID NO: 7747183 - DNA, 22 bp, Homo sapiens
acccctgtgggctcagagcctg

SEQ ID NO: 7747184 - DNA, 20 bp, Homo sapiens
accctgcatactggaaggct

SEQ ID NO: 7747185 - DNA, 22 bp, Homo sapiens
accgggaagtcctgcactgggc

SEQ ID NO: 7747186 - DNA, 22 bp, Homo sapiens
accctgagtgcaacggtgagga

SEQ ID NO: 7747187 - DNA, 22 bp, Homo sapiens
acattttacaccaagacttctt

SEQ ID NO: 7747188 - DNA, 22 bp, Homo sapiens
acattttaatatgcttagtgtg

SEQ ID NO: 7747189 - DNA, 22 bp, Homo sapiens
acagtgtttaagagatggcatt

SEQ ID NO: 7747190 - DNA, 22 bp, Homo sapiens
acagtgtttatgtacagattgt

SEQ ID NO: 7747191 - DNA, 22 bp, Homo sapiens
acagtgtttaaaaatcagatct

SEQ ID NO: 7747192 - DNA, 22 bp, Homo sapiens
aagctggagagttaggtgaata

SEQ ID NO: 7747193 - DNA, 22 bp, Homo sapiens
acagccttattgcgagcaaggc

SEQ ID NO: 7747194 - DNA, 22 bp, Homo sapiens
aagctaattgtacttctcacag

SEQ ID NO: 7747195 - DNA, 21 bp, Homo sapiens
accgtgcttatctcctgctca

SEQ ID NO: 7747196 - DNA, 22 bp, Homo sapiens
accgtgtctgacactttgggcg

SEQ ID NO: 7747197 - DNA, 22 bp, Homo sapiens
acgtagcactgagagatgcagg

SEQ ID NO: 7747198 - DNA, 22 bp, Homo sapiens
aagtctaggacaggaagtctat

SEQ ID NO: 7747199 - DNA, 22 bp, Homo sapiens
actccctcaagtcactttagtt

SEQ ID NO: 7747200 - DNA, 22 bp, Homo sapiens
actctcactagctctgtgacct

SEQ ID NO: 7747201 - DNA, 22 bp, Homo sapiens
actacagaagtcttattagaga

SEQ ID NO: 7747202 - DNA, 22 bp, Homo sapiens
actcagaagatataatgactca

SEQ ID NO: 7747203 - DNA, 22 bp, Homo sapiens
aatagtccttagtaagctgtga

SEQ ID NO: 7747204 - DNA, 22 bp, Homo sapiens
aatatagatttactcaagagaa

SEQ ID NO: 7747205 - DNA, 21 bp, Homo sapiens
actgttcatttgatgaactgg

SEQ ID NO: 7747206 - DNA, 22 bp, Homo sapiens
agaacaatgcgtattttactcc

SEQ ID NO: 7747207 - DNA, 22 bp, Homo sapiens
agaacaatgttaaattattaag

SEQ ID NO: 7747208 - DNA, 22 bp, Homo sapiens
agaaattgccagaatgtcaggc

SEQ ID NO: 7747209 - DNA, 22 bp, Homo sapiens
agaagcagaaggaagcagggcc

SEQ ID NO: 7747210 - DNA, 22 bp, Homo sapiens
aatgatgtgagtttttattctc

SEQ ID NO: 7747211 - DNA, 22 bp, Homo sapiens
aatcagaatttgtcccctgagt

SEQ ID NO: 7747212 - DNA, 22 bp, Homo sapiens
aatcagctaaataaactagtca

SEQ ID NO: 7747213 - DNA, 22 bp, Homo sapiens
agaccctgttagttccagtctt

SEQ ID NO: 7747214 - DNA, 22 bp, Homo sapiens
agaccctgtatgtgtttagttt

SEQ ID NO: 7747215 - DNA, 22 bp, Homo sapiens
agaccctgtcagtgttaggaaa

SEQ ID NO: 7747216 - DNA, 22 bp, Homo sapiens
agaccctggtaaacactccagg

SEQ ID NO: 7747217 - DNA, 20 bp, Homo sapiens
agaccctgtgtcctgtggcc

SEQ ID NO: 7747218 - DNA, 22 bp, Homo sapiens
agaccctgcacctctcgtgggc

SEQ ID NO: 7747219 - DNA, 22 bp, Homo sapiens
agaccctgaagttttctatgat

SEQ ID NO: 7747220 - DNA, 20 bp, Homo sapiens
agaccctctggactgggccc

SEQ ID NO: 7747221 - DNA, 22 bp, Homo sapiens
agaccctctcctcatggacatg

SEQ ID NO: 7747222 - DNA, 21 bp, Homo sapiens
agaccctgcatatgttcagta

SEQ ID NO: 7747223 - DNA, 22 bp, Homo sapiens
agaccctggggaaagtcacttc

SEQ ID NO: 7747224 - DNA, 22 bp, Homo sapiens
agaccctgcattttccagggtt

SEQ ID NO: 7747225 - DNA, 22 bp, Homo sapiens
agaccctggagaatgaaagtgc

SEQ ID NO: 7747226 - DNA, 22 bp, Homo sapiens
agagccaggcggctgggcacct

SEQ ID NO: 7747227 - DNA, 22 bp, Homo sapiens
agagccaggctcccatggggca

SEQ ID NO: 7747228 - DNA, 22 bp, Homo sapiens
agagccaggctctacctgggtt

SEQ ID NO: 7747229 - DNA, 22 bp, Homo sapiens
agagcctggaggttctgctgaa

SEQ ID NO: 7747230 - DNA, 22 bp, Homo sapiens
aatgtgaggccttggtagttat

SEQ ID NO: 7747231 - DNA, 22 bp, Homo sapiens
aatggcactttataaatgttaa

SEQ ID NO: 7747232 - DNA, 22 bp, Homo sapiens
agacaatatgtatattaagaat

SEQ ID NO: 7747233 - DNA, 22 bp, Homo sapiens
agaggctgtgcccaccaggcaa

SEQ ID NO: 7747234 - DNA, 22 bp, Homo sapiens
aattgagatgacagaggaatag

SEQ ID NO: 7747235 - DNA, 22 bp, Homo sapiens
acaagctgtggtgggacaagag

SEQ ID NO: 7747236 - DNA, 22 bp, Homo sapiens
acaagcttccaggtgatgctga

SEQ ID NO: 7747237 - DNA, 22 bp, Homo sapiens
acaagccaattactgtgccagg

SEQ ID NO: 7747238 - DNA, 22 bp, Homo sapiens
acaagaatttacatgtagtgga

SEQ ID NO: 7747239 - DNA, 22 bp, Homo sapiens
acaagagacaagaggttcttct

SEQ ID NO: 7747240 - DNA, 22 bp, Homo sapiens
acaagagattatctacagatga

SEQ ID NO: 7747241 - DNA, 22 bp, Homo sapiens
agataataaatgttttaggttt

SEQ ID NO: 7747242 - DNA, 17 bp, Homo sapiens
acaacagaaatgtattc

SEQ ID NO: 7747243 - DNA, 22 bp, Homo sapiens
acaacacatgtgtatatgtgtg

SEQ ID NO: 7747244 - DNA, 22 bp, Homo sapiens
acactgaatatacaatgaatat

SEQ ID NO: 7747245 - DNA, 22 bp, Homo sapiens
acactgaatcagaaattgttgg

SEQ ID NO: 7747246 - DNA, 22 bp, Homo sapiens
acactagtctcttcttgacttg

SEQ ID NO: 7747247 - DNA, 22 bp, Homo sapiens
acactagtggaaattgatttgt

SEQ ID NO: 7747248 - DNA, 22 bp, Homo sapiens
acactagtagaatagtgtttgc

SEQ ID NO: 7747249 - DNA, 22 bp, Homo sapiens
acactgagctgagcattcttgt

SEQ ID NO: 7747250 - DNA, 22 bp, Homo sapiens
acactgaatgctgtttagaaat

SEQ ID NO: 7747251 - DNA, 22 bp, Homo sapiens
agcagagccagaattggaccag

SEQ ID NO: 7747252 - DNA, 19 bp, Homo sapiens
agcagagcagggccgtggg

SEQ ID NO: 7747253 - DNA, 22 bp, Homo sapiens
agcagagcatggtgggaagggc

SEQ ID NO: 7747254 - DNA, 19 bp, Homo sapiens
agcagagcaaagtggctga

SEQ ID NO: 7747255 - DNA, 22 bp, Homo sapiens
agcagagcagaatgtgaaggtg

SEQ ID NO: 7747256 - DNA, 18 bp, Homo sapiens
agcagagcccatgcattc

SEQ ID NO: 7747257 - DNA, 22 bp, Homo sapiens
agcagagcccttccatggcctt

SEQ ID NO: 7747258 - DNA, 22 bp, Homo sapiens
agcagatgtttcagagcaggct

SEQ ID NO: 7747259 - DNA, 22 bp, Homo sapiens
acacagaagatctcttaatgct

SEQ ID NO: 7747260 - DNA, 22 bp, Homo sapiens
acacagaagatctcttaatgct

SEQ ID NO: 7747261 - DNA, 22 bp, Homo sapiens
acacagaggctccagagataga

SEQ ID NO: 7747262 - DNA, 22 bp, Homo sapiens
acacagagggcagaagatacat

SEQ ID NO: 7747263 - DNA, 21 bp, Homo sapiens
acacagaggcatcatcacttt

SEQ ID NO: 7747264 - DNA, 22 bp, Homo sapiens
acacagatgctatttagtctct

SEQ ID NO: 7747265 - DNA, 22 bp, Homo sapiens
acacagataatgctcatatagg

SEQ ID NO: 7747266 - DNA, 22 bp, Homo sapiens
acacagatattgtacttgatcc

SEQ ID NO: 7747267 - DNA, 22 bp, Homo sapiens
acagacagacagagaactattc

SEQ ID NO: 7747268 - DNA, 22 bp, Homo sapiens
acagaaacccagaaaacctctc

SEQ ID NO: 7747269 - DNA, 22 bp, Homo sapiens
acagaaagaaggtgtatttgag

SEQ ID NO: 7747270 - DNA, 22 bp, Homo sapiens
acagaaaatgccagaagggtgg

SEQ ID NO: 7747271 - DNA, 22 bp, Homo sapiens
acagaaaaatgagggagctgga

SEQ ID NO: 7747272 - DNA, 22 bp, Homo sapiens
acagaaaagtttacttttgctc

SEQ ID NO: 7747273 - DNA, 22 bp, Homo sapiens
acagagactaagcttttcatca

SEQ ID NO: 7747274 - DNA, 22 bp, Homo sapiens
acagagacaatatttgtaaagt

SEQ ID NO: 7747275 - DNA, 23 bp, Homo sapiens
acagagacaatggtttcatcttg

SEQ ID NO: 7747276 - DNA, 19 bp, Homo sapiens
agccagggtgagaaggagc

SEQ ID NO: 7747277 - DNA, 19 bp, Homo sapiens
agccagggtccagacatgt

SEQ ID NO: 7747278 - DNA, 22 bp, Homo sapiens
acagacattcagctaagtctat

SEQ ID NO: 7747279 - DNA, 23 bp, Homo sapiens
acagacattccataatgtacacc

SEQ ID NO: 7747280 - DNA, 22 bp, Homo sapiens
acagatgtaatctattcacatt

SEQ ID NO: 7747281 - DNA, 19 bp, Homo sapiens
acagcacagaaatatttca

SEQ ID NO: 7747282 - DNA, 22 bp, Homo sapiens
acagcaattgtatgcatagcat

SEQ ID NO: 7747283 - DNA, 22 bp, Homo sapiens
acagagctgtacatgtgccatg

SEQ ID NO: 7747284 - DNA, 22 bp, Homo sapiens
acagagctgggatctgaaccca

SEQ ID NO: 7747285 - DNA, 22 bp, Homo sapiens
acagcactggtcccgcaagcct

SEQ ID NO: 7747286 - DNA, 22 bp, Homo sapiens
acagcacttattcagcacagtg

SEQ ID NO: 7747287 - DNA, 22 bp, Homo sapiens
acagcacttattcagcacagtg

SEQ ID NO: 7747288 - DNA, 22 bp, Homo sapiens
acagctgaaaccagggatctgg

SEQ ID NO: 7747289 - DNA, 22 bp, Homo sapiens
acagctgaacaagatagtgtca

SEQ ID NO: 7747290 - DNA, 22 bp, Homo sapiens
acagctgattggatcaaggaca

SEQ ID NO: 7747291 - DNA, 22 bp, Homo sapiens
acagctgatcattttgaagaat

SEQ ID NO: 7747292 - DNA, 22 bp, Homo sapiens
acagctgacattggcagctatt

SEQ ID NO: 7747293 - DNA, 22 bp, Homo sapiens
acagctgatagttacctctgtc

SEQ ID NO: 7747294 - DNA, 22 bp, Homo sapiens
acagctgtgaaaatccacagga

SEQ ID NO: 7747295 - DNA, 22 bp, Homo sapiens
acagctgtgaagcaagcactct

SEQ ID NO: 7747296 - DNA, 22 bp, Homo sapiens
acagctgtgagggtcacttgta

SEQ ID NO: 7747297 - DNA, 22 bp, Homo sapiens
acagctgtgatttctatcatga

SEQ ID NO: 7747298 - DNA, 22 bp, Homo sapiens
acagctgtgttttataatcagc

SEQ ID NO: 7747299 - DNA, 22 bp, Homo sapiens
acaggctggaggaggaccaaga

SEQ ID NO: 7747300 - DNA, 22 bp, Homo sapiens
acagtgattggcactgattcag

SEQ ID NO: 7747301 - DNA, 21 bp, Homo sapiens
aggcagcatctgatttatatg

SEQ ID NO: 7747302 - DNA, 22 bp, Homo sapiens
aggcaggcaagttcatatgagg

SEQ ID NO: 7747303 - DNA, 22 bp, Homo sapiens
aggcaggcactccggaagtgtc

SEQ ID NO: 7747304 - DNA, 22 bp, Homo sapiens
acaggtggccccgagggagtgg

SEQ ID NO: 7747305 - DNA, 21 bp, Homo sapiens
aggaggaacccgtggctgggc

SEQ ID NO: 7747306 - DNA, 22 bp, Homo sapiens
aggaggaactcagaaagaaggt

SEQ ID NO: 7747307 - DNA, 22 bp, Homo sapiens
acagtaagggtaaataagaaca

SEQ ID NO: 7747308 - DNA, 22 bp, Homo sapiens
agggagccttcctggctgtggt

SEQ ID NO: 7747309 - DNA, 20 bp, Homo sapiens
agggacacaatatttctgtg

SEQ ID NO: 7747310 - DNA, 22 bp, Homo sapiens
agggaattcactggaacgccct

SEQ ID NO: 7747311 - DNA, 22 bp, Homo sapiens
agggacactgatgagaaattct

SEQ ID NO: 7747312 - DNA, 22 bp, Homo sapiens
agggacacactccagtgttatt

SEQ ID NO: 7747313 - DNA, 22 bp, Homo sapiens
agggacacatgtgattatttat

SEQ ID NO: 7747314 - DNA, 22 bp, Homo sapiens
aggctggatttatggggacttc

SEQ ID NO: 7747315 - DNA, 22 bp, Homo sapiens
agggcctggtgacctgggtcct

SEQ ID NO: 7747316 - DNA, 17 bp, Homo sapiens
accctcaatctcctgca

SEQ ID NO: 7747317 - DNA, 22 bp, Homo sapiens
accctcaagatggaagcagttt

SEQ ID NO: 7747318 - DNA, 22 bp, Homo sapiens
accctcagacatattccatcat

SEQ ID NO: 7747319 - DNA, 22 bp, Homo sapiens
accctcagagtaggcactgctg

SEQ ID NO: 7747320 - DNA, 16 bp, Homo sapiens
accctcagaaactgct

SEQ ID NO: 7747321 - DNA, 22 bp, Homo sapiens
accctcagacagctgtggccag

SEQ ID NO: 7747322 - DNA, 22 bp, Homo sapiens
acccgtcagaatggctgttatt

SEQ ID NO: 7747323 - DNA, 22 bp, Homo sapiens
accccttttatagaagaacaga

SEQ ID NO: 7747324 - DNA, 22 bp, Homo sapiens
acccggagtcggaggttgcagt

SEQ ID NO: 7747325 - DNA, 22 bp, Homo sapiens
acccaggctggagtgcagtagc

SEQ ID NO: 7747326 - DNA, 22 bp, Homo sapiens
acccaggctagggtgcagtggc

SEQ ID NO: 7747327 - DNA, 22 bp, Homo sapiens
acccaggctagaagtgaattat

SEQ ID NO: 7747328 - DNA, 22 bp, Homo sapiens
acccaggcgggagtgcagtgtc

SEQ ID NO: 7747329 - DNA, 22 bp, Homo sapiens
acccaggctagagtgcagtggt

SEQ ID NO: 7747330 - DNA, 22 bp, Homo sapiens
accattctttacatcagcacag

SEQ ID NO: 7747331 - DNA, 17 bp, Homo sapiens
accattctttttactgc

SEQ ID NO: 7747332 - DNA, 22 bp, Homo sapiens
accattctggttaagaacccat

SEQ ID NO: 7747333 - DNA, 22 bp, Homo sapiens
accattctttacacttatttct

SEQ ID NO: 7747334 - DNA, 22 bp, Homo sapiens
accatcagtcacatgtagagaa

SEQ ID NO: 7747335 - DNA, 16 bp, Homo sapiens
accattctagccacat

SEQ ID NO: 7747336 - DNA, 20 bp, Homo sapiens
accattaatgtaagctttgt

SEQ ID NO: 7747337 - DNA, 22 bp, Homo sapiens
accattctgtctctttacaaat

SEQ ID NO: 7747338 - DNA, 22 bp, Homo sapiens
agggcatgaaatgggcagaagc

SEQ ID NO: 7747339 - DNA, 22 bp, Homo sapiens
aggctgaggctggcagctccag

SEQ ID NO: 7747340 - DNA, 22 bp, Homo sapiens
acatttcactgttcacagcagg

SEQ ID NO: 7747341 - DNA, 22 bp, Homo sapiens
aggctgagtttctcattctcgc

SEQ ID NO: 7747342 - DNA, 20 bp, Homo sapiens
aggctgagttctatgcactt

SEQ ID NO: 7747343 - DNA, 22 bp, Homo sapiens
aggctgagtgctcccctagatg

SEQ ID NO: 7747344 - DNA, 22 bp, Homo sapiens
aggctagggccatggctggtga

SEQ ID NO: 7747345 - DNA, 22 bp, Homo sapiens
aggctagggtaacagatgtggc

SEQ ID NO: 7747346 - DNA, 22 bp, Homo sapiens
aggccttaccatagctgtagca

SEQ ID NO: 7747347 - DNA, 22 bp, Homo sapiens
aggcctgcctggatcacacaga

SEQ ID NO: 7747348 - DNA, 18 bp, Homo sapiens
aggccttgggtagcctga

SEQ ID NO: 7747349 - DNA, 22 bp, Homo sapiens
aggccttgggccatagtctcct

SEQ ID NO: 7747350 - DNA, 22 bp, Homo sapiens
aggccttgtgagaagcagagaa

SEQ ID NO: 7747351 - DNA, 22 bp, Homo sapiens
aggccttggaagccagggagcc

SEQ ID NO: 7747352 - DNA, 22 bp, Homo sapiens
aggcgcagaaggccaggggcct

SEQ ID NO: 7747353 - DNA, 22 bp, Homo sapiens
aggcgcagggtttggacccagg

SEQ ID NO: 7747354 - DNA, 22 bp, Homo sapiens
aggcaggctggtctgaagagtg

SEQ ID NO: 7747355 - DNA, 22 bp, Homo sapiens
acatgcaatattgagactttct

SEQ ID NO: 7747356 - DNA, 22 bp, Homo sapiens
acatgaggaactcaggagtcac

SEQ ID NO: 7747357 - DNA, 22 bp, Homo sapiens
aggccctgtccatggtgctgaa

SEQ ID NO: 7747358 - DNA, 20 bp, Homo sapiens
aggccctgccagggacggag

SEQ ID NO: 7747359 - DNA, 22 bp, Homo sapiens
acatgcaggaaaatgcacagat

SEQ ID NO: 7747360 - DNA, 22 bp, Homo sapiens
aggcctgcctggagcctggctg

SEQ ID NO: 7747361 - DNA, 22 bp, Homo sapiens
acatggcagctgatgattggaa

SEQ ID NO: 7747362 - DNA, 22 bp, Homo sapiens
agggctgtttttggcacctggg

SEQ ID NO: 7747363 - DNA, 22 bp, Homo sapiens
agggctgtgtttgcaccctctg

SEQ ID NO: 7747364 - DNA, 22 bp, Homo sapiens
accctcagcttcttggattaat

SEQ ID NO: 7747365 - DNA, 22 bp, Homo sapiens
accctcaggcagaatgtattct

SEQ ID NO: 7747366 - DNA, 22 bp, Homo sapiens
accctcagctggagattgaatt

SEQ ID NO: 7747367 - DNA, 18 bp, Homo sapiens
acctccccattttctgaa

SEQ ID NO: 7747368 - DNA, 22 bp, Homo sapiens
acctccccgggagcagcctcct

SEQ ID NO: 7747369 - DNA, 22 bp, Homo sapiens
acctcccctgactcgaaaccca

SEQ ID NO: 7747370 - DNA, 22 bp, Homo sapiens
aggtagcatattccagacttgt

SEQ ID NO: 7747371 - DNA, 19 bp, Homo sapiens
actcagggaaaggagaatt

SEQ ID NO: 7747372 - DNA, 22 bp, Homo sapiens
actcacagactgcaggtttatt

SEQ ID NO: 7747373 - DNA, 22 bp, Homo sapiens
actcacagcagactatgaggga

SEQ ID NO: 7747374 - DNA, 22 bp, Homo sapiens
actattcaagtgctcattcaga

SEQ ID NO: 7747375 - DNA, 22 bp, Homo sapiens
acgtttatggagtgcctatcat

SEQ ID NO: 7747376 - DNA, 20 bp, Homo sapiens
acctgtggtgctgatgacag

SEQ ID NO: 7747377 - DNA, 22 bp, Homo sapiens
accttagctgttaaaactaagt

SEQ ID NO: 7747378 - DNA, 22 bp, Homo sapiens
acgggccttctcttcaggcgag

SEQ ID NO: 7747379 - DNA, 22 bp, Homo sapiens
actgcaacctccacctcctggg

SEQ ID NO: 7747380 - DNA, 21 bp, Homo sapiens
actgcaaacagcagagactga

SEQ ID NO: 7747381 - DNA, 22 bp, Homo sapiens
actgcaaagggaagccctttct

SEQ ID NO: 7747382 - DNA, 22 bp, Homo sapiens
actggattgggaaagtacttca

SEQ ID NO: 7747383 - DNA, 22 bp, Homo sapiens
agtctgggctgtctgcaggagt

SEQ ID NO: 7747384 - DNA, 22 bp, Homo sapiens
agtctgggtggctgagctacag

SEQ ID NO: 7747385 - DNA, 22 bp, Homo sapiens
agtctctgcatgatgcagcaca

SEQ ID NO: 7747386 - DNA, 18 bp, Homo sapiens
agtttatgagccactgcc

SEQ ID NO: 7747387 - DNA, 22 bp, Homo sapiens
agtttatgataactggtgacct

SEQ ID NO: 7747388 - DNA, 22 bp, Homo sapiens
agtttatgattttatgtaagta

SEQ ID NO: 7747389 - DNA, 22 bp, Homo sapiens
agtttatgaaacacagatttga

SEQ ID NO: 7747390 - DNA, 19 bp, Homo sapiens
agtttatgcagatactggt

SEQ ID NO: 7747391 - DNA, 22 bp, Homo sapiens
agtttatgtaaaattagtaatg

SEQ ID NO: 7747392 - DNA, 23 bp, Homo sapiens
agtttccacccagggtagaaggg

SEQ ID NO: 7747393 - DNA, 22 bp, Homo sapiens
agtttccagcacagggcaagct

SEQ ID NO: 7747394 - DNA, 22 bp, Homo sapiens
agtttccaggcaggagctaatt

SEQ ID NO: 7747395 - DNA, 22 bp, Homo sapiens
agtttccaaaaggagacaggga

SEQ ID NO: 7747396 - DNA, 22 bp, Homo sapiens
acttcaaacaattaacagagaa

SEQ ID NO: 7747397 - DNA, 22 bp, Homo sapiens
acttccagaaatgatttaattt

SEQ ID NO: 7747398 - DNA, 22 bp, Homo sapiens
acttccagatggccccatctaa

SEQ ID NO: 7747399 - DNA, 22 bp, Homo sapiens
acttccagacctgtgcttgctc

SEQ ID NO: 7747400 - DNA, 22 bp, Homo sapiens
acttccagagggtgtggaaata

SEQ ID NO: 7747401 - DNA, 22 bp, Homo sapiens
acttccagaacaggtacatttt

SEQ ID NO: 7747402 - DNA, 22 bp, Homo sapiens
acttccagaattagaatttaag

SEQ ID NO: 7747403 - DNA, 20 bp, Homo sapiens
atcactggagaaggaaacct

SEQ ID NO: 7747404 - DNA, 22 bp, Homo sapiens
atcacaaaggctgcttcatgat

SEQ ID NO: 7747405 - DNA, 22 bp, Homo sapiens
agaaacatttagattatatgtc

SEQ ID NO: 7747406 - DNA, 22 bp, Homo sapiens
agaaacatcgcttagtcctcat

SEQ ID NO: 7747407 - DNA, 22 bp, Homo sapiens
agaaacatcctgctttccattt

SEQ ID NO: 7747408 - DNA, 22 bp, Homo sapiens
agaaacatcattgtttggtatt

SEQ ID NO: 7747409 - DNA, 22 bp, Homo sapiens
atatatttgagaatattcatga

SEQ ID NO: 7747410 - DNA, 22 bp, Homo sapiens
atatcttttagagcaagcttgt

SEQ ID NO: 7747411 - DNA, 22 bp, Homo sapiens
atatctttgtttttgccaagat

SEQ ID NO: 7747412 - DNA, 22 bp, Homo sapiens
atatctttcaaagccaaaagta

SEQ ID NO: 7747413 - DNA, 22 bp, Homo sapiens
agaaaattagattttactgtgt

SEQ ID NO: 7747414 - DNA, 22 bp, Homo sapiens
agaaaatttattcatgttagtt

SEQ ID NO: 7747415 - DNA, 22 bp, Homo sapiens
agaaacaacttgtttctcttgc

SEQ ID NO: 7747416 - DNA, 22 bp, Homo sapiens
cagaagaaagtggggagacaag

SEQ ID NO: 7747417 - DNA, 22 bp, Homo sapiens
cagaagaaatcattatctggac

SEQ ID NO: 7747418 - DNA, 22 bp, Homo sapiens
agccaggattggctgagcctta

SEQ ID NO: 7747419 - DNA, 22 bp, Homo sapiens
cactgaaatattaatatcttat

SEQ ID NO: 7747420 - DNA, 22 bp, Homo sapiens
cagagctggagaagtggattta

SEQ ID NO: 7747421 - DNA, 22 bp, Homo sapiens
cagagctggagcttgaatggag

SEQ ID NO: 7747422 - DNA, 22 bp, Homo sapiens
agccctcaggctttgctgggcc

SEQ ID NO: 7747423 - DNA, 22 bp, Homo sapiens
cagagctggcggtgagaagaca

SEQ ID NO: 7747424 - DNA, 23 bp, Homo sapiens
cagagctggctcagagctgcctg

SEQ ID NO: 7747425 - DNA, 22 bp, Homo sapiens
agccagtcttacgctcgttttt

SEQ ID NO: 7747426 - DNA, 21 bp, Homo sapiens
agccagtctgttttctagtgc

SEQ ID NO: 7747427 - DNA, 21 bp, Homo sapiens
agccagtctgccagagaagcc

SEQ ID NO: 7747428 - DNA, 21 bp, Homo sapiens
agccagtctcagtactgtact

SEQ ID NO: 7747429 - DNA, 22 bp, Homo sapiens
agccagtctctctccctggaga

SEQ ID NO: 7747430 - DNA, 21 bp, Homo sapiens
agccagtcattatgagcggga

SEQ ID NO: 7747431 - DNA, 22 bp, Homo sapiens
agccagtcagaggctcccccaa

SEQ ID NO: 7747432 - DNA, 22 bp, Homo sapiens
agccagtcagccatgcttacct

SEQ ID NO: 7747433 - DNA, 22 bp, Homo sapiens
agccagtcggggccatgctggg

SEQ ID NO: 7747434 - DNA, 19 bp, Homo sapiens
agccagtccaagttctgtc

SEQ ID NO: 7747435 - DNA, 22 bp, Homo sapiens
agccagtccatcactaatgggt

SEQ ID NO: 7747436 - DNA, 22 bp, Homo sapiens
agccagtcccttgagcgtgccc

SEQ ID NO: 7747437 - DNA, 22 bp, Homo sapiens
agccagtgcaacagcagtgaag

SEQ ID NO: 7747438 - DNA, 22 bp, Homo sapiens
cagacagcaaatctgcttgcat

SEQ ID NO: 7747439 - DNA, 22 bp, Homo sapiens
cagacagaggctgtatgagggc

SEQ ID NO: 7747440 - DNA, 18 bp, Homo sapiens
agccaggtggaatggaac

SEQ ID NO: 7747441 - DNA, 22 bp, Homo sapiens
agccaggtcaggaaaggtccca

SEQ ID NO: 7747442 - DNA, 22 bp, Homo sapiens
agccaggtctaaggacatcagg

SEQ ID NO: 7747443 - DNA, 20 bp, Homo sapiens
agccagggttctggatgcac

SEQ ID NO: 7747444 - DNA, 22 bp, Homo sapiens
agccagggttagaagatagtca

SEQ ID NO: 7747445 - DNA, 22 bp, Homo sapiens
cagcagaaacccagcaaagcca

SEQ ID NO: 7747446 - DNA, 22 bp, Homo sapiens
cagcagaaatggattttgagat

SEQ ID NO: 7747447 - DNA, 22 bp, Homo sapiens
agcctcagtttcaggcctcctc

SEQ ID NO: 7747448 - DNA, 22 bp, Homo sapiens
cagcagaggaaagcaaatctaa

SEQ ID NO: 7747449 - DNA, 22 bp, Homo sapiens
cagcagcagtgttctagaatct

SEQ ID NO: 7747450 - DNA, 22 bp, Homo sapiens
cagcagcatgaattcgagccac

SEQ ID NO: 7747451 - DNA, 22 bp, Homo sapiens
cagcagaggttttgctccatga

SEQ ID NO: 7747452 - DNA, 22 bp, Homo sapiens
cagcacagggacaatagcagat

SEQ ID NO: 7747453 - DNA, 22 bp, Homo sapiens
cagcacaggcctgtctttgtct

SEQ ID NO: 7747454 - DNA, 22 bp, Homo sapiens
agcctcagggctctgcgcagac

SEQ ID NO: 7747455 - DNA, 23 bp, Homo sapiens
agcctcagccggtggcagaagtg

SEQ ID NO: 7747456 - DNA, 22 bp, Homo sapiens
cagcacagggcttgagaggtgt

SEQ ID NO: 7747457 - DNA, 22 bp, Homo sapiens
cagcacaggtcagttttttaag

SEQ ID NO: 7747458 - DNA, 22 bp, Homo sapiens
cagcacagagtattttattgat

SEQ ID NO: 7747459 - DNA, 22 bp, Homo sapiens
cagaggctcagatggccctggc

SEQ ID NO: 7747460 - DNA, 22 bp, Homo sapiens
cagcaggacgtccaagtgctat

SEQ ID NO: 7747461 - DNA, 22 bp, Homo sapiens
cagccagagaggaaggaatgca

SEQ ID NO: 7747462 - DNA, 22 bp, Homo sapiens
cagccagaggggccagagtcgg

SEQ ID NO: 7747463 - DNA, 22 bp, Homo sapiens
agctccctgagatgccacagca

SEQ ID NO: 7747464 - DNA, 21 bp, Homo sapiens
agctccctgtttcctcactct

SEQ ID NO: 7747465 - DNA, 22 bp, Homo sapiens
agctccctgcacgaccctgccc

SEQ ID NO: 7747466 - DNA, 22 bp, Homo sapiens
agcagggctcctgaaagccgcg

SEQ ID NO: 7747467 - DNA, 22 bp, Homo sapiens
agcaggtcgccgaagatagctc

SEQ ID NO: 7747468 - DNA, 22 bp, Homo sapiens
cacatcaggtagacctacagag

SEQ ID NO: 7747469 - DNA, 23 bp, Homo sapiens
cacatcagtttaggtcagatttt

SEQ ID NO: 7747470 - DNA, 19 bp, Homo sapiens
cacatcagcagggctgtgg

SEQ ID NO: 7747471 - DNA, 22 bp, Homo sapiens
cacatcagggctgcttgggggt

SEQ ID NO: 7747472 - DNA, 22 bp, Homo sapiens
cacaggaaggccttctcacaat

SEQ ID NO: 7747473 - DNA, 22 bp, Homo sapiens
agcagctgtactttcatctgtt

SEQ ID NO: 7747474 - DNA, 22 bp, Homo sapiens
caatgataatggctgtatttat

SEQ ID NO: 7747475 - DNA, 22 bp, Homo sapiens
cacagtacgcacccgatacatg

SEQ ID NO: 7747476 - DNA, 22 bp, Homo sapiens
agcacagagaagatttcaatta

SEQ ID NO: 7747477 - DNA, 22 bp, Homo sapiens
agcacagagattatttacaaga

SEQ ID NO: 7747478 - DNA, 22 bp, Homo sapiens
agcacagagttgcagagagcgt

SEQ ID NO: 7747479 - DNA, 22 bp, Homo sapiens
agcacagatggatgtattcatt

SEQ ID NO: 7747480 - DNA, 22 bp, Homo sapiens
agcacagataacatggagtgga

SEQ ID NO: 7747481 - DNA, 22 bp, Homo sapiens
agcacagatgtactttgagggg

SEQ ID NO: 7747482 - DNA, 22 bp, Homo sapiens
agcacagatgtgagtggaggct

SEQ ID NO: 7747483 - DNA, 22 bp, Homo sapiens
agcacagatttgtcaacataga

SEQ ID NO: 7747484 - DNA, 23 bp, Homo sapiens
agcacagactagaaaggtctttc

SEQ ID NO: 7747485 - DNA, 17 bp, Homo sapiens
agcagaagtcagaggga

SEQ ID NO: 7747486 - DNA, 22 bp, Homo sapiens
agcacttaactgacagtactat

SEQ ID NO: 7747487 - DNA, 22 bp, Homo sapiens
agcagaattccatgtgagaggg

SEQ ID NO: 7747488 - DNA, 22 bp, Homo sapiens
agcagacaccaggagtaaagaa

SEQ ID NO: 7747489 - DNA, 22 bp, Homo sapiens
agcagcaatggaaagcaacaca

SEQ ID NO: 7747490 - DNA, 22 bp, Homo sapiens
agcagcatatcagagaaagtca

SEQ ID NO: 7747491 - DNA, 22 bp, Homo sapiens
caatgaaattgagatccagaga

SEQ ID NO: 7747492 - DNA, 20 bp, Homo sapiens
agcagcattgttctagagca

SEQ ID NO: 7747493 - DNA, 22 bp, Homo sapiens
agacacaggtgtaatttctgct

SEQ ID NO: 7747494 - DNA, 22 bp, Homo sapiens
agacacagctaccataatacca

SEQ ID NO: 7747495 - DNA, 21 bp, Homo sapiens
agacacaggggttgctggggt

SEQ ID NO: 7747496 - DNA, 22 bp, Homo sapiens
agacacaggattctgcatttct

SEQ ID NO: 7747497 - DNA, 22 bp, Homo sapiens
agacacagtgttgaaggctagt

SEQ ID NO: 7747498 - DNA, 22 bp, Homo sapiens
agacaggcagcagatggagtgt

SEQ ID NO: 7747499 - DNA, 22 bp, Homo sapiens
agacagtgcaagaagagcaggc

SEQ ID NO: 7747500 - DNA, 22 bp, Homo sapiens
agacagtgatggacaggcagac

SEQ ID NO: 7747501 - DNA, 22 bp, Homo sapiens
agacagtgatgtaagcaggagt

SEQ ID NO: 7747502 - DNA, 19 bp, Homo sapiens
agacacacttgatatgtgt

SEQ ID NO: 7747503 - DNA, 22 bp, Homo sapiens
agacacagaacacaaaagcata

SEQ ID NO: 7747504 - DNA, 22 bp, Homo sapiens
agacaatatataattttagttg

SEQ ID NO: 7747505 - DNA, 22 bp, Homo sapiens
agaatgcttgtacctttgtttt

SEQ ID NO: 7747506 - DNA, 22 bp, Homo sapiens
agaatgatagctagtatttact

SEQ ID NO: 7747507 - DNA, 22 bp, Homo sapiens
agaagagccactgttgacggca

SEQ ID NO: 7747508 - DNA, 22 bp, Homo sapiens
agaagaatacttgatgttcatg

SEQ ID NO: 7747509 - DNA, 22 bp, Homo sapiens
atcttattgctgttgccagata

SEQ ID NO: 7747510 - DNA, 22 bp, Homo sapiens
agaaggccagatggacggggct

SEQ ID NO: 7747511 - DNA, 22 bp, Homo sapiens
agaaggccctgtgtggtctgag

SEQ ID NO: 7747512 - DNA, 22 bp, Homo sapiens
agaaggcggctcctctggcgcc

SEQ ID NO: 7747513 - DNA, 22 bp, Homo sapiens
agaaggctcactaagagtgact

SEQ ID NO: 7747514 - DNA, 22 bp, Homo sapiens
agaaggctcatttgactgcatt

SEQ ID NO: 7747515 - DNA, 22 bp, Homo sapiens
agaaggctaaagtaacttagta

SEQ ID NO: 7747516 - DNA, 22 bp, Homo sapiens
agaaggccaatagggtgcactg

SEQ ID NO: 7747517 - DNA, 22 bp, Homo sapiens
agaaggctggccatggtgccct

SEQ ID NO: 7747518 - DNA, 22 bp, Homo sapiens
agaaggctgagactgggatgaa

SEQ ID NO: 7747519 - DNA, 21 bp, Homo sapiens
agaataatggtatcatttgct

SEQ ID NO: 7747520 - DNA, 22 bp, Homo sapiens
atgtccaatttctgaggctgct

SEQ ID NO: 7747521 - DNA, 22 bp, Homo sapiens
atgtcttctaagctctaagctg

SEQ ID NO: 7747522 - DNA, 22 bp, Homo sapiens
atgggaggatcacttgaggcca

SEQ ID NO: 7747523 - DNA, 22 bp, Homo sapiens
agactaaaagaaggaagctacc

SEQ ID NO: 7747524 - DNA, 22 bp, Homo sapiens
agactacattatgacagcattt

SEQ ID NO: 7747525 - DNA, 22 bp, Homo sapiens
atgttaagaatgcagacaaatg

SEQ ID NO: 7747526 - DNA, 22 bp, Homo sapiens
atgttaaatggtttattattaa

SEQ ID NO: 7747527 - DNA, 23 bp, Homo sapiens
atgtgtgggaggtcagagagcca

SEQ ID NO: 7747528 - DNA, 22 bp, Homo sapiens
attagcattgctactctcaaga

SEQ ID NO: 7747529 - DNA, 19 bp, Homo sapiens
attagcatgcttgaggatg

SEQ ID NO: 7747530 - DNA, 22 bp, Homo sapiens
attagcatgccaagcttttaga

SEQ ID NO: 7747531 - DNA, 22 bp, Homo sapiens
attagcataagtgttcggtgca

SEQ ID NO: 7747532 - DNA, 22 bp, Homo sapiens
attagcacataagaggtatagg

SEQ ID NO: 7747533 - DNA, 22 bp, Homo sapiens
attctgggtttttgtcttctgt

SEQ ID NO: 7747534 - DNA, 22 bp, Homo sapiens
attcacactgtatacacaggat

SEQ ID NO: 7747535 - DNA, 22 bp, Homo sapiens
attcacagagtggttagtggta

SEQ ID NO: 7747536 - DNA, 22 bp, Homo sapiens
attcacagaatagttttaccag

SEQ ID NO: 7747537 - DNA, 22 bp, Homo sapiens
attcagcataatcagtagcttg

SEQ ID NO: 7747538 - DNA, 22 bp, Homo sapiens
attcagcacatctttgtacagc

SEQ ID NO: 7747539 - DNA, 22 bp, Homo sapiens
attcacagttactgctgaacca

SEQ ID NO: 7747540 - DNA, 22 bp, Homo sapiens
attcacagttcattagctgtaa

SEQ ID NO: 7747541 - DNA, 22 bp, Homo sapiens
attcacagtttcctcatattct

SEQ ID NO: 7747542 - DNA, 20 bp, Homo sapiens
attcacaggcacaaaaccct

SEQ ID NO: 7747543 - DNA, 22 bp, Homo sapiens
attcacagggacaatgggagag

SEQ ID NO: 7747544 - DNA, 21 bp, Homo sapiens
attcacaggtatcctctccct

SEQ ID NO: 7747545 - DNA, 22 bp, Homo sapiens
attcacagggctttccgcatgg

SEQ ID NO: 7747546 - DNA, 22 bp, Homo sapiens
attcacagggggagaagggtat

SEQ ID NO: 7747547 - DNA, 22 bp, Homo sapiens
attcacagtatggacgaaatga

SEQ ID NO: 7747548 - DNA, 22 bp, Homo sapiens
atttccaaggtaattttgagta

SEQ ID NO: 7747549 - DNA, 21 bp, Homo sapiens
atttccaagggtacctaagat

SEQ ID NO: 7747550 - DNA, 22 bp, Homo sapiens
atttcattgaagttaattcttc

SEQ ID NO: 7747551 - DNA, 22 bp, Homo sapiens
agcaaaataaggtaatttattg

SEQ ID NO: 7747552 - DNA, 20 bp, Homo sapiens
agcaaaatgcaagattttca

SEQ ID NO: 7747553 - DNA, 22 bp, Homo sapiens
attcttcatcactaccttgtga

SEQ ID NO: 7747554 - DNA, 22 bp, Homo sapiens
atttaagggatttggagaccaa

SEQ ID NO: 7747555 - DNA, 22 bp, Homo sapiens
atttagcacacggcctggtaca

SEQ ID NO: 7747556 - DNA, 22 bp, Homo sapiens
atttattatgggatttggctca

SEQ ID NO: 7747557 - DNA, 22 bp, Homo sapiens
atttattatgggatttggctca

SEQ ID NO: 7747558 - DNA, 22 bp, Homo sapiens
atttattattgtggttacttct

SEQ ID NO: 7747559 - DNA, 22 bp, Homo sapiens
atttattattgtggttacttct

SEQ ID NO: 7747560 - DNA, 22 bp, Homo sapiens
atttagcaaaaaatgatgaagc

SEQ ID NO: 7747561 - DNA, 22 bp, Homo sapiens
aggagctgagggagcgcccttg

SEQ ID NO: 7747562 - DNA, 20 bp, Homo sapiens
aggagctgaattagagggtt

SEQ ID NO: 7747563 - DNA, 20 bp, Homo sapiens
aggaggcaatgtagataagc

SEQ ID NO: 7747564 - DNA, 22 bp, Homo sapiens
aggaggcaactgagatttagaa

SEQ ID NO: 7747565 - DNA, 22 bp, Homo sapiens
aggaggaattgacacagaagcc

SEQ ID NO: 7747566 - DNA, 21 bp, Homo sapiens
aggacaggaactggctgaata

SEQ ID NO: 7747567 - DNA, 22 bp, Homo sapiens
aggactttatcttctagacctc

SEQ ID NO: 7747568 - DNA, 22 bp, Homo sapiens
aggagacagaatttaaatttgg

SEQ ID NO: 7747569 - DNA, 22 bp, Homo sapiens
cagtctctttatccaccaagcc

SEQ ID NO: 7747570 - DNA, 22 bp, Homo sapiens
cagtctctctgaagtattaaga

SEQ ID NO: 7747571 - DNA, 22 bp, Homo sapiens
aggagaagccaagttgtgagca

SEQ ID NO: 7747572 - DNA, 22 bp, Homo sapiens
aggaggcactcactctcagggt

SEQ ID NO: 7747573 - DNA, 22 bp, Homo sapiens
catgcacattattcaaagccca

SEQ ID NO: 7747574 - DNA, 22 bp, Homo sapiens
aggaggtggcctgagcgtgccc

SEQ ID NO: 7747575 - DNA, 22 bp, Homo sapiens
catgcaggaggaaaaagcagct

SEQ ID NO: 7747576 - DNA, 22 bp, Homo sapiens
catgcaggcccgcctgaatggg

SEQ ID NO: 7747577 - DNA, 22 bp, Homo sapiens
aggcacaggcctcagcacccag

SEQ ID NO: 7747578 - DNA, 22 bp, Homo sapiens
aggcacagcctcccccaactcc

SEQ ID NO: 7747579 - DNA, 22 bp, Homo sapiens
aggcacagcctcccttcacatg

SEQ ID NO: 7747580 - DNA, 22 bp, Homo sapiens
aggcacaggaacaggaaaagag

SEQ ID NO: 7747581 - DNA, 22 bp, Homo sapiens
catggcctgcctcctcctggtg

SEQ ID NO: 7747582 - DNA, 22 bp, Homo sapiens
aggcagcatttctgcttatcca

SEQ ID NO: 7747583 - DNA, 21 bp, Homo sapiens
aggcagccagtcatgctccct

SEQ ID NO: 7747584 - DNA, 21 bp, Homo sapiens
catttacatgacagattggtt

SEQ ID NO: 7747585 - DNA, 22 bp, Homo sapiens
aggcagcagactgttaatcaga

SEQ ID NO: 7747586 - DNA, 22 bp, Homo sapiens
aggcagcagaggttgaggaaag

SEQ ID NO: 7747587 - DNA, 18 bp, Homo sapiens
aggaaagacgaagagggc

SEQ ID NO: 7747588 - DNA, 22 bp, Homo sapiens
agctttagagactcttaggctt

SEQ ID NO: 7747589 - DNA, 22 bp, Homo sapiens
cagggccagccgcagcatccac

SEQ ID NO: 7747590 - DNA, 20 bp, Homo sapiens
aggaactggaagggaggaaa

SEQ ID NO: 7747591 - DNA, 22 bp, Homo sapiens
aggaactagtgcaacaggagcg

SEQ ID NO: 7747592 - DNA, 23 bp, Homo sapiens
aggaactgaggcctagggaggta

SEQ ID NO: 7747593 - DNA, 22 bp, Homo sapiens
aggaacatctatcacataaacg

SEQ ID NO: 7747594 - DNA, 22 bp, Homo sapiens
aggaacacttgtggaaacattc

SEQ ID NO: 7747595 - DNA, 22 bp, Homo sapiens
aggaacacttaattcgatacta

SEQ ID NO: 7747596 - DNA, 22 bp, Homo sapiens
aggaaccagaggttgagcaact

SEQ ID NO: 7747597 - DNA, 22 bp, Homo sapiens
aggaaccagacagaactgaatg

SEQ ID NO: 7747598 - DNA, 22 bp, Homo sapiens
aggaaccctgcgccatactttg

SEQ ID NO: 7747599 - DNA, 18 bp, Homo sapiens
aggaagcaggaggaaggc

SEQ ID NO: 7747600 - DNA, 22 bp, Homo sapiens
aggaaatgtacaaatgaagatg

SEQ ID NO: 7747601 - DNA, 22 bp, Homo sapiens
aggaacacatctttgtagcagg

SEQ ID NO: 7747602 - DNA, 22 bp, Homo sapiens
aggaacacatggacatttctga

SEQ ID NO: 7747603 - DNA, 22 bp, Homo sapiens
aggaacacccccttcctaccag

SEQ ID NO: 7747604 - DNA, 22 bp, Homo sapiens
aggaacacaatgcttctgtgtg

SEQ ID NO: 7747605 - DNA, 22 bp, Homo sapiens
aggaacacactgagcaactcct

SEQ ID NO: 7747606 - DNA, 22 bp, Homo sapiens
aggaacacaagctatgatccac

SEQ ID NO: 7747607 - DNA, 22 bp, Homo sapiens
aggaacaattgataaactcaca

SEQ ID NO: 7747608 - DNA, 22 bp, Homo sapiens
aggaacacaacttcctgagagc

SEQ ID NO: 7747609 - DNA, 22 bp, Homo sapiens
cagggccagcgcccaggcccag

SEQ ID NO: 7747610 - DNA, 22 bp, Homo sapiens
caggcctgggcttcggggctga

SEQ ID NO: 7747611 - DNA, 22 bp, Homo sapiens
caggcctgggctgggtatcagg

SEQ ID NO: 7747612 - DNA, 22 bp, Homo sapiens
caggcctggcccccggcacacc

SEQ ID NO: 7747613 - DNA, 22 bp, Homo sapiens
caggcctggggctggcttccag

SEQ ID NO: 7747614 - DNA, 22 bp, Homo sapiens
agctgggaagactggaagacag

SEQ ID NO: 7747615 - DNA, 23 bp, Homo sapiens
agctgggaattttctgaagcttt

SEQ ID NO: 7747616 - DNA, 22 bp, Homo sapiens
caggcctcaccagcggagctgc

SEQ ID NO: 7747617 - DNA, 23 bp, Homo sapiens
agctgtttcattattacaacacc

SEQ ID NO: 7747618 - DNA, 22 bp, Homo sapiens
agctgttttttcctcaccactt

SEQ ID NO: 7747619 - DNA, 22 bp, Homo sapiens
agcttggtggccctcctggctg

SEQ ID NO: 7747620 - DNA, 22 bp, Homo sapiens
agcttgatagtggctatcaagc

SEQ ID NO: 7747621 - DNA, 22 bp, Homo sapiens
agctctcttgtgttctgtatgg

SEQ ID NO: 7747622 - DNA, 22 bp, Homo sapiens
cagctgttgtctctcacatatt

SEQ ID NO: 7747623 - DNA, 22 bp, Homo sapiens
cagctgttgtgatccatttacg

SEQ ID NO: 7747624 - DNA, 22 bp, Homo sapiens
agctgaggccacgagtgaaggg

SEQ ID NO: 7747625 - DNA, 22 bp, Homo sapiens
agctgaggcatggacaggctgc

SEQ ID NO: 7747626 - DNA, 22 bp, Homo sapiens
agctgaggcatgatgctatcag

SEQ ID NO: 7747627 - DNA, 22 bp, Homo sapiens
agctgaggctctgagagggaag

SEQ ID NO: 7747628 - DNA, 23 bp, Homo sapiens
agctgaggctgtgggtgtcagag

SEQ ID NO: 7747629 - DNA, 22 bp, Homo sapiens
ccaggcatcacgggcatgtggc

SEQ ID NO: 7747630 - DNA, 22 bp, Homo sapiens
ccaggcagggctcaaggaacct

SEQ ID NO: 7747631 - DNA, 22 bp, Homo sapiens
aggctgagcaaagggccttacc

SEQ ID NO: 7747632 - DNA, 22 bp, Homo sapiens
aggctgagataggtggatcatt

SEQ ID NO: 7747633 - DNA, 22 bp, Homo sapiens
aggctctgttattctagagggc

SEQ ID NO: 7747634 - DNA, 22 bp, Homo sapiens
aggctctgcagtgctggaggac

SEQ ID NO: 7747635 - DNA, 22 bp, Homo sapiens
aggctctgcatccaggctttat

SEQ ID NO: 7747636 - DNA, 22 bp, Homo sapiens
aggctctgatcaggtggctgtg

SEQ ID NO: 7747637 - DNA, 22 bp, Homo sapiens
aggctctgagtctggtgtctgc

SEQ ID NO: 7747638 - DNA, 22 bp, Homo sapiens
aggctgagcggggtcccagagc

SEQ ID NO: 7747639 - DNA, 23 bp, Homo sapiens
aggctgagctctcccagcttcag

SEQ ID NO: 7747640 - DNA, 22 bp, Homo sapiens
aggctgaggcgggaggatcact

SEQ ID NO: 7747641 - DNA, 22 bp, Homo sapiens
aggctgaggcaggtggatcatt

SEQ ID NO: 7747642 - DNA, 22 bp, Homo sapiens
aggctgaggcaggtggatcact

SEQ ID NO: 7747643 - DNA, 22 bp, Homo sapiens
aggcattgtcatgggagcctag

SEQ ID NO: 7747644 - DNA, 23 bp, Homo sapiens
aggcagtggtggtaacatgtcaa

SEQ ID NO: 7747645 - DNA, 22 bp, Homo sapiens
aggcatgatgtgcagtggcaaa

SEQ ID NO: 7747646 - DNA, 17 bp, Homo sapiens
aggcatgaggcatcact

SEQ ID NO: 7747647 - DNA, 21 bp, Homo sapiens
aggcatgagccctgcatggac

SEQ ID NO: 7747648 - DNA, 22 bp, Homo sapiens
aggcagtgctcaagacagcagc

SEQ ID NO: 7747649 - DNA, 22 bp, Homo sapiens
aggcaggttggtgagaagactg

SEQ ID NO: 7747650 - DNA, 22 bp, Homo sapiens
aggccctcacagtctattgtga

SEQ ID NO: 7747651 - DNA, 19 bp, Homo sapiens
aggccctcaagtaacatta

SEQ ID NO: 7747652 - DNA, 22 bp, Homo sapiens
aggccctccattgatgtttatt

SEQ ID NO: 7747653 - DNA, 20 bp, Homo sapiens
aggccctccccactgttgct

SEQ ID NO: 7747654 - DNA, 22 bp, Homo sapiens
aggccctctagaggagtgtttg

SEQ ID NO: 7747655 - DNA, 22 bp, Homo sapiens
aggccctctcattccagaggca

SEQ ID NO: 7747656 - DNA, 22 bp, Homo sapiens
ccctggggagcaggcgaaggag

SEQ ID NO: 7747657 - DNA, 22 bp, Homo sapiens
ccctggggctgagggatggccg

SEQ ID NO: 7747658 - DNA, 23 bp, Homo sapiens
cccttcagcgagggcattaaggt

SEQ ID NO: 7747659 - DNA, 22 bp, Homo sapiens
cccttagctcacaagctaaagc

SEQ ID NO: 7747660 - DNA, 22 bp, Homo sapiens
cccttagctcaatttcttgccc

SEQ ID NO: 7747661 - DNA, 22 bp, Homo sapiens
cccttagctggtgagcccagcg

SEQ ID NO: 7747662 - DNA, 22 bp, Homo sapiens
cccttagctccaaggggtttgg

SEQ ID NO: 7747663 - DNA, 18 bp, Homo sapiens
cccttagcctttcctctc

SEQ ID NO: 7747664 - DNA, 22 bp, Homo sapiens
cccttagccaggaaatcgacct

SEQ ID NO: 7747665 - DNA, 19 bp, Homo sapiens
ccctgggggtttctggtac

SEQ ID NO: 7747666 - DNA, 22 bp, Homo sapiens
ccctgtggttgctagggcacag

SEQ ID NO: 7747667 - DNA, 22 bp, Homo sapiens
cctcagagactgcatcttccct

SEQ ID NO: 7747668 - DNA, 20 bp, Homo sapiens
cctccaggcacacccatgtg

SEQ ID NO: 7747669 - DNA, 22 bp, Homo sapiens
cctcccatggagctctgtccat

SEQ ID NO: 7747670 - DNA, 22 bp, Homo sapiens
ccccatgaagtagggtctctga

SEQ ID NO: 7747671 - DNA, 19 bp, Homo sapiens
ccccagggtaggctagggg

SEQ ID NO: 7747672 - DNA, 22 bp, Homo sapiens
ccccagggtcagtgtgtggagg

SEQ ID NO: 7747673 - DNA, 22 bp, Homo sapiens
agggagccagagttgggagctc

SEQ ID NO: 7747674 - DNA, 22 bp, Homo sapiens
agggagcagcagccacaggatg

SEQ ID NO: 7747675 - DNA, 19 bp, Homo sapiens
agggaatccggctgaggga

SEQ ID NO: 7747676 - DNA, 18 bp, Homo sapiens
aggcttacagcagcaggc

SEQ ID NO: 7747677 - DNA, 22 bp, Homo sapiens
aggcttagaaattcagctgagt

SEQ ID NO: 7747678 - DNA, 22 bp, Homo sapiens
aggcttagactacctggtctgt

SEQ ID NO: 7747679 - DNA, 22 bp, Homo sapiens
ccagttttgccatggtaacact

SEQ ID NO: 7747680 - DNA, 22 bp, Homo sapiens
cccagcagttgttggtgcacat

SEQ ID NO: 7747681 - DNA, 22 bp, Homo sapiens
cccagcagtgacccagtgatac

SEQ ID NO: 7747682 - DNA, 22 bp, Homo sapiens
aggctgtggtgggctttgagcc

SEQ ID NO: 7747683 - DNA, 22 bp, Homo sapiens
aggctgtgtttcttgcgttttc

SEQ ID NO: 7747684 - DNA, 22 bp, Homo sapiens
aggctgtgtttcccctggagct

SEQ ID NO: 7747685 - DNA, 22 bp, Homo sapiens
aggctgtgtttaagtggtaatg

SEQ ID NO: 7747686 - DNA, 22 bp, Homo sapiens
aggctgtgttctgccctctccc

SEQ ID NO: 7747687 - DNA, 22 bp, Homo sapiens
aggctgtgttctggttcttagc

SEQ ID NO: 7747688 - DNA, 22 bp, Homo sapiens
aggctgtgtggatgagtcttac

SEQ ID NO: 7747689 - DNA, 22 bp, Homo sapiens
aggctgtgtggtcatggtggct

SEQ ID NO: 7747690 - DNA, 22 bp, Homo sapiens
aggctgtgtcctcattttatat

SEQ ID NO: 7747691 - DNA, 22 bp, Homo sapiens
aggctgtgtgctccttatgaga

SEQ ID NO: 7747692 - DNA, 22 bp, Homo sapiens
aggctgtgtaaagtgctttccc

SEQ ID NO: 7747693 - DNA, 22 bp, Homo sapiens
aggctgtgtggataatattggg

SEQ ID NO: 7747694 - DNA, 22 bp, Homo sapiens
cctgccaggacattgcttgaag

SEQ ID NO: 7747695 - DNA, 22 bp, Homo sapiens
cctgctgagaaatcaagggagt

SEQ ID NO: 7747696 - DNA, 22 bp, Homo sapiens
cctggctggactggaccgtggc

SEQ ID NO: 7747697 - DNA, 19 bp, Homo sapiens
cctggctgctgtgggatgc

SEQ ID NO: 7747698 - DNA, 22 bp, Homo sapiens
cctggctggcaagatcgtgaag

SEQ ID NO: 7747699 - DNA, 22 bp, Homo sapiens
cctggctggggtagaagtgagg

SEQ ID NO: 7747700 - DNA, 22 bp, Homo sapiens
ccttttaagggagactagagat

SEQ ID NO: 7747701 - DNA, 20 bp, Homo sapiens
cgaggccaaggggctgggcc

SEQ ID NO: 7747702 - DNA, 22 bp, Homo sapiens
cggaggttgaggctgcagtgag

SEQ ID NO: 7747703 - DNA, 22 bp, Homo sapiens
cggaggcaaactcacctggctc

SEQ ID NO: 7747704 - DNA, 22 bp, Homo sapiens
aggtgccagctctcaggcagga

SEQ ID NO: 7747705 - DNA, 22 bp, Homo sapiens
aggtgctggagtagaagaaaaa

SEQ ID NO: 7747706 - DNA, 22 bp, Homo sapiens
aggtgctgccccgagaaggatg

SEQ ID NO: 7747707 - DNA, 22 bp, Homo sapiens
aggtgctggcgccccaggagac

SEQ ID NO: 7747708 - DNA, 22 bp, Homo sapiens
aggtgctggagtctgggcagga

SEQ ID NO: 7747709 - DNA, 22 bp, Homo sapiens
aggtgctgtttgtcagcagttt

SEQ ID NO: 7747710 - DNA, 19 bp, Homo sapiens
aggtgctggtgagggtgtt

SEQ ID NO: 7747711 - DNA, 20 bp, Homo sapiens
ccttctctggaattgcctcc

SEQ ID NO: 7747712 - DNA, 22 bp, Homo sapiens
ccttctctgcaggtagttggct

SEQ ID NO: 7747713 - DNA, 21 bp, Homo sapiens
ctcagaccacagctcacaccc

SEQ ID NO: 7747714 - DNA, 22 bp, Homo sapiens
agtcccagcctgtaggattggg

SEQ ID NO: 7747715 - DNA, 22 bp, Homo sapiens
agtcccagcctaggctgtgctg

SEQ ID NO: 7747716 - DNA, 22 bp, Homo sapiens
agtcccagatgacccagctact

SEQ ID NO: 7747717 - DNA, 22 bp, Homo sapiens
agtcccagcccagtcctgtaag

SEQ ID NO: 7747718 - DNA, 22 bp, Homo sapiens
agtcccagatctacaggaggga

SEQ ID NO: 7747719 - DNA, 20 bp, Homo sapiens
agtcccagatcaaatttctg

SEQ ID NO: 7747720 - DNA, 22 bp, Homo sapiens
agtcccagatctccattcggtc

SEQ ID NO: 7747721 - DNA, 22 bp, Homo sapiens
agtcccagactccagttttctg

SEQ ID NO: 7747722 - DNA, 22 bp, Homo sapiens
agtcccagagaggtcggggcca

SEQ ID NO: 7747723 - DNA, 22 bp, Homo sapiens
ctcagcacactcccatctaatt

SEQ ID NO: 7747724 - DNA, 22 bp, Homo sapiens
ctcagcacatctttacatttcc

SEQ ID NO: 7747725 - DNA, 22 bp, Homo sapiens
ctctccattccctacagttttc

SEQ ID NO: 7747726 - DNA, 22 bp, Homo sapiens
ctctccattccctacagttttc

SEQ ID NO: 7747727 - DNA, 22 bp, Homo sapiens
agtgctggcccatagctgctgg

SEQ ID NO: 7747728 - DNA, 22 bp, Homo sapiens
ctctgtctatcccattctgtgc

SEQ ID NO: 7747729 - DNA, 22 bp, Homo sapiens
agtgtaaacttaagagaatatc

SEQ ID NO: 7747730 - DNA, 22 bp, Homo sapiens
ataatatttgcattactgtgat

SEQ ID NO: 7747731 - DNA, 22 bp, Homo sapiens
ataatattgagtcaggacctga

SEQ ID NO: 7747732 - DNA, 22 bp, Homo sapiens
ataatattgaagagccttggcc

SEQ ID NO: 7747733 - DNA, 22 bp, Homo sapiens
ataatatttggataggacagta

SEQ ID NO: 7747734 - DNA, 22 bp, Homo sapiens
atacagaattcactacagtttc

SEQ ID NO: 7747735 - DNA, 22 bp, Homo sapiens
ctggaggaaaacaactgcagac

SEQ ID NO: 7747736 - DNA, 22 bp, Homo sapiens
atacagaattcactacagtttc

SEQ ID NO: 7747737 - DNA, 22 bp, Homo sapiens
ctggagggctgcagcgaggctg

SEQ ID NO: 7747738 - DNA, 22 bp, Homo sapiens
atactttagagctagattgcct

SEQ ID NO: 7747739 - DNA, 21 bp, Homo sapiens
ctgaggcatgcaggcctgggc

SEQ ID NO: 7747740 - DNA, 22 bp, Homo sapiens
ctgaggcaggatggcctggctg

SEQ ID NO: 7747741 - DNA, 22 bp, Homo sapiens
ctgaggcaggggcagctggaga

SEQ ID NO: 7747742 - DNA, 19 bp, Homo sapiens
agttggggcagggaagaga

SEQ ID NO: 7747743 - DNA, 22 bp, Homo sapiens
ctgagggtcaacttgattgtat

SEQ ID NO: 7747744 - DNA, 22 bp, Homo sapiens
ctgaggcctctttccttggctt

SEQ ID NO: 7747745 - DNA, 22 bp, Homo sapiens
ctgaggcctctctccttggctt

SEQ ID NO: 7747746 - DNA, 22 bp, Homo sapiens
ctgaggcttggaggggtctggt

SEQ ID NO: 7747747 - DNA, 18 bp, Homo sapiens
ctgaggcttagagaggtt

SEQ ID NO: 7747748 - DNA, 22 bp, Homo sapiens
ctgccaggcactgggctctgca

SEQ ID NO: 7747749 - DNA, 22 bp, Homo sapiens
ctgtgagttcattgtgccacct

SEQ ID NO: 7747750 - DNA, 22 bp, Homo sapiens
atccaaagatggaaagaacttt

SEQ ID NO: 7747751 - DNA, 22 bp, Homo sapiens
atccaaatatattttattcact

SEQ ID NO: 7747752 - DNA, 22 bp, Homo sapiens
atccaaatcatgtcagaagaac

SEQ ID NO: 7747753 - DNA, 22 bp, Homo sapiens
atccaaatcttcacacataaca

SEQ ID NO: 7747754 - DNA, 22 bp, Homo sapiens
ctgtggaggtaggagcaggaca

SEQ ID NO: 7747755 - DNA, 22 bp, Homo sapiens
atccatttgtaaatgttagagt

SEQ ID NO: 7747756 - DNA, 22 bp, Homo sapiens
atccctcagccacctttgagga

SEQ ID NO: 7747757 - DNA, 22 bp, Homo sapiens
atcctcagtgtttctgacatct

SEQ ID NO: 7747758 - DNA, 19 bp, Homo sapiens
atctacaattattctcagt

SEQ ID NO: 7747759 - DNA, 22 bp, Homo sapiens
atctacaagaggttctcctctc

SEQ ID NO: 7747760 - DNA, 22 bp, Homo sapiens
atatgttagggaacaatttgag

SEQ ID NO: 7747761 - DNA, 22 bp, Homo sapiens
atatgtttcagtattcaagtca

SEQ ID NO: 7747762 - DNA, 18 bp, Homo sapiens
atatgttaattaggtagg

SEQ ID NO: 7747763 - DNA, 22 bp, Homo sapiens
atatgtgtaaatgcatttgttt

SEQ ID NO: 7747764 - DNA, 22 bp, Homo sapiens
ctgggagaggaacctcgagggt

SEQ ID NO: 7747765 - DNA, 22 bp, Homo sapiens
ctgggcacacagtgactctgca

SEQ ID NO: 7747766 - DNA, 22 bp, Homo sapiens
ctgggcacagcgttgggctctt

SEQ ID NO: 7747767 - DNA, 22 bp, Homo sapiens
ctgggaagtagaatcagatgag

SEQ ID NO: 7747768 - DNA, 22 bp, Homo sapiens
ctgggaagcttcgagcaggaaa

SEQ ID NO: 7747769 - DNA, 22 bp, Homo sapiens
ctgggacacccaaggaaagagc

SEQ ID NO: 7747770 - DNA, 22 bp, Homo sapiens
gggccttggcgaagtgtggtgg

SEQ ID NO: 7747771 - DNA, 22 bp, Homo sapiens
gggccttgccatggagcctgag

SEQ ID NO: 7747772 - DNA, 22 bp, Homo sapiens
cagagcccttcctcccacgggg

SEQ ID NO: 7747773 - DNA, 22 bp, Homo sapiens
gggcgagggcgaaagcgagagc

SEQ ID NO: 7747774 - DNA, 22 bp, Homo sapiens
cagagccctagtcctgatggcc

SEQ ID NO: 7747775 - DNA, 22 bp, Homo sapiens
cagagctgacccaaggattgaa

SEQ ID NO: 7747776 - DNA, 22 bp, Homo sapiens
ggggaaagtgaattgtgtagtg

SEQ ID NO: 7747777 - DNA, 23 bp, Homo sapiens
ggggaaagaccatgcttgaggac

SEQ ID NO: 7747778 - DNA, 22 bp, Homo sapiens
ggggaaactgaggcacagacag

SEQ ID NO: 7747779 - DNA, 22 bp, Homo sapiens
gggctgtgtgcagtacgggtcc

SEQ ID NO: 7747780 - DNA, 22 bp, Homo sapiens
ggggaaacatgttgttcagacc

SEQ ID NO: 7747781 - DNA, 19 bp, Homo sapiens
cagagctgctggcctcgtc

SEQ ID NO: 7747782 - DNA, 22 bp, Homo sapiens
cagagctgctcatggtggccag

SEQ ID NO: 7747783 - DNA, 22 bp, Homo sapiens
cagagctgcgctttttcctggt

SEQ ID NO: 7747784 - DNA, 19 bp, Homo sapiens
gggtcgggaagttgagaat

SEQ ID NO: 7747785 - DNA, 22 bp, Homo sapiens
cagaggccagtggacaagggcc

SEQ ID NO: 7747786 - DNA, 22 bp, Homo sapiens
cagaggcccagtgagagggctg

SEQ ID NO: 7747787 - DNA, 22 bp, Homo sapiens
cagaggccaggctgcctgactg

SEQ ID NO: 7747788 - DNA, 19 bp, Homo sapiens
cagaggccagaagcacagg

SEQ ID NO: 7747789 - DNA, 22 bp, Homo sapiens
cagagctggtaagtggtagagg

SEQ ID NO: 7747790 - DNA, 22 bp, Homo sapiens
cagagctggtgtgtcctggcat

SEQ ID NO: 7747791 - DNA, 22 bp, Homo sapiens
ggggaagaaatagaacattttg

SEQ ID NO: 7747792 - DNA, 22 bp, Homo sapiens
gggaaggaggtggcttgaagtg

SEQ ID NO: 7747793 - DNA, 22 bp, Homo sapiens
gggaaactgtccagttctcccc

SEQ ID NO: 7747794 - DNA, 22 bp, Homo sapiens
gggaaacttctgctaaaaccag

SEQ ID NO: 7747795 - DNA, 22 bp, Homo sapiens
gggaaactttcacaatgtccag

SEQ ID NO: 7747796 - DNA, 21 bp, Homo sapiens
gggaaactctgcttaacagag

SEQ ID NO: 7747797 - DNA, 22 bp, Homo sapiens
gggaaactgaattcaggactct

SEQ ID NO: 7747798 - DNA, 22 bp, Homo sapiens
gggaaactcaggcatttccact

SEQ ID NO: 7747799 - DNA, 22 bp, Homo sapiens
gggaaactgcaactcagagagg

SEQ ID NO: 7747800 - DNA, 22 bp, Homo sapiens
gggaaactggggactgaatctg

SEQ ID NO: 7747801 - DNA, 22 bp, Homo sapiens
gggaaactagaagcagggttat

SEQ ID NO: 7747802 - DNA, 22 bp, Homo sapiens
gggaaactcacaggtgcagggg

SEQ ID NO: 7747803 - DNA, 22 bp, Homo sapiens
cagaagggcagcactgggaagg

SEQ ID NO: 7747804 - DNA, 22 bp, Homo sapiens
cagaagggacagggtttgtaga

SEQ ID NO: 7747805 - DNA, 22 bp, Homo sapiens
cagaaggctgcaggtttgctgt

SEQ ID NO: 7747806 - DNA, 22 bp, Homo sapiens
cagaagcagtgagagatgtgca

SEQ ID NO: 7747807 - DNA, 22 bp, Homo sapiens
cagaaggcaaggcctgccacgc

SEQ ID NO: 7747808 - DNA, 22 bp, Homo sapiens
cagaaggcatagatgaaggcct

SEQ ID NO: 7747809 - DNA, 22 bp, Homo sapiens
gggcacaccttgtctgagcaca

SEQ ID NO: 7747810 - DNA, 22 bp, Homo sapiens
gggcaagctcttcagaagctct

SEQ ID NO: 7747811 - DNA, 18 bp, Homo sapiens
cagcattagcagcttcca

SEQ ID NO: 7747812 - DNA, 22 bp, Homo sapiens
gtatttggaaaccaccagtgcc

SEQ ID NO: 7747813 - DNA, 22 bp, Homo sapiens
gtatttggtgatgcctccaaac

SEQ ID NO: 7747814 - DNA, 22 bp, Homo sapiens
gtattttaagtgactactaggt

SEQ ID NO: 7747815 - DNA, 22 bp, Homo sapiens
gtattttactgctcaaagctct

SEQ ID NO: 7747816 - DNA, 22 bp, Homo sapiens
gtattttacttacgcatgactt

SEQ ID NO: 7747817 - DNA, 22 bp, Homo sapiens
gtatctagtcaatgctgttcaa

SEQ ID NO: 7747818 - DNA, 22 bp, Homo sapiens
cagcagcactctgcgggtcccc

SEQ ID NO: 7747819 - DNA, 22 bp, Homo sapiens
cagcagcagacatttgatcttc

SEQ ID NO: 7747820 - DNA, 22 bp, Homo sapiens
cagcagcaacaacggaagcctt

SEQ ID NO: 7747821 - DNA, 22 bp, Homo sapiens
cagcagcaacaatagcggtcac

SEQ ID NO: 7747822 - DNA, 22 bp, Homo sapiens
cagcagcaaatctagaagagga

SEQ ID NO: 7747823 - DNA, 22 bp, Homo sapiens
cagcagagtaattctcacctct

SEQ ID NO: 7747824 - DNA, 22 bp, Homo sapiens
cagcagagtatggcactcaact

SEQ ID NO: 7747825 - DNA, 22 bp, Homo sapiens
cagcagagtttggcttctaatg

SEQ ID NO: 7747826 - DNA, 22 bp, Homo sapiens
cagcagcctggagggggccacg

SEQ ID NO: 7747827 - DNA, 22 bp, Homo sapiens
cagcagctacttggagcagcag

SEQ ID NO: 7747828 - DNA, 22 bp, Homo sapiens
cagcaggcaggtgggccaagtc

SEQ ID NO: 7747829 - DNA, 22 bp, Homo sapiens
cagcaggcggcccgcgggcccg

SEQ ID NO: 7747830 - DNA, 22 bp, Homo sapiens
ggttgcaaactcctgggatcaa

SEQ ID NO: 7747831 - DNA, 22 bp, Homo sapiens
ggtggggttttaggctgctgca

SEQ ID NO: 7747832 - DNA, 22 bp, Homo sapiens
cagcaagggataaagagttact

SEQ ID NO: 7747833 - DNA, 22 bp, Homo sapiens
ggctagggagacagagggcatg

SEQ ID NO: 7747834 - DNA, 22 bp, Homo sapiens
cactggatttccaggaatactc

SEQ ID NO: 7747835 - DNA, 22 bp, Homo sapiens
cactgagaggtctcatttccaa

SEQ ID NO: 7747836 - DNA, 22 bp, Homo sapiens
cactgagacccgaatacttcca

SEQ ID NO: 7747837 - DNA, 22 bp, Homo sapiens
ggcctcgcggcttctggtggct

SEQ ID NO: 7747838 - DNA, 22 bp, Homo sapiens
ggcctcgagcaatactcccatc

SEQ ID NO: 7747839 - DNA, 22 bp, Homo sapiens
cacccaggttggagtgcagtgg

SEQ ID NO: 7747840 - DNA, 22 bp, Homo sapiens
cacccaggctggaatgcagtgg

SEQ ID NO: 7747841 - DNA, 22 bp, Homo sapiens
ggcagtttctcaggcaggggta

SEQ ID NO: 7747842 - DNA, 18 bp, Homo sapiens
ggcagtttgtgtagggga

SEQ ID NO: 7747843 - DNA, 22 bp, Homo sapiens
caccccttgtctttggggtcgt

SEQ ID NO: 7747844 - DNA, 22 bp, Homo sapiens
caccctcaagcagtggcacgtg

SEQ ID NO: 7747845 - DNA, 22 bp, Homo sapiens
cacccctgtggagcatggtggc

SEQ ID NO: 7747846 - DNA, 22 bp, Homo sapiens
caccccttccgccactgccttc

SEQ ID NO: 7747847 - DNA, 22 bp, Homo sapiens
cacccctcgccactgcccttgt

SEQ ID NO: 7747848 - DNA, 22 bp, Homo sapiens
ggcagttctcagccaaggcaat

SEQ ID NO: 7747849 - DNA, 22 bp, Homo sapiens
cacccagagggcttgctgaaca

SEQ ID NO: 7747850 - DNA, 22 bp, Homo sapiens
cacccagagcctgagagggata

SEQ ID NO: 7747851 - DNA, 22 bp, Homo sapiens
cacactgacctgaacttagcat

SEQ ID NO: 7747852 - DNA, 22 bp, Homo sapiens
cacactagtctatccattagct

SEQ ID NO: 7747853 - DNA, 22 bp, Homo sapiens
ggatgttgattgaatggccatt

SEQ ID NO: 7747854 - DNA, 22 bp, Homo sapiens
ggatgtcgaggatggggtagca

SEQ ID NO: 7747855 - DNA, 20 bp, Homo sapiens
ggcacagtttttgcacctgc

SEQ ID NO: 7747856 - DNA, 22 bp, Homo sapiens
ggcacaaggtttaaataacatc

SEQ ID NO: 7747857 - DNA, 22 bp, Homo sapiens
ggcacacaaaggcagcatttga

SEQ ID NO: 7747858 - DNA, 22 bp, Homo sapiens
ggcacagtgattaagagccagt

SEQ ID NO: 7747859 - DNA, 22 bp, Homo sapiens
ggcagatggaaggacagacgga

SEQ ID NO: 7747860 - DNA, 22 bp, Homo sapiens
caaagtaactgcctttccaatt

SEQ ID NO: 7747861 - DNA, 22 bp, Homo sapiens
caaagtaatatggtcccagtga

SEQ ID NO: 7747862 - DNA, 22 bp, Homo sapiens
caaagtaatttggagatatata

SEQ ID NO: 7747863 - DNA, 22 bp, Homo sapiens
gctgcatggagggtgcccagga

SEQ ID NO: 7747864 - DNA, 22 bp, Homo sapiens
caaggaggaagatgcaggggac

SEQ ID NO: 7747865 - DNA, 22 bp, Homo sapiens
caagctgctataggttgctggg

SEQ ID NO: 7747866 - DNA, 20 bp, Homo sapiens
gctgccttggatggctacac

SEQ ID NO: 7747867 - DNA, 22 bp, Homo sapiens
cacaagtttgggtcactcagct

SEQ ID NO: 7747868 - DNA, 22 bp, Homo sapiens
ggaaaatactgattcatgccat

SEQ ID NO: 7747869 - DNA, 22 bp, Homo sapiens
cacaaaatctttctcgattatt

SEQ ID NO: 7747870 - DNA, 17 bp, Homo sapiens
ggaaaagaagagtagga

SEQ ID NO: 7747871 - DNA, 22 bp, Homo sapiens
cacaccctcgtgctccctcccg

SEQ ID NO: 7747872 - DNA, 22 bp, Homo sapiens
cacacattcaccatgactgaaa

SEQ ID NO: 7747873 - DNA, 22 bp, Homo sapiens
cacacattccaaaatcaagggt

SEQ ID NO: 7747874 - DNA, 22 bp, Homo sapiens
gcttctctctcagactgcaagc

SEQ ID NO: 7747875 - DNA, 22 bp, Homo sapiens
gcttctctggcctgcagggcat

SEQ ID NO: 7747876 - DNA, 22 bp, Homo sapiens
gcttctctggctggtctgccac

SEQ ID NO: 7747877 - DNA, 22 bp, Homo sapiens
gcttctcttaatgcctggcttt

SEQ ID NO: 7747878 - DNA, 22 bp, Homo sapiens
gcttctctcaggagcatcagcc

SEQ ID NO: 7747879 - DNA, 22 bp, Homo sapiens
gcttccaggtcattctcaccct

SEQ ID NO: 7747880 - DNA, 22 bp, Homo sapiens
gctgtggcctggcgcagagctg

SEQ ID NO: 7747881 - DNA, 22 bp, Homo sapiens
gcttctcttgtccaagggcagg

SEQ ID NO: 7747882 - DNA, 22 bp, Homo sapiens
gcttctcttcgcctaggtcctt

SEQ ID NO: 7747883 - DNA, 22 bp, Homo sapiens
gcttctctttctcccctggcgg

SEQ ID NO: 7747884 - DNA, 19 bp, Homo sapiens
gcttgggagagggagctaa

SEQ ID NO: 7747885 - DNA, 22 bp, Homo sapiens
caaggcaagtcatatgggcaag

SEQ ID NO: 7747886 - DNA, 22 bp, Homo sapiens
caaggcagaattcagactcagg

SEQ ID NO: 7747887 - DNA, 18 bp, Homo sapiens
gctgtggaagtctttata

SEQ ID NO: 7747888 - DNA, 22 bp, Homo sapiens
gctgtggagtacagagctggtt

SEQ ID NO: 7747889 - DNA, 22 bp, Homo sapiens
gaggagctggctgtcgggaggc

SEQ ID NO: 7747890 - DNA, 22 bp, Homo sapiens
gagctgggcctcagaacacagt

SEQ ID NO: 7747891 - DNA, 22 bp, Homo sapiens
gagctgggcctgcgagtgctgc

SEQ ID NO: 7747892 - DNA, 22 bp, Homo sapiens
gagctggggcagcttaggagtg

SEQ ID NO: 7747893 - DNA, 21 bp, Homo sapiens
gagctgggcgaggctccgggg

SEQ ID NO: 7747894 - DNA, 22 bp, Homo sapiens
gaggcctggctgggaggaggtg

SEQ ID NO: 7747895 - DNA, 22 bp, Homo sapiens
gaggcctgggcaagggggtctg

SEQ ID NO: 7747896 - DNA, 20 bp, Homo sapiens
gaggctgcggactgctggac

SEQ ID NO: 7747897 - DNA, 22 bp, Homo sapiens
gaggctgctgttagccctgggc

SEQ ID NO: 7747898 - DNA, 22 bp, Homo sapiens
gaggggaagacttctggacagt

SEQ ID NO: 7747899 - DNA, 22 bp, Homo sapiens
gagaaatatggctcagttccac

SEQ ID NO: 7747900 - DNA, 22 bp, Homo sapiens
gagaaatagattcatggtagat

SEQ ID NO: 7747901 - DNA, 20 bp, Homo sapiens
atggaggaagggcaagagaa

SEQ ID NO: 7747902 - DNA, 22 bp, Homo sapiens
atggagctgtagggagcagtgg

SEQ ID NO: 7747903 - DNA, 22 bp, Homo sapiens
atggaacatgaattaatatggt

SEQ ID NO: 7747904 - DNA, 22 bp, Homo sapiens
gacactgagaaatattcagaca

SEQ ID NO: 7747905 - DNA, 18 bp, Homo sapiens
gacactgagcattttgag

SEQ ID NO: 7747906 - DNA, 22 bp, Homo sapiens
gacagcaacactcaattctgca

SEQ ID NO: 7747907 - DNA, 22 bp, Homo sapiens
gagccaggagatacctaagggg

SEQ ID NO: 7747908 - DNA, 22 bp, Homo sapiens
gagccaggaagaaggccttact

SEQ ID NO: 7747909 - DNA, 22 bp, Homo sapiens
gagccaggaggcagagactgca

SEQ ID NO: 7747910 - DNA, 22 bp, Homo sapiens
gagaacacttatggattattct

SEQ ID NO: 7747911 - DNA, 22 bp, Homo sapiens
cttttattttgaattaagggct

SEQ ID NO: 7747912 - DNA, 22 bp, Homo sapiens
atctagattaggtataagagct

SEQ ID NO: 7747913 - DNA, 22 bp, Homo sapiens
cttgctgagataaatgctgtct

SEQ ID NO: 7747914 - DNA, 22 bp, Homo sapiens
cttgctctagatgttcagagct

SEQ ID NO: 7747915 - DNA, 21 bp, Homo sapiens
cttggcctctagctagagctg

SEQ ID NO: 7747916 - DNA, 22 bp, Homo sapiens
cttggcctgggccgcagccact

SEQ ID NO: 7747917 - DNA, 22 bp, Homo sapiens
cttggcctcttctcagggtggg

SEQ ID NO: 7747918 - DNA, 22 bp, Homo sapiens
gacactgaccccaagctgtcct

SEQ ID NO: 7747919 - DNA, 20 bp, Homo sapiens
atgcatgcatgcacatgcac

SEQ ID NO: 7747920 - DNA, 21 bp, Homo sapiens
atgcagagaactccagggaag

SEQ ID NO: 7747921 - DNA, 22 bp, Homo sapiens
atgcagaatcttgagaaaaatt

SEQ ID NO: 7747922 - DNA, 22 bp, Homo sapiens
atgcagaagactgaaaagctga

SEQ ID NO: 7747923 - DNA, 22 bp, Homo sapiens
atgcagaaagagaatgtaatgt

SEQ ID NO: 7747924 - DNA, 22 bp, Homo sapiens
gcctgggagtgcacagtgaggt

SEQ ID NO: 7747925 - DNA, 22 bp, Homo sapiens
gcctgtgacccctccatctgct

SEQ ID NO: 7747926 - DNA, 22 bp, Homo sapiens
gcctgtgatgcccccataagta

SEQ ID NO: 7747927 - DNA, 22 bp, Homo sapiens
caaaagaagctcttggggctag

SEQ ID NO: 7747928 - DNA, 22 bp, Homo sapiens
caaaaccaagaacattcatttc

SEQ ID NO: 7747929 - DNA, 22 bp, Homo sapiens
gcgcacgtcagaaaggctttta

SEQ ID NO: 7747930 - DNA, 22 bp, Homo sapiens
gcgcagagtagcagagtgctga

SEQ ID NO: 7747931 - DNA, 22 bp, Homo sapiens
gcgaggcagccctcaggtgtta

SEQ ID NO: 7747932 - DNA, 22 bp, Homo sapiens
gctcaggaaggctcaaccagga

SEQ ID NO: 7747933 - DNA, 22 bp, Homo sapiens
gcctgctgggagacacccccag

SEQ ID NO: 7747934 - DNA, 22 bp, Homo sapiens
gcctgctgccaccctggctccg

SEQ ID NO: 7747935 - DNA, 22 bp, Homo sapiens
gcctgctggaggagcctcaggg

SEQ ID NO: 7747936 - DNA, 22 bp, Homo sapiens
gcctccccaagcagcagggatt

SEQ ID NO: 7747937 - DNA, 22 bp, Homo sapiens
gcctccccaaagtgctgacagc

SEQ ID NO: 7747938 - DNA, 22 bp, Homo sapiens
gcctctagggctgttgggaatt

SEQ ID NO: 7747939 - DNA, 22 bp, Homo sapiens
gcctccagcccacgcaggcctg

SEQ ID NO: 7747940 - DNA, 22 bp, Homo sapiens
atttctcagtaatctcagcaat

SEQ ID NO: 7747941 - DNA, 23 bp, Homo sapiens
gccaggagtgggtagactaatgc

SEQ ID NO: 7747942 - DNA, 22 bp, Homo sapiens
gccaggagtgtcccactcattt

SEQ ID NO: 7747943 - DNA, 22 bp, Homo sapiens
gccaggagggaaaggacaattt

SEQ ID NO: 7747944 - DNA, 22 bp, Homo sapiens
gccaggccactcccgggtcctg

SEQ ID NO: 7747945 - DNA, 22 bp, Homo sapiens
atttccttgcaacttaggcatg

SEQ ID NO: 7747946 - DNA, 22 bp, Homo sapiens
attctcaatggctactttcata

SEQ ID NO: 7747947 - DNA, 22 bp, Homo sapiens
attcttcacctgagtcagtcta

SEQ ID NO: 7747948 - DNA, 22 bp, Homo sapiens
attcttatttaaatagagtctg

SEQ ID NO: 7747949 - DNA, 22 bp, Homo sapiens
attcttcacacctgttcctgtt

SEQ ID NO: 7747950 - DNA, 22 bp, Homo sapiens
attgaagcatggagatgaggca

SEQ ID NO: 7747951 - DNA, 22 bp, Homo sapiens
gcagcagggtgccagctttgca

SEQ ID NO: 7747952 - DNA, 22 bp, Homo sapiens
attctacacctctctcatttag

SEQ ID NO: 7747953 - DNA, 22 bp, Homo sapiens
attcctcatttgttgagaacca

SEQ ID NO: 7747954 - DNA, 22 bp, Homo sapiens
attccctttgacgatccctagg

SEQ ID NO: 7747955 - DNA, 20 bp, Homo sapiens
gcagagctgttctgtgggga

SEQ ID NO: 7747956 - DNA, 22 bp, Homo sapiens
attcagtggatatcttcacttt

SEQ ID NO: 7747957 - DNA, 22 bp, Homo sapiens
attaatatttgcaccttctgtc

SEQ ID NO: 7747958 - DNA, 21 bp, Homo sapiens
gatgatgccatcctccatctc

SEQ ID NO: 7747959 - DNA, 22 bp, Homo sapiens
gatgatattttgactggagaat

SEQ ID NO: 7747960 - DNA, 22 bp, Homo sapiens
attaatatcccccgccgttctg

SEQ ID NO: 7747961 - DNA, 22 bp, Homo sapiens
attaagcacttggggaaaggat

SEQ ID NO: 7747962 - DNA, 22 bp, Homo sapiens
attaagcattcagggctagaga

SEQ ID NO: 7747963 - DNA, 22 bp, Homo sapiens
attaatatgagaaagtggcaga

SEQ ID NO: 7747964 - DNA, 22 bp, Homo sapiens
attaatatcctgctggctaaat

SEQ ID NO: 7747965 - DNA, 22 bp, Homo sapiens
attaatattggttcattagctg

SEQ ID NO: 7747966 - DNA, 22 bp, Homo sapiens
attagaactaggctaagtaaaa

SEQ ID NO: 7747967 - DNA, 22 bp, Homo sapiens
attagagctgttagtgaagtgc

SEQ ID NO: 7747968 - DNA, 22 bp, Homo sapiens
attagagcagtgtattatgata

SEQ ID NO: 7747969 - DNA, 22 bp, Homo sapiens
attattcttaatgcagggatta

SEQ ID NO: 7747970 - DNA, 22 bp, Homo sapiens
attattcttatgtcatcatggc

SEQ ID NO: 7747971 - DNA, 22 bp, Homo sapiens
attattcttgaggtgtttattg

SEQ ID NO: 7747972 - DNA, 22 bp, Homo sapiens
attattctttgataaatggcag

SEQ ID NO: 7747973 - DNA, 22 bp, Homo sapiens
attattctctggaggaaagatt

SEQ ID NO: 7747974 - DNA, 22 bp, Homo sapiens
atgtgttctgaggcagatgact

SEQ ID NO: 7747975 - DNA, 20 bp, Homo sapiens
atgttttataaaagaacggg

SEQ ID NO: 7747976 - DNA, 22 bp, Homo sapiens
atgttttatattttgcagcagt

SEQ ID NO: 7747977 - DNA, 22 bp, Homo sapiens
atgttttaccctttgcacaaac

SEQ ID NO: 7747978 - DNA, 22 bp, Homo sapiens
atgttttaccctttgcacaaac

SEQ ID NO: 7747979 - DNA, 22 bp, Homo sapiens
atgttttatgttccactcaagg

SEQ ID NO: 7747980 - DNA, 23 bp, Homo sapiens
atgttttatgtctctagctgcca

SEQ ID NO: 7747981 - DNA, 23 bp, Homo sapiens
atgttttatgtctctagctgcca

SEQ ID NO: 7747982 - DNA, 22 bp, Homo sapiens
atgttttatgcttcagatgagg

SEQ ID NO: 7747983 - DNA, 22 bp, Homo sapiens
atgttttatattttgcagcagt

SEQ ID NO: 7747984 - DNA, 22 bp, Homo sapiens
atgttttattaccaacttgtac

SEQ ID NO: 7747985 - DNA, 22 bp, Homo sapiens
caggtctggtgagagaacagtt

SEQ ID NO: 7747986 - DNA, 22 bp, Homo sapiens
caggtctgttttcaaggtcagt

SEQ ID NO: 7747987 - DNA, 19 bp, Homo sapiens
caggtcttcttggaggact

SEQ ID NO: 7747988 - DNA, 22 bp, Homo sapiens
caggtctgtattaacagagggt

SEQ ID NO: 7747989 - DNA, 22 bp, Homo sapiens
caggtctgtgtgccatttccaa

SEQ ID NO: 7747990 - DNA, 17 bp, Homo sapiens
caggtctgaggccaggc

SEQ ID NO: 7747991 - DNA, 22 bp, Homo sapiens
caggtctgggttgatggcctgg

SEQ ID NO: 7747992 - DNA, 22 bp, Homo sapiens
caggtctgagtcacatgttcat

SEQ ID NO: 7747993 - DNA, 22 bp, Homo sapiens
caggtctgcaggctggagtcca

SEQ ID NO: 7747994 - DNA, 22 bp, Homo sapiens
caggtctggcatcagctgtgtg

SEQ ID NO: 7747995 - DNA, 22 bp, Homo sapiens
caggtctgcagacagggccatg

SEQ ID NO: 7747996 - DNA, 22 bp, Homo sapiens
caggggcaggtgtgagatcatc

SEQ ID NO: 7747997 - DNA, 22 bp, Homo sapiens
caggggccaagggtccagacct

SEQ ID NO: 7747998 - DNA, 22 bp, Homo sapiens
tcacttcccagacggggtggca

SEQ ID NO: 7747999 - DNA, 22 bp, Homo sapiens
cagtgctggagatgggtggaac

SEQ ID NO: 7748000 - DNA, 22 bp, Homo sapiens
tcagctgagttctagagcactc

SEQ ID NO: 7748001 - DNA, 22 bp, Homo sapiens
tcagctgagctccagctcatag

SEQ ID NO: 7748002 - DNA, 22 bp, Homo sapiens
tcagctgaagtggagaagcaga

SEQ ID NO: 7748003 - DNA, 22 bp, Homo sapiens
cagtttcttcctcccccagaga

SEQ ID NO: 7748004 - DNA, 22 bp, Homo sapiens
cagtttatatgagggtatcaag

SEQ ID NO: 7748005 - DNA, 22 bp, Homo sapiens
catagaatgtaataaagagtag

SEQ ID NO: 7748006 - DNA, 22 bp, Homo sapiens
tcaggaagtgcctaggctggcc

SEQ ID NO: 7748007 - DNA, 22 bp, Homo sapiens
tcaggaagtggtaaaggatgtt

SEQ ID NO: 7748008 - DNA, 21 bp, Homo sapiens
catcacaggatgattttttca

SEQ ID NO: 7748009 - DNA, 22 bp, Homo sapiens
catcacagaaataaacatacct

SEQ ID NO: 7748010 - DNA, 22 bp, Homo sapiens
tcagggccacaacaccagagtc

SEQ ID NO: 7748011 - DNA, 22 bp, Homo sapiens
catcacagtttgtcagaaatca

SEQ ID NO: 7748012 - DNA, 22 bp, Homo sapiens
catcacagtggctgtttattta

SEQ ID NO: 7748013 - DNA, 22 bp, Homo sapiens
catgagaaggttttggcatata

SEQ ID NO: 7748014 - DNA, 22 bp, Homo sapiens
catgatataaagtagtagataa

SEQ ID NO: 7748015 - DNA, 22 bp, Homo sapiens
catgtgcagtgtaagacatgct

SEQ ID NO: 7748016 - DNA, 22 bp, Homo sapiens
catgtgcagactctgacaggct

SEQ ID NO: 7748017 - DNA, 19 bp, Homo sapiens
catgtgcatgagcacagga

SEQ ID NO: 7748018 - DNA, 22 bp, Homo sapiens
catgtgcattggggccagggag

SEQ ID NO: 7748019 - DNA, 22 bp, Homo sapiens
tctcttgtaatttaaaaaatct

SEQ ID NO: 7748020 - DNA, 22 bp, Homo sapiens
tctgaggagttgggccagtgct

SEQ ID NO: 7748021 - DNA, 22 bp, Homo sapiens
tctgaggatagaggcaatagga

SEQ ID NO: 7748022 - DNA, 22 bp, Homo sapiens
tctgaggactattgcaatactt

SEQ ID NO: 7748023 - DNA, 22 bp, Homo sapiens
ccagccctcactgaggcctctc

SEQ ID NO: 7748024 - DNA, 22 bp, Homo sapiens
tctgaggacctactgaagagtt

SEQ ID NO: 7748025 - DNA, 22 bp, Homo sapiens
tctgagagtctttcttcaagtg

SEQ ID NO: 7748026 - DNA, 22 bp, Homo sapiens
tctgaggcatacccaggccccc

SEQ ID NO: 7748027 - DNA, 22 bp, Homo sapiens
ccagctggtctgtgctcatgtt

SEQ ID NO: 7748028 - DNA, 22 bp, Homo sapiens
ccaggaagaaacagtctttata

SEQ ID NO: 7748029 - DNA, 22 bp, Homo sapiens
ccaggaagacacatgctcatcc

SEQ ID NO: 7748030 - DNA, 22 bp, Homo sapiens
ccaggaaccgatgatcagaggg

SEQ ID NO: 7748031 - DNA, 22 bp, Homo sapiens
ccaggaacaaagccccatccac

SEQ ID NO: 7748032 - DNA, 16 bp, Homo sapiens
ccaggaacacacagct

SEQ ID NO: 7748033 - DNA, 19 bp, Homo sapiens
ccaggaacccctagctacc

SEQ ID NO: 7748034 - DNA, 22 bp, Homo sapiens
ccaggaactcagctctgcactt

SEQ ID NO: 7748035 - DNA, 22 bp, Homo sapiens
ccaggaactaagaatcctttag

SEQ ID NO: 7748036 - DNA, 22 bp, Homo sapiens
ccaggaaaaagagaaacatggt

SEQ ID NO: 7748037 - DNA, 22 bp, Homo sapiens
ccaggaaaataccaagctttaa

SEQ ID NO: 7748038 - DNA, 22 bp, Homo sapiens
ccaggaagcctgtgtctctgga

SEQ ID NO: 7748039 - DNA, 22 bp, Homo sapiens
ccaggaagcctcagatgctgag

SEQ ID NO: 7748040 - DNA, 23 bp, Homo sapiens
ccaggaagaggccatccacagtc

SEQ ID NO: 7748041 - DNA, 22 bp, Homo sapiens
ccaggaagcataatgtagtggg

SEQ ID NO: 7748042 - DNA, 22 bp, Homo sapiens
ccaggaagatttattttggctt

SEQ ID NO: 7748043 - DNA, 21 bp, Homo sapiens
ccaggaaggactgagctccct

SEQ ID NO: 7748044 - DNA, 22 bp, Homo sapiens
ccaggaagctgtctgatatgaa

SEQ ID NO: 7748045 - DNA, 22 bp, Homo sapiens
ccaggaagctctgctccacggg

SEQ ID NO: 7748046 - DNA, 22 bp, Homo sapiens
ccaggaagctgtgagattccaa

SEQ ID NO: 7748047 - DNA, 22 bp, Homo sapiens
ccaggaaggaagcaggggtttc

SEQ ID NO: 7748048 - DNA, 22 bp, Homo sapiens
ccaggaagcctttttctttgac

SEQ ID NO: 7748049 - DNA, 22 bp, Homo sapiens
ccaggaagcggtgagggctgcc

SEQ ID NO: 7748050 - DNA, 22 bp, Homo sapiens
tctgtcttagccatctcaggct

SEQ ID NO: 7748051 - DNA, 22 bp, Homo sapiens
ccaggaggcggaaggtacagtg

SEQ ID NO: 7748052 - DNA, 22 bp, Homo sapiens
tcccagggctctagagtgctgg

SEQ ID NO: 7748053 - DNA, 22 bp, Homo sapiens
tcccagggcttttctcatgctt

SEQ ID NO: 7748054 - DNA, 22 bp, Homo sapiens
tcccagggtcagtggtgaggcc

SEQ ID NO: 7748055 - DNA, 22 bp, Homo sapiens
tcccagggccgcaaacgagttt

SEQ ID NO: 7748056 - DNA, 22 bp, Homo sapiens
tcccagggggatgaacactgcc

SEQ ID NO: 7748057 - DNA, 22 bp, Homo sapiens
tcccagggtatcctgtagtaaa

SEQ ID NO: 7748058 - DNA, 21 bp, Homo sapiens
tcccagggccaggtgccatca

SEQ ID NO: 7748059 - DNA, 22 bp, Homo sapiens
tcccagggcagctgtccagaag

SEQ ID NO: 7748060 - DNA, 22 bp, Homo sapiens
tcccagggcactcaccctccct

SEQ ID NO: 7748061 - DNA, 20 bp, Homo sapiens
ccaaatgtggagaaaaagta

SEQ ID NO: 7748062 - DNA, 22 bp, Homo sapiens
tcctcccacataggacaatggg

SEQ ID NO: 7748063 - DNA, 22 bp, Homo sapiens
tcctccccaaagcccagcctgg

SEQ ID NO: 7748064 - DNA, 17 bp, Homo sapiens
tcctccccgcagttgca

SEQ ID NO: 7748065 - DNA, 20 bp, Homo sapiens
tcctcccccacctttgcagc

SEQ ID NO: 7748066 - DNA, 22 bp, Homo sapiens
ccacaaggaggacagcagttgg

SEQ ID NO: 7748067 - DNA, 22 bp, Homo sapiens
ccacacagataagtgttttcta

SEQ ID NO: 7748068 - DNA, 22 bp, Homo sapiens
ccacacagggggatgagttatt

SEQ ID NO: 7748069 - DNA, 22 bp, Homo sapiens
ccacagaatcgctagtggagca

SEQ ID NO: 7748070 - DNA, 22 bp, Homo sapiens
ccacagaatgatgacacttcag

SEQ ID NO: 7748071 - DNA, 19 bp, Homo sapiens
ccacagcctgctgtcttcc

SEQ ID NO: 7748072 - DNA, 22 bp, Homo sapiens
tctcccacagccgtgcttcaag

SEQ ID NO: 7748073 - DNA, 22 bp, Homo sapiens
ccagacagcagttaaaggacat

SEQ ID NO: 7748074 - DNA, 23 bp, Homo sapiens
tcctggtgacatgcctgagcatc

SEQ ID NO: 7748075 - DNA, 22 bp, Homo sapiens
ccacagtcctggcttctgtctg

SEQ ID NO: 7748076 - DNA, 22 bp, Homo sapiens
ccagaaaagcatctggttcttt

SEQ ID NO: 7748077 - DNA, 22 bp, Homo sapiens
ccagaaaaggagctgcaggatg

SEQ ID NO: 7748078 - DNA, 22 bp, Homo sapiens
gtgggtggggagctctctggag

SEQ ID NO: 7748079 - DNA, 22 bp, Homo sapiens
gtgtcttttctgtctagcacaa

SEQ ID NO: 7748080 - DNA, 22 bp, Homo sapiens
gtgtgagagactgaagaaagcc

SEQ ID NO: 7748081 - DNA, 22 bp, Homo sapiens
gtggggcatgcacgctgctcct

SEQ ID NO: 7748082 - DNA, 22 bp, Homo sapiens
gtggggcagtggcctgggagca

SEQ ID NO: 7748083 - DNA, 22 bp, Homo sapiens
gtggggctgcttaggctgcgca

SEQ ID NO: 7748084 - DNA, 22 bp, Homo sapiens
cagctgcagatcatgtttacag

SEQ ID NO: 7748085 - DNA, 22 bp, Homo sapiens
gtggcagaaactggcagaggag

SEQ ID NO: 7748086 - DNA, 22 bp, Homo sapiens
gtggcctgtcagaagccgtggg

SEQ ID NO: 7748087 - DNA, 22 bp, Homo sapiens
cagctgaggaatactagatgta

SEQ ID NO: 7748088 - DNA, 22 bp, Homo sapiens
cagctgagctgccagactactg

SEQ ID NO: 7748089 - DNA, 22 bp, Homo sapiens
cagctgagctcccaggccatca

SEQ ID NO: 7748090 - DNA, 22 bp, Homo sapiens
cagctgaacatgtagagcatct

SEQ ID NO: 7748091 - DNA, 22 bp, Homo sapiens
gtgggacagctggagggtccct

SEQ ID NO: 7748092 - DNA, 22 bp, Homo sapiens
gtgttttattggtgcagtcaga

SEQ ID NO: 7748093 - DNA, 22 bp, Homo sapiens
cagctgtgctagaagccacgaa

SEQ ID NO: 7748094 - DNA, 22 bp, Homo sapiens
cagctgtgattcctgctgtcca

SEQ ID NO: 7748095 - DNA, 22 bp, Homo sapiens
cagcttcagcgtgacaccagtg

SEQ ID NO: 7748096 - DNA, 22 bp, Homo sapiens
cagcttcaactgcacagtcaac

SEQ ID NO: 7748097 - DNA, 22 bp, Homo sapiens
cagctgtttcagtagcgttact

SEQ ID NO: 7748098 - DNA, 22 bp, Homo sapiens
cagctgtttgggcatggccaga

SEQ ID NO: 7748099 - DNA, 22 bp, Homo sapiens
cagctgttgtgtatcaggcaga

SEQ ID NO: 7748100 - DNA, 22 bp, Homo sapiens
cagctgttgttatgtctgcagg

SEQ ID NO: 7748101 - DNA, 22 bp, Homo sapiens
cagctgttgtgatttccaggag

SEQ ID NO: 7748102 - DNA, 22 bp, Homo sapiens
cagctgttgtgctgggcagtta

SEQ ID NO: 7748103 - DNA, 22 bp, Homo sapiens
cagcttcattgcctgatgtctt

SEQ ID NO: 7748104 - DNA, 22 bp, Homo sapiens
gttattagtaagactcgcacat

SEQ ID NO: 7748105 - DNA, 22 bp, Homo sapiens
gttattagaagtgaaggattgt

SEQ ID NO: 7748106 - DNA, 22 bp, Homo sapiens
gttattctacagtcattgaagt

SEQ ID NO: 7748107 - DNA, 22 bp, Homo sapiens
gttattctagtgctcagccatt

SEQ ID NO: 7748108 - DNA, 22 bp, Homo sapiens
gttattctattaatgtgattgt

SEQ ID NO: 7748109 - DNA, 22 bp, Homo sapiens
gttattctaccactatgtacag

SEQ ID NO: 7748110 - DNA, 22 bp, Homo sapiens
gttattctgccaaacttccaca

SEQ ID NO: 7748111 - DNA, 22 bp, Homo sapiens
gttattctgcgatgcaatcctg

SEQ ID NO: 7748112 - DNA, 18 bp, Homo sapiens
gttattctctctgcagta

SEQ ID NO: 7748113 - DNA, 22 bp, Homo sapiens
gttattctcttggcctaattat

SEQ ID NO: 7748114 - DNA, 22 bp, Homo sapiens
gttattctgcacacctttaaaa

SEQ ID NO: 7748115 - DNA, 22 bp, Homo sapiens
gttattctttgtatggtacatc

SEQ ID NO: 7748116 - DNA, 22 bp, Homo sapiens
gttattcttggtggccctgctg

SEQ ID NO: 7748117 - DNA, 22 bp, Homo sapiens
gttattcttttatagcaataca

SEQ ID NO: 7748118 - DNA, 22 bp, Homo sapiens
gttcacagcttcttaggtcata

SEQ ID NO: 7748119 - DNA, 22 bp, Homo sapiens
caggaaacattcccataacaca

SEQ ID NO: 7748120 - DNA, 22 bp, Homo sapiens
caggaaacggctattcttttgt

SEQ ID NO: 7748121 - DNA, 22 bp, Homo sapiens
caggaaaatctgcccacacaag

SEQ ID NO: 7748122 - DNA, 22 bp, Homo sapiens
caggaaaatgtcaatggaaagc

SEQ ID NO: 7748123 - DNA, 22 bp, Homo sapiens
gttgctgaaattaatattggag

SEQ ID NO: 7748124 - DNA, 22 bp, Homo sapiens
gttgctgaaagccctgactggc

SEQ ID NO: 7748125 - DNA, 22 bp, Homo sapiens
gttcttcacatttcattgagga

SEQ ID NO: 7748126 - DNA, 22 bp, Homo sapiens
gttgctgattaacactttgagt

SEQ ID NO: 7748127 - DNA, 22 bp, Homo sapiens
gttgctgaaggcatgccagaga

SEQ ID NO: 7748128 - DNA, 22 bp, Homo sapiens
gttgctgatggcaagattccag

SEQ ID NO: 7748129 - DNA, 22 bp, Homo sapiens
gttcctgggaggcatgggctgg

SEQ ID NO: 7748130 - DNA, 22 bp, Homo sapiens
gttcctgatgctttgaaattca

SEQ ID NO: 7748131 - DNA, 22 bp, Homo sapiens
gttcctggcattgtcagcggcc

SEQ ID NO: 7748132 - DNA, 22 bp, Homo sapiens
caggaaatggggtttagttatt

SEQ ID NO: 7748133 - DNA, 22 bp, Homo sapiens
caggaaatgggtcgttttataa

SEQ ID NO: 7748134 - DNA, 22 bp, Homo sapiens
caggaaatgtataattttataa

SEQ ID NO: 7748135 - DNA, 22 bp, Homo sapiens
caggaaattcttttgtttgtgc

SEQ ID NO: 7748136 - DNA, 22 bp, Homo sapiens
caggaaattctttttaacagaa

SEQ ID NO: 7748137 - DNA, 22 bp, Homo sapiens
caggaaatttatgttctactta

SEQ ID NO: 7748138 - DNA, 22 bp, Homo sapiens
caggaaatttaagagtgtacaa

SEQ ID NO: 7748139 - DNA, 22 bp, Homo sapiens
caggaacaactcccagcatctc

SEQ ID NO: 7748140 - DNA, 22 bp, Homo sapiens
caggaacaatacctcttgccag

SEQ ID NO: 7748141 - DNA, 22 bp, Homo sapiens
caggaacaatatctgtcctggt

SEQ ID NO: 7748142 - DNA, 22 bp, Homo sapiens
caggaacaaggcctatgggact

SEQ ID NO: 7748143 - DNA, 22 bp, Homo sapiens
caggaacaatcttactactatt

SEQ ID NO: 7748144 - DNA, 22 bp, Homo sapiens
gtttacagtactcacttgcatt

SEQ ID NO: 7748145 - DNA, 23 bp, Homo sapiens
caggaagcagatggggtagaaga

SEQ ID NO: 7748146 - DNA, 22 bp, Homo sapiens
caggaagcacagtgaggagacc

SEQ ID NO: 7748147 - DNA, 22 bp, Homo sapiens
caggaagcaagtgattttcttg

SEQ ID NO: 7748148 - DNA, 22 bp, Homo sapiens
caggaagcaccagcccggcccc

SEQ ID NO: 7748149 - DNA, 22 bp, Homo sapiens
caggaagaggtggggctaaagt

SEQ ID NO: 7748150 - DNA, 22 bp, Homo sapiens
caggaagaggtatcaccgagca

SEQ ID NO: 7748151 - DNA, 22 bp, Homo sapiens
caggaacattgtagaattgaaa

SEQ ID NO: 7748152 - DNA, 21 bp, Homo sapiens
caggaacattctttacattta

SEQ ID NO: 7748153 - DNA, 22 bp, Homo sapiens
caggaacatttaaccacagggt

SEQ ID NO: 7748154 - DNA, 22 bp, Homo sapiens
caggaacatgtctccaattaga

SEQ ID NO: 7748155 - DNA, 22 bp, Homo sapiens
caggaacatgttggaaagaaat

SEQ ID NO: 7748156 - DNA, 19 bp, Homo sapiens
caggaacatggagggaggg

SEQ ID NO: 7748157 - DNA, 22 bp, Homo sapiens
caggaacagcaccaggagctag

SEQ ID NO: 7748158 - DNA, 22 bp, Homo sapiens
caggaacagctgacctgacaat

SEQ ID NO: 7748159 - DNA, 22 bp, Homo sapiens
caggaacaggggagtgaacctg

SEQ ID NO: 7748160 - DNA, 22 bp, Homo sapiens
caggaacagggtgtcctggcag

SEQ ID NO: 7748161 - DNA, 22 bp, Homo sapiens
caggaacaggctgatgggcagg

SEQ ID NO: 7748162 - DNA, 22 bp, Homo sapiens
caggaacacctgcagctagtgg

SEQ ID NO: 7748163 - DNA, 22 bp, Homo sapiens
caggaacagagtggcattgtct

SEQ ID NO: 7748164 - DNA, 22 bp, Homo sapiens
caggaacacaatgagtctcaaa

SEQ ID NO: 7748165 - DNA, 22 bp, Homo sapiens
caggaacaatgtaagtctcatt

SEQ ID NO: 7748166 - DNA, 22 bp, Homo sapiens
caggaacacaagttcagggatg

SEQ ID NO: 7748167 - DNA, 22 bp, Homo sapiens
gtttattgataaaagctggaca

SEQ ID NO: 7748168 - DNA, 22 bp, Homo sapiens
gtttattattcaacttcatgtt

SEQ ID NO: 7748169 - DNA, 22 bp, Homo sapiens
gtttattattcaacttcatgtt

SEQ ID NO: 7748170 - DNA, 20 bp, Homo sapiens
caggaggcaaggtcaaggtc

SEQ ID NO: 7748171 - DNA, 22 bp, Homo sapiens
caggaggcccaaagggcgcaga

SEQ ID NO: 7748172 - DNA, 22 bp, Homo sapiens
caggaggcatcatggagcggac

SEQ ID NO: 7748173 - DNA, 22 bp, Homo sapiens
caggaggccaactgtgggactt

SEQ ID NO: 7748174 - DNA, 22 bp, Homo sapiens
caggaggctcctagggctctgt

SEQ ID NO: 7748175 - DNA, 22 bp, Homo sapiens
caggaggcccggccacagccca

SEQ ID NO: 7748176 - DNA, 22 bp, Homo sapiens
taacaaagtaccatagactgga

SEQ ID NO: 7748177 - DNA, 22 bp, Homo sapiens
taacaaagtattgtttgtgtat

SEQ ID NO: 7748178 - DNA, 22 bp, Homo sapiens
taacaaagtaccatagattggg

SEQ ID NO: 7748179 - DNA, 22 bp, Homo sapiens
taaatgcttagattcatagaaa

SEQ ID NO: 7748180 - DNA, 22 bp, Homo sapiens
taaagcataatgaatatctaga

SEQ ID NO: 7748181 - DNA, 22 bp, Homo sapiens
caggagccctggtgggtggaca

SEQ ID NO: 7748182 - DNA, 22 bp, Homo sapiens
caggagagatatgagtccccac

SEQ ID NO: 7748183 - DNA, 22 bp, Homo sapiens
caggagcaaatccaaaagaatt

SEQ ID NO: 7748184 - DNA, 22 bp, Homo sapiens
caggagcaaggagcagtgggat

SEQ ID NO: 7748185 - DNA, 22 bp, Homo sapiens
caggaccaagcaaagtttcttt

SEQ ID NO: 7748186 - DNA, 22 bp, Homo sapiens
caggacattgatccattggcac

SEQ ID NO: 7748187 - DNA, 22 bp, Homo sapiens
caggacatcgtcatcatgggga

SEQ ID NO: 7748188 - DNA, 22 bp, Homo sapiens
caggacccatcagccaggcact

SEQ ID NO: 7748189 - DNA, 22 bp, Homo sapiens
caggagacagtgttattttatt

SEQ ID NO: 7748190 - DNA, 22 bp, Homo sapiens
caggaatgtagcagcgatggaa

SEQ ID NO: 7748191 - DNA, 22 bp, Homo sapiens
caggacacatttcttgttcagg

SEQ ID NO: 7748192 - DNA, 22 bp, Homo sapiens
caggacaccttagctaaaattc

SEQ ID NO: 7748193 - DNA, 22 bp, Homo sapiens
caggaagcatctggctagctaa

SEQ ID NO: 7748194 - DNA, 22 bp, Homo sapiens
caggaagccacaggacaggtag

SEQ ID NO: 7748195 - DNA, 22 bp, Homo sapiens
caggaagctcttagcagtcacc

SEQ ID NO: 7748196 - DNA, 22 bp, Homo sapiens
caggaagctagattttgttgct

SEQ ID NO: 7748197 - DNA, 22 bp, Homo sapiens
caggaagccttccttgtctgct

SEQ ID NO: 7748198 - DNA, 22 bp, Homo sapiens
caggaagcagtagaacttttcc

SEQ ID NO: 7748199 - DNA, 22 bp, Homo sapiens
gtttggacctctgctagatgga

SEQ ID NO: 7748200 - DNA, 22 bp, Homo sapiens
caggaagctgatgtctagtcat

SEQ ID NO: 7748201 - DNA, 22 bp, Homo sapiens
caggaagctgagctgcactgca

SEQ ID NO: 7748202 - DNA, 22 bp, Homo sapiens
caggaagctgccggtgagcgag

SEQ ID NO: 7748203 - DNA, 22 bp, Homo sapiens
caggaagctggtcagatcctgt

SEQ ID NO: 7748204 - DNA, 22 bp, Homo sapiens
caggaagctgggtttccataca

SEQ ID NO: 7748205 - DNA, 22 bp, Homo sapiens
caggaagggggatccttggaag

SEQ ID NO: 7748206 - DNA, 22 bp, Homo sapiens
caggaagctgtgaaggagacgg

SEQ ID NO: 7748207 - DNA, 22 bp, Homo sapiens
caggaaggaaagggtgtggaga

SEQ ID NO: 7748208 - DNA, 22 bp, Homo sapiens
caggaatagtggagcaacaaga

SEQ ID NO: 7748209 - DNA, 22 bp, Homo sapiens
tacaagttgcagaaagttgttt

SEQ ID NO: 7748210 - DNA, 19 bp, Homo sapiens
tacaagcttttttggcagg

SEQ ID NO: 7748211 - DNA, 22 bp, Homo sapiens
caggccctgggcaggcacagag

SEQ ID NO: 7748212 - DNA, 22 bp, Homo sapiens
caggccctgggcaggatcagcc

SEQ ID NO: 7748213 - DNA, 22 bp, Homo sapiens
caggccctggcagggctgagtc

SEQ ID NO: 7748214 - DNA, 22 bp, Homo sapiens
caggccctttcctgggcatagg

SEQ ID NO: 7748215 - DNA, 22 bp, Homo sapiens
caggcagaaggaagtaccaggc

SEQ ID NO: 7748216 - DNA, 22 bp, Homo sapiens
caggcagactttgagaatgatg

SEQ ID NO: 7748217 - DNA, 22 bp, Homo sapiens
caggcagagacgtcagtgtagg

SEQ ID NO: 7748218 - DNA, 23 bp, Homo sapiens
caggcaggatgaggactacactc

SEQ ID NO: 7748219 - DNA, 22 bp, Homo sapiens
caggcagggagccactgtataa

SEQ ID NO: 7748220 - DNA, 22 bp, Homo sapiens
caggcaagatccagaggctgct

SEQ ID NO: 7748221 - DNA, 22 bp, Homo sapiens
caggcacaaaaggaccccagca

SEQ ID NO: 7748222 - DNA, 22 bp, Homo sapiens
caggcacaatgagcgccatctt

SEQ ID NO: 7748223 - DNA, 22 bp, Homo sapiens
caggcacagacgcaaacttctt

SEQ ID NO: 7748224 - DNA, 22 bp, Homo sapiens
caggcacaaatttctagataag

SEQ ID NO: 7748225 - DNA, 22 bp, Homo sapiens
caggcacaagaagcaaatgtta

SEQ ID NO: 7748226 - DNA, 22 bp, Homo sapiens
caggcacaagatcggctagata

SEQ ID NO: 7748227 - DNA, 22 bp, Homo sapiens
caggcacagctaagactggcca

SEQ ID NO: 7748228 - DNA, 22 bp, Homo sapiens
caggcacagagagaataccttt

SEQ ID NO: 7748229 - DNA, 22 bp, Homo sapiens
caggcacagagttattcattta

SEQ ID NO: 7748230 - DNA, 22 bp, Homo sapiens
caggcacagctgggcaattgcg

SEQ ID NO: 7748231 - DNA, 22 bp, Homo sapiens
caggcacaggggaatgtctttt

SEQ ID NO: 7748232 - DNA, 22 bp, Homo sapiens
caggcacagttccaagcatttt

SEQ ID NO: 7748233 - DNA, 22 bp, Homo sapiens
caggcacagtggggtcctctct

SEQ ID NO: 7748234 - DNA, 22 bp, Homo sapiens
caggcacagtgttgctgttcaa

SEQ ID NO: 7748235 - DNA, 17 bp, Homo sapiens
caggcacatgaagccag

SEQ ID NO: 7748236 - DNA, 22 bp, Homo sapiens
caggcacatgggagctcatcat

SEQ ID NO: 7748237 - DNA, 22 bp, Homo sapiens
taaggcaccataatatatttaa

SEQ ID NO: 7748238 - DNA, 22 bp, Homo sapiens
taaggcacccgtgagctgccag

SEQ ID NO: 7748239 - DNA, 22 bp, Homo sapiens
caggatggagagtgaggggtca

SEQ ID NO: 7748240 - DNA, 22 bp, Homo sapiens
taacagaaatagaaatgagagt

SEQ ID NO: 7748241 - DNA, 22 bp, Homo sapiens
taacagaaaggggacagaaata

SEQ ID NO: 7748242 - DNA, 22 bp, Homo sapiens
taacagaaatagtaggtgaggg

SEQ ID NO: 7748243 - DNA, 22 bp, Homo sapiens
taacagaagagcaggcagccct

SEQ ID NO: 7748244 - DNA, 20 bp, Homo sapiens
taacagaagtagaagtgggt

SEQ ID NO: 7748245 - DNA, 22 bp, Homo sapiens
taacagaaattttagttagggg

SEQ ID NO: 7748246 - DNA, 22 bp, Homo sapiens
taacagaaatatttccaggtga

SEQ ID NO: 7748247 - DNA, 22 bp, Homo sapiens
taacagaagaaaacatattgga

SEQ ID NO: 7748248 - DNA, 22 bp, Homo sapiens
taacagaagttgttcattgtgg

SEQ ID NO: 7748249 - DNA, 22 bp, Homo sapiens
taacagaaaggctcaggtgctc

SEQ ID NO: 7748250 - DNA, 22 bp, Homo sapiens
taacagaaacagataagtgtaa

SEQ ID NO: 7748251 - DNA, 22 bp, Homo sapiens
taacagaaaggggacagaaata

SEQ ID NO: 7748252 - DNA, 22 bp, Homo sapiens
taacagaaaagaactgagtttg

SEQ ID NO: 7748253 - DNA, 22 bp, Homo sapiens
ctccagggttccccgatccact

SEQ ID NO: 7748254 - DNA, 22 bp, Homo sapiens
ctccaggggccagaagcctggc

SEQ ID NO: 7748255 - DNA, 22 bp, Homo sapiens
ttgttaagggttatgcagcttt

SEQ ID NO: 7748256 - DNA, 22 bp, Homo sapiens
ctcatccatgtcgtaacatatg

SEQ ID NO: 7748257 - DNA, 22 bp, Homo sapiens
ctcatctaggataaagcatctt

SEQ ID NO: 7748258 - DNA, 22 bp, Homo sapiens
ctcatccaccctcaacaaagat

SEQ ID NO: 7748259 - DNA, 22 bp, Homo sapiens
ttgcttttaattaatcattgct

SEQ ID NO: 7748260 - DNA, 22 bp, Homo sapiens
ttgatattctgagaagctgaag

SEQ ID NO: 7748261 - DNA, 22 bp, Homo sapiens
ttgatattagagtatttgtttg

SEQ ID NO: 7748262 - DNA, 22 bp, Homo sapiens
ctcctggctcgcccccagctga

SEQ ID NO: 7748263 - DNA, 22 bp, Homo sapiens
tttaaaaaactagtctgagtct

SEQ ID NO: 7748264 - DNA, 22 bp, Homo sapiens
ctctcctcagaacaggccctct

SEQ ID NO: 7748265 - DNA, 22 bp, Homo sapiens
ctctcctccaacagccctgccg

SEQ ID NO: 7748266 - DNA, 22 bp, Homo sapiens
ctcctgggagcagggatggatg

SEQ ID NO: 7748267 - DNA, 22 bp, Homo sapiens
ttcattcttgggatcagagagt

SEQ ID NO: 7748268 - DNA, 21 bp, Homo sapiens
cggaaactcggctctggttcc

SEQ ID NO: 7748269 - DNA, 22 bp, Homo sapiens
cgctggtcaccatggcgtcctg

SEQ ID NO: 7748270 - DNA, 22 bp, Homo sapiens
ttcacagtggtaagggttgtga

SEQ ID NO: 7748271 - DNA, 22 bp, Homo sapiens
ttcacatctcagcactgcctct

SEQ ID NO: 7748272 - DNA, 22 bp, Homo sapiens
ttcacatctataacttagataa

SEQ ID NO: 7748273 - DNA, 17 bp, Homo sapiens
ttcacatccgagaacaa

SEQ ID NO: 7748274 - DNA, 22 bp, Homo sapiens
ctaataatagaggtggcatttg

SEQ ID NO: 7748275 - DNA, 20 bp, Homo sapiens
ctaatattctactctaagga

SEQ ID NO: 7748276 - DNA, 22 bp, Homo sapiens
ctaatatttttagaaatcacga

SEQ ID NO: 7748277 - DNA, 22 bp, Homo sapiens
ttccatttttctaactctcaga

SEQ ID NO: 7748278 - DNA, 22 bp, Homo sapiens
ttccaaatgcccatctacacag

SEQ ID NO: 7748279 - DNA, 22 bp, Homo sapiens
ttccaaatggagaagatgagtt

SEQ ID NO: 7748280 - DNA, 22 bp, Homo sapiens
ttccaaatgttggacaactgta

SEQ ID NO: 7748281 - DNA, 22 bp, Homo sapiens
ttccaaatgagttccatcgaat

SEQ ID NO: 7748282 - DNA, 22 bp, Homo sapiens
ctatttcagctgcctttgactg

SEQ ID NO: 7748283 - DNA, 22 bp, Homo sapiens
ctatttggggtagaagatggat

SEQ ID NO: 7748284 - DNA, 22 bp, Homo sapiens
ctatttggccatagtgcagtta

SEQ ID NO: 7748285 - DNA, 22 bp, Homo sapiens
ctatttggatgttagcctcagt

SEQ ID NO: 7748286 - DNA, 22 bp, Homo sapiens
ctatttggccaagctgcccaca

SEQ ID NO: 7748287 - DNA, 22 bp, Homo sapiens
ctatttggccagaagagggtca

SEQ ID NO: 7748288 - DNA, 22 bp, Homo sapiens
ttctgtcatgctcatgtaattg

SEQ ID NO: 7748289 - DNA, 22 bp, Homo sapiens
ttctgtcaaatgccagtagaga

SEQ ID NO: 7748290 - DNA, 22 bp, Homo sapiens
ctattttaacttgattacctct

SEQ ID NO: 7748291 - DNA, 22 bp, Homo sapiens
ctaggctgagctgggctgagct

SEQ ID NO: 7748292 - DNA, 22 bp, Homo sapiens
ttccttttagaatcatgaagac

SEQ ID NO: 7748293 - DNA, 22 bp, Homo sapiens
ttccttttatttgtccaggctt

SEQ ID NO: 7748294 - DNA, 22 bp, Homo sapiens
ttccttttcttatgcatcatta

SEQ ID NO: 7748295 - DNA, 20 bp, Homo sapiens
ttccttttcgcctctctccc

SEQ ID NO: 7748296 - DNA, 22 bp, Homo sapiens
ttccttttcttaaacatatgtg

SEQ ID NO: 7748297 - DNA, 22 bp, Homo sapiens
ctcagcactttggaaggctgat

SEQ ID NO: 7748298 - DNA, 22 bp, Homo sapiens
ctcagcactgacccaggagatg

SEQ ID NO: 7748299 - DNA, 19 bp, Homo sapiens
ctcagcacttttacacagg

SEQ ID NO: 7748300 - DNA, 22 bp, Homo sapiens
ctcagcaccccgacaggacatt

SEQ ID NO: 7748301 - DNA, 22 bp, Homo sapiens
ctattttaagaggccattaggt

SEQ ID NO: 7748302 - DNA, 22 bp, Homo sapiens
ttgaccctggtgtcagagatgg

SEQ ID NO: 7748303 - DNA, 22 bp, Homo sapiens
ttgagaaacctggcagtagaga

SEQ ID NO: 7748304 - DNA, 22 bp, Homo sapiens
ttgagaaaaccatcgtaagaat

SEQ ID NO: 7748305 - DNA, 22 bp, Homo sapiens
ctctggctctgacagttgatcc

SEQ ID NO: 7748306 - DNA, 22 bp, Homo sapiens
ctctggctctgttgagatttgt

SEQ ID NO: 7748307 - DNA, 22 bp, Homo sapiens
ctctggctgtcccgatgagcag

SEQ ID NO: 7748308 - DNA, 22 bp, Homo sapiens
ctctggcttctaccttgcagtt

SEQ ID NO: 7748309 - DNA, 22 bp, Homo sapiens
ctctgggcaagtttcttcatga

SEQ ID NO: 7748310 - DNA, 22 bp, Homo sapiens
ctctgggcaccaaagagcagct

SEQ ID NO: 7748311 - DNA, 22 bp, Homo sapiens
ctctgggcaggaccagtggacc

SEQ ID NO: 7748312 - DNA, 22 bp, Homo sapiens
ttttattatctttgaatgggac

SEQ ID NO: 7748313 - DNA, 22 bp, Homo sapiens
ttttattcaaatagttcacact

SEQ ID NO: 7748314 - DNA, 22 bp, Homo sapiens
ttttattctcagctccagagag

SEQ ID NO: 7748315 - DNA, 22 bp, Homo sapiens
ctgaagaatagcaggtgggcac

SEQ ID NO: 7748316 - DNA, 22 bp, Homo sapiens
ctgaagaagctgcagcctggag

SEQ ID NO: 7748317 - DNA, 20 bp, Homo sapiens
ctgaagagtggcctgatctg

SEQ ID NO: 7748318 - DNA, 22 bp, Homo sapiens
ctgagaaggtgtggagatgggc

SEQ ID NO: 7748319 - DNA, 22 bp, Homo sapiens
ctgcagagctaggctgagtgaa

SEQ ID NO: 7748320 - DNA, 22 bp, Homo sapiens
ctgcagaaagctgagatgatta

SEQ ID NO: 7748321 - DNA, 21 bp, Homo sapiens
ctgattgtgaaagtcatcatt

SEQ ID NO: 7748322 - DNA, 22 bp, Homo sapiens
ctgatgatagtgatttattgag

SEQ ID NO: 7748323 - DNA, 22 bp, Homo sapiens
ctgaggagaacaatgagatcaa

SEQ ID NO: 7748324 - DNA, 22 bp, Homo sapiens
ctgaggaccccacaggaggccc

SEQ ID NO: 7748325 - DNA, 22 bp, Homo sapiens
ctgagagaatcatgctgcaggt

SEQ ID NO: 7748326 - DNA, 22 bp, Homo sapiens
ctgagagagtaaagtagaatta

SEQ ID NO: 7748327 - DNA, 22 bp, Homo sapiens
ctgagagaaacatgactcagga

SEQ ID NO: 7748328 - DNA, 22 bp, Homo sapiens
ctgagagaagagcgcagtttgt

SEQ ID NO: 7748329 - DNA, 22 bp, Homo sapiens
ctgagacattatgacaagtgga

SEQ ID NO: 7748330 - DNA, 22 bp, Homo sapiens
ctgagacccagacacctgagga

SEQ ID NO: 7748331 - DNA, 21 bp, Homo sapiens
ctgagacctgcattagagagg

SEQ ID NO: 7748332 - DNA, 22 bp, Homo sapiens
ctgagacacagtggctgaaaag

SEQ ID NO: 7748333 - DNA, 22 bp, Homo sapiens
ctgaggaggggcctgagtgaga

SEQ ID NO: 7748334 - DNA, 22 bp, Homo sapiens
ctgccaggtaaactgcaggaat

SEQ ID NO: 7748335 - DNA, 22 bp, Homo sapiens
ctgcagcagtactcagcagcca

SEQ ID NO: 7748336 - DNA, 22 bp, Homo sapiens
ctgcagccacgagtcacagccc

SEQ ID NO: 7748337 - DNA, 22 bp, Homo sapiens
ctgccaggctgtcccaggtccg

SEQ ID NO: 7748338 - DNA, 22 bp, Homo sapiens
ctgcagaggtcttgctgatggt

SEQ ID NO: 7748339 - DNA, 22 bp, Homo sapiens
ctgcagagcttgtctggatgtg

SEQ ID NO: 7748340 - DNA, 22 bp, Homo sapiens
ctggattctcatcagagccaga

SEQ ID NO: 7748341 - DNA, 22 bp, Homo sapiens
ctggcacatagtaggtgcacag

SEQ ID NO: 7748342 - DNA, 22 bp, Homo sapiens
ctggcctggggcctcagctgct

SEQ ID NO: 7748343 - DNA, 22 bp, Homo sapiens
ctggcctgaggtcggctgtagg

SEQ ID NO: 7748344 - DNA, 22 bp, Homo sapiens
ctggcctgctgggtgaggtcct

SEQ ID NO: 7748345 - DNA, 22 bp, Homo sapiens
ctggcctgatctcatgctgtcc

SEQ ID NO: 7748346 - DNA, 22 bp, Homo sapiens
ctggcctggagcctctgggtgg

SEQ ID NO: 7748347 - DNA, 22 bp, Homo sapiens
ctgcctggcccagggatgggcc

SEQ ID NO: 7748348 - DNA, 22 bp, Homo sapiens
ctgcctggagcattctgaaggt

SEQ ID NO: 7748349 - DNA, 22 bp, Homo sapiens
ctgcctgctctatccaggcctg

SEQ ID NO: 7748350 - DNA, 22 bp, Homo sapiens
ctggaggacccctgcctggaag

SEQ ID NO: 7748351 - DNA, 22 bp, Homo sapiens
ctggaggaccacagaagctggt

SEQ ID NO: 7748352 - DNA, 22 bp, Homo sapiens
ctggaggaatcacagaaggctt

SEQ ID NO: 7748353 - DNA, 22 bp, Homo sapiens
tgcctgggacatgctgtggact

SEQ ID NO: 7748354 - DNA, 22 bp, Homo sapiens
tgcctgggcctctgaggaaggc

SEQ ID NO: 7748355 - DNA, 22 bp, Homo sapiens
tgctgaatgaatggatggttgc

SEQ ID NO: 7748356 - DNA, 21 bp, Homo sapiens
tgctgaatctgccatattttc

SEQ ID NO: 7748357 - DNA, 22 bp, Homo sapiens
tgctgaatcccaccctccagtg

SEQ ID NO: 7748358 - DNA, 22 bp, Homo sapiens
tgctgaataataagattactca

SEQ ID NO: 7748359 - DNA, 22 bp, Homo sapiens
tgctgaatatagagcaagaagt

SEQ ID NO: 7748360 - DNA, 22 bp, Homo sapiens
tgctgaatcaaaacaaaggttt

SEQ ID NO: 7748361 - DNA, 22 bp, Homo sapiens
tgctgaatcatatggtaattct

SEQ ID NO: 7748362 - DNA, 22 bp, Homo sapiens
tgctgaataaagatatattttc

SEQ ID NO: 7748363 - DNA, 22 bp, Homo sapiens
tgctgaataaataaagtctatt

SEQ ID NO: 7748364 - DNA, 22 bp, Homo sapiens
tgctgaataagacgtggcttgt

SEQ ID NO: 7748365 - DNA, 22 bp, Homo sapiens
tgctgaattaaactctatgtgg

SEQ ID NO: 7748366 - DNA, 22 bp, Homo sapiens
tgctgaatgtgctcccttttaa

SEQ ID NO: 7748367 - DNA, 22 bp, Homo sapiens
tgctgaattccagggccccact

SEQ ID NO: 7748368 - DNA, 22 bp, Homo sapiens
tgctgaattctaccatccattt

SEQ ID NO: 7748369 - DNA, 22 bp, Homo sapiens
tgctgaatgctgcatgccgtat

SEQ ID NO: 7748370 - DNA, 22 bp, Homo sapiens
tgctgaatgggatatgttgagc

SEQ ID NO: 7748371 - DNA, 22 bp, Homo sapiens
tgctgaatgggtgattttggag

SEQ ID NO: 7748372 - DNA, 22 bp, Homo sapiens
tgctgaatggtaaagaagtata

SEQ ID NO: 7748373 - DNA, 22 bp, Homo sapiens
tgctgaattggtagtactgttg

SEQ ID NO: 7748374 - DNA, 22 bp, Homo sapiens
tgctgaattctcattccctgga

SEQ ID NO: 7748375 - DNA, 22 bp, Homo sapiens
tgctgaatttacatttttgtag

SEQ ID NO: 7748376 - DNA, 22 bp, Homo sapiens
tgctgagacagtggataggggc

SEQ ID NO: 7748377 - DNA, 22 bp, Homo sapiens
tgctgagaggaaagaatgcaca

SEQ ID NO: 7748378 - DNA, 22 bp, Homo sapiens
tgctgagatagctgactaggca

SEQ ID NO: 7748379 - DNA, 22 bp, Homo sapiens
tgctgcagatcagctgagtcct

SEQ ID NO: 7748380 - DNA, 22 bp, Homo sapiens
tgctgcaggaattctcaaggga

SEQ ID NO: 7748381 - DNA, 22 bp, Homo sapiens
tgctggagcatctgagagcatc

SEQ ID NO: 7748382 - DNA, 22 bp, Homo sapiens
ccccaggcctgttggatggcgc

SEQ ID NO: 7748383 - DNA, 22 bp, Homo sapiens
tgctggagactcactcaggtgc

SEQ ID NO: 7748384 - DNA, 21 bp, Homo sapiens
ccctcaggaaacagaatgcac

SEQ ID NO: 7748385 - DNA, 22 bp, Homo sapiens
ccctcagcttctccctgcagct

SEQ ID NO: 7748386 - DNA, 22 bp, Homo sapiens
ccctcaggagatgtcagctgga

SEQ ID NO: 7748387 - DNA, 22 bp, Homo sapiens
ccctcaggatgcagtggaagtg

SEQ ID NO: 7748388 - DNA, 19 bp, Homo sapiens
ccctcaggtctgagcagtc

SEQ ID NO: 7748389 - DNA, 22 bp, Homo sapiens
ccctcagggaccactgacttca

SEQ ID NO: 7748390 - DNA, 22 bp, Homo sapiens
cccctcattctctgagctagtt

SEQ ID NO: 7748391 - DNA, 22 bp, Homo sapiens
cccctcattacaggcggggagc

SEQ ID NO: 7748392 - DNA, 22 bp, Homo sapiens
cccctcattcatgtccttgctt

SEQ ID NO: 7748393 - DNA, 21 bp, Homo sapiens
cccctcatacactctccttgc

SEQ ID NO: 7748394 - DNA, 22 bp, Homo sapiens
cccctcataggtcagacacgca

SEQ ID NO: 7748395 - DNA, 22 bp, Homo sapiens
cccctcaggtacccgtgcagca

SEQ ID NO: 7748396 - DNA, 16 bp, Homo sapiens
cccctcaggaagtaca

SEQ ID NO: 7748397 - DNA, 22 bp, Homo sapiens
ccccgccctgcgcggggataac

SEQ ID NO: 7748398 - DNA, 22 bp, Homo sapiens
tgcattaaaatgtgcctctctt

SEQ ID NO: 7748399 - DNA, 22 bp, Homo sapiens
tgcattaaaaccatcgaccatc

SEQ ID NO: 7748400 - DNA, 22 bp, Homo sapiens
tgcatgttttataccaaagctt

SEQ ID NO: 7748401 - DNA, 22 bp, Homo sapiens
tgcatgtttgtaggttcttcta

SEQ ID NO: 7748402 - DNA, 22 bp, Homo sapiens
tgcatgtttgtgtctgagaact

SEQ ID NO: 7748403 - DNA, 20 bp, Homo sapiens
tgcattaagtggcattgagc

SEQ ID NO: 7748404 - DNA, 19 bp, Homo sapiens
cccagctgttcttccacca

SEQ ID NO: 7748405 - DNA, 22 bp, Homo sapiens
cccaggaaaggaaatgaatggg

SEQ ID NO: 7748406 - DNA, 22 bp, Homo sapiens
cccaggaaagtgaatctaattg

SEQ ID NO: 7748407 - DNA, 22 bp, Homo sapiens
cccaggaaagtggaggcggctg

SEQ ID NO: 7748408 - DNA, 22 bp, Homo sapiens
cccaggaaagagactgctgggt

SEQ ID NO: 7748409 - DNA, 22 bp, Homo sapiens
cccaggaaagaaagtatatggt

SEQ ID NO: 7748410 - DNA, 22 bp, Homo sapiens
cccaggaaagaatttagagcca

SEQ ID NO: 7748411 - DNA, 22 bp, Homo sapiens
cccaggaaaagcagtgccagca

SEQ ID NO: 7748412 - DNA, 22 bp, Homo sapiens
cccaggaaacccgaaggcgacc

SEQ ID NO: 7748413 - DNA, 22 bp, Homo sapiens
cccagctgaacttgcattccaa

SEQ ID NO: 7748414 - DNA, 22 bp, Homo sapiens
tgcagggaggccccgcagccct

SEQ ID NO: 7748415 - DNA, 22 bp, Homo sapiens
tgcagggacaggctctggggat

SEQ ID NO: 7748416 - DNA, 22 bp, Homo sapiens
tctgtggcagttctggttcatc

SEQ ID NO: 7748417 - DNA, 22 bp, Homo sapiens
cctagtccccaggaggtcagtg

SEQ ID NO: 7748418 - DNA, 22 bp, Homo sapiens
tggccaggaggctgcttctgac

SEQ ID NO: 7748419 - DNA, 22 bp, Homo sapiens
tggcaagaaactgaggcctgct

SEQ ID NO: 7748420 - DNA, 23 bp, Homo sapiens
ccctggccttggggcacaggctg

SEQ ID NO: 7748421 - DNA, 22 bp, Homo sapiens
ccctggagctagtctgagcaga

SEQ ID NO: 7748422 - DNA, 22 bp, Homo sapiens
ccctcagttttccagtgtgggc

SEQ ID NO: 7748423 - DNA, 22 bp, Homo sapiens
ccctcaggtgaaaggaaaaatt

SEQ ID NO: 7748424 - DNA, 19 bp, Homo sapiens
ccctcattcacttattctc

SEQ ID NO: 7748425 - DNA, 22 bp, Homo sapiens
ccctcattgcctcctgcgtgca

SEQ ID NO: 7748426 - DNA, 22 bp, Homo sapiens
ccctcatgtcagtccctgccca

SEQ ID NO: 7748427 - DNA, 22 bp, Homo sapiens
cctcgtgtgctaggatccaggt

SEQ ID NO: 7748428 - DNA, 22 bp, Homo sapiens
cctctcagcgattcctcttgga

SEQ ID NO: 7748429 - DNA, 22 bp, Homo sapiens
cctctgggctggaaaattaatg

SEQ ID NO: 7748430 - DNA, 22 bp, Homo sapiens
cctctgagaggccatctctcct

SEQ ID NO: 7748431 - DNA, 22 bp, Homo sapiens
cctctgtccccagtgcaggcct

SEQ ID NO: 7748432 - DNA, 22 bp, Homo sapiens
cctctgtgatttctgagccaat

SEQ ID NO: 7748433 - DNA, 22 bp, Homo sapiens
cctctgggggtcctcagagtct

SEQ ID NO: 7748434 - DNA, 22 bp, Homo sapiens
cctctgggtgacagactcttgg

SEQ ID NO: 7748435 - DNA, 22 bp, Homo sapiens
cctctgggtatctgtggaagta

SEQ ID NO: 7748436 - DNA, 22 bp, Homo sapiens
tggcccgaagatccgagggtca

SEQ ID NO: 7748437 - DNA, 22 bp, Homo sapiens
tggccccctgattgtcaccttt

SEQ ID NO: 7748438 - DNA, 22 bp, Homo sapiens
cctcggggcaccgcggcctgct

SEQ ID NO: 7748439 - DNA, 22 bp, Homo sapiens
cctggcctgtgaatctgagagc

SEQ ID NO: 7748440 - DNA, 22 bp, Homo sapiens
cctggcctcagcctagggctga

SEQ ID NO: 7748441 - DNA, 22 bp, Homo sapiens
cctggcctcagacagagggtgg

SEQ ID NO: 7748442 - DNA, 19 bp, Homo sapiens
tgtctcagtgtcccttcct

SEQ ID NO: 7748443 - DNA, 18 bp, Homo sapiens
tgtctcagttctgctatg

SEQ ID NO: 7748444 - DNA, 22 bp, Homo sapiens
tgtctcagctgtgcttcattgg

SEQ ID NO: 7748445 - DNA, 22 bp, Homo sapiens
tgtctcagggcagcagcagggg

SEQ ID NO: 7748446 - DNA, 22 bp, Homo sapiens
tgtctcaggtacatgcgtcctg

SEQ ID NO: 7748447 - DNA, 22 bp, Homo sapiens
tgtctatttttactggaccatg

SEQ ID NO: 7748448 - DNA, 22 bp, Homo sapiens
tgtcctggagacacaaggtggt

SEQ ID NO: 7748449 - DNA, 22 bp, Homo sapiens
tggtccctagcacagctgtcct

SEQ ID NO: 7748450 - DNA, 22 bp, Homo sapiens
cctgccagtgaagctgacgggc

SEQ ID NO: 7748451 - DNA, 22 bp, Homo sapiens
cctctgtgctttgtccagcctc

SEQ ID NO: 7748452 - DNA, 22 bp, Homo sapiens
tggtccctaggaaagcagtgtt

SEQ ID NO: 7748453 - DNA, 22 bp, Homo sapiens
tggtccctagtgtgggagcttg

SEQ ID NO: 7748454 - DNA, 22 bp, Homo sapiens
tggtccctattgtggtaagtgg

SEQ ID NO: 7748455 - DNA, 22 bp, Homo sapiens
tggtccctccttcttcccagat

SEQ ID NO: 7748456 - DNA, 23 bp, Homo sapiens
tggtccctcaaggaggccagggc

SEQ ID NO: 7748457 - DNA, 22 bp, Homo sapiens
tggtccctgagacctttgggag

SEQ ID NO: 7748458 - DNA, 23 bp, Homo sapiens
tggtccctgagagctggggaggg

SEQ ID NO: 7748459 - DNA, 22 bp, Homo sapiens
tggtccctgaagagagaccttg

SEQ ID NO: 7748460 - DNA, 22 bp, Homo sapiens
tggtccctgcctgccaagtgct

SEQ ID NO: 7748461 - DNA, 22 bp, Homo sapiens
tggtccctgcgttaagagcact

SEQ ID NO: 7748462 - DNA, 22 bp, Homo sapiens
tggtccctgatctaatgtctca

SEQ ID NO: 7748463 - DNA, 22 bp, Homo sapiens
tggtccctttgactgcccgcca

SEQ ID NO: 7748464 - DNA, 22 bp, Homo sapiens
tggtccctttctactgagcaca

SEQ ID NO: 7748465 - DNA, 23 bp, Homo sapiens
tggtccctgggacctttccctgt

SEQ ID NO: 7748466 - DNA, 22 bp, Homo sapiens
tggtccctggatttctggaaca

SEQ ID NO: 7748467 - DNA, 21 bp, Homo sapiens
tggtccctttcagagtctgga

SEQ ID NO: 7748468 - DNA, 18 bp, Homo sapiens
tggtccagttcagatata

SEQ ID NO: 7748469 - DNA, 22 bp, Homo sapiens
tggtccctaaagatgtctacat

SEQ ID NO: 7748470 - DNA, 22 bp, Homo sapiens
tggtccctagaagttctgaatc

SEQ ID NO: 7748471 - DNA, 19 bp, Homo sapiens
tggtcccatactgctggcc

SEQ ID NO: 7748472 - DNA, 21 bp, Homo sapiens
cctggagacaaagacagggtg

SEQ ID NO: 7748473 - DNA, 22 bp, Homo sapiens
cctggagaccagaggatacttc

SEQ ID NO: 7748474 - DNA, 22 bp, Homo sapiens
cctggagacctgatggcagcgg

SEQ ID NO: 7748475 - DNA, 22 bp, Homo sapiens
cctggagagagaggccaactgc

SEQ ID NO: 7748476 - DNA, 22 bp, Homo sapiens
cctggagagctcgggccaggca

SEQ ID NO: 7748477 - DNA, 22 bp, Homo sapiens
cctggagatttcttcaagcttt

SEQ ID NO: 7748478 - DNA, 22 bp, Homo sapiens
cctggagaggagaaagggccca

SEQ ID NO: 7748479 - DNA, 22 bp, Homo sapiens
cctggagaggcgctgcagagga

SEQ ID NO: 7748480 - DNA, 23 bp, Homo sapiens
tgtattacagatgcatcagtgat

SEQ ID NO: 7748481 - DNA, 22 bp, Homo sapiens
tgtattagagcatataatttga

SEQ ID NO: 7748482 - DNA, 22 bp, Homo sapiens
tgtattaggagattccatgttt

SEQ ID NO: 7748483 - DNA, 22 bp, Homo sapiens
tgtattaggttgatgcgaaagt

SEQ ID NO: 7748484 - DNA, 22 bp, Homo sapiens
tgtgctggtacatgtgaggatg

SEQ ID NO: 7748485 - DNA, 22 bp, Homo sapiens
tgtgctgggagatagagggagg

SEQ ID NO: 7748486 - DNA, 22 bp, Homo sapiens
cctgggaagagctgacaggagg

SEQ ID NO: 7748487 - DNA, 22 bp, Homo sapiens
cctggctgctgtcactgaccat

SEQ ID NO: 7748488 - DNA, 22 bp, Homo sapiens
cctggctgcattttgctggatg

SEQ ID NO: 7748489 - DNA, 22 bp, Homo sapiens
cctggctgccgagtgtgcagcg

SEQ ID NO: 7748490 - DNA, 22 bp, Homo sapiens
tgtgaggacctcagcagagtct

SEQ ID NO: 7748491 - DNA, 22 bp, Homo sapiens
tgtgaggagggtcaaactgagt

SEQ ID NO: 7748492 - DNA, 22 bp, Homo sapiens
tgtgaggaacccggaatgtggg

SEQ ID NO: 7748493 - DNA, 22 bp, Homo sapiens
tgtgaggaacaggactagagca

SEQ ID NO: 7748494 - DNA, 22 bp, Homo sapiens
tgtgaggcctagacagcctggg

SEQ ID NO: 7748495 - DNA, 22 bp, Homo sapiens
tgtgaggcctctgcaggagcag

SEQ ID NO: 7748496 - DNA, 22 bp, Homo sapiens
cctggctgaggggccaaggacc

SEQ ID NO: 7748497 - DNA, 22 bp, Homo sapiens
tgtggggtgtggtccaggcatc

SEQ ID NO: 7748498 - DNA, 22 bp, Homo sapiens
cctgggcctcacccagctcttg

SEQ ID NO: 7748499 - DNA, 17 bp, Homo sapiens
tgtggctttgactggga

SEQ ID NO: 7748500 - DNA, 22 bp, Homo sapiens
cctgggtcttggttcatgctct

SEQ ID NO: 7748501 - DNA, 22 bp, Homo sapiens
cctgggctcaagcgatcttgtc

SEQ ID NO: 7748502 - DNA, 19 bp, Homo sapiens
gacaggaaggctaccagta

SEQ ID NO: 7748503 - DNA, 22 bp, Homo sapiens
gacaggaagtctgaaggaggga

SEQ ID NO: 7748504 - DNA, 22 bp, Homo sapiens
gacacagggggatgtgtggacg

SEQ ID NO: 7748505 - DNA, 22 bp, Homo sapiens
gacacagcactgtacaaggaat

SEQ ID NO: 7748506 - DNA, 22 bp, Homo sapiens
gacacagatgatcaggtgtgga

SEQ ID NO: 7748507 - DNA, 22 bp, Homo sapiens
gacacagatatctctgagatta

SEQ ID NO: 7748508 - DNA, 22 bp, Homo sapiens
gacacagagctcacagtctcct

SEQ ID NO: 7748509 - DNA, 22 bp, Homo sapiens
gacacagagggcaccagatatg

SEQ ID NO: 7748510 - DNA, 22 bp, Homo sapiens
gacacagagtattttaagtact

SEQ ID NO: 7748511 - DNA, 22 bp, Homo sapiens
gacacagataatttagttaaaa

SEQ ID NO: 7748512 - DNA, 22 bp, Homo sapiens
gaaggctgagtgggtacggagg

SEQ ID NO: 7748513 - DNA, 22 bp, Homo sapiens
gaaggctgcatggaggctgtgg

SEQ ID NO: 7748514 - DNA, 22 bp, Homo sapiens
gaaggctgcgaggggagtgccg

SEQ ID NO: 7748515 - DNA, 20 bp, Homo sapiens
gaaggcttggacagtgacag

SEQ ID NO: 7748516 - DNA, 22 bp, Homo sapiens
gaaggcttgccgggaagcggca

SEQ ID NO: 7748517 - DNA, 22 bp, Homo sapiens
gaaggcttgcagctctgtggca

SEQ ID NO: 7748518 - DNA, 19 bp, Homo sapiens
gaaggcttttggtatgttt

SEQ ID NO: 7748519 - DNA, 22 bp, Homo sapiens
gaaggcttttctaccagatctt

SEQ ID NO: 7748520 - DNA, 22 bp, Homo sapiens
gaaggcttcctgatgccaacca

SEQ ID NO: 7748521 - DNA, 22 bp, Homo sapiens
gaaggcttcccacctgatattt

SEQ ID NO: 7748522 - DNA, 22 bp, Homo sapiens
gaaggcttcctggaggaggtgg

SEQ ID NO: 7748523 - DNA, 21 bp, Homo sapiens
gaaggcttctgcctggaggag

SEQ ID NO: 7748524 - DNA, 22 bp, Homo sapiens
gaaggcttgattgaggaatgcc

SEQ ID NO: 7748525 - DNA, 22 bp, Homo sapiens
gaaggttttcaggagcctagtc

SEQ ID NO: 7748526 - DNA, 22 bp, Homo sapiens
gaagtacaaaggacatggaaac

SEQ ID NO: 7748527 - DNA, 22 bp, Homo sapiens
gaaggaagtcattagtgcagac

SEQ ID NO: 7748528 - DNA, 22 bp, Homo sapiens
gaaggaagggctggctgtcttg

SEQ ID NO: 7748529 - DNA, 22 bp, Homo sapiens
gaaggcggacgccagggggtcg

SEQ ID NO: 7748530 - DNA, 22 bp, Homo sapiens
gaccagtcattactcatgccct

SEQ ID NO: 7748531 - DNA, 22 bp, Homo sapiens
gacccaggctcgtgggacggct

SEQ ID NO: 7748532 - DNA, 22 bp, Homo sapiens
gagagctggattctggataggt

SEQ ID NO: 7748533 - DNA, 22 bp, Homo sapiens
gagacacaggcacagaagaggc

SEQ ID NO: 7748534 - DNA, 22 bp, Homo sapiens
gagacacagcagatattcaatc

SEQ ID NO: 7748535 - DNA, 22 bp, Homo sapiens
gagacacaatctcatttacatt

SEQ ID NO: 7748536 - DNA, 22 bp, Homo sapiens
gagacacacccaaggttatgag

SEQ ID NO: 7748537 - DNA, 22 bp, Homo sapiens
gagacacaagacgcaactctgt

SEQ ID NO: 7748538 - DNA, 22 bp, Homo sapiens
gagaaaatagcatgtgtagtat

SEQ ID NO: 7748539 - DNA, 22 bp, Homo sapiens
gagaaaatgtcagacttggtcg

SEQ ID NO: 7748540 - DNA, 22 bp, Homo sapiens
gagaaaatcttgggtcaagaat

SEQ ID NO: 7748541 - DNA, 22 bp, Homo sapiens
ctggctgggagctcgcctgcgg

SEQ ID NO: 7748542 - DNA, 22 bp, Homo sapiens
cttctcagttgcaagtgtcaga

SEQ ID NO: 7748543 - DNA, 22 bp, Homo sapiens
cttctctatctttggcacatca

SEQ ID NO: 7748544 - DNA, 22 bp, Homo sapiens
cttctctgtgtagagattcaga

SEQ ID NO: 7748545 - DNA, 22 bp, Homo sapiens
cttctctggcagatgtgtgtcc

SEQ ID NO: 7748546 - DNA, 22 bp, Homo sapiens
cttgggctcagacttgaggaca

SEQ ID NO: 7748547 - DNA, 22 bp, Homo sapiens
cttgggctctgtgggccttagt

SEQ ID NO: 7748548 - DNA, 23 bp, Homo sapiens
cttgaatgggatggaattcactg

SEQ ID NO: 7748549 - DNA, 22 bp, Homo sapiens
cttgaatgaaaccaactgatga

SEQ ID NO: 7748550 - DNA, 22 bp, Homo sapiens
cttttaagggataataagatgt

SEQ ID NO: 7748551 - DNA, 22 bp, Homo sapiens
gaaaacatccagagatagacct

SEQ ID NO: 7748552 - DNA, 22 bp, Homo sapiens
gaaagttcaaattatagaaggt

SEQ ID NO: 7748553 - DNA, 22 bp, Homo sapiens
gaaaagtatgtttattttgact

SEQ ID NO: 7748554 - DNA, 22 bp, Homo sapiens
gaacagacagaagcttatctcc

SEQ ID NO: 7748555 - DNA, 22 bp, Homo sapiens
gaaccctagcatgtcctttagg

SEQ ID NO: 7748556 - DNA, 18 bp, Homo sapiens
gaacagcaatttcatgtt

SEQ ID NO: 7748557 - DNA, 22 bp, Homo sapiens
gaacagagttgaaacaaggctg

SEQ ID NO: 7748558 - DNA, 22 bp, Homo sapiens
gaactacaggtgcagcaagtga

SEQ ID NO: 7748559 - DNA, 22 bp, Homo sapiens
gaactacagtaagaattgatgt

SEQ ID NO: 7748560 - DNA, 22 bp, Homo sapiens
gaactacagtgcattttcttaa

SEQ ID NO: 7748561 - DNA, 22 bp, Homo sapiens
gaacgcaacggaaaagatttca

SEQ ID NO: 7748562 - DNA, 22 bp, Homo sapiens
gaacgcactttgtaaactgtaa

SEQ ID NO: 7748563 - DNA, 22 bp, Homo sapiens
gaacacagaagaatttctaaga

SEQ ID NO: 7748564 - DNA, 22 bp, Homo sapiens
gaacacaagcgtatgtctttgt

SEQ ID NO: 7748565 - DNA, 22 bp, Homo sapiens
gaacacagcagggataaccact

SEQ ID NO: 7748566 - DNA, 22 bp, Homo sapiens
gaacacagtacttttcctgatg

SEQ ID NO: 7748567 - DNA, 22 bp, Homo sapiens
gaacacagtgtgatcgtatgtc

SEQ ID NO: 7748568 - DNA, 22 bp, Homo sapiens
gaacacagtttagaaaatgctg

SEQ ID NO: 7748569 - DNA, 22 bp, Homo sapiens
gaacactcatggaagagttttt

SEQ ID NO: 7748570 - DNA, 22 bp, Homo sapiens
gaaagttttctcacacagtaat

SEQ ID NO: 7748571 - DNA, 22 bp, Homo sapiens
gaggcctctgtcccaccaggga

SEQ ID NO: 7748572 - DNA, 22 bp, Homo sapiens
gaggcctctgtcccgccaggga

SEQ ID NO: 7748573 - DNA, 22 bp, Homo sapiens
gaggcccagtcctgcaagcacg

SEQ ID NO: 7748574 - DNA, 22 bp, Homo sapiens
gaggcccaggtcaagcagccac

SEQ ID NO: 7748575 - DNA, 22 bp, Homo sapiens
gaggagggagctggaagctctt

SEQ ID NO: 7748576 - DNA, 22 bp, Homo sapiens
gaggaggcttccgggaggcacg

SEQ ID NO: 7748577 - DNA, 22 bp, Homo sapiens
gaggcagaggttgttgcagtga

SEQ ID NO: 7748578 - DNA, 22 bp, Homo sapiens
gaggcagagtgcaccccaggag

SEQ ID NO: 7748579 - DNA, 22 bp, Homo sapiens
gaggcagcagaacatggaagag

SEQ ID NO: 7748580 - DNA, 18 bp, Homo sapiens
gagctgggagaaggaagg

SEQ ID NO: 7748581 - DNA, 22 bp, Homo sapiens
gagctgggagttatagcatgtt

SEQ ID NO: 7748582 - DNA, 22 bp, Homo sapiens
gagctgggaggactgggaactt

SEQ ID NO: 7748583 - DNA, 22 bp, Homo sapiens
gaggacacaaagtggctgagat

SEQ ID NO: 7748584 - DNA, 22 bp, Homo sapiens
gaggacacatgactccagcagg

SEQ ID NO: 7748585 - DNA, 22 bp, Homo sapiens
gagatatgttggcagctggtat

SEQ ID NO: 7748586 - DNA, 22 bp, Homo sapiens
gagctgggacatgggtcctctc

SEQ ID NO: 7748587 - DNA, 22 bp, Homo sapiens
gagctgggaagatagcttgagc

SEQ ID NO: 7748588 - DNA, 22 bp, Homo sapiens
gagctggctccgccatgctgct

SEQ ID NO: 7748589 - DNA, 22 bp, Homo sapiens
gagctggcctcaggcacaggag

SEQ ID NO: 7748590 - DNA, 22 bp, Homo sapiens
gaggctgggggctgccttcctc

SEQ ID NO: 7748591 - DNA, 22 bp, Homo sapiens
gaggggaaagttctgcacaagg

SEQ ID NO: 7748592 - DNA, 22 bp, Homo sapiens
gagtcacaaagcctttcttatt

SEQ ID NO: 7748593 - DNA, 22 bp, Homo sapiens
gagtcacaaagcctttcttatt

SEQ ID NO: 7748594 - DNA, 22 bp, Homo sapiens
gagtcacatactatgtaataga

SEQ ID NO: 7748595 - DNA, 22 bp, Homo sapiens
gagtcacattaatttaatttta

SEQ ID NO: 7748596 - DNA, 22 bp, Homo sapiens
gagtcacattaatttaatttta

SEQ ID NO: 7748597 - DNA, 22 bp, Homo sapiens
gaggtcaggctcaagctgggcc

SEQ ID NO: 7748598 - DNA, 22 bp, Homo sapiens
gatcttctagcagaagtaattt

SEQ ID NO: 7748599 - DNA, 22 bp, Homo sapiens
gatcttctatgtaatgaagtgt

SEQ ID NO: 7748600 - DNA, 22 bp, Homo sapiens
gatgcacagccatgttaatgtg

SEQ ID NO: 7748601 - DNA, 22 bp, Homo sapiens
gatgacataacctaattacagt

SEQ ID NO: 7748602 - DNA, 22 bp, Homo sapiens
gatgacataaacttaacagtat

SEQ ID NO: 7748603 - DNA, 22 bp, Homo sapiens
gatatttttagtatttctgcct

SEQ ID NO: 7748604 - DNA, 22 bp, Homo sapiens
gatatttttagtatttctgcct

SEQ ID NO: 7748605 - DNA, 22 bp, Homo sapiens
gatatttttgcagacacctggg

SEQ ID NO: 7748606 - DNA, 22 bp, Homo sapiens
gatatttttgcagacacctggg

SEQ ID NO: 7748607 - DNA, 22 bp, Homo sapiens
gatattttgagaaatcctatga

SEQ ID NO: 7748608 - DNA, 22 bp, Homo sapiens
gatattttgagaaatcctatga

SEQ ID NO: 7748609 - DNA, 22 bp, Homo sapiens
gatatttttaggtgatgcaggc

SEQ ID NO: 7748610 - DNA, 22 bp, Homo sapiens
gatatttttaggtgatgcaggc

SEQ ID NO: 7748611 - DNA, 22 bp, Homo sapiens
gatattttcattcggatgctca

SEQ ID NO: 7748612 - DNA, 22 bp, Homo sapiens
gatattttcagtctcctttcaa

SEQ ID NO: 7748613 - DNA, 22 bp, Homo sapiens
gatattttcagtctcctttcaa

SEQ ID NO: 7748614 - DNA, 22 bp, Homo sapiens
gatattttcattcggatgctca

SEQ ID NO: 7748615 - DNA, 22 bp, Homo sapiens
gatattttcgcagggagaattc

SEQ ID NO: 7748616 - DNA, 22 bp, Homo sapiens
gatattttcgcagggagaattc

SEQ ID NO: 7748617 - DNA, 22 bp, Homo sapiens
gataataagcacagcaggatgt

SEQ ID NO: 7748618 - DNA, 22 bp, Homo sapiens
gataatatctggtttattcacc

SEQ ID NO: 7748619 - DNA, 22 bp, Homo sapiens
gataagctaacccaagcccttt

SEQ ID NO: 7748620 - DNA, 22 bp, Homo sapiens
gagtttattgtcttccaggctt

SEQ ID NO: 7748621 - DNA, 22 bp, Homo sapiens
gagtttatttgactggattctc

SEQ ID NO: 7748622 - DNA, 22 bp, Homo sapiens
gagtggggtctgggcatcagtc

SEQ ID NO: 7748623 - DNA, 22 bp, Homo sapiens
gatgggctgtctgagcgctgtg

SEQ ID NO: 7748624 - DNA, 22 bp, Homo sapiens
gatgcattacaaaagtgattat

SEQ ID NO: 7748625 - DNA, 22 bp, Homo sapiens
gattcacagaacttagtcaagc

SEQ ID NO: 7748626 - DNA, 22 bp, Homo sapiens
gattagctctagatctgggcta

SEQ ID NO: 7748627 - DNA, 17 bp, Homo sapiens
gcagaaaagtcaaggga

SEQ ID NO: 7748628 - DNA, 22 bp, Homo sapiens
gcagaacatggaaagagaacta

SEQ ID NO: 7748629 - DNA, 22 bp, Homo sapiens
gcagagcagtgcttgcccagcg

SEQ ID NO: 7748630 - DNA, 22 bp, Homo sapiens
gcagaaggatccgcaggtgcaa

SEQ ID NO: 7748631 - DNA, 18 bp, Homo sapiens
gcagagcatcaagggtta

SEQ ID NO: 7748632 - DNA, 22 bp, Homo sapiens
gcagagccccattgctggcggg

SEQ ID NO: 7748633 - DNA, 22 bp, Homo sapiens
gcagagccaggctggggcaggt

SEQ ID NO: 7748634 - DNA, 22 bp, Homo sapiens
gcagagcccctcaagccagcct

SEQ ID NO: 7748635 - DNA, 22 bp, Homo sapiens
gcagagccaggagagacccttg

SEQ ID NO: 7748636 - DNA, 22 bp, Homo sapiens
gcagagccagaatggccaggac

SEQ ID NO: 7748637 - DNA, 22 bp, Homo sapiens
gcacccagggcaggaagtgagg

SEQ ID NO: 7748638 - DNA, 22 bp, Homo sapiens
gcacccaggcttgggcagcaac

SEQ ID NO: 7748639 - DNA, 22 bp, Homo sapiens
gcacacacatgtgagtacatgc

SEQ ID NO: 7748640 - DNA, 22 bp, Homo sapiens
gcaccgagaaggaagcatgcct

SEQ ID NO: 7748641 - DNA, 22 bp, Homo sapiens
gcacccctcagcttgtttacta

SEQ ID NO: 7748642 - DNA, 22 bp, Homo sapiens
gcacccctgcgtgccttccctt

SEQ ID NO: 7748643 - DNA, 22 bp, Homo sapiens
gcacccctggacggtagggcca

SEQ ID NO: 7748644 - DNA, 22 bp, Homo sapiens
gatttgcagctagagcaaaggt

SEQ ID NO: 7748645 - DNA, 22 bp, Homo sapiens
gattttatatggcatactgtgg

SEQ ID NO: 7748646 - DNA, 22 bp, Homo sapiens
gattttatagtcaggaaaaaga

SEQ ID NO: 7748647 - DNA, 22 bp, Homo sapiens
gattttattagcccaaactttg

SEQ ID NO: 7748648 - DNA, 22 bp, Homo sapiens
gattttatctttgtgtgcagta

SEQ ID NO: 7748649 - DNA, 22 bp, Homo sapiens
gattttatcgtcatccttctgg

SEQ ID NO: 7748650 - DNA, 22 bp, Homo sapiens
gcagagcctgtgtctgagcaaa

SEQ ID NO: 7748651 - DNA, 22 bp, Homo sapiens
gcagctgacatctggctgggcc

SEQ ID NO: 7748652 - DNA, 22 bp, Homo sapiens
gcagctgaatgtccattgctgc

SEQ ID NO: 7748653 - DNA, 18 bp, Homo sapiens
gcagctgacactggagtt

SEQ ID NO: 7748654 - DNA, 22 bp, Homo sapiens
gcagctgaagctgcagttccag

SEQ ID NO: 7748655 - DNA, 20 bp, Homo sapiens
gcagctgaaagtatgacacc

SEQ ID NO: 7748656 - DNA, 22 bp, Homo sapiens
gcagctgaaagggatctctaca

SEQ ID NO: 7748657 - DNA, 22 bp, Homo sapiens
gcagctgagcgtgaggaagagt

SEQ ID NO: 7748658 - DNA, 22 bp, Homo sapiens
gcagctgagagaagaacagggc

SEQ ID NO: 7748659 - DNA, 22 bp, Homo sapiens
gcagctgatggaagtcctattg

SEQ ID NO: 7748660 - DNA, 22 bp, Homo sapiens
gcaggagaacaaagcaagctgc

SEQ ID NO: 7748661 - DNA, 22 bp, Homo sapiens
gcaggagaaatgaagattgggt

SEQ ID NO: 7748662 - DNA, 22 bp, Homo sapiens
gcaggagccctggcatgttctt

SEQ ID NO: 7748663 - DNA, 22 bp, Homo sapiens
gcaggagccaggccgagctggt

SEQ ID NO: 7748664 - DNA, 22 bp, Homo sapiens
gcaggcaccgggttgctcccct

SEQ ID NO: 7748665 - DNA, 22 bp, Homo sapiens
gcaggggctgagcaccagcggg

SEQ ID NO: 7748666 - DNA, 21 bp, Homo sapiens
gcaggggatagaaatggtctg

SEQ ID NO: 7748667 - DNA, 22 bp, Homo sapiens
gcaggggcaggagatctcaggc

SEQ ID NO: 7748668 - DNA, 22 bp, Homo sapiens
gcaggggctaaggacacagaga

SEQ ID NO: 7748669 - DNA, 20 bp, Homo sapiens
gcagggcaagggatatgaaa

SEQ ID NO: 7748670 - DNA, 22 bp, Homo sapiens
gcagggcacaaggacgcacagg

SEQ ID NO: 7748671 - DNA, 22 bp, Homo sapiens
gcagggcacacaagaatgataa

SEQ ID NO: 7748672 - DNA, 22 bp, Homo sapiens
gcagggcacagacagtgccaag

SEQ ID NO: 7748673 - DNA, 22 bp, Homo sapiens
gcaggcttgggacgagctggag

SEQ ID NO: 7748674 - DNA, 22 bp, Homo sapiens
gcaggcagagaaggaacattta

SEQ ID NO: 7748675 - DNA, 22 bp, Homo sapiens
gcatgttatgtatctgcccagc

SEQ ID NO: 7748676 - DNA, 22 bp, Homo sapiens
gcatgggctttctcagagttct

SEQ ID NO: 7748677 - DNA, 22 bp, Homo sapiens
gcatgggcaagaggactggggg

SEQ ID NO: 7748678 - DNA, 22 bp, Homo sapiens
gccagcagcccagaaggacttt

SEQ ID NO: 7748679 - DNA, 22 bp, Homo sapiens
gccagcaactaggagctgaatt

SEQ ID NO: 7748680 - DNA, 22 bp, Homo sapiens
gccagatttacagatttgccct

SEQ ID NO: 7748681 - DNA, 22 bp, Homo sapiens
gccagcaaggaggggaaaaatg

SEQ ID NO: 7748682 - DNA, 22 bp, Homo sapiens
gccagcaagtatcaccaaagcc

SEQ ID NO: 7748683 - DNA, 19 bp, Homo sapiens
gccagcagaatgatgaggc

SEQ ID NO: 7748684 - DNA, 22 bp, Homo sapiens
gccagggaaactgcagaccagc

SEQ ID NO: 7748685 - DNA, 22 bp, Homo sapiens
gcccaggctggagtgcagtggc

SEQ ID NO: 7748686 - DNA, 22 bp, Homo sapiens
gcccaggatggagaatagtggt

SEQ ID NO: 7748687 - DNA, 22 bp, Homo sapiens
gccatggggacttcatggattt

SEQ ID NO: 7748688 - DNA, 22 bp, Homo sapiens
gccatgggcaaatgcagagctg

SEQ ID NO: 7748689 - DNA, 22 bp, Homo sapiens
gcccttataaacaaggcttcag

SEQ ID NO: 7748690 - DNA, 22 bp, Homo sapiens
gcccttaggtactacttattct

SEQ ID NO: 7748691 - DNA, 22 bp, Homo sapiens
gcccttagtcagcactttcact

SEQ ID NO: 7748692 - DNA, 22 bp, Homo sapiens
gccctctggcacagagatgcag

SEQ ID NO: 7748693 - DNA, 22 bp, Homo sapiens
gcccttaggcaagcagaagccc

SEQ ID NO: 7748694 - DNA, 22 bp, Homo sapiens
gcccttagggccactgtcactg

SEQ ID NO: 7748695 - DNA, 22 bp, Homo sapiens
gcccttagccttatagcctcta

SEQ ID NO: 7748696 - DNA, 22 bp, Homo sapiens
gccctcagtggattcttattgt

SEQ ID NO: 7748697 - DNA, 22 bp, Homo sapiens
gccctcagtgaccactgattca

SEQ ID NO: 7748698 - DNA, 22 bp, Homo sapiens
gccctcctttgcttctcctagt

SEQ ID NO: 7748699 - DNA, 22 bp, Homo sapiens
gccctcgggctgccctaggctg

SEQ ID NO: 7748700 - DNA, 20 bp, Homo sapiens
gccctcagtcttgtctttat

SEQ ID NO: 7748701 - DNA, 23 bp, Homo sapiens
gccctcagtagaaaatgttagaa

SEQ ID NO: 7748702 - DNA, 19 bp, Homo sapiens
gccctcaggcagctccatc

SEQ ID NO: 7748703 - DNA, 22 bp, Homo sapiens
gccctcaggcagggagtctttc

SEQ ID NO: 7748704 - DNA, 21 bp, Homo sapiens
gccctcaggggaggatggcct

SEQ ID NO: 7748705 - DNA, 15 bp, Homo sapiens
gccctcaggcgacac

SEQ ID NO: 7748706 - DNA, 22 bp, Homo sapiens
gccctcagctcctggacacatg

SEQ ID NO: 7748707 - DNA, 22 bp, Homo sapiens
gccctcagcttgatgttgttct

SEQ ID NO: 7748708 - DNA, 17 bp, Homo sapiens
gccctcagctttaacca

SEQ ID NO: 7748709 - DNA, 22 bp, Homo sapiens
gccctcaggacaaggttacgct

SEQ ID NO: 7748710 - DNA, 19 bp, Homo sapiens
gccctcaggcagctccatc

SEQ ID NO: 7748711 - DNA, 22 bp, Homo sapiens
gccctcagcatcctcagggcca

SEQ ID NO: 7748712 - DNA, 22 bp, Homo sapiens
gccctcagcaggaaagatcaac

SEQ ID NO: 7748713 - DNA, 22 bp, Homo sapiens
gccctcagatgggaaaggaggg

SEQ ID NO: 7748714 - DNA, 22 bp, Homo sapiens
gcccaggctggagtgcagtggt

SEQ ID NO: 7748715 - DNA, 22 bp, Homo sapiens
gccgtgtgggcaacatggtcat

SEQ ID NO: 7748716 - DNA, 22 bp, Homo sapiens
gccgttagataataacaagcat

SEQ ID NO: 7748717 - DNA, 22 bp, Homo sapiens
gccgccctctgcaggggctgag

SEQ ID NO: 7748718 - DNA, 20 bp, Homo sapiens
gccgactgccttgtgagcct

SEQ ID NO: 7748719 - DNA, 22 bp, Homo sapiens
gccgaggctctgcccagctgct

SEQ ID NO: 7748720 - DNA, 22 bp, Homo sapiens
gcctgggaactctgatctcctg

SEQ ID NO: 7748721 - DNA, 23 bp, Homo sapiens
gcctgggactcaggaggagctca

SEQ ID NO: 7748722 - DNA, 22 bp, Homo sapiens
gcctgtgtcatgtagtagcttc

SEQ ID NO: 7748723 - DNA, 22 bp, Homo sapiens
gcctgtggttgctttgggatcc

SEQ ID NO: 7748724 - DNA, 22 bp, Homo sapiens
gcctgtggggctgaggctgcct

SEQ ID NO: 7748725 - DNA, 22 bp, Homo sapiens
gcctgtgggttggagcttggcc

SEQ ID NO: 7748726 - DNA, 22 bp, Homo sapiens
gcctgttccttagtggcttcac

SEQ ID NO: 7748727 - DNA, 20 bp, Homo sapiens
gcctgttcacaggcttcttg

SEQ ID NO: 7748728 - DNA, 22 bp, Homo sapiens
gcctgtggcccaactgtctgtc

SEQ ID NO: 7748729 - DNA, 20 bp, Homo sapiens
gcctgtggaggaggacggac

SEQ ID NO: 7748730 - DNA, 22 bp, Homo sapiens
gcctgtggccactgcgtctgca

SEQ ID NO: 7748731 - DNA, 22 bp, Homo sapiens
gcctgtggccgactgagagcct

SEQ ID NO: 7748732 - DNA, 19 bp, Homo sapiens
gcctgtggcttgatgttgg

SEQ ID NO: 7748733 - DNA, 22 bp, Homo sapiens
gcctggcaggggcctgggagtg

SEQ ID NO: 7748734 - DNA, 23 bp, Homo sapiens
gcctgctgtcacagcgggcccag

SEQ ID NO: 7748735 - DNA, 22 bp, Homo sapiens
gcctgcctttgtgaggaagcgg

SEQ ID NO: 7748736 - DNA, 22 bp, Homo sapiens
gcctggaaattgaggcacagtt

SEQ ID NO: 7748737 - DNA, 21 bp, Homo sapiens
gcctgctgttcaccctgccac

SEQ ID NO: 7748738 - DNA, 22 bp, Homo sapiens
gcctgcctgctgtcatctgcct

SEQ ID NO: 7748739 - DNA, 21 bp, Homo sapiens
gcctgcctgcgtgaccctctt

SEQ ID NO: 7748740 - DNA, 18 bp, Homo sapiens
gcctgccagccgagggac

SEQ ID NO: 7748741 - DNA, 22 bp, Homo sapiens
gcctgccaaaagaagctgctgg

SEQ ID NO: 7748742 - DNA, 22 bp, Homo sapiens
gcctgccacgcatgcagagtca

SEQ ID NO: 7748743 - DNA, 22 bp, Homo sapiens
gcctgcctcaaaatcccagttc

SEQ ID NO: 7748744 - DNA, 23 bp, Homo sapiens
gcctgcctgacctgtgcaaagtc

SEQ ID NO: 7748745 - DNA, 22 bp, Homo sapiens
gctgggcagctgaggcctctca

SEQ ID NO: 7748746 - DNA, 22 bp, Homo sapiens
gctgggcaggcctcgtgagggc

SEQ ID NO: 7748747 - DNA, 22 bp, Homo sapiens
gctgggcagtgagtgagtcctt

SEQ ID NO: 7748748 - DNA, 22 bp, Homo sapiens
gctgggcagcccctacagagag

SEQ ID NO: 7748749 - DNA, 22 bp, Homo sapiens
gctgggcaaggctgaagctacc

SEQ ID NO: 7748750 - DNA, 22 bp, Homo sapiens
gctgggcaatgccagagaggag

SEQ ID NO: 7748751 - DNA, 22 bp, Homo sapiens
gctgggagtgggcaagatgaga

SEQ ID NO: 7748752 - DNA, 22 bp, Homo sapiens
gctgggcaacggaagagagaaa

SEQ ID NO: 7748753 - DNA, 22 bp, Homo sapiens
gctggcctgcgagggcaggctg

SEQ ID NO: 7748754 - DNA, 22 bp, Homo sapiens
gctggcctgggcagcctgtcgg

SEQ ID NO: 7748755 - DNA, 22 bp, Homo sapiens
gctggcctgggctcaagaccag

SEQ ID NO: 7748756 - DNA, 22 bp, Homo sapiens
gctggccttgaggtgtctttat

SEQ ID NO: 7748757 - DNA, 22 bp, Homo sapiens
gctggccttgtgtctgaggaag

SEQ ID NO: 7748758 - DNA, 22 bp, Homo sapiens
gctggagagtagtaagcagtta

SEQ ID NO: 7748759 - DNA, 22 bp, Homo sapiens
gctggagatactgctcagtatc

SEQ ID NO: 7748760 - DNA, 22 bp, Homo sapiens
gctggagatgctatgcagaggg

SEQ ID NO: 7748761 - DNA, 22 bp, Homo sapiens
gctggagatagtaggatccata

SEQ ID NO: 7748762 - DNA, 22 bp, Homo sapiens
gctggcctgaccagccacaggc

SEQ ID NO: 7748763 - DNA, 22 bp, Homo sapiens
gctggcctgacctgaggctggg

SEQ ID NO: 7748764 - DNA, 22 bp, Homo sapiens
gctgaggattacttgaagtcag

SEQ ID NO: 7748765 - DNA, 22 bp, Homo sapiens
gctgaggatatagcaggaacaa

SEQ ID NO: 7748766 - DNA, 21 bp, Homo sapiens
gctggagagccaggcaggggc

SEQ ID NO: 7748767 - DNA, 22 bp, Homo sapiens
gctccaggagagggaagcagat

SEQ ID NO: 7748768 - DNA, 22 bp, Homo sapiens
gccttaattgcagagcaatata

SEQ ID NO: 7748769 - DNA, 22 bp, Homo sapiens
gccttagcatcttaaagctgtg

SEQ ID NO: 7748770 - DNA, 23 bp, Homo sapiens
gctctgaggaagttgggcacggg

SEQ ID NO: 7748771 - DNA, 22 bp, Homo sapiens
gctctgaggctgtgaggtgctg

SEQ ID NO: 7748772 - DNA, 22 bp, Homo sapiens
gctctgagtgatcagctgggaa

SEQ ID NO: 7748773 - DNA, 18 bp, Homo sapiens
gctctgcagctgaggctt

SEQ ID NO: 7748774 - DNA, 18 bp, Homo sapiens
gctctgcaggtgctcggt

SEQ ID NO: 7748775 - DNA, 22 bp, Homo sapiens
gctctgccaacagtttgggcaa

SEQ ID NO: 7748776 - DNA, 22 bp, Homo sapiens
gctctgagcactgtgcggctgg

SEQ ID NO: 7748777 - DNA, 22 bp, Homo sapiens
gctgagagtgggtgcagtgctt

SEQ ID NO: 7748778 - DNA, 21 bp, Homo sapiens
gctgaagaactctttattttc

SEQ ID NO: 7748779 - DNA, 20 bp, Homo sapiens
gctgaagaagtagcatgtac

SEQ ID NO: 7748780 - DNA, 22 bp, Homo sapiens
gctgagagtgtgagatcagatt

SEQ ID NO: 7748781 - DNA, 22 bp, Homo sapiens
gctgagcaacgtggagagtttt

SEQ ID NO: 7748782 - DNA, 22 bp, Homo sapiens
gctctgcccaaagctgtggctg

SEQ ID NO: 7748783 - DNA, 22 bp, Homo sapiens
gctctgccagacactgtggcca

SEQ ID NO: 7748784 - DNA, 22 bp, Homo sapiens
ggaggctgagaggtcgcagtgg

SEQ ID NO: 7748785 - DNA, 22 bp, Homo sapiens
ggaggctgaggcaggcggatca

SEQ ID NO: 7748786 - DNA, 22 bp, Homo sapiens
ggaggctgctgcctcacgtggg

SEQ ID NO: 7748787 - DNA, 23 bp, Homo sapiens
ggagggcttcatcagacccccag

SEQ ID NO: 7748788 - DNA, 22 bp, Homo sapiens
ggagggctgccacccgctcacg

SEQ ID NO: 7748789 - DNA, 22 bp, Homo sapiens
ggagggacccactctagaggtg

SEQ ID NO: 7748790 - DNA, 22 bp, Homo sapiens
ggagggcatcaatcaggcctgg

SEQ ID NO: 7748791 - DNA, 22 bp, Homo sapiens
ggcaaggcctgcagctcagtgt

SEQ ID NO: 7748792 - DNA, 22 bp, Homo sapiens
ggcacacatggtggttggtgaa

SEQ ID NO: 7748793 - DNA, 22 bp, Homo sapiens
ggcacacaggcagatggagtgt

SEQ ID NO: 7748794 - DNA, 22 bp, Homo sapiens
ggcacagagcccagcttcctag

SEQ ID NO: 7748795 - DNA, 22 bp, Homo sapiens
ggcacagacttttgcttgcgtt

SEQ ID NO: 7748796 - DNA, 22 bp, Homo sapiens
ggcacacagcggaatttgctct

SEQ ID NO: 7748797 - DNA, 22 bp, Homo sapiens
ggcaagggacggccgtgagaca

SEQ ID NO: 7748798 - DNA, 22 bp, Homo sapiens
ggcacacagatggagcactagc

SEQ ID NO: 7748799 - DNA, 22 bp, Homo sapiens
ggagtgggaacaatgacatggt

SEQ ID NO: 7748800 - DNA, 22 bp, Homo sapiens
ggcagacacctttatgtctaat

SEQ ID NO: 7748801 - DNA, 23 bp, Homo sapiens
ggcagagagcatggctggggccc

SEQ ID NO: 7748802 - DNA, 22 bp, Homo sapiens
ggcacagcacagagcacatgta

SEQ ID NO: 7748803 - DNA, 22 bp, Homo sapiens
ggcacagcactgtaggcctggg

SEQ ID NO: 7748804 - DNA, 22 bp, Homo sapiens
ggcacagaggttgcctccagat

SEQ ID NO: 7748805 - DNA, 22 bp, Homo sapiens
ggcagaggaagctggaagtggg

SEQ ID NO: 7748806 - DNA, 22 bp, Homo sapiens
ggcaggcattgcaacatgtaca

SEQ ID NO: 7748807 - DNA, 22 bp, Homo sapiens
ggcaggcaggagcgtgcttggg

SEQ ID NO: 7748808 - DNA, 22 bp, Homo sapiens
ggcaggcagcctccatccacag

SEQ ID NO: 7748809 - DNA, 22 bp, Homo sapiens
ggaactttaggatcctggctca

SEQ ID NO: 7748810 - DNA, 22 bp, Homo sapiens
ggaaactaaagaggtgtttttg

SEQ ID NO: 7748811 - DNA, 22 bp, Homo sapiens
ggaaacttggatgccagcactc

SEQ ID NO: 7748812 - DNA, 22 bp, Homo sapiens
ggaaacttgttattgtattttc

SEQ ID NO: 7748813 - DNA, 22 bp, Homo sapiens
ggaaacttggcataattttaag

SEQ ID NO: 7748814 - DNA, 19 bp, Homo sapiens
ggaaacaggggccagagga

SEQ ID NO: 7748815 - DNA, 22 bp, Homo sapiens
ggaaaacaagagaatgatgttt

SEQ ID NO: 7748816 - DNA, 22 bp, Homo sapiens
ggaaaacagcgattggtatcat

SEQ ID NO: 7748817 - DNA, 22 bp, Homo sapiens
ggaaagaaccctggatggctgg

SEQ ID NO: 7748818 - DNA, 22 bp, Homo sapiens
ggaaagatttgtcacatgaatg

SEQ ID NO: 7748819 - DNA, 19 bp, Homo sapiens
ggaactcacttagagaaac

SEQ ID NO: 7748820 - DNA, 22 bp, Homo sapiens
ggaactgaatgtctcggtataa

SEQ ID NO: 7748821 - DNA, 16 bp, Homo sapiens
gcttcgctcgcttgcc

SEQ ID NO: 7748822 - DNA, 22 bp, Homo sapiens
gcttcgctgctagctagttggt

SEQ ID NO: 7748823 - DNA, 23 bp, Homo sapiens
gcttctagtcaatttcaccagga

SEQ ID NO: 7748824 - DNA, 22 bp, Homo sapiens
gcttctcaattctcaccctcca

SEQ ID NO: 7748825 - DNA, 22 bp, Homo sapiens
gcttcatgaaaatcactggtca

SEQ ID NO: 7748826 - DNA, 22 bp, Homo sapiens
gcttcagcctcacactgatatc

SEQ ID NO: 7748827 - DNA, 22 bp, Homo sapiens
gcttcagctttgtctccttggg

SEQ ID NO: 7748828 - DNA, 20 bp, Homo sapiens
gcttcagtttcctcactggt

SEQ ID NO: 7748829 - DNA, 22 bp, Homo sapiens
gcttcagggttatgcaagagtg

SEQ ID NO: 7748830 - DNA, 21 bp, Homo sapiens
gcttcagcaaggcttgctggt

SEQ ID NO: 7748831 - DNA, 22 bp, Homo sapiens
gcttcagccgggcacttaatga

SEQ ID NO: 7748832 - DNA, 22 bp, Homo sapiens
gcttcagcccatcccagtacat

SEQ ID NO: 7748833 - DNA, 22 bp, Homo sapiens
gcttcagagatttcactagttt

SEQ ID NO: 7748834 - DNA, 22 bp, Homo sapiens
gcttagtcaacctagggccatc

SEQ ID NO: 7748835 - DNA, 22 bp, Homo sapiens
gcttacactaaacaagtttcct

SEQ ID NO: 7748836 - DNA, 22 bp, Homo sapiens
gcttagcatcttacaatgctga

SEQ ID NO: 7748837 - DNA, 20 bp, Homo sapiens
gcttagcaggcatagtagct

SEQ ID NO: 7748838 - DNA, 22 bp, Homo sapiens
gcttagcaatgtgacaagatgc

SEQ ID NO: 7748839 - DNA, 22 bp, Homo sapiens
ggagagggtaggggtcctgccc

SEQ ID NO: 7748840 - DNA, 22 bp, Homo sapiens
ggagaaggaagaaagctactat

SEQ ID NO: 7748841 - DNA, 22 bp, Homo sapiens
ggagaaggcacacccacctctg

SEQ ID NO: 7748842 - DNA, 21 bp, Homo sapiens
ggagaaggacaatgttgagta

SEQ ID NO: 7748843 - DNA, 22 bp, Homo sapiens
ggagaaggaatattggagtagg

SEQ ID NO: 7748844 - DNA, 22 bp, Homo sapiens
ggagacactggaaagtattaca

SEQ ID NO: 7748845 - DNA, 22 bp, Homo sapiens
ggagaaggtggctcagcaaagg

SEQ ID NO: 7748846 - DNA, 22 bp, Homo sapiens
ggagacacatatacagaaagag

SEQ ID NO: 7748847 - DNA, 22 bp, Homo sapiens
ggagacacagagcaacaaaata

SEQ ID NO: 7748848 - DNA, 22 bp, Homo sapiens
ggaatacaaatctttgttctct

SEQ ID NO: 7748849 - DNA, 22 bp, Homo sapiens
ggagctgaggtaacagtgagtg

SEQ ID NO: 7748850 - DNA, 22 bp, Homo sapiens
ggaggaaatccttagtaaggca

SEQ ID NO: 7748851 - DNA, 22 bp, Homo sapiens
ggaggaagggcccaggctttat

SEQ ID NO: 7748852 - DNA, 22 bp, Homo sapiens
ggaggaagtgcagttctactac

SEQ ID NO: 7748853 - DNA, 22 bp, Homo sapiens
ggaggacggcatgctgggacgt

SEQ ID NO: 7748854 - DNA, 22 bp, Homo sapiens
ggaggaggcggcagaagttcct

SEQ ID NO: 7748855 - DNA, 22 bp, Homo sapiens
ggaggccagtcctggccgggct

SEQ ID NO: 7748856 - DNA, 15 bp, Homo sapiens
ggaggccaggctgtg

SEQ ID NO: 7748857 - DNA, 22 bp, Homo sapiens
gggccatgagaggttcatcaac

SEQ ID NO: 7748858 - DNA, 22 bp, Homo sapiens
gggcggggggagctggaatgaa

SEQ ID NO: 7748859 - DNA, 22 bp, Homo sapiens
gggcagcacagacagtgaaggc

SEQ ID NO: 7748860 - DNA, 22 bp, Homo sapiens
gggatgcagtatgtatattttc

SEQ ID NO: 7748861 - DNA, 22 bp, Homo sapiens
gggatgcagtcagagcccctgt

SEQ ID NO: 7748862 - DNA, 22 bp, Homo sapiens
gggatggactgacggtagcgcg

SEQ ID NO: 7748863 - DNA, 22 bp, Homo sapiens
gggatgctggtgcctgtggcac

SEQ ID NO: 7748864 - DNA, 19 bp, Homo sapiens
gggatgcactctgaccact

SEQ ID NO: 7748865 - DNA, 22 bp, Homo sapiens
gggatgcagactacagggctta

SEQ ID NO: 7748866 - DNA, 22 bp, Homo sapiens
gggatggagggtagagcaagtg

SEQ ID NO: 7748867 - DNA, 22 bp, Homo sapiens
gggatggatcttggctgaggct

SEQ ID NO: 7748868 - DNA, 22 bp, Homo sapiens
gggatggggagctggaaagggg

SEQ ID NO: 7748869 - DNA, 22 bp, Homo sapiens
gggaccagtgtctgtgagaaaa

SEQ ID NO: 7748870 - DNA, 20 bp, Homo sapiens
gggagaagggctgatgagag

SEQ ID NO: 7748871 - DNA, 23 bp, Homo sapiens
gggggctggttgactctctgcag

SEQ ID NO: 7748872 - DNA, 22 bp, Homo sapiens
ggggtaggaagagaaaatagtg

SEQ ID NO: 7748873 - DNA, 19 bp, Homo sapiens
gggtgaggaagagcgttgc

SEQ ID NO: 7748874 - DNA, 22 bp, Homo sapiens
gggctgagacgatggggtcttc

SEQ ID NO: 7748875 - DNA, 22 bp, Homo sapiens
gggctgagaattcagctttcct

SEQ ID NO: 7748876 - DNA, 22 bp, Homo sapiens
ggccagaggtggtacatagctt

SEQ ID NO: 7748877 - DNA, 17 bp, Homo sapiens
ggccagaggcggggctg

SEQ ID NO: 7748878 - DNA, 18 bp, Homo sapiens
ggccagagggagggtccc

SEQ ID NO: 7748879 - DNA, 22 bp, Homo sapiens
ggcccctggcaccaggctgatt

SEQ ID NO: 7748880 - DNA, 22 bp, Homo sapiens
ggccatggtcatgggtgagctt

SEQ ID NO: 7748881 - DNA, 22 bp, Homo sapiens
ggctcaggactgcagcgtagag

SEQ ID NO: 7748882 - DNA, 22 bp, Homo sapiens
ggccctctgctcacttcctatt

SEQ ID NO: 7748883 - DNA, 22 bp, Homo sapiens
ggccctctgatacagaagaatg

SEQ ID NO: 7748884 - DNA, 22 bp, Homo sapiens
ggccctctgatccaactggtat

SEQ ID NO: 7748885 - DNA, 22 bp, Homo sapiens
ggccctctgcctgtgctggcga

SEQ ID NO: 7748886 - DNA, 22 bp, Homo sapiens
ggccctctccaactctgttcca

SEQ ID NO: 7748887 - DNA, 22 bp, Homo sapiens
ggccctctctacatgttagacg

SEQ ID NO: 7748888 - DNA, 22 bp, Homo sapiens
ggccctctgagtagctgcaaac

SEQ ID NO: 7748889 - DNA, 22 bp, Homo sapiens
ggccctcttttggtttggatgt

SEQ ID NO: 7748890 - DNA, 22 bp, Homo sapiens
ggccctctttagacagagtagg

SEQ ID NO: 7748891 - DNA, 22 bp, Homo sapiens
ggccctcttttatccatcataa

SEQ ID NO: 7748892 - DNA, 22 bp, Homo sapiens
ggccctcttgatatccagcggc

SEQ ID NO: 7748893 - DNA, 22 bp, Homo sapiens
ggccctctgctctgagatgaag

SEQ ID NO: 7748894 - DNA, 22 bp, Homo sapiens
ggccctctggcttccgcatggg

SEQ ID NO: 7748895 - DNA, 22 bp, Homo sapiens
ggccctctgtggctgccatgga

SEQ ID NO: 7748896 - DNA, 22 bp, Homo sapiens
ggccctctggtgagtatcacat

SEQ ID NO: 7748897 - DNA, 22 bp, Homo sapiens
ggcttcaggggcccagtcagca

SEQ ID NO: 7748898 - DNA, 22 bp, Homo sapiens
ggcttcagtggccagagatgat

SEQ ID NO: 7748899 - DNA, 22 bp, Homo sapiens
ggcttcagtgagctgagctcac

SEQ ID NO: 7748900 - DNA, 19 bp, Homo sapiens
ggcttcagtttagcaggct

SEQ ID NO: 7748901 - DNA, 22 bp, Homo sapiens
gggaacagcatatctgaagggt

SEQ ID NO: 7748902 - DNA, 22 bp, Homo sapiens
gggaagaagacatggtgaaggc

SEQ ID NO: 7748903 - DNA, 22 bp, Homo sapiens
gggaccaggtcagggctctgac

SEQ ID NO: 7748904 - DNA, 22 bp, Homo sapiens
ggcttcgcagctcggcagccgc

SEQ ID NO: 7748905 - DNA, 22 bp, Homo sapiens
ggcttcgcaggttcgtgttgca

SEQ ID NO: 7748906 - DNA, 22 bp, Homo sapiens
ggcttcgccatcgccagcttca

SEQ ID NO: 7748907 - DNA, 19 bp, Homo sapiens
ggcttcgaggctggggaag

SEQ ID NO: 7748908 - DNA, 19 bp, Homo sapiens
gggaaattcacttgcttcc

SEQ ID NO: 7748909 - DNA, 22 bp, Homo sapiens
gggaacacagacttgatgatga

SEQ ID NO: 7748910 - DNA, 22 bp, Homo sapiens
gggaacactccagggcttggaa

SEQ ID NO: 7748911 - DNA, 22 bp, Homo sapiens
ggctctagagactctagagaaa

SEQ ID NO: 7748912 - DNA, 22 bp, Homo sapiens
ggctgcagaggcccccagtggg

SEQ ID NO: 7748913 - DNA, 22 bp, Homo sapiens
ggctgcaggaacgacggagggg

SEQ ID NO: 7748914 - DNA, 22 bp, Homo sapiens
ggctgcaggcagaggctgtctg

SEQ ID NO: 7748915 - DNA, 22 bp, Homo sapiens
gtgtggggccaggatcagggct

SEQ ID NO: 7748916 - DNA, 22 bp, Homo sapiens
gtgtgcagatgtgatgctgggc

SEQ ID NO: 7748917 - DNA, 22 bp, Homo sapiens
gtgtgcagggctgcctgtgccg

SEQ ID NO: 7748918 - DNA, 22 bp, Homo sapiens
gttgtatttgcctgaatgcagt

SEQ ID NO: 7748919 - DNA, 22 bp, Homo sapiens
gttgtattcttcaatatcagag

SEQ ID NO: 7748920 - DNA, 22 bp, Homo sapiens
gttgtgcagaagtgcctcagta

SEQ ID NO: 7748921 - DNA, 22 bp, Homo sapiens
gttgtgcagggcgaggacctga

SEQ ID NO: 7748922 - DNA, 22 bp, Homo sapiens
gttgtgcagtcagactgcctgg

SEQ ID NO: 7748923 - DNA, 22 bp, Homo sapiens
gttgttgatcacatgcatatct

SEQ ID NO: 7748924 - DNA, 22 bp, Homo sapiens
gttctattcattgctccacgag

SEQ ID NO: 7748925 - DNA, 22 bp, Homo sapiens
gtgggcagacatgatagaagga

SEQ ID NO: 7748926 - DNA, 22 bp, Homo sapiens
gtgggccacatcccagggctct

SEQ ID NO: 7748927 - DNA, 22 bp, Homo sapiens
gtgggctggatttgcttgcaga

SEQ ID NO: 7748928 - DNA, 22 bp, Homo sapiens
gtgggggatgctgagttggaaa

SEQ ID NO: 7748929 - DNA, 21 bp, Homo sapiens
gtggttctagagaaacagaat

SEQ ID NO: 7748930 - DNA, 21 bp, Homo sapiens
gtgtaaacggactcatgcagt

SEQ ID NO: 7748931 - DNA, 18 bp, Homo sapiens
gtggggtgttgtgaggat

SEQ ID NO: 7748932 - DNA, 22 bp, Homo sapiens
gtggggtgtccagcagcgagct

SEQ ID NO: 7748933 - DNA, 22 bp, Homo sapiens
gtggggtgggctgagttaggcc

SEQ ID NO: 7748934 - DNA, 22 bp, Homo sapiens
taacagaatcctgttattgcca

SEQ ID NO: 7748935 - DNA, 22 bp, Homo sapiens
taacagaatagcagaaacagaa

SEQ ID NO: 7748936 - DNA, 22 bp, Homo sapiens
taaaggaatcagttttagagat

SEQ ID NO: 7748937 - DNA, 22 bp, Homo sapiens
taaaggaagaattctctgtgat

SEQ ID NO: 7748938 - DNA, 18 bp, Homo sapiens
taaaggaagtgggagagg

SEQ ID NO: 7748939 - DNA, 19 bp, Homo sapiens
taaaggaagaagggaggat

SEQ ID NO: 7748940 - DNA, 22 bp, Homo sapiens
gtggcagaggctctgggaccag

SEQ ID NO: 7748941 - DNA, 22 bp, Homo sapiens
gtggcacagaagtttagagaac

SEQ ID NO: 7748942 - DNA, 22 bp, Homo sapiens
gtggcacataggatcctgtggc

SEQ ID NO: 7748943 - DNA, 22 bp, Homo sapiens
gtggcacagtgggagagcccca

SEQ ID NO: 7748944 - DNA, 22 bp, Homo sapiens
gtggatggagctggaagccatt

SEQ ID NO: 7748945 - DNA, 22 bp, Homo sapiens
gtggagagagataagcctggtc

SEQ ID NO: 7748946 - DNA, 22 bp, Homo sapiens
gtggacaggcaggctgtcgggg

SEQ ID NO: 7748947 - DNA, 22 bp, Homo sapiens
gtggagaggaacccagctctgt

SEQ ID NO: 7748948 - DNA, 22 bp, Homo sapiens
gtggagagagtgacagcatctt

SEQ ID NO: 7748949 - DNA, 23 bp, Homo sapiens
gtggagagattagtaattcaccc

SEQ ID NO: 7748950 - DNA, 22 bp, Homo sapiens
gtggagagcaaataattggaat

SEQ ID NO: 7748951 - DNA, 22 bp, Homo sapiens
gtggaaggtgaaggagcagcga

SEQ ID NO: 7748952 - DNA, 22 bp, Homo sapiens
gtggaagggactgcctagagga

SEQ ID NO: 7748953 - DNA, 22 bp, Homo sapiens
gtgacaatattagctcaggggc

SEQ ID NO: 7748954 - DNA, 22 bp, Homo sapiens
gtggctggtttcctgcatgcaa

SEQ ID NO: 7748955 - DNA, 22 bp, Homo sapiens
gtggcagggtgctcatcatgca

SEQ ID NO: 7748956 - DNA, 22 bp, Homo sapiens
gtctgggggtccgggtgcctgc

SEQ ID NO: 7748957 - DNA, 22 bp, Homo sapiens
gtctgagggttgtgctggagga

SEQ ID NO: 7748958 - DNA, 20 bp, Homo sapiens
gtctgcagtaagagggaata

SEQ ID NO: 7748959 - DNA, 22 bp, Homo sapiens
gtctgagacccactcccagaga

SEQ ID NO: 7748960 - DNA, 22 bp, Homo sapiens
gtctgagaactactgaggataa

SEQ ID NO: 7748961 - DNA, 22 bp, Homo sapiens
gtctgagggagaaggatctggg

SEQ ID NO: 7748962 - DNA, 22 bp, Homo sapiens
gtctgagaggaggcagcctcgg

SEQ ID NO: 7748963 - DNA, 22 bp, Homo sapiens
gtccattttattcagagacttt

SEQ ID NO: 7748964 - DNA, 22 bp, Homo sapiens
gtcccaggtgggctccacctct

SEQ ID NO: 7748965 - DNA, 22 bp, Homo sapiens
gtcccaggtgcccagtgggcag

SEQ ID NO: 7748966 - DNA, 22 bp, Homo sapiens
gtcccagggccaccatatatag

SEQ ID NO: 7748967 - DNA, 22 bp, Homo sapiens
gtcccaggtcccagcacatctg

SEQ ID NO: 7748968 - DNA, 22 bp, Homo sapiens
gtcccagggatgcagacatgag

SEQ ID NO: 7748969 - DNA, 22 bp, Homo sapiens
gtcccagggcaaggctgtttct

SEQ ID NO: 7748970 - DNA, 22 bp, Homo sapiens
gtcccagggaggttcagggctt

SEQ ID NO: 7748971 - DNA, 22 bp, Homo sapiens
gtcaggaaaaattgataatttt

SEQ ID NO: 7748972 - DNA, 22 bp, Homo sapiens
gtaaatattccctcggttccta

SEQ ID NO: 7748973 - DNA, 22 bp, Homo sapiens
ggtggttcacgcctataatccc

SEQ ID NO: 7748974 - DNA, 23 bp, Homo sapiens
ggtggcaggagtggatgctgagc

SEQ ID NO: 7748975 - DNA, 22 bp, Homo sapiens
ggtggcaggctggcattggcaa

SEQ ID NO: 7748976 - DNA, 22 bp, Homo sapiens
tctgcaggtcacgctccagcct

SEQ ID NO: 7748977 - DNA, 22 bp, Homo sapiens
tctgcaggtagagctcaggaat

SEQ ID NO: 7748978 - DNA, 22 bp, Homo sapiens
tctgcaggctctagatgaggtt

SEQ ID NO: 7748979 - DNA, 22 bp, Homo sapiens
tctgcaggctgtacaggaagca

SEQ ID NO: 7748980 - DNA, 22 bp, Homo sapiens
tctgcaggcttataggatgggt

SEQ ID NO: 7748981 - DNA, 22 bp, Homo sapiens
tctgcaggaggctggctgcagg

SEQ ID NO: 7748982 - DNA, 22 bp, Homo sapiens
tctgcaggatggatgctcagaa

SEQ ID NO: 7748983 - DNA, 22 bp, Homo sapiens
tctgcaggcctcgacaaggcca

SEQ ID NO: 7748984 - DNA, 22 bp, Homo sapiens
tctgcagcttcttgccagagag

SEQ ID NO: 7748985 - DNA, 22 bp, Homo sapiens
tctgcaggaaaaaagtgcctgg

SEQ ID NO: 7748986 - DNA, 22 bp, Homo sapiens
tctgcagccagaggcatgaaaa

SEQ ID NO: 7748987 - DNA, 22 bp, Homo sapiens
tctgcctgagggagctgaggaa

SEQ ID NO: 7748988 - DNA, 21 bp, Homo sapiens
tctgcctgagactttgctggt

SEQ ID NO: 7748989 - DNA, 19 bp, Homo sapiens
tctgcctgcttgtaggggc

SEQ ID NO: 7748990 - DNA, 22 bp, Homo sapiens
tctgctcagggagggtcactac

SEQ ID NO: 7748991 - DNA, 22 bp, Homo sapiens
tctgctcactattacatggaca

SEQ ID NO: 7748992 - DNA, 22 bp, Homo sapiens
tctgagcagggcagtgtccatg

SEQ ID NO: 7748993 - DNA, 22 bp, Homo sapiens
tctgagccagccacctccttca

SEQ ID NO: 7748994 - DNA, 22 bp, Homo sapiens
tctgagagatacaaggaggcaa

SEQ ID NO: 7748995 - DNA, 22 bp, Homo sapiens
tctgagcacatcacacagctca

SEQ ID NO: 7748996 - DNA, 22 bp, Homo sapiens
tctgagacccatacaggcccac

SEQ ID NO: 7748997 - DNA, 22 bp, Homo sapiens
tctgagactccataagttgaaa

SEQ ID NO: 7748998 - DNA, 22 bp, Homo sapiens
tctgagacaacttagccctcga

SEQ ID NO: 7748999 - DNA, 22 bp, Homo sapiens
tctgagagagcacctatccact

SEQ ID NO: 7749000 - DNA, 20 bp, Homo sapiens
tctgagacttgtagtgtgga

SEQ ID NO: 7749001 - DNA, 22 bp, Homo sapiens
tctgagactgcagtgagccgct

SEQ ID NO: 7749002 - DNA, 22 bp, Homo sapiens
tctgagggcttgaggggaagta

SEQ ID NO: 7749003 - DNA, 22 bp, Homo sapiens
tctgaggaagcagcaggaagtg

SEQ ID NO: 7749004 - DNA, 22 bp, Homo sapiens
tctgaggacaaactgcatgctg

SEQ ID NO: 7749005 - DNA, 22 bp, Homo sapiens
tctgaggccctaccctgagcct

SEQ ID NO: 7749006 - DNA, 22 bp, Homo sapiens
tctgaggaattctgcagtgaga

SEQ ID NO: 7749007 - DNA, 22 bp, Homo sapiens
tctgaggaatcttgacacattt

SEQ ID NO: 7749008 - DNA, 22 bp, Homo sapiens
tctggagtatgtccctggtgaa

SEQ ID NO: 7749009 - DNA, 21 bp, Homo sapiens
tctggagtcatctttaccata

SEQ ID NO: 7749010 - DNA, 22 bp, Homo sapiens
tctggccagcatgagacctggt

SEQ ID NO: 7749011 - DNA, 22 bp, Homo sapiens
tctgctgacatttatgaataga

SEQ ID NO: 7749012 - DNA, 22 bp, Homo sapiens
tctggagaagaaacttgctctg

SEQ ID NO: 7749013 - DNA, 22 bp, Homo sapiens
tctgggagagtcacaggcattg

SEQ ID NO: 7749014 - DNA, 22 bp, Homo sapiens
tctgggagagctgctgtcagag

SEQ ID NO: 7749015 - DNA, 18 bp, Homo sapiens
tctgggcaatctcagtat

SEQ ID NO: 7749016 - DNA, 22 bp, Homo sapiens
tctgggagtttctgtgggagct

SEQ ID NO: 7749017 - DNA, 22 bp, Homo sapiens
tctgggcagaagcagtgcaaag

SEQ ID NO: 7749018 - DNA, 22 bp, Homo sapiens
tctgggcagcagcagctagtag

SEQ ID NO: 7749019 - DNA, 22 bp, Homo sapiens
tctgggctgctgtgcagtgacc

SEQ ID NO: 7749020 - DNA, 23 bp, Homo sapiens
tctgggctgagctcgagtgtaga

SEQ ID NO: 7749021 - DNA, 22 bp, Homo sapiens
tctgtggggagcaggagccggg

SEQ ID NO: 7749022 - DNA, 22 bp, Homo sapiens
tctgtgggtttcagggggctgt

SEQ ID NO: 7749023 - DNA, 22 bp, Homo sapiens
tcttagcaaatactacttagaa

SEQ ID NO: 7749024 - DNA, 22 bp, Homo sapiens
tcttagcacagctatataagtt

SEQ ID NO: 7749025 - DNA, 22 bp, Homo sapiens
tcttagcatttgttaataccca

SEQ ID NO: 7749026 - DNA, 22 bp, Homo sapiens
tcttagcatttcataacaactg

SEQ ID NO: 7749027 - DNA, 22 bp, Homo sapiens
tcttataatctctattttaatg

SEQ ID NO: 7749028 - DNA, 17 bp, Homo sapiens
tctgggcttcagtggtc

SEQ ID NO: 7749029 - DNA, 22 bp, Homo sapiens
tctgggctgtggttccactccg

SEQ ID NO: 7749030 - DNA, 22 bp, Homo sapiens
tctgggctggttgtgcttgctt

SEQ ID NO: 7749031 - DNA, 22 bp, Homo sapiens
tctgggcttttccatgcctgtg

SEQ ID NO: 7749032 - DNA, 22 bp, Homo sapiens
tctgtcacccaggctggagtgc

SEQ ID NO: 7749033 - DNA, 22 bp, Homo sapiens
tctgtctctttgttctgtgagt

SEQ ID NO: 7749034 - DNA, 22 bp, Homo sapiens
tctgtctcctgccagtgcctct

SEQ ID NO: 7749035 - DNA, 21 bp, Homo sapiens
tctgtctctccactgccctgc

SEQ ID NO: 7749036 - DNA, 22 bp, Homo sapiens
tcttcacatggaacatgaagct

SEQ ID NO: 7749037 - DNA, 22 bp, Homo sapiens
tcttccagagcctccatcccta

SEQ ID NO: 7749038 - DNA, 21 bp, Homo sapiens
tcttcagtacacttgcacgcc

SEQ ID NO: 7749039 - DNA, 22 bp, Homo sapiens
tcttcagtgcacctgatgtctt

SEQ ID NO: 7749040 - DNA, 22 bp, Homo sapiens
tcttcagtgaatggcaagatct

SEQ ID NO: 7749041 - DNA, 22 bp, Homo sapiens
tcttcagtaggtcctcagaatc

SEQ ID NO: 7749042 - DNA, 22 bp, Homo sapiens
tcttcagtatttggataacatt

SEQ ID NO: 7749043 - DNA, 22 bp, Homo sapiens
tcttcagtcaatccagatgttt

SEQ ID NO: 7749044 - DNA, 22 bp, Homo sapiens
tcttcagttgtcatactgcctt

SEQ ID NO: 7749045 - DNA, 22 bp, Homo sapiens
tcttcagttgtaaaagtgttgg

SEQ ID NO: 7749046 - DNA, 22 bp, Homo sapiens
tcttcagtgcatgttacctata

SEQ ID NO: 7749047 - DNA, 22 bp, Homo sapiens
tcttcagtgcatgccctcaggc

SEQ ID NO: 7749048 - DNA, 23 bp, Homo sapiens
tcttcagtgagaccagcaaggcc

SEQ ID NO: 7749049 - DNA, 22 bp, Homo sapiens
tcttccttctttgatgacaagg

SEQ ID NO: 7749050 - DNA, 22 bp, Homo sapiens
tcttccaggctagagttgttgc

SEQ ID NO: 7749051 - DNA, 22 bp, Homo sapiens
tcttcctccctacagagctcag

SEQ ID NO: 7749052 - DNA, 21 bp, Homo sapiens
tcttgaaaagttagattctct

SEQ ID NO: 7749053 - DNA, 22 bp, Homo sapiens
tcttcttcccatccctcaaatg

SEQ ID NO: 7749054 - DNA, 22 bp, Homo sapiens
tcttctcagtttctctaggatg

SEQ ID NO: 7749055 - DNA, 22 bp, Homo sapiens
tcttctcatagctagttcttcc

SEQ ID NO: 7749056 - DNA, 22 bp, Homo sapiens
tcttctcaaaaaatgtaggtgg

SEQ ID NO: 7749057 - DNA, 22 bp, Homo sapiens
tcttctctacaccagcagcccc

SEQ ID NO: 7749058 - DNA, 20 bp, Homo sapiens
tcttctggatttcctttagg

SEQ ID NO: 7749059 - DNA, 22 bp, Homo sapiens
tcttctctcatgtaggagggaa

SEQ ID NO: 7749060 - DNA, 22 bp, Homo sapiens
tctttctgcagcacaggggcag

SEQ ID NO: 7749061 - DNA, 22 bp, Homo sapiens
tctttcttaaataggtggattg

SEQ ID NO: 7749062 - DNA, 22 bp, Homo sapiens
tctttcttacaaagaaaacggt

SEQ ID NO: 7749063 - DNA, 22 bp, Homo sapiens
tctttgaacttggctgatctct

SEQ ID NO: 7749064 - DNA, 22 bp, Homo sapiens
tctttgaactctgtgtattaac

SEQ ID NO: 7749065 - DNA, 22 bp, Homo sapiens
tctttgaagttcccctggaaga

SEQ ID NO: 7749066 - DNA, 22 bp, Homo sapiens
tctttgaagtatcttaaatggt

SEQ ID NO: 7749067 - DNA, 22 bp, Homo sapiens
tctttcttattagccattgttc

SEQ ID NO: 7749068 - DNA, 22 bp, Homo sapiens
tctttgaactttttgtaagtta

SEQ ID NO: 7749069 - DNA, 22 bp, Homo sapiens
tctttgaagttgaagtagttgg

SEQ ID NO: 7749070 - DNA, 22 bp, Homo sapiens
tctttgaatacaggaagcatga

SEQ ID NO: 7749071 - DNA, 22 bp, Homo sapiens
tctttgaatttctgactgtctt

SEQ ID NO: 7749072 - DNA, 22 bp, Homo sapiens
tctttgaatcctttacatctga

SEQ ID NO: 7749073 - DNA, 22 bp, Homo sapiens
tctttgaattcaaactgttcaa

SEQ ID NO: 7749074 - DNA, 22 bp, Homo sapiens
tctttacaatctaagcatagtt

SEQ ID NO: 7749075 - DNA, 22 bp, Homo sapiens
tctttacatagtgtggactact

SEQ ID NO: 7749076 - DNA, 22 bp, Homo sapiens
tcttgaattgtactcccataag

SEQ ID NO: 7749077 - DNA, 22 bp, Homo sapiens
tcctgggcagcgggacgctcag

SEQ ID NO: 7749078 - DNA, 22 bp, Homo sapiens
tcctgggcctgtactccatccg

SEQ ID NO: 7749079 - DNA, 22 bp, Homo sapiens
tcctggagccaatgtgctgctg

SEQ ID NO: 7749080 - DNA, 22 bp, Homo sapiens
tcctggcccaatctgcccatga

SEQ ID NO: 7749081 - DNA, 22 bp, Homo sapiens
tcctggcccactatgccagcat

SEQ ID NO: 7749082 - DNA, 22 bp, Homo sapiens
tcctggcctcgctgtccacctt

SEQ ID NO: 7749083 - DNA, 22 bp, Homo sapiens
tccttagcttacaagtcttctg

SEQ ID NO: 7749084 - DNA, 22 bp, Homo sapiens
tccttagctgtgaaatgagaat

SEQ ID NO: 7749085 - DNA, 18 bp, Homo sapiens
tccttagctgagcttgtc

SEQ ID NO: 7749086 - DNA, 22 bp, Homo sapiens
tccttagccggagcagctcatc

SEQ ID NO: 7749087 - DNA, 22 bp, Homo sapiens
tccttagcccactaatacttat

SEQ ID NO: 7749088 - DNA, 22 bp, Homo sapiens
tccttagccagggcagctcaaa

SEQ ID NO: 7749089 - DNA, 22 bp, Homo sapiens
tccttagcaggcattcaggacc

SEQ ID NO: 7749090 - DNA, 22 bp, Homo sapiens
tccttagcaacactgttataat

SEQ ID NO: 7749091 - DNA, 21 bp, Homo sapiens
tccttgctattttcctcagct

SEQ ID NO: 7749092 - DNA, 22 bp, Homo sapiens
tccttctttccccctagtcatt

SEQ ID NO: 7749093 - DNA, 22 bp, Homo sapiens
tccttctcctccttgagtgaca

SEQ ID NO: 7749094 - DNA, 21 bp, Homo sapiens
tccttctctatgattgtctga

SEQ ID NO: 7749095 - DNA, 19 bp, Homo sapiens
tccttctccggccaccccg

SEQ ID NO: 7749096 - DNA, 22 bp, Homo sapiens
tctaaagaagagggttctgcgg

SEQ ID NO: 7749097 - DNA, 22 bp, Homo sapiens
tcgtggatgcgcagggcggcct

SEQ ID NO: 7749098 - DNA, 22 bp, Homo sapiens
tcgccagggatgctgtaaggaa

SEQ ID NO: 7749099 - DNA, 22 bp, Homo sapiens
tcctttctgggcctcagtgact

SEQ ID NO: 7749100 - DNA, 22 bp, Homo sapiens
tctacaagtcaagtctatcaag

SEQ ID NO: 7749101 - DNA, 22 bp, Homo sapiens
tctacaaagaagaattaatgtc

SEQ ID NO: 7749102 - DNA, 19 bp, Homo sapiens
tctagtcagtcagtcattc

SEQ ID NO: 7749103 - DNA, 22 bp, Homo sapiens
tctagtcatattttttcagtat

SEQ ID NO: 7749104 - DNA, 22 bp, Homo sapiens
tctagtttaagatctgttagtc

SEQ ID NO: 7749105 - DNA, 22 bp, Homo sapiens
tctagttttagcttgagttgca

SEQ ID NO: 7749106 - DNA, 22 bp, Homo sapiens
tctattagattattctcaagga

SEQ ID NO: 7749107 - DNA, 22 bp, Homo sapiens
tctattgattggcttcctggat

SEQ ID NO: 7749108 - DNA, 22 bp, Homo sapiens
tctcagtgaagagtataacaaa

SEQ ID NO: 7749109 - DNA, 23 bp, Homo sapiens
tctcagggtggctgggcccatcc

SEQ ID NO: 7749110 - DNA, 17 bp, Homo sapiens
tctcaggggctagccct

SEQ ID NO: 7749111 - DNA, 22 bp, Homo sapiens
tctcaggggcagtgatcctaag

SEQ ID NO: 7749112 - DNA, 22 bp, Homo sapiens
tctcaggggcctggagtcctgg

SEQ ID NO: 7749113 - DNA, 22 bp, Homo sapiens
tctcagggcctccctctgtttc

SEQ ID NO: 7749114 - DNA, 22 bp, Homo sapiens
tctcattcataccctacatgct

SEQ ID NO: 7749115 - DNA, 22 bp, Homo sapiens
tctcatttacttccacaggctg

SEQ ID NO: 7749116 - DNA, 22 bp, Homo sapiens
tctcatggtttgtgattcaaat

SEQ ID NO: 7749117 - DNA, 22 bp, Homo sapiens
tctcattatccatcactgcact

SEQ ID NO: 7749118 - DNA, 22 bp, Homo sapiens
tctcagaaaagagcttcagaaa

SEQ ID NO: 7749119 - DNA, 18 bp, Homo sapiens
tctcagggcatacccaga

SEQ ID NO: 7749120 - DNA, 22 bp, Homo sapiens
tctcagggatgggaggccccag

SEQ ID NO: 7749121 - DNA, 23 bp, Homo sapiens
tctccctcatgcctaggcctggg

SEQ ID NO: 7749122 - DNA, 22 bp, Homo sapiens
tctccccaaaggactcactctc

SEQ ID NO: 7749123 - DNA, 22 bp, Homo sapiens
tctccagggactgaggctggag

SEQ ID NO: 7749124 - DNA, 22 bp, Homo sapiens
tctccaggcttaatctcagctt

SEQ ID NO: 7749125 - DNA, 22 bp, Homo sapiens
tctccaggtgaaacttgcaggg

SEQ ID NO: 7749126 - DNA, 22 bp, Homo sapiens
tctccaggtagatatgtcagga

SEQ ID NO: 7749127 - DNA, 22 bp, Homo sapiens
tctcctggtatgtatgcacctg

SEQ ID NO: 7749128 - DNA, 22 bp, Homo sapiens
tctcgctctgtcgcccaggctg

SEQ ID NO: 7749129 - DNA, 22 bp, Homo sapiens
tctctagtctcctttaacctga

SEQ ID NO: 7749130 - DNA, 22 bp, Homo sapiens
tctcctgatgactttatcttgg

SEQ ID NO: 7749131 - DNA, 22 bp, Homo sapiens
tctctggggcctttctacatca

SEQ ID NO: 7749132 - DNA, 22 bp, Homo sapiens
tctctgggtatggtaacgttgg

SEQ ID NO: 7749133 - DNA, 22 bp, Homo sapiens
tctctgggtaaagttctctcat

SEQ ID NO: 7749134 - DNA, 20 bp, Homo sapiens
tctctgggttctcactcagc

SEQ ID NO: 7749135 - DNA, 22 bp, Homo sapiens
tctctgggcctgttttctcatc

SEQ ID NO: 7749136 - DNA, 22 bp, Homo sapiens
tctctgggcctccctttccaag

SEQ ID NO: 7749137 - DNA, 22 bp, Homo sapiens
tctctggggatgcttattcttg

SEQ ID NO: 7749138 - DNA, 22 bp, Homo sapiens
tctctgggcctcagttttctca

SEQ ID NO: 7749139 - DNA, 22 bp, Homo sapiens
tctctggcagacacctccctga

SEQ ID NO: 7749140 - DNA, 22 bp, Homo sapiens
tctctgctaagattgtgtctag

SEQ ID NO: 7749141 - DNA, 22 bp, Homo sapiens
tctctgcttggtgtatgtgagt

SEQ ID NO: 7749142 - DNA, 18 bp, Homo sapiens
tctctctgataacatttt

SEQ ID NO: 7749143 - DNA, 22 bp, Homo sapiens
tctctcagactccccatggttt

SEQ ID NO: 7749144 - DNA, 18 bp, Homo sapiens
tctctcagggaaacagaa

SEQ ID NO: 7749145 - DNA, 22 bp, Homo sapiens
tctctcagaggccagggtcctg

SEQ ID NO: 7749146 - DNA, 22 bp, Homo sapiens
tctctgtgagatttgtattaag

SEQ ID NO: 7749147 - DNA, 22 bp, Homo sapiens
tctctgtgtcctgaaatgaagg

SEQ ID NO: 7749148 - DNA, 22 bp, Homo sapiens
tctctgtggcatccactcaact

SEQ ID NO: 7749149 - DNA, 23 bp, Homo sapiens
tctctttcaagagcttaatgtgc

SEQ ID NO: 7749150 - DNA, 22 bp, Homo sapiens
tctctttctttgtatgtctatt

SEQ ID NO: 7749151 - DNA, 22 bp, Homo sapiens
tctctttctcaaaatgtaagca

SEQ ID NO: 7749152 - DNA, 22 bp, Homo sapiens
tctctttctcagatggtggaga

SEQ ID NO: 7749153 - DNA, 21 bp, Homo sapiens
tctctttctggaagcttccct

SEQ ID NO: 7749154 - DNA, 22 bp, Homo sapiens
tctctttctatatgtgagtctt

SEQ ID NO: 7749155 - DNA, 18 bp, Homo sapiens
tctctttcctcagtggag

SEQ ID NO: 7749156 - DNA, 22 bp, Homo sapiens
tctctttctattgcaccatgct

SEQ ID NO: 7749157 - DNA, 19 bp, Homo sapiens
tctctttcatggggctagt

SEQ ID NO: 7749158 - DNA, 17 bp, Homo sapiens
tctctttccctttctgc

SEQ ID NO: 7749159 - DNA, 22 bp, Homo sapiens
tctgaaagaagggcagtctttt

SEQ ID NO: 7749160 - DNA, 22 bp, Homo sapiens
tgcagccatttgaaaagcagtt

SEQ ID NO: 7749161 - DNA, 22 bp, Homo sapiens
tgcagctgaggccagctatgcc

SEQ ID NO: 7749162 - DNA, 22 bp, Homo sapiens
tgcaggcagctaaaccatgtaa

SEQ ID NO: 7749163 - DNA, 21 bp, Homo sapiens
tgcaggattccaggtcagtat

SEQ ID NO: 7749164 - DNA, 22 bp, Homo sapiens
tgcaggcaccattctgcctctc

SEQ ID NO: 7749165 - DNA, 22 bp, Homo sapiens
tgcaggaggccccatggaaccg

SEQ ID NO: 7749166 - DNA, 21 bp, Homo sapiens
tgcaggagtctgtgagtcagg

SEQ ID NO: 7749167 - DNA, 22 bp, Homo sapiens
tgcaggagtccaatcaggagac

SEQ ID NO: 7749168 - DNA, 22 bp, Homo sapiens
tgcaggagccttggacttgaaa

SEQ ID NO: 7749169 - DNA, 22 bp, Homo sapiens
tgcaggagctgtgcggtgaggg

SEQ ID NO: 7749170 - DNA, 19 bp, Homo sapiens
tgcaggaggactgagcaga

SEQ ID NO: 7749171 - DNA, 22 bp, Homo sapiens
tgcagaggagctggaaggctgg

SEQ ID NO: 7749172 - DNA, 22 bp, Homo sapiens
tgcagaggagtcagcctgggca

SEQ ID NO: 7749173 - DNA, 23 bp, Homo sapiens
tgcagaggcatgatcactgctca

SEQ ID NO: 7749174 - DNA, 22 bp, Homo sapiens
tgcagaggcccagcggttcttc

SEQ ID NO: 7749175 - DNA, 22 bp, Homo sapiens
tgcagaggctggctcgccgggt

SEQ ID NO: 7749176 - DNA, 22 bp, Homo sapiens
tgcagagctcttggcacttcag

SEQ ID NO: 7749177 - DNA, 20 bp, Homo sapiens
tgcagagctgacattacctg

SEQ ID NO: 7749178 - DNA, 22 bp, Homo sapiens
tgcagaggaccattgtcctgga

SEQ ID NO: 7749179 - DNA, 22 bp, Homo sapiens
tgcagcaccacacctggctaat

SEQ ID NO: 7749180 - DNA, 18 bp, Homo sapiens
tgcagcaagtgctaaata

SEQ ID NO: 7749181 - DNA, 22 bp, Homo sapiens
tgcagcaatttgcagtaattta

SEQ ID NO: 7749182 - DNA, 22 bp, Homo sapiens
tgcagcaaggggccctgatagg

SEQ ID NO: 7749183 - DNA, 23 bp, Homo sapiens
tgcagagggactgaagccagctt

SEQ ID NO: 7749184 - DNA, 19 bp, Homo sapiens
tgcagagggtaggaaggcc

SEQ ID NO: 7749185 - DNA, 22 bp, Homo sapiens
tgcagagggagtgacggttcac

SEQ ID NO: 7749186 - DNA, 22 bp, Homo sapiens
tgcagagggacagccacagctc

SEQ ID NO: 7749187 - DNA, 22 bp, Homo sapiens
tgcagagggaaaaggtgctcct

SEQ ID NO: 7749188 - DNA, 22 bp, Homo sapiens
tgcaccctcatcagtcaaatgg

SEQ ID NO: 7749189 - DNA, 22 bp, Homo sapiens
tgcacacagttctcaggaaaga

SEQ ID NO: 7749190 - DNA, 22 bp, Homo sapiens
tgcagaagaatgagcttggagt

SEQ ID NO: 7749191 - DNA, 22 bp, Homo sapiens
tgcacgtgtgagcattcacatg

SEQ ID NO: 7749192 - DNA, 22 bp, Homo sapiens
tgatattttatgagctttcata

SEQ ID NO: 7749193 - DNA, 22 bp, Homo sapiens
tgatatttttcactggcctctg

SEQ ID NO: 7749194 - DNA, 22 bp, Homo sapiens
tgatctggtcctactgtgggca

SEQ ID NO: 7749195 - DNA, 22 bp, Homo sapiens
tgatacttttcttttagactaa

SEQ ID NO: 7749196 - DNA, 22 bp, Homo sapiens
tgatatgggaaaagggctcgga

SEQ ID NO: 7749197 - DNA, 20 bp, Homo sapiens
tgatatggtttggctgtgtt

SEQ ID NO: 7749198 - DNA, 22 bp, Homo sapiens
tgatatgtgaagctattagttc

SEQ ID NO: 7749199 - DNA, 22 bp, Homo sapiens
tgatatttgctgactgcattgt

SEQ ID NO: 7749200 - DNA, 20 bp, Homo sapiens
tgatatttctggaagtggag

SEQ ID NO: 7749201 - DNA, 22 bp, Homo sapiens
tgatatttaagcaaaaatatgg

SEQ ID NO: 7749202 - DNA, 22 bp, Homo sapiens
tgatgatttcatttctagctgt

SEQ ID NO: 7749203 - DNA, 22 bp, Homo sapiens
tgatgtttaatactatgctttt

SEQ ID NO: 7749204 - DNA, 22 bp, Homo sapiens
tgatgtgtgggcatgcagacag

SEQ ID NO: 7749205 - DNA, 22 bp, Homo sapiens
tgatgtgtgattcattctcaaa

SEQ ID NO: 7749206 - DNA, 22 bp, Homo sapiens
tgatggtgatggttgcacaatg

SEQ ID NO: 7749207 - DNA, 22 bp, Homo sapiens
tgatggtgggtctgatctcata

SEQ ID NO: 7749208 - DNA, 22 bp, Homo sapiens
tgcaaagaagggctgaggagca

SEQ ID NO: 7749209 - DNA, 23 bp, Homo sapiens
tgcaaagatttaatgcaggggca

SEQ ID NO: 7749210 - DNA, 22 bp, Homo sapiens
tgcacacacacgtagagaaaag

SEQ ID NO: 7749211 - DNA, 22 bp, Homo sapiens
tgcaatctcggcactttgggag

SEQ ID NO: 7749212 - DNA, 22 bp, Homo sapiens
tgcaatgagaatatattaacca

SEQ ID NO: 7749213 - DNA, 22 bp, Homo sapiens
tgcaagaaaggtggggccaggc

SEQ ID NO: 7749214 - DNA, 22 bp, Homo sapiens
tgcaagaagtcctctctgggtg

SEQ ID NO: 7749215 - DNA, 22 bp, Homo sapiens
tgcaagagcagaaagaactgag

SEQ ID NO: 7749216 - DNA, 22 bp, Homo sapiens
tgcaagaggtaaaatgaaagga

SEQ ID NO: 7749217 - DNA, 22 bp, Homo sapiens
tgcaaatttgacttcacacatc

SEQ ID NO: 7749218 - DNA, 22 bp, Homo sapiens
tgcaacaggagagttcagggca

SEQ ID NO: 7749219 - DNA, 22 bp, Homo sapiens
tgcaacagtggggcatgctgaa

SEQ ID NO: 7749220 - DNA, 22 bp, Homo sapiens
tgcatctgattctcaggcagaa

SEQ ID NO: 7749221 - DNA, 22 bp, Homo sapiens
tgcatctgcctggagtagcgcc

SEQ ID NO: 7749222 - DNA, 22 bp, Homo sapiens
tgcatctggcctttgctggcta

SEQ ID NO: 7749223 - DNA, 22 bp, Homo sapiens
tgcataattcatccttctggga

SEQ ID NO: 7749224 - DNA, 22 bp, Homo sapiens
tgcataggtgccaagtgggctt

SEQ ID NO: 7749225 - DNA, 22 bp, Homo sapiens
tgcatgtgtgacaaggacagtt

SEQ ID NO: 7749226 - DNA, 22 bp, Homo sapiens
tgcatgttccaactccatcact

SEQ ID NO: 7749227 - DNA, 22 bp, Homo sapiens
tgcatgttattgtggcaagaat

SEQ ID NO: 7749228 - DNA, 22 bp, Homo sapiens
tgcatgtttataacagatgagg

SEQ ID NO: 7749229 - DNA, 22 bp, Homo sapiens
tgcatgttaagaaaatattgag

SEQ ID NO: 7749230 - DNA, 22 bp, Homo sapiens
tgcatggaattatgggagtggt

SEQ ID NO: 7749231 - DNA, 22 bp, Homo sapiens
tgcatgcatgctactgggaggt

SEQ ID NO: 7749232 - DNA, 22 bp, Homo sapiens
tgcatgcacatgtaggtatggt

SEQ ID NO: 7749233 - DNA, 22 bp, Homo sapiens
tgcagggaaagggcactgggct

SEQ ID NO: 7749234 - DNA, 22 bp, Homo sapiens
tgcagggaacttggacagctag

SEQ ID NO: 7749235 - DNA, 22 bp, Homo sapiens
tgcagggaaaacccaggatgct

SEQ ID NO: 7749236 - DNA, 18 bp, Homo sapiens
tgcaggctggggttcctc

SEQ ID NO: 7749237 - DNA, 22 bp, Homo sapiens
tgcagggattatgtaggggttg

SEQ ID NO: 7749238 - DNA, 22 bp, Homo sapiens
tgcagtccaagagtctcctggt

SEQ ID NO: 7749239 - DNA, 21 bp, Homo sapiens
tgcagtgtccctaacagtggt

SEQ ID NO: 7749240 - DNA, 22 bp, Homo sapiens
tgcagggtgcacagtggggtgc

SEQ ID NO: 7749241 - DNA, 22 bp, Homo sapiens
tgcctggcaagaggggctggct

SEQ ID NO: 7749242 - DNA, 22 bp, Homo sapiens
tgcctggcaactgtggtgggct

SEQ ID NO: 7749243 - DNA, 22 bp, Homo sapiens
tgcctggcacagagcaggtggc

SEQ ID NO: 7749244 - DNA, 22 bp, Homo sapiens
tgcctggcatctagccctggga

SEQ ID NO: 7749245 - DNA, 22 bp, Homo sapiens
tgcctggcactcctggagctca

SEQ ID NO: 7749246 - DNA, 22 bp, Homo sapiens
tgcctgcattttgtggctggct

SEQ ID NO: 7749247 - DNA, 22 bp, Homo sapiens
tgcctgagtttaaccctcagag

SEQ ID NO: 7749248 - DNA, 22 bp, Homo sapiens
tgcctgcaagagttggggctac

SEQ ID NO: 7749249 - DNA, 22 bp, Homo sapiens
tgcctcagtctaaagtctctca

SEQ ID NO: 7749250 - DNA, 22 bp, Homo sapiens
tgcctgaggagtcagggcaggt

SEQ ID NO: 7749251 - DNA, 22 bp, Homo sapiens
tgcctgaggtggtctgcaaatg

SEQ ID NO: 7749252 - DNA, 22 bp, Homo sapiens
tgcctgagggagtaagagtcct

SEQ ID NO: 7749253 - DNA, 22 bp, Homo sapiens
tgcctgaacatgaatagtttat

SEQ ID NO: 7749254 - DNA, 22 bp, Homo sapiens
tgccctgcatgcagggagctgt

SEQ ID NO: 7749255 - DNA, 22 bp, Homo sapiens
tgcccttacacatggaaaggga

SEQ ID NO: 7749256 - DNA, 22 bp, Homo sapiens
tgcccttatgaaagaggcccaa

SEQ ID NO: 7749257 - DNA, 22 bp, Homo sapiens
tgcccttaggaaggctcaccaa

SEQ ID NO: 7749258 - DNA, 22 bp, Homo sapiens
tgcccttataaaggaggcctga

SEQ ID NO: 7749259 - DNA, 22 bp, Homo sapiens
tgccgtggggctgaggctggag

SEQ ID NO: 7749260 - DNA, 23 bp, Homo sapiens
tgaggcaggcggatcacgaggtc

SEQ ID NO: 7749261 - DNA, 22 bp, Homo sapiens
tgaggcagttgagcttcctgag

SEQ ID NO: 7749262 - DNA, 22 bp, Homo sapiens
tgaggcaggagaatggcgggaa

SEQ ID NO: 7749263 - DNA, 22 bp, Homo sapiens
tgaggcaggaggttgagaactg

SEQ ID NO: 7749264 - DNA, 22 bp, Homo sapiens
tgaggcaggagttcaggctgcg

SEQ ID NO: 7749265 - DNA, 17 bp, Homo sapiens
tgaggcctgcatcagtg

SEQ ID NO: 7749266 - DNA, 16 bp, Homo sapiens
tgaggccagccatttc

SEQ ID NO: 7749267 - DNA, 18 bp, Homo sapiens
tgaggccagagtgggcat

SEQ ID NO: 7749268 - DNA, 22 bp, Homo sapiens
tgaggccaatgaccctgggcag

SEQ ID NO: 7749269 - DNA, 22 bp, Homo sapiens
tgaggatggggagatggtgtct

SEQ ID NO: 7749270 - DNA, 22 bp, Homo sapiens
tgaggatggtcccgaggacact

SEQ ID NO: 7749271 - DNA, 22 bp, Homo sapiens
tgaggatggtgttggagagggc

SEQ ID NO: 7749272 - DNA, 22 bp, Homo sapiens
tgaggatggaatgctgtgcaag

SEQ ID NO: 7749273 - DNA, 22 bp, Homo sapiens
tgaggaaggaattgaggtttta

SEQ ID NO: 7749274 - DNA, 22 bp, Homo sapiens
tgaggaagccaaacagctacac

SEQ ID NO: 7749275 - DNA, 22 bp, Homo sapiens
tgaggaagcaaaggcttgtgtg

SEQ ID NO: 7749276 - DNA, 18 bp, Homo sapiens
tgaggaaggggaagtatt

SEQ ID NO: 7749277 - DNA, 22 bp, Homo sapiens
tgaggaagggcacacggaccct

SEQ ID NO: 7749278 - DNA, 22 bp, Homo sapiens
tgaggaagggtgtgacggcacc

SEQ ID NO: 7749279 - DNA, 22 bp, Homo sapiens
tgaggcaaggctgaatgaaggc

SEQ ID NO: 7749280 - DNA, 19 bp, Homo sapiens
tgaggcacatgataagaac

SEQ ID NO: 7749281 - DNA, 22 bp, Homo sapiens
tgaggcactccaggatgctgtt

SEQ ID NO: 7749282 - DNA, 19 bp, Homo sapiens
tgaggcactagtctggtcc

SEQ ID NO: 7749283 - DNA, 22 bp, Homo sapiens
tgaggcacagaaaatggtaggg

SEQ ID NO: 7749284 - DNA, 22 bp, Homo sapiens
tgaggcacaggcagtgcccccg

SEQ ID NO: 7749285 - DNA, 22 bp, Homo sapiens
tgaggcacatccaggccagctc

SEQ ID NO: 7749286 - DNA, 19 bp, Homo sapiens
tgaggcacagtggtgaaat

SEQ ID NO: 7749287 - DNA, 22 bp, Homo sapiens
tgaggcactgggagagcacact

SEQ ID NO: 7749288 - DNA, 20 bp, Homo sapiens
tgaggcaggagaatggcatg

SEQ ID NO: 7749289 - DNA, 22 bp, Homo sapiens
tgaggcctggactctgcatgga

SEQ ID NO: 7749290 - DNA, 22 bp, Homo sapiens
tgaggctggcaaggctggtatt

SEQ ID NO: 7749291 - DNA, 22 bp, Homo sapiens
tgaggctgttctaccagggcca

SEQ ID NO: 7749292 - DNA, 21 bp, Homo sapiens
tgaggctgttgtaccagggag

SEQ ID NO: 7749293 - DNA, 22 bp, Homo sapiens
tgaggcttggagaggtcaggga

SEQ ID NO: 7749294 - DNA, 22 bp, Homo sapiens
tgaggggagacagagtggactc

SEQ ID NO: 7749295 - DNA, 22 bp, Homo sapiens
tgaggtggtccaaagactgttt

SEQ ID NO: 7749296 - DNA, 22 bp, Homo sapiens
tgaggtggccgaggagcaggac

SEQ ID NO: 7749297 - DNA, 18 bp, Homo sapiens
tgagtatccagagtcttc

SEQ ID NO: 7749298 - DNA, 19 bp, Homo sapiens
tgagggtgagctttggaga

SEQ ID NO: 7749299 - DNA, 22 bp, Homo sapiens
tgagggtgcatttagcatgtag

SEQ ID NO: 7749300 - DNA, 22 bp, Homo sapiens
tgagggtgggccctgggcatct

SEQ ID NO: 7749301 - DNA, 22 bp, Homo sapiens
tgagggtggccttgtgtggact

SEQ ID NO: 7749302 - DNA, 22 bp, Homo sapiens
tgagggtgggcctgcaggaaga

SEQ ID NO: 7749303 - DNA, 22 bp, Homo sapiens
tgagccccggagtttcaggctg

SEQ ID NO: 7749304 - DNA, 22 bp, Homo sapiens
tgagccccaggaaattgaggag

SEQ ID NO: 7749305 - DNA, 22 bp, Homo sapiens
tgagccctggctctttcactta

SEQ ID NO: 7749306 - DNA, 22 bp, Homo sapiens
tgagccctgaggatctgttcgg

SEQ ID NO: 7749307 - DNA, 22 bp, Homo sapiens
tgagccgtggtctctgagggtg

SEQ ID NO: 7749308 - DNA, 22 bp, Homo sapiens
tgagcttccctcctgcactaca

SEQ ID NO: 7749309 - DNA, 22 bp, Homo sapiens
tgagctggaggacaggagggta

SEQ ID NO: 7749310 - DNA, 18 bp, Homo sapiens
tgagcagagtaaggcttt

SEQ ID NO: 7749311 - DNA, 22 bp, Homo sapiens
tgagcagagtcgctccagagtg

SEQ ID NO: 7749312 - DNA, 22 bp, Homo sapiens
tgagcagaggccagcacctggg

SEQ ID NO: 7749313 - DNA, 22 bp, Homo sapiens
tgagcagagatgactgggcatt

SEQ ID NO: 7749314 - DNA, 22 bp, Homo sapiens
tgagcagagcaggctgcgccct

SEQ ID NO: 7749315 - DNA, 22 bp, Homo sapiens
tgagcatctactatgaactggg

SEQ ID NO: 7749316 - DNA, 23 bp, Homo sapiens
tgagcatcacaggagaaccaggc

SEQ ID NO: 7749317 - DNA, 22 bp, Homo sapiens
tgagatgtaaggtatgcttact

SEQ ID NO: 7749318 - DNA, 18 bp, Homo sapiens
tgagaggctattttttgc

SEQ ID NO: 7749319 - DNA, 17 bp, Homo sapiens
tgagagcagggctgggc

SEQ ID NO: 7749320 - DNA, 22 bp, Homo sapiens
tgagagcagaggtgggcagcct

SEQ ID NO: 7749321 - DNA, 22 bp, Homo sapiens
tgagagcacagtgtggtctgga

SEQ ID NO: 7749322 - DNA, 22 bp, Homo sapiens
tgagacaacctaattaaacacc

SEQ ID NO: 7749323 - DNA, 22 bp, Homo sapiens
tgagaaatattgcacagtgagg

SEQ ID NO: 7749324 - DNA, 22 bp, Homo sapiens
tgagaaattacttcagtgatgg

SEQ ID NO: 7749325 - DNA, 22 bp, Homo sapiens
tgagaagagcaaggaactggtt

SEQ ID NO: 7749326 - DNA, 22 bp, Homo sapiens
tgacaggttgtgtaggtggcca

SEQ ID NO: 7749327 - DNA, 19 bp, Homo sapiens
tgacacagctaggtttgct

SEQ ID NO: 7749328 - DNA, 22 bp, Homo sapiens
tgactgaaattgcattttaaaa

SEQ ID NO: 7749329 - DNA, 22 bp, Homo sapiens
tgacctccaatacctttcttcc

SEQ ID NO: 7749330 - DNA, 22 bp, Homo sapiens
tgacccttgtttatcatttctg

SEQ ID NO: 7749331 - DNA, 22 bp, Homo sapiens
tgaaggctgtcacctgcacctt

SEQ ID NO: 7749332 - DNA, 22 bp, Homo sapiens
tgaaggctgggctcagccagct

SEQ ID NO: 7749333 - DNA, 22 bp, Homo sapiens
tgaaggcttggtggcagcctct

SEQ ID NO: 7749334 - DNA, 22 bp, Homo sapiens
tgaattgactggctcagaattg

SEQ ID NO: 7749335 - DNA, 22 bp, Homo sapiens
tgaatgagaacactgaaagagg

SEQ ID NO: 7749336 - DNA, 19 bp, Homo sapiens
tgaatgacgggcatgagca

SEQ ID NO: 7749337 - DNA, 22 bp, Homo sapiens
tgaatcatggataaatagctta

SEQ ID NO: 7749338 - DNA, 22 bp, Homo sapiens
tgaaatcatgtagttattgcaa

SEQ ID NO: 7749339 - DNA, 22 bp, Homo sapiens
tgaaagattgtgattcaatatg

SEQ ID NO: 7749340 - DNA, 22 bp, Homo sapiens
tgaaagatgctcaatgaatggt

SEQ ID NO: 7749341 - DNA, 22 bp, Homo sapiens
tgaaagataagttattatgtac

SEQ ID NO: 7749342 - DNA, 22 bp, Homo sapiens
tgaaagatgaaagcaggctggt

SEQ ID NO: 7749343 - DNA, 22 bp, Homo sapiens
tgaacatgctgttgatggcctg

SEQ ID NO: 7749344 - DNA, 22 bp, Homo sapiens
tgaacacaaatattttggggtt

SEQ ID NO: 7749345 - DNA, 22 bp, Homo sapiens
tgaacacacacctatgtacaaa

SEQ ID NO: 7749346 - DNA, 22 bp, Homo sapiens
tgaacacacacatcttaataat

SEQ ID NO: 7749347 - DNA, 18 bp, Homo sapiens
tgaaattgcatccatgag

SEQ ID NO: 7749348 - DNA, 22 bp, Homo sapiens
tgaagaaacgcagagaggtagg

SEQ ID NO: 7749349 - DNA, 22 bp, Homo sapiens
tgaagaagccaattggtaggct

SEQ ID NO: 7749350 - DNA, 22 bp, Homo sapiens
tgaagcacatttcttgagatga

SEQ ID NO: 7749351 - DNA, 22 bp, Homo sapiens
tgaaaacactttagtttaggtc

SEQ ID NO: 7749352 - DNA, 22 bp, Homo sapiens
tgaaaacagaatccttgttttc

SEQ ID NO: 7749353 - DNA, 22 bp, Homo sapiens
tgaaaatatagttttccagact

SEQ ID NO: 7749354 - DNA, 22 bp, Homo sapiens
tgaaacttattcagtttctacc

SEQ ID NO: 7749355 - DNA, 22 bp, Homo sapiens
tgaaacttttgaggttcttcca

SEQ ID NO: 7749356 - DNA, 22 bp, Homo sapiens
tgaaagaagtgtcacattgcca

SEQ ID NO: 7749357 - DNA, 22 bp, Homo sapiens
tgaaagaagggtggaaaatgta

SEQ ID NO: 7749358 - DNA, 22 bp, Homo sapiens
tcttttctagcaaatccaggag

SEQ ID NO: 7749359 - DNA, 22 bp, Homo sapiens
tcttttaaaagccctgctgtct

SEQ ID NO: 7749360 - DNA, 21 bp, Homo sapiens
tcttttaacaccaggaattcc

SEQ ID NO: 7749361 - DNA, 22 bp, Homo sapiens
tcttttaacctaactagcttgg

SEQ ID NO: 7749362 - DNA, 22 bp, Homo sapiens
tcttttaagcctctggcatagg

SEQ ID NO: 7749363 - DNA, 22 bp, Homo sapiens
tggcctgtggatcccagctctg

SEQ ID NO: 7749364 - DNA, 22 bp, Homo sapiens
tggcctgtggcacgtgctccat

SEQ ID NO: 7749365 - DNA, 22 bp, Homo sapiens
tggctccggcgctctgagacag

SEQ ID NO: 7749366 - DNA, 22 bp, Homo sapiens
tggctccgttgtacaggctgga

SEQ ID NO: 7749367 - DNA, 22 bp, Homo sapiens
tggctgagttctccaggagtag

SEQ ID NO: 7749368 - DNA, 22 bp, Homo sapiens
tggctgcagatcaagggcaggc

SEQ ID NO: 7749369 - DNA, 22 bp, Homo sapiens
tggcttcggcattgctacaccc

SEQ ID NO: 7749370 - DNA, 22 bp, Homo sapiens
tggcttctgtccctgctacatt

SEQ ID NO: 7749371 - DNA, 22 bp, Homo sapiens
tggctggacagtgggcagtgga

SEQ ID NO: 7749372 - DNA, 19 bp, Homo sapiens
tggctgggcgtgcctccgt

SEQ ID NO: 7749373 - DNA, 22 bp, Homo sapiens
tggctgtgtgccaggctgtctg

SEQ ID NO: 7749374 - DNA, 22 bp, Homo sapiens
tggctgtgggatgagagcctca

SEQ ID NO: 7749375 - DNA, 20 bp, Homo sapiens
tggctgtgggcatctgtttc

SEQ ID NO: 7749376 - DNA, 22 bp, Homo sapiens
tgggagaaagaaccctgagtga

SEQ ID NO: 7749377 - DNA, 22 bp, Homo sapiens
tgggagaacccagggtcaggct

SEQ ID NO: 7749378 - DNA, 20 bp, Homo sapiens
tgggagaagaacactggaac

SEQ ID NO: 7749379 - DNA, 22 bp, Homo sapiens
tgggagaagagaaattactgcc

SEQ ID NO: 7749380 - DNA, 22 bp, Homo sapiens
tgggagaagcagtgggacagta

SEQ ID NO: 7749381 - DNA, 22 bp, Homo sapiens
tgggagaagcatggggtgcaga

SEQ ID NO: 7749382 - DNA, 22 bp, Homo sapiens
tgggactgctcttgctggggtc

SEQ ID NO: 7749383 - DNA, 22 bp, Homo sapiens
tgggacagtgaccccagaggtc

SEQ ID NO: 7749384 - DNA, 22 bp, Homo sapiens
tgggaagggccgatggagcctc

SEQ ID NO: 7749385 - DNA, 22 bp, Homo sapiens
tgggaaggggagctggaaagga

SEQ ID NO: 7749386 - DNA, 22 bp, Homo sapiens
tgggaaggtacacgggaaagag

SEQ ID NO: 7749387 - DNA, 22 bp, Homo sapiens
tggattgataaaatgggatgtt

SEQ ID NO: 7749388 - DNA, 22 bp, Homo sapiens
tggatttagttcttcacaggcc

SEQ ID NO: 7749389 - DNA, 22 bp, Homo sapiens
tggcacagcccagagctcttga

SEQ ID NO: 7749390 - DNA, 22 bp, Homo sapiens
tggcacaaatctagtccctggt

SEQ ID NO: 7749391 - DNA, 22 bp, Homo sapiens
tggcaggaaaaagggccagagg

SEQ ID NO: 7749392 - DNA, 22 bp, Homo sapiens
tggcaggagcctgcggggaggt

SEQ ID NO: 7749393 - DNA, 21 bp, Homo sapiens
tggcatggaggtagcagtgtg

SEQ ID NO: 7749394 - DNA, 22 bp, Homo sapiens
tggcctgaggctcggcatgggt

SEQ ID NO: 7749395 - DNA, 22 bp, Homo sapiens
tggcctgactgtcaggctgtat

SEQ ID NO: 7749396 - DNA, 22 bp, Homo sapiens
tggccctcagcactgagacctt

SEQ ID NO: 7749397 - DNA, 22 bp, Homo sapiens
tggccctcagtcttgctcctgc

SEQ ID NO: 7749398 - DNA, 22 bp, Homo sapiens
tggccctctgcaagattctgga

SEQ ID NO: 7749399 - DNA, 22 bp, Homo sapiens
tggagcagaaatttgaagccat

SEQ ID NO: 7749400 - DNA, 22 bp, Homo sapiens
tggagaggagcaccatggccat

SEQ ID NO: 7749401 - DNA, 22 bp, Homo sapiens
tggagcagaggaagaaggcttt

SEQ ID NO: 7749402 - DNA, 22 bp, Homo sapiens
tggagcagccatgatgacagag

SEQ ID NO: 7749403 - DNA, 22 bp, Homo sapiens
tggagaagattggtcaccattc

SEQ ID NO: 7749404 - DNA, 22 bp, Homo sapiens
tggagaagctgtaggtggactc

SEQ ID NO: 7749405 - DNA, 22 bp, Homo sapiens
tggagaaggacagcctgagaaa

SEQ ID NO: 7749406 - DNA, 22 bp, Homo sapiens
tggagaaggccggccaggagtg

SEQ ID NO: 7749407 - DNA, 22 bp, Homo sapiens
tggagaaggggcagggtctcca

SEQ ID NO: 7749408 - DNA, 22 bp, Homo sapiens
tggagaagtcaaagtgaacagg

SEQ ID NO: 7749409 - DNA, 20 bp, Homo sapiens
tggagccacagtcaggttcc

SEQ ID NO: 7749410 - DNA, 22 bp, Homo sapiens
tggagccagcaggactcagagg

SEQ ID NO: 7749411 - DNA, 22 bp, Homo sapiens
tggagccagcccaggcccctct

SEQ ID NO: 7749412 - DNA, 18 bp, Homo sapiens
tggagccagctctaggat

SEQ ID NO: 7749413 - DNA, 22 bp, Homo sapiens
tggagccaggagcctgggagtc

SEQ ID NO: 7749414 - DNA, 22 bp, Homo sapiens
tggagccaggctggccctgcca

SEQ ID NO: 7749415 - DNA, 22 bp, Homo sapiens
tggagccaagagtcaaggggag

SEQ ID NO: 7749416 - DNA, 22 bp, Homo sapiens
tggagccaaaaagggaaggaga

SEQ ID NO: 7749417 - DNA, 22 bp, Homo sapiens
tggagcagtggtcctggagatg

SEQ ID NO: 7749418 - DNA, 22 bp, Homo sapiens
tggagccatgcctggcctttcc

SEQ ID NO: 7749419 - DNA, 22 bp, Homo sapiens
tggagtgcaatagtaataaggt

SEQ ID NO: 7749420 - DNA, 22 bp, Homo sapiens
tggagggaacccaggctgctct

SEQ ID NO: 7749421 - DNA, 22 bp, Homo sapiens
tggaggtggcatctgacagctg

SEQ ID NO: 7749422 - DNA, 22 bp, Homo sapiens
tggaggagggctggtgtctgta

SEQ ID NO: 7749423 - DNA, 22 bp, Homo sapiens
tggaggagtagattttcagagg

SEQ ID NO: 7749424 - DNA, 22 bp, Homo sapiens
tggaggatgagtgtgggctctg

SEQ ID NO: 7749425 - DNA, 22 bp, Homo sapiens
tggaggcaactgaagatgtagt

SEQ ID NO: 7749426 - DNA, 22 bp, Homo sapiens
tggaggaaaaaaccaggcagag

SEQ ID NO: 7749427 - DNA, 23 bp, Homo sapiens
tggagctgggctcagaccctggg

SEQ ID NO: 7749428 - DNA, 22 bp, Homo sapiens
tggagctgggagtcctgggctg

SEQ ID NO: 7749429 - DNA, 22 bp, Homo sapiens
tggaggcagtaactgagcaaca

SEQ ID NO: 7749430 - DNA, 22 bp, Homo sapiens
tggaggcagtcacctgaagtca

SEQ ID NO: 7749431 - DNA, 20 bp, Homo sapiens
tggaggcacctgtggagatc

SEQ ID NO: 7749432 - DNA, 22 bp, Homo sapiens
tggactcagagttggtggcagt

SEQ ID NO: 7749433 - DNA, 22 bp, Homo sapiens
tggactcaccttgagttagcca

SEQ ID NO: 7749434 - DNA, 22 bp, Homo sapiens
tggactcaagtccaagttcacg

SEQ ID NO: 7749435 - DNA, 22 bp, Homo sapiens
tggaccctggactgccctggcc

SEQ ID NO: 7749436 - DNA, 17 bp, Homo sapiens
tggacccttgggcctcc

SEQ ID NO: 7749437 - DNA, 22 bp, Homo sapiens
tggaccactctggtgcccatgt

SEQ ID NO: 7749438 - DNA, 22 bp, Homo sapiens
tggaccacatagtgaggccccc

SEQ ID NO: 7749439 - DNA, 20 bp, Homo sapiens
tggaccaccctcctctttgc

SEQ ID NO: 7749440 - DNA, 22 bp, Homo sapiens
tggacacacatgtatgtcagag

SEQ ID NO: 7749441 - DNA, 22 bp, Homo sapiens
tggaagcccagaaggaagcaga

SEQ ID NO: 7749442 - DNA, 22 bp, Homo sapiens
tggaaggaaaggtagcagagaa

SEQ ID NO: 7749443 - DNA, 22 bp, Homo sapiens
tggaaggaagccaaggaaggtt

SEQ ID NO: 7749444 - DNA, 22 bp, Homo sapiens
tggaagccaaggtcagaaggag

SEQ ID NO: 7749445 - DNA, 22 bp, Homo sapiens
tggaacactttgttgaaatgca

SEQ ID NO: 7749446 - DNA, 22 bp, Homo sapiens
tggaacactgtggatgagaaga

SEQ ID NO: 7749447 - DNA, 22 bp, Homo sapiens
tggaacactttcagtagctatt

SEQ ID NO: 7749448 - DNA, 19 bp, Homo sapiens
tggaacactcaaactgggt

SEQ ID NO: 7749449 - DNA, 22 bp, Homo sapiens
tggaacactgatcattgccttt

SEQ ID NO: 7749450 - DNA, 22 bp, Homo sapiens
tggaacactggctttccactgt

SEQ ID NO: 7749451 - DNA, 22 bp, Homo sapiens
tggaacacatctcgctgcaggg

SEQ ID NO: 7749452 - DNA, 22 bp, Homo sapiens
tggaacacattaaccacaggga

SEQ ID NO: 7749453 - DNA, 22 bp, Homo sapiens
tggaacaccttgctccagaaag

SEQ ID NO: 7749454 - DNA, 22 bp, Homo sapiens
tggaacacacttcaaggagaaa

SEQ ID NO: 7749455 - DNA, 22 bp, Homo sapiens
tggaacacaagtcattgagggg

SEQ ID NO: 7749456 - DNA, 22 bp, Homo sapiens
tggaacacagtgattgatagcg

SEQ ID NO: 7749457 - DNA, 22 bp, Homo sapiens
tggaacacaggactatcagctg

SEQ ID NO: 7749458 - DNA, 22 bp, Homo sapiens
tggaacacatctaaggaagcag

SEQ ID NO: 7749459 - DNA, 22 bp, Homo sapiens
tgcttttatttaatatcttgca

SEQ ID NO: 7749460 - DNA, 22 bp, Homo sapiens
tgctttctttagctcctgagtc

SEQ ID NO: 7749461 - DNA, 22 bp, Homo sapiens
tgctttctgtttttcatataat

SEQ ID NO: 7749462 - DNA, 22 bp, Homo sapiens
tgctgagatgaatagagacctc

SEQ ID NO: 7749463 - DNA, 22 bp, Homo sapiens
tgctgaaatatttatgggtcaa

SEQ ID NO: 7749464 - DNA, 22 bp, Homo sapiens
tgctgaaagaccgtatttatct

SEQ ID NO: 7749465 - DNA, 22 bp, Homo sapiens
tgctgaggagggcacccggggg

SEQ ID NO: 7749466 - DNA, 23 bp, Homo sapiens
tgctcttctcagacctgtcagcc

SEQ ID NO: 7749467 - DNA, 22 bp, Homo sapiens
tgctgaggtcacggcggccaga

SEQ ID NO: 7749468 - DNA, 20 bp, Homo sapiens
tgctgaggttgacatgccca

SEQ ID NO: 7749469 - DNA, 22 bp, Homo sapiens
tgctgaggcatttggacagagt

SEQ ID NO: 7749470 - DNA, 22 bp, Homo sapiens
tgctgatatattctagttttct

SEQ ID NO: 7749471 - DNA, 22 bp, Homo sapiens
tgctgagtcgtattatttttta

SEQ ID NO: 7749472 - DNA, 19 bp, Homo sapiens
tgctgcagtcaggcgaggg

SEQ ID NO: 7749473 - DNA, 22 bp, Homo sapiens
tgctgcagtgtttgctgaagtt

SEQ ID NO: 7749474 - DNA, 22 bp, Homo sapiens
tgctcagattacagccccacat

SEQ ID NO: 7749475 - DNA, 22 bp, Homo sapiens
tgcgggatgacagtggccaaca

SEQ ID NO: 7749476 - DNA, 22 bp, Homo sapiens
tgcgaccctagccccctcactt

SEQ ID NO: 7749477 - DNA, 22 bp, Homo sapiens
tgccttgctgctttggagtcct

SEQ ID NO: 7749478 - DNA, 22 bp, Homo sapiens
tgcctgggtgtaaagggccaac

SEQ ID NO: 7749479 - DNA, 22 bp, Homo sapiens
tgcctggctctatcagtggtgg

SEQ ID NO: 7749480 - DNA, 22 bp, Homo sapiens
tgctggagaactgctctgtgtt

SEQ ID NO: 7749481 - DNA, 22 bp, Homo sapiens
tgctggagaagctcctgggact

SEQ ID NO: 7749482 - DNA, 20 bp, Homo sapiens
tgctgcagtttcatgggact

SEQ ID NO: 7749483 - DNA, 22 bp, Homo sapiens
tgctggatgcttgattttgagg

SEQ ID NO: 7749484 - DNA, 23 bp, Homo sapiens
tgctggagtttactcaggccagc

SEQ ID NO: 7749485 - DNA, 22 bp, Homo sapiens
tgctggagtaacaagacactca

SEQ ID NO: 7749486 - DNA, 20 bp, Homo sapiens
tgctgggcatgcagtggaaa

SEQ ID NO: 7749487 - DNA, 22 bp, Homo sapiens
tgctgggcactgtctctgggga

SEQ ID NO: 7749488 - DNA, 22 bp, Homo sapiens
tgctgggctggagctgccaggg

SEQ ID NO: 7749489 - DNA, 22 bp, Homo sapiens
tgcttcagtgtgtcattattta

SEQ ID NO: 7749490 - DNA, 22 bp, Homo sapiens
tgcttcaggagatgtcaccatg

SEQ ID NO: 7749491 - DNA, 22 bp, Homo sapiens
tgcttcatgcttctgacaatag

SEQ ID NO: 7749492 - DNA, 22 bp, Homo sapiens
tgcttcagaggaaaggcaaaag

SEQ ID NO: 7749493 - DNA, 22 bp, Homo sapiens
tgggatgagaagtgcgagggtt

SEQ ID NO: 7749494 - DNA, 22 bp, Homo sapiens
tgggatagattgatggatagag

SEQ ID NO: 7749495 - DNA, 19 bp, Homo sapiens
tgggatgatgcagaaggta

SEQ ID NO: 7749496 - DNA, 22 bp, Homo sapiens
tgggcaaatgtcactttctttt

SEQ ID NO: 7749497 - DNA, 22 bp, Homo sapiens
tgggcacagaatagatggccca

SEQ ID NO: 7749498 - DNA, 22 bp, Homo sapiens
tgggcacagagtcccatctgcc

SEQ ID NO: 7749499 - DNA, 22 bp, Homo sapiens
tgggcacactgaatctgctatt

SEQ ID NO: 7749500 - DNA, 22 bp, Homo sapiens
tgggcacaaacatctgcctgtt

SEQ ID NO: 7749501 - DNA, 22 bp, Homo sapiens
tgggcagagtcatacaggagac

SEQ ID NO: 7749502 - DNA, 22 bp, Homo sapiens
tgggcacagtgagttgccttta

SEQ ID NO: 7749503 - DNA, 21 bp, Homo sapiens
tgggcagatggcagtgtggct

SEQ ID NO: 7749504 - DNA, 22 bp, Homo sapiens
tgggcagattaatgcagtggct

SEQ ID NO: 7749505 - DNA, 22 bp, Homo sapiens
tgggcagatctttggtggctag

SEQ ID NO: 7749506 - DNA, 22 bp, Homo sapiens
tgggcagggagctggaaccaca

SEQ ID NO: 7749507 - DNA, 22 bp, Homo sapiens
tgggccagctgaagtgccgccc

SEQ ID NO: 7749508 - DNA, 19 bp, Homo sapiens
tgggcaggttcagtaatgg

SEQ ID NO: 7749509 - DNA, 22 bp, Homo sapiens
tgggccagtccagccccaggga

SEQ ID NO: 7749510 - DNA, 22 bp, Homo sapiens
tgggccagggcacccagtccag

SEQ ID NO: 7749511 - DNA, 23 bp, Homo sapiens
tgggcctggaaagccttagagag

SEQ ID NO: 7749512 - DNA, 22 bp, Homo sapiens
tgggcctgccccaggcttcagc

SEQ ID NO: 7749513 - DNA, 20 bp, Homo sapiens
tgggcctgagcctgtgggct

SEQ ID NO: 7749514 - DNA, 22 bp, Homo sapiens
tgggcctgacacttactaggga

SEQ ID NO: 7749515 - DNA, 22 bp, Homo sapiens
tgggctgccagctctccagatg

SEQ ID NO: 7749516 - DNA, 22 bp, Homo sapiens
tgggctgcccaaggtggccatg

SEQ ID NO: 7749517 - DNA, 22 bp, Homo sapiens
tgggctgccctgatggtcctca

SEQ ID NO: 7749518 - DNA, 22 bp, Homo sapiens
tgggctgccggcaggctctgcc

SEQ ID NO: 7749519 - DNA, 22 bp, Homo sapiens
tgggctgcagagcccggccttc

SEQ ID NO: 7749520 - DNA, 22 bp, Homo sapiens
tgggctagatttggtgacccag

SEQ ID NO: 7749521 - DNA, 22 bp, Homo sapiens
tgggccttgctgagctatggag

SEQ ID NO: 7749522 - DNA, 22 bp, Homo sapiens
tgggccttacttggggctgact

SEQ ID NO: 7749523 - DNA, 22 bp, Homo sapiens
tgggccttctcaatgcactgga

SEQ ID NO: 7749524 - DNA, 22 bp, Homo sapiens
tgggccttctaatctggtccct

SEQ ID NO: 7749525 - DNA, 22 bp, Homo sapiens
tgggcctgtttcccttcagggc

SEQ ID NO: 7749526 - DNA, 18 bp, Homo sapiens
tgggcttgaaagcaaggt

SEQ ID NO: 7749527 - DNA, 18 bp, Homo sapiens
tgggctgcctggcctctg

SEQ ID NO: 7749528 - DNA, 22 bp, Homo sapiens
tggggaaggcggagcttgcagc

SEQ ID NO: 7749529 - DNA, 22 bp, Homo sapiens
tggggaagggcaccctggagac

SEQ ID NO: 7749530 - DNA, 22 bp, Homo sapiens
tggggaagaataatgtatgtac

SEQ ID NO: 7749531 - DNA, 22 bp, Homo sapiens
tggggaaactatttccttgtcc

SEQ ID NO: 7749532 - DNA, 22 bp, Homo sapiens
tggggaggttcgggaatcttgt

SEQ ID NO: 7749533 - DNA, 21 bp, Homo sapiens
tggggaggggacctgattatg

SEQ ID NO: 7749534 - DNA, 22 bp, Homo sapiens
tggggaggatatgtgagttatt

SEQ ID NO: 7749535 - DNA, 17 bp, Homo sapiens
tgggggcgccagggtct

SEQ ID NO: 7749536 - DNA, 22 bp, Homo sapiens
tggggctaacgagagagcagag

SEQ ID NO: 7749537 - DNA, 22 bp, Homo sapiens
tggggctagaatcctgcaggaa

SEQ ID NO: 7749538 - DNA, 22 bp, Homo sapiens
tggtattacttctagacacaag

SEQ ID NO: 7749539 - DNA, 22 bp, Homo sapiens
tggtatgaccgtggtgcaagca

SEQ ID NO: 7749540 - DNA, 21 bp, Homo sapiens
tggtaggtactggcttcaggc

SEQ ID NO: 7749541 - DNA, 22 bp, Homo sapiens
tgggtgaggatgatgaggcagc

SEQ ID NO: 7749542 - DNA, 22 bp, Homo sapiens
tgggtgtgaagtctgttggcct

SEQ ID NO: 7749543 - DNA, 22 bp, Homo sapiens
tgggtccacttctgcactgtgg

SEQ ID NO: 7749544 - DNA, 22 bp, Homo sapiens
tgggtagggagctggaatccta

SEQ ID NO: 7749545 - DNA, 22 bp, Homo sapiens
tggggggcacttcagcacaatg

SEQ ID NO: 7749546 - DNA, 20 bp, Homo sapiens
tggggtctagttggcctggg

SEQ ID NO: 7749547 - DNA, 22 bp, Homo sapiens
tggggtgctttcttgcctgtac

SEQ ID NO: 7749548 - DNA, 22 bp, Homo sapiens
tggggtgccgacagggagggca

SEQ ID NO: 7749549 - DNA, 22 bp, Homo sapiens
tggggtggtgggaaccaagtag

SEQ ID NO: 7749550 - DNA, 22 bp, Homo sapiens
tgtatgaggcatacatcaggca

SEQ ID NO: 7749551 - DNA, 22 bp, Homo sapiens
tgtagaagctagcctggagcca

SEQ ID NO: 7749552 - DNA, 22 bp, Homo sapiens
tgtagcagtctgggggaattac

SEQ ID NO: 7749553 - DNA, 22 bp, Homo sapiens
tgtagcattttatgtaataagt

SEQ ID NO: 7749554 - DNA, 23 bp, Homo sapiens
tgtagctttatacaagatctgtt

SEQ ID NO: 7749555 - DNA, 22 bp, Homo sapiens
tgtatttattcaggatgtaact

SEQ ID NO: 7749556 - DNA, 22 bp, Homo sapiens
tgtcacaatatcccaatctgcc

SEQ ID NO: 7749557 - DNA, 22 bp, Homo sapiens
tgtcacaaggccatgaaaagaa

SEQ ID NO: 7749558 - DNA, 22 bp, Homo sapiens
tgtccagagtcacagagctcaa

SEQ ID NO: 7749559 - DNA, 22 bp, Homo sapiens
tgtccagctgacattcccttcc

SEQ ID NO: 7749560 - DNA, 22 bp, Homo sapiens
tgtccgcggtttgcgttgtggg

SEQ ID NO: 7749561 - DNA, 22 bp, Homo sapiens
tggtgtgggcagcagcaggtac

SEQ ID NO: 7749562 - DNA, 22 bp, Homo sapiens
tggtggggtcatcgtcagatgc

SEQ ID NO: 7749563 - DNA, 23 bp, Homo sapiens
tggtggggtcttggagacagcac

SEQ ID NO: 7749564 - DNA, 23 bp, Homo sapiens
tgtaaagatgatgctctagacac

SEQ ID NO: 7749565 - DNA, 22 bp, Homo sapiens
tggttttaaaaacatgctgcat

SEQ ID NO: 7749566 - DNA, 22 bp, Homo sapiens
tgtaaaagacatttctaagcaa

SEQ ID NO: 7749567 - DNA, 17 bp, Homo sapiens
tgtaaaacccagaggtc

SEQ ID NO: 7749568 - DNA, 22 bp, Homo sapiens
tgtaaaataattctccatgttt

SEQ ID NO: 7749569 - DNA, 20 bp, Homo sapiens
tgtaagaagtaggagggtta

SEQ ID NO: 7749570 - DNA, 22 bp, Homo sapiens
tggtggggctttccttctgctt

SEQ ID NO: 7749571 - DNA, 22 bp, Homo sapiens
tggtgcagatagtggtgtagta

SEQ ID NO: 7749572 - DNA, 22 bp, Homo sapiens
tggtcctgagcaccagcctgac

SEQ ID NO: 7749573 - DNA, 22 bp, Homo sapiens
tggtccagggtgtagtacagag

SEQ ID NO: 7749574 - DNA, 22 bp, Homo sapiens
tggtcctgccccgtgcacagag

SEQ ID NO: 7749575 - DNA, 22 bp, Homo sapiens
tggtgaggtcatagagaactgt

SEQ ID NO: 7749576 - DNA, 22 bp, Homo sapiens
tggtgcaaaactaattgcggtt

SEQ ID NO: 7749577 - DNA, 19 bp, Homo sapiens
tggtctctgtctctttgca

SEQ ID NO: 7749578 - DNA, 22 bp, Homo sapiens
tggtcctggggtgcaggctgac

SEQ ID NO: 7749579 - DNA, 22 bp, Homo sapiens
ttccagatgtttaagttctgct

SEQ ID NO: 7749580 - DNA, 22 bp, Homo sapiens
ttccagatttctacacaagacc

SEQ ID NO: 7749581 - DNA, 22 bp, Homo sapiens
ttccagcctttatccatccaga

SEQ ID NO: 7749582 - DNA, 22 bp, Homo sapiens
ttccagccatggtttccctatg

SEQ ID NO: 7749583 - DNA, 22 bp, Homo sapiens
ttccagctcttgaaggtgggat

SEQ ID NO: 7749584 - DNA, 22 bp, Homo sapiens
ttcattagaaaagtaaaaatgc
